United States Patent 11,078,247 (RNA ENCODING A THERAPEUTIC PROTEIN) - sequence listing, part 40

SEQ ID NO: 67313 - RNA, 3135 nt, Artificial Sequence
  derived and/or modified sequence opt5 from CEP131__Homo_sapiens__NP_001009811
augaagggcaccagagccaucgggagcgugcccgagcgguccccugcuggagucgaccugucucucacaggccugccgcccccuguuagccgcagacccggguccgccgcgacgaccaaaccuauugugcggucugugagcgucgugacaggauccgaacagaagcgcaaaguucuugaggcuaccggccccgggggaucucaagccaucaacaaucugagacggagcaacuccacaacccaggugagccagccucgcucuggcuccccgagacccacagaaccuaccgauuuccucaugcuguuugagggcagccccucugggaagaaacggccugccucccuuagcacggcucccucugaaaagggagccaccuggaauguccuggacgaucagccgcgcggcuucacacucccuuccaacgcuagaagcuccucugcccuggacagccccgcggggccucggcgcaaggagugcaccguggcccuggcucccaauuuuacagccaacaauagauccaacaaaggagcuguuggcaauugugugaccacgaugguccacaaccgguacacacccagcgagcgcgccccuccgcucaagucuuccaaucaaaccgcgcccagccugaacaauauuaucaaagccgcuacaugcgaagggucugagagcuccggauucggcaaacuuccuaaaaacgugucuagcgccacccauuccgcuagaaauaacaccggcgggagcacaggacugccccggagaaaggaagugacggaggaggaagccgagcgcuuuauucaccaggucaaccaggccaccguuacaauccagcggugguauagacaucaagugcagcgccggggcgcuggggcggccagacucgaacaucugcuucaggcuaagcgcgaggaacagcggcaaagaucuggagagggcacccugcucgaucugcaccagcagaaagaggccgcccgccggaaggcuagagaagagaaagcccgccaagcgcggagagcugccauccaggaacugcagcagaagcgggcccuccgcgcucaaaaagccuccacagcugagagagggccucccgaaaauccgcgggagaccagagugccuggaaugcgccagcccgcccaggagcugagcccuacgcccggcggcacagcgcaccaggcccuuaaggcuaacaauaccgggggaggccugccugccgcugggcccggagaccggugucucccgaccucugauuccagcccugaaccccaacagcccccugaggacagaacacaggauguccuggcccaggacgcggccggcgauaaccuugaaaugauggcuccgucccgcgggucugccaaaagcagaggcccccuggaggaacuccugcacacccugcaacuccuggagaaggagccugacgugcuuccccggccucgcacacaucacagaggacgguacgcuugggccuccgaagaggaugacgccucuagccugacggcugacaaucucgaaaaguucggcaaacuguccgcguuucccgagccucccgaggaugggacccuucugagcgaagccaagcuccagucuauuauguccuuccuggacgagauggaaaagagcggacaggaucagcuggacucucaacaggagggcuggguuccggaagcugggccuggaccccucgagcugggcuccgaggugagcacaucugucaugcgccuuaagcuggaaguggaggagaaaaagcaggccaugcuccugcugcaaagagcccuugcucagcagcgggaucucaccgcccgcagaguuaaggagacagaaaaagcgcugagccggcagcugcaacgccagagagagcauuaugaggcuaccauccagcggcaccucgccuuuauugaccagcugaucgaagauaagaaagugcuuuccgagaagugcgaagccgucguggcugagcugaaacaagaagaccagagauguacggagcgcgucgcccaggcgcaggcucaacacgagcucgaaauuaagaagcugaaagagcugaugagcgccaccgaaaaggcccggagagagaaauggaucucugagaagaccaaaaagauuaaggaagugacaguucgcgggcuugagccugaaauccagaaacucaucgcucggcauaagcaggaggugagacgccugaaaucccugcacgaagccgagcuccugcaaagcgaugagcgggcuucccagagaugccuucgccaggccgaagaacugcgggaacagcucgagagagaaaaggaggcgcugggccaacaggagcgggaacgcgccagacagcggcagcgcgcugagcuggaagaacuuagacaacagcucgaagagucuagcuccgcccugacacgggcucugagagccgaguucgaaaaaggacgcgaggaacaggagcggagacaucagauggagcucaacacccugaagcaacagcuugaacuggagcgccaggccugggaagcuggccggacgagaaaagaggaagcguggcuccugaaucgcgagcaggagcugcgggaagagauuagaaaggggcgcgacaaggaaaucgagcuugucauucacagacucgaagccgauauggcucuggccaaagaggagucugaaaaggccgcugagagccggaucaaacgccugagagacaaguacgaagccgagcucuccgaacuggagcaaucugagcggaaacuucaggaacgcuguagcgagcugaagggacagcucggcgaagcggagggggagaaccugagacugcaaggacuugugcggcagaaggaaagagcucuggaggacgcccaggccguuaaugaacagcucuccagcgagcgcucuaaccuggcucaagugauucggcaggaauuugaggauagacucgccgcguccgaggaagagacacgccaggcuaaagccgaacuggccacccuucaggcucggcaacagcuggagcucgaagagguccauagacgggugaagacagcccuggcucgcaaagaggaagccgugagcucucugagaacccagcacgaggcggccguuaagcgggcugaccaccuugaggagcugcucgaacagcaucgcagacccaccccguccacaaaauga

SEQ ID NO: 67314 - RNA, 3423 nt, Artificial Sequence
  derived and/or modified sequence opt5 from CEP135__Homo_sapiens__NP_079285
augaccacagccguggagagaaaguacaucaacauucggaaacgccuggaccagcucggcuauagacaaacgcugaccgucgaaugccuuccccugguugagaaacucuucagcgaucuggugcacacaaccgaaucccuucggcagucuaaacugagcgcugugaaggccgagaaagaauccgcgaauuuugacuucguccucgagccuuacaagcuggagaacgcucgccugucuagagaaaauaacgagcucuaucuggaacuuaugaagcugcgggagcauagcgaucagcacgugaaagagcucaagacaucccugaaaaagugugcccgcgaaaccgccgaccuuaaauuucugaauaaccaguacgcucauaagcucaagcugcuggagaaagaaucuaaggccaaaaaugagagaauccaacagcuccaggaaaagaaccugcacgcuguugugcagacacccgggggaaagaagcggagcauugccuuccgcagacaacggaugcagaucgaugagcccgucccucccuccgaggugagcucuuauccuguuccccagccugacgauccguacauugcggaccuucuccagguggccgauaaucgcauccaagaacugcagcaggagguccaucaacugcaggaaaaacuugcuaugauggaguccggcgugagagacuauagcaagcagaucgaacugcgggagcgcgagauugaaagacucucuguggcccuggaugggggacggucccccgacguccugagccucgagucuagaaacaagaccaaugaaaaacugaucgcucaccuuaacauucagguugauuuucugcaacaggccaauaaggaccucgagaaacgcauccgggaacugauggagacgaaggagaccgugacauccgaaguggucaaccuuagcaauaaaaacgagaagcugugccaggaacucaccgagauugaccagcuggcgcaacagcuggagagacacaaggaagaggugcucgaaacagccgauaaagagcugggcgaagcuaagaaagagaucaagcgcaaacuuuccgagaugcaggaccuggaagagaccauggccaagcuccagcuggaacugaaccuuugucaaaaggagaaagaacggcucucugaugagcugcugguuaagagcgaccucgagacggugguccaucagcuggaacaggagaaacagagacuuuccaagaaaguggagagcuucgcuguuacagaacgccaacugacccucgaaguggagcggaugagacuggagcacgggauuaagcgccgggauagaucuccuucccgccuggacacauuucuuaagggaaucgaagaggaacgggauuacuacaaaaaggagcucgagagacugcagcauaucauucagcggcgcagcugcucuaccagcuauuccgccagagaaaaaucuagcaucuuccggacccccgagaagggcgacuacaauuccgaaauucaccaaaucacaagagagcgcgaugaacugcagcggaugcucgagagauuugagaaauauauggaagacauucagagcaacgucaagcugcuuacggccgagcgcgauaaacugucugugcucuacaaugaagcucaggaggaacuguccgcgcugagaaaggagagcacccaaacaaccgccccucacaacaucgucucucuuauggagaaggaaaaagagcucgcucuguccgaccugcggcgcaucauggccgaaaaggaggcccucagagaaaaacuggagcauauugaggaagugagccuuuucggcaaguccgagcuggagaaaacaaucgaacaccucaccuguguuaaucaucagcuggagucugaaaaguaugagcuuaagagcaaagugcugauuaugaaggaaacgaucgagucccucgaaaacaaacugaagguccaggcucagaaauuuucucacguggccggggacagcucccaucaaaagacagagguuaauagccugcggauugugaacgagcagcuccagcgcucugucgaugacuaccagcacagacuguccaucaagcggggagaacuugagagcgcgcaagcucagaucaaaauucuggaagagaagaucgaugaacucaaucugaaaaugaccucucaggacgaggaggcccacgugaugaagaaaaccauuggcgugaucgauaaggaaaaggacuuccugcaagagacaguugaugagaaaaccgaaaagauugccaaccuucaggaaaaucuggcuaacaaagagaaggccgucgcucagaugaaaaucaugauuuccgagugcgaaagcucugugaaucagcucaaggagacacuggugaaccgcgacagagaaaucaauagccuccggcgccaacuggaugccgcgcauaaagagcuugacgaggucgggagaucccgggaaaucgccuuuaaggagaacagacgccugcaggaugaccucgcuacgauggcccgggaaaaccaggagauuagccuggaacuggaggcugccgugcaggagaaggaagagaugaaaucuagaguucacaaguauaucaccgaagugucccgcugggagagccuuauggcggccaaagaaaaggagaaucaagaucugcucgaccgguuccagaugcugcauaacagagcugaggacugggaagucaaagcccaccaggcugagggagaauccucuagcgugcgccucgagcugcuuuccauugauacagaacggagacaucugcgcgagcggguugagcuccuggaaaaggagauccaggaacacauuaaugcccaccaugccuacgagucucaaaucagcuccauggcuaaggcgaugucuagacuggaggaggaacuucggcaccaggaagacgagaaagccaccgugcugaacgaucucagcucccugcgcgaacucuguaucaagcuggacagcggcaaagauauuaugacacagcagcuuaauucuaagaaccuggaguucgagagagucgugguugaacuggagaaugugaaauccgaaagcgaccuccugaagaagcaacuuucuaacgagcggcauaccgucaaaaaucuggaaucccuccuggcuacgaaccgcgauaaggaguuucacagccaccucaccucucaugagaaagacacagaaauccagcugcuuaaggagaaacugacccuguccgaaagcaagcucacaucccagagcagagagaauaccaugcugcgggccaagguggcccaacuucagacggauuacgacgcucugaaaagacagauuucuacagaacgcuaugagcgggagagagccauccaggaaaugcgccggcacgggcucgcgaccccgccgcugagcuccacacucagaucuccuagccauucccccgagcaccgcaacguguga

SEQ ID NO: 67315 - RNA, 4965 nt, Artificial Sequence
  derived and/or modified sequence opt5 from CEP152__Homo_sapiens__NP_055800
augagccuggacuucggcuccguggcccuccccguccagaacgaggaugaagaguacgacgaagaggauuaugaaagagagaaggagcugcaacagcuucugaccgaccucccucacgauaugcuggacgaugaccuuucuagcccggaacugcaguacuccgauugcucugaggacgggacagauggacagccccaucacccugaacaacucgagaugagcuggaaugagcagaugcugcccaaaucccagucuguuaacggcuauaaugaaauccagagccuguacgcuggggagaaguguggaaacgugugggaagagaaucgguccaaaacggaagaccgccauccuguguaucaccccgaggagggcggggaugaaggaggcagcggcuacucuccuccguccaagugcgagcaaaccgaccucuaucaucugcccgaaaacuuuagaccuuacacaaaugggcagaaacaggaguucaacaaucaggccaccaacgucauuaaguuuagcgacccccaauggaaucacuuccagggaccuucuugucagggccuugaacccuacaacaaggugacauauaaaccguaccaauccagcgcgcagaauaacgggucuccugcucaggagaucaccggauccgauacauuugagggccugcagcaacaguuccucggggccaaugaaaacagcgccgagaacaugcagauuauccagcugcaaguucuuaauaaggcuaaagaacggcagcuggagaaccucauugaaaagcugaaugaguccgagcgccagaucagauaucugaaccaccagcucgugaucauuaaagacgaaaaggauggacugacccuuucucugcgggagagccaaaagcucuuucagaauggcaaagaacgcgagauccagcuggaggcccagauuaaggcucuugaaacgcaaauccaggcccugaaagucaacgaggaacagaugauuaagaaauccagaaccacagagauggcgcucgaaagccugaagcaacagcugguggaccuccaucacucugagucccugcagcgggcccgcgagcagcaugaaagcaucguuaugggccuuaccaaaaaguacgaggaacaagugcugucucuccagaagaaucuggaugcuacagucaccgcccuuaaagagcaggaagacauuugcagcagacugaaggaucacgugaaacagcucgagcggaaccaagaggcuaucaagcuggaaaagacggagaucauuaauaagcugacacgcucccucgaagagucucagaagcagugugcccaucugcuucagagcggguccgugcaagaagucgcgcagcugcaguuccaacuccagcaggcccagaaagcucacgccaugagcgcuaacaugaauaaggcccugcaagaggagcugaccgaacuuaaagacgagaucucucucuaugaauccgccgcuaagcugggcauucaccccagcgauucugagggagagcugaacaucgaacucacagaguccuacguugaccuggggauuaaaaaggugaauuggaagaaaagcaaggugaccuccaucguccaggaagaggauccuaacgaggagcuuucuaaagacgaguuuauccugaagcucaaagcggaagugcagagacugcugggaagcaauuccaugaagcggcaucuuguuucucagcuccaaaacgaccugaaggauugccacaaaaagauugaggaccugcaucaggugaaaaaggaugagaaaagcaucgaagucgaaaccaagacagacacguccgagaaacccaagaaccagcucuggcccgagagcucuaccuccgaugugguucgcgacgauauucugcuucugaagaaugaaauccaggugcuccaacagcagaaccaggagcugaaagaaacagagggcaagcugagaaauaccaaccaagaccuuuguaaucagaugcggcagaugguccaagauuucgaccacgauaaacaggaagccguggacagaugcgagcgcacauaucagcagcaccaugaggcuaugaagacccaaauucgggaaagccuccuggccaaacacgcccuggagaagcagcagcucuuugaggcuuacgaaagaacgcaucugcagcuucgcucugagcuggauaagcucaacaaagaagucacagccgugcaagaguguuaccuggaaguuugccgggagaaggacaaucuggaacuuacccucagaaaaaccacagagaaggagcagcagacccaggagaaaaucaaggaaaagcugauccaacagcuggaaaaagaguggcaguccaagcucgaccaaacaauuaaagcgaugaagaaaaagacgcuggauugugggagccagaccgaccaggugacaaccucugaugucaucagcaagaaagaaauggcuauuaugaucgaggagcagaagugcacaauucaacagaaccuugaacaggagaaagacaucgccauuaagggagccaugaaaaagcuggaaaucgagcucgaacugaaacacugcgagaauaucaccaaacagguggagauugcuguucaaaacgcccaccagcgcuggcugggcgaacuuccugagcuggcugaauaucaggcccucgugaaggcggagcagaaaaagugggaggaacaacaugaggucuccgugaauaaacggaucagcuucgccgugucugaagcuaaggagaaauggaaguccgaacuggagaacaugagaaagaauauucucccgggcaaagagcuggaagagaagauccacagccuucagaaagaacuggagcucaagaacgaagagguucccgucgugauucgcgccgagcuggcuaaagcccgguccgaauggaauaaggagaagcaggaagagauccauagaauccaggaacaaaacgagcaggauuaccgccaguuucuggacgaucaccggaacaaaauuaaugaggugcuugcggccgcuaaggaagacuucaugaaacaaaagacggagcugcuccugcagaaagaaaccgagcuccagacaugucuggaucagucuagacgggaguggaccaugcaagaagccaagcgcauccagcuugagauuuaucaguacgaagaggacauccugacaguccucggggugcugcugagcgauacccagaaggaacauauuuccgacucugaggauaaacaacuucuggagaucaugagcacgugcuccucuaaguggaugagcguucaguauuucgaaaaacucaagggauguauccagaaggcuuuucaggacacacugccucuccugguggagaacgccgaccccgaauggaagaagagaaauauggccgagcuuuccaaagauagcgcuucucaaggcaccgggcagggagacccuggccccgcggccgggcaccacgcucagccgcuggcccugcaagccacagaagcugaggccgaggaaaacaauaaggucguggaggaacucauugaggaaaacaaugauaugaaaaacaagcuggaggagcuucagacccugugcaaaaccccuccccggucccucagcgcgggcgcuaucgaaaaugccugucugccuugcucuggaggcgcccucgaggaacugagagggcaguacauuaaggcuguuaaaaagaucaagugugacaugcuucgcuauauucaggaguccaaagagcgggccgcggaaauggugaaggcugagguccugagagaacgccaagagacagccagaaaaaugcggaaguacuaccugaucugccuccagcagauccugcaggaugacggaaaagaaggcgccgagaagaagauuaugaacgcugccagcaaacuugcuacgauggccaagcugcucgagacccccaucucuuccaaaagccaauccaagacaacccagagcgcgcugccucucacaucugaaaugcugauugccgugaaaaagagcaagcgcaaugauguuaaccagaaaauccccuguugcauugaguccaagucuaauagcgugaacaccaucacgagaacacuuugugaacaggcuccgaaacggcgcgccgcuugcaaucugcaaagacugcucgagaacuccgaacaucagucuauuaagcacgucgggagcaaagagacccaucuggaguuccaguuuggagacggcuccugcaagcaccuuaacucucugccucggaaugugagccccgaguucgugcccugugaaggggaaggcggauuuggccuccauaagaaaaaggaucugcucuccgacaacgggagcgagucucugccucacuccgccgccuauccguuccuuggaacccugggcaauaaacccagcccucgcugcacacccgggccuucugaauccggauguaugcacaucaccuuuagagauagcaacgagcggcugggccucaaggucuacaaaugcaauccccugauggaguccgaaaacgcugcgucugaaaagagccaagggcuugacguucaggaaccucccgugaaagacggcggagaucuguccgacugucucggcuggccgucuagcuccgccacacugagcuucgauucucgcgaggcuagcuuugugcaugggagaccucagggaacgcuggagauccccuccgaaucugucaagagcaagcaguucuccccuucuggcuaucucagcgacaccgaggaauccaauaugauuugccaaacaaugaaaugucagcgguaccagacccccuaucuuagcgaggaaacaaccuaccuggagccggggaagaucucugugaacugcggacacccuuccagacauaaagccgaucgccucaagagcgacuuuaaaaagcuguccucuacgcugcccagcuccguuugucagcaaccuucucggaaacuuauugugccccugagcucccagcaggauagcggcuucgacucucccuuugucaaucucgauuga

SEQ ID NO: 67316 - RNA, 4212 nt, Artificial Sequence
  derived and/or modified sequence opt5 from CEP162__Homo_sapiens__NP_055710
auggccaacugcagccaggaggaacuggacgaggaauuugagcaauuuaugaaggaacucuccgaugacucuuucgagaauagcgauaaaaccgcuagacaguccaagaaagagaugaagaaaaaggacacagugcccugguggaucacggaagaugacuuuaaggaugacggccugcuugggaccaacgucucuuaccugaaaacaaagaaaaccagccagccuguuauggagauugaagaggaguccgccgaaaagauccaguuccucaaaucuagcggaacaucccugcuuagcaccgauucucuggagacaaaugaacucgugguguccgagcugaaccacagcucucugggcgucgggcucgacacccuggaagaacaggaggaaaaggagcaguuuuucgcgcggcuugaaaagggacugacguccagcauugauuauucucgccucaauaaagagcuggacuccaacgauagcacccauuuuaaggcccuucacuccaaucaggccaacgccgaacugacagacgacgagcaugagaaugaaucuaaacacgaggaacucgcugagaacuacagcgaugacuucgaagaugaguaugugggcgccccgcugaccacaaaggacgaggaaaugcccuccaaagagaauagcaagucugagaaaaucuccguuccuaagcaggaggaggaaaagaccgggaugcuggcuaacgugguccuccuggauagccuugacucuguggccgagguuaaucuggaugaacaagacaaaauuacgcccaagccuagaugucuccccgagaugacagaaaacgagaugaccggaacaggcgugagcuacggccaguccucuagcgaugucgaggcgcugcaucaggccuauugccacaucgcucacucccuuggggacgaagauaaacagaagaucgagagcaauaccguggaagacauuaaaucuuccgugaagggacauccucaagagaacgaagagaacagcaagaauaucucuaccauggaguccgaccugccgacagucgaggagcucaugaaacccauucggaucgauagcuuuggcauuuccggguucgaccugcagccuguuucuagcgaaaagguggccgagcgcaaagaaacggaguuuuucuccucucugccccucaagaugaacccuaauauccugagccaggauucccaacacgugaaccuguuuuucgacaaaaaugaugagaacgucauucuucagaagaccacaaaugaaagcauggagaacucuuguccccaggugaccgaaguuacagcuaccgaggagcauguggacaagauguaccucaauauccugcggaaaaagaucacggucaacuccagcucucuuucccaggaugacaaaauuaauaagacauaucggagccaacugucuagcgaagaagaaggagcugugaugggcaaacaaguuccguacaagaaggcgcgcuccgccccuccccuccugaaaagaaagccucagagcgggcuguacgcuucugugcgguccagcggauauggcaaacccuccucuccccucaagauguucagcacccuggagaaaaagaccuccgaagauaucauuaaaucuaagaaccuucgcagcaucuccacaucuaaucagccuagaaagaaagagauucugagcggcaccaagcucaucaaaccggccgcucuggacaagcccgcccacaaaacagaguccugccugagcacgcggaagaagucugaaaacccuaccgagacagauuccuguauccaauuccagaccgacagccuuggguacugcggagaaaauaaagagaagaaacuccugauguucaagcgcguccaggaagccgaggauaaauggagaggcgcucaggcgcugauugagcaaaucaaggccacauuuucugaaaaggagaaagaacucgagaacaagcuggaggaacuuaaaaagcagcaggagaaagaacuguucaagcucaaccaggacaauuauauucugcaagcuaagcuguccagcuuugaggaaaccaacaaaaagcagcgguggcuucacuucggggaggccgccgaccccgugacgggagagaaacucaagcagauccaaaaagaaauucaggagcaggaaacccugcugcagggcuaccaacaggagaaugaacgccucuauaaccaggucaaggaucugcaggagcaaaauaaaaagaacgaggaaagaauguuuaaggagaaucagucucuuuucuccgaaguggcuagccugaaagagcagaugcauaagucccgguuucucagccagguuguggaagacucugagccuacaagaaaccaaaauuucaccgaucugcuggccgagcuucgcauggcgcagaaagaaaaggacagccuccuggaggauaucaaacggcugaagcaggacaagcaagcucucgaagucgauuuugagaaaaugaagaaagaaagagaccaggccaaggaucagaucgccuacgugacaggggagaaacuguaugagauuaagauccuugaagagacccacaagcaggaaauuucccgccugcaaaaacggcuccagugguacgcugagaaccaggagcugcuggacaaggaugcccuuagacuccgcgaagcuaaugaggaaaucgagaaacugaagcuggaaauugagaaacucaaggccgagucuggaaaccccagcauccggcagaagauuagacugaaagacaaggcggccgaugcuaaaaagauccaagaccuugaacgccagguuaaagagauggaaggcauccugaagcggagauacccuaauucccucccggcccugauucuggcugccucugcggccggcgacacgguggauaagaacacagucgaguucauggaaaaacgcaucaagaaacuugaggcugaccuggaggggaaggaugaagacgccaaaaagagccuccggaccauggagcagcaguuucagaaaaugaagauucaauaugaacagagacuggagcagcaagaacagcuccuggcuuguaaacuuaaucagcaugauucccccagaaucaaggcccuggagaaggagcucgacgauauuaaagaagcccaccaaaucacagugcgcaaccuggaggcugaaaucgacgugcugaagcaucagaacgcggagcuugauguuaaaaagaaugacaaggaugacgaggacuuccagucuauugaguuccaggucgaacaagcccacgcuaaagccaagcuggugagacucaacgaggaacuggccgcuaaaaagcgggaaauccaggaucucagcaaaaccguggagagacugcagaaggaccgccggaugaugcuuuccaaucagaacagcaagggaagagaggaaaugucugccaaacgcgcgaagaaagauguccugcacuccagcaagggcaaugcuaacucuuuuccugggacccucgacuccaaacuguaccaaccccauacauucacggauagccacguguccgagguucugcaggaaaauuauagacuuaagaacgagcuggaaggacucauuucugagaagaaugagcugaaaaugaaaagcgaagccgugaugaaccaguuugagaacuccaugcggcgcgucaaggaagacaccgccgcucauaucgccagccucaaggcgucucaccagagagagauugaaaaacugcuuugccaaaaugcuguggagaacuccagcucuaagguugccgagcugaaucggaaaaucgccacacaggaagugcugauccgccacuuccagagccaagucaaugagcuccaguccaagcaggaaucucuggugguuagcgaggugagagaggaaauucuucagaaggagaucaccaaacugcucgaggaacugcgggaagcuaaggagaaccauacaccugagaugaaacacuuugucggccucgaaaagaaaauuaagcaaauggagaugcgccaugcccagagagaacaggagcugcagcaaaucauucagcagacccaccaggugguggaaacggagcaaaacaaggaggucgaaaaauggaagcggcuugcucagcugaaaaaucgcgagcuggaaaaguucagaacagagcucgauuccauccuggacguucuucgggaacugcauagacaggggguggugguccccguggccuuugcggaugagaugaacgccccggaguacuga

SEQ ID NO: 67317 - RNA, 4368 nt, Artificial Sequence
  derived and/or modified sequence opt5 from CEP164__Homo_sapiens__NP_001258862
auggccggcagaccccugcggaucggggaccagcucgugcuggaggaagauuacgacgagaccuauauuccuagcgaacaagagauccuugaguucgcucgcgaaauuggaaucgauccgauuaaggagcccgaacugauguggcucgccagagagggcaucgucgcgccucugcccggggaauggaaaccuugccaggacaucacaggagauauuuacuauuuuaacuucgcuaauggccaguccaugugggaccaccccugugaugagcauuaccggucucuuguuauccaggagcgcgccaagcugagcacguccggggccauuaaaaagaaaaagaagaaaaaggaaaagaaggacaaaaaggauagagacccuccgaagucuagccucgcucugggauccucucuggcccccgugcacgugccucucggcggccuggcuccccuucgggggcuggucgauaccccucccagcgcccuccgcggaucccaaagcgugucucugggcuccagcguugagucugggagacagcuuggagaacugaugcucccgucccagggccugaaaacaagcgcguauaccaaggggcugcucggaucuaucuacgaggacaaaacagcccugucccuucugggccucggcgaagagaccaacgaggaagaugaggaagagagcgacaaucaguccgugcauucuagcuccgaaccucugcggaaccuucaccuggacauuggggcucucggaggcgauuuugaguaugaggaaagccugcgcacaucucaacccgaggaaaagaaagacgucucccuggauagcgacgccgcugggccucccacccccugcaagccuucuagcccgggagccgauuccucucucagcuccgcggugggcaaagggagacagggaagcggcgcccggcccggccugccugagaaggaagagaaugagaagucugaacccaaaaucugucgcaaccuuguuacgccuaaggcugaccccaccggguccgagccggccaaagcuagcgaaaaggaggccccugaggauacaguggacgccggagaagagggcucuagacgggaagaggcugcgaaagaacccaagaagaaagccuccgcucuggaggaggggagcuccgaugccucucaggaacucgagauuagcgaacauaugaaggagccucagcuguccgacucuaucgccagcgaucccaaauccuuccacggacuugacuuuggcuuccgcagcagaaucucugaacaucugcucgacgucgaugugcuguccccugugcuugggggcgcuugccggcaagcccagcagccccucggaauugaggacaaggaugacagccaaucuucccaggaugagcugcagagcaaacagucuaagggccuugaagagagauaccaccgccugagcccgccucucccccacgaggaacgggcgcaauccccucccagaagccuggcuaccgaagaggagccgccccaggggccugaaggacagcccgaguggaaggaagccgaggagcugggcgaagacucugccgcuucccuuagccuccagcugucccugcaacgcgagcaggccccuucucccccugcugccugugaaaaagggaaggagcagcauagccaggcggaggaacucggacccggccaagaggaagccgaggauccggaagagaaagucgcuguuuccccuacacccccugugucucccgaagugcggagcaccgagccggucgccccucccgagcagcuguccgaagcugcccuuaaggcgauggaggaagccguggcucagguucuggagcaggaccaaagacaccuccuggaaucuaaacaggagaagaugcagcaacugcgcgagaaacuuugccaggaagaggaagaggagauccuccggcugcaccagcagaaagaacaaagccuguccagccucagagagcgccugcagaaggccauugaagaggaagaggcucggaugagagaggaagagucucagcgccuuuccuggcugcgggcccaggugcaaagcucuacgcaggccgaugaagaccagaucagagcugagcaggaagcgucccuccaaaaacugcgggaggagcuggaaagccagcagaaggccgagcgcgcuucucuugaacagaaaaauagacaaaugcucgagcagcugaaggaagagauugaggccuccgaaaaauccgagcaggccgcucugaacgccgcgaaggaaaaggcucuccaacagcugcgggagcagcuugagggggaaagaaaagaggccgucgccacacuggaaaaggagcauuccgcugaacucgagcgccuguguagcucucuggaggccaaacaccgggaagugguuagcucccuucagaagaaaauccaagaggcgcagcagaaggaagaggcucagcuccaaaagugccugggccagguggaacauagaguccaccagaaaucuuaccauguggccggauaugagcacgagcugagcucccuccugcgcgaaaagagacaggaggucgaaggcgagcacgaacggcgccuugauaaaaugaaggaggagcaucaacaggugauggccaaagcuagagaacaguacgaggccgaggaacggaagcaacgcgcugagcugcucgggcaccugaccggagaacuggagagacuucagcgggcccaugaacgcgagcuggaaacaguuagacaggagcagcacaagcggcucgaggaccugcgcagacggcacagagaacaagagcgcaaacuccaggaucuggaacuugaccuggagacccgggcgaaggacgugaaagccagacucgcucugcuggaaguccaggaggagaccgcccgccgggaaaagcagcaacuucuggaugugcagagacagguugcucucaaaucugaggaagccacagccacgcaucagcaacuggaggaagcucagaaggagcacacccaucuccugcagagcaaucaacagcuucgcgagauccuggacgaacuccaggcgcggaagcugaaacuggagucccagguggaucuucugcaagcccagucucagcagcuccaaaagcacuuuagcucccuggaagcugaggcccagaaaaagcagcaucuccugagagaggucacaguggaagagaacaaugccagcccucacuucgaacccgaccuucacauugaggaucugcgcaaaucucugggcaccaaccagacaaaggaaguguccagcucucucucccaaagcaaagaggaccuguaucuugauucccugucuagccauaauguuuggcaccuccuguccgcugagggggucgcccuccggagcgcgaaggaauuucuggugcagcagaccagaucuaugcggcgcagacagacggcucuuaaggccgcccaacagcauuggcggcacgagcuggcuuccgcccaggaaguggcgaaagaucccccuggaaucaaggcucuggaggacaugcgcaaaaaccucgaaaaggagacaagacaucuggacgagaugaaaagcgccaugcggaagggccacaaucuucugaagaaaaaggaagagaaacucaaccaacuggaaucuagccucugggaggaagccuccgaugaggggacccugggcggaucuccgaccaagaaagcugucacauucgaccuuagcgauauggacucccugucuagcgaguccagcgaaucuuuuagcccuccccaccuggacagcacccccucccucacaucuagaaagauucauggccugagccacucccuucgccagaucucuagccagcuguccagcgugcucucuauucuggauucccucaacccucagucucccccuccgcugcuugccagcaugcccgcucaacugccuccccgggacccuaaguccacgcccaccccgacauacuaugggagccuggccagauucucugcgcucagcuccgccaccccuacaucuacccagugggcuugggauagcggacagggcccccgccugcccuccagcguugcccagacgguggacgauuuucuucuggagaaauggcggaaguacuucccuuccgggaucccccuccugucuaauagcccuaccccgcuggaauccagacucggauauaugucugcuagcgagcaacuucgccugcugcagcauucccacucucagguccccgaggccggcagcacaaccuuccaggggaucauugaagccaaccggagauggcucgagcgcgugaaaaaugacccuagacugccccuguuuuccagcacaccuaagcccaaagcuacccugucucuccugcaacugggccucgaugaacacaaccggguuaagguguaccgcuucuga

SEQ ID NO: 67318 - RNA, 4461 nt, Artificial Sequence
  derived and/or modified sequence opt5 from CEP170__Homo_sapiens__NP_001035863
augagccugaccuccugguuccucgugucuagcggcgggacaagacaccggcugccccgcgagaugaucuuugucggaagagacgauugcgaacuuaugcugcagucccggucuguugacaagcaacaugccgugauuaacuacgaugcuagcacggacgagcaccucgugaaagaucugggcucccuuaaugggaccuucgucaacgacgugcgcaucccugaacagacauauauuacccugaagcucgaggauaaacugagauuuggauacgacacaaaucuguucaccguugugcagggcgaaaugcgggucccggaggaggcccucaagcaugaaaaauuuacaauccagcugcaacuuucucaaaagagcuccgagagcgaacugucuaaguccgcgagcgcuaaaucuauugauuccaagguggccgacgccgcuaccgagguucagcacaaaacgaccgaggcccucaagagcgaagagaaagcuauggauaucucugccaugccccgcgggacaccucuguauggacagcccuccugguggggcgacgaugaaguggacgagaagagagcguucaagaccaacggcaaaccugaagagaagaaucaugaggccgggacaagcggauguggcaucgacgcuaaacaggucgaggaacaguccgccgcugccaacgaagaggugcuuuuucccuucugccgggaaccuucuuacuuugagauuccgaccaaggaguuccagcagcccagccaaaucacggaauccacaauucacgagaucccuaccaaagauacacccagcucucacauuaccggggcgggacaugccuccuuuaccaucgaguucgacgauagcacaccuggcaaggugacgauucgcgaccacgucaccaaauuuacaucugaucagagacauaagagcaagaaauccucucccgggacccaggaccugcucggaauccaaacaggcaugauggcuccggaaaauaagguugccgauuggcuggcucagaacaauccuccccagaugcugugggaacggaccgaggaggacagcaaauccaucaagagcgaugugccuguguaucucaaacgccugaagggcaacaagcacgacgaugggacgcagucugacuccgaaaaugccggagcccacagacgguguagcaaacgcgcuacacuugaggaacaucugagacggcaccauucugagcacaagaaacuccaaaagguccaggcgaccgagaaacaucaggaccaggccgugguuuucggcguggaugacaaccaagauuacaauagacccgucauuaacgaaaagcacaaggaccugaucaaagauugggcucuuuccagcgccgccgcugugauggaggaacgcaagccccugaccacauccggguuccaccauucugaggaaggaaccagcuccucuggcagcaaacgguggguuucccagugggccagccucgcggcuaaucacacaagacaugaccaggaggagcgcauuauggaauuuucugccccucugccgcuggagaacgaaacggagaucuccgaaagcgggaugaccgugcggucuacaggauccgccaccagccucgcuucucagggcgagagacgccggagaacacugccccaacuuccuaacgaggaaaagagccuggagucccaccgcgccaaagucgugacccagcggagcgaaauuggcgagaagcaggauacggaacuccaggagaaggagacccccacacaagucuaucagaaagacaagcaggaugcugacagaccucugucuaaaaugaaucgcgccgugaacggggaaacccuuaagacaggaggcgauaauaaaacccugcuccaccugggguccagcgcgcccggaaaggagaaauccgaaacggacaaggagacaucucugguuaagcaaacccucgccaaacugcagcagcaggagcaacgggaagaggcucaguggacaccgaccaaacuuagcuccaaaaacgugucuggccagaccgauaagugcagagaagagacauucaaacaggaaagccaaccucccgagaagaauagcgggcauucuacgagcaagggcgaccgggucgcccaguccgagagcaaacgcagaaaggcugaagagauccugaaaucucagaccccuaagggaggcgacaaaaaggaauccagcaagucucucgugcggcagggguccuuuacaaucgagaaacccagcccuaacauucccaucgaacugauuccgcacaucaauaagcaaaccucuuccacaccuagcucccuggcccuuaccagcgcgucucggauucgcgagcggagcgagucccucgaucccgacucuagcauggauacgacacugauccugaaagacaccgaagccguuauggcuuuccucgaggccaagcugagagaagauaacaaaaccgacgagggacccgauacaccuuccuacaaucgcgacaacucuaucagcccggaauccgauguggacaccgcuucuacaauuagccuugucacgggcgagaccgagagaaaguccacacagaagcggaaauccuuuaccucucuguacaaggaucgcuguuccacagggagccccucuaaagacgugaccaaguccagcuccucuggagccagagaaaagauggagaagaaaaccaagagccgguccaccgaugugggcagccgcgccgacgggagaaaguucguucagucuuccggccggauccgccaaccuagcgucgaccucacagaugacgaucagaccucuagcgugccccauuccgcuauuucugacaucaugagcuccgaucaggaaacauauucuugcaaaccucacggaagaacgccccugacaagcgcggacgagcaugugcacuccaagcuggagggcagcaaagucaccaagucuaaaacguccccugugguuagcggguccucuagcaaguccacaacccuuccccggccgcgcccuaccagaacaucucuccugcggagagcccgccugggagaagcuagcgauuccgagcucgccgacgccgauaaggcuagcguggccucugaagucuccaccacgagcucuacauccaaacccccuaccggccggagaaauauuagccgcaucgaccugcuugcgcagccccggagaacacgccuggggucucucagcgcucgguccgauucugaggccaccauuagcagauccagcgccuccucucgcacagcugaagccaucauccggagcggagcgagacuggugccguccgacaaguuuucuccucggauucgcgcuaacagcaucuccagacugucugacagcaaaguuaaguccaugaccagcgcccacggcucugccuccgugaauagccgguggcgcagauuccccacggauuacgcuucuaccuccgaggacgaguuugggagcaacagaaauucuccuaaacauacaagacuucgcaccucccccgcccucaagacaacccggcugcaaagcgcuggcuccgccaugcccacgagcucuagcuucaagcacagaauuaaagaacaggaggauuauauccgcgacuggacagcgcaucgggaagagauugccagaaucucccaggaucuggcucucaucgcccgcgaaauuaacgacgucgcuggagagaucgauucugugaccagcuccggcacagccccuucuaccaccguuagcacagccgcuacgaccccgggguccgcgauugacacacgggaggaacugguggauagagucuuugacgagucucuuaacuuccgcaagauucccccucuggugcacagcaaaacccccgaaggaaauaacggcagauccggggauccucggccccaggccgcugagccuccggaccaucucacaaucacccgcagacggacguggagccgcgaugaagugaugggagacaaucugcugcuuucuuccgucuuucaauucagcaagaaaaucagacagucuaucgacaagacagccggcaagauucggauccucuucaaagauaaggacagaaacugggaugacauugaguccaaacugcgcgccgagagcgaaguucccaucgugaagaccuccucuauggagauuagcuccauccugcaggaacucaaacggguggagaagcagcugcaagcuaucaaugccaugauugauccugacgggacccuugaggcgcugaacaauaugggcuuucccagcgcuaugcucccuucucccccgaagcagaaauccagcccugucaacaaucaccacucucccggacagacacccacccugggccagccugaagccagagcccugcaucccgcugccgugagcgcggcugccgaguucgaaaacgccgaguccgaagcugauuuuucuauccacuucaaucgcuuuaacccugacggggaggaggaagauguuacagugcaagaguga

SEQ ID NO: 67319 - RNA, 7614 nt, Artificial Sequence
  derived and/or modified sequence opt5 from CEP192__Homo_sapiens__NP_115518
auggaagacuucagaggaaucgccgaagagagcuuucccuccuuccugaccaacucucuguuugggaauagcgggauucuggaaaacgugacccuuuccucuaaucugggccucccugucgcuguuagcacgcuggcccgggaucgcuccucuaccgacaacagauacccggauauccaggcgagcuaucuuguggaagggcgguucuccgugcccagcggaucuuccccuggcagccaaucugacgcugaaccccgcgagagacugcagcucuccuuucaggaugacgauagcauuucucggaagaaauccuacgucgagagccagcgccuguccaaugcccugucuaagcaaagcgcccuccagauggaaacagcugggccugaggaagaacccgccggagcuaccgagucccugcagggccaggaccuuuucaacagagccagcccucuggaacaagcgcaggauucuccgaucgacuuucaccuccaguccuggaugaauaacaaagagcccaagauugugguucuggaugccggcaaacauuucgaagacaagacacuuaagagcgaucugucucacaccagccuccuggagaaugaaaaacugauccucccuacaucccuggaggacucuagcgacgaugacaucgaugacgagauguuuuaugaugaccaucuugaggcuuacuucgagcagcuggccauucccgggaugaucuaugaagaucucgagggaccugaacccccggagaagggcuuuaaacugccuaccaacgggcuucggcaagcuaaugagaacggaucccugaauugcaaguuccagagcgaaaacaauucuucccucauuagccuggacucucacuccagcgagacgacccauaaagaauccgaggaaucucaggugaucugucugcccggcacaagcaacuccauugggaccggagauucucgcagauacacagacggcaugcucccuuuuagcuccggcaccugggggacggagaaggagaucgaaaaccugaagggaauuguccccgaucuuaauagcgagugcgccucuaaagacgugcugguuaagacacuccgggcgaucgacgugaaacugaacuccgauaauuuccacgacgccaacgcuaaucgcggcggguucgaucuuaccgaccccgucaagcaaggagccgaauguccucaccagaacaaaacagugcugcauauggauggcugccucgacaccgagaccccgacagugagcauccaggagaaugucgauguugcuucucugaagcccauuuccgacagcgggaucaacuuuacggaugccauuuggucuccuaccugugaaagacggacaugcgagugucacgaaagcaucgagaaaaauaaggacaagaccgaucugccccaguccgugguguaucaaaacgaagagggacgcugggucacagaccucgccuacuacaccagcuucaauucuaaacagaaccugaaugugucccuuagcgaugagaugaacgaagacuuuagauccggcucugaggcuuucgaccugauugcgcaggaugaagaggaauuuaauaaggagcaucaguucauccaagaggaaaacaucgacgcccacaacacgagcguugcucucggcgauacauccuggggagccaccauuaauuauucucugcugcggaaaagcagauccaccucugaccuugauaaggacgaugccagcuaccuccgccugucccugggagaguuuuucgcucagcggagcgaagcccucggcugccucgggggaggcaacaaugugaaaagaccuucuuuuggguauuucauccgcucccccgagaagcgggaaccgauugcgcuuaucagaaagagcgacgucucucgcggcaaccuggagaaagagauggcucaccucaaucaugaucuguacuccggagaccugaacgaacagagccaggcccaacuuucugagggcuccauuacacuccagguggaagccguugagagcaccucccagguggaugagaaugacgucacacugacggcugauaaggggaaaaccgaagacacauuuuucaugagcaacaagccucagcgguauaaagacaagcugcccgauucuggagacagcaugcucagaaucuccaccaucgccucugcuauugccgaggcgagcgugaauacagauccuucccaacuggccgcuaugaucaaggcccuuucuaacaaaacccgcgacaagacguuucaggaagaugagaaacagaaggacuacagccacguccggcauuuccugcccaaugaucucgaaaaauccaacggcucuaaugcucuggacauggagaaguaucugaagaaaaccgaggugagcagauacgaauccgcccuugagaacuucagccgcgcgucuauguccgauacaugggaccucagccugccuaaggaacaaaccacacaggauauucaccccguugaccugucugccaccuccgugagcguccgggcuccggaggaaaauacggccgcuaucguguacguugagaacggggaguccgaaaaccaggagucuuuuagaacaauuaauagcuccaacagcgugaccaaucgggaaaacaauucugccgucguggacgugaaaacauguuccaucgauaacaagcuccaggacguuggaaaugaugagaaagccaccagcauuucuaccccuagcgacuccuauucuagcguccgcaaccccagaaucacaucccugugccuucugaaggauugugaagagauccgggacaauagagagaaccaacgccagaaugaaugcgugucugagauuagcaacuccgaaaaacaugugacguucgagaaucaccggaucgucagccccaagaacucugaucucaagaauaccuccccugagcacggcgggagaggcagcgaagacgagcaggaauccuuucgcccgucuacaagcccccugucccauucuagcccuuccgagauuagcggaaccucuuccagcggcugcgcucuggaaucuuucggguccgcggcccagcaacagcagcccccuugugagcaggagcuuagcccccucgugugcucuccugcuggaguuagcagacugacauacguguccgaacccgagucuagcuauccgaccacggccacagaugacgcccuggaagaucggaaauccgacaucaccagcgagcucuccaccacaauuauccaaggcucuccugcugcccuggaagaacgcgcgauggagaaacuuagagaaaaaguccccuuucagaaccgggggaagggaacccugagcuccaucauucagaacaauucugauacacgcaaagcuacggagaccacaagccucuccucuaagccugaauacgugaagcccgacuucagauggagcaaagacccguccagcaagucuggcaaccugcuggagaccuccgaaguuggguggacaagcaauccugaggagcuugaucccauccggcuggcccuccugggcaaaucuggacucuccugucaagugggcagcgccaccucucacccugucuccugccaggaacccauugacgaggaucagcgcaucagccccaaggacaaauccacggcugggagagaauuuagcggacaggugucucaucaaaccacaagcgagaaccaguguaccccuauuccguccucuacaguucacagcuccguggccgauaugcagaauaugcccgcggcuguccacgcccugcuuacccagccuucucugagcgccgcucccuucgcccaacgguaucucggcacacugccuuccaccgggucuacgacacugccccagugccaugcuggaaacgccaccguguguggcuuuagcgggggccuuccuuacccggcgguggccggagagcccguccaaaauuccguugcugugggcaucugccuggggagcaacaucggaucuggcuggauggggaccuccagccucuguaauccuuauucuaacacacugaaucagaaccuccuguccaccacgaagcccuucccugugcccagcgucggaacaaauugcggcauugaaccgugggacuccggcgugaccucugggcuuggaagcguucgcgugccugaggaacugaagcucccccacgccuguugcgucggcaucgcuucccaaacacugcugagcgugcuuaaccccaccgauagauggcugcagguuucuauuggggugcucuccaucagcgucaauggagagaaaguggaccugucuacauaccggugccucguuuuuaagaacaaagccauuaucagaccucaugccaccgaagagaucaaggugcuguucauucccagcuccccuggcgucuuucgcuguacguucucuguggcuagcuggccgugcuccaccgaugcggagacaaucgugcaggccgaagcucuugccucuaccgucacacugaccgccauugcugagagccccguuaucgaaguggagacggagaagaaggacgugcuggauuucggggaccucacauacggaggcuggaaggcccugccucuuaaacugauuaaucggacccacgcgacaguccccaucagacucauuaucaacgcuaacgccguggccuggcgcuguuuuaccuucuccaaggagagcguucgggcuccuguggaggucgcccccugcgcggaugugguuaccagacuggcuggcccgucuguggucaaucauaugaugccugccuccuaugacgggcaggaccccgaauuucucaugaucugggugcuguuccacagcccuaaaaagcaaauuuccucuagcgauauccuugacuccgccgaggaauuuucugcuaaagucgauauugagguggacagccccaacccuacacccguucugcgcuccgugagccugcgggccagagcuggaaucgcccgcauucacgcgccgcgggaucuccagacgaugcauuuccuggccaaggucgcuucuuccagaaaacagcaccuuccucugaagaaugccggcaacaucgaaguguaccucgacaucaagguucccgagcaagggagccauuuuucuguggaucccaaaaaucugcuccugaagccuggagaggaacacgaggucauuguguccuucaccccgaaagaccccgaggcuugugaggagcggauccuuaagauuuuugugcagccuuucggcccccaguaugaaguuguccugaaaggggaggugaucagcucuggauccaagccucugagccccggcccuugccucgauauuccgucuauccugagcaacaagcaguuucuugccuggggcggggugccccugggacgcacacaacuccagaaacuggcccucagaaauaacuccgcuagcaccacacagcaucugcggcuucugauccgcggccaggaccaagauuguuuccagcugcagaauaccuucggguccgaacagagacucacgucuaacugcgagauucggauccacccuaaggaagacauuuuuaucagcguccuguucgcgcccacaagacuuuccuguaugcuggcccgccucgagauuaaacaacugggaaaucggucucagccuggcaucaaguuuaccauuccccugagcggguacggaggcaccuccaaccucauccuugagggcgugaaaaagcugucugacagcuauaugguuacagugaaugggcuggucccgggaaaggaauccaaaaucguguucagcguuagaaacaccggcucucgcgcugccuuugugaaggccgucggguucaaagauucccagaagaaagugcuccuggacccuaagguucuucggauuuuucccgauaaguucgugcugaaagagagaacacaagaaaaugucacgcucaucuacaaccccagcgaccgcggaauuaacaauaagaccgcuacagagcugucuaccguguaucuguuuggcggggaugaaaucucccggcagcaguacagacgcgcccuccuucacaaaccugagaugauuaagcagauccugcccgagcauagcgugcugcaaaacaucaauuucgucgaagcguuucaggacgagcuccugguuacagaaguguacgaucuuccucagagaccgaacgacgugcagcuguucuauggaucuaugugcaaaauuauccucuccgucauuggcgaguuucgggauuguaucagcucucgcgaguuccugcaacccuccagcaaggcuagccuggaguccaccucugaccucggcgccagcgggaagcacggaggcaaugugucccuugauguucugccugugaaagggccccagggaucuccucugcucagcagagccgcucggcccccgcuggaccagcuugccuccgaggaaccuuggacgguccugcccgagcaucucauucugguggcgccuucucccugcgauauggccaagaccggccgcuuccagaucguuaacaauagcgugagacugcuccgguuugaacuuugcuggccugcucacugucugacagucacaccccagcacgggugcguggccccggaguccaaacugcagauccucgucagcccuaacucuucccugagcacaaagcagucuauguuccccugguccggacuuauuuacauccauugugacgacggccagaaaaagauugugaaaguucaaaucagagaggaucugacccagguggaacuccugacacgccugacgagcaagcccuuuggcauucucuccccugugucugagccgagcgucucccaccuuguuaagcccaugaccaaaccucccucuacaaagguggaaauccggaauaaaagcauuaccuucccuaccacagagcccggggaaacguccgagagcugccuggagcuggaaaaccauggaaccacagacgugaaguggcaccucucuucccuggcuccucccuaugucaaaggcguggaugagagcggggacguuuuuagagccaccuacgcugccuuccgcuguucuccgaucagcggacuucuggaaucccauggcauccagaaggugucuauuacauuucucccucgggggagaggagauuaugcgcaauucugggacgucgagugccacccccugaaggaaccucacaugaaacauacccugcgguuucagcucagcggccaguccaucgaggccgagaaugaacccgagaacgcuugucuuagcacggauucucugauuaagaucgaccaccuggugaaaccgcgcagacaggccgucuccgaagcuagcgcccggauuccugagcaacucgaugugacagcccgcggcguuuacgcucccgaagacguguauagauuccggcccaccuccgucggggagucucgcacccugaaggugaaucuuagaaacaauagcuuuaucacacauucccugaaauuccucucuccucgggagcccuuuuacguuaagcacagcaaguacucccugcgcgcgcagcacuauaucaacaugccugugcaguucaaaccgaagucugccggaaaauucgaagcucugcucgucauucagaccgaugagggcaagagcaucgccauuagacuuaucggggaagcccugggcaaaaacuga

SEQ ID NO: 67320 - RNA, 504 nt, Artificial Sequence
  derived and/or modified sequence opt5 from CEP19__Homo_sapiens__NP_116287
auguacaugggcaugaugugcaccgccaagaaaugugggaucagauuccagcccccugcuauuauccugauuuaugagagcgaaaucaagggaaaaauucggcaacgcaucaugccggugagaaacuuuuccaaguucucugacugcacacgggccgcggagcagcucaaaaauaacccccgccacaagagcuaccuggaacaggucucccuuagacagcuggagaagcucuuuucuuuccugcggggcuaucuuagcgggcaaucccuggcugaaacgauggagcagauccagcgcgagaccacaauugauccugaagaggaccucaauaaacuggaugacaaggaacuggccaaaagaaagucuaucauggaugagcucuuugagaaaaaccagaagaagaaagacgaucccaauuucguuuacgacauugaaguggaguuuccucaagaugaccagcugcagagcuguggaugggauaccgaauccgccgacgaguucuga

SEQ ID NO: 67321 - RNA, 7329 nt, Artificial Sequence
  derived and/or modified sequence opt5 from CEP250__Homo_sapiens__NP_009117
auggagaccagaagccccggccugaacaauaugaaaccucagucccuccaacuggugcuugaggaacagguccuggcucuccagcagcaaauggcugaaaaccaggccgcgucuuggcggaaacugaagaauagccaggaggcucagcaaagacaggccacacuuguuagaaaacugcaggccaaggugcuccaguaccgguccuggugccaagaacuggagaaacgccuggaggcuacagggggaccgaucccccagagaugggaaaacguggaggaaccuaaucucgacgagcugcuuguccggcuggaggaggaacagcaacgcugugaaucucucgccgaggugaacacccagcugagacuucacauggaaaaggcugauguugugaauaaggcccugcgggaggacgucgagaaacucacgguggauuggagccgcgcgagagacgaacugaugcggaaggagucccaguggcagauggaacaagaguucuuuaaaggcuaucugaagggggaacacggacgccuccugucucuuuggagagagguugugaccuuccggcgccacuuucuggagaugaaaagcgccacagauagagaccucauggaacugaaggcugagcauguccggcuuuccggcagccugcugaccugcugucugagacugacagugggggcccagucucgcgaacccaacggauccggccggauggauggcagagagccugcucagcuccugcuucugcucgccaagacccaggaacuggagaaagaggcgcacgaacgcagccaagagcuuauucagcugaagucucagggggaccucgaaaaagccgagcugcaggaucgggugacggagcuguccgcucuccugacccaaagccagaagcagaaugaagacuacgagaaaaugaucaaggcccuuagagaaacagucgagauucuggaaaccaaccauacagagcucauggagcacgaggcuucucugucccgcaaugcccaggaggaaaaacugagccuucaacagguuaucaaggauauuacccaggugaugguggaggaaggagacaacaucgcccaaggcuccgggcacgaaaauucucucgagcuggauagcuccaucuucagccaguuugacuaucaggacgcugauaaggcgcugacgcucguccggucugugcugacaagacgccggcaggccguucaagaccuuagacagcagcuggcuggaugccaggaagccgugaaccuccugcaacagcagcaugaucagugggaggaagagggcaaagcccugcgccaacggcuucagaagcucaccggggaaagagacacacuggcuggacagaccgucgaucugcaaggcgagguggacucccucagcaaagagcgggaacugcuucagaaggcccgcgaggaacugagacagcagcucgagguucuggagcaagaagcguggcggcugagacgcgugaaugucgagcuucagcuccagggcgauucugcucaggggcaaaaagaggaacagcaggaggaacuccaccuggccgugcgggagagagaacgccuccaggagaugcugaugggacuugaagccaagcaaagcgagucccugucugaacucauuacccugagagaggcucuggagagcucccaucuugaaggcgagcuccugcggcaggaacagacagaggucacggccgcucuggcccgcgcggaacagagcaucgccgagcucucuuccagcgagaacacccugaagacagaaguggcugaccuuagagccgcugccguuaaacugucugcgcucaacgaggcccuggcucuggauaagguggggcuuaaucaacagcugcuccagcuggaagaggagaaccaauccgucuguagccggauggaagccgcugagcaggcccgcaaugcccuccagguggaccuggcugaagcggagaaaagacgggaagcccuuugggagaagaacacccaccuggaggcucagcuccaaaaagccgaagaggccggagcugaacugcaggccgaucugcgcgacauucaggaggaaaaggaggagauccagaagaaacuuuccgaaucuagacaccaacaggaggcggcuacaacccagcuggaacagcuccaucaagaggccaagcggcaggaagagguucuggcccgcgcugugcaggagaaagaagcccucgucagagagaaggcggcucuggaagugcggcuucaagccguggagagagaccgccaggaucuggccgagcagcuccagggccugagcuccgcuaaagaacugcuugagucuagccuguucgaagcccaacagcaaaauuccguuauugaggucacgaaggggcagcucgaagugcaaauccagacagugacccaggcuaaggaggucauucagggagaggugcggugccugaaacucgaacuggacaccgagagaagccaagccgaacaggagcgcgaugcggccgcucggcagcuugcccaggcugaacaagagggcaagacagcccuggagcagcagaaagccgcucacgaaaaggagguuaaccaacugagagaaaaaugggagaaggaacgcucuuggcaucagcaggagcucgcgaaagcccuggagucccuugaacgggagaagauggaacuggagaugagacucaaggagcagcaaaccgaaauggaggcuauccaggcccagcgcgaagaggaacggacacaggccgagagcgcucugugucaaaugcagcucgagacggaaaaagagagagugucucugcuugaaacccugcugcagacacagaaggagcucgccgacgcgucccaacagcuggaacggcuucgccaggauaugaaaguccaaaagcugaaagagcaggagaccacaggcauccuccagacccagcugcaagaagcucagagagagcucaaggaagccgcccggcagcaccgcgacgaucuggcugcccuucaggaggaaagcucuagccugcugcaagacaagauggaucuccagaaacagguggaggaccugaagucccagcuuguugcgcaagaugacagccagagacugguggagcaggaaguccaagagaaacuccgggaaacgcaggaguacaaucgcauucagaaggagcuggaacgcgagaaggcuucucucacccugucccuuauggaaaaggagcagcggcugcuggugcuccaagaagccgauagcaucagacagcaggagcuguccgcccuucgccaggacaugcaagaggcucagggggaacagaaggagcugucugcccagauggaacuccugcggcaagagguuaaagaaaaggaggcugacuuucuggcccaggaggcgcagcuccuugaggaacuggaagccagccauauuacagagcagcaacugagagcuucccucugggcccaggaagcuaaagccgcccagcugcaacuucgccugcggucuaccgagagccagcucgaggcucuggcggccgaacagcagcccggaaaccaagcucaggcccaggcccagcuggcuucccucuauucugcccuucaacaggcgcugggcagcgugugcgaguccagaccugaacugagcgggggaggcgauucugcuccguccgucugggggcucgagcccgaccagaauggcgcccgcagccuguucaagagaggaccucuucugacagcccucucugcugaggccguggcguccgcccugcacaaacugcaccaggaucucuggaagacccaacagacgcgggacgugcuucgcgaucagguccaaaagcuggaagagagacugacagacaccgaagcugagaaaagccagguucauacagaacuccaggaucugcagcggcaacuuucucagaaccaggaggagaaguccaaaugggaaggcaagcagaauagccuggaguccgaacucauggagcugcacgaaaccauggccagccugcaaucucgccucagacgggcugagcuucagagaauggaggcccagggggaacgcgagcugcugcaggcugccaaagaaaaccucaccgcgcaaguggagcaucugcaggccgcuguggucgaagcccgggcucaggccagcgccgcuggaauccuugaggaggaccugagaacagcgcgcuccgcccucaagcugaaaaaugaagagguggaaucugagcgggagagagcucaggcccugcaagaacagggcgagcucaagguugcccaggggaaggcccuucaggaaaaccuggcucugcucacgcagacccuggcggagcgggaagaggagguggaaacacuucgcggacagauucaggagcuggaaaaacaaagagagaugcagaaggccgcucucgaacugcugagccucgaucuuaaaaagcggaaucaggaggucgaccugcagcaagagcagauccaggaacuggagaaaugucgcuccgugcucgaacaucugcccauggccguucaggagagagaacaaaaacuuaccgugcagcgggagcagauccgcgagcuggaaaaggauagagagacacaacggaacguccucgaacaccagcugcuggagcucgagaaaaaggaccagaugauugaaucucagcgcggccaagugcaggaucuuaaaaagcagcugguuacccuggagugccucgcucuggaacuugaggaaaaccaucacaaaauggagugucagcaaaagcugaucaaggagcucgaagggcagagagagacgcagcggguggcccugacacaucugacccucgaccuugaagagagaagccaggaacugcaagcgcaguccucucagauucacgaccuggagagccauuccaccguccucgcccgcgagcugcaagaacgggaucaggaggugaaaagccagagagaacagaucgaggaacuucaacgccagaaggagcaccugacacaggaccucgagcggagagaucaggaacugaugcugcaaaaagagcgcauucaggugcucgaagaccagcggaccagacagacaaagauccuugaggaggaucuggaacaaaucaaacugucucuccgcgagcggggcagagaacugacgacccagcgccagcuuaugcaggagcgggcugaagagggaaagggcccuuccaaggcccaaagagggagccuggagcacaugaaacucauucugcgcgacaaggaaaaagaggucgaaugccagcaggagcauauccacgaacugcaagagcucaaggaucagcuggagcagcagcuucaaggacugcauagaaaaguuggcgaaacaucucuccugcuuucccagcgggagcaggaaauuguggugcugcagcaacagcuccaggaggcucgcgaacagggggagcugaaggagcaaagccugcagucccagcucgacgaagcccaaagagcucuggcccagcgggaucaggagcuugaagcgcugcagcaagagcagcagcaggcccaaggacaggaggaaagagucaaggagaaagcugacgcccuccagggcgcucuggaacaggcccacaugacccuuaaggagcggcauggggaacugcaagaucacaaagagcaggcccgcagacucgaggaggaacuggcgguggaaggccggcgcguucaggcucuggaggaagugcucggagaccugagagccgagucucgggagcaggaaaaggcccuucuggcccuccaacagcagugcgccgagcaagcucaggaacacgaggucgaaacacgcgcccugcaggacagcuggcuucaggcgcaagccgugcugaaagagagagaucaggagcucgaagcucugcgggccgagucccagagcucucgccaucaggaagaggcugccagagcgcgggccgaggcucugcaagaagcccucggcaaggcucacgccgcucugcaggggaaagagcagcaucuucuggaacaggccgagcucucccgcagccuggaagcgucuaccgccacgcuucaagcuagccuggacgccugucaggcucacuccagacagcucgaggaggcccugcggauccaagaaggagagauucaggaucaggaccugcgcuaccaggaagauguucaacagcuccagcaggcccuggcgcaaagagacgaggaacuucggcaccagcaggagagagagcagcugcucgaaaagucucuggcucaacgcgugcaggagaauaugauccaggaaaagcagaaccuuggccaagagcgggaagaggaggaaauuagagggcugcaucagagcguccgcgagcuccagcugacccuggcccaaaaagaacaggagauccucgagcugcgggaaacacagcagagaaauaaccuugaggcccugccccacucccauaagaccucuccgauggaggaacaaagccucaaacuggauucccuugaaccucgccugcagcgggagcucgagagacugcaggcugcccugcgccagacagaagcucgggagaucgaauggagagagaaggcccaagaccucgcgcugagccuugcccagaccaaggcuucuguguccagccugcaggaagucgccauguuucuccaggcuuccgugcuggagcgcgauucugagcaacagcggcuucaggacgaacuggagcucacaagacgggcccuggaaaaggagagacugcacagccccggagcgaccuccacggccgaacuuggcucucgcggggagcaaggcguucagcugggagaggugagcggcgucgaagcugagccuucccccgaugggauggaaaagcagagcuggcggcagagacucgagcaucugcaacaggccguggcucgccucgagauugacagaucucggcugcagcgccacaauguucagcuuagauccacacuggaacaaguggagcgggaacgcagaaaacugaagcgggaggccaugcgcgcugcccaggcgggaagccucgaaaucucuaaagccaccgcuuccagccccacccagcaggauggcagagggcaaaagaacucugacgccaaaugcgucgccgagcugcagaaggagguggugcuucugcaggcucaacucacacuggaacggaagcagaaacaggacuauauuacccgcagcgcccagacguccagagagcucgcgggacugcaccauucucugagccacucccuucuggcuguugcccaagccccugaagcuacaguccucgaggccgaaacccggcgccuggaugagagccuuacacagucccugaccucuccgggccccgugcuccugcauccuagccccuccacaacccaggcugccucuagauga

SEQ ID NO: 67322 - RNA, 7440 nt, Artificial Sequence
  derived and/or modified sequence opt5 from CEP290__Homo_sapiens__NP_079390
augcccccuaacaucaauuggaaggagauuaugaaaguggacccggaugaccugcccagacaggaagagcucgccgauaaccugcuuaucagccuguccaaggucgaaguuaaugagcucaaaucugaaaagcaagagaacgugauucaccuguuccggaucacccagagccuuaugaaaaugaaggcucaggagguggaacuggcccucgaggaagucgagaaggcgggcgaggaacaggcuaaauuugagaaucaacugaagacaaaagugaugaagcuggaaaacgagcucgaaauggcccagcaguccgccgggggacgcgacacgagauuccugcggaaugagauuugccagcuugagaaacaacuggaacagaaggaucgcgagcucgaagacauggagaaggaacuggagaaagagaagaaaguuaacgaacagcuugcucugagaaaugaggaagccgagaacgaaaauucuaagcuccggcgcgagaacaaaagacugaagaaaaagaaugagcagcugugucaagauaucaucgacuaccagaagcagauugauagccaaaaagaaacccuccugucccggcgcggcgaggacucugauuauagaagccagcuuuccaagaaaaacuacgaacugauccaguaucucgacgagauucagacacugaccgaggcuaaugaaaagaucgaggugcaaaaccaggaaaugcggaaaaaccuugaggaaagcguccaggagauggagaagaugacagaugaauacaaucgcaugaaggccauugugcaucagaccgacaacguuaucgaccaacugaaaaaggagaaugaucacuaucagcuccaggugcaggaacugacagaccugcucaaaucuaagaacgaggaagaugacccuauuauggucgcggugaaugccaaaguggaggaguggaagcugauccuuuccagcaaggaugacgaaaucauugaguaccaacagaugcugcauaaccucagagaaaaacugaagaaugcucagcuugaugccgacaaaucuaacgucauggcucugcagcaagggauccaggagcgggauucccagauuaagaugcucaccgaacaaguugagcaguauacgaaagagauggaaaagaauaccugcaucauugaggaccugaagaacgaacugcagcgcaauaaaggagccagcacacucucucagcaaacccacaugaagauccaguccacacuggauauccuuaaagagaagaccaaagaggcggaaagaacggccgagcuggcugaagccgacgcucgggagaaggacaaagaacucguggaggcccugaagagacugaaggauuacgagagcggcguguacgggcuugaagacgccgucguggagauuaaaaacuguaagaaucagaucaaaauucgcgaucgggaaaucgagauucucacaaaggaaaucaacaaacuggagcugaagaucuccgacuuucucgaugagaaugaagcucugagagagcgcguuggacuugaacccaagaccaugauugaccugacagaguuccggaacucuaaacaucucaagcagcaacaguauagagcggaaaaccagauccugcugaaagagauugagagccuugaagaggaacgccucgaucugaagaaaaagauccggcagauggcccaagagagaggcaagcgcuccgcuaccagcggccugaccacagaggaccucaaucugacggaaaacauuucucagggggaucggaucuccgagagaaaacuugaccugcucagccugaagaauaugucugaagcccagagcaaaaacgaguuucugucccgcgaacuuauugagaaggagcgggaucucgaaagaucucggaccgugaucgccaaauuccaaaauaagcugaaggagcuggucgaagagaacaaacagcucgaagagggaaugaaggagauccugcaggcuauuaaagaaaugcagaaggacccugaugugaaaggcggggagacaagccuuaucauucccucccuggaacgccucguuaaugccaucgagagcaagaacgcggaaggaauuuuugacgcuucucugcaccugaaagcccaaguggaccagcuuaccggcagaaaugaggagcuccggcaggaacugagagagucccgcaaggaagccaucaacuacagccagcaacuggcuaaggccaaucucaaaaucgaucaccuggagaaggagacaucucuucugcggcaguccgaagggagcaacgucguguucaaaggaauugaccucccugauggcaucgcuccguccucugccagcauuaucaauucccagaacgaguaucugauucaucugcuucaggaacuggagaauaaggaaaaaaagcucaagaaccuggaggacucucucgaggauuacaacagaaaauuugcggucauccgccaccaacagagccugcuuuauaaggaauaccuguccgagaaagaaaccuggaagacggagagcaaaacaaucaaggaagagaagagaaaacucgaggaccaggugcagcaagaugccauuaagguuaaagaauauaauaaccugcugaaugcucuucagauggacucugaugagaugaagaaaauccuggccgaaaacucccggaagauuaccgugcuccaggucaaugagaagagccugauccgccaauacaccacacucguggaacuggagagacagcuucggaaagagaacgaaaagcagaaaaaugagcugcucucuauggaagcugagguuugcgagaagauuggcugucugcagcgcuucaaagaaauggccaucuuuaagaucgcggcccugcaaaagguggucgacaacuccgugagccuuucugagcuggaacucgcuaauaaacaguacaacgagcugaccgccaaguauagagauauucuccagaaagacaauaugcuggugcagcggacaagcaaccuugaacaucuggagugcgagaauaucucccugaaggaacaaguugagagcauuaacaaagaacucgagaucacgaaggaaaaacugcacaccauugagcaggcuugggagcaggaaacaaagcuugggaaugagucuuccauggauaaggccaaaaagagcaucaccaacuccgacauugucucuaucagcaaaaagaucacaaugcuggaaaugaaagagcucaacgaacgccagagagccgagcacugucaaaagauguacgagcaucugcggaccucccucaagcagauggaagagcgcaauuucgaacuggagacgaaauuugcugagcuuaccaagauuaaccuggacgcgcagaaaguggaacaaaugcugagagaugagcucgccgacucugugagcaaggcugucuccgaugccgaccggcagagaauccuggaacuugagaaaaaugaaauggagcugaagguggagguuucuaagcuccgcgaaauuagcgauaucgcccggagacagguggagauucugaacgcucagcaacagucccgcgacaaagaagucgagagccuccggaugcagcugcuugauuaucaggcccaaucugacgaaaagucccugaucgcgaaacugcaccagcauaaugugagccuccagcugucugaggcuacagcccuuggaaagcuggaguccaucaccagcaaacuccagaagauggaagccuacaaccugagacucgagcaaaagcuggaugaaaaagagcaggcucuuuauuacgcccgccuggaaggccggaauagagcgaagcaccugcgccagacaauucagucucuccggagacaauucuccggggcucugccccuugcccagcaggagaaauucagcaagaccaugauccaacugcagaacgacaaacucaagauuaugcaggagaugaaaaauucccagcaagaacaucggaacauggagaauaagacgcuggaaauggagcugaagcucaaaggacuugaggaacugaucagcacacugaaggauaccaaaggcgcccagaagguuauuaacuggcacaugaaaaucgaggaacuccgccugcaggagcuuaagcugaauagagaacucgugaaggacaaagaggagaucaaguaucugaacaauauuaucucugaauacgagcggacaauuagcucccuggaagaggaaaucguccagcaaaacaaauuucacgaggagcgccagauggcuugggaccagagagaaguggaucucgagcggcagcuugacauuuucgauagacaacagaaugaaauccugaacgccgcucagaaguuugaggaagccaccgggucuauuccugaccccagccugccucuccccaaccaacuggagaucgcgcuucgcaaaaucaaggagaauauucggaucauucuggaaaccagagccacaugcaagucccucgaggaaaaacugaaggagaaagagucugcucugcgccucgccgaacagaacauccuuagccgggauaagguuauuaaugagcugagacugcgccucccggcuacggccgaacgggagaaacugaucgccgaacuuggaagaaaggagauggagccuaagucccaucacacccugaaaaucgcucaucagacaauugcgaacaugcaggcccgccucaaucaaaaggaagaggugcugaaaaaguaccagagacugcucgaaaaagcucgggaggaacagcgcgagaucgucaagaaacacgaggaagaccuucacauucugcaucacagacuggagcuccaggccgauucuagccugaacaaguucaagcaaaccgccugggaccuuaugaaacagucccccacaccugugcccaccaauaagcauuuuauccggcuggcugaaauggagcagacgguggccgaacaggaugacagccucucuucccugcuggucaaacucaagaaaguuagccaagaucuugagcgccagagagagauuacagaacugaaggugaaggaguucgaaaacaucaaacugcagcuccaagagaaucacgaggacgaagugaagaaagucaaggcggagguggaagaucugaaauaucuucuggaccagucucagaaggagucccagugucucaagagcgaacugcaagcucagaaagaggccaacucccgggcccccaccaccacaaugagaaaucugguugagcgccucaagucucagcuugcucugaaagaaaagcagcaaaaagcccugagccgggcgcuccuggagcuuagagcugaaaugaccgccgccgcugaggaacgcaucauuuccgccacaagccagaaggaggcucaucugaacgugcagcagaucgucgaccggcacacgagagagcucaagacccaaguggaagaucugaaugagaaccugcucaaacuuaaggaagcccugaaaacaucuaagaaucgggagaacucccugaccgacaaccucaaugaucugaacaaugaacuucagaaaaagcagaaggcguacaacaaaauucugcgcgagaaggaggaaaucgaccaggagaaugaugaacucaaaagacaaauuaagcggcugacaagcggccugcagggcaaaccucucaccgacaacaagcagucucuuaucgaggagcugcaacgcaaaguuaagaagcuggaaaaucagcucgaggggaaaguggaagaggucgaucugaagccgaugaaagaaaagaacgccaaagaggagcuuauuagaugggaagagggaaagaaguggcaggcuaaaaucgaaggcauccggaauaagcugaaagagaaggaaggggagguguuuacgcucaccaaacagcugaacacacugaaggaccucuucgccaaggcugauaaagagaagcuuacccugcaacgcaaacugaagacaaccggaaugacaguugaccaggugcucggcauuagagcccuggaaagcgagaaagaacuugaggaacugaagaagcggaaucucgaucuggagaacgacauccuguauaugcgcgcccaccaggcucuccccagagauuccgucguggaggaccugcaucuucagaaucgguaccugcaagaaaaacuccacgcgcuggagaagcaguuuucuaaagacaccuauagcaagccuuccauuucugggaucgaaagcgaugaccauugccagagagagcaggagcuucaaaaagaaaaccugaagcucuccagcgagaauauugaacugaaauuccagcuggagcaggccaacaaggaucucccccgccugaagaaccaagugcgggaccuuaaagaaaugugugaguuucugaagaaagagaaggcugaaguccagagaaaacucggccacguucgcggaucuggccgguccgggaagacgaucccugagcuggaaaagacaaucggacuuaugaaaaaggugguggagaaaguccagagagaaaaugagcagcugaagaaagccagcggcauucucaccuccgagaagauggccaacaucgaacaagagaaugaaaagcugaaagcugagcuggaaaagcucaaagcccaucuggggcaccagcuuucuaugcacuacgagagcaagaccaaaggaacagagaagauuaucgcggaaaacgagcgccugcggaaggaacucaaaaaggagaccgaugcugccgagaaacugagaauugccaagaauaaccuugaaauccugaaugagaaaaugacggugcagcucgaagagacaggcaagcgccugcaguucgcugaaucccgggggccccaacuggagggcgccgacucuaaaagcuggaaguccaucguugugaccagaauguaugagacaaagcucaaagaacuggagaccgauauugcgaagaaaaaccagagcaucacagaccuuaagcagcuggucaaagaagccaccgagcgcgaacagaaggugaauaaguacaacgaggaucucgagcaacagauuaaaauccugaagcauguuccggaaggagcugagacggaacagggccuuaaacgggagcugcaggugcucagacuggccaaucaccaacuggacaaggaaaaagcugagcucauucaucagaucgaggccaacaaggaucagucuggggcugaauccaccauuccugacgccgaccaacugaaggagaaaaucaaggaucuugaaacacagcugaaaaugagcgaccucgagaagcagcaccugaaagaggaaaucaagaagcuuaaaaaggagcuggaaaauuuugaucccucuuucuucgaggaaauugaggaccucaaauacaacuauaaggaggaagucaaaaagaauauccugcuggaggaaaaggugaaaaagcucuccgagcagcugggagucgaacuuaccagcccuguggcggccucugaggaguuugaagaugaggaagagagccccguuaacuucccuauuuacuga

SEQ ID NO: 67323 - RNA, 906 nt, Artificial Sequence
  derived and/or modified sequence opt5 from CEP41__Homo_sapiens__NP_001244087
augagccugagacggcacaucggcaaccccgaguaccucaugaagcgcauuccucagaauccgagauaucaacauaucaaaucccggcuggacaccgggaacucuaugacaaaguacacggaaaaacuugaggaaauuaagaaaaauuaucgcuacaagaaggaugagcuguucaaaagacucaaggugaccacauuugcccagcugaucauucaggucgcuagccuuuccgaccagacccuggaaguuacagccgaggagauccaacggcucgaagauaacgacucugcggcuagcgaucccgacgccgagaccacagcccgcaccaauggaaaaggcaacccuggggaacagucccccucuccugagcaguucaucaauaacgcuggagccggcgauagcuccagaagcacgcugcagucugugauuuccggggugggagagcuggaccucgauaagggccccgucaaaaaggcugaaccucacaccaaggacaaaccguaucccgauugcccuuuucugcuucuggacgugcgggaucgcgacagcuaccaacagugucauaucguuggcgccuauucuuaccccauugcgacacucuccagaaccaugaauccuuacagcaacgacauccuggaguauaagaaugcccacgggaaaauuaucauucuuuacgaugacgaugaacggcuggcuucucaggccgcuacaaccaugugcgagcgcggauucgaaaaccucuuuaugcuguccggcgggagacugaaucaggccaacagcuccggacgggagucuaaggugcccggcgcgcgcagcgcccaaaaucucccugggggaggcccggcuucccauagcaaccccagaucucuguccagcggccaccuucaggggaaaccuuggaaguga

SEQ ID NO: 67324 - RNA, 1395 nt, Artificial Sequence
  derived and/or modified sequence opt5 from CEP55__Homo_sapiens__NP_001120654
augagcuccagaucuaccaaggaccugaucaaaagcaaguggggcuccaaacccucuaacagcaaguccgagacaacgcucgaaaaacugaagggggagauugcccaccuuaagaccucuguggaugaaaucacaagcggaaaaggcaagcugaccgacaaagagcggcaucgccuccuggaaaagauuagaguccuugaggcugagaaagaaaagaaugccuaccagcugacagagaaggauaaagaaauccaacggcuccgcgaccagcugaaggcgagauauuccaccacagcucugcucgagcagcuggaggaaaccacgcgggagggggaacgcagagagcagguucuuaaagcccugagcgaagagaaggaugugcucaaacaacagcugucugccgcuaccucccggauugccgagcuugaaagcaagacaaacacccugcgccucucucagacaguggcuccuaauugcuucaacuccagcaucaauaacauccacgagauggaaauucagcugaaagacgcccuggagaagaaucaacaguggcucgucuacgaucagcagagagaaguguauguuaagggacugcuugcgaaaaucuuugagcuggagaagaaaaccgaaacggccgcucauucucucccgcaacagacaaagaaacccgaguccgaaggcuaccugcaggaggaaaagcaaaaguguuauaacgaccuucuggccagcgcuaaaaaggaucucgagguggagcggcagaccauuacacagcuguccuucgaacugucugaguuucgcagaaaauacgaagagacccagaaggagguccacaaucucaaccaacugcuuuauagccagcggcgcgccgacgugcagcaucuggaagaugacagacacaaaaccgagaagauccagaagcuccgggaagagaaugauauugcgagagggaaacuggaagaggagaagaaacgcuccgaagaacuucugagccaaguucaguuccucuacacaucucugcugaagcagcaggaggagcaaacgcggguggcccuccuggaacagcagaugcaggcuugcacccuugacuuugagaacgagaaacuggacagacaacacguccagcaucagcuccacgugauccugaaggaacugcgcaaggcccggaaucaaauuacacagcuugagucccucaaacagcugcaugaguucgcuaucaccgaaccucuggugacauuucagggagaaaccgagaacagagagaaggucgccgccagccccaaaucuccuacggcugcgcucaaugaaagccugguugagugucccaagugcaacauccaauacccugccacagaacaccgcgaucuucuggugcacguggaguauuguuccaaauga

SEQ ID NO: 67325 - RNA, 1476 nt, Artificial Sequence
  derived and/or modified sequence opt5 from CEP57__Homo_sapiens__NP_001230705
augcugaccagaaucgacaacagcuucgccgagcccucccggucuaauggcagcauggugcgccacuccucuagcccuuacgucguuuauccguccgauaagcccuuucucaacucugaccugagacggagcccuuccaaacccacacuugcuuacccugaaagcaauucucgcgccauuuucuccgcgcugaagaaccuccaggauaaaaucagacggcuggagcuugaacgcauucaagcugaggaaagcgugaagacgcugucuagagagaccaucgaguauaaaaaggugcucgacgaacagauucaggagcgggaaaauuccaagaacgaggagagcaaacauaaucaggaacugacaucucaacugcucgccgccgagaacaagugcaaucugcuugaaaaacagcuggaguacaugcgcaacaugaucaagcacgcugaaauggagagaaccuccguccucgagaaacaggugagccuggaacgggagcgccagcaugaucaaacacacguucagucccagcuugaaaagcuggaccuccuggagcaggaauauaauaagcugaccacaaugcaagcccucgcugagaaaaagaugcaggagcuggaagccaaacuucaugaggaagaacaggaaagaaagcggaugcaagcgaaagccgcugagcugcagaccgggcucgagacgaaccgccugaucuuugaagauaaggccacccccugugugccuaaugcuagacggauuaaaaagaagaaaucuaagccgcccgagaaaaagagcuccagaaacuacuucggagcccagccucacuaucgccuuugccugggcgacaugcccuuugucgcggggaaaagcacaucuccuucccacgccgugguugcuaaugugcagcucguccugcaucugaugaagcaacacagcaaggcccucuguaacgaucgggugaucaacucuauuccccuggcuaaacaggugagcuccagaggaggcaagucuaaaaagcugagcgucaccccgccuuccagcaaugggaucaacgaggagcuuucugagguucuccagacacugcaggacgaguucggacaaauguccuuugaucaucagcagcuugccaaacugauucaggaaagccccaccguggaacucaaggacaagcuggagugcgaacuggaggcccucgugggccgcauggaggcuaaagcgaaucaaaucacgaagguccggaaauaccaggcccagcuggaaaagcagaaacuugagaagcaaaagaaagaacugaaggcuaccaaaaagacacucgaugaggaaagaaacucuuccagccgcuccggcauuacagggaccaccaauaaaaaggacuucaugaaacugcggccuggagagaagagacgcaagaaccugcagcuucucaaagacaugcagucuauccaaaauagccugcaguccucuagccuguguugggauuacuga

SEQ ID NO: 67326 - RNA, 1488 nt, Artificial Sequence
  derived and/or modified sequence opt5 from CEP63__Homo_sapiens__NP_001035842
auggaggcccugcucgaaggcauccagaacagagggcacggaggcggguuccugaccagcugcgaggcugaacuucaagagcugaugaagcagauugacaucaugguggcccauaaaaaguccgaaugggagggacggacacacgcgcucgagacgugucugaaaauucgcgaacaggagcuuaagucucugagaagccagcucgaugucacccauaaagaaguuggcaugcugcaccaacagguggaggagcaugaaaagaucaagcaggagaugacaauggaauacaaacaggagcugaagaaacuccacgaagaacugugcauucuuaagcgguccuaugagaaacugcaaaagaagcagaugcgcgaauuuagagggaauaccaaaaaccaccgggaggaccgcucugaaaucgagagacucacagcuaagaucgaagaguuccggcagaaaagccuggauugggagaagcagcgccuuauuuaccaacaacagguguccucucuggaagcccagagaaaagcccucgcugagcagagcgaaaucauucaggcccagcuggucaaucggaagcaaaaacuggaguccguggaacucagcucucaguccgagauccagcaucugagcucuaaacuugagcgcgcuaacgacaccauuugugccaaugaacuggagaucgaaagacucacaaugcggguuaacgaucuggugggaaccuccaugacgguccuucaggagcaacagcagaaggaggaaaagcugcgcgagagcgaaaagcuccuggaggcgcugcaggaagagaaaagagagcucaaggccgcucugcaaucucaggaaaaucuuauucacgaggcccggauccagaaagaaaagcugcaggagaaggugaaagcuaccaacacacaacaugccguugaagcgaucucccucgagagcguguccgcuaccugcaagcagcugucucaggagcuuauggaaaaauaugaggaacugaagagaauggaggcccacaauaacgaauacaaagccgagauuaagaagcucaaagagcaaauccugcagggcgaacagagcuauuccagcgcucuggagggcaugaagauggaaauuucucaccucacacaggagcugcaucaacgcgacaucaccauugccuccacgaaagggagcucuagcgauauggagaagcggcuuagagccgaaaugcagaaagcugaggacaaggcggucgaacacaaggagauccuggaucagcucgaaucccugaaacuggagaaucgccaucuuucugagauggugaugaagcucgaacugggacugcacgaguguagccuccccguguccccucugggcagcaucgccacacgguuucuugaagaggaggagcugagaucucaucacauucucgagcgccuggacgcucacaucgaggaacugaaacgggaauccgagaagaccgucagacaguucacagcccuuaaauga

SEQ ID NO: 67327 - RNA, 2274 nt, Artificial Sequence
  derived and/or modified sequence opt5 from CEP68__Homo_sapiens__NP_055962
auggcccugggcgaggaaaaggcugaggccgaagcgagcgaggacaccaaagcucaguccuacgggagaggaucuugccgggaacgcgagcucgauauccccggcccuaugagcggggagcaaccgcccagacuggaagccgagggaggccuuauuuccccuguguggggagccgaagggauccccgcuccuacauguuggauuggcacggaccccggcgggccuucucgggcccaccagccgcaggcuagcgaugccaaccgcgagcccgucgcggagagauccgaaccugcccugucuggacugcccccugcuaccaugggcagcggggaccuccuucuguccggagagagccagguugaaaagacaaaacucucuuccagcgaggaguucccccaaacccugucucugccgcggacaaccacaaucugcuccggccaugaugccgacaccgaagaugacccuagccucgcugaucugccccaggcccuugaccugucucagcagccucacuccagcgggcucuccugucugucucaauggaaguccgugcuuucccccggaagcgcggcccagcccucuuccugcagcauuucugcuagcuccacgggcucuagccugcagggccaucaggagcgcgccgaaccuagagggggaucccucgcuaaagugagcagcucccuggagccggucgugccccaagaaccuagcucuguugugggccuggggccccggccucaguggagcccccagccggucuuuagcggaggcgaugccuccgggcucggacgcagacggcugucuuuccaagccgaguauugggcuugugugcuuccugacagccugcccccuucccccgaucgccacucuccucucuggaaucccaacaaggaauacgaggaccugcuugacuauaccuacccgcugagaccuggcccccagcuccccaagcaucuggauagccggguuccugcggacccggugcugcaggauuccggcgucgaccucgauagcuuuucugugucccccgccagcacacugaaaucuccuaccaaugugucccccaacugcccucccgcugaggccacagcccuuccuuucagcgggccccgcgaaccgucucugaagcaguggccuagcagagucccccaaaaacagggaggcauggggcucgcuuccuggagccagcuggccucuaccccucgggcgcccggauccagagacgcucgcugggagcggagagaaccggcccuucgcggcgccaaggaucggcugacgaucgggaaacaccucgacaugggcagcccucagcugagaacacgcgaucggggauggcccuccccuagacccgagcgcgaaaagcggaccucucaaagcgcuagacgccccacauguaccgagucccgguggaagucugaggaagagguugaaagcgacgaugaguaucuggcccucccugcuagacugacccagguguccucucuugugagcuaccugggcuccaucagcacacucgucacgcugccgaccggggacauuaaaggacagucuccccuggagguguccgacagcgauggcccugccucuuuucccuccucuucuucccagagccaacuuccucccggggcggcccuccagggauccggcgacccugaagggcagaauccgugcuuccugcggagcuuuguucgcgcucacgauucugccggcgagggaagccugggcuccucucaggcucucggggugagcuccggacugcuuaagacaagacccucucugccugcccggcucgacagauggcccuucagcgauccugacgucgaaggccaacugccccgcaaagggggagagcagggcaaggaaucccuggugcaguguguuaaaaccuuuugcugucaacuugaggagcucaucugcuggcuguauaacguggcggaugucacagaccaugggaccgccgcucggucuaaucugacgagccucaaguccagccugcagcuuuacagacaguucaaaaaggauauugacgaacaccagucucugacagaguccgugcuccaaaagggcgaaauccugcugcagugccuucucgagaacaccccgguccuggaagaugugcugggacgcauugccaaacagagcggcgagcucgagucucaugcugacagacuguacgauuccauccuugccagccuggacaugcucgccggguguacccugauuccugacaagaaacccauggcugcgauggaacaccccugcgagggaguuuga

SEQ ID NO: 67328 - RNA, 1944 nt, Artificial Sequence
  derived and/or modified sequence opt5 from CEP72__Homo_sapiens__NP_060610
auggccagagcuggcccccggcuggugcucagcgaggaagccguccgcgcgaaguccgggcugggaccucacagagaccuugcugagcugcagucucucagcaucccgggcaccuaccaagaaaagauuacacaucuggggcacucccuuaugucucugacgggacucaagagccuggaucugucccggaacucucucguuagccuggagggcauccaguaucuuaccgcccuggaaucccucaaucuguacuauaacugcauuagcucucuugccgagguguuccgccugcaugcucucacagagcugguggacgucgauuuuagacugaaucccgugguuaaaguggaaccugacuaccgccucuucgucgugcaucugcuucccaagcugcagcagcucgaugaccgcccuguuagagccuccgagcggaaagcuagccgccugcacuuugccucugaagauucccuugacagcaaggagucugugcccgcgucccugaaggaggggagaccucaccacccgcgggccaaauguaccgaagcucucgccaagcaaagccuggucauggaugcugacgaugaggccgugcugaaccucaucgcggaaugcgagugggaccugggacggcccccuggcuccacaucuuucagccagaaaggcagagaagccgauucccgggggagccaggagucucgccaucuucugagcccccagcucgugcaauaucaguguggagacuccggcaagcaggggagagagacccggagaucuagcugccgcggauguugccuggagaaaaugccuuggucccagcuuuguggcgaacugcccccgcucuacggggcugaaccugaggccucucgggcucccagaccucacacauauuuuacgccccaucccgacagcauggauaccgaagacuccgccagcucucaaaagcuggaucuguccggagagauggucccuggcccgcuccccgccccuggcaagugccgcaaacggagaaugcccguugggcgcuuccagaccuuuagcgaccaggagggacugggcuguccugaacggacacacgggucuuccgugcccaaggagagccuuuccagacaagauucuagcgaaucccgcaauggacggacccugucucagccggaggcuagcgaaacagaggagcagagaucccgcggcgugaccgacacgcgggaaccuagccccgggucucacuccgcgcucccuggcaaaaagacagcccugcaggcugcccugcuugagacccuccuggaucuggucgacagaagcuggggaggcugccggucucuccauuccaacgaagccuuccuggcucaagcccgccacauucuuagcucuguggaggaguuuacagcggcucaggauagcuccgccaugguuggggaagacgugggaagccuggcccucgagucuaaaucccugcagagcagacuggcugaacagcaacagcagcaugcccgggagauguccgaagucaccgcugagcuucaccauacccacaaggagcucgaugaccugagacagcaccuggacaaaucucucgaagagaauagccgccugaagucccuucugcucucuaugaagaaagaagugaaaagcgccgauacagcggccacgcugaaccugcaaaucgcuggccuucagaccuccguuaaacggcucuguggggagaucguggaacugaagcagcaucuggagcacuacgacaaaauucaggagcucacacaaaugcugcaggaaucucauagcucccuugucagcaccaaugagcaucugcuccaggaacugucucaagugagagcccagcaccgcgcugaggucgaacagaugcacugguccuaccaggagcugaagaagacaauggcccuuuucccccacagcucugcgucccauggaggcugccaagccugcuga

SEQ ID NO: 67329 - RNA, 1755 nt, Artificial Sequence
  derived and/or modified sequence opt5 from CEP76__Homo_sapiens__NP_001258918
augagccugcccccugagaaggccuccgaacucaaacagcugauccaccaacagcuuucuaagauggacgugcauggccggauuagagagauccuggcugaaaccauucgcgaggaacucgccccggaucagcagcaccugagcacagaggaccuuaucaaagcgcugagacggcgcgggauuaucgaugacgucaugaaggagcucaacuucguuacggauuccguggaacaagagcugcccucuagcccuaaacagcccaucugcuuugacagacaguccacccugaagaagucugauggaacacggauggcugacagcaccacaaugcucuccauuagcgauccuauccauauggugcugauuaaaaccgacaucuucggcgaaacaacccuugucgccucuuacuuucuggaguggcgcuccgugcucgggagcgagaauggaguuacgucucugaccguggaacuuaugggcgucgggacagaguccaaggugagcguuggcauucugaacaucaaacucgaaauguaucccccucugaaucagacccugucucaagagguggucaacacacagcucgcccuggaaagacagaagaccgcugagaaagagcggcuuuuccugguguacgccaagcagugguggcgcgaauaucuccaaauuagaccgucccacaauagccggcuggugaagaucuuugcucaggaugagaacggaaucaaucgccccgucuguuccuacguuaaaccucuuagagccggccggcugcucgacacgccccgccaggcggccagauucgugaacgugcugggguaugaacgggcuccugucauuggaggcgggggaaagcaagagcaguggugcacacugcucgccuuucuguguagaaauaaaggcgauugcgaagaccaugcuaaccuucuguguucucuccugcuuggguacggacuggaggccuucgugugcguuggcaccaaggcgaaaggcgugccccacgccugggucaugacaugugggaccgacggagcuaucaccuuuugggagagccucacaggccaccgcuauauucauaagccgacgaauccugaugaacccccuguggccgagcagcccaaaccccuguacccuuaccggaccaucgggugcguuuucaaccaccagauguuucugggaaauugucaaccguccgacgcuguggaaacaugcgucuucgaucucaacgacgagagcaaguggaagcccaugucugaagaggccauuaaauccgugugugccccuggcgcuaccacaagccugcccccuuuucccccgcuuugcgcgucuaccaucgaugccagcgucacguccaaugagaucgaaaugcagcugagacuccuggugucugagcaucgcaaggaccuggggcuuacaaccguuugggaagaucagcucagcuaucugcuguccccugcucucgccagcuacgaguucgagcggaccacaucuauuuccgccggaaacgaagaguuccaggacgcuaucagacgcgccgugcccgauggccacaccuuuaaaggcuucccuauucacuuugucuaucggaacgcgagacgcgcuuucgccacaugccugcggagccccuuuugugaagagaucauuugcuguagaggggaccaagugcgccuugccguucgggugagagucuucacguacccugaaucugcuugcgccguguggaucauguuugcuuguaaguaucgguccgugcuguga

SEQ ID NO: 67330 - RNA, 2106 nt, Artificial Sequence
  derived and/or modified sequence opt5 from CEP83__Homo_sapiens__NP_057206
augguggucagcaccuucacagacauggauacguuucccaacaauuucccuccgggcggggacuccggacugaccggcucucagagcgaguuucaaaagaugcucaucgaugaaagacugcggugcgagcaccauaaagccaacuaccagacacuuaaggcugaacacacccgccugcagaaugagcauguuaaacuccagaacgaacugaagcaccuuuucaaugagaaacaaacacagcaggagaagcugcagcuccugcuggaagaacucagaggggaacugguggagaagaccaaagaccuugaggaaaugaagcugcaaauucucacaccccagaaacuggagcuucugcgggcccagauccagcaagaacucgagaccccuaugcgcgaaagauuucggaaccuggaugaggagguggaaaaguaucgcgcggucuacaauaaacugagauaugagcauacguuccucaaguccgaauuugagcaccagaaggaagaguacgcucggauucuggacgagggaaaaaucaaguaugaaucugagauugcccgccuugaagaggauaaagaggagcugagaaaccagcuccugaauguggaccuuaccaaggauagcaaacggguugagcaacuggcccgcgaaaagguguaccucugucagaaacugaagggccuggaggcugaagucgccgagcucaaggcugagaaagaaaacuccgaggcccagguggaaaaugcgcagagaauccaaguucggcagcuggccgagaugcaggcuacagugcgcucucuugaagccgagaagcagagcgcuaaccugagagccgagcggcucgaaaaagagcugcaauccagcucugaacagaauaccuuccuuaucaacaagcugcacaaagcggagagagaaauuaauacacucuccagcaaggucaaggagcugaaacauucuaacaagcuggagaucaccgacauuaaacucgaaacggcccgcgcuaaguccgagcuggaacgggagagaaacaaaauccagagcgaacuugaugggcugcagucugacaaugagauucucaaggccgcuguggagcaccauaaggugcugcuggucgaaaaagaucgcgagcuuauccggaagguucaagccgccaaagaagagggauaucagaagcucguggugcugcaggacgagaaacuggaacucgagaacagacuggcugaccuugaaaagaugaaggucgagcacgauguguggcgccaguccgaaaaagaccaauacgaggagaagcugcgggcgagccagauggccgaagagauuacaagaaaagaacuccaguccguucgccugaagcugcaacagcagaucgugaccaucgagaaugcugaaaaagagaagaacgaaaauucugaucuuaaacagcaaauuagcucccuccagauccaggucacaagccuggcccagucugaaaacgaccugcucaauuccaaccaaaugcugaaggagaugguggaacggcuuaagcaggagugcagaaauuuucgcagccaggccgaaaaagcucagcuggaggccgagaagacccucgaagagaaacaaauucaguggcuggaagagaagcacaaacugcaugagcggaucaccgauagagaagagaaguacaaccaggcgaaggaaaaacuucaacgggcugccauugcccagaagaaacgcaagucucuccacgagaauaaacugaagagacugcaggaaaagguugaggugcucgaggcuaaaaaggaggagcuggaaacagagaaccagguccuuaaucggcaaaacgugcccuucgaagacuauacgagacugcagaaacgccucaaggauauccagcggagacauaaugaguuucgcagccugauccuggucccuaacaugcccccuaccgccuccauuaacccggugucuuuccagagcuccgcuaugguucccagcauggagcuuccuuuucccccucacaugcaagaggaacagcaucagagagaacucucucugcugcggaaacgccucgaggaacuggagacaacccagagaaagcaacuugaggaacugggcuccagcggcgaguga

SEQ ID NO: 67331 - RNA, 2418 nt, Artificial Sequence
  derived and/or modified sequence opt5 from CEP85L__Homo_sapiens__NP_001035940
auguggggcagauuccuggcccccgaggcuagcgggcgggacuccccuggaggcgcccgcucuuuuccggcggggcccgauuacagcuccgcuuggcucccugccaacgaaucucuguggcaggccaccacagugcccagcaaucacagaaacaaucauauccggcgccacuccauugcuucugacagcggagauacgggcaucgggaccuccugcagcgacucugucgaggaucauuccacaagcucuggaacccuuuccuucaagccuagccaaucucugauuacacuccccaccgcccacguuaugccuuccaacagcuccgcuucuaucagcaaacugagagaaucccuuacaccggacggcagcaaguggucuaccucccugaugcagacgcucggcaaucauagccggggcgagcaggauucuagccuggacaugaaagauuuucgcccccugagaaagugguccucucucagcaaacugaccgccccugacaacuguggacagggcgggacagugugccgggaagagucccgcaauggacuugagaagauuggcaaggcgaaagcccugaccagccaacucagaacaaucgggcccucuugucugcacgauuccauggaaaugcuucggcuggaggacaaggaaaucaacaaaaagcgcagcucuacccucgauugcaaauauaaguucgaguccuguagcaaggaggacuuuagagcuuccucuagcacgcugcggcgccagccuguggacaugacauacuccgcccugcccgaaucuaaaccgauuaugaccagcuccgaggcuuucgaaccucccaaguaucucaugcugggacagcaggccgucggcggcgugccuauccaacccagcguuagaacacagauguggcuuaccgagcagcugcggaccaauccccucgaagggagaaacacagaggauucuuacucccuggcgccuuggcagcaacagcagauugaggacuuucgccaaggaagcgaaacgccgaugcaagugcuuaccgggucuucccggcagagcuauucucccggguaccaggauuucagcaaaugggaguccaugcugaagaucaaagaaggacuccugagacagaaggagauugucaucgaccgccagaaacagcagauuacacaucugcacgaacggaucagagauaaugagcuccgcgcccaacacgcuaugcugggccauuaugugaacugcgaggacagcuacguugccucucuucagccucaguacgaaaauaccucccugcagacacccuuuagcgaggaauccgugucucacagccaacagggggaguucgaacagaagcucgcuuccaccgagaaggagguccugcagcuuaacgaauuucugaaacaacggcucucucuguucagcgaggaaaagaaaaagcuggaggagaaacucaagacgagagaucgcuauaucuccucucugaagaaaaagugucagaaagaaagcgagcagaauaaggaaaaacaacggagaauugagacacuugaaaaguaccuggccgaccucccuacccuggaugacgugcagucccagagccugcagcuucaaauccucgaggagaagaacaaaaaccugcaggaagcccugauugauaccgagaagaaacucgaagagaucaagaaacagugccaggacaaggaaacacaacugauuugucagaagaaaaaggagaaagagcuugugaccacaguccagucucugcagcaaaagguugaacgcugccucgaggacggaauccggcugcccaugcuggaugcuaaacagcuucagaaugaaaacgacaaucucagacaacagaacgagacggcguccaagaucauugauagccagcaggacgaaaucgaucggaugauucuggagauccaaucuaugcagggcaaacuguccaaggagaagcucaccacacagaaaaugauggaggaacuggaaaagaaagagcgcaaugugcagagacuuaccaaggcccugcucgagaaccaacggcagacagacgaaaccuguagccugcuggaucagggccaggagccggaccaaucuagacagcagacggugcuuuccaaacgcccucucuuugaucugaccgucauugaccagcuguucaaggaaaugagcugcugccucuucgaucugaaggcucuuuguuccauccugaaucaacgggcccaggggaaagagcccaaccucagccugcugcuuggaaucagaucuaugaauugcagcgccgaagagacagagaacgaccacuccaccgaaacacucaccaagaaacugucugaugugugucagcugcgcagagacauugacgagcuccggacgacaaucagcgaucgcuaugcucaagacaugggcgauaauugcauuacccaguga

SEQ ID NO: 67332 - RNA, 2352 nt, Artificial Sequence
  derived and/or modified sequence opt5 from CEP89__Homo_sapiens__NP_116205
augcugcucggcuucagacgggggcgcagaagccacuuuaagcauaucauucacggacugcuucccgccgcuuccguggcccccaaagcggcugucccgcggacacccccuccccgcucuccuaaccccagcccugagagaccgcgguccgcccuggccgcugccauccucgcuaccacgcugaccggccgcacaguugccauuccccagccuagacaacggucucgcagcgaauccgacgugucuagcguggagcaggauuccuucaucgaacccuacgcgaccacaagccagcuuagaccucggcccaauuggcagucugagauggggcgcagauccagccugccgucuuuugaaacccucgacuauggagaugaggaggacauugaaacacaacuguccagcucuggcaaggagcugggggaugucuccgcccgggaagaccgcggaggccauagcgaugaccucuacgcugugccucacagaaaccagguuccccugcuucaugaggucaauuccgaggaugacgaaaacaucucucaccaggauggcuucccugggagcccucccgcuccccagcggacccaacagaaagacggaaagcacccggugcugaaucucaaagaugagaagcccccucugugcgaaaagcccccucccuccccggacaucacgggcagagcccgccagcgguauaccgagauuacaagagaaaaauuugaggcccuuaaggaggaaaacauggaccugaauaacaugaaucagagccucacccuggagcugaacacaaugaaacaagcgaugaaggaacuccagcugaaacuuaaggggauggagaaggaaaaacgcaagcugaaagaggccgagaaggcuucuucccaggaaguggccgcuccugagcuccuguaccuucggaaacaagcccaggaacugguugaugagaaugacggacucaagaugaccgugcauagacugaacgucgaacugagccgcuaucagacgaaauuccggcaccucucuaaggaggagagccugaauaucgaaggccuucccuccaaggggccuauucccccuuggcugcucgauaucaaauaccugucuccccuucugcucgccuaugaggacaugaugaaggaaaaagaugagcugaacgcuacacugaaggaggaaaugagaauguuucgcaugcgggugcaggagguggucaaagaaaaugaggaacuccaucaagagcugaacaagagcuccgcgguuaccagcgaggaauggagacagcuucagacacaggccaagcuggugcucgaggaaaacaaacugcugcuugagcaacucgaaauucagcagcgcaaggcuaaagacucucaccaggagcggcugcaagagguguccaagcugaccaaacagcucaugcugcuugaagccaagacccacggacaggagaaggaacuggccgagaauagagaacagcucgagauccugcgggcuaaaugucaagagcugaagacacauagcgauggcaaaauugccgucgaagugcacaagucuaucguuaacgagcuuaaaucccagcuccagaaggaagaggagaaggaacgcgcggagauggaggaacugauggaaaaacugacggugcuccaagcucagaagaaaagccugcuucuggagaaaaauucccucaccgagcagaacaaggcccuggaagccgagcuggaaagagcucagaagaucaaucggaaaucucaaaagaagauugagguccuuaaaaagcaaguggaaaaagccaugggcaacgagaugagcgcucaucaguaccucgccaaucugguugggcuggcggagaacaucacacaggaaagagacucccucaugugccuggccaagugucuugagucugaaaaagauggagugcugaauaaggucauuaagagcaacauccgccucggcaaacuggaggaaaaggugaaaggguacaagaaacaggcugcccugaaacuuggagacauuucccaccggcuccuggagcagcaggaggauuucgcuggcaagaccgcccaguauagacaagaaaugcgccaucugcaccagguccucaaggacaagcaggaggugcuggaccaagcgcuucagcagaauagagaaauggagggggagcuggaaguuaucugggagagcacauuucgggaaaaccgcagaauccgggagcuccugcaggauacccugacgcgcacaggagugcaagacaauccgagagcccuugucgcuccuucucugaacggcgugucccaggccgaucuccuggacggcugcgauguuuguagcuacgaccucaaaucucacgcuccuaccugcuga

SEQ ID NO: 67333 - RNA, 804 nt, Artificial Sequence
  derived and/or modified sequence opt5 from CER1__Homo_sapiens__NP_005445
augcaucugcuccuguuccagcuucuggugcuccugccccuuggcaagaccacaagacaccaagacgggcggcagaaccagagcucccugucuccuguccuccugccgcgcaaucagagagagcugcccacgggaaaccacgaagaggccgaagagaaaccugaucucuuuguugcugugccccaucugguggccaccagcccugcgggcgaagggcaacggcagcgcgagaagaugcuuuccagauucggacgguuuuggaaaaagcccgagcgcgaaaugcacccuucuagagacagcgauuccgagccguuucccccuggcacacagucucugauccagcccauugacgggaugaaaauggaaaagagcccucuccgggaggaggcuaagaaauucuggcaucacuucauguuucgcaagacccccgccucccaaggagucauccugccgauuaaaagccacgaagugcauugggagacaugcagaaccguuccuuucucucagacaaucacccacgaaggcugugagaagguggucgugcagaauaaccuuugcuuuggcaaauguggguccguucauuuccccggagccgcucagcacagccacacgucuugcucccauugucugccugccaaguuuaccacaaugcaccucccccugaauugcaccgaacugagcucugugauuaaggucgugaugcucguggaggagugucaaugcaaagucaagacagaacaugaggauggccacauccugcaugcugggucccaggacagcuucauccccggaguuuccgccuga

SEQ ID NO: 67334 - RNA, 1614 nt, Artificial Sequence
  derived and/or modified sequence opt5 from CERK__Homo_sapiens__NP_073603
augggcgccaccggggcugccgagccccugcagagcgugcucugggucaagcaacagagaugcgcgguuucccuggaaccugcucgggcccuucugcgcugguggagaucuccgggacccggcgccggggcuccuggagccgacgcuuguagcgugcccguguccgagaucauugccgucgaagagacagaugugcacggcaaacaucaggggucuggaaaguggcagaaaauggaaaagccuuacgcguucacgguucacugcgugaaacgggcccgcagacaucgguggaagugggcucaagucaccuuuuggugucccgaggagcagcucugccaccuguggcuucagacacugcgcgaaaugcucgagaagcugaccagcagaccuaaacaucugcucguguucaucaacccguuuggcggcaaggggcagggaaaacggauuuaugaacgcaagguugcuccccuguucacacuugccuccaucaccacagacauuaucgugaccgagcacgccaaucaagcgaaagagacgcuguacgaaaucaacauugauaaguaugacggcaucgucugugucgggggagauggcauguuuucugaggugcuccacgggcugauuggaagaacccagcggagcgccggcguggaccagaaucauccucgcgcuguucuugugcccuccagccugagaaucggcauuaucccugccgggucuacagauugcguguguuacuccaccgucggaacaagcgacgcugaaaccucugcccuccacauugugguuggcgauucccuggccauggacgugagcucuguccaucacaacuccacgcugcuccgguauagcgugucccugcuuggguacggauucuauggcgauaucaucaaggacucugagaaaaagcgcuggcuggggcucgcuagauacgauuuuagcggacugaaaacauuccuuucccaccauugcuacgaaggcaccguuagcuuucugcccgcgcagcacacagugggcucuccgcgggacagaaagccuugucgcgccgggugcuucgucugucggcaauccaaacagcagcucgaggaggaacaaaagaaagcucuguauggacuggaggccgccgaagacguggaggaauggcaggucgugugcggcaaguuucucgcuauuaaugccaccaacaugagcugcgcguguagacgcucuccccgggggcugagcccugcugcccaucuuggagauggcuccucugaccugauccucauuagaaagugcagccgcuucaauuuucugcgguuccuuaucagacacaccaaccagcaggaucaauucgacuuuacauucguugagguguaccgcgucaaaaaguuucaguucacguccaaacauauggaggaugaagacagcgaucugaaggaagggggcaaaaagcgguuuggacacauuuguucuucccaccccagcugcuguugcaccgugucuaauuccagcuggaacugugacggcgagguucuccauucccccgccaucgaggugagaguccacugccagcuggugcgccuguucgcucgggggaucgaagagaauccuaagccggauucucauagcuga

SEQ ID NO: 67335 - RNA, 1677 nt, Artificial Sequence
  derived and/or modified sequence opt5 from CERKL__Homo_sapiens__NP_001025482
augcccuggagacggcgcagaaaccgggugagcgcccuggagggcgggcgcgaagaggaagcuccuccggaggccgcggcugugcccccugcccuccugaccucuccccagcaaacagaagccgcugccgagagaauccuucugcggggaauuuucgagaucggccgcgacuccugcgauguugugcucagcgaaagagcucugcgguggcgcccuauucagcccgagagaccugccggggacuccaaguacgaucuucuguguaaagaagaguuuaucgagcucaaggacauuuucucugugaaacugaagcggcgcugcagcgucaaacagcagagauccggaacgcugcucggcaucacccuguuuaucugucuuaagaaggaacaaaauaaacugaagaacucuacacucgaucugauuaaucuuagcgaggaccacugcgauaucugguuccggcaguuuaaaaagauucuggcgggguucccgaaccgccccaaaucccucaagauccugcugaauccucagagccauaagaaagaagccacccagguguauuacgagaagguugaaccccuccugaaacuugcuggaauuaagacagacgugaccaucauggaguaugagggccacgcccugucucuccugaaagaaugugagcuucaaggcuuugaugggggacauagaaagccucuguucgcuauucacugguccguccagcggcucuuuacaggcaugcagacccuggaacccagcgugguuugcgucgggggagacggcucugccuccgaggucgcgcaugcccugcuccugagagcucagaaaaacgccgggauggaaacggaucgcauccuuaccccggugcgggcucaacugccucucggacugauccccgccggcagcacaaaugugcuugcccacucucugcacggcgucccucauguuauuaccgcuacacuccacaucauuauggggcaugugcagcugguggacgucuguaccuucuccacggcgggaaagcugcucagauuuggcuucagcgccauguuuggguucggaggccgcacacuggcucuugccgagaaguaccgguggaugucccccaaccagagacgcgauuucgccgugguuaaagcucuggccaagcucaaagcggaggacugcgaaaucucuuuucugcccuucaauagcuccgacgaugugcaagagcggagagcucaggggagcccuaagucugacuguaacgaucaguggcagaugauucaaggacaguuucugaaugucuccaucauggccaucccgugccuuuguagcguggcuccccgcggccucgccccuaacacccggcugaauaacggcucuauggcccugauuaucgcuagaaauacaagccgccccgaguucauuaaacaccucaagcgguaugccuccguuaagaaccaguuuaacuucccuuuuguggaaaccuacaccgucgaagaggugaaaguccaccccagaaauaacacagggggauauaauccggaggaagaggaagacgagacggcgucugagaacugcuucccuuggaauguggauggcgaccugauggaaguugccagcgaggugcauauccggcuucacccccgccugauuucccucuacgggggaagcauggaagagaugaucccuaaguga

SEQ ID NO: 67336 - RNA, 720 nt, Artificial Sequence
  derived and/or modified sequence opt5 from CERS1__Homo_sapiens__NP_001277194
augcccgagagcgccuggaaguuccuguuuuaccucggcuccuggucuuauagcgcuuaccugcuuuucgggaccgacuauccuuucuuccacgauccgcccuccguguuuuacgacuggacaccuggaauggccguccccagagauaucgcggcugccuaucugcuccagggcucuuucuacgggcauagcauuuaugccacgcuguacauggacaccuggcggaaagauuccguugugaugcuucugcaccauguggucacacucauccugauugugucuagcuacgcuuuucgcuaucacaacguuggaauccuggugcucuuucugcaugacauuuccgauguccaacuugaauuuaccaagcugaauaucuacuucaaaagcagaggcgggucuuaucaccggcuccacgcccuggcugccgaccuuggaugccuguccuuuggcuucagcugguuuugguuccgccucuacugguucccucugaaggugcuguaugcgacaucucauuguucccucagaaccguucccgauaucccuuuuuacuucuuuuucaacgcccugcuucugcuccugacacuuaugaaucuguauugguuucucuacauuguggcuuucgccgcuaaaguccugaccggccaggugcacgagcugaaggaccuccgggaauacgauacggccgaggcgcagagccugaagccgucuaaagccgaauga

SEQ ID NO: 67337 - RNA, 1203 nt, Artificial Sequence
  derived and/or modified sequence opt5 from CERS2__Homo_sapiens__XP_011507753
auggugccccuggcccuccacuucccuggcgaggucgggcugcaggaaaccgcuguuagaaugcuucaaacacuguacgacuauuuuuggugggagcggcucuggcugccggugaaccuuacgugggccgaucuggaagaccgcgauggaagaguguacgcgaaggcuagcgaccucuauaucacccugccccuggcccuccuguuccuuauuguccgguacuuuuucgagcuguauguggccacaccucucgcugcccugcuuaauaucaaagaaaagacccgccugagagcucccccuaacgccacacucgagcauuuuuaccugaccuccggcaaacagcccaagcagguugagguggaacugcucucucggcagagcgggcuguccggacgccaagucgagagaugguuccggcgcagacggaaucaggaucgcccuucucuucugaaaaaguuuagagaagcgagcuggcgguucacauuuuaucucauugccuucaucgcuggcauggccgugauuguugacaagccgugguuuuacgauaugaaaaaggugugggagggguaccccauccaguccaccaucccuucucaguauugguacuauaugauugagcugagcuucuacuggucccuucuguuuagcaucgcuucugacgucaaacgcaaggauuucaaagaacaaauuauccaccauguggccacgauuauccucauuuccuucagcugguuugcgaacuauaucagagccggaacccugaucauggcucugcacgacucuuccgauuaccuccuggagagcgccaagauguucaauuaugcuggcuggaagaacacaugcaauaacauuuuuaucguguucgccauugucuuuaucauuacccggcuuguuauccugcccuucuggauccuccauuguacacugguguacccucuugaacuguaccccgccuuuuucggcuauuacuuuuucaauucuaugaugggggugcuccagcugcugcacaucuuuugggcuuaucucauucugagaauggcgcacaaauucauuaccggaaaacuugucgaggacgaacgcuccgaucgggaggagacggaaagcuccgagggcgaagaggccgcugccgggggaggcgccaagucuagaccgcuggcuaacgggcauccuauccucaauaacaaucaccgcaagaacgacuga

SEQ ID NO: 67338 - RNA, 1185 nt, Artificial Sequence
  derived and/or modified sequence opt5 from CERS3__Homo_sapiens__NP_001277270
augcugcacaccacagccagacgggcugcccgcauguucuggacguuuaaggagugguucuggcucgaaagauuuuggcugcccccuaccaucaaauggagcgaccuugaggaucaugacggccugguguucgucaagccgucccaccucuacguuacaauucccuaugcguuucugcuucugaucauucggcgcguguucgaaaaauuuguggcuucuccucucgccaagagcuucgggaucaaagagaccgucagaaaggugacacccaacaccguucuggaaaauuucuucaagcauuccacacggcagccucugcaaaccgauauuuacggacucgccaaaaagugcaaccugacggagcgccagguggagagaugguuucggucucgcagaaaucaggaacggcccagccgccuuaaaaaguuccaggaggcuuguuggagauuugccuucuaucugaugaucaccgucgcuggcaucgccuuccucuacgacaaaccuuggcuguaugaucuuugggaaguguggaacggguacccgaagcaaccccugcucccuucccaguauugguacuacauucuggagaugucuuuuuauuggagccugcucuuucggcugggauuugacguuaagcgcaaagauuuccuugcgcacaucauucaucaccuggccgcuaucucccucaugagcuuuucuuggugcgccaauuacauuagauccggcacacuggugaugaucguccacgacguggcugauauuuggcuugagagcgccaagauguucucuuaugcgggguggacccagacauguaacacccuguuuuucaucuuuuccacgaucuucuuuauuagccggcucaucguguuccccuuuuggauucuguacugcacacugauccucccuauguaucaucuggaacccuucuucucuuacauuuuucuuaaucugcagcucaugauccugcaaguccuucaccuguauuggggauacuacauccucaaaaugcugaacagauguauuuucaugaaguccauccaggacguucgcagcgaugacgaggauuaugaagaggaagaggaggaagaggaagaggaagccaccaaaggcaaggagauggacugccugaaaaauggccuccgggcugagagacaucugauuccgaacgggcagcacggacacuga

SEQ ID NO: 67339 - RNA, 1185 nt, Artificial Sequence
  derived and/or modified sequence opt5 from CERS4__Homo_sapiens__NP_078828
augcugagcuccuucaacgagugguuuuggcaggacagauucuggcugcccccuaaugugaccuggacagaacucgaggaucgggacggccgcgucuacccgcacccccaagaucuucuggccgcucucccucuggcccuuguucugcucgcgaugagacuggcuuuugaacgguucaucgggcugccccucucucgcuggcugggagugagagaccagacgcggcgccaggugaagccuaacgccacccuugagaaacauuuucugacagaaggccacagacccaaggagccucagcucagccugcuugccgcucaaugcgggcugacccuccagcagacacagcggugguuccgcagacggcgcaaucaagauagaccgcagcugaccaaaaaguuuugugaggccuccuggcgguuccuguuuuaucucucuagcuucgucggaggccuguccgugcuuuaccaugaaucuuggcugugggcucccguuaugugcugggaccgcuauccuaaccagacacucaaacccagccuguacuggugguaucuucuggagcucggguuuuaccugucccugcucauuagacugccuuucgaugugaagcggaaggacuuuaaagaacaggucauccaccauuucguggccguuauucuuaugaccuucagcuauucugcgaaucugcucagaaucggaucccuggugcuucugcuccacgauagcucugacuaccugcuggaggccuguaagauggucaacuacaugcaauaucagcagguuugcgaugcucucuuucugauuuucuccuuuguguucuuuuacacgcgccuuguccuguuccccacccaaauccucuauacaaccuacuaugagagcaucucuaaucggggcccguuuuucggcuacuacuuuuucaacgggcugcugaugcuucuccagcugcugcacguguuuugguccugucucauucugagaaugcuuuauagcuucaugaaaaagggacagauggaaaaagacauccgcuccgauguggaggaaucugacagcuccgaggaagccgcugccgcgcaggagccucugcaacucaagaauggcgccgcugggggaccccggccugcccccacagacggccccagaagccgcguggcugggcggcugaccaacagacauacgacagccaccuga

SEQ ID NO: 67340 - RNA, 1179 nt, Artificial Sequence
  derived and/or modified sequence opt5 from CERS6__Homo_sapiens__NP_001243055
auggccggcauccuggcuugguucuggaacgagagauuuuggcucccccacaaugugaccugggccgaccugaagaacacagaagaggcgacguucccucaggcugaagaucuuuaccuggccuuuccgcucgccuucugcauuuuuaugguccggcugaucuucgagcgcuuuguugcuaaacccugugccauugcucuuaauauccaagccaacgggccucagauugcgcccccuaaugccauccuggaaaagguguucaccgcuaucacaaaacaucccgacgagaagagacucgagggacugagcaaacagcuggauugggacgugcgguccauucagcgcugguuuagacaacggcgcaaccaggaaaagccuucuacccucacaagauucugcgagagcauguggcgguuuuccuucuaucuguacgucuuuaccuauggcgugcgcuuccuuaagaaaacaccguggcuguggaauaccagacacuguugguacaacuaucccuaccagccucucacgaccgaucugcauuauuacuacauccuugaacugucuuucuauuggagccucauguuuucccaguucacagacauuaagcggaaagauuuugggaucauguuccugcaccaucugguuucuauuuuucucaucaccuucagcuacgugaauaacauggcccgcgucggaacacuggugcuuugccugcacgacuccgcugaugcccuccuggaggcggccaagauggcuaauuaugccaaauuucaaaagaugugugaccuucuguucguuauguuugcuguggucuucauuaccacgagacucggcaucuuuccccugugggugcugaacacaacccucuucgagagcugggaaaucguggggccuuaccccucuuggugggucuuuaaucugcuucugcuccugguucagggacuuaacugcuucugguccuaucugauugugaagaucgccuguaaagccgugagccggggcaaggcuggcaaauggaauccgcuccacgucucuaaggaugaccgcuccgauauugagucuagcuccgacgaagaggacagcgaaccucccgggaaaaacccucauacagcgaccaccacaaacggaacguccggcaccaauggguaccugcugacaggaucuugcagcauggaugacuga

SEQ ID NO: 67341 - RNA, 1704 nt, Artificial Sequence
  derived and/or modified sequence opt5 from CES1__Homo_sapiens__NP_001020365
auguggcugagagccuucauccucgcuacccugagcgccuccgcggcuuggggccaccccucuagcccuccgguggucgacacaguucaugggaaggugcuuggaaaauuugugucccuggagggcuucgcccagcccgucgccauuuuucucgggaucccuuucgcuaagcccccucugggaccccuucgguuuacgccuccgcaacccgccgaaccuuggucuuucgugaaaaacgcuaccagcuaucccccuaugugcacacaggaucccaaggccggccagcugcucuccgagcuguuuaccaaucgcaaagaaaacauuccgcugaagcucucugaggacugucuguaccuuaauaucuacacacccgcggaucugaccaagaaaaacagacuccccguuaugguguggauucacgggggaggccugauggucggcgccgcuagcacauaugacgggcuugcccuggcugcccaugaaaaugugguuguggucaccauccaguaccggcucggaaucuggggcuucuuuuccacgggggaugagcacagccgcggaaacuggggccaucuggaccaaguggcggcccugagaugggugcaggauaauauugcuucuuucgggggaaacccuggcuccgucaccaucuuuggcgagagcgccgggggagaaucuguuuccgugcucgugcugagcccccuugcuaagaaucuguuccaccgggccauuucugaguccggcgucgcccucacaagcgugcugguuaaaaagggggacgugaaaccccuugcugaacagaucgcgauuaccgccggaugcaagacaaccacguccgcugucauggugcacugucugcgccagaagacagaggaggaacuccuggagaccacacugaaaaugaaguuucucucucuggaucuucaaggcgacccuagagaaagccagccgcugcucgggaccguuaucgauggaaugcugcuucugaaaacccccgaggaacuccaggccgagcggaacuuccauacagugccuuauauggucggcauuaauaagcaggaguucggcuggcugauccccaugcaacugauguccuacccucucagcgaagggcagcuggaccagaaaacggccaugucucuucuguggaaguccuauccccucgugugcaucgcuaaagagcugauuccggaagccaccgagaaguaccugggaggcacagaugacaccgucaagaaaaaggaccuuuuucucgaucugaucgcggacgugauguucgggguuccuagcgugauugucgcucgcaaccacagagaugccggagcccccacauacauguaugaauuucaauaccggccuucuuucagcuccgacaugaaacccaagaccgugaucggcgaucauggggacgagcuguuuucuguuuucggcgcuccuuuucucaaagagggagccagcgaagaggaaauucgccuguccaagauggugaugaaguucugggcuaauuuugccagaaacggcaaucccaacggggagggacuuccgcacuggccugaauauaaccagaaagagggcuaccugcagaucggggcgaauacgcaggccgcucaaaagcucaaagauaaggaggucgccuucuggacaaaccuguuugcuaaaaaggccguggaaaagccuccccagaccgagcacaucgaacuguga

SEQ ID NO: 67342 - RNA, 1872 nt, Artificial Sequence
  derived and/or modified sequence opt5 from CES2__Homo_sapiens__NP_003860
augaccgcccagagcagaucccccacaacgccuaccuucccgggccccucucaacggacaccucugacccccugcccugugcagacaccccgccucgggaaggcucugauccacuguuggaccgacccuggacagccgcuuggcgagcagcaaagaguccggcgccagagaacagaaaccagcgagcccacgaugcggcugcaucgccucagagcccggcuguccgcgguugcuugcgggcuucugcuccugcuggugcgcggacagggccaggauucugccagcccuauuagaaccacacacaccgggcaagugcucggaucccugguccaugugaaaggcgccaacgcuggcguucagacauuucuugggauccccuucgccaagccuccccugggaccgcuccgguuugcuccucccgaaccucccgagucuuggagcggcgugcgcgacgggaccacgcaccccgccaugugucugcaggaucuuacagcggucgaauccgaguuccugagccaguuuaauaugaccuucccuucugacuccaugagcgaggauugccucuaccugucuauuuauacaccggcccauucccacgaaggaagcaaccugcccgugaugguuuggauccacggcggggcucucguguuuggaauggccucucuguacgacggcuccaugcuugcugcccuggagaaugucgugguggucauuauccaauauagacucggcguucugggguucuuuagcaccggagauaaacaugcgaccggcaacuggggguaccuugaccagguggccgcucugcggugggugcagcaaaauaucgcccacuucggaggcaacccugaucgcgucacaauuuuuggggaauccgcuggaggcacgucugugagcucccucguugugagccccaucucucagggccuguuccauggggccauuauggaguccggagucgcccugcucccuggccugaucgcuagcucugcggacgugauuagcaccguuguggccaaucuuuccgcuugugaucaggucgacucugaggcccugguggggugccucagaggaaagagcaaagaagagauccuggccauuaacaagcccuuuaagaugaucccgggcgucguggaugggguuuuccuuccucggcacccccaggaacugcucgcuuccgccgacuuccaaccugugcccagcaucgucggcgugaauaacaaugaguuuggauggcugauuccuaaaguuaugagaaucuaugacacacagaaggaaauggaucgcgaggcgucucaggcugcccugcagaaaaugcucacccugcuuaugcugcccccgacauucggcgaccuccugcgggaggaauacauuggggauaacggagacccucaaacccugcaggcccaguuucaggagaugauggcugauuccauguucgugauccccgcccuucaagucgcucacuuucaguguagcagagcccccguguauuucuacgaauuucagcaucagccuucuuggcucaagaauauucgcccgccccacaugaaagcggaccauggcgaugagcugccuuucguguuucgguccuucuuugggggaaacuacaucaaguucacggaagaggaggaacaacugagcagaaagaugaugaaauauugggccaauuuugcucgcaacggcaaccccaauggggagggccucccucacuggccccuguucgaccaggaagaacaguaccuucaacugaaccuccagccugccguuggacgggcucugaaggcccauagacugcaguucuggaaaaaggcgcuuccccagaaaauccaagaacucgaggagccggaggagcgccacacagaacuguga

SEQ ID NO: 67343 - RNA, 633 nt, Artificial Sequence
  derived and/or modified sequence opt5 from CES3__Homo_sapiens__NP_001172105
auggagcagaugagcagagaagacaugcuggccaucuccacccccgugcucacaucucuggaugucccuccggagaugaugcccacgguuauugacgaauaccuuggcagcaacuccgaugcucaagccaagugccaggcguuccaggaguuuaugggggacguguucaucaaugugccuaccgucucuuuuagccgguaucugcgcgauuccggaucucccguguucuuuuacgaguuccagcacagaccuagcuccuuugcuaaaauuaagcccgccuggguuaaagccgaccauggcgcugaaggggccuucguguuuggaggcccuuuccucauggaugagagcucucggcuggcuuuuccggaagccacagaggaagagaagcaacuuucccugaccaugauggcgcaguggacacacuucgcccgcaccggggaccccaacagcaaagcucucccucccuggccucaguuuaaucaggccgagcaauaucuggaaaucaaccccgucccgagagcuggacagaaguuccgggaggccuggaugcaguucuggucugaaacacugccuuccaagauucagcaauggcaucagaaacagaagaaucgcaaagcgcaagaggaucucuga

SEQ ID NO: 67344 - RNA, 519 nt, Artificial Sequence
  derived and/or modified sequence opt5 from CETN1__Homo_sapiens__NP_004057
auggccagcggcuucaagaaacccuccgcugccucuaccgggcagaagagaaaaguggcgccuaagccggagcugacagaagaccaaaaacaggagguccgggaggcuuuugaucucuucgacguugauggaagcggcacgaucgacgccaaggaacugaagguggccaugcgcgcucuuggguuugaacccagaaaagaggagaugaagaaaaugauuuccgaaguggaucgggagggaaccggcaagaucucuuucaacgacuuucuggccgucaugacacagaaaaugagcgaaaaggauaccaaggaggagauucucaaggcuuuccgccuguuugacgaugacgaaacagggaaaaucuccuucaaaaaucuuaagagaguggccaacgagcugggagaaaaucucaccgaugaggaacugcaggagaugauugacgaggcggaucgggacggcgacggcgaaguuaacgaggaagaguuucugcgcaucaugaaaaagacaucucucuacuga

SEQ ID NO: 67345 - RNA, 519 nt, Artificial Sequence
  derived and/or modified sequence opt5 from CETN2__Homo_sapiens__NP_004335
auggccagcaacuucaagaaagcuaauauggccuccucuagccagagaaagcggaugucccccaaaccugagcugaccgaagaacaaaagcaggaaauccgcgaggcguuugaccucuucgaugcugacggcacagggacgauugaugugaaagaacugaaggucgccaugagagcccuuggauuugagccgaagaaagaggaaaucaagaaaaugauuucugagaucgacaaggaaggcaccgggaaaaugaacuucggagauuuucugacaguuaugacccagaagaugagcgagaaggacacaaaagaggaaauucucaaggcuuucaaacuguuugaugacgaugagaccggcaagaucuccuucaaaaaucuuaagcggguggccaaagaacugggggagaaccucacagacgaggagcugcaggagaugaucgaugaagcugaccgcgauggagacggcgaggugucugaacaagaguuucugagaauuaugaagaagaccagccucuacuga

SEQ ID NO: 67346 - RNA, 504 nt, Artificial Sequence
  derived and/or modified sequence opt5 from CETN3__Homo_sapiens__NP_004356
augagccuggcccucagauccgaacugguggucgacaagaccaaacggaagaaacgcagagaacuuucugaggaacagaagcaagagaucaaagaugcuuucgaacuguuugacacagauaaggacgaggccauugauuaccacgagcucaagguugcgaugcgggcucugggcuucgacgugaaaaaggccgaugugcuuaaaauccugaaggacuaugaucgcgaagccacggggaaaauuaccuuugaggacuucaacgaagucgugacagauuggauccucgagagagacccccaugaggaaauucugaaggcuuuuaagcuguucgaugacgacgauagcggaaaaaucucccuccggaaucugcgcagaguugcccgggagcuuggcgaaaacaugucugacgaggaacugcgcgcuaugaucgaggaguuugauaaggacggggauggagaaauuaaucaggaggaguucaucgccauuaugaccggcgacaucuga

SEQ ID NO: 67347 - RNA, 1482 nt, Artificial Sequence
  derived and/or modified sequence opt5 from CETP__Homo_sapiens__NP_000069
augcuggccgcuaccgugcucacacuggcccuucugggcaacgcgcacgcuugcagcaaggggacgucccaugaggccggaaucgucuguagaauuaccaaacccgcccuccugguucuuaaucacgaaacagcuaaggugauccagaccgccuuccaacgggcuucuuacccugacauuacaggcgagaaagccaugaugcugcucggacaggugaaguaugggcugcauaacauccagauuagccaccuguccaucgcgucuagccaggucgaacucguggaggccaaauccaucgauguuucuauucaaaaugugagcgucguguuuaagggcacccugaaguacggguauacaaccgcuugguggcuuggaaucgaccaguccauugauuucgaaaucgacagcgccauugaucugcagaucaacacgcagcugaccugcgacucuggccgcguuagaacagaugcuccggacuguuaccuguccuuucauaaacuucugcuccaccuccaaggcgagcgggagcccggguggauuaagcagcuguucaccaauuuuaucagcuucacacucaaacuggugcuuaagggacagaucugcaaagaaauuaacgucaucucuaauauuauggccgauuuugugcagacccgcgcggccuccauccugagcgacggcgauauugggguggacaucucucucacgggagauccugucaucacagcuuccuaucuggagagccaccauaagggccacuucauuuacaagaacguuuccgaagaccuuccccugccuaccuuuucucccacacuccugggggacagcagaaugcuguauuucugguuuuccgagcggguguuccauagccucgccaaaguggcuuuucaagauggacgccugaugcuuucucugaugggcgacgaguucaaggccguccucgaaaccuggggcuucaauaccaaccaggagaucuuucaggaagugguugggggauucccuucccaagcccaggugacaguccacugucugaaaaugccgaagauuagcugccagaauaaaggcgugguugugaacucuagcgucauggugaaguuucuuuuccccagaccugaucagcaacacuccgucgcuuacacguuugaggaagacaucgugaccacaguucaggcgucuuacagcaaaaagaagcuguuccucucccugcuggauuuucagauuacccccaaaacagugagcaaucucaccgagucuuccagcgagucuguccaguccuuccugcaaagcaugaucacggccguggggaucccugaaguuaugucccggcuugagguggucuuuacagcucugaugaacucuaagggagugagccucuucgacauuaucaaucccgaaauuaucacccgcgauggcuuucugcugcuucagauggacuucggguuuccggagcaucuccugguggauuuccugcagucccucucuuga

SEQ ID NO: 67348 - RNA, 534 nt, Artificial Sequence
  derived and/or modified sequence opt5 from CFAP126__Homo_sapiens__NP_001013647
auggccaccaacuacagcgcuaaucaguaugagaaggccuucuccucuaaauaccugcaaaacuggagccccacaaagccuacgaaagaauccaucucuagccacgagggcuauacccagauuaucgcgaaugacagagggcaucuccugccguccgugccccggucuaaggcuaacccuuggggaucuuuuaugggcacauggcagaugccccuuaaaauuccucccgcccgcgucacccugacauccagaaccacagccggggcugccagccucaccaaguggauccagaagaauccugaucugcuuaaagcuagcaacggacugugcccggaaauucucggcaagccccacgacccugauucccagaaaaagcugcggaaaaagagcaucacgaagaccguucaacaggcccgcucucccacaaucauuccuuccagccccgcggccaaucugaacucuccggacgagcuccaguccagccauccuuccgcugggcacacccccggaccucaaagacccgccaaaucuuga

SEQ ID NO: 67349 - RNA, 1104 nt, Artificial Sequence
  derived and/or modified sequence opt5 from CFAP36__Homo_sapiens__NP_001269690
auggccgcugaggaagaggacgaaguggagugggucguugaaagcaucgccggcuuccugagagggcccgauugguccauuccuauccucgacuuuguggagcagaagugcgaggugaacuguaaaggaggccacgucauuaccccggggucucccgaaccugugauccugguugcgugcgugccccuugucuucgaugacgaggaagagagcaagcugacauacacggagauucaucaagaauauaaagagcucguggaaaagcugcuugagggauaccugaaagaaaucggcaucaaugaggaucaguuucaggaggcuuguaccuccccucucgccaagacacacaccucucaggccauucugcaacccguucuggcugccgaagacuucacaaucuuuaaggcuaugauggugcagaaaaacauugagaugcagcuccaggccauccggauuauccaagaacgcaaugggguccugccugauugccuuaccgacggaagcgaugugguguccgaccuggagcaugaagagaugaagauucucagagagguccugcggaaaucuaaggaagaguaugaucaggaagaggaacgcaaaagaaagaagcagcuuagcgaggcgaaaacagaggaaccgaccguucacuccagcgaggccgcuaucaugaacaauucucagggcgacggcgaacauuucgcccaucccccuuccgaggugaagaugcacuuugcuaaccaaagcaucgagccccuggggcggaaaguggaacgcucugagacguccagccucccucagaaggaucugaaaauucccggacuggaacacgccucuaucgagggcccgauugcgaaucucuccguccuggggaccgaggaacuuagacagcgggagcacuaccugaagcaaaaacgcgacaagcucaugagcaugagaaaggacaugcggacaaaacagauccagaacauggaacagaagggaaaaccuaccggcgagguggaagagaugacagaaaagcccgagaugaccgccgaggaaaaacaaacgcugcuuaagcgcagacugcucgcugagaagcugaaagaagagguuauuaauaaguga

SEQ ID NO: 67350 - RNA, 2949 nt, Artificial Sequence
  derived and/or modified sequence opt5 from CFAP44__Homo_sapiens__NP_060808
augaaggagcccgacgaucaggacaccgauggcgagaaaagcgugacauccaagucugacgggaaaaagagccugagauccucuaaaagcgagucccggucuccuguccaagaagauaacacguuccucgaggacgauaccgacgaaacauuuaccaagggagagggcagcuaccuggaggaagauuccgacgaggaacgccuugaggggagccugucuuccuuccaguauggagaucuccagagcacaaccguuccgcagcaaacacccgccccugcuguggaggaagccgaggaagaggugaagaaaaagaucucugaauccuuuuucuacgacuauauggagcuggcgagcaugcccuuugucacccuugauucuaauauuccucuggaccuccugacgcuggugcacuccuucggcuacgacugcagaaaacgggcuaaccuccagcugcuugaugacagcaucgccauuuauaucgccgggaaucagcugauuuuucucaaccugaagaccaaagagcagaucuaccuucgcuccucuagcggagaaggcaucggcguuauuggggugcauccccacaagacauauuucaccgucgcugagaagggauccuuuccugauaucauuaucuacgaauacccgagccugagacccuaucgggugcuccgcgacggcacagagaaaggguacgccuauguugauuucaauuacucuggaaaccugcuggcuuccgugggcagcaauccugacuauacccucacgauuuggaacuggaaggaagaacaacccauccugagaacaaaagccuuuucucaggaggucuucaaggugaccuuuaauccugauaaagaagaacagcuuacaaccagcggguccggacauauuaaguucugggaaauggcguucaccuuuacaggccugaaacuccagggcucucuggggcgguucggaaagacgaucaccacagacaucgagggcuacauggaacuucccgaugggaaggugcugagcggauccgaguggggcaacaugcuccugugggaagggggacugauuaaagucgaacucugucgcggcaccagcaagucuugccacaauggcccgaucaaccaaauuaugcuguaugagggggaaguuaucacagugggauccgacggcuacgugagaauuugggauuuugagaccaucgacacggccgacgucaucgaugagacagggcuucuggaaauugagccuaucaaugaacuccagguggacaaaaacguuaaucuguucagcaugauuaagaugaacgagaccggaaacaauuuuuggcuugcucaggaugccaacggcgcuaucuggaaacuggaccucucuuucuccaauauuacccaagaucccgaaugucuguuuagcuuccauuccggggccaucgaggcgguggccgucucuccucugacauaccucauggcuaccacagcccuggacugcagcgugcggaucuaugauuuugcuuccaagacgccccuugcccagaugaaguucaaacagggcggaaccgcccugguuugggugccccgcauggucaacuuuacaggcgcucagauuaucgugggguucgaggacggagucgugcgcauucucgaacuguacgauccuaagggccugaccaucuuugcggggcggaaaaagauucuugacgccgauauccaacucaaacagguuuucaagccgcacacagcuugugugaccgcccuggccuaugagcgcgacggagaaauucuggcuacgggcucuaaggaucagaccgucuucuuuuucgagguggaaagagacuacaaacccaucggguauaucaauacaccuggccccguuugccagcucauguggagcccuaugucccaccccgagagcacccugcuuauuaucugugagaacggauacauucuggaagccccgcucccuacaaucaagcaagaggaagacgaucaugacguggucucuuaugagauuaaagauaugugcaucaaguguuuucacuucuccagcgugaaaucuaagauccugcggcugauugaaaucgagaagagagagcgccagcgggaacuuaaagagaagauuagagaagagagacggaauaaacucgcggcugagaugggcgaagacggggagaaggaauuucaggaggaagaggaggaaaaagaggaagaggaagaggaggaggagccccugccugaaaucuucauucccuccaccccuagccccauccugugcggauuuuacucugagccgggcaaguucugggugagccucgggggauacgauuccggcuuucuguaucauugugaguucccucccugcgacgagagcucugauuuuaaagagcagaaggacgaacccaucgauguuagauaccuugccgacacggaggauaacccuauucaaacaaucaccuucaauauuaacaaggucaugauguuuugcgggaugaaaaauggcgccauccgcguguaugugcugaaccagaaugacccgucccucacaagccuggucgauuacuggcacuucaacaugcacgacaauaacuauggauguauuaaguccaucgcuaacucuuucgacgaucgguuucuggugaccgccggcgcugacgggaauaucuucguuuuuaacauuuucagcgaauuuaugcuuagaaaagauaugaaggccaaagugcccuccccucgcuucggaaucgagaccgagcccauuccugaagacaucgaggaucccaaggcguacucuauugaaaaugcccggagaaagcgcgagcaugacaaacucaugaaggaagucggcgagaucaaagcucggaagagagagcagauuaaagcccugcggagcgaauuuugcaaccugcucgagaugaaugaaaagcugccuaagcacaugcaguucaaacgcacagugucccuuaucuga

SEQ ID NO: 67351 - RNA, 1659 nt, Artificial Sequence
  derived and/or modified sequence opt5 from CFAP52__Homo_sapiens__NP_001074025
auggacaacaagaucagccccgaggcccagguggcugaacuggagcucgaugccgucauuggcuucaaugacaucauucugugggauuacaaaaacagagaacuucuggcgcggcucucccugcacaaggggaaaaucgaggcucuugccuuuucuccuaaugaccuguaucucguuagccugggaggcccggaugacggguccgugguggucuggucuauugccaagcgcgaugcuaucugcggaagccccgccgcuggccugaacguggggaaugccaccaacguuaucuucuccagaugucgggacgaaauguuuaugacagcgggaaauggcacgauucgcgugugggagcucgaucugccuaacagaaaaaucuggcccaccgagugccaaacaggccagcuuaagcggauugucaugucuaucgggguggacgaugacgauagcuucuuuuaccugggaaccacaaccggcgacauucucaagaugaauccucgcacaaaacugcuuaccgacguugggcccgccaaggauaaauucucccugggagugagcgcuaucagaugucucaagaugggcgggcugcuggucggaucuggcgccggccuccugguguuuugcaaauccccuggguauaagccgauuaagaaaauccagcuucagggaggcaucacgagcauuacccugcggggcgaaggacaucaauuccucgugggcacagaggaaucucacaucuaccgcgucuccuuuaccgacuucaaggagacacugauugcuaccugucauuuugaugccguugaggacaucguguuccccuuugggacggcggaacuuuucgccacaugcgcuaaaaaggauauuagaguguggcacaccagcucuaaccgggagcugcuccgcaucacagucccuaauaugaccugucauggaaucgacuucaugagagauggcaaauccauuaucagcgccuggaacgacggcaagauucgggcuuuugcccccgaaaccgggcgccugauguaugugaucaauaacgcccacagaauuggaguuacagcuaucgcgacgaccuccgauugcaaacgggugaucucuggcgggggagagggcgaagucagaguguggcagauugggugucagacacagaagcuggaggaggcccucaaggaacacaaaagcuccguuagcugcauccgcgugaagcggaauaacgaggaaugugucaccgcuucuacagacgggaccugcauuaucugggaucuggugagacuucgccggaaccaaaugauucuggccaauacacucuuccagugcgucuguuaccauccugaggaauuucagaucauuacguccggaaccgacagaaaaaucgccuauugggagguguucgacggcaccguuauccgcgagcuggaagggagccuuucuggaagcauuaacggcauggauaucacacaggagggggugcacuuugucaccggaggcaaugaccaucuggugaagguuugggauuacaacgaaggggaggugacacacgucggcgugggacacuccggcaauauuacgcggaucagaauuucucccgggaaccaauacaucgugagcguuuccgcugacggagccauccuccgcuggaaauauccguacaccagcuga

SEQ ID NO: 67352 - RNA, 1545 nt, Artificial Sequence
  derived and/or modified sequence opt5 from CFAP53__Homo_sapiens__NP_659457
auguacagccagagauucggcaccgugcaacgggaggucaaggggcccacaccuaaaguugugaucgugcgcuccaagccgcccaaaggacagggcgccgaacaccaucuggagagaauuagacgcucucaccagaagcauaacgcuauccucgccagcauuaaauccucugaaagagaccggcugaaggcggagugggaucagcacaaugacugcaagauccuugauagccugguccgcgcuagaauuaaagacgccgugcaaggguuuaucaucaacauugaagaacggcgcaauaagcucagagagcugcuugcccuggaagagaacgaauauuucacggagaugcagcucaaaaaggagaccaucgaagagaaaaaggaucggaugcgcgaaaagacaaaacugcugaaggagaaaaaugaaaaggagagacaggacuuuguugcugagaaacucgaucagcaauuccgggaacgcugugaggaacugagaguggagcuucuguccauucaucagaagaaagucugcgaggagcggaaggcccagaucgcuuuuaacgaggaacucucuagacagaagcugguggaggaacaaauguucagcaaacuuugggaggaagaccgccuggccaaggagaaacgggaggcgcaggaagccagacgccagaaggagcucauggaaaauacccggcugggacugaacgcucaaauuacauccaucaaagcccagagacaggcuacccagcuccugaaggaggaggaagcccgccuuguugagagcaauaacgcgcaaauuaagcacgaaaaugagcaggauaugcugaaaaagcagaaagccaagcaggaaacacggaccauccuccaaaaagcucugcaggagagaaucgagcacauucagcaggaauaccgcgacgagcaagaucuuaacaugaagcuggugcagcgggcccuccaggaccugcaggaagaggcugauaagaaaaagcaaaaacgggaagacaugauccgcgagcagaagauuuaucauaaauaccuggcccagcggagagaggaagagaaggcccaagaaaaggaguuugaccggauccucgaagaggauaaagcuaagaaacuggcggagaaggacaaagaacuucgccuggagaaggaagccagacggcagcucgucgaugaggugauguguacgagaaaacuucaggugcaggagaagcugcaacgcgaagcuaaggagcaggaggaacgggccauggaacagaaacacauuaaugagucucugaaggagcucaacugcgaagagaaagaaaauuucgccagacgccagagacuggcucaagaguaucggaagcagcugcagaugcagaucgccuaccaacagcagucccaagaagcggagaaagaggaaaagcgcagagaguuugaagcuggcgucgccgccaacaagaugugucucgacaaaguucaggaggugcugagcacccaucaggugcuuccucagaacauccaccccaugcggaaggcuugcccuucuaaacugcccccuuga

SEQ ID NO: 67353 - RNA, 3366 nt, Artificial Sequence
  derived and/or modified sequence opt5 from CFAP57__Homo_sapiens__XP_011539101
augagcgccguggucgcucagacccugcacguuuucggccucagaucccauguggccaacaauaucuuuuacuucgacgagcaaauuaucauuuuucccucugggaaccacugcgugaaguauaaugucgaucagaaauggcagaaguucaucccuggaagcgaaaaaucccagggcaugcuggcgcuuucuauuagcccgaaccggcgcuaccuggcuaucuccgagacagugcaagaaaagcccgccaucacgauuuaugagcucucuagcaucccuuguagaaaacggaagguucugaauaacuuugacuuccaggugcagaaguuuauuuccauggccuucagccccgauucuaaauaccuucuggcucagaccuccccucccgaaagcaaucucgucuauuggcugugggagaagcaaaaagugauggccaucguucgcauugacacacagaacaauccuguguaccaggucucuuuuuccccgcaggauaacacccaagugugcgugacagggaauggaauguucaagcugcucagauuugcugagggcacccugaaacagaccagcuuccagagaggggaaccccaaaacuaucuugcccauacaugggucgcggacgauaagaucguugugggaacggacaccggcaagcuguuucucuucgagucuggcgaucagcgcugggaaacauccauuauggugaaagagccuaccaaugggagcaagucccuggacgucauccaggagucugaaagccuuaucgaguuucccccuguguccagcccccugccgucuuacgaacagaugguugccgcuuccagccacucucaaaugagcaugccucagguguucgccauugcugccuacuccaaaggauucgcguguucugccggccccgggagaguccuccuguuugagaagauggaagagaaagauuucuaucgggagagccgcgaaauccggauuccuguggacccccaguccaacgaucccagccagucugacaagcaagacguucugugccucuguuuuuccccuagcgaggaaacacugguggcuucuaccuccaaaaaucagcuuuacagcaucacgaugucccugacagagauuucuaagggagaaccggcccauuucgaguaucucauguacccccugcacagcgcuccuaucaccggccuugccacaugcauccggaagccccugauugccaccuguucccucgaucgcucuaucagacuguggaacuaugagaccaacacacuggaacucuuuaaagaguaccaggaagaggcuuauagcauuucccugcacccuagcgggcauuucaucgucgugggauuugcggacaaacuucggcugaugaaucuccugauugaugacauccgcucuuucaaagaauacuccgucagaggcugcggcgaguguagcuuuucuaacgggggacaccuuuucgccgcugugaauggcaacguuauccauguguacacgaccacaucccuggagaauauuagcucucucaaggggcacaccggaaaaaugcugcugacauuugaugaccaguuccuccugaccgccgccgaagauggcugccuuuucacguggaaggucuuugacaaggaugggcggggaaucaaaagagagcgcgaagugggcuucgcugaggagguucuggugacaaagaccgacauggaagagaaagcccaagucaugcucgaacugaagacccggguggaggaacugaaaauggagaacgaguaucagcuuagacucaaggauaugaauuacagcgaaaagauuaaagagcugacagacaaguuuauccaggaaauggagucccugaaaaccaagaaccaggugcuccgcacagaaaaagagaagcaagacguuuaucaccaugagcacauugaagaucugcuugacaagcagagccgggagcugcaggauauggaauguugcaauaaccaaaaacuccugcuggaguacgaaaaguaucaggagcuucagcucaaaucucagagaaugcaagaggaauacgagaagcagcugcgcgacaaugaugaaacgaaaucccaggcgcuggaggagcucaccgaguucuaugaggcuaagcugcaggaaaagacaacccuucuggaggaagcccaagaggacguccggcagcagcucagagaguuugaagagacaaagaagcagaucgaagaggaugaagaccgcgagauucaagauaucaaaaccaaguacgagaaaaagcugcgggacgaaaaagagagcaaccugagacuuaagggcgaaacggggaucaugcgcaagaaauucuccucucuccagaaggagauugaagaacggaccaaugauaucgagacacugaaaggagaacagaugaagcugcaaggcgugauuaaaagccucgagaaggacauccaggggcugaagagagaaauucaggagcgggaugagaccauccaggacaaagaaaagcgcaucuacgaccuuaaaaagaaaaaccaagagcugggaaaguuuaaguucgugcucgauuauaaaauuaaggaacugaaaaagcagaucgagcccagagaaaaugagauucgggucaugaaagagcagauccaggaaauggaggccgaacuggagaacuuucauaagcaaaacacacagcuugaacucaauauuaccgagcuguggcagaaacugagagcuacggaccaggagaugcgccgggaaagacaaaaggagcgcgaucucgaagcccuggugaagagauucaaaacagaccuucacaacugcguugcuuacauccaggagccgcggcugcucaaggaaaaagugcgcggccuguuugagaaguauguccagagagccgauaugguggagaucgcggggcugaauaccgaccuucagcaagaauacacacggcagcgcgagcaucuggaaagaaaccucgccacccugaaaaagaagguugugaaagagggcgagcuccaccggaccgauuauguccgcauuaugcaggaaaaugugucccugaucaaggagauuaacgaacuuagacgggagcugaaauucacacgcucucaaguuuacgaccucgaagcugcccugaagcugacgaaaaaggugagaccucaggaggucagcgagaccgaacccucccgggauaugcuuucuacagcuccuaccgccagacugaaugagcaggaagagacaggacgcaucauugaaaugcagcggcucgagauccaaagacugcgcgaccagauccaggagcaggaacaagugaccggcuuucacacgcucgcgggggugcggcugcccagccuuuccaacagcgaggucgaucuggaaguuaagacaaauuga

SEQ ID NO: 67354 - RNA, 2619 nt, Artificial Sequence
  derived and/or modified sequence opt5 from CFAP58__Homo_sapiens__NP_001008723
auggccgaggaaaagggcgggaaacaggugcuggaggaaagcgcuuucgaggaaauggagagagacuuucaaggaguccuccacgagcuguccggcgauaagucucuugaaaaauuccggaucgaguacgaacgccugcaugccguuaugaagaaaagcuaugacaacgagaagagacucauggcgaagugccgggagcugaaugcugaaauuguggugaacuccgccaaagucgccaccgcucuuaagcugucucaggaugaccagacaacgaucgccagccucaaaaaggagauugaaaaggcuuggaaaaugguggauuccgccuacgacaaggagcagaaagcgaaggaaaccauccuggcccugaaagaggagauuguuaaucucacaaagcugguggaacaagggucuggacuuagcauggaucagcacuccaacauccgcgaccugcucagauuuaaagaggaagucaccaaggagcgggaucagcugcuuagcgaagugguuaaacugcgcgagucucucgcucagacaaccgagcaacagcaggaaacagagagauccaaggaagaggccgaacaugcuaucagccaguuccaacaggagauucagcaacggcagaaugaggccucucgcgaauuuagaaagaaagagaagcuggaaaaagagcugaagcagauccaggcggacauggauucccggcaaaccgagauuaaagcccuccagcaguaugugcaaaagagcaaggaagaacugcaaaaacuugaacagcagcugaaggagcagaaaauccucaacgaacgcgcugccaaggagcuggagcaauuccagaugagaaaugcuaaacuucagcaggaaaacgagcaacacucucuggucugugaacagcucucccaggagaaucaacagaaggcccuggaacugaaggccaaagaggaggaagugcaucagaugcggcucgacauuggcaagcugaacaaaauccgcgagcagauucacaagaaacuucaccauacggaagaucaaaaggcugagguggaacagcacaaggagacccugaaaaaucagaucgucgggcucgagagagaaguugaggcgagcaagaaacaggccgaacuggaccggaaggcuauggacgagcuucugagagagcgcgauauccucaacaaaaauaugcugaaggccgugaacgccacacaaaaacagaccgaccuggugaagcuccaugaacaggcuaagcggaaucuggagggagaaauucagaacuacaaagaugaggcccaaaagcagagaaaaaucauuuuucaccuugaaaaggagcgcgaccgguauaucaaccaggcguccgaucugacacaaaaaguccucaugaauauggaggacauuaaggugagagaaacccagaucuucgauuaccgcaagaaaaucgcugagucugaaauuaagcugaaacagcagcaaaaccuguaugaggccguucggagcgacagaaaucuuuacuccaagaaccucguggaagcccaggaugagaucacggacaugaaacgcaagcugaagauuaugauccaccaggucgaugagcugaaagaagacauuagcgcuaaggagucugcccucgugaaacugcaucuugaacagcaacggaucgagaaggaaaaagagacacugaaggcugagcuccagaagcugagacagcaggcccuggaaaccaaacacuuuaucgagaagcaagaagcggaggagcgcaaacuucuccggauuaucgccgaagcugacggcgagagacugcggcagaagaaagaacuggaucagguuauuuccgagcgcgacauccucggcagccagcuggugagacggaaugaugaacuugcccugcucuacgagaagauuaaaauccaacagucuguccugaacaagggggagagccaguauaaucaaagacuggaagacaugcgcauucuucggcucgagaucaagaaacugagacgcgaaaagggaauccuggcuagauccauggccaacguggaggaacuccggcaggaguucuuucauaugcagcgcgagcugcuuaaagaaagaacacggugccgcgcgcuggaggaggagcucgaaaauccccugaacguccacagauggcggaagcuggaggccucugauccuaaugcuuacgagcuuauucagaaaauccauacccuccaaaagcgccugauuagcaagaccgaagaggugguugaaaaagagcugcuccugcaggagaaggaaaaacuuuauauggagcugaagcacgugcucgccagacagccgggccccgaagcugccgagcagcugaaacuguaccggcgcacacuucacgacaagaagcaacagcugaaaguccucuccagcgaacugaacauguaugaggugcagucuaaggaguacaaauaugaaguugagaagcucacgaaugaacugcagaaccuuaaaaagaaguaccuggcccagaaaagaaaggagcagcuccagaaaaauaaggauaccgcuccuauggacaacacauuccugauggugaaacccaacgggccuggauuuaccggcgggggauucccccugcgguccacaaagaugaccuucuga

SEQ ID NO: 67355 - RNA, 3714 nt, Artificial Sequence
  derived and/or modified sequence opt5 from CFAP61__Homo_sapiens__NP_056400
augagcgugcugaccucccccagaggcaaggucgagguugugcacugccggcgcacagaaucucaggacguguacuguaucaaaagccucauuagaaaguucacgugcaaacuguuugggaaacuuaacaucauuuaucugcucgagaaggccaaucuggcugucacccuuuguaacgauaaggaagagaucauggcccaagcgacauuccuggacuacccuaauuggaacguggcuaagcaggaugacuggguuuccguguuucgggaacucgauucugacauuccgugcacaccccugaauacccuguucaugcaucucuuugucgccguggaugaguauagcguuggauguugcaaagagauccugcgcaccguguacaaggccgucccugaacuucacuucaucuuucugauugugcccuccuauaugucucucggcagcacacugaucaccguguucgaccaggucgggaacauuccuugucuuacguacgaggaagauuuugcuguucauaucugccacagacauucccacuauccccagcugcacgugcggaaagcccgcguggaggaccaugaugaccucaugccuauuuucaugagauacgauaccauccugaaggagacauacggagaauauuuucuggcugagcucauugaagcccaagacgaggaaaaucacgcggucgugugugagguugagggcaccgccgugggguucaugagcgucugcucucgggugaacaugcagcugcuucaugaauguuuugaccugggaccguuccacggccucugcuucccccacccugaugacguucuggagagcccccaggaucuuuccgugcgcagaucucaggacgcugaacugcgguccagcucucaaggcucccagaaaaucgucgaggaacuccaggagccugugagccccgauacaauggagaauauccaggggaacauugcccgcgaagcugccuccgaggaagcgcugaccgccguccaaucuggaaaugugagcgagccggaagacaucgagaagcuguccgauauuagcacgggcuacgcucaguaucaucacguuucuuccagaagccucgccucucuggugcuuccugaggaacccguccauuuucggccuaucuaccgcggggcuagcgccgccuucugcauucagcuguuuuguaucgacgagaaguaugaagcuagaucccucgauuucaugaacuuuguguucucucuguuuagcgacaaaaauuucugcguuaucucccuuccccaccugacacccgaguuuuuccucauucaaaacuuugugaagauggucccuuucaauaccuguacacuggagcaggaucuguacguguuucaucgggcgggacuccugaaaagcaucaacauuagauucgccacccuucuggacaccccgggcguggaaaaccucguuucuacacugaugcugaauaaguccauccuugaggaccucgaucgcuauaacaaagcucggaaggaccccgaugggacgcugcugcaggccuucgucgccgaaguggcugagcagauugugggaaucgccgucaucagaaaugaaauggacauugaguacauccgcagccacuacaacauugaggauuuuaucuauuucucucaccaucaacgggaggaacacggccauaugcaccacuuugcgcucaauccuauuuucagacauuacaccaaauuuuuccugaaggaaauccuucgccugggcuuuaaguccugccucuauuaccggguguaucccaaaagcagagaggggaaguuccagaacccuuacgcucacucccugacaucugcccugcauuaucuuguucccgugcgcccgcggagacagauugucuacccucucgaaaaacugggaaucaaugcccccagcaaggcuguguccaaagacccuaugucuuacgcccugaaccacaccaaucgcaagcucacacuggagcccaagaucaccguuaacgcuaaaauuaucguggucggcgccagcuccguggggauuagcuuucuugagacgcugguuuucuguucucauaugaaguuuaauaaccucacacugaucuccacccacggacugccuggcaaaaagcuccuugauaccgaacagcggaaauuccuggcgagcgaccacugcuuuaaugauaaggacuaugcccugaugucucucuguuccugggugaacgucgugguggggagaaugacaggaauugaucgggcugccaagcaugucguucugagcaccgacgagaucgugcccuacgaucaccuuauccugugcacaggccaacaguaucaggugccguguccuacggaagcugacauuucucagcaucucaccaaucgcgagguccccaacagcucccaaagacgguacacaggcaaagugcccugcaaccacuucacccugaaugaagaggaggacuguuucaaggcccugaucuggauuagaaacaauagcaucacaaccgaagggaacauuaucguuuauggaaauacgaucgauaccuacacaaccguggagacacuucucaaccugggcgucucugggucccgcauucaucuggugcagccuccgcccgcgagcaccaucacgugcauuaauaacuauuccguugaaucugccguggcugacgcccucggagcugccggcgucacaauguaccgggaugccauccuggcucaguggaaugacgggcuucacccugaucccauuuacagcgcguccuuuaccacaccuaccaaacccuucagacugcagugcucuauguuuuucagcuuuugugagaagaacguggacuaugagaccuucaaagcccucaaugaugcuugccugguuuacgacucccgccuggugaucgauacaaacuuucacacgaaugacaucgccauuagagccgcuggcucucuuaccaaguucagcaaccgguauuacuccaaugaauggacacauagcaacuuuucuuccaaggagaucggauuccaacuggccgcggcuaugcuccaccuguuugauccuacccucgaacccgucacagagccgccugccaaccuggaccgccuuauucccauguauaaaggcgccaagauccagggagggauucugccuggcagcuaccauuaucuccacaucgcuaaacccgccauuccgaccccucuggaagugcagauggcgcaacccaauuacgggcuggagcuugugacgggaucugcuaagaacggcacauacuucagaauccacaucaauaaauauaagauggucgagaccauuaccugucugucccgggaaccuuuccccgccagcaacuacauccgccucuuugggcagcaugagcagcugcucaauaaccugugcgccagauaugaugaaaaucuuauuacagaccuguacucuuauuucaccgagcccuggugucucgcucuguuucacgaccgguucaucgaucugcgcaaagaacuuagacagauucuggccuccaaggaggaggaagaccucccuagcaucgagcaacuggcucaucagaucgaagaugaggaaauuaacccgacagagaagccccggcaguaccucaaacgcguuuuugaggaauccaucuauaagacgcugguggagagaagcacccuugacuaccugcacuacaaucgguaucaucugccuauguacgccuggcccggcauuguguga

SEQ ID NO: 67356 - RNA, 2826 nt, Artificial Sequence
  derived and/or modified sequence opt5 from CFAP69__Homo_sapiens__NP_001034795
auguggaccgaggaagccggcgcuacagccgaggcgcaggaaagcgggaucagaaacaaguccucuagcuccucucaaauucccguggucggaguugugacggaggacgaugaagcucaggacguguucaaaccuauggaucugaaucgggucaucaagcuccuggaggagaccgacaaagauggccuugaagagaagcagcugaaauuugugaagaagcucguucagugcuaccaaaacgggcugccgcuucgcgaccuggcccagauuuucaaaauccucaaucuguguagcggaaagauuaaaaaccagcccagauuuaucgaauccgccuaugauaucauuaagcugugcggccucccuuuccugaaaaagaaggugucugacgagaucacauacgcugaggauaccgccaauagcauugcccuucugggggaccucaugaaaauccccuccagcgaacugcggauucagaucuguaagugcauugucgauuuuuaucacgcugagccucccaaaaagcauaucccuggauaccaacaggcgucuuccagcuauaaaauccagauggccgaagugggcggccuugcuaagacaaugguucagucuaugacccugcucgagaaccaacugguggaaaaacuguggguccucaaggugcugcagcaccuuuccacaagcgaggugaauuguaccauuaugaugaaggcccaggcugccucugggaucugcacgcaucugaacgacccggaucccuccggacaacuccuguuccgcagcuccgagauucuuuggaaucugcucgaaaaaucuagcaaggaggaagucauccagcagcuguccaaccuggagugucuccuggcgcuuaaagaaguuuuuaagaaucuguucaugagaggcuuuagccacuacgaccggcagcuccgcaacgacauucuggugaucaccacaaucauugcccaaaauccugaggcucccaugaucgagugcggguucaccaaagaucuuauucuguuugccacauucaacgaagugaagucucagaaucuccuggucaagggacugaaacucuccaacagcuaugaggacuuugaacugaagaaacuucuguucaacgugaucguuauucucuguaaggaucugccuaccgugcagcugcuuaucgacggcaaagucauccucgcucuguucacguacgugaagaagcccgagaaacagaagauuaucgauuggucugccgcccaacaugaagaacugcagcuccacgcuauugcgacacugagcuccguugccccgcuucugaucgaggaauacaugucuugccaggggaaugcuagagugcucgccuuucuggaguggugugaaagcgaggacccuuucuuuucccacggaaacagcuuccauggcaccggcgggcggggaaauaaauuugcccagaugcgcuauucucugagacuucuccgggcugucguguaccuggaggaugaaacagucaacaaggaccugugcgagaaaggcaccauucaacagaugaucgggauuuucaagaauaucaucuccaagcccaacgaaaaagaggaagccauugugcucgagauccagagcgauauucugcuuauccugucuggacucugcgagaaucacauucagcgcaaggaaaucuuuggcaccgaggggguugacaucgugcugcaugucaugaaaacagauccuagaaagcugcaauccggacuuggcuauaacgugcuccuguucagcacgcuggacuccauuugguguugcauccucggcuguuaccccucugaagacuauuuucuggagaaagaagggauuuuccuucugcucgaucugcuggcgcuuaaucagaagaaauuuugcaaccucauccugggaauuaugguugaguucugugacaaucccaagaccgcugcccacgugaacgccuggcagggcaagaaagaucaaacagcugccagccugcucaucaagcuguggcggaaagaggaaaaggagcuuggggucaaacgcgacaagaauggaaagaucauugauaccaaaaagccucuguuuacauccuuccaggaggagcagaaaaucauuccgcuccccgcuaacugcccuucuaucgccgugauggacgugagcgaaaauauuagagcgaagaucuacgccauccugggcaaacuggauuucgagaaccuucccgggcuguccgcugaggacuuuguuacccucuguauuauccaccgguaucuggauuucaagauuggcgaaaucuggaacgagauuuacgaagagaucaagcucgagaaacugagaccugucacgacagacaagaaagcccuugaagcuauuaccaccgccagcgagaauaucggaaagaugguggcgucucugcaguccgauaucauugaaagccaagccugccaggacaugcagaacgagcagaaaguguacgcuaagauccaagccacacauaagcagcgcgaacucgcuaauaaaucuugggaggauuuucuggcccggaccuccaacgccaagacacugaaaaaggcuaaaagccuucaggagaaggcgauugaagccucuagauaucacaaacgcccccagaaugcuaucuuccaucaaacgcacauuaagggccugaacaccacagucccgagcgggggagugguuaccguggaguccaccccugcccggcucgucggcgggccccugguggacacagacaucgcccucaagaaacugccuaucagaggaggcgcccuucagcgcguuaaggcugugaaaauugucgaugcgcccaagaaaagcaucccuacguga

SEQ ID NO: 67357 - RNA, 1362 nt, Artificial Sequence
  derived and/or modified sequence opt5 from CFAP97__Homo_sapiens__NP_001278962
auggaccaguucggcgauauccuggagggggaaguggaccacagcuuuuucgauuccgacuuugaggaaggaaagaaaugcgagaccaacucugucuucgauaagcaaaaugacgaucccaaagaaagaauugacaaggauacgaaaaacguuaauagcaacacaggcaugcagaccacagagaauuaccucaccgagaaggggaacgaacggaaugugaaguuuccuccggagcaucccguggaaaacgacgucacacagaccguguccucuuucagccugccugccuccucucgcagcaaaaagcugugugauguuacaaccggacugaaaauccacguguccauucccaauagaaucccuaagauugucaaagagggcgaggacgauuauuacacggacggggaagagagcucugacgauggaaagaaguaucaugugaaauccaagagcgcuaaacccucuaccaacguuaagaaauccauccggaagaaauacugcaaggugagcagcuccagcuccucuagccucuccucuucuuccagcggcucuggcacagacugucuggaugccgggagcgacucccaccuuucugauagcuccccuagcucuaaguccagcaaaaagcaugucucuggaaucacccugcucuccccgaaacacaaguauaaaagcggcauuaaguccacagaaacccagcccucuagcacgacaccuaagugcgggcacuaccccgaggaauccgaggacaccgugacagaugugucuccucugagcacccccgacaucuccccgcugcagagcuuugagcucggaauugcgaaugaucaaaaagucaagaucaaaaagcaggaaaacguuucucaggagauuuaugaagacguggaggaucugaaaaauaacuccaaguaccuuaaggcugccaaaaagggcaaagaaaagcaugagccugacgugagcucuaaauccagcucuguccuggacagcucccucgaucaccgccauaagcaaaaggugcugcacgacaccauggaucuuaaucaccuucucaaagccuuccugcagcuggacaagaaagggccccagaagcaucacuuugaucagccuagcguugcucccggcaaaaacuacucuuucacaagagaggaagugcggcaaaucgaccgcgagaaccagagacuccugaaggaacuuucccggcaggccgagaaacccggaagcaaguccacgauuccucgcucugcugaucauccgcccaagcuguaucacagcgcccucaauagacaaaaagaacagcagcggaucgagcgcgagaaccugaccaucucccuuugucauccuggcuggucugcggucacauga

SEQ ID NO: 67358 - RNA, 2295 nt, Artificial Sequence
  derived and/or modified sequence opt5 from CFB__Homo_sapiens__NP_001701
augggcagcaaccugucuccccagcucugccugaugccuuucauccuugggcugcucuccggaggcgugaccacaacgccguggagccuggccagaccccaaggguccuguucucuugagggagucgaaauuaagggcgggagcuuucggcugcuccaggagggacaggcucuggaauacguuugcccuuccggcuucuaucccuacccugugcagacccgcacauguagaucuaccggcagcugguccacacugaaaacccaagaccagaagacagugcggaaagccgagugccgcgcgauccacugucccagaccucaugauuuugaaaauggggaguauuggccgcggagccccuacuauaacgucucugacgagauuuccuuccacugcuacgauggauauacccuccgcggcagcgcuaauagaacgugucaggugaacgggcgguggucuggacagaccgccaucugcgacaauggcgccggguacuguuccaacccuggcauucccaucggaacacgcaagguuggcagccaauacagacuggaagauucugugaccuaucauugcucccgggggcuuacacugcgcggaagccagagacggaccugucaggagggcggguccuggucuggaacggaaccuagcugccaggacuccuuuauguacgauacaccccaagaggucgcugaggccuuccucagcucucugaccgaaacaaucgagggcguggacgcugaagaugggcacggaccgggcgagcagcagaaacgcaagauuguucuugacccuuccggcagcaugaauaucuaucuggugcucgaugggucugacagcauuggagccuccaacuuuaccggcgcgaagaaaugccuggucaaucugaucgaaaagguggccucuuacggggugaaacccagauauggacucgucaccuacgcuacauauccuaagauuuggguuaaagugagcgaggccgauuccagcaacgcugacugggugacgaagcaacugaaugagaucaacuacgaagaccauaaacuuaagucuggcaccaauacaaagaaagcccugcaggcggucuacuccaugaugagcuggcccgaugacgugcccccugagggguggaaccggaccagacacguuauuauccucaugacagauggccugcacaauaugggaggcgacccgaucaccgugauugaugaaauccgcgaccuucuguauauugggaaggaucggaaaaaccccagagaggacuaccucgaugucuauguguucggaguuggcccucuggugaaccaggucaauaucaacgcccuggcuucuaagaaagacaaugaacagcauguguuuaaggucaaggauauggagaaccucgaggacguguucuaccaaaugauugacgaaucccagagccugucccuuugugggaugguuugggagcaccgcaaaggaacggauuaucauaagcagcccuggcaggccaaaaucucugugauccggccuagcaagggccacgaauccugcaugggggcugucgugucugaguacuuuguucugacagccgcccacuguuucaccguggacgauaaagaacauagcauuaaggucuccgugggcggagagaagagagaccucgagaucgaagugguucuguuucaccccaauuauaacauuaauggcaaaaaggaggcugggaucccggaguucuacgauuacgacgucgcgcuuauuaaacugaagaacaaacucaaguauggacaaaccauccgcccuaucugccugcccuguacagaaggcaccacacgggcccugagacucccucccacgaccacaugccagcagcagaaggaggaacugcuuccugcucaagauauuaaagcccuguucgugagcgaggaagagaagaaacucacccgcaaggaaguguacaucaaaaauggggacaagaagggaucuugugagcgggaugcccaguaugcucccggcuacgacaaagucaaggauauuuccgaggugguuacaccgagauuucugugcaccgggggcgugagcccuuaugccgaccccaacacgugucgcggagauucuggcgggccccugaucguccauaaacgguccagauucauucaggugggaguuaucagcuggggcguggucgacgugugcaagaaucagaaacggcaaaagcagguuccugcgcacgcucgcgacuuucauauuaaccuuuuccaggugcucccguggcugaaagaaaagcugcaagaugaggaccucggguuucuguga

SEQ ID NO: 67359 - RNA, 672 nt, Artificial Sequence
  derived and/or modified sequence opt5 from CFC1B__Homo_sapiens__NP_001072998
augaccuggagacaccaugugcggcuccuguucacagucagccuggcccuucagaucauuaaccugggcaauuccuaccaacgcgagaagcacaacgggggaagagaagagguuacgaaaguggcuacccagaagcaucggcagucuccccucaauuggacaagcucccacuuuggcgaagugaccgggucugccgagggauggggcccugaggaaccgcugcccuauagcugggcguucggggagggagcuuccgcccgcccuagaugcugucggaacggcggcacaugcguccuugggucuuuuugugugugccccgcccauuucaccggacgcuacugugaacacgaccagagacggagcgagugcggcgcucuggaacacggggccuggacacuccgcgcuugucaucugugcagauguaucuuuggagcccugcacugccucccucugcaaacccccgaucggugugacccuaaagauuuccuugcgucccaugcccacggcccgagcgcugggggagcccccucucugcuccugcuucugccuugcgcucuccugcaccgccugcucagacccgacgccccugcgcauccccggucccugguuccgagcgugcuucagcgcgagagacggccuugcggcagacccggccuggggcaccgccucuga

SEQ ID NO: 67360 - RNA, 672 nt, Artificial Sequence
  derived and/or modified sequence opt5 from CFC1__Homo_sapiens__NP_115934
augaccuggagacaccaugugcggcuccuguucacagucagccuggcccuucagaucauuaaccugggcaauuccuaccaacgcgagaagcacaacgggggaagagaagagguuacgaaaguggcuacccagaagcaucggcagucuccccucaauuggacaagcucccacuuuggcgaagugaccgggucugccgagggauggggcccugaggaaccgcugcccuauagccgcgcguucggggagggagcuuccgccagaccucggugcugucgcaacggcggcacaugcguccuugggucuuuuugugugugccccgcccauuucaccggaagauacugugaacacgaccagcggcgcagcgagugcggcgcucuggaacacggggccuggacacucagagcuugucaucugugccgguguaucuuuggagcccugcacugccucccucugcaaacccccgaucgcugugacccuaaagauuuccuugcgucccaugcccacggcccgagcgcugggggagcccccucucugcuccugcuucugccuugcgcucuccugcacagacugcuccggcccgacgccccugcgcauccccgcucccugguuccgagcgugcuucagagagagcggagaccuugcggccgccccggccuggggcaccggcucuga

SEQ ID NO: 67361 - RNA, 762 nt, Artificial Sequence
  derived and/or modified sequence opt5 from CFD__Homo_sapiens__NP_001919
augcacagcugggagagacuggccgugcucguccugcuuggcgcugccgcgugcgcugcucccccucgggggcgcauccugggaggcagagaagccgaggcccaugcccggccguacauggcuuccguucagcucaacggggcccaccuguguggaggcgugcuuguggcggaacaauggguccugucugccgcucauugccucgaggacgccgcugaugggaaggugcagguucugcugggagcccacagccucucccagcccgaaccuucuaaacgccuguaugacgugcuuagagcggucccccauccugauagccagcccgacaccauugaucacgaccugcuccugcuucaacuguccgagaaggccacacucggcccugcugugcggccgcugcccuggcagcgcguugauagagacguggccccuggcacgcugugugaugucgcuggguggggaaucgugaaucacgccggccggcgccccgacucucuccagcaugugcugcuuccuguccuggauagagcuaccugcaaccggcgcacacaccaugacggggccauuaccgagagacucaugugugcggaaagcaaucggcgcgauuccugcaaaggagacagcggcgggccccugguuuguggaggcgugcuugagggcguggucacaucuggguccagagugugcggaaaccggaagaaaccgggcaucuacaccagaguugccagcuaugcugccuggauugacucugugcuggccuga

SEQ ID NO: 67362 - RNA, 900 nt, Artificial Sequence
  derived and/or modified sequence opt5 from CFDP1__Homo_sapiens__NP_006315
auggaggaguucgacagcgaagauuuuuccaccucugaagaggacgaagauuacgugcccagcggcggggaguauuccgaggacgaugucaacgaacugguuaaggaggacgaaguggauggagaggagcagacacagaaaacgcagggcaagaaaagaaaggcccagucuaucccugcucggaaacgcagacaagggggacucagccuggaagaggaagaggaagaggacgccaauuccgagucugaaggcagcuccagcgaggaagaggaugacgcggcugaacaagagaaggggauuggaucugaggaugcccggaagaaaaaggaagacgagcuuugggccuccuuccugaacgaugugggcccgaaaagcaaggugcccccuucuacccaggucaaaaagggcgaagagacagaagagaccuccagcucuaagcuccugguuaaagcugaggaacuugagaagcccaaagaaacagagaaggugaaaaucaccaaggucuuugacuucgccggggaggaagugcgcguuacaaaagagguggacgcuaccuccaaggaagccaagagcuuuuucaaacagaaugagaaggaaaaaccucaggcgaacguccccuccgcccugccuucucucccggcuggaagcggccugaagagauccagcgggaugucuucccugcucggaaaaauuggcgccaagaagcagaaaaugagcacgcuggagaagucuaaacuugauugggagagcuuuaaggaagaggaagggaucggagaggaacuggcuauucacaaucggggcaaagagggcuacaucgagcgcaaggccuuccucgacagaguggaucaucggcaauuugaaaucgagcgcgaccugagacuuuccaagaugaaacccuga

SEQ ID NO: 67363 - RNA, 3696 nt, Artificial Sequence
  derived and/or modified sequence opt5 from CFH__Homo_sapiens__NP_000177
augagacugcucgccaagaucauuugccugaugcuuugggcuaucuguguggccgaggacugcaacgaacugcccccucggcgcaauaccgagauucucacaggcagcugguccgaucagacguacccggaagggacccaagcgaucuauaaauguagacccggauaccggucucugggcaacgucauuaugguuugccgcaagggggaguggguggcucuuaauccucugagaaaaugucagaagcggcccugcggacacccuggcgacacacccuucgggaccuuuacacucaccggaggcaacguguucgaauauggcgucaaagccguguacacauguaaugagggguaucagcugcugggagagaucaacuaccgcgaaugcgauaccgacggcuggacgaaugauaucccuauuugugagguugugaagugccucccggucaccgcccccgaaaacgggaagaucgugagcuccgcuauggagccugacagagaguaucauuuuggacaggccguucgguucguguguaauucuggcuacaaaauugaaggggaugaggaaaugcacugcagcgacgauggauuuugguccaaggagaaacccaagugcgucgaaaucucuuguaaaagcccugacgugauuaacggcucccccaucagccaaaagauuaucuacaaggagaaugagcgcuuccaguauaaaugcaacaugggcuacgaauauucugagagaggggaugcuguguguacagaauccggauggcggccgcugccuagcugcgaggaaaagucuugugacaaucccuacaucccuaacggcgauuauagcccccuucgcauuaaacauagaaccggggacgagaucacauaccagugccggaauggauuuuaucccgccacccgcggcaacacggcgaaguguacauccaccggguggauuccugccccgagaugcacacugaaacccugugacuacccugauaucaagcacggaggccucuaccaugagaacaugcggagacccuauuucccugucgcuguuggcaaauacuauucuuacuauugcgacgaacacuuugagacccccuccgggagcuacugggaucacauucauuguacccaggacggaugguccccggccgugccuugccugcgcaagugcuauuuccccuaccuugaaaauggcuacaaccaaaaucacgggcggaaguuugugcagggaaaaucuaucgaugucgcuugucauccuggcuaugcccugcccaaggcgcagacaacggugaccugcauggagaacggguggagcccuacacccagauguauccgcguuaaaaccugcuccaagagcucuauugacaucgaaaauggcuucauuuccgagagccaguacacauaugcccucaaagagaaggcuaaguaccaauguaaacugggauaugugaccgccgauggcgaaacgucugggagcaucacaugcggaaaggacggcugguccgcucagccgaccuguauuaaaucuugcgauaucccugucuuuaugaacgcccggaccaagaaugacuucacaugguucaaacugaacgauacccucgacuacgagugucacgacggguaugaaagcaauacaggauccacgaccggcagcaucgugugcggguacaacggcuggucugaucugcccauuuguuacgagagagagugcgaacuucccaagaucgacguucaccuggugccugaucgcaagaaagaccaguauaaggucggagaggugcucaaauuuuccugcaagccgggcuucacaauugucgggcccaauagcgugcaauguuaccauuuuggacugucuccugaucuucccaucugcaaagaacagguucaguccuguggcccucccccugagcugcucaacgggaaugugaaggaaaagaccaaagaggaguauggacacagcgaagucguggaguacuauugcaacccccgguuccugaugaagggcccgaauaaaauucaguguguugacggggaauggacaacccugccugugugcaucgucgaggaauccacguguggcgauauucccgagcucgagcauggaugggcccaacugucuagcccucccuacuauuacggcgacuccguggaauuuaacugcucugagagcuucaccaugaucgggcacagauccaucacauguauucauggaguguggacccagcuuccgcagugcguugcuaucgauaagcugaaaaaguguaaaagcucuaaccucauuauccuggaggagcaccuuaagaauaagaaagaauuugaccacaacuccaauauucgcuaccggugcagaggcaaggagggguggauccauacagucugcaucaacggacgcugggauccugaggugaauuguagcauggcgcagauucaacugugucccccuccuccccagauccccaacucucacaauaugaccacgacacucaacuaucgggacggcgaaaaaguguccguccugugccaggagaauuaccugauucaggaaggggaggagauuaccugcaaggauggcagauggcaaagcaucccgcucuguguggagaaaauccccugcucucagccuccccagaucgaacauggaacaauuaacagcucccggagcucucaggaauccuaugcccacggcaccaagcugagcuacaccugugaagggggauuccgcaucuccgaagagaaugagacaacgugcuauaugggcaaguggucuagcccuccccaaugugaagggcuuccuugcaaauccccgcccgagauuucucacggaguuguggcucauaugagcgacuccuaccaguauggcgaagaggucaccuacaaguguuuugaaggcuucgggaucgacggaccugccauugccaaaugccugggcgagaaguggucucaucccccuagcugcaucaaaacagauugucucucccugcccagcuuugagaacgcuaucccgaugggggaaaagaaggacguguacaaagccggagagcagguuaccuauacaugcgcgaccuacuauaagauggauggcgcuucuaaugugacguguauuaacuccagauggacagggcggccuaccugcagagacaccagcugugucaauccucccacagugcaaaacgccuacaucguuucucgccagauguccaaauaucccagcggagaacgggugagauaccagugccgcucucccuaugagauguucggcgaugaagaggucaugugucugaacggcaauuggaccgagccuccgcagugcaaggacuccacagggaaauguggacccccucccccuauugauaacggcgacaucacgagcuuuccccuuuccguguacgccccggcuagcucuguggaauaccaaugccagaaucucuaucagcuggaggggaacaagagaauuaccugucggaauggacaguggagcgaaccucccaagugccugcacccuugcgucaucucccgcgagauuauggagaacuacaauaucgcccucagauggacagcuaaacaaaagcuguauucucggaccggcgaaagcguugaguucguguguaaacgcggguacagacuuuccucucggagccacacacugcgcaccacgugcugggauggaaagcucgaauaucccaccugugccaaaagauga

SEQ ID NO: 67364 - RNA, 993 nt, Artificial Sequence
  derived and/or modified sequence opt5 from CFHR1__Homo_sapiens__NP_002104
auguggcugcucgugagcgucauccugauuuccagaaucucuagcguuggcggggaggccaccuucugcgacuuucccaagauuaaccacggaauccuuuacgaugaagagaaauauaagccuuucucccaggugccgacaggcgaaguguuuuacuauucuugugaguacaauuucgucagccccuccaaaucuuuuuggacgcggauuaccugcacagaagagggguggagcccuacccccaagugucugcgccucugcuucuuuccuuucguggagaacggacauuccgaaagcucuggccaaacacaccuggagggggacaccguucagaucaucuguaauacaggauauagacuucagaacaaugaaaacaauauuuccugcguggagcggggcuggagcacgcccccuaaaugucgcucuaccgauaccuccugcgucaacccgcccacagugcagaaugcucauauccugagcagacaaaugucuaaguacccuuccggcgagcggguucgcuaugaauguagaagccccuacgagauguuuggggacgaagaggugaugugccucaacggaaauuggaccgaaccuccccaguguaaggauuccacaggcaaaugcgggccgccucccccuauugacaacggagauaucaccucuuucccccugagcgucuacgcccccgcguccagcguggaguaucagugccagaaucuguaccaacucgagggcaacaagcggauuacgugucgcaaugggcaguggucugaaccuccgaaaugccugcaccccugugugaucuccagagagauuauggaaaacuauaacaucgcccuucgguggacagcuaagcagaaacuguaccuccgcaccggagagagcgccgaauuugucugcaagagaggcuaucggcugucuagccgcucccauacacuuagaaccaccuguugggacggcaagcuggaguacccuacaugcgcuaaacgguga

SEQ ID NO: 67365 - RNA, 813 nt, Artificial Sequence
  derived and/or modified sequence opt5 from CFHR2__Homo_sapiens__NP_005657
auguggcugcucgugagcgucauccugauuuccagaaucucuagcguuggcggggaggccauguucugcgacuuucccaagauuaaccacggaauccuuuacgaugaagagaaauauaagccuuucucccaggugccgaccggcgaaguguuuuacuauucuugugaguacaauuucgucagccccuccaaaucuuuuuggacacggauuacgugcgcugaagagggguggagcccuacccccaagugucugcgccucugcuucuuuccuuucguggagaacggacauuccgaaagcucuggccaaacacaccuggagggggacaccguucagaucaucuguaauacaggauauagacuucagaacaaugaaaacaauauuuccugcguggagcggggcuggagcacacccccuaaaugucgcucuaccaucuccgccgagaagugcggcccgcccccucccauugauaacggggacaucaccagcuuucugcucucugucuacgcgccuggauccagcguggaauaucagugucaaaaucuguaccagcuggagggcaacaaucagauuacgugcagaaacgggcagugguccgaacccccgaagugucucgauccuugcguuaucucucaagagauuauggaaaaauacaauaucaagcugaaauggaccaaccagcagaaacuuuauagccggacaggagacaucguggaguucgucugcaaguccggcuaccaucccaccaagagccacucuuuucgcgcuaugugucagaaugggaagcugguguauccuuccugcgaggaaaaauga

SEQ ID NO: 67366 - RNA, 810 nt, Artificial Sequence
  derived and/or modified sequence opt5 from CFHR3__Homo_sapiens__NP_001160096
augcugcuccugaucaacgugauucuuacccugugggucagcugcgccaauggccagguuaagcccugugacuucccugauaucaaacacgggggacucuuucaugagaacaugagacggccguacuuccccguggcugugggcaaguauuacuccuauuacugcgacgaacacuuugagacaccuucugggagcuauugggauuacauucauuguacgcaaaauggauggucccccgccgucccuugccugcgcaaauguuauuuccccuaccuugaaaacggcuacaaucagaacuaugggagaaaguuugugcagggaaauucuaccgagguugcgugccacccuggcuacggccugccgaaagcucagacaaccgugacauguaccgaaaagggguggagccccacaccucggugcauccgcgucaacuccucugagaaguguggacccccucccccgauuagcaauggcgacaccacguccuuccuccugaaaguguauguuccucaaagcagaguggaguaccagugccagcccuauuacgaacugcaggggucuaacuaugucaccuguuccaauggagaguggagcgaaccuccccggugcauccaucccugcaucauuacagaggagaacaugaauaagaacaauaucaaacucaagggccgcucugauagaaaauacuacgccaagaccggggacacaauugaauuuauguguaagcugggauauaacgccaacaccuccauccuuagcuuccaagcugugugccgggagggcauuguggaauacccucgcugugaguga

SEQ ID NO: 67367 - RNA, 1734 nt, Artificial Sequence
  derived and/or modified sequence opt5 from CFHR4__Homo_sapiens__NP_001188480
augcugcuccugaucaacgugauucuuacccugugggucagcugcgccaauggccagguuaagcccugugacuucccugagauccaacacgggggacucuacuauaaaucccugagacggcuuuacuuuccggcugccgcgggccagucuuauagcuacuauugcgaucagaacuucgugacacccuccgggucuuacugggacuauauucauuguacgcaggauggauggagcccuaccgugcccugccugcgcacauguuccaagucugacgucgaaaucgagaauggcuuuauuagcgaauccagcucuaucuacauccucaacgaggaaacccaauacaauugcaaaccuggguaugcuacagccgagggaaacuccagcggcucuauuaccugucugcagaauggcugguccacacagcccaucugcauuaaguucugugauaugccuguguuugagaacagcagagccaaaucuaaugggaugugguucaagcugcacgacacccucgauuacgaaugcuaugacggauacgaguccagcuauggcaacacgaccgauuccaucguuuguggggaagacggauggucucaucugccgacaugcuacaauagcuccgagaacugcgggcccccucccccuauuagcaauggcgauaccacaucuuuuccccagaagguguaucuuccguggucccgggucgaguaccaaugucagagcuacuaugaacugcagggaucuaaauacgugaccugcagcaacggcgacugguccgagccuccccgcuguaucucuaugaagccuugcgaguuccccgaaauucagcacggccaucucuauuacgaaaauacgagacggcccuauuuuccuguugcuacagggcaaagcuacuccuauuacugugaucagaacuucgugaccccgagcggaucuuacugggacuauauccacugcacacaggacggcuggcugcccaccgucccuugucuuagaaccugcuccaaaagcgauaucgagauugagaacggguuuaucucugaauccagcuccauuuacauccugaauaaggagauucaauauaaauguaagcccggauacgccacagcugacggcaacucuagcggguccaucacgugccuccagaauggauggucugcccagccuaucuguauuaaguucugcgauaugcccguguuugaaaacagccgcgcgaaauccaauggcaugcgguucaagcugcacgacacccuggauuaugagugcuacgacggcuaugaaaucagcuacgggaacacaaccggaucuauuguguguggcgaggauggguggucccauuucccgacaugcuacaauagcucugagaaauguggaccucccccucccaucuccaacggcgacaccacgagcuuucuccugaaggucuauguuccucagucucgcguggaauaccaaugccagagcuauuacgagcuucagggguccaauuaugugacauguagcaacggcgaauggucugagcccccgagaugcauucacccuuguaucaucaccgaagagaauaugaacaaaaauaacauucagcugaagggaaaauccgauaucaaguacuaugccaagaccggcgacacaauugaguucaugugcaaacucggguacaaugcuaacaccagcguccuguccuuucaagccgugugucgggaaggaaucguugaguacccccgcugcgaauga

SEQ ID NO: 67368 - RNA, 1710 nt, Artificial Sequence
  derived and/or modified sequence opt5 from CFHR5__Homo_sapiens__NP_110414
augcugcuccuguucagcgugauccuuauuuccugggucucuaccguuggcggggagggaacacugugcgacuuucccaagauccaccauggcuuccucuacgaugaagaggacuauaacccuuuuagccaggugccgacgggggaaguguucuacuauuccugugaguacaauuuugucucucccagcaaauccuucuggaccagaauuacaugcaccgaagagggauggucuccuacacccaagugucugcggaugugcagcuuuccuuucgugaaaaacggccacuccgagagcucugggcuuauccaucuggaaggagauaccguucaaauuaucuguaauacaggcuauucccuccagaacaaugagaagaacaucagcugcguggaacgcggcuggucuacgcccccuauuuguuccuuuaccaaaggggagugccacgucccgauccuggaggccaauguggacgcucagcccaagaaggaaagcuacaaaguuggagaugugcugaaguucucuuguagaaagaaccucauucgggucggcuccgacagcgugcagugcuaucaauuugggugguccccuaauuuccccaccuguaagggacaggugcgcucuugcggcccucccccgcagcugagcaacggggaggucaaagaaaucagaaaggaggaauacggacauaaugagguuguggaguacgauugcaacccuaauuuuauuaucaacggccccaagaaaauucaguguguggacggcgaauggacaacccuuccuacaugcgucgagcaagugaagaccuguggguauauccccgaacuggaguacggauauguucagcccuccgugccuccguaccagcacggcgucagcguggaaguuaauugccggaacgaguaugccaugaucgggaacaauaugauuacguguaucaacggaauuuggacagagcuccccaugugcguggcgacccaccagcugaaacgcuguaagaucgcuggcgucaauauuaaaacacuucugaagcucucugggaaagaguucaaccauaauuccagaauccgguaccgcugcagcgauaucuucagauaucggcacucuguguguauuaacggaaaguggaauccugaagucgacugcaccgaaaagcgcgagcaauuuugucccccucccccgcagaucccuaacgcccagaauaugaccacaacggugaacuaccaagauggcgaaaaaguugccgugcugugcaaggagaauuaccugcuccccgaggcuaaagaaauugucugcaaggacggcagauggcagagccugccucgguguguggaguccaccgccuauugcgggcccccucccucuaucaacaauggagauacaaccagcuucccgcuuuccguuuacccucccggcagcacagugaccuaucgcugucagucuuuuuacaaacugcagggguccgucacggugacaugcagaaacaagcaauggagcgaacccccucggugucucgacccgugcgugguuucugaggagaauaugaacaagaacaauauucagcugaaauggagaaacgacggaaaacuuuaugcuaaaaccggcgaugccgucgaguuccaguguaaguuuccccauaaagcgaugaucuccagcccucccuuccgcgccaucugccaggaagggaaguuugaauacccuauuugugaguga

SEQ ID NO: 67369 - RNA, 1752 nt, Artificial Sequence
  derived and/or modified sequence opt5 from CFI__Homo_sapiens__NP_000195
augaagcugcuccacguguuccugcuuuuucugugcuuccaucucagauuuuguaaagucaccuacacaagccaggaggaccugguugaaaagaaaugccuugccaagaaauauacgcaccuguccugugauaagguguucugccaacccuggcagcgguguaucgaggggaccugcguguguaagcucccuuaccagugcccgaaaaacgggacagcugucugugccaccaaucgcagaucuuuucccacauauugccagcaaaagagccuggaaugucugcauccuggaaccaaauuccucaacaauggcacaugcaccgcggaggggaaguuuuccgugucucugaaacacggaaacacggacagcgaaggcauuguugaggugaaacuugucgaucaggacaagaccauguucaucugcaaguccucuuggagcaugcgggaggcuaauguggccugucuggaucucggguuucagcagggagccgacacacaacgcagauucaagcuguccgaucuuagcauuaacucuaccgaaugccugcauguucacugucggggccucgagacaucccuggcugaaugcaccuuuacgaaacgcagaacaaugggcuaccaggacuucgccgauguggucuguuauacccagaaggcugacagccccauggaugacuuuuuccagugcgugaaugggaaauacaucucucaaaugaaggccugugauggaauuaacgacugcggcgaccaguccgaugagcuguguugcaaagcgugucaggggaagggauuccacugcaagagcggcgugugcaucccuucucaauaucaguguaauggggaggucgacugcaucacaggagaagaugagguuggcugugccggcuuugcuuccguggcccaggaagagaccgaaauucucaccgcugacauggaugccgagcggcgcagaaucaaaagccugcuucccaagcuguccugcggggugaaaaaccggaugcauauucgcagaaagcggaucgucggaggcaaacgcgcgcagcucggggaccugccuuggcaaguggccauuaaggaugcuucuggaaucacauguggcgggauuuacaucggaggcugcuggauccuuacggccgcucacugucugagagccagcaagacccaucgguaccagauuuggacaaccguuguggacuggauccacccggaucucaaaagaauugucaucgaguauguggaccgcauuaucuuccacgaaaauuacaacgccggcacauaucagaaugauaucgcucugauugagaugaagaaagacgggaacaagaaagacugcgaacugccccgguccaucccugcguguguucccuggagcccuuaccucuuucagcccaaugauaccugcauugugucuggauggggcagagagaaggacaacgaacgcgucuucucccugcaauggggcgaggugaaacuuaucagcaacuguucuaaguuuuauggaaaucgguucuacgagaaggaaauggagugcgccggcacguaugaugggagcauugacgcuugcaaaggcgauuccggaggcccgcuggucuguauggacgccaacaaugugacauacguuuggggaguggucucuuggggcgaaaacugcgggaagccugaguuucccgggguguacaccaaaguugccaauuauuucgauuggaucagcuaccaugugggaagaccuuuuaucucccaguauaacgucuga

SEQ ID NO: 67370 - RNA, 501 nt, Artificial Sequence
  derived and/or modified sequence opt5 from CFL1__Homo_sapiens__NP_005498
auggccagcggcguggcugucuccgacgggguuaucaagguguucaacgauaugaaagugagaaagucuagcacccccgaggaagucaaaaagcggaaaaaggccgugcuguuuugccucuccgaggacaagaaaaauauuauccuggaagagggaaaggaaauucuuguuggcgauguggggcagacagucgacgauccuuacgcgacguucgugaaaaugcugccggacaaggauugucgcuaugcucucuacgacgccaccuaugagacaaaagagucuaagaaggaagaucugguuuuuaucuucugggcccccgagagcgcuccucuuaaauccaagaugauuuacgccucuagcaaagacgcuaucaagaaaaagcugaccggaaucaaacacgaacuccaagccaacugcuaugaggaggugaaggauagauguacacuggcggaaaagcugggcggguccgccgucauuagccucgagggaaaaccccuguga

SEQ ID NO: 67371 - RNA, 501 nt, Artificial Sequence
  derived and/or modified sequence opt5 from CFL2__Homo_sapiens__NP_068733
auggccagcggcgugaccgucaacgacgagguuaucaagguguucaaugauaugaaagugagaaaguccucuacacaggaagagauuaaaaagcggaaaaaggcuguccuguuuugccucagcgacgauaagcgccaaaucauuguggaagaggccaaacagauccugguuggggacauuggagauacgguggaagaccccuacaccuccuucgucaaacuucugccucucaacgauuguagauaugcgcuguacgacgcuacauaugagaccaaggagucuaagaaagaagaucuuguguuuaucuucugggccccggagagcgcuccccugaaguccaagaugaucuacgccucuagcaaagacgccauuaagaaaaaguuuacaggcaucaaacacgaauggcagguuaaugggcucgaugacauuaaggaucgguccacccugggagagaaacugggcgggaacguggucgugagccucgagggaaagccucuguga

SEQ ID NO: 67372 - RNA, 666 nt, Artificial Sequence
  derived and/or modified sequence opt5 from CFLAR__Homo_sapiens__NP_001120656
augagcgccgaggugauccaccaggucgaagaggcucuggacaccgaugaaaaggagaugcuccuguuccuuugcagagacguugccauugauguggugcccccuaacguccgggaccugcucgauauccugcgcgaaagaggcaaacuuuccgugggggaccuggcggagcuccuguaccggguucgcagauuugaucugcucaagcggauucugaaaauggaccgcaaggcuguggagacacaucuucugagaaauccgcaccucgucucugauuaucgggugcugauggccgaaaucggagaggaccuugauaaaagcgacguuuccucucugauuuuccucaugaaggauuacaugggccgcgggaagaucagcaaagaaaaguccuuucuggaccugguggucgagcucgagaaacugaaccuuguggcccccgaccaacuggaucuccuggaaaagugucuuaaaaauauccauagaauugaccugaagacgaagauccagaaauauaagcagucugugcagggagcuggcaccagcuaccggaacguccuccaagccgcuauucagaaaucccugaaggauccuagcaauaacuuccgcaugaucacacccuaugcccacugcccugaccugaaaauucucgggaauuguucuauguga

SEQ ID NO: 67373 - RNA, 1410 nt, Artificial Sequence
  derived and/or modified sequence opt5 from CFP__Homo_sapiens__NP_002612
augaucaccgagggcgcccaggcucccagacugcuccugccuccgcuucugcuccugcuuacacugcccgccacggggagcgacccugugcucugcuucacccaauacgaagaguccucuggaaaguguaaaggccugcucgggggaggcgucagcguugaagauugcugucugaacacagcguuugcuuaucagaagcgguccgggggacugugccagcccugucgcucuccuagauggagccuuugguccaccugggcccccugcucugugacauguagcgagggcucccagcugcgguaccgcagaugcgugggcuggaaugggcaauguagcggaaaagucgccccuggcacccucgaauggcagcugcaggcuugcgaggaccagcaauguugcccggagaugggaggguggucuggcugggggcccugggaaccuugcuccgugacauguagcaagggaacccggacgcgcagacgggccugcaaccaccccgcuccuaaauguggcggccauugccccgggcaggcccaggagucugaagcgugugauacccagcaaguuugcccgacacacggagccugggcuaccuggggcccuuggacacccuguuccgccagcugccaugggggaccucacgagcccaaggagacccgcucuagaaaguguuccgcucccgaaccuagccagaaaccgcccggcaagccuugccccgggcuugccuaugagcagcggcgcuguacgggacugccucccugcccgguggcgggcggcugggggccuuggggacccgucuccccuugccccgugacauguggccucgggcaaaccauggaacagagaacaugcaaucauccuguuccccagcacggaggcccguucugugccggggacgcuacccggacccacauuugcaacacagccgugccuugucccgucgauggcgagugggacucuuggggagaauggagccccugcauccgcagaaauaugaaauccauuagcugucaggagaucccuggccaacagucucgggggagaacgugccgcggacggaaguuugauggccauagaugugcugggcagcagcaagacauucgccacugcuacuccauccagcauuguccgcugaaaggaagcuggucugaguggagcaccuggggccugugcaugcccccuugcgggcccaacccuacacgggccagacagcgccucuguacaccccugcuuccuaaguaucccccgaccguguccaugguggaaggccagggagagaagaaugucaccuucuggggccggccucugcccagaugcgaggaacuccaagggcagaaacugguuguggaagagaagcgcccuugucuucacgugcccgccugcaaagauccggaggaagaggaacuguga

SEQ ID NO: 67374 - RNA, 4443 nt, Artificial Sequence
  derived and/or modified sequence opt5 from CFTR__Homo_sapiens__NP_000483
augcagagaagcccccuggagaaggccuccguggucucuaaacucuucuuuagcuggacccggccuauccugcgcaagggcuacagacaacggcuugaacuguccgacauuuaucagaucccgucuguugauagcgcugacaaccucuccgagaaacuggaacgcgagugggauagagaacuugccucuaagaaaaaucccaagcugauuaacgcgcuccggcgcugcuucuuuuggagauucauguuuuacgggaucuuccuguaucugggagaggugacaaaggcugugcagccucuccugcuuggccggauuaucgccagcuacgaccccgauaauaaagaggaacgcuccaucgccauuuaucuggggaucggacucugucugcuuuuuauugucagaacgcugcuccugcacccugcuaucuucggccugcaucacauugggaugcagaugcggaucgccauguuuagccucauuuacaagaaaacccugaaacuuucuucccgcgugcuggacaagaucagcaucggacaacucguuucucugcuuuccaacaaucugaacaaguucgaugagggccucgcucuggcccauuuuguguggauugcgccccugcaggucgcccuccugaugggccuuaucugggaacugcuccaggcuagcgccuucugcgggcugggauuucuuauugugcuggcucucuuccaggccggccuggggagaaugaugaugaaguaucgggaccaacgcgcgggaaaaaucucugagagacugguuauuacauccgagaugaucgaaaauauccagagcgugaaggccuacuguugggaggaagcuauggagaaaaugauugaaaaccuccggcagaccgagcugaaacuuacaagaaaggccgcuuacguccgcuauuucaauuccucugccuuuuucuuuagcggcuucuuugugguguuccuguccguccucccuuacgcccugaucaaggggauuauccugcggaaaauuuuuaccacaaucagcuucugcaucguucuuagaauggcugugacccgccaguuuccgugggcggugcaaacgugguaugauucucucggagccauuaacaagauccaggacuuccugcagaagcaagaguacaaaacccuggaauauaaucucacaaccacagaggucgugauggaaaacguuaccgcuuuuugggaggaaggcuucggcgagcuguuugagaaggccaaacagaauaacaauaaccggaagacguccaacggggaugacagccuuuucuucucuaauuuuagccugcucggaacacccgugcugaaagauauuaacuucaagaucgaaagaggccagcugcuugccgucgcuggguccaccggagccggcaagacaucucuccugauggugauuaugggggagcuggaaccuagcgagggaaaaaucaagcacuccggccgcauuagcuuuuguucucaguucuccuggaucaugcccggcaccaucaaagaaaauauuaucuuugggguuagcuacgacgaguaucgguacagaucugugauuaaggcgugccaacucgaggaagacaucuccaaauucgcugagaaggauaacauuguccugggagaaggcgggaucacccuuagcggaggccagcgcgcccggaucucccuggccagagcuguguacaaggacgccgaucucuaucugcuggacucuccuuuuggguaccuugauguccucacagagaaagagauuuucgaaagcugugugugcaagcugauggcuaauaaaacgcgcauccugguuaccuccaagauggagcaucucaaaaaggccgacaagauucugauccuucacgaaggcucuagcuauuuuuacggaacauucuccgagcugcagaaccuccagcccgauuuuagcucuaaacugaugggcugugacuccuucgaucaauuuagcgcggaacggagaaauucuauucugaccgagacacuucaccgguucucccucgagggggacgccccggugagcuggaccgaaacgaagaaacagucuuucaagcagacaggagaguuuggcgaaaaacgcaagaacagcauccugaauccuaucaacuccauuagaaaauucagcaucguccagaagacgccccugcaaaugaaugggauugaggaagauucugacgagccucucgagcggagacugucccuugugcccgacagcgaacagggagaggcuauccugccccgcauuuccguuaucucuaccggcccuacacuccaggcccggagacgccagagcgugcugaaccugaugacccauuccgucaaucaagggcagaacauccacagaaagacaacggcuucuacccggaaagugagccuugccccgcaggcgaaucugacagaacucgauauuuauucccgcagacugucucaagagaccggccucgaaaucagcgaggagauuaacgaagaggaccugaaggaaugcuuuuucgaugacauggaguccauccccgccgugacaaccuggaacacguaccuucgguauauuaccguucauaaaagccugaucuuuguccucauuuggugucuggugaucuuccuggcugagguggccgcuucucuugucgugcuguggcuccugggaaauacaccucuccaggauaagggcaacuccacccacagccgcaauaacucuuacgccguuaucauuacauccaccagcucuuacuauguguuuuacaucuaugucgggguggccgacacgcugcuugcuaugggauucuuuagaggccugccccucguucacacacugauuaccguguccaaaauccugcaucacaagaugcuucauagcguccugcaggcgccuauguccacacucaauacccugaaggccgggggcauucucaaccgguucagcaaagauaucgcuauccuggacgaucuucugccccugaccauuuuugacuucauccagcuccugcuuauugugaucggagccauugccguuguggcuguccugcaaccguacaucuucguggccacagugccugucaucguugcguuuauuaugcuccgcgcuuauuuccugcagacgucucagcagcucaagcaacuggaaagcgaggggagaucccccaucuuuacccaccuugugacaucucugaaaggccuguggacccuccgggccuucggacgccagccuuacuuugaaacacuguuccauaaggcccuuaaucugcacaccgcuaacugguuucucuaucugagcacgcucagaugguuccagaugcggauugagaugaucuuugugauuuucuuuaucgccgucacauucauuuccauccugaccaccggcgaaggggagggaagagugggcaucauucuuacacuggcgaugaauaucaugucuacccugcagugggcuguuaacagcuccauugauguggacucucucaugcgcagcgucucccggguguuuaaauucaucgauaugcccacagaggggaagccuaccaagagcaccaaacccuacaagaauggacaacugucuaaaguuaugauuaucgaaaacucccacgugaagaaagacgacaucuggccgagcggcgggcagaugacagucaaggaucuuaccgccaaguacacagagggcggaaaugccauucuggaaaacaucucuuucuccauuagcccuggccagagaguggggcuccugggacgcaccggcuccgggaaaucuacgcuccugagcgcuuuucuucggcugcugaauaccgagggagaaauccaaauugacggcguuuccugggauagcaucacacuccagcaguggagaaaggccuucggcgugaucccccagaaagucuuuauuuucucugggaccuuucgcaagaaccuggaccccuaugagcaaugguccgaucaggagaucuggaaaguggcugacgaagugggacuucggagcgucauugagcaguucccuggcaagcuggauuuuguucucguggacgggggaugcgugcugucucauggccacaaacagcugaugugccucgccagaagcguccuuuccaaggcgaagauccugcugcucgaugaaccgucugcccaucuggaccccgugacauaccaaauuauccgccggacccuuaaacaggcuuucgccgauuguacaguuauucugugcgagcacagaaucgaagcuaugcucgagugucagcaguuucuggugaucgaggaaaacaagguccggcaauaugacagcauucagaaacugcucaaugagcgcucccuuuucagacaggccaucucuccuagcgaucgggugaagcuguuuccccaccgcaacuccagcaaaugcaagucuaagccucagauugccgcucugaaagaagagaccgaggaagagguucaagacacgagacucuga

SEQ ID NO: 67375 - RNA, 351 nt, Artificial Sequence
  derived and/or modified sequence opt5 from CGA__Homo_sapiens__NP_000726
auggacuacuauagaaaguacgccgcuaucuuccuggugacccucagcgucuuucugcacguucuucauuccgcccccgaugugcaggacugcccugaguguacacugcaagaaaacccguucuuuucucagcccggcgcgccuauucuccagugcaugggguguugcuucagccgggcuuaucccacgccucugcgcuccaaaaagaccaugcuugugcagaaaaaugucacaucugagagcaccuguugcguggccaaguccuacaacagaguuacagugaugggaggcuuuaaagucgaaaaucacaccgccugucauugcucuacauguuauuaccacaagagcuga

SEQ ID NO: 67376 - RNA, 468 nt, Artificial Sequence
  derived and/or modified sequence opt5 from CGB1__Homo_sapiens__NP_203695
augagcaagagacugcuccugcuucugcuccuguccaugggcgggaccugggccucuaaagagccccuucggccucgcugcagaccgaucaacgcuacacuggccguggaaaaggagggaugucccgucugcauuacgguuaauaccacaaucugugcgggcuacugcccuaccaugacacgggugcuccagggggugcugcccgcucugccucaagucguguguaacuaucgcgacguuagauucgaaagcauucggcuccccggaugcccucgcggcgugaauccggucguguccuacgccguugcccugucuugucagugcgcucuuuguagacggagcaccacagauugcgggggacccaaagaccacccucugaccugugaugacccccgcuuucaggauuccucuagcuccaaggccccucccccgagccucccuucucccuccagacugccuggccccuga

SEQ ID NO: 67377 - RNA, 492 nt, Artificial Sequence
  derived and/or modified sequence opt5 from CGB2__Homo_sapiens__NP_203696
augagcaagggccugcuccugcuucugcuccuguccaugggagggaccugggccucuaaagagccccuuagaccucggugccgcccgaucaacgcuacacuggccguggaaaaggagggcugucccgucugcauuacgguuaauaccacaaucugugcgggguacugcccuaccaugacaagagugcuccagggagugcugcccgcucugccucaagucguguguaacuaucgggacguucgcuucgaaagcauuagacuccccggcugcccucgcggggugaauccggucguguccuacgccguugcccugucuugucagugcgcucuuugucggagaagcaccacagauugcggaggccccaaagaccacccucugaccugugaugacccccgguuucaggccuccucuagcuccaaggcuccucccccgagccucccuucucccucccgccugccuggccccagcgauacgcccauccuuccucaguga

SEQ ID NO: 67378 - RNA, 498 nt, Artificial Sequence
  derived and/or modified sequence opt5 from CGB5__Homo_sapiens__NP_149032
auggagauguuccagggccugcuccugcuucugcuccugagcaugggagggaccugggccuccaaggaaccccuuagaccucggugccgcccgaucaacgcuacacuggccguggagaaagaaggcugucccgucugcauuacgguuaauaccacaaucugugcgggguacugcccuaccaugacaagagugcuccaaggagugcugcccgcucugccucaggucguguguaacuaucgggacguucgcuuugagucuauuagacuccccggcugcccucgcggggugaauccggucgugagcuacgccguugcccuguccugucagugcgcucuuugucggagaucuaccacagauugcggaggccccaaggaccacccucugaccugugaugacccccgguuccaggauagcuccucuagcaaagccccucccccgucccucccuagccccucucgccugccuggccccuccgacacgcccauccuuccucaauga

SEQ ID NO: 67379 - RNA, 498 nt, Artificial Sequence
  derived and/or modified sequence opt5 from CGB7__Homo_sapiens__XP_011525821
auggagauguuccagggccugcuccugcuucugcuccugagcaugggagggaccugggccuccagagaaaugcuucggccccgcugcagaccuaucaacgcuacacuggccguggagaaggaaggcuguccggucugcauuacgguuaauaccacaaucugugcgggguacugccccaccaugacacgggugcuccaaggagugcugccugcucugccccaggucguguguaacuaucgcgacguuagauuugagucuauucggcucccuggcugcccccgcggggugaauccugucgugagcuacgccguugcccuguccugucagugcgcucuuuguagacggucuaccacagauugcggaggcccgaaagaccacccccugaccugugaugacccucgcuuccaggccagcuccucuagcaaggcucccccucccucccucccgagcccuucuagacugcccggcccuuccgauacgcccauccuuccccaauga

SEQ ID NO: 67380 - RNA, 3612 nt, Artificial Sequence
  derived and/or modified sequence opt5 from CGN__Homo_sapiens__XP_005245422
auggagcaggcccccaacauggcugaaccuagaggcccgguggaccacgggguccaaauccgguucauuaccgagcccguuagcggagccgaaaugggcacacugcgcagagggggacggcgcccugcgaaggaugcuagagccuccacguacggcguggccgugcggguccaggggaucgcuggacagcccuuugugguucucaauucuggcgagaaaggcggggacagcuucggagugcagauuaagggcgccaacgaucaaggggcuuccggagcccugucuagcgaccuugaacugccugagaaucccuauucccaggucaaaggcuuuccugcgccgucucagagcuccaccagcgaugaggaacccggggccuacuggaacggaaagcuccugcgcucucauucccaggcuagccuugccggcccuggccccguggacccuucuaauagauccaacagcaugcuggagcucgcucccaaaguugccucuccgggguccacaaucgauaccgcgccucugagcuccguggacucucugauuaauaaguucgauagccaacucggaggccaggcccgggggcgcacaggaagacggacccgcaugcugcccccugaacagagaaagcgguccaaaagccuugacucucgccugcccagagauacauuugaggagcgggaaagacaguccaccaaccacuggacgagcucuaccaaguaugacaaucaugucggcacaagcaaacaacccgcucagucccagaaccucucuccucugagcggguucucccgcagccggcaaacccaggauugggugcuucagucuuuugaggaaccgagacgcuccgcccaggaccccacaaugcugcaauucaagagcaccccugaccuccugcgggaucagcaggaggcugcucccccuggaucuguggaccacaugaaagccacgaucuacggcauccugagagaaggcuccagcgaguccgagacaucuguccgccggaagguuagccucgugcuggaaaagaugcagccccuugugauggucuccucugggagcaccaaagccguggcgggacaaggcgagcugacaagaaagguugaagaacuccagcgcaaacuggaugaagaggugaagaaacggcagaaacuugagccgucccaggucgggcuggaaagacaacucgaggaaaagaccgaggaaugcagccgccugcaggagcugcucgagcggagaaagggagaagcccagcagucuaauaaggagcugcaaaacaugaaacggcuucuggaccagggcgaagaucuccgccaugggcuggagacccaggugauggagcuucaaaauaagcugaaacacguucagggcccugaacccgcuaaggaggugcuccugaaagaccugcucgaaacaagagagcugcuugaagagguccuggagggaaagcagcggguggaggagcagcucagacugcgcgaacgggagcugacggcccuuaagggcgcccucaaagaagaggucgcuuccagagaucaagagguggaacacguucgccagcaguaucagagagacaccgagcaacugcggcgcagcaugcaggaugccacacaggaccaugcggugcuggaagcugagagacagaagaugucugcccucguccgggggcugcaacgcgaacuugaggagaccuccgaagagacaggacacuggcagagcauguuucagaaaaacaaggaagaucugagagccaccaaacaagagcuccugcagcugcggauggagaaggaagagauggaagaggaacuuggcgagaagauugaggugcuccagcgcgaacuggagcaggcuagagccucugcuggggacacgcggcaaguugaagugcugaaaaaggagcuccugcgcacacaggaggaacuuaaagagcugcaggccgaaagacagagccaagaggucgcgggacggcauagagaccgcgaacucgagaagcagcuggccgugcugcggguggaagcugauagaggccgcgagcuugaggaacagaaucuccagcugcagaaaacccugcaacagcuccggcaggacugugaggaagccuccaaggcuaagaugguugccgaggcggaggccaccguccuggggcaaagacgcgcugccguggaaacaacccuucgggagacacaggaagagaacgaugaguucagacgccggauccugggccucgaacagcaacugaaagagacgagaggacugguggacggcggggaagcugucgaggcccggcuucgcgauaagcuccagagacuggaagccgagaaacagcagcuggaagaggcucucaacgcgagccaagaggaagagggaucucuggccgcugccaagcgggcccuugaagcucgccuggaggaagcccagagaggccucgcgcggcuggggcaggagcagcaaacccugaauagagcucuugaggaagagggaaaacagcgcgaagugcugcggagaggcaaggccgagcucgaggaacagaaacgccugcucgaccggacaguugauagacugaacaaggagcuugaaaagauuggggaggacuccaaacaggcccugcaacagcuccaggcucaacuggaagauuacaaggagaaagcccgccgggagguggcggacgcucagagacaggccaaggauugggccagcgaagcugagaaaaccuccggcggacugucucgccuucaggacgaaauccaaagacugcggcaggcccuccaggcuagccaggccgagcgcgauacagcgagacuggacaaggaacuccuggcccaacggcuucagggccuggagcaggaggcugaaaauaagaaacgcucccaggacgauagagcccggcaacucaaggggcuggaggaaaaagucucuagacuggagaccgaacuugacgaggagaagaacacgguggaacugcucaccgaucgcguuaaucggggaagagaccagguggaucagcugcgcacagagcucaugcaggaacggagcgcuagacaagaccuggagugcgauaaaauuucccuugagcggcagaacaaggaccugaagacccgccuggccucuagcgaaggcuuucagaaaccuuccgccagccucucucaacuggagucccagaaucagcuucugcaggaaagacuccaagcugaggaacgggagaagacaguccugcagagcaccaaccgcaaacucgagagaaaggugaaagaacugucuauccagauugaggaugaacggcagcacguuaaugaccaaaaggaucagcuuucccugcgcgugaaggcgcugaaaagacaggucgacgaggccgaagaggagaucgaacggcucgaugggcugcgcaagaaagcucagagagagguggaggaacaacacgaagugaacgagcagcuucaggcccggaucaagagccuggagaaagacucuuggagaaaggccucccgcagcgcugccgaauccgcgcucaaaaaugagggacugagcucugacgaagaguucgauagcgucuaugaccccuccucuauugcuagccuccugacggaguccaaccuucaaacaucuagcuguuga

SEQ ID NO: 67381 - RNA, 3909 nt, Artificial Sequence
  derived and/or modified sequence opt5 from CGNL1__Homo_sapiens__NP_116255
auggagcuguacuucggcgaauaucagcacgugcaacaggaguacgggguccaucucagacuggccagcgacgauacccagaagucccggucuagccagaacuccaaagcuggaucuuauggcguuagcauccgcgugcaagggauugacggacaccccuacaucgugcuuaauaacacagaaagaugccuggccggcacguccuuuucugagaaugggccuccguuucccccucccgucauuaacaaucucccucugcauagcuccaacggaagcgugcccaaggaaaauucugaggagcuucagcugccugaaaacccguaugcgcagcccuccccuauccggaaucucaaacagccccugcugcacgagggcaagaacggcguucucgaucgcaaagacgggagcgugaagccuucucaucugcuuaauuuccaaagacaccccgaacugcuccagccguacgauccugagaagaacgagcugaaucuucagaaccaccagcccuccgaaagcaauuggcugaaaacccucacagaggaaggaauuaacaacaagaaaccuuggaccuguuuccccaagcccucuaauucccaaccuacaagcccgucccuggaggaccccgcuaaaucuggcgucaccgccauccggcugugcagcuccgugguuaucgaagauccuaagaagcagacaagcgugugugucaacgugcagucuugcaccaaagagcgcgugggggaggaagcccucuuuacguccggaagaccccugaccgcucauagcccucacgcccaucccgagacaaagaaaacccggccggacguccuuccuuuccgcagacaagauucugcuggccccguucuggacggggcccggagccgcagauccucuagcuccagcacaaccccuacgucugccaauucccucuaucgguuucugcuugaugaccaggaaugugcgauucacgcugauaacgugaaucgccacgagaacagacgguacauccccuuccugccuggaacaggcagagacauugacaccggcagcauccccgggguggaucagcucauugaaaaguuugaccagaaaccgggacugcaacgccggggcagaucugggaagcgcaaucggaucaacacagaugacagaaaacgcucccggagcgucgauuccgccuucccuuuuggacugcagggcaauucugaguaccucauugaguucagcagaaaccuggggaaguccucugaacaucuucugcgccccagccaggugugcccccagcggccucucucccaagagagacgcggaaagcagagcguuggccggaccuuugcuaaacugcagggcgccgcgcacggggccucuugugcucauuccagaccgccccagccuaauaucgacggaaaggugcuugaaaccgagggcagccaagaaucuacagucauccgggcccccucccugggggcucagagcaaaaaggaggaggaagugaaaacggccaccgccacacucaugcugcagaaccgcgcuaccgcgacaucuccugauagcggagccaagaagauuuccguuaaaaccuuccccagcgcuucuaauacgcaggccacaccugaccugcucaagggccaacaggagcugacccagcaaaccaacgaagagacagccaaacagauccuuuauaauuaccugaaggagggguccaccgauaacgacgaugcuacaaaaagaaaggugaaccucgucuucgaaaagauucagacgcugaaaagccgggccgcgggcuccgcucagggaaauaaccaagccugcaauucuaccagcgaggugaaggaccugcuugaacagaaauccaagcucacaaucgaggucgccgaacugcagagacagcugcaacucgaggugaaaaaccagcagaauauuaaggaggaacgcgagcggaugagagcuaaccuggaagaacuucgcucucagcacaaugaaaagguugaggagaacagcacccugcaacagagacucgaagaguccgaaggcgagcugcggaaaaaucuggaggagcuuuuucaggugaagauggagcgcgaacaacaucagacagagaucagagaccuccaggaucagcugucugaaaugcacgacgagcuggauagcgccaaacgguccgaggaccgcgaaaagggggcucucaucgaggaacugcuucaagccaaacaggaucugcaggaccuccugauugcgaaggaggaacaggaggaucugcuuagaaaacgggagcgcgaacucaccgcccugaagggagcucugaaggaggaagucagcucucacgaccaagagauggauaaacucaaggaacaguaugacgccgagcugcaggcucuuagagaguccguggaagaggccacgaaaaacguugaagugcuggcgagccggucuaauaccuccgagcaggaucaagccggcacagaaaugcgcgucaagcuccugcaggaggagaacgaaaaacugcaggggagaagcgaggaacuugagcggagaguggcucagcuccaacgccagaucgaggaccugaagggagaugaagccaaggcuaaagagacccugaagaaauacgaaggcgagauucggcagcucgaagaggcccuggugcaugccagaaaggaggaaaaagaggcuguuucugcgcgccgggcccuugaaaaugagcuggaagcugcccaagggaaccucucccagacaacccaggagcagaagcaacugagcgagaagcugaaagaagaguccgaacagaaggagcagcuuagacgccugaaaaaugaaauggagaacgagcgguggcaccucggcaagacgaucgaaaaacugcagaaggagauggccgacauugucgaagcuagcagaacaucuacccucgagcugcaaaaccagcuugacgaguauaaggagaaaaaucgccgggagcuggccgaaaugcagagacagcucaaggagaaaacacuggaagcggaaaagagccggcugaccgcuaugaaaaugcaagaugagaugcgccuuauggaagaggaacugagagacuaccagcgggcccaggaugaggcccucaccaagcgccaacugcucgaacagacacugaaagaccuugaguaugagcuggaagcuaagucccaucucaaggaugacagaucucggcuggugaaacagauggaggauaaggugagccagcuggaaauggagcuugaagaggagagaaacaauuccgaccugcucucugaacgcaucagccgguccagagagcaaauggaacagcugcgcaacgagcuccugcaggagcgggccgcgagacaggaucuugaaugugacaaaaucucucuggagcgccaaaauaaggaucugaaaagccggauuauccaccucgaaggauccuacagaagcucuaaggagggccuggucgugcagauggaagcucgcauugccgagcuugaggacagacuggaauccgaggaacgggaucgcgccaaccuccagcugagcaauagacggcucgagcgcaagguuaaagaacuggugaugcaggucgacgacgagcaccuuucucugacggaucaaaaggaccagcugucccucagacugaaagcuaugaagagacagguggaggaagccgaggaagagaucgaucggcuugaaagcuccaaaaagaagcugcagcgcgagcucgaggaacaaauggacaugaacgagcaucugcaggggcagcucaauucuaugaaaaaggaucugcggcuuaaaaagcugcccagcaaaguucuggacgauauggacgaugacgaugaccucuccaccgacggaggcagccuguacgaagcuccggugucuuauacauucuccaaggauagcaccgucgccucucaaauuuga

SEQ ID NO: 67382 - RNA, 999 nt, Artificial Sequence
  derived and/or modified sequence opt5 from CGRRF1__Homo_sapiens__NP_006559
auggccgcuguguuccuggucacccucuacgaguauagcccccuguuuuacaucgccguuguguucacaugcuuuauugugacgaccggccuuguccuggggugguucggaugggacgugccuguuauccucagaaacuccgaagagacacaguuuucuacccggguguucaagaaacaaaugcgccaggucaagaauccguuuggccuggaaauuacaaaccccagcuccgcgucuaucaccacagggauuacccuuacgaccgauugucuggaggacagccuccugacaugcuauuggggauguuccgugcagaaacuguacgaagcucuccagaagcacguuuauugcuucagaaucucuaccccucaagcccuggaggaugcccuuuacagcgaguaucuguaccaggaacaguacuuuaucaaaaaggacuccaaggaggaaauuuauugucagcucccccgggauacaaaaaucgaggacuucggcaccgugccucgcagcagauacccccuggucgcucuccugacgcucgccgaugaggacgaucgggaaauuuaugacaucauuucuaugguguccgugauccauauuccugaucgcacauacaagcugagcugcagaauccuguaucaauaccuccugcuugcucaggggcaguuucacgaccugaaacagcuuuucaugucugccaauaacaauuuuaccccguccaacaauucuagcuccgaggaaaagaacacagaucggagccugcuugagaaagucggacuguccgaaucugagguugagcccagcgaagaaaauuccaaggacuguguggugugccaaaacggcaccgucaauugggugcuccugccuugucgccauaccugccugugugacggcugcguuaaguauuuccagcagugccccauguguagacaauucgugcaggagagcuuugcgcucugcucucagaaagagcaggauaaggacaaaccuaagacacuguga

SEQ ID NO: 67383 - RNA, 819 nt, Artificial Sequence
  derived and/or modified sequence opt5 from CH25H__Homo_sapiens__NP_003947
augagcugccacaacuguuccgacccccaggugcugugcucuagcggccaacucuuccugcagccucuuugggaucaucugagauccugggaggcccuccugcagucuccguuuuuccccgucaucuuuagcauuaccacauacguuggguucugucuuccuuuuguggugcuggacauccucugcuccuggguccccgcucugcggcgcuauaagauucacccugauuucucucccagcgcccagcaacugcucccuugucugggacagacgcuuuaccagcaugugauguuuguuuucccggugacccugcuccacugggcgagaucccccgcucugcuuccucaugaagcccccgagcugcuccugcugcuccaccacauccuguuuugccuucuccuguucgacauggaauuuuucgucuggcaucugcuucaccauaaagugccuuggcuguaucggacauuucacaagguucaccaucagaauagcuccucuuucgcccucgcuacccaauacaugagcgugugggagcuguucucucugggcuuuuucgauaugaugaacgucacacuccuggggugucacccccuuaccacacugaccuuucauguggugaauauuuggcucuccgucgaagaccacagcggauauaacuucccguggucuacgcaucgccugguuccuuuuggcugguacgggggaguggugcaccacgaucuucaucacucccauuucaauugcaacuuugcccccuauuucacccacugggacaaaauccugggcacacucagaaccgcuagcgucccugcccgguga

SEQ ID NO: 67384 - RNA, 660 nt, Artificial Sequence
  derived and/or modified sequence opt5 from CHAC1__Homo_sapiens__NP_001136248
augggcggggcccagcuggagcuccccagcggagcuagaccuggcgugugcguccggcgcuccuucagagcccacgcgggggaccaaccgcggagacccccuggacccaucccuguucccggcaccaugaagcaggaaucugcugccccuaacacaccgcccacgagccaguccccuacccccucugcccaguuuccucgcaaugauggggacccccaagcucuguggauuuucggauacggcagccuuguguggcggccggauuuugccuauuccgacucucgcgugggcuucgucagaggguacagccggcgcuuuuggcagggagauacauuccauagaggcuccgacaaaaugccugggcgggugguuacccugcucgaggaucacgaaggauguacauggggcguggcuuaucagguccagggggagcaaaaccccggauaccugggcccugcccccgaagaggcgaucgccacccagauucuugcuugccgcggcuuuagcgggcauaaucuggaguaucuccugagacuggccgacuucaugcagcucuguggaccccaggcucaagaugaacaccuggccgcgaucguggacgccguuggcacaaugcuuccuugcuuuuguccgaccgagcaggcucuggcccucguguga

SEQ ID NO: 67385 - RNA, 1323 nt, Artificial Sequence
  derived and/or modified sequence opt5 from CHAD__Homo_sapiens__XP_011522516
augcacggcagcagacugggggagcggccccgcccucucccgagaggaggccgggggcgcaucuccggaagagaacgggugaagcccucuggccuggacgccccucgcagaagcuggcuugggugccggcugcgcuccggacccccuuacaaagagggcggcagacccgaacggcucgggcuggcugccgcgcgcgcuccuccgccccuucugccucccgccccugcccccggagucccggcuaugguuagaccuaugcuccugcugucucucggccugcuugccgggcugcuccccgcucuggccgcguguccucagaacugccauugucacagcgaucuucaacaugugauuugcgacaaggugggacugcagaaaauccccaaggucuccgagaaaaccaagcuccugaaucugcagcggaacaauuuccccgugcucgccgcuaacucuuuucgcgccaugccuaaucugguuagccuucaucugcagcacugucaaauuagagaaguggcugccggcgcguuccgggggcucaagcagcugaucuaucuuuaccugucccacaacgauauuagaguccuccgcgccggagcuuuugacgaucugacagagcugacguaucucuaccuggaccacaauaaagugaccgagcuuccgcggggccugcucagcccccugguuaaccuuuucauccugcagcucaauaacaauaagaucagagaacugcgcgccggcgcuuuucagggggccaaagaucugcgguggcucuaucugucugagaacgcccuuuccagccugcaaccuggagcucucgacgauguggaaaaucuggcgaaguuccaugucgacagaaaccagcugucuuccuaccccagcgccgcucuuucuaaacuccgcgugguggaggagcugaagcugucccacaauccucucaagagcauucccgauaacgccuuucaguccuucggccgguaucuggaaacacuuuggcuggacaacaccaaucucgagaaauuuucugauggggccuuccugggagucacaacccugaagcauguucaccuugaaaacaauagacucaaccagcugccgagcaauuuuccuuucgacucccuggagacacucgcucugaccaacaaucccuggaaaugcacgugucaacuucgcggccugcggagauggcucgaagccaaggcgagccgcccugacgcuaccugcgccucucccgccaaauuuaaggggcagcacauccgggauacagacgcuuucagauccuguaaauucccuaccaagcggagcaagaaagccggacgccauuga

SEQ ID NO: 67386 - RNA, 2871 nt, Artificial Sequence
  derived and/or modified sequence opt5 from CHAF1A__Homo_sapiens__NP_005474
augcuggaggaacucgagugcggcgcccccggggcuagaggagccgcgaccgcuauggacuguaaggaucggccugccuucccggugaaaaagcugauccaggcccgccuucccuuuaaaagacugaaccucgucccuaagggcaaagcugacgauaugagcgacgaucaagggacauccguucagucuaagagccccgaccuggaagccucccuugauacgcuggagaauaacugccacgugggaucugacauugauuuccggccuaagcucgugaauggcaaagggccccuggacaacuuucugcgcaauagaaucgaaaccagcauuggacaguccacagucaucauugaucucaccgaggacucuaacgagcagccugauagccugguggaccauaauaagcugaacuccgaagcuagcccgucucgggaggccaucaauggccaacgcgaagacacaggcgaucagcaggggcugcucaaagcgauccagaacgacaagcuggccuuccccggagagacccuuuccgauauuccuuguaaaacagaggaagagggcguugggugcggaggcgcugggagacggggagacagccaagaauguucuccccgcuccugcccugagcugaccagcggccccagaauguguccgcggaaggaacaggauucuugguccgaggccggcgggauccucuuuaagggaaaagugccuauggucgugcugcaggacauucuggcuguuagacccccucagaucaagagccuccccgccacgccccaaggcaaaaauaugaccccugaguccgaagugcuggagucuuucccggaagaggauagcguccuuucccacagcucucuguccagccccucuagcacauccucuccugaagggcccccugcgcccccgaagcagcauagcuccaccagcccuuuucccacaucuaccccucuccgccggauuacgaaaaaguucgugaaaggauccacagagaagaacaagcugcgccuucagagagaccaagagcggcugggcaaacagcucaagcugagagccgaacgcgaggaaaaagagaagcugaaagaagaggcuaagcgggccaaggaggaagcuaaaaagaaaaaggaggaagagaaagagcucaaggaaaaggagagacgcgaaaaacgggagaaggaugaaaaagagaaggccgagaaacagagacugaaggaagaacgccggaaggaaagacaggaggcccuugaagcuaaacuggaggagaagcgcaaaaaggaagaggaaaaacggcucagagaggaagagaagcgcaucaaagcggagaaggccgaaauuacccgguuuuuccaaaagcccaaaacaccucaggcucccaagacccuggccgggagcugcggaaaauuugccccguucgagaucaaggaacacauggugcuugcuccuagacggcgcaccgccuuucaucccgaccuguguucucagcucgaucagcugcugcaacagcaguccggcgaguucagcuuccucaaagaccugaagggcagacagccccuucgguccgggccuacacacgucucuacgagaaaugcggacaucuuuaacagcgauguugugauuguggagcgcggaaagggcgacggggucccggaacggagaaaauucggacgcaugaagcugcuccaauuuugcgagaaucacagacccgcuuacuggggcaccuggaacaaaaagacagcccugauccgggcccgcgauccuugggcucaggacaccaaacugcuugauuaugaaguggacuccgaugaggaaugggaggaggaggagcccggggaaucucucagccauuccgagggcgacgaugacgaugacaugggagaagaugaggacgaggacgauggcuucuuuguuccucacggguaccugagcgaagacgagggagugacagaagagugugccgaucccgaaaaccauaaggucagacagaagcugaaagcuaaggagugggacgaguuccucgccaaaggcaagcgguuucgcgugcugcagccuguuaaaauugggugcgugugggcggccgauagagacugcgcuggagaugaccuuaagguccugcaacaguucgccgcuuguuuucucgaaacccugcccgcccaggaggaacaaacgccgaaggcgucuaaacgggagcgcagagaugagcagauccuggcccagcuucucccucugcugcacggcaaugugaacggguccaaggucauuauccgggaguuccaggaacacugccgcagaggccuccugagcaaucauacaggaucuccccgguccccuagcaccaccuaucuucacacacccaccccgucugaagacgcugccaucccuagcaaauccagacugaagcgccucauuagcgagaacucuguguacgaaaaacggcccgauuuuagaauguguugguauguucauccucaagugcugcaguccuuccagcaggagcaccuucccguccccugccaauggagcuacgugacauccguuccuucugcuccgaaggaggacagcggcuccgugcccucuacggggccuagccagggaacccccaucucccuuaaacgcaagucugccggcagcauguguauuacacaguuuaugaagaaacggagacaugaugggcagaucggagccgaagacauggacggcuuccaagcugauaccgaggaagaggaagaggaggaaggggacugcaugauugucgaugugccugacgcggccgaggugcaggcucccuguggcgccgccuccggagcuggcgggggaguuggcgucgauacagggaaggccacccucacggcgagcccucugggagcuucuuga

SEQ ID NO: 67387 - RNA, 1680 nt, Artificial Sequence
  derived and/or modified sequence opt5 from CHAF1B__Homo_sapiens__NP_005432
augaaggugaucacaugcgagauugccuggcacaacaaagaacccgucuacagccuggacuuccagcauggcacagcugggagaauccaccggcucgccuccgcgggaguugauacgaaugugcgcauuuggaagguggagaaaggcccugacgggaaggcuaucgucgaauuucugucuaaccuugccagacauaccaaagccgugaauguugugcgguucagcccgacaggagagauucuggcuuccggcggggaugacgccgucauccuccuguggaaggugaacgauaauaaggaacccgagcaaaucgcuuuucaggacgaggaugaagcccagcuuaacaaagagaauuggaccguugugaagacacugcgcggacaccucgaagacgucuaugauauuuguugggcgaccgacggcaaccugauggccucugcuagcguggauaauacagccaucauuugggacguguccaaaggccagaagaucucuauuuucaacgagcauaaaagcuacguccaagggguuaccugggauccucugggacaguauguggcuacgcucuccugcgacagagugcugcgggucuacagcauccagaagaagcgcguggccuuuaauguuucuaaaaugcuuuccggcauuggggcggagggagaagccagaagcuaucggauguuccacgacgauucuaugaaguccuuuuuccgcagacugagcuuuacccccgacggcucucuccugcuuaccccugcuggguguguggaguccggagaaaacgucaugaauaccacauacguguucagccggaaaaaccugaagcgccccaucgcccaccucccuugcccgggcaaagcuacccuggccguuagauguugccccguguauuuugagcugcggccugucguggaaacgggcgucgagcucaugucccugcccuaccgccuuguguucgccguugcuucugaggauagcgugcugcucuacgacacacagcaauccuuuccuuucggguaugucagcaauauccauuaccacacccugucugauauuuccuggagcucugacggagcguuccuugccaucagcuccacagauggcuauuguucuuuugugaccuucgaaaaggacgagcuggggauuccccucaaagaaaagccgguucugaacaugagaaccccugauacagcuaagaaaacgaagucccagacccaucggggauccagccccggcccuagacccguggaggggacacccgccucucgcacccaggacccuuccagcccgggaacaacacccccucaggcccggcaagcucccgccccuacggucaucagagaucccccgucuauuaccccugcggugaaaagcccccugccuggccccagcgaagagaagacccuccagccuuccucucagaacaccaaagcucaccccagccgccgggugacacugaauacccuucaagccugguccaagacaacgccgagacgcaucaaccugaccccucucaagacagacaccccucccucuagcguucccacauccgucaucagcaccccgucuacggaggaaauucaguccgagacccccggcgacgcccaggggagcccucccgaacugaaacggccuagacuugaugagaauaagggaggcacagaaucucuggaccccuga

SEQ ID NO: 67388 - RNA, 2439 nt, Artificial Sequence
  derived and/or modified sequence opt5 from CHAMP1__Homo_sapiens__NP_001157617
auggaggccuuccaggaacugagaaagcccagcgcucggcucgagugcgaccacuguuccuuucgcggcaccgauuacgaaaacgugcaaauccauauggggacaauucacccugaguucugcgacgaaauggaugccggaggccuggggaaaaugaucuuuuaucagaagucugcgaaacuuuuccauugucacaagugcuuuuucacgagcaaaauguacuccaaugucuauuaccauauuaccucuaagcacgcuagcccggacaaguggaacgauaaacccaagaaucagcugaacaaagagacagacccuguuaaguccccgccucuccccgagcaccagaaaaucccuuguaauucugccgaacccaagagcauucccgcccuguccauggagacccaaaaacuuggaagcgugcugucuccugaaucccccaaaccuacaccccucaccccgcuggagccucagaagcccggcagcguggucucuccugagcugcagacaccccuccccuccccugaaccgagcaaacccgcuucuguguccagcccugagcccccuaaguccguucccgugugcgaaucucagaaacuggccccggucccuagccccgagccucaaaagcccgcuccugugucccccgaaagcguuaaagccacccuuucuaacccgaagccucagaagcagucccauuuucccgagacgcuggggcccccuagcgcgucuagcccggagucccccgugcucgccgcuucuccugaacccuggggaccuagccccgccgcuuccccugagagcagaaaaucugcccggaccacaucccccgaaccgcgcaagccuagccccucugaguccccugaacccuggaaaccguucccugcggucagccccgagccuagacggcccgcccccgcuguguccccuggcucuuggaagccggggcccccuggcagcccccgcccuuggaaauccaaucccucugccagcuccggaccuuggaagccggcuaagcccgccccuagcgugucucccggcccuuggaaacccaucccguccgucagcccugggcccuggaagcccaccccuucuguuuccagcgccucuuggaaaagcuccagcgugucucccuccagcuggaaguccccuccggcuucucccgagagcuggaaauccggaccucccgaacugagaaagacagcgccuacccuuucucccgagcacuggaaggccgugccgccugucagccccgaacugcggaaaccugggcccccucucucccccgagauccgcucuccggcuggcagcccugaacugagaaagcccuccggaagccccgaucuguggaaacucucuccugaccagcggaagacguccccggccagccuggauuuucccgagucucaaaaauccagccgcggcggcucuccugaccuuuggaaguccagcuucuuuauugagccccagaagccuguguuccccgaaacaagaaaaccugggccguccggacccagcgagucuccuaaggccgcuagcgauaucuggaaacccguucuguccauugacaccgaaccucggaagcccgcccucuuuccggagccugcgaaaacagcuccucccgccucucccgaggcccgcaagagagcucuguuccccgaaccucggaaacaugcccuuuucccggagcugcccaagagcgcucucuuuuccgaaucucagaaggccguggagcugggcgaugaacugcaaaucgacgcgauugacgaucagaaaugugacauccucguccaggaggagcugcuugccagcccuaagaaacugcucgaagauacccuguuccccuccucuaagaaacuuaagaaggacaaccaggagagcuccgaugcugaacugagcagcuccgaguauauuaaaaccgaccucgaugccauggacaucaaggggcaagaaucuucuuccgaucaggaacagguggacguugagagcaucgauuuuuccaaagaaaauaagauggacaugacaucuccugagcagagcagaaacgugcugcaauucacggaagagaaagaggcuuuuauuuccgaggaggaaaucgccaaguacaugaagcgcggaaaaggcaaguauuacugcaaaauuuguugcugucgggcgaugaagaaaggggccguccugcaccaccucgugaauaagcauaacguccacagccccuacaagugcaccaucugcggaaaggcuuuccugcuugagucucugcucaagaaucauguggccgcucacggccagucccugcugaaauguccgagaugcaacuuugaaagcaauuucccucgcggcuuuaagaaacaucuuacacacugucagucucggcacaacgaggaggccaacaagaaacucauggaagcccuggagcccccucuggaggaacagcaaauuuga

SEQ ID NO: 67389 - RNA, 1893 nt, Artificial Sequence
  derived and/or modified sequence opt5 from CHAT__Homo_sapiens__NP_001136401
auggccgcuaagacccccagcuccgaggaaucuggccugccuaaacucccggugcccccucugcagcaaacacuugccacguaccugcagugcaugagacaccucgucagcgaggaacaguuccggaagucccaggcgaucguucaacaguuuggggcucccggaggccugggggagacccuucagcagaaacugcucgaacgccaagagaagacagccaacugggugucugaguauuggcugaaugacauguaccugaacaauagacucgcccugccugugaacagcucccccgcugucauuuucgcccggcagcauuuuccuggaaccgaugaccagcuucgcuucgcugccucucugaucagcggcgugcucuccuauaaagcgcugcuugauagccacucuauuccgacagacugugccaaggggcagcuguccggacaaccccucugcaugaagcaguacuauggccuguuuagcucuuacagacugccuggccauacccaggauacacucguugcucaaaauuccagcaucaugcccgaaccugagcacgugauugucgccuguugcaaccaguucuuugugcuggacguugugaucaauuuccggcgccuuucugaaggggaucuguuuacccagcucagaaaaaucgucaagauggcuuccaacgaggacgagcggcugcccccgauuggacuucugacgagcgauggccgcuccgaaugggccgaggcgagaaccgugcucgugaaagacucuacaaaucgggauagccuggacaugaucgaacgcuguauuugccuggucugucucgaugccccugggggaguugagcuguccgacacccauagagcccuucagcugcuccacggcgggggauauagcaagaacggcgcuaaucggugguacgacaaaucucugcaauucguggugggccgcgaugggacaugcggagucgugugugaacacucccccuuugacggcaucguucuugugcagugcaccgagcaucugcucaagcacaugacgcagagcucuagaaagcugauucgggcugauagcgucuccgagcugccugcccccagacgccuccgguggaaauguucucccgaaauccaggggcaucuggccagcuccgcugagaaacuucaaagaauugugaagaaccuggacuucaucguuuacaaguuugauaauuauggaaaaacauucaucaagaaacagaagugcagcccugacgcguucauucagguggcccuccagcuggcuuuuuaccgccugcaccggagacuugucccgaccuaugaaucugccuccauccgccgguuccaagagggcagaguggauaacauucgcagcgccacacccgaagcucucgccuuuguccgggcggugaccgaccacaaggcugccguuccugccucugagaaacugcugcuccugaaggaugcuaucagagcccagaccgcuuacacagugauggccauuacggggauggcgaucgacaaucaucuucuggcccuccgcgagcuggcucgggccaugugcaaagaacugcccgagauguucauggaugaaaccuaucuuauguccaacagauuuguccucagcacaucccaggugccuaccacaaccgagauguucuguugcuacggacccguugugccgaacggcuauggcgcuuguuacaauccucagcccgaaacgauccuguuuugcauuucuagcuuccacuccuguaaggagacaucuagcuccaaauuugccaaggcggucgaggaaagccugaucgacaugcgggaccucugcucucugcuuccucccaccgaguccaagccucuggccaccaaagaaaaggcuacacgccccagccaagggcaucagccguga

SEQ ID NO: 67390 - RNA, 429 nt, Artificial Sequence
  derived and/or modified sequence opt5 from CHCHD10__Homo_sapiens__NP_998885
augcccagaggcagccgguccgccgcuucucgcccugccagcagaccggcggcucccuccgcccacccucccgcccauccucccccuucugcugccgcuccggcccccgcgccuagcgggcagcccggacugauggcccaaauggcuaccacagccgcuggcguggccgucggguccgcgguuggacacgugaugggcucugcccucacgggggcuuucagcggaggcuccagcgagccuucucagcccgccgugcagcaggcuccgaccccugccgcuccccaaccucugcagaugggccccugcgccuacgaaauccggcaguuucuugacuguuccacaacccagagcgaucugucucucugcgagggguucuccgaagcgcugaagcaauguaaauauuaccauggacuuagcucucugcccuga

SEQ ID NO: 67391 - RNA, 357 nt, Artificial Sequence
  derived and/or modified sequence opt5 from CHCHD1__Homo_sapiens__NP_976043
auggccacccccagccugagaggccggcucgcucgcuucgggaacccuagaaagccggugcugaaacccaauaagccucuuauccuggccaaccgggucggagagcgcagacgggaaaaaggcgaggcgacaugcauuacggaaauguccguuaugauggcuuguuggaagcagaaugaguuucgcgacgaugccugcagaaaagaaauccaaggguuccucgacugugccgcucgggcccaggaggcucgcaagaugagaucuauucaggagacccugggagaaagcggcucccuucugcccaacaagcucaauaaacugcugcagcgguuuccuaacaagcccuaccucucuuga

SEQ ID NO: 67392 - RNA, 684 nt, Artificial Sequence
  derived and/or modified sequence opt5 from CHCHD3__Homo_sapiens__NP_060282
augggcgggaccacaagcacgagacgggugaccuucgaggccgacgaaaacgagaauaucacagucguuaagggcauucgccuguccgaaaacgugaucgauagaaugaaagagucuagccccuccggaucuaagagccagcgguacuccggggcuuauggagccucugugagcgacgaagaacucaaacgcagagucgcggaggaacuggcucuugagcaagccaagaaagaauccgaggaucagaagcggcugaagcaggccaaagagcucgaccgcgaaagagcugccgcuaaugagcagcugacccgggccauucuucgcgaaagaaucugcagcgaggaggagcgggcgaaggccaaacaccuggcucgccaacucgaggaaaaggauagagugcugaaaaagcaggacgccuuuuacaaggagcagcuggcucggcucgaagagagaucuuccgaguucuaucgcguuacaaccgaacaguaccaaaaagccgcggaggaaguggaggccaaguuuaaacgguaugaaagccauccugucugugcugaucugcaggccaagauucuucagugcuacagagagaacacacaccagacccugaaauguucugcucucgccacgcaauauaugcauugcgugaaucacgccaagcaguccaugcuggaaaaaggcggguga

SEQ ID NO: 67393 - RNA, 333 nt, Artificial Sequence
  derived and/or modified sequence opt5 from CHCHD5__Homo_sapiens__NP_115685
augcaggccgcucuggaggugaccgccagauacugcggccgggaacucgagcaauaugggcagugugucgcggcuaagcccgaaagcuggcagcgcgacugccacuaccugaaaauguccaucgcccaguguacaucuagccauccuauuaucagacaaauucggcaggccugcgcucagccguucgaggccuuugaagagugucuucgccagaacgaggcugccguuggaaauugcgcggaacacaugagacgguuccugcaaugugccgaacaggugcagcccccucgcucccccgcuacgguggaggcccagccucuccccgcuucuuga

SEQ ID NO: 67394 - RNA, 708 nt, Artificial Sequence
  derived and/or modified sequence opt5 from CHCHD6__Homo_sapiens__NP_115719
augggcagcaccgaguccucugaagggagacgggugagcuucggagucgacgaggaggaacgcguuagagugcugcagggcgugcggcucuccgaaaacgucgugaaucgcaugaaggagcccucuagcccuccgcccgccccuacauccucuacguuugggcugcaagauggaaaccuuagagcuccccacaaagagagcacccugccucgguccggcagcucugggggacagcagcccuccggcaugaaggaaggcguuaaacgcuacgagcaggaacaugccgcgauccaagacaaacucuuccagguggcuaaaagagagcgggaggccgccacaaagcacagcaaggcuucucugccuaccggggaaggauccauuagccaugaggaacagaaaucuguccgccuugccagagagcuggaaucccgggaggcugagcuccgcagacgggauacauuuuauaaggaacagcuggagcgcaucgaaagaaagaaugccgagauguacaagcugagcuccgaacaauuccacgaggcggccucuaaaauggagagcaccauuaagccgcggagaguggaacccguuugcuccggccuccaggcucagauccugcauuguuaucgcgaccggccucacgaggugcuucugugcagcgaucucgucaaggccuaccagagaugugugucugcugcccacaaaggguga

SEQ ID NO: 67395 - RNA, 333 nt, Artificial Sequence
  derived and/or modified sequence opt5 from CHCHD7__Homo_sapiens__NP_001011668
augaagugcgaggaaacccacgcccccaacagcaauuggguguacgucaugcugccuuccaaaaagacaguuagaaugccgucugugacgcagcggcuccgcgaccccgauaucaacccuugucugagcgaguccgacgcuucuaccagaugccuugaugaaaauaacuaugaccgggagcgcuguagcacauacuuccugagauauaaaaauugccggcgcuuuuggaacuccauugugaugcaaagacggaagaauggcgucaaacccuucaugccuaccgccgcggaacgcgaugagauccucagagcuguggggaacaugcccuacuga

SEQ ID NO: 67396 - RNA, 5397 nt, Artificial Sequence
  derived and/or modified sequence opt5 from CHD1__Homo_sapiens__XP_005271923
augaacggccacagcgacgaggaauccgugagaaauucuagcggggaguccucucagagcgaugacgauuccggcucugccagcggcuccgggagcggaucuuccagcggaucuuccagcgacgggucuuccagccaauccggaucuagcgauuccgacagcggcucugaauccggcagccagucugagagcgaauccgauaccucucgggagaacaaggugcaggcuaaacccccuaagguugacggggccgaguucuggaaaagcuccccgagcauccuggcggugcagcgcucugcuauucucaagaaacaacagcagcagcaacagcagcagcaacaucaggccuccagcaauucuggauccgaagaggauagcuccucuagcgaagacuccgaugacucuagcuccgaggugaagagaaagaaacacaaggaugaggacuggcagaugagcggcucugggucccccagccaaucuggauccgacagcgaaucugaggaagaacgggagaagucuuccugcgaugagacagagagcgacuacgaaccuaagaacaaagucaagucucgcaagccccagaauagauccaaaagcaagaacggcaaaaagauccuggggcagaaaaagcggcagauugauuccucugaggaagacgaugacgaggaagauuaugacaaugauaaacgcagcuccagacggcaagccacggugaacguuucuuacaaggaggacgaggaaaugaagaccgauagcgacgaccuucuggagguguguggagaagaugucccucagcccgaggaagaggaguuugaaacaaucgagcgcuucauggacugcagaauuggccggaaaggcgcuaccggggccacaaccacaaucuaugcuguggaagccgauggagacccuaaugcgggcuuugagaagaacaaagagccgggggaaauccaguaccucauuaaguggaaaggauggucccauauccacaauaccugggagacggaagagacccugaagcagcaaaacguucgcggcaugaagaaacuugauaauuauaagaaaaaggaccaggaaacaaaaagauggcugaagaacgccucucccgaggauguggaguacuauaauugucagcaggaacucaccgacgaucugcauaagcaauaccagauugucgagcggaucauugcucacagcaaccagaaauccgccgcuggguacccugacuauuacugcaaguggcagggacugcccuauagcgaauguucuugggaggauggcgcccucaucuccaaaaaguuccaagcgugcauugacgaauacuuuagccgcaaccagucuaaaacaaccccuuucaaggauuguaaggugcugaaacagagaccccgguuuguggcccuuaagaaacaaccguccuauaucggcgggcacgagggacuggagcucagagacuaccagcugaauggccuuaacuggcuggcucauagcuggugcaaggggaauagcuguauccucgccgacgaaaugggacugggcaaaacgauucagacaaucuccuuccugaacuaucucuuucacgagcaucagcuguacgggccuuuccuucuggucguuccccucagcacccugacauccuggcaacgcgaaauucagaccugggcuagccagaugaaugccgugguguaccuuggcgauaucaacucucggaauaugauuagaacccacgaguggacacaccaucagacgaagcgccugaaauuuaacauccuccugaccacauaugaaauccugcucaaggacaaggccuuccugggaggccuuaauugggcuuuuauuggggucgaugaggcgcaccggcugaaaaacgacgauagccuccuguacaagacccuuaucgacuucaaauccaaucauagacugcucauuacaggaaccccucugcaaaacucucugaaggagcucuggagccugcuucacuucaucaugcccgaaaaauuuuccucuugggaggauuucgaagaggagcauggcaaggggcgcgaauauggauacgccagccugcacaaggagcucgaacccuuucugcugcggagagugaaaaaggacguugagaaaucccuuccugcuaagguggaacagauucuccgcauggagaugucugcccugcagaaacaguauuacaaguggauccugacgcggaauuauaaggcccucagcaaaggcuccaaggggagcacaucuggcuuccugaacaucaugauggagcuuaaaaagugcuguaaucacugcuaccugauuaaaccgcccgauaacaacgaauuuuacaauaagcaagaggcucuccagcaucugaucagauccagcggaaagcugauucuucucgacaaacugcugauccgccuccgggaaagaggcaaccggguccugauuuucucucagauggugcgcaugcuugauauccuggccgaguaucucaaguacagacaauuuccuuuccagcggcuggacggguccauuaaaggagaacugagaaagcaggcgcuugaucacuuuaaugcugagggcagcgaggacuucugcuuucuccuguccacccgcgccgggggacugggcaucaaccucgccucugcugacaccguugugaucuucgauagcgacuggaauccccagaacgaucugcaagcccaggcucgggcccauagaauugggcagaaaaagcaggucaauaucuaucgccuugugacaaaaggcuccgucgaagaggacauucuggaaagagcgaagaagaaaauggugcucgaucaccugguuauccaacggauggacaccacaggaaagacggugcugcacaccggcagcgccccuucuuccagcacacccuuuaacaaagaggaacuuucugcuauucucaaguucggggccgaggagcuguucaaagaaccggagggagaggaacaggagccucaggaaauggauaucgacgagauccugaagcgcgcugaaacccaugagaaugaacccggcccucucacagucggggaugagcugcuuagccaguuuaagguggccaacuucuccaauauggacgaggaugacauugaacuggagcccgaaagaaacucuaaaaauugggaggaaaucauuccugaggaccaacggcgcagacucgaggaagaggaacggcagaaggagcuggaagagaucuacaugcugccccgcaugagaaacugugcgaaacagauuagcuuuaauggauccgagggccggcgcucuagaagccggagauauuccgggagcgauucugacuccaucagcgaaggcaagcgcccgaaaaagcggggaagaccucgcaccaucccccgggagaacauuaagggcuucuccgaugccgaaaucagacgcuuuauuaaaucuuacaagaaauucgggggaccccuugagcggcuggacgcuaucgccagagaugcugagcucguugacaagagcgaaacggaucugcgccggcucggcgagcuggugcacaacgggugcauuaaagcccuuaaggacuccucuagcggaaccgaaagaacaggcggccggcuggggaaggucaaaggaccuaccuuucgcaucuccggcguccaggugaaugccaagcucguuaucagccaugaggaggaacugauuccgcugcacaaaucuauccccuccgauccugaggaaagaaagcaauauacaauucccugucauaccaaagcugcgcacuucgacaucgauugggggaaggaggacgauagcaaccuucugauuggaaucuacgaauacggcuaugggucuugggagaugauuaagauggacccugaccucucccugacgcacaaaauccuccccgaugacccugauaagaaaccccaggccaagcagcugcaaacacgggcugacuaccuuaucaaacugcucagccgcgaucuggccaagaaagaagcccugucuggagcuggcagcuccaagagacggaaggccagagcgaaaaagaauaaagcuaugaagucuauuaaagucaaggaggagaucaagagcgacuccagcccgcuuccuuccgaaaaaucugaugaggacgaugacaaggaugaaauuagcuccgugaaacaucccaacaagaaaaucaagaccgagcgcgacucugaagagaagccugagcccgauguguauauuaaaaaggaaccggaggaaaaacgggaggccaaggagaaagaaaauaagaaggagcugaaaagagaaaucaaggagaaagaagacaagaaagacaucaaggagaaagauuuuaaggagaagcgcgaaaacaaagucaaggaggccauucagaaagaaaaggacaucaaagaggaaaagcucagcgaguccaagucugauggccgggagagaagcaaaaaguccagcgugucugacgcuccuguucacauuacagccuccggggaacccgugccuaucagcgaggaaucugaggaacuggaucagaaaaccuucuccauuugcaaggagcgcaugcggcccgucaaagcggcucucaagcagcuggacagacccgagaagggacuuagcgaacgcgagcaacuggaacauaccagacagugucugaucaaaaucggcgaucacauuacagagugccucaaggaguacacgaauccugaacagaucaaacaguggcggaagaaccuguggauuuuugugucuaaauucaccgaguuugacgcccgcaaacuucauaagcuguauaaacacgccaucaagaaaagacaagaaucccagcagaauagcgaucagaacuccaaucucaacccgcacguuauucggaaucccgacguggagcgccugaaggaaaacacaaaucaugaugacagcucuagagacagcuacuccucugaucggcaccucacccaauaucaugaccaccacaaagauagacaucagggggacagcuacaagaaauccgauucucgcaagcggccuuacagcuccuucucuaacggaaaggaccacagagauugggaccauuauaaacaggauagccgcuacuauuccgaccgggagaagcacagaaaacuggaugaccaucggagccgcgaucacagaucuaaccuugagggcucccugaaggaccggagccacucugaccaucgcucccacagcgaucauagacugcacuccgaccaccggucuagcuccgaauacacacaucacaaaagcucucgcgauuauagauaccauuccgacuggcaaauggaucaccgggcuagcucuagcgggccccgcuccccucucgaccagagaucucccuauggaagccgguccccuuucgagcauucugucgaacacaagagcaccccggagcacacgugguccagcagaaagacauga

SEQ ID NO: 67397 - RNA, 1506 nt, Artificial Sequence
  derived and/or modified sequence opt5 from CHD2__Homo_sapiens__NP_001036037
augaugagaaacaaggacaaaagccaggaggaagauuccucucugcacagcaaugccuccucucauagcgcuuccgaggaagccucuggcagcgacuccgggagccaaucugaguccgaacagggaagcgaucccggcucugggcacggauccgagagcaacucuuccagcgaguccucugaaagccaguccgagagcgaaucugaguccgcgggcagcaagucucagccugugcucccggaggcuaaagaaaagcccgccagcaaaaaggagcggaucgccgacgucaagaaaaugugggaagaguacccugauguuuauggggugcgcagauccaaucggucucgccaagaacccagcagauucaacauuaaggaggaggcuuccagcggaucugaauccggcagcccuaaacggcgcggccagagacagcugaagaaacaggagaaguggaagcaagaacccucugaggacgaacaggagcaggggaccuccgccgagagcgaaccugagcagaaaaaggugaaagcucggcgcccgguccccagacggacagugccuaagccccgcguuaaaaagcaaccuaaaacgcagagaggaaagcggaagaaacaggauuccucugacgaagaugacgaugacgaugaggcccccaagcgccaaaccagacggagagcggccaaaaaugugagcuacaaggaagacgacgauuuugagacagacuccgaugaccuuaucgagaugaccggcgaaggggucgaugagcagcaggacaacucugaaacaauugagaaagugcuggauagccgccucggaaagaagggcgcuaccggggccuccacaaccguuuaugcuaucgaggccaauggagacccgagcggcgauuucgacacggaaaaagaugagggcgaaauucaguaccugaucaaguggaaaggguggucuuauauccauuccaccugggagagcgaagagucucuucaacagcagaaggugaaaggacugaagaagcucgagaacuuuaaaaagaaagaagacgagauuaagcaguggcugggcaaagucuccccugaagacguggaguacuucaauugccaacaggaacuggcgagcgagcucaacaagcaguaucagaucguggagcgggucauugccguuaagacaucuaaaagcacccuggggcaaacagauuuucccgcucacuccagaaagccugcccccagcaaugaacccgaguaccuuuguaaauggaugggacugccuuacucugaaugcuccugggaggacgaagcucucaucggcaagaaauuccagaacuguauugauagcuuucauucccgcaauaacucuaagaccaucccgacgcgggagugcaaagcccugaagcagagaccccgcuucguggcccuuaagaaacagccugcuuaucucgggggagagaaucuggaacugcgggacuaccaacuggagggccucaacuggcuggcgcacagcugguguaaguga

SEQ ID NO: 67398 - RNA, 6180 nt, Artificial Sequence
  derived and/or modified sequence opt5 from CHD3__Homo_sapiens__NP_001005271
auggccagcccccugagagacgaagaagaggaagaggaagagaugguggucuccgaggaagaggaagaggaggaagaggaaggagaugaggaagaggaggaagagguugaagcugccgacgaggaugacgaagaggaugacgaugagggggugcucggacggggcccugggcacgacagaggacgggaucggcauucuccucccggcugccaccuguucccucccccucccccuccgcccccuccccuuccucccccgccucccccuccgcccccugacaaggaugacaucagacugcucccgagcgcccugggggugaaaaagagaaaacggggacccaagaaacagaaggaaaacaagccuggcaaaccccgcaagcgcaagaagcgggauuccgaggaagaguuuggcucugaacgcgacgaguacagagagaaaagcgaauccgggggaucugaguauggcaccgggccuggacggaagcgcagacggaagcaucgcgagaagaaggagaaaaagaccaaaagacggaagaaaggcgagggggacggaggccagaagcaggucgaacaaaagagcuccgcuacgcuucugcucaccuggggccuggaggauguggaacacguuuucagcgaggaagacuaccauacacugaccaauuauaaagccuuuucucaguucaugagaccccucauugccaagaaaaacccgaagaucccuauguccaaaaugaugacaauucugggggcuaaguggcgcgaguuuagcgccaauaaccccuucaagggaucugcugccgcgguggccgcugccgcugccgcggccgcugccgcugucgccgagcaaguguccgccgcuguuagcucugccaccccuaucgcccccuccggcccucccgcgcuucccccuccgcccgccgccgauauucagccuccgcccauccggagagcuaaaacaaaggaagggaaaggaccuggccacaagcgccggagcaaaucccccagagugccugacgggcgcaagaagcugcggggcaaaaagauggcgccccucaaaaucaagcugggccuucugggcgggaaaagaaagaagggaggcucuuacgucuuucagagcgaugaggggccugaacccgaggcggaagaguccgaccucgauagcggaucugugcacuccgcuagcggccgcccggacgggccugugcggaccaaaaagcugaaaagaggccgccccggacggaagaaaaagaaaguccugggcuguccugccguugccggggaggaagagguggauggauaugaaacggaccaucaggauuacugcgaggugugucaacagggcggggaaauuauccucugcgacaccugucccagagcuuaucaccuggucugccuugacccggagcuggaucgggccccugagggaaaguggucuuguccccauugcgaaaaggagggcgugcagugggaagcuaaagaggaggaagaggaauacgaggaagagggggaggaagagggcgaaaaggaggaagaggacgaucacauggaguacugucgcguuugcaaagacggaggcgaacuccuguguugcgaugccugcauuagcuccuaucacauccauugucuuaauccuccccugcccgacauuccuaacggggaguggcucugcccgagauguacaugccccgugcugaagggacggguccagaaaauccugcacuggagauggggcgaaccucccguggcgguuccugcgccccagcaggcugaugggaauccugacgugccgcccccucgcccccuccagggacggucugagagagaguucuuugucaagugggugggccugagcuacuggcauuguuccugggccaaggagcuucaacuggagauuuuccaccucgucauguaucgcaacuaccagcgcaaaaaugauauggacgaaccucccccgcuggauuaugggagcggcgaggacgauggaaagucugacaaacggaaggugaaagacccucauuacgcugaaauggaggagaaguauuaccgcuuuggcaucaagcccgaauggaugaccguucacagaaucauuaaccacuccguggauaaaaaggggaauuaccauuaucuugucaaauggcgggaccugcccuacgaucagagcacaugggaggaagacgagaugaacauccccgaauaugaggagcacaagcagucuuacuggcgccauagagaacucauuaugggagaggaucccgcccaaccucggaaauauaagaagaaaaagaaagaacugcagggcgacgggccgcccuccagcccuaccaaugaucccacggugaaguacgagacacagccucgcuucaucaccgcgacaggaggcacccugcacauguaucagcucgaagggcugaacuggcuuagauuuuccugggcccaaggcaccgacacaauucuggcugaugagaugggacucggcaaaacgauccagaccaucguuuuccuguacucucuguacaaggaggggcacacaaaaggacccuuccuugugagcgccccgcucuccaccauuaucaauugggaacgggaguuucagaugugggcuccuaaguucuaugucgugacauacaccggcgacaaggauucucgcgccauuaucagagaaaacgaguuuagcuucgaagacaacgccauuaaagggggaaagaaggcuuuuaaaaugaaacgggaggcucaggugaaguuccauguucugcugacguccuaugagcucaucacaaucgaucaagccgcucugggcagcauuagaugggccugccuugucguggacgaagcccaccgccugaagaauaaccagucuaaauuuuuccgggugcucaauggcuacaagaucgaccauaaacugcugcuuaccgggacaccccuccagaacaaucuggaggaacuguuucaccuccugaacuuccuuacaccugagagauuuaauaaccuggagggauuccucgaagaguuugcugauauuuccaaggaagaccagaucaaaaagcugcaugaucugcuuggcccccacaugcuccgccggcugaaggccgacgucuucaaaaauaugccugcgaagaccgagcugauugugagaguugaacucagccccaugcaaaagaaauauuacaaauauauccugacacgcaacuucgaggcucuuaauucuagagggggaggcaaccaggugucccugcucaauauuaugauggaucugaaaaaguguugcaaccacccguaccuguuuccugucgccgccauggagagccccaaacuucccucuggggcuuacgaaggaggcgcccucaucaagagcuccggcaaacugaugcugcuccagaagaugcugagaaaacuuaaggagcaagggcaucgcgugcugaucuucagccagaugacgaagaugcucgaccugcuggaagauuuucuugacuaugagggauacaaauaugaacggauugauggcgggaucaccggagcgcugagacaggaggcuauugaccgguucaaugccccuggcgcccagcaauuuuguuuccuccugucuacacgcgcugggggacucggcaucaaccuggccaccgcugauacaguuauuaucuuugacuccgacuggaacccgcacaaugauauccaggccuucagcagagcgcaucggauuggccaggccaacaaggugaugaucuaccgcuuugucaccagagcuuccguggaggaacggauuacgcagguugccaaaagaaagaugaugcuuacccaccuggugguccgccccgggcucggaucuaaagcuggcagcauguccaagcaagagcuggacgauauccugaaauucgggacagaagaacuuuuuaaggacgaaaaugagggagagaacaaggaagaggauucuagcgugauucauuaugacaaugaagccaucgcccggcugcucgauagaaaccaggacgcuaccgaggauacagacgugcagaauaugaacgaguaccuguccucuuucaaagucgcgcaguauguugugcgcgaagaggauaagaucgaagagauugaacgggagaucauuaaacaagaggaaaauguggacccugauuacugggagaagcuccugagacaccacuacgaacagcagcaagaggaccuugcccgcaaccugggcaaagggaagcgggucagaaaacaggugaauuauaacgacgcugcccaggaagaucaggacaaucaaagcgaguacuccguuggaagcgaggaagaggaugaagacuuugaugagcgccccgaaggcagacggcagucuaaacgccagcucagaaacgagaaggacaaaccucugcccccucugcuugcccgggugggcgggaauaucgagguccugggauucaacacccgccagagaaaggcuuuccucaacgccgugaugcgguggggcaugccgccccaagaugcguuuacgacacaguggcugguuagagaccuccgcgggaaaaccgaaaaggaguucaaggcuuaugugucccuguuuaugcggcaucuuugcgaaccuggagccgauggcagcgagacauucgccgacgggguccccagagagggacugucucgccaacaggugcugacccggauuggcguuaugucccucgugaaaaagaaaguccaagaauuugagcacaucaauggcagauggagcaugccugaacugaugcccgauccgucugcugacuccaagcggagcucccgcgccagcucuccuaccaaaacaagccccacgacccccgaggcguccgcuacaaacucuccuuguaccagcaagcccgccaccccugccccguccgaaaagggggagggaaucagaacaccccuugagaaagaagaggcugaaaaucaggaggaaaagccugagaaaaacucucggauuggcgagaagauggaaacggaggccgaugcucccagcccugcccccucccugggggaacgccucgagccgagaaaaaucccucuggaagacgaggugcccggagugccuggcgagauggaacccgagccuggguaccggggagaccgcgaaaagucugcgacagagagcacccccggcgagagaggcgaagagaaaccgcucgaugggcaggaacaucgggagcgcccugaaggagagaccggcgaccuggggaagagagaggaugucaagggagaccgggaacuuagacccggcccccgcgaugagccucgguccaaugggagacgcgaagagaaaacagaaaagccgcgguucauguuuaacauugccgacggaggcuucaccgagcugcacacacuguggcagaaugaggaaagagcugccaucagcucuggcaaacucaacgagauuuggcaccgccggcaugauuauuggcugcuugcugggaucguucugcacggauacgccagauggcaagacauucagaaugaugcccaguuugcuaucaucaacgaacccuucaagacggaggcgaauaaaggcaacuuucucgaaaugaagaauaaguuccuggcccgccgguucaaacuccuggagcaagcucuugugauugaggaacagcugagacgcgccgccuaucugaaccucucccaggagccugcucaucccgccauggcgcugcacgcucgguuugccgaagccgagugccuugcugagagccaucagcaccugucuaaggaaucccucgccgggaauaaaccugcgaacgccgugcugcacaagguccucaaccaacuggaggaacuucugagcgacaugaaagcugaugugaccagacugcccgccacacucucccgcaucccucccauugcugccagacugcagaugucugagcggagcauccuuucccgccuggcuagcaagggaaccgaaccgcauccuacacccgccuacccucccggcccguacgcgaccccucccggguauggcgccgcuuucucugccgcucccguuggagcccucgccgcugcgggcgccaauuacucccagaugccugcugggagcuuuauuacggccgccaccaacggacccccugugcuggucaagaaagagaaggagauggugggcgcucugguuucugacgggcucgacagaaaagaaccgcgggccggagaggugaucugcaucgaugacuga

SEQ ID NO: 67399 - RNA, 5718 nt, Artificial Sequence
  derived and/or modified sequence opt5 from CHD4__Homo_sapiens__NP_001284482
auggccagcggccuggggucccccucuccuugcagcgcuggauccgaggaagaggacauggaugcccuccugaacaauucucuucccccuccccaccccgaaaacgaggaagacccugaggaggaucugagcgaaaccgagacccccaagcucaaaaagaaaaagaaaccuaagaagccgagagaccccaaaaucccuaaguccaaacggcagaagaaagaacugggcgauucuagcggggagggacccgaguucguggaagaggaagaggaaguugcgcuuagauccgacagcgagggcucugauuacacgccugggaagaagaaaaagaaaaagcugggacccaaaaaggagaaaaaguccaagagcaaaagaaaggaagaggaagaggaagaggacgaugacgaugacucuaaagagccgaaguccagcgcucagcuccuggaagauuggggcauggaggacauugaccacgucuuuucugaagaggauuaucggacccugacaaauuacaaagccuucucccaguuugugcgcccucucaucgccgcuaagaaccccaagauugccgugagcaaaaugaugaugguccugggcgcuaaguggagagaguucuccaccaauaacccuuuuaaagggucuagcggagccuccguggccgccgcugccgcugccgcgguugccguggucgagagcauggugacagcuaccgagguugcgccgcccccuccgcccguggaagucccuauccggaaggcuaaaacaaaggagggcaaggggcccaaugcccgcagaaaaccuaagggaucuccccgggugccggacgccaaaaagccuaaacccaagaagguggcuccucuuaaaauuaagcugggcggguucggauccaaacgcaagagaagcucuagcgaagaugacgaucucgacgucgaguccgauuuugacgaugcgucuaucaacagcuauuccguuagcgacggcucuaccucccggagcucucgcucccgcaagaagcugcggacgaccaaaaagaagaaaaagggcgaggaagaggugacagccguggauggguacgaaaccgaccaccaggacuauugugaggucugccagcaaggaggcgaaaucauucuuugugauacaugcccccgcgcuuaccauauggugugucuggacccugauauggagaaagcccccgaggggaaguggagcugcccgcacugugaaaaagagggaauccagugggaagccaaggaggacaauuccgaaggcgaggagauucucgaagagguugggggagaucuggaagaggaagacgaucaucacauggaguucugcagaguguguaaggacggcggcgagcugcucugcugugauaccugcccuucuagcuaucacauccauugccugaacccuccccuucccgaaauuccgaauggggaguggcuguguccccggugcacguguccugcucucaaaggaaagguccagaaaauccugauuuggaaguggggccagcccccuucccccacaccugugcccagaccgccugacgccgaucccaacaccccuucucccaaaccgcuugaagggcgcccugagcggcaauuuuucguuaaguggcagggaaugagcuacuggcacugcuccugggugagcgagcugcagcucgaacugcauugucaggucauguuuagaaauuaccaacgcaagaacgacauggaugagcccccuucuggcgacuucgggggcgacgaagagaaaucccggaagcgcaaaaauaaggaucccaaauuugcggaaauggaggagcgcuucuaucgguacggaaucaagcccgaauggaugaugauccacagaauccugaaccacagcguggacaagaaaggccauguccacuaucucaucaaguggcgcgaucugccuuacgaccaggcuucuugggaguccgaagauguggagauucaggacuaugaucuuuucaaacaaagcuacuggaaccaucgggaacugaugagaggggaggagggacgcccgggcaagaaacucaagaaaguuaagcugcggaaacuugaaagacccccugagacacccaccguggacccuaccgucaaauaugaacggcagcccgaguaccuggaugccacagggggaacgcuccacccuuaccagauggaaggccugaauuggcugcgcuuuucuugggcccaggggaccgacacaauccucgcugaugagaugggccugggaaagaccgugcaaacagccguuuuccuuuauagccuguacaaagagggccauuccaaggggccguuucucgugagcgcuccccugucuaccauuaucaacugggaaagagaguucgaaaugugggccccugacauguaugucgugacguacgugggagauaaagacucccgggcgaucauuagagagaaugaguuuagcuucgaagacaacgccauccgcggcgggaagaaggcuucccggaugaaaaaggaggccucuguuaaauuucacguccugcuuacaagcuaugaacucauuaccaucgauauggcuauucugggauccaucgacugggccugccugaucguggaugaggcgcacagacucaagaauaaccagucuaaauucuuucgcgugcugaauggcuacagccuucagcauaagcugcuccugaccgggacaccccugcagaacaaucuugaagaacucuuccaucugcugaacuuucucaccccugagagauuccauaaucuggaaggcuuucuugaggaguucgccgacauugcuaaggaggaucaaaucaaaaagcugcacgacaugcucggaccccacaugcugcggcgccugaaagccgaugucuucaagaacaugccguccaaaacagaacuuauugugagaguugagcucucuccuaugcagaagaaguauuacaaauacauccugacgcggaauuuugaggcucugaacgcccgcggcgggggaaaucaggugagccuccugaacgucgugauggaccuuaagaaauguugcaaccaucccuaucuguuccccguugccgcuauggaagcgccuaagaugcccaauggcauguacgauggguccgcccucauuagagcuagcggaaaacugcugcuucuccagaagaugcugaagaaccugaaagagggcgggcaccgggugcucaucuuuucucaaaugaccaagaugcuggaccuucuggaagauuuccucgagcaugaaggcuauaaauacgagcgcauugacggaggcaucacagggaauaugagacaggaggccaucgaccgguuuaacgccccuggagcucagcaguucuguuuucugcuguccacccgcgccggcgggcuuggaauuaaucuggcgacagcugauaccgucaucauuuaugacagcgauuggaacccgcacaaugacauccaagccuucucuagagcccaucggauuggccagaacaagaaagugaugaucuacagauuuguuacgcgcgcuuccguggaagaacggaucacccaggucgccaagaaaaagaugaugcucacacaccugguggugagacccggccucgggagcaagaccggaucuauguccaaacaagaacuggaugacauucuuaaguucggcacagaggagcuguuuaaagaugaagcgaccgacgggggaggcgauaauaaggagggggaagacagcuccgucauccacuaugaugacaaagcuauugagcgccuccuggaucggaaccaggacgaaacggaggacacagagcugcagggaaugaaugaauaccuuagcucuuucaagguugcccaguacguggugagagaggaagagaugggcgaagaggaggaagucgagcgcgaaaucauuaagcaagaggaaagcguggauccugacuauugggagaaacugcuccggcaucacuacgagcagcagcaggaagaucuggccagaaaccucggcaaggggaaacgcauccggaagcaaguuaauuauaacgacggaucccaggaggauagagacuggcaggaugaccagucugauaaucaaagcgacuacuccguggcuucugaagagggcgaugaggacuuugaugaacggagcgaggcccccagaagaccuucccggaaagggcugcgcaacgacaaggacaagccccuuccgccucugcucgcuagagucggaggcaacaucgaagugcugggguucaaugcccggcagagaaaagcguuccugaacgccauuaugcgcuauggaaugcccccucaggaugcuuuuaccacacaauggcuuguucgggaccugagaggcaagucugagaaagaguucaaggccuacgugagccucuuuaugcgccaucugugcgagcccggcgcugauggggccgagaccuucgccgacggagucccucgggaaggccucuccagacagcacgugcugacccgcaucgggguuaugagccuuauucggaaaaaggugcaggaguuugaacaugucaauggaagauggucuaugcccgagcuggcugaaguggaggagaacaagaaaaugucccagccgggcagcccuucucccaagacacccacgccuuccaccccgggggauacacaacccaauaccccugcgcccgugccucccgccgaagacggaaucaaaauugaggaaaacagccugaaggaggaagaguccaucgagggcgaaaaagaggucaagucuacagcuccugaaaccgccaucgaguguacgcaggccccggcucccgccagcgaggaugaaaaaguugugguggagccucccgaaggcgaggaaaaggucgagaaggcggaggugaaagaacgcacagaggaaccuauggagaccgaacccaagggggcugccgacguugagaaaguggaggaaaaguccgccauugaucucaccccgaucgucguggaggacaaagaagagaagaaggaagaggaggagaaaaaggagguuaugcugcagaauggagaaacaccuaaagaucuuaacgacgagaagcagaaaaagaauauuaagcaaagauucauguuuaacaucgcugacggcggguucaccgagcugcacagccucuggcagaaugaagaacgggccgcgacagugacgaaaaagaccuaugaaauuuggcaccgcagacaugauuacuggcugcucgcuggaaucauuaaccacggcuacgcccgguggcaggacauccagaaugauccccgcuaugccauccugaacgagcccuuuaaaggggaaaugaauagaggaaacuuccuugagauuaagaacaaauuucuggcucggagauucaagcugcucgagcaagcccuggucaucgaagaacagcuucgccgggcugccuaccugaauaugucugaagacccuucccaucccagcauggcgcucaacacaagauucgccgagguggaaugccuggcugagucucaccagcaccucagcaaggaguccauggccggcaauaaaccugcuaacgccguccugcauaaggugcuuaaacagcuggaggaacugcucucugauaugaaggccgacguuacccgccugccggcuacaauugcgcggauucccccuguggccgucagacuucaaaugagcgaacggaauauucugucccgccucgcuaacagagcccccgagccuacaccccaacagguggcccaacagcaguga

SEQ ID NO: 67400 - RNA, 8148 nt, Artificial Sequence
  derived and/or modified sequence opt5 from CHD6__Homo_sapiens__NP_115597
augaagaugaaaauccagaagaaagaaaagcaacugagcaaccucaaagugcugaaucacucccccaugucugacgccagcgucaacuucgauuacaaguccccuucuccguuugacugcagcaccgaucaggaagagaagauugaagacguugcuucccauugucuuccccagaaagaucuguauacggccgaggaagaggcggcuacacucuucccuagaaagaugaccucucacaauggaauggaggacagcgggggaggagggacaggagugaaaaagaaacggaagaagaaagaacccggcgaucaggagggggccgccaagggauccaaagaccgcgaaccuaagcccaaaagaaagcgggagccuaaagagccgaaggaaccccgcaaggcuaaagagccuaagaaagccaaggaacauaaagagcccaagcaaaaggauggcgcuaaaaaggccagaaaaccucgggaagcgagcggcaccaaggaggccaaagagaagcgcucuugcacagacuccgcugccagaaccaagagccggaaggcuucuaaggaacaggggcccacaccgguggagaaaaagaaaaagggaaagcgcaaauccgaaaccacggucgagagccuggaacuugaucagggccugaccaacccuucucucagaucccccgaggagagcacagaauccaccgacucucagaagcggcgcagcgggagacaagugaaacggcgcaaguacaaugaggaucuggacuuuaaaguuguggacgaugacggagaaacaaucgccguccugggcgcggggagaaccuccgcccucagcgcuucuacgcuggccuggcaggcugaggaaccucccgaggaugacgccaacauuaucgagaagauucuugccuccaaaacagugcaggaaguucaccccggagagccuccguucgaucuggaacucuuuuaugugaaguaccggaauuucagcuaucugcauuguaagugggcuaccauggaggagcuugaaaaagaccccagaaucgcgcagaagaucaaacgcuuucggaacaagcaagcccagaugaaacacauuuucacagagccugaugaagaccuguuuaaucccgauuacgucgagguggacagaauccucgaaguggcucacaccaaggaugccgagaccggcgaggaagucacacauuaucugguuaaguggugcucucugccuuacgaggaaagcacgugggagcucgaagaggacguggaccccgccaaagugaaggaguucgaaucccugcagguccuuccggagauuaaacacguggaacgcccugcuucugauagcuggcaaaagcuggagaaaucccgggaauacaagaacagcaaucagcucagagaguaucagcuggagggcaugaacuggcuucuguuuaauugguacaaccgcaagaauuguauccucgccgacgaaauggggcugggaaaaaccauucagucuaucacauuccuguccgagauuuuucuccggggcauccaugggcccuuccugaucauugcgccucuuagcaccaucacaaacugggaaagagaguuccgcaccuggacggagaugaacgcuauuguuuaucacggaucucaaaucucccggcagaugauucagcaguacgaaaugguguauagagaugcccaaggcaauccccugagcggggucuuuaaguuccacgugguuaucacaaccuuugagaugauccucgccgacugcccugaacugaaaaagauucauugguccugugugaucauugaugaggcucaccgccuuaaaaaccggaauugcaagcugcucgaaggacugaagcugauggcccucgagcauaaaguccugcuuaccggcacaccccugcagaacucuguggaggaacucuucagccugcugaauuuucuugagccgucccaguucccuucugaaaccgcuuuucucgaggaguucggcgaccugaagacagaggagcaggucaaaaagcugcaaagcauccucaaacccaugaugcugagacggcuuaaggaugacguggagaaaaaccuggcccccaagcaggagacgauuaucgaaguugagcucaccaauauccagaagaaauacuaucgcgcgauucuggaaaagaacuuuuccuuccugacaaaaggggccaaucagcacaacaugccuaaucuuaucaacaccaugauggagcucagaaaguguugcaaucauccguaccugauuaacggagcugaggagaaaauccuggaggauuuucggaagacacacagccccgacgccccugauuuccaacuccaggcuaugauucaggccgcgggcaagcuggugcuuaucgacaaacugcuccccaagcugauugccgggggacacaaaguccugaucuuuucucaaauggugagaugucuugauauccucgaagacuaccugauucagcgccgguauaccuacgagagaaucgacggccgcguuagagggaaucugcggcaggcugccauugaucgcuucugcaagccugacuccgauagauucguguuucuccugugcacgcgggcuggcggacuuggcaucaaccugaccgccgccgacacauguauuaucuucgauagcgacuggaacccccagaaugaucuccaagcucaggcgcgcugccauagaaucgggcagucuaaagccgucaagguguaucggcugauuacccgcaacuccuacgagagagaaauguuugacaaggcuagccugaaacuuggacucgauaaggccgugcugcaggacaucaaucggaaaggcgggacaaacggaguucaacagcugucuaagauggaggucgaagaucuccugcgcaaaggcgccuauggggcucuuauggacgaggaagaugagggcagcaaguucugugaggaagacauugaccagauccugcagagacggacccacacgauuacaauccaauccgagggaaagggcagcaccuuugccaaagcgucuuucguggcuuccgggaauagaacagauaucagccucgacgauccuaacuuuuggcagaagugggccaaaauugccgaacuggacaccgaggcuaagaaugaaaaagagucccuggugaucgaucgcccccgggucagaaagcagaccaagcauuacaacucuuucgaggaagacgagcuuauggaauuuagcgagcuggauuccgacucugaugaacgcccgacacggagcagacgccucaaugacaaagcccggagauaucugcgcgcggagugcuuccggguggagaagaaccuccugauuuuuggauggggcagauggaaagauauccuuacgcacgggcgguucaaguggcaccugaaugaaaaagacauggagaugauuugucgcgcucuccugguuuacugcgugaagcauuacaaaggagacgaaaagaucaaguccuuuaucugggagcugauuaccccuacaaaagauggccaagcccagacccuucagaaccacucugggcugagcgcccccgucccuagaggccggaagggcaagaaaaccaaaaaucagcuccugauccccgagcucaaagacgcugauuggcuggccaccuguaacccggaagugguucuucaugacgauggcuauaagaaacaccugaagcaacauugcaauaaagugcuccugcgcgucagaaugcuguacuaucuuaaggcugagauucugggggaagccgcggagaaagccuucgaaggauccccugcucgggagcucgacgugccccugccugauaucgacuacauggagauucccguugauuggugggacgccgaagcugauaagagccuccugaucggcguguucaagcacggguaugagagauacaacgccaugcgcgccgaccccgcucuuuguuuucuggaaaaagucggaaugccugaugagaagucucuguccgcggaacagggcgugacggacgggacaagcgacauuccggagcggggcaacaccgauaaagaggacaaugccgaagauaagguggacggacuccagaaacagaccgagucuuccagcgauggcggggacggagucuucucugaaaagaaggaugacuccagagcugcccaagauggcagcgaccccgauaaauccccuuggcccguuagcucugcccugacagcucgccuucggagacuggugaccguguaucagcgcugcaaccggaaggagcucuguagaccugaaauccuggggcccggaaaucagggcuacuggguccaggaggagauguuucgcagaacaagcgaaauggaccucaucaacaaagaggcccaaaagcgguggacgcgcagagaacaggcggauuucuaccggaccguguccucuuuuggcguuguguaugaccaggagaaaaagacauucgacuggacccaguuucgcauuaucagcagacuggauaaaaaguccgacgagucucuugaacaauacuucuauagcuuugucgcuaugugccggaaugugugcagacugccuacauggaaggaugggggaccgcccgacaccacgauuuacguugagccuaucaccgaagaacgcgccgcccggacacuguauagaauugaacuccugcgcaaagugcgggagcagguccuuaaguguccccagcugcacgagagacuccaacugugccggccuucccucuaccugcccguguggugggaauguggcaaacaugaucgcgaccuucugaucgggaccgcuaagcacggacugaacagaacagauugcuauaucaugaaugacccgcagcucucuuuccuggaugccuaccggaacuacgcgcagcauaaacgcagcggcacccaggcuccugggaaucuuuguugccuguaucaaacaaacuccaagcucuacgagagccugaccuauucucagauguccagaacgagcgaaucucucgagaaugaacccgagaaccugguucggguggagucccgcgacgaucaccuuagccugcccgacgucacaugugaaaauuuuauuuccaaggugcaggacgugaucucuauuaaccaugaugagagccugcucccugaaucccuggagagcaugauguacggcaaaaagguccuuucucaggaacccuccagcuuccaagagucuccuagcaccaauaccgaguccagaaaagacguuaucacaauuucuaucagcaaggauggcaacugccaguccggcgggccggaagccgagaucgccucuggacccaccuucaugggcagccuggaagcugggggaguggcccaggcuaacauuaaaaauggcaagcaccuccugauguccaucagcaaggagggggagcuguguugcucugaagccggacagcggccugagaacauuggccaacucgaagcgaaaugucuugccucccccagccugaauccuggcaacgaguccggguuuguggacaugugcucucugagcgucugcgauuccaagcgcaaucucucuagcgaccagcagcugaucgaucuucuggaaaacaaaucccucgagagcaagcugauucugucucaaaaucacuccgacgaggaagaggaagaggaagagaacgaggaagagaaucucgcuauggccgugggaaugggcgaaagacccgagguucuucaucugacggaaccgacaaccaacaucagccgggagaaaaaucagggguuccaggaugagacaaagaagggaucucuggaaguggcuaaccagaccccuggccuccaaagagccuuucccgccccugcugcgugucagugccacuguaaacauauggagcgcuggaugcacgggcuggaaaaugacgaguucgagauugaaaagcccaaagccuauaucccugaucuuuuuaaguccaaaacaaacaccaucgcuauggagggagaacccacggccauuccgagccagccuuucaaggucaaacacgagcugcucaaggaacccuggaaggagucugccgagggccagaauguguuucccaccuacccucuggaaggcagcgagcugaaauccgaagacauggauuucgagaacaaggacgacuaugaucgggacgggaauugccauucucaagauuacccgggaaaauacagcgaagaggaguccaagagcuccacaucuggcaucaccggggacauuggagaugaacuccaggaggcuagagcccccacaaucgcgcagcuucugcaggagaaaacacuguauagcuuuuccgaauggccuaaggaccgcguuauuaucaaccggcucgauaacaucugucacgugguccugaagggcaaauggcccucuagccaacaguacgaaccuuccgggacgcuucccacaccugugcugaccucuagcgcuggauccagaacaagccucucugagccggaggccgccgaacauuccuucagcaauggcgcugcccuggcggcccagauucacaaggagucuuuucuggcucccgucuucaccaaagacgaacagaagcaucgccggccuuaugaguuugagguggaaagagaugccaaagcucgcggccucgagcaauucuccgccacccacgggcacacacccaucauucuuaacggauggcauggcgaaagcgcuauggaccugucuugcuccagcgagggguccccuggagccacgagccccuucccgguuucugcgagcaccccuaagaucggcgccauuuccucucugcagggggcucucggaauggaucugagcggcauccuucaggccggccugauccaccccgugacagggcaaauugucaauggaucccuccggagagacgacgcugccacccgccggagacgcggcagacggaagcauguggaagggggaauggaucugaucuuucugaaagagcagacacuccaggccggcauucuugagguucacgaagaccccgggcaggcuacccugucuacgacacacccugagggacccggcccugcgaccagcgccccggaacccgcuaccgccgccuccucucaagcugaaaagagcaucccuuccaaaagccugcucgauuggcugcgccagcaggccgacuacucucuugaagugcccggcuucggggcgaacuuuuccgauaagccuaaacagagacggcccagauguaaggagccgggaaagcuggacgucagcucucucuccggcgaggaacgggugccugccauucccaaagagccugggcugcgcggauuccugcccgaaaauaaguuuaaccauacacucgcugagccuauccuuagagauaccggcccccggcgcagagggcggcgcccgagaagcgaacugcugaaagccccuuccauuguggcugacucucccagcggcaugggaccccucuucaugaauggccugaucgccgggauggaucuuguuggacugcaaaacaugcggaauaugccuggcaucccgcucacagggcuggucggauuucccgcgggcuucgccacgaugccuaccggggaggaggugaaguccacacugagcaugcuccccaugaugcuuccuggcauggcugccgugccccagauguuuggagucggcgggcugcugucuccucccauggcuaccacaugcaccuccacggccccggcuagccucucuagcaccacaaaauccggaaccgccgugacagaaaagaccgcggaggacaagccuucuagccacgauguuaaaacagacacgcuggccgaagauaagcccggcccugggcccuucuccgaccagucugagccggcuauuaccacaagcuccccuguggccuuuaaccccuuccuuauccccggagucagcccuggccugauuuaucccucuauguuucucuccccugggaugggcauggcucugccggccaugcagcaagcccgccauagcgagaucgugggacuggaaucccagaaaagaaagaaaaagaaaaccaagggcgacaaucccaacucucacccugagcccgcgccuagcugugaacgggagcccuccggggaugaaaauugcgcugagccuucugccccgcuccccgcugagcgcgaacauggagcccaggccggcgagggggcucuuaaggacagcaacaaugauaccaacuga

SEQ ID NO: 67401 - RNA, 8994 nt, Artificial Sequence
  derived and/or modified sequence opt5 from CHD7__Homo_sapiens__NP_060250
auggcggaccccggaaugaugagccuguucggggaagauggaaacaucuuuuccgaaggacucgaggggcugggagaaugcggcuacccugagaaucccgugaaccccauggggcagcaaaugccuauugaccagggauucgcuucucuucagcccagccugcaccauccuuccaccaaucagaaccaaacaaagcucacgcacuuugaucauuauaaucaguacgaacagcagaaaaugcaccugauggaccaacccaacagaaugaugucuaauaccccuggcaacggccuugccagcccccauucccaguaucacacacccccugucccccagguuccucacgggggaucuggcgggggacagaugggcguguaccccgggaugcaaaaugagcggcauggacagagcuucguggauuccagcucuauguggggcccgagagcgguccaggugccugaccaaaucagagcucccuaucagcagcagcaaccucagccccagcccccucagccggcccccuccggcccucccgcccaagggcacccucagcauaugcagcagaugggaagcuacauggcucggggcgauuuuucuaugcaacagcacgggcagccccagcaacgcaugucccaguucagccagggacaagagggccugaaccaggggaauccguuuauugccaccucuggaccuggccaccucucccauguuccccagcagagcccuuccauggcucccucucugagacacagcgugcaacaguuccaucaccauccuuccacagcccugcacggcgaaagcgucgcgcacucuccccgguuuuccccgaacccuccccagcagggggccgugcgcccccaaacccucaauuucagcucuagaagccagacaguuccuuccccgaccaucaacaauucuggacaguauagccgguaccccuacuccaaccugaaccagggccuugugaauaacacggggaugaaucaaaaccugggacucaccaauaacacaccuaugaaucagagcgucccccgcuauccuaacgcugugggcuuucccucuaauuccgggcagggccugaugcaucaacagccuauucaccccagcggaucucuuaaccagaugaauacccagacaaugcauccgucccaaccucagggcaccuacgccucucccccucccauguccccgaugaaggcuauguccaacccugccgggacgcccccuccccaggugagacccggaagcgcgggcaucccuauggaggucggguccuauccgaauaugccccacccucagcccucucaccaaccucccggagccaugggcaucgggcagcggaacaugggcccucgcaauaugcagcagagcagaccguucauuggaauguccagcgcuccccgggaacugacaggccauaugcgcccuaacgggugccccggaguuggccucggggacccucaagccauccaggagagacugauucccggacagcagcacccgggccaacagccuucuuuucagcaacugccgaccugucccccucuccagccccauccugggcugcaccaucaguccagcccgccccacccucaccaucagcccugggcucaacuucacccuucuccccagaacacaccgcagaaagugccugugcaucagcacucccccagcgagccuuuccuggaaaagcccgucccugauaugacccaagugucuggccccaaugcccagcucguuaaaagcgacgauuaccugccguccaucgagcagcagccucaacagaagaagaaaaagaaaaagaacaaucauauuguggccgaagaccccagcaaaggauucggcaaggaugacuuucccgggggagucgacaaccaggagcuuaaucggaacucucuggauggcucccaagaagagaagaaaaagaaaaagagaagcaaagcuaagaaagacccuaaggagccgaaggaacccaaagagaagaaagaaccuaaggagcccaaaaccccuaaggcgcccaagaucccuaaagaaccgaaggagaaaaaggccaaaacagcuacgcccaagccuaaguccucuaaaaagagcuccaauaaaaagcccgauucugaggccagcgcccucaaaaagaaggugaacaaagggaagaccgaaggauccgaaaauucugaccuggauaaaacaccucccccgagcccuccgcccgaagaggacgaagauccuggcguucagaagcgccgguccagcagacaggugaaacgcaagcgguauaccgaggaccuggaguucaaaauuucugaugaagaggcugacgaugccgacgcggcugggagagacucccccagcaacacaucucaguccgaacaacaggagagcgucgaugccgagggcccuguggucgaaaagaucaugucuucccgcagcgugaagaaacagaaggaguccggagaagagguugaaaucgaggaguuuuacgugaaauauaagaauuucagcuaccuccacugucagugggccucuauugaagaccuggagaaagauaagcggauccaacagaagauuaaaagauuuaaggcuaaacagggccagaacaaguuccuuagcgaaaucgaggacgaacuguuuaauccggauuacgucgagguggaccgcauuauggauuucgcccgguccaccgacgauagaggggagcccguuacgcacuaucucgugaaauggugcucucugccuuacgaagacagcacaugggagcgccggcaagauaucgaccaggcuaagaucgaagaguuugaaaaacuuauguccagagagcccgagaccgaacgggucgagcgcccucccgccgaugacuggaaaaagucugaaagcuccagagaguauaaaaacaauaacaagcugcgggaguaccagcucgaaggagugaacuggcugcuguucaauugguauaacaugagaaauuguauucucgcggacgagaugggccuggggaaaaccauccagucuauuacauuucuuuacgaaaucuaucugaagggcauucauggcccguuccucgugaucgccccucugagcaccauccccaacugggagcgcgaauuucggacauggacggagcugaauguugucguguaccacggcucccaagcuagcagacgcaccauucagcuuuacgagauguauuucaaggauccucaggggagagugaucaaaggaucuuacaaguuccaugccauuaucacaaccuuugaaaugauucucacagacugccccgagcugcggaacaucccuuggcgcugugucgugauugaugaagcucacagacugaaaaaucggaacugcaagcuccuggagggccuuaaaaugauggaccuggaacacaagguucuccugaccgggacgccccugcaaaauaccguggaggagcuuuucucccuccugcauuuucuggaaccgagccgcuucccuucugagacaaccuuuaugcaggaguucggagaucucaaaacagaggaacagguccagaagcugcaagccauccuuaagcccaugaugcugagacggcucaaagaggacguggagaagaaccuggcgcccaaagaagagaccaucauugaaguugagcugacgaauauccagaagaaauauuaccgcgccauucuugagaagaacuuuacauuccucuccaagggcgggggacaggcuaaugugccuaaccugcugaauaccaugauggaacucagaaaauguugcaaccacccguaucugaucaacggcgccgaggaaaagauucuugaggaauuuaaagagacacauaaugcugagagccccgauuuccagcugcaagccaugauccaggccgcuggcaagcucguccugaucgacaaacugcuuccuaagcucaaggccgggggacaccgggugcugauuuuuagccagaugguucgcugucuggauauccucgaagacuaccugauucagagacgguaucccuacgagagaaucgauggccgcgugcgggggaaccuuagacaagccgcuauugaccgcuucucuaaaccugauagcgaccgguuugucuuccugcucugcaccagagccggaggccuggggaucaaucugaccgccgcugacacaugcaucauuuucgauuccgacuggaacccccagaaugaucuucaggcccaagcgcgcugucaucggaucggacagagcaagucugugaaaauuuacagacugaucacgcgcaacuccuaugaacgggagauguuugacaaggcuagccucaaacugggccucgauaaggccgugcugcagucuaugagcggcagagaaaaugccaccaacgggguccagcaacuuuccaagaaagagauugaggaccugcuccggaagggagcuuacggcgcccugauggaugaagaggacgaagggucuaaauucugcgaggaagauaucgaccagauccugcuucgcagaacacacaccauuacaaucgagagcgagggaaagggcuccaccuuugcgaaggcuucuuucguugccagcgggaaucggacggauauuucccuggacgacccuaacuuuuggcagaagugggccaagaaagcugaacucgauaucgacgcccugaauggacgcaacaaucucgugauugauacacccagagugcggaagcagaccagacuguauagcgcugucaaagaggacgaacuuauggaguucucugaucuggaguccgacagcgaagagaagccgugugccaaaccucgccggccccaagauaagucccagggcuacgcgagaucugaaugcuuucgcguggagaaaaaccuccugguuuauggcugggggcgguggaccgacauccugagccacggaagauacaagcgccagcuuacagaacaggauguggagaccauuugucggacaauccuggucuauugccucaaucauuacaagggcgacgagaacaucaaauccuucauuugggaucugaucacgccuaccgccgacgggcaaacaagagcucucgugaaucacucuggacugagcgcccccguuccgcgcggcagaaaggggaaaaaggugaaagcucaguccacccagccugucgugcaagaugccgacuggcuugccagcuguaaccccgacgcucuguuucaggaagauucuuacaagaagcaucugaaacaccacugcaacaagguucuccugcgggugcgcaugcuuuauuaccugagacaggaggucauuggagaccaggcggauaaaauccucgaaggcgccgacuccagcgaggcugauguguggauucccgaaccuuuccaugccgaggugcccgccgacuggugggauaaggaggcugacaaaucucugcucaucggcgucuuuaagcacggguaugaaaaguacaauuccaugcgggccgauccugcgcuguguuuccuugagcgcguuggaaugccggacgcuaaagccaucgccgcugaacaaagaggcacagauaugcuggccgacgggggagauggcggggaguucgaccgggaagacgaggaucccgaguauaagccuaccagaacgcccuuuaaagacgaaauugaugaguucgcgaacagcccuucugaagacaaggaggagagcauggaaauccaugcuaccggaaaacacuccgagucuaaugccgaacugggccagcucuacuggcccaacacaagcacccugacaacccgccuucggagacugauuacagccuaucagcgcuccuacaagcggcagcaaaugagacaggaggcucucaugaagaccgaucggcgcagacggcgcccuagagaagaggugcgggcccuggaggcugaacgcgaggccaucauuagcgagaaaagacagaaguggacgcggcgcgaggaagcggacuuuuacagaguggucuccacauucggcgugaucuuugauccgguuaaacagcaauucgacuggaaucaguuucgggccuucgcuagacucgauaagaaaucugacgagagccuggagaaguauuuuuccugcuucguggccaugugucgccgggucugcagaaugcccgugaaaccugaugacgaacccccugaccuuucuagcaucauugagcccaucaccgaagaaagagcuucccggacccuguacagaauugaacugcuccgcaagauccgggagcagguucugcaucacccgcagcuuggggagagacugaagcucugccaaccuucucuggaucuccccgaauggugggaguguggacgccacgaccgggaucugcuugugggcgccgccaaacauggggucagcagaacagacuaucacauucugaacgaucccgaacuguccuuucucgacgcucauaagaauuucgcgcagaaccgcggagccggcaauaccagcucucugaacccucuugcugugggguuuguccagacgcccccugugaucuccagcgcccacauucaagaugagcggguucuggagcaggccgaaggaaaaguggaggaaccggagaaucccgcugccaaggaaaaaugcgagggcaaggaggaagaggaagagacagacggcucugggaaggaauccaaacaggagugugaggcggaagcuagcucugucaagaacgagcucaaaggaguggaaguuggcgccgauaccggguccaagagcaucuccgagaaaggaagcgaagaggacgaggaagagaagcuggaagaugacgauaagucugaggagagcucccagccugaagccggcgcugugucuagagggaaaaauuucgacgaggaaagcaacgccuccaugucuacagcgcgcgacgagaccagagauggcuucuacauggaagacggagaucccagcgucgcccaacugcuccacgagcggacauuugcuuucuccuuuuggccuaaggaccgcgugaugaucaauagacuugauaacauuugcgaggccgugcugaaaggcaaguggcccguuaaccggagacagauguucgacuuucaggggcugaucccgggauauaccccuacgaccgucgauucuccccuccagaaacggagcuucgcugaacuguccauggugggccaagccagcauuucuggguccgaggacaucacaaccagcccucagcuuucuaaggaagaugcucugaaucucuccgugccccgccagagacggcgcagacggcgcaagauugagaucgaagccgagagagcggccaaacggcgcaaccugauggagauggucgcucagcugagagaaagccaagugguuuccgagaauggacaggaaaagguggucgaccucucuaaagccagccgggaggcuacauccagcaccucuaacuuuuccagccuuucuagcaaguucauccugccgaauguguccacgccuguuucugaugccuuuaaaacacagauggaacugcuccaagccggccugagccgcacccccacaagacaucuucugaacgggucccucguggacggcgagcccccuaugaagcggcgcagaggacggcgcaaaaaugucgagggccuggaccugcuguucaugucucacaagcgcaccagccuuuccgcugaagaugcggaggugaccaaggccuuugaagaggacauugagacacccccuacgcggaacaucccgagccccgggcagcuggauccugacacccgcauucccguuaucaaucuggaagauggaacacgccucgugggcgaggacgcuccuaaaaacaaggaucuggucgaauggcuuaaacugcaucccaccuacacaguggacaugccuucuuaugugccgaagaaugccgauguccucuucuccagcuuucagaaacccaagcagaagcggcacagaugucgcaacccuaauaaacuggacauuaacacccugacgggggaggaacggguucccguggugaauaagagaaacggcaaaaagaugggcggggccauggcuccucccaugaaagaucucccgcgcuggcuugaggagaacccugaguucgccgucgcgcccgacuggacagauaucgugaagcaauccggcuucguucccgagucuauguuugaccggcugcugaccggaccuguggucagaggcgaaggggccagccgccggggaagacggcccaaguccgagaucgcuagagccgcugccgcggccgcugccguggcuucuaccagcggcauuaauccucuccugguuaacucccuuuucgccgggauggaccugacaagccuccagaaucugcagaaccugcagucucuccaacuugcuggacugaugggcuuuccgcccggccuggccaccgcggccacagcugggggagaugccaaaaauccugcugccgugcucccccugaugcuuccuggcauggccgggcugcccaacgucuucggacucggcgggcugcugaauaacccgcucuccgcggcuacgggaaauaccacaaccgccagcucucagggcgaaccugaggacuccacaagcaagggcgaggaaaaagggaacgagaaugaagaugagaacaaggacucugaaaaauccaccgaugcugugagcgccgccgacucugcuaauggaagcgucggcgccgcgacggcccccgcugggcuuccuuccaacccccuggccuuuaauccuuuccugcucagcaccauggcucccggacuguuuuacccguccauguuccuucccccuggccucgggggacucacacugcccggcuuuccugcccuggcgggccuccagaacgccguggggucuagcgaggagaaggcugccgauaaggcugaaggaggcccguucaaagacggggagacccuugaaggauccgaugccgaggagucucuggacaagacagcugaaagcucccugcucgaggaugaaaucgcccagggcgaggaacuggacucucuugaugggggagacgagauugagaacaaugaaaacgacgaguga

SEQ ID NO: 67402 - RNA, 7746 nt, Artificial Sequence
  derived and/or modified sequence opt5 from CHD8__Homo_sapiens__NP_001164100
auggccgaccccaucauggaccuguucgacgauccuaaccuguuuggacuggacagccuuaccgaugacuccuucaaucaggugacccaagauccgauugaagaagcucuggggcuucccucuagccuggacucccuugaucagaugaaccaggacggaggcgggggagaugucggcaauucuagcgccuccgaacugguuccucccccugaagagacggcccccaccgaacucucuaaggagagcacagcuccugccccggaguccaucacccugcacgacuacacaacccagcccgccagccaagaacagccugcucagcccgugcugcagacaucuaccccuacguccgggcuccugcaagugagcaaaucucaggagauucuuucccagggaaaccccuuuaugggcgucagcgccaccgcugugucuuccagcuccgccggcgggcagccgccucaaucugcgcccaagaucguuauucugaaagccccucccagcuccagcgugacaggagcucacgucgcccagauccaggcucaaggcaucaccucuacagcccagccccucguggcggggaccgccaauggaggcaagguuacguucacaaaagugcugaccgggacaccucuucggccgggagucuccauugugagcggcaacaccgugcuggcugccaagguccccggcaaucaggcugccguucagcggaucgugcaaccuucucgccccgugaagcagcucguccugcagccugugaaagggagcgcccccgcuggaaacccgggcgcgaccgggccuccccugaagccugccguuacacucacguccacccccacacagggagaaucuaaacggauuacccuggugcuucaacagccucagagcggcgggccccagggacaccggcaugucgugcugggcucccucccgggcaagaucguucugcaagggaaucagcuugcugcccugacacaggccaaaaacgcucagggacaaccugccaagguggucaccauucagcuccaggugcaacagccccagcagaagauccaaauugucccccagccuccgagcucucagccccagccucaacagcccccuuccacgcagcccgugacacugagcucuguucagcaagcgcagaucaugggcccugggcagucccccggacaacgccugagcgugccggucaaagugguucuccagccucaggcuggcuccucucagggggccagcuccggccugucuguggucaaggugcuuagcgccuccgagguggcugcccugagcucucccgcuuccagcgccccucacucuggaggcaaaaccgggauggaggaaaauagacggcucgagcaucaaaagaaacaggaaaaggcgaaccgcaucguugccgaggcuauugccagagcucgggcccgcggagaacagaauauccccagaguccugaacgaggaugagcuuccguccgugcggccugaagaggaaggcgagaaaaagcgcagaaagaaaagcgcgggggaacggcugaaggaggagaaacccaagaaaucuaagaccagcggagccuccaagacaaaaggcaagagcaaacucaauaccauuacaccuguggucgggaagaaacgcaagagaaacacgucuuccgacaacagcgacguggaaguuaugcccgcucagagcccccgggaggaugaagagucuagcauccaaaagagacgcuccaauagacaggugaaaagaaagaaauauaccgaagaccuggauauuaagaucacagacgaugaggaggaagaggaagucgacgugaccggcccuaucaaaccggagcccauucugccugagcccguucaggaaccugauggagagacacuccccucuaugcaguuuuucguggaaaacccuagcgaggaagacgccgcuaucgucgauaaggugcuguccaugcgcauuguuaagaaagagcuuccgucuggccaauacaccgaggccgaagaguuuuucgugaaguauaaaaauuacagcuaucugcacugcgaaugggccacgaucucccagcucgagaaggacaaacggauucaccagaagcugaaaagauuuaagaccaagauggcucagaugcgccauuucuuucacgaagaugaggagcccuucaacccugacuacgucgaaguggaccggauccuggaugagagccauucuaucgacaaagauaauggggaacccgugauuuauuaccuugucaagugguguucccucccuuacgaggacagcacaugggaacugaaagaggauguugacgagggaaagaucagagaauuuaaacgcauucaaucucggcaccccgagcugaagagagugaaccgcccgcaggcguccgccuggaagaaacucgaacugagccacgaguauaagaaucggaaccagcuuagagaguaccaacuggaaggcgugaauuggcuccuguucaacugguauaaucggcagaacugcauccuggcugaugagauggggcuuggaaaaaccauucagucuaucgccuuccuccaggaagucuacaaugugggcauucaugggccuuuucugguuaucgcgccccuguccacaaucaccaacugggagcgcgaguucaauacguggacagagaugaacaccauuguguaucacggcagccucgcuuccagacaaaugauccagcaguacgagauguauuguaaggacagccggggaagacugauucccggcgccuacaaauuugaugcgcuuaucacaaccuucgaaaugauucugucugacugcccugagcuccgcgaaaucgaguggcggugugucaucauugaugaagcucauagacugaagaaccgcaauugcaagcugcuugacagccucaaacacauggaucuggagcauaaggugcugcucaccgggacaccccugcagaacacgguugaggaacucuuuagccugcuccacuuccuggagccuucucaauuuccgagcgaauccgaguuccugaaagacuuuggagaccuuaagaccgaagaacaggugcagaaacuccaggccauccugaagcccaugaugcugagacggcucaaggaggaugucgagaagaaucuggccccuaagcaagagacaauuaucgaaguggagcuuaccaacauucagaaaaaguacuaucgcgcuauccuggagaaaaauuucucuuuucucagcaagggcgccgggcacacaaacaugcccaaucugcugaacaccaugauggaacuuagaaaauguugcaaucauccuuaccugaucaacggagcggaggaaaagauucucacggaguuccgggaggcuugucacaucauuccccaugacuuucaucugcaggccaugguucgcuccgccggcaagcucgugcugaucgauaaacuucugccgaagcucaaagcugggggccacaagguccugauuuucucucaaauggugagaugccuggacauccuugaggauuaucugauccagcggcgcuaccucuaugagagaauugacggacgggugcgcggcaaucugagacaggccgcuaucgaucgguucagcaaaccugacuccgauagauuugucuuccuccuguguacacgcgccgggggacuuggcauuaaccugaccgcggccgauaccugcaucauuuuugauagcgacuggaauccccagaacgaucuccaagcucaggcccggugccauagaaucgggcagucuaaggcuguuaagguguaccgccugauuacaagaaauagcuaugaaagagagauguucgacaaagccagccugaaacuuggacuggacaaagccgugcuccagucuauguccggccgcgauggcaacaucaccgggauccaacaguuuagcaagaaagaaauugaggaccugcuccggaagggagcuuacgcggccaucauggaagaggaugacgagggcuccaaguucugugaagaggauauugaccagauccugcuuagacgcacaacgaccauuacaaucgaaucugaggggaaaggaagcaccuuugcuaaggccuccuucgucgccagcgaaaaccggacagauaucucucuggacgauccuaauuuuuggcagaaaugggcuaagaaagccgaccuggauauggaccuccugaacuccaagaauaaccuugugauugacacccccagaguucggaagcaaacgcgccacuucagcacccugaaagaugacgaucucguggaguuuucugaccuggagagcgaagaugacgagagaccucggucccgcagacaugaucggcaccaugcguacggcagaacagacugcuuccgcgucgaaaagcaccuccugguguauggguggggacgguggagagauauccuuucucacggccgcuuuaaacggagaaugaccgagcgcgacguugagacaauuugucgggcuauccugguguacugccugcuccauuauagaggcgaugaaaauauuaagggguucaucugggaccugaucagccccgccgagaacggaaaaaccaaggaacuucagaaucacuccggccugucuauuccggucccucgcgggagaaagggcaaaaaggugaaaagccaguccacauucgauauccauaaggccgacuggauucggaaauacaaccccgacacccucuuucaggaugagagcuauaagaaacaccugaagcaucaauguaauaagguccuccugcgcgugagaaugcuuuacuaucugcggcaggaaguuaucggcgaccaggcugagaaagugcucggcggggccauugcgucugagaucgauauuugguuccccgucguggaccaacucgaaguuccuacgacauggugggauuccgaggcugacaagagccugcuuaucgggguguuuaaacacggcuacgaaaaguacaacaccaugcgcgccgauccggcccugugcuuccucgagaaagcugggagacccgacgauaaggccaucgcugccgaacaccggguccuggacaauuuuuccgauauuguggagggaguggacuucgauaaggacugugaggacccugaauauaaaccccuccagggcccucccaaggaucaggacgaugagggggacccucugaugaugauggaugaagagaucucuguuauugacggagaugaagcgcaggucacccaacagccgggccaucuguuuuggcccccugggagcgcccuuacagcuagacugcgccggcucgugaccgccuaccagagauccuauaaacgcgagcagaugaagaucgaggcugccgaacggggagacagacggcgcagacggugcgaggccgcuuucaaacugaaggaaauugcgcgcagagagaagcaacagcgguggacgcgcagagagcagacagauuuuuaccggguggucucuaccuucggcguggaauaugaccccgauacaaugcaguuucacugggaccgcuucagaaccuucgcccggcuugacaaaaagacagaugagagccugaccaaauacuuucauggcuucguugcuauguguagacaagugugccgccucccucccgccgccggggacgaaccgccugaucccaaccuguuuaucgagcccaucacggaagaacgggcuuccagaacccuguaucgcauugagcuccuucggagacugcgcgaacagguccugugucacccucuccuggaggaccggcuugcccugugccagcccccuggaccggaacuccccaaguggugggagccugugagacacgauggcgaacugcugcgcggggcggcucggcauggaguuagccaaacagacugcaauaucaugcaggaucccgacuucucuuuucucgccgccagaaugaacuacaugcagaaucaccaggcuggcgccccugcgcccucccuuagccgcuguucuaccccgcugcugcaucaacaguacacaucccggaccgccagcccucucccccugagaccugaugcucccguggagaaaucuccugaggaaacggccacacagguccccagccuugagucccugacccucaagcuggaacacgaggugguugcucgcucuagaccgacaccucaggacuaugaaaugcgggugagccccuccgauaccacaccccuggucagccgcuccgugccuccggugaagcucgaggacgaggaugacucugacagcgaacuugaucuguccaaacugucucccagcuccucuagcuccuccucuuccuccucuuccuccucuuccacagacgagagcgaagaugagaaggaggaaaaacucacggaccaauccagaagcaagcuguacgaugaggaaucucuucugagccucaccaugucccaggacggguucccuaacgaggauggagaacagaugacacccgagcugcugcuccuucaggagcggcaaagagccucugaauggccuaaagaccggguccugauuaaccgcaucgaucugguuugccaggcugugcucagcggcaaguggcccuccucuagacggagccaggagauggugaccggcgggauucugggaccuggcaaucaucuucuggacucccccucucucacaccgggggaauauggagauagcccuguccccaccccucgcuccagcucugccgcguccauggccgaggaagaggcuagcgccgugucuacggcugccgcccaauuuacaaaacugagacggggcauggacgagaaggaguucaccguucagaucaaggacgaggaagggcugaaacucaccuuucagaagcacaaacuuauggcuaacggagugaugggcgauggccacccccuguuccauaagaaaaaggggaaucgcaagaaacuggucgagcucgaaguggaguguauggaggaaccgaaccaccuggacguugaucuugagacaagaaucccugugauuaauaaggucgacggaacccugcucgugggcgaagaugcgccccggcgcgccgagcuggagauguggcugcaggggcaucccgaauuugcugucgacccuagauuccucgccuacauggaggaucggcgcaaacaaaaguggcagagaugcaaaaagaacaauaaggccgaacuuaacugucugggaauggagcccgugcagacagcuaauucccggaacggcaaaaaggggcaccacacggaaaccguuuuuaaucgcgugcugccuggaccgaucgcccccgagagcuccaaaaagagagcgcggagaaugcgcccugaccucucuaaaaugauggcccugaugcagggcggcagcacagggucccuuagccugcauaacaccuuccaacacucuuccagcggacuccagucugugagcucccugggccauucuagcgcuacauccgccucucugcccuucaugccuuuugucaugggaggagcucccagcuccccucacguugauagcucuaccaugcuccaucaccaccaucaccauccgcacccccaccaucaccaucaccaucacccuggccuucgggcccccggguauccuuccagccccgugacgaccgcguccggcacaacccugagacugccgccucuccagcccgaggaagacgaugacgaggaugaagaggacgacgaugaccugucucagggauacgauagcuccgaacgcgacuucucucuuauugaugaccccaugaugccugccaauagcgauuccagcgaggacgcugaugacuga

SEQ ID NO: 67403 - RNA, 1785 nt, Artificial Sequence
  derived and/or modified sequence opt5 from CHDH__Homo_sapiens__NP_060867
auguggugccugcucagaggccuggggcggcccggagcccuugcucgcggcgcccuggggcagcaacagagccucggagcgagagcucuggccuccgccggcucugagagccgggacgaauacuccuauguggucguuggggcuggaucugccggcugugugcuugcuggccgccugaccgaggauccugccgaaagagugcuccugcuggaggcggggccgaaggacguccucgccggaagcaaacggcuguccuggaagauccacaugcccgcugcccuuguggcuaaccugugcgaugaccgcuacaauugguguuaucauacagaaguucagagaggccucgaugggcgggugcuguacuggccucgcggaagagucuggggcgggucuagcucccuuaacgccaugguguauguucggggacacgcggaggacuacgagcgcuggcagagacaaggcgcccggggcugggauuaugcucauugccugcccuacuuccgcaaagcccaggggcacgaacucggagcuagcagauaccggggcgccgacgggccucugagagugucucgcggaaagacgaaucauccccugcacugugccuuucucgaggcuacccagcaggcgggcuauccucugacagaagauaugaacggguuccaacaggagggauuuggcuggauggacaugaccauucacgagggcaaacggugguccgccgcuugcgccuaccuucauccggcccugagcagaacaaaucucaaggcugaagccgagacccuggucucucgcgugcuuuucgaagggacacgggcggugggagucgaguauguuaagaacggccagucccacagagcuuacgccagcaaagaagugauccugucugggggagccauuaauagcccccagcuccugaugcuguccggcaucgggaacgcugaugaccucaagaaacugggcauuccuguggucugucaucuucccggagugggccaaaaucugcaggaucaccucgagaucuauauccagcaagccugcacccgcccuauuacgcugcacuccgcucagaagccccuucggaaaguuuguaucgggcuggaguggcucuggaaguuuaccggagaaggcgccacagcgcaucuggagaccgggggauucauuagaucucagccgggcgugccucaccccgacauccaguuucauuuccugccuagccaagucauugaccacgggcgcgugcccacacagcaggaagccuaccagguucaugugggccccaugcggggaaccuccgucggcuggcucaagcugagaagcgcuaacccucaagaucacccggugauccagcccaauuaucuuucuacggagacagacauugaagauuuucgccugugcgucaaacucacccgggagaucuucgcccaggaggcucuggccccuuuuagagggaaggaacugcagcccggaucccacauccaaagcgacaaagagauugaugcguucgugcgggccaaggcugacucugccuaccauccuagcuguacaugcaaaaugggccagcccuccgauccgaccgcuguuguggacccucagacccgcguccuugggguggaaaaccucagaguuguggaugccucuaucaugcccagcauggucuccggaaaucugaacgccccuacaauuaugaucgcugagaaggcggccgacauuaucaaaggccagcccgcucugugggauaaggacgugccuguguacaagccccggacgcucgccacccaaagauga

SEQ ID NO: 67404 - RNA, 1329 nt, Artificial Sequence
  derived and/or modified sequence opt5 from CHEK1__Homo_sapiens__NP_001231775
auggccgugcccuucgucgaagacugggaucugguucagacccucggcgaaggggcuuacggagaggugcaacuggccgugaacagagucacagaagaggcgguggcuguuaagaucguggacaugaaacgggccgucgauugcccugaaaauauuaagaaagagaucuguauuaacaagaugcuuaaucacgagaacgugguuaaauuuuauggccaucgcagagaagggaauauccaguaccuguuccucgaguauugcagcggaggcgaacuguuugaccggauugagccggauaucgggaugcccgagccugacgcccagcgcuucuuucaccagcuuauggcuggaguggucuaccugcauggcaucggcauuacgcacagagauaucaagcccgaaaaccuccugcuggacgagcgggauaaucucaagauuuccgacuucgggcuggccaccguguuucgcuauaacaauagagaacggcuucugaacaaaauguguggaacacucccuuacguggcucccgagcugcuuaagcgcagagaguuccaugccgaaccugucgauguuuggucuugcggcaucgugcugaccgcgaugcucgccggggagcugccgugggaccaacccagcgauuccugucaggaauauucugacuggaaagagaagaaaacauaccugaauccuuggaagaagauugacagcgcuccccucgcccugcuucacaaaauccugguggaaaacccuuccgcucggauuaccauccccgauaucaagaaagaccgcugguacaauaagccgcucaaaaagggagccaaaagaccucgggucacaucuggcggggugagcgagucccccagcggauuuucuaagcacauucaguccaaccuggauuucagcccuguuaauucugcguccagcgaagagaacgugaaguauucuuccagccagcccgagccccgcaccggccuuucccugugggacacgucuccuagcuacaucgauaaacucguccaaggcauuuccuuuagccagccgaccugccccgaccauaugcugcugaacucucagcuccuggggacaccuggauccagccagaaucccuggcaaagacuugugaagcggaugaccagauucuuuacaaaacuggaugccgacaagucuuaucagugucucaaagaaaccugcgagaagcugggcuaccaguggaagaaaagcuguaugaaccaaggggauggacuugaguucaagcgccacuuccugaaaaucaagggcaaacucauugacaucguuuccucucagaagaucuggcugccugcuacguga

SEQ ID NO: 67405 - RNA, 969 nt, Artificial Sequence
  derived and/or modified sequence opt5 from CHEK2__Homo_sapiens__NP_001244316
augagcaagacccugggcuccggggccugcggagaggugaaacucgcuuucgaaagaaagacauguaaaaaggucgccaucaaaauuaucucuaagcggaaguuugcgauuggcagcgcucgcgaggccgaccccgcccugaacguugaaacggagaucgaaauucuuaaaaagcugaaucacccuugcaucaucaaaauuaagaacuucuuugaugcugaggacuacuauaucgugcucgagcugauggaagggggagagcuuuucgauaaaguggucggcaauaagagacugaaggaagccaccuguaaacucuacuuuuaucagaugcugcuggcugugcaauaccuccaugagaacgggauuauccaccgggaccugaagccggagaauguucuucuguccucucaggaagaggauugccucauuaaaaucacagacuucggacauagcaagauucugggcgaaaccucccuuaugcgcacacuguguggcacccccacauaucucgccccugaggugcuggucucuguggggaccgcgggauacaacagagccguugauugcuggagccugggcgugauccucuuuaucugucuguccggguaucccccuuucagcgaacaccggacgcaggucucucuuaaagaccagauuaccuccggaaaguacaauuuuauccccgaggugugggcugaggugagcgaaaaagcccuggaucucgucaagaagcugcuuguuguggacccuaaagcucgcuucacaaccgaggaagcccugagacauccguggcuccaagaugaggacaugaagcggaaauuucaggaucugcugucugaagagaacgaguccacagcgcucccccaggugcuggcccagccuagcaccucucgcaagagaccccgggaaggcgaggcugaaggggccgagacgacaaaacgcccugcugucugcgccgccgugcuuuga

SEQ ID NO: 67406 - RNA, 2751 nt, Artificial Sequence
  derived and/or modified sequence opt5 from CHERP__Homo_sapiens__NP_006378
auggagaugccccugccuccggacgaucaggaacucagaaacgugaucgacaagcuggcccaauucgucgcucggaauggccccgaguuugagaaaaugaccauggaaaagcagaaagauaacccuaaguucagcuuucuuuucgggggagaauuuuacuccuauuacaaaugcaagcuggcccucgagcagcagcaacugauuuguaagcagcagacacccgagcuugaaccugcggcuacgaugcccccucugccgcagcccccucucgcccccgccgcuccuauucccccggcccaaggcgcuccuucuauggacgagcugauccagcagagccaguggaaucugcaacagcaggaacaacaccuccuggcccuucgccaggagcagguuaccgcggccguggcucaugccguggagcagcaaaugcagaaacugcucgaagagacacagcuggauaugaacgaguucgacaaucuucugcagcccaucauugauaccugcacaaaggacgcuaucuccgccgggaaaaacuggauguuuucuaaugccaagagcccuccccacugugaacucauggcgggacaucugagaaaccggaucaccgcugauggcgcccacuucgaacugcgccuccaucugauuuaucuuaucaaugacguccugcaccacugccaaagaaaacaggcucgggagcuccuggccgcccuucagaaggugguugugcccauuuacuguacauccuuucuggcugucgaggaagauaagcagcagaaaaucgcgcgccuccugcagcugugggagaagaacggguauuucgacgauucuauuauccagcagcuccaaagcccugcccugggacuuggccaguaccaggcuacccugauuaaugaauauuccagcgugguucaaccggugcagcucgccuuucagcagcaaauccagacgcugaaaacccagcaugaggaguucgucacaucucuugcccagcaacagcagcagcaacagcagcaacagcagcagcugcaaaugccccagauggaagcugaggugaaggccaccccucccccucccgcgccgccucccgcuccugcccccgccccugcuauucccccgacaacccagccugacgacuccaaaccgcccauccagaugccuggcagcucugaauacgaggcccccgggggagugcaagaucccgcugccgcgggcccuagagggcccggaccucacgaccagauucccccuaacaagcccccgugguuugaucagccucaucccgucgccccuuggggccagcaacagcccccggaacagccucccuacccucaccaccaagggggaccuccccauugcccuccguggaauaacucccacgagggcauguggggcgaacaacgcggggaccccggauggaauggccagcgggaugcuccuuggaacaaccagcccgacgccgcuuggaauagccaauucgaggggccuuggaacucucagcaugagcagcccccuuggggaggcgggcagagagaaccgcccuuccggaugcaacgcccuccccacuuuagaggaccuuuucccccgcaucagcagcacccucaguucaaucaaccuccccacccccauaacuucaaucgguuucccccucgcuucaugcaggaugacuuuccgcccagacacccuuucgagcggcccccuuauccccauagauuugauuacccgcagggcgacuucccugccgaaauggggcccccucaccaccaucccggccaccgcaugccucaucccggaaucaacgagcacccgccuugggcgggcccccagcaucccgauuuugggccuccgccccacggauucaauggccaaccuccccacaugcggagacaggggccuccccauaucaaccacgacgacccuucccucguuccgaaugugcccuauuuugaucugccugccggccugauggcuccccucgugaaacuggaggaccaugaauacaagccucuugaucccaaggacauucgccugccgccucccaugcccccuagcgagcggcuccuggccgcugucgaagccuucuauuccccgcccucucacgauagaccccgcaacagcgagggaugggaacagaauggccuguacgaguucuuucgggccaaaaugagagcucgccggagaaaggggcaagagaaacgcaacuccggacccagccggucuagaucccggagcaagucucgcggcagaagcuccucucggagcaauuccagaagcucuaaauccagcgggucuuauucccgcagccgguccagaucuuguagccgcuccuacucuagaagccggucccgcagcagaucucggucccgcagcucuagaucccggagccgcucucagagcagaucccggagcaagucuuacuccccuggacgcagacggagaagccgcucccggucucccacgccucccagcuccgcgggccuugggucuaacagcgccccgccuauccccgacuccagacucggcgaagagaauaagggacaucagaugcuggugaaaaugggcuggucugggagcggaggccugggggcuaaggaacagggaauccaagauccuauuaaaggcggggacguucgcgauaagugggaccaguauaaaggcgugggagucgcccucgaugaccccuacgagaacuaucggagaaacaaguccuacagcuucaucgcccgcaugaaggcucgggaugaaugcaaauga

SEQ ID NO: 67407 - RNA, 1995 nt, Artificial Sequence
  derived and/or modified sequence opt5 from CHFR__Homo_sapiens__NP_001154816
auggagagacccgaagagggcaagcagagcccuccgccccaaccuugggggcggcugcuccgccugggagccgaagagggcgaaccccacgugcuucugagaaaacgggaguggaccaucgggcgcagacggggaugcgaccucuccuucccuucuaacaagcuggucagcggcgaucauugucgcauuguuguggacgagaaauccggacaggugacacuugaagauacgucuaccagcgggacagucaucaauaagcugaaagugguuaagaagcagaccugcccccuccagacaggcgacgugauuuaccuggucuaucggaaaaacgagccugaacacaauguggcuuaccuguaugagucccucucugagaagcaaggcaugacccaggagagcuuugaagccaacaaagaaaauguuuuccaugggacaaaggauaccuccggagcgggcgcugggagaggagccgacccgcgcgugcccccuagcucucccgccacgcaggucuguuuugaggaaccucagcccuccaccagcacaucugaucuguucccgaccgcuuccgccagcucuacagagccuucccccgcuggcagagagcggagcuccucuugcgggagcggaggcggcgggaucuccccuaaaggaagcggccccucuguggccuccgacgaagugagcucuuuugcgagcgcccuucccgaucgcaagaccgcuuccuucucuagccuggagccucaagaccaggaagaucucgagccggucaagaaaaagaugagaggggacggagaucuggaccuuaacggccagcugcucguugcccagccccggcgcaaugcucaaacggugcacgaagacgugagagccgcggccgggaaaccugauaagauggaggagacacugaccuguauuaucugccaggaccugcuccaugauugugucucccugcagcccugcaugcacacauuuugugcugccugcuacagcggauggauggaacggucuucccuuuguccuaccugcagaugccccguggagcgcaucuguaaaaaccacauucugaauaaccucguugaagccuaucugauccaacauccggacaagagccggucugaggaagaugugcaguccauggacgccagaaauaaaauuacccaggauaugcuucagccuaagguccgccggagcuucuccgacgaggagggcucuagcgaagaucugcucgagcuguccgacguggauucugaaagcuccgacaucagccaacccuacguugugugcagacaguguccugaguaucgccggcaggccgcucagcccccucacugccccgcgccggagggcgaaccuggggcuccccaagcucugggagacgcccccucuacauccgucagccucacgaccgccgugcaggauuacgucuguccucugcagggcucucaugcucuuugcacauguugcuuucagccgaugcccgacagacgcgccgagcgggaacaagauccuagaguggcgccccagcagugugcuguuugccugcagccuuucugucaccucuacugggggugcacccgcacaggaugcuauggcugucuggcccccuuuugcgagcuuaaccugggggacaagugucucgauggcgugcugaauaacaauuccuacgaaagcgacauucugaaaaacuaucucgccacccggggacugacguggaagaacaugcuuacagagucucuggucgcucuccaaagaggcguguuccugcugagcgauuaccggguuaccggggacaccgugcuuugcuauuguugcggacuccgcuccuuuagagagcugacauaccaguaucggcagaauaucccugccagcgaacugcccgucgcugugaccucuagaccggauuguuacuggggccgcaacugccggacacaagugaaagcccaccaugcgaugaaguucaaucacauuugugagcagacgagauucaaaaacuga

SEQ ID NO: 67408 - RNA, 921 nt, Artificial Sequence
  derived and/or modified sequence opt5 from CHGA__Homo_sapiens__NP_001288619
augagaagcgccgcugugcuggcccuccugcuuugcgcgggccaggucaccgcucugcccguuaacuccccuaugaauaagggggacacagaggugaugaaauguaucguggaagucauuucugauacgcucagcaagccgucccccaugccugugucucaagagugcuucgaaacccugcggggagacgagcgcauccuuagcauucugagacaccagaaccuccugaaagaacugcaggaucucgcccugcagggcgccaaggagcgggcucaucaacagaaaaagcacuccggguuugaggacgaacuuucugagguucuggaaaaucagagcucccaggccgagcucaagggacgcagcgaggcucuggccguggauggcgcggggaaacccggagccgaagaggcucaagacccugaaggcaagggcgagcaggaacauucucagcagaaagaggaggaagaggaaauggccgucgugccccaagggcuuuucagaggaggcaaguccggggagcuggaacaggaggaggaacggcucagcaaagagugggaagauucuaagcgcugguccaagauggaccagcuggcuaaagagcugacagccgaaaagagacucgagggacaagaggaagaggaagauaaccgggacagcucuaugaaacuguccuuucgcgcgagagccuacggcuuccgggggccuggaccgcagcuucgcagaggcuggcggcccagcucccgcgaggauucucuggaggcuggccucccucugcagguuagaggguaucccgaagagaagaaagaagaggaaggaagcgccaaucggagaccugaggaccaggagcuugaaucccugagcgcuaucgaggccgaacucgagaagguggcccaccaacugcaggcucugcgccggggcuga

SEQ ID NO: 67409 - RNA, 2034 nt, Artificial Sequence
  derived and/or modified sequence opt5 from CHGB__Homo_sapiens__NP_001810
augcagcccacccugcuccugagccuucugggcgccguggggcucgcugccgucaacuccaugccuguugacaauagaaaccacaaugagggaauggugacacggugcaucauugaagugcugucuaacgcgcuuagcaaguccucugcuccgcccaucacgccugagugucgccaaguccugaaaaccagcagaaaggaugugaaagacaaggaaacaaccgagaaugaaaacacaaaauucgagguucggcuccugcgcgaucccgccgacgccuccgaggcucaugaaucuagcuccagaggcgaggccggggcuccuggagaagaggauauucagggccccaccaaggccgacacagagaagugggcggaagggggaggccacagccgggagcgcgccgaugaaccucaguggucucuguacccguccgacagccaggugucugaggaagucaaaaccagacauuccgaaaagagccaacgggaggaugaagaggaagaggaaggcgagaauuaucagaaaggggagcgcggagaagacucuuccgaggaaaagcaccucgaggaacccggcgagacgcagaacgcuuuucugaaugagagaaaacaggccagcgcuaucaagaaggaggagcuuguggcccgguccgaaacccaugcggccgggcacucucaagagaaaacacacagccgcgagaaguccagccaggaaucuggagaggaaaccggcucccaggagaaccauccucaggaaagcaaagggcaacccagaucucaggaggagagcgaagagggagaagaggaugcuacauccgaaguugacaagcggcgcaccagaccucggcaccaucacggcagaucucgccccgaucggagcucccagggcgggagccugccgucugaggagaaaggacacccucaagaagaguccgaagagagcaaugugucuauggccucccucggcgaaaagagagaccaucacagcacgcauuaccgcgcuuccgaggaggaacccgaguauggggaagagauuaaaggauacccuggcguccaggcccccgaggaccuggaaugggagcgguauagagggcgcggaucugaagaguaccgggcccccagaccucagagcgaagaguccugggaugaggaagacaagcgcaacuauccgucucuugagcuggauaagauggcucacggcuacggcgaagagagcgaagaggagcgggggcucgaacccggaaaaggcagacaucaccgcgggcggggaggcgagccuagagcguacuucauguccgacacacgggaagagaagcgcuuucugggggaaggccaccauagagugcaggagaaucaaauggauaaagcccggagacacccccagggagcuuggaaggagcuggaccgcaacuaucucaauuacggcgaagagggggccccuggaaaauggcagcagcaaggcgaucugcaggacaccaaggaaaaccgggaggaggccagauuccaggauaagcaguauagcucucaucacacagcugaaaaacgcaagagacuuggggagcuguuuaaccccuacuaugacccgcuccaauggaaauccagccacuucgaacggcgcgauaauaugaacgacaauuuucuggagggagaagaggagaacgaacuuacccugaaugagaagaacuucuuuccugaauacaauuaugacuggugggagaaaaagcccuucucugaagaugugaacuggggcuacgagaagagaaaucucgcccgggucccuaaacuggaccugaagcgccaguacgauagaguugcgcagcucgaccagcugcuucauuaucggaaaaaguccgcugaguuucccgauuucuacgacagcgaggaaccugugucuacccaccaagaagccgagaacgaaaaagaucgcgccgaccagacagugcugacggaggaugagaagaaggaacucgagaaucuggcugccauggaccuugaacugcagaaaaucgcugagaaguuuagccaaagaggguga

SEQ ID NO: 67410 - RNA, 987 nt, Artificial Sequence
  derived and/or modified sequence opt5 from CHI3L1__Homo_sapiens__XP_011507410
augggcgugaaggccagccagaccggguucgucguucuggugcuccugcaaugcuguuccgcuuacaaacuugugugcuauuacacaucuuggagccaguauagagagggagacggcuccuguuuucccgaugcccuggaccgguuccucugcacgcacaucauuuacucuuuugcgaacaucagcaaugaucauauugacaccugggaauggaacgaugucacacuguaugggaugcuuaauacccugaagaaccgcaauccuaaccucaaaacacugcuguccgugggaggcuggaauuucgggucucagagagcugacuuuggaccgcgguucagcaagaucgccuccaacacccagagccgcagaacauuuauuaaaucuguucccccuuuccuccggacccacggcuuugauggccuggaccuugccuggcuguaccccgggcgcagagauaagcaacauuucacgacccucaucaaggagaugaaagcugaauuuaucaaggaggcccagccuggcaaaaagcagcugcuucuguccgcugcccucagcgcgggaaaagugacaauugacucuuccuaugauaucgccaagauuagccagcaccuggacuucaucucuauuaugaccuacgauuuucauggggcuuggcggggaacaaccggccaccacagcccccuguuccgcgggcaagaagacgccuccccugacagauucuccaauacgaucugugauuuucuccggggagcuacaguccaucgcauucugggccaacaggugccguacgccaccaagggcaaccaguggguuggguaugacgaucaggagucugugaaaagcaagguccaguaccuuaaagacagacagcuggcgggagccauggugugggcucucgaucuggacgauuuccaaggcuccuuuugcgggcaggaccuucgguucccccugacaaaugccaucaaggaugcucucgccgccaccuga

SEQ ID NO: 67411 - RNA, 675 nt, Artificial Sequence
  derived and/or modified sequence opt5 from CHIC1__Homo_sapiens__NP_001034929
augagcauccugcuccccaacauggcugaguucgacaccauuuccgaacuggaggaagaggaagaggaggaagcugccacaucuagcuccucuccuagcuccucuagcuccgugagcggcccggaugacgaugaggaagacgaggaggaagaggaagaggaagaggaggaagaggaagaggaagaggaggaagaggaagaggaagcgcccccucccccuagagucguuucugaggagcaccuucggcgcuacgcucccgauccugugcuggugagaggggccggacauaucacggucuuuggccucuccaauaaguucgacaccgaauuuccgagcgugcugacagggaaaguugcccccgaggaguucaagaccucuauuggacgggugaacgcuugccuuaaaaaggcccugccugucaaugugaaauggcuccuguguggcugccuguguugcuguugcacacucggguguucccuguggcccguuaucugccuuaacaagcgcaccagacggagcauucagaagcugaucgaaugggagaauaaccgccucuaucacaaacuggcccuucauuggaagcugacaaaaagaaagugugaaaccucuaauaugauggaguacgugauccucauugaauuucugccuaaauaucccaucuuccggccggauuga

SEQ ID NO: 67412 - RNA, 498 nt, Artificial Sequence
  derived and/or modified sequence opt5 from CHIC2__Homo_sapiens__NP_036242
auggccgacuucgaugagaucuacgaagaggaagaggacgaagagagagcucuggaggaacagcuccugaaguauagccccgauccuguggucguucggggcuccgggcacgugaccguguuuggacuuucuaacaaauucgagagcgaauuuccguccucucugacaggcaaggucgcccccgaggaguucaaagcgagcauuaaucgcgugaacuccugccucaagaaaaaucugccuguuaacgugagauggcuucugugugggugccucuguugcuguugcacgcugggauguucuauguggcccgucaucugccugagcaagcggacccgcagauccauugaaaagcuccuggagugggaaaauaaccggcuuuaccauaaacugugucuccacuggcgccugagcaagagaaaaugcgagacaaauaacaugauggaauaugugauccuuauugaguuucugccuaagacccccaucuuccggccugacuga

SEQ ID NO: 67413 - RNA, 1344 nt, Artificial Sequence
  derived and/or modified sequence opt5 from CHIT1__Homo_sapiens__NP_001243054
auggugagaagcgucgccugggcuggcuucaugguucugcucaugauccccuggggguccgccgcgaagcuggugugcuacuuuaccaacugggcucaguaucggcaaggagaggcccgcuuccuuccuaaagaccuggauccgucucucuguacacaccugauuuacgccuuugcuggcaugacgaaucaucagcuuagcaccacagaauggaacgacgagacccuguaucaggaguucaaugggcucaagaaaauguuuacagauaugguggccaccgcuaacaauagacagacauucgucaacuccgccauccgguuucugcgcaaguacucuuucgacggacuggaucucgacugggaguaucccggcagccaaggguccccugcgguggauaaagaaagauuuaccacgcugguucaggaccuugccaaugcuuuccagcaggaggcccaaaccucuggaaaggagcggcugcuccugagcgcugccgugcccgcgggccagacauacgucgaugccggcuaugaaguggacaagauugcucagaaccuugauuuuguuaaucugauggccuacgacuuccacggguccugggagaaagugaccggacauaacagcccucucuacaagcgccaggaagagucuggcgcugccgccucccugaaugucgaugcugcggugcaacaguggcugcagaaagggacacccgccagcaagcucauccugggaaugccuaccuauggcagaucuuuuacgcuugcuuccagcucugacacacgggugggggccccggccaccggauccggcacacccggcccuuucaccaaagaagggggaaugcuggcuuacuaugaagucugcagcuggaagggcgccaccaagcaacgcauucaggaccagaaaguucccuacaucuucagagauaaccagugggugggguuugacgauguggaguccuucaagacaaaagucucuuaucucaagcaaaaaggacugggcggggcgauggugugggcucuugaccuggaugacuuugccggauucagcuguaaucagggccgguacccucucauccagacgcugcgccaggaacugucccuccccuaucugccgagcggcaccccugagcuugaaguucccaagccugggcaacccucugagcccgagcacggaccuuccccgggccaggauacauuuugccaggggaaagccgacggacuguaccccaacccuagagaacggagcucuuucuacagcugugcugccggccgccucuuucagcaauccugccccaccgggcugguguucucuaauagcuguaagugcuguacauggaacuga

SEQ ID NO: 67414 - RNA, 1320 nt, Artificial Sequence
  derived and/or modified sequence opt5 from CHKA__Homo_sapiens__NP_997634
augaagaccaaauucugcacaggcggggaggccgaacccagcccucugggacuccugcuuuccuguggcucugggagcgcugccccggcgcccggagugggccagcaaagagacgcugccuccgaucuggagucuaagcagcucgggggacagcagccuccccuggcccuuccucccccuccgccccugccucucccccugccucugccccaaccgccucccccucagccucccgcugacgaacagcccgagccgcggacgcgcagacgggccuaccucuggugcaaagaauuucugcccggcgcuuggcgcggccuuagagaggaugaguuccacaucagcgucauucgcgggggacuguccaacaugcucuuucaguguucucugccugacaccacagccacccuuggcgaugaaccccggaagguucugcucagacuguauggggcgauccugcaaaugggagccgaggcuauggugcucgaaagcgugauguucgccauucuggcugagcggucccuuggcccuaaacuguacgggaucuuuccccagggacgccucgagcaguucauuccgagcagacggcuggacacagaggaacuuucucugccugauaucuccgccgaaaucgcggagaagauggccaccuuucauggcaugaagaugcccuucaauaaagaaccuaaguggcucuuuggcacaauggagaaauaucugaaggagguccugcgcauuaaauucaccgaagagagcagaaucaagaagcuccacaaacugcuuucuuacaaccugccccucgaacuggagaaucuucggucccugcucgaaagcacgccuucucccgugguguuuugccauaacgacugucaggaggggaauauucugcugcucgagggacgcgaaaacuccgagaagcaaaaacugaugcuuaucgauuucgaauauagcuccuacaauuauagaggcuuugacauugggaaccacuucugcgaguggauguacgauuacucuuaugaaaaguacccguucuuucgggcuaauaucagaaaauauccuaccaagaaacagcagcugcauuucauuagcuccuaccuccccgccuuucaaaacgacuucgagaaucugagcacagaggaaaagucuaucaucaaggaggaaaugcugcuugagguuaaccgcuuugcucucgccucccacuuccuguggggacuguggagcauuguccaggccaaaaucucuagcauugaguuuggcuauauggauuacgcucaggcgcgguucgacgccuauuuucaccagaagagaaaacucgggguguga

SEQ ID NO: 67415 - RNA, 1188 nt, Artificial Sequence
  derived and/or modified sequence opt5 from CHKB__Homo_sapiens__NP_005189
auggccgcugaggccaccgcgguggcuggcagcggggccgucggaggcugccuggccaaggacgggcuccagcaauccaaaugucccgauacaacgccuaagagacggcgcgcuucuagccuguccagagacgccgaacggcgcgcuuaccaguggugcagagaguaucuuggaggcgccuggcggcgcguucagccggaagaacugagaguguaccccgugucugggggacucagcaaccugcuuuuccgguguucccugccugaucaccuccccucugucggcgaagaaccucgcgaggugcugcugagacucuauggcgcgauccugcaggggguugacagccuugugcuggaauccgucauguuugccauucucgcugagcggagccugggaccccaacuuuacggcguguucccugaagggcgccuggagcaguauaucccgucuagaccccucaaaacccaggagcugcgggaaccuguucuguccgccgcuauugccacaaagauggcgcaguuucauggaauggagaugcccuucaccaaagaaccucacuggcucuuuggcacaauggagcgcuaccugaagcaaauccaggaucuucccccgaccgggcugccugaaaugaaucuccuggagauguauagccuuaaggacgagaugggaaaccugagaaaacuccuggaaucuacacccuccccuguggucuucugccauaaugauauucaggagggcaacauccugcuccugagcgaacccgagaaugccgacucucuuaugcugguggauuuugaauacuccagcuacaacuaucggggcuucgacaucgggaaucacuuuugugaguggguguacgauuauacccaugaggaauggcccuucuacaaggcuagaccuacggacuauccgacccaggagcaacagcuccacuuuauucgccacuaccuggccgaagcuaaaaagggagagacacuuucccaggaggagcaacggaaacuggaggaagaucuccuggucgagguuucuagauaugcccuggccagccauuucuuuuggggccucugguccauccugcaggcuagcaugucuaccauugaguucggguaccuugacuacgcgcagucccgcuuccaguuuuauuuccaacagaagggacagcugacaagcgugcacucuagcuccuga

SEQ ID NO: 67416 - RNA, 3516 nt, Artificial Sequence
  derived and/or modified sequence opt5 from CHL1__Homo_sapiens__NP_001240317
auggagccccugcuccugggcagagggcuuaucguguaccugauguuccuccugcuuaaguuuagcaaagccauugaaaucccuuccucuguccagcaaguuccgaccauuaucaagcagagcaaaguccagguggcuuuccccuuugacgaguauuuccagauugaaugcgaggccaagggaaacccugaacccacauuuuccuggacgaaagauggcaauccuuucuacuuuaccgaccaccggaucauccccucuaacaauagcgggacauuccgcauuccuaacgagggacauaucucccacuuucaaggcaaguauagauguuucgcgucuaauaagcuggggauugcuaugagcgaggaaaucgaguuuauugugccguccgugcccaaauucccuaaggaaaagaucgauccccucgagguugaggaaggagacccuauugugcugcccugcaacccgccuaagggccugcccccucuccauaucuacuggaugaauaucgagcuggaacacauugagcaggaugaacgggucuauaugagccagaaaggcgaccuuuacuuugccaacguggaggagaaggauucucgcaaugacuauuguugcuucgccgcuuuccccagacugcggaccaucguucagaagaugcccaugaaacucacagugaacucccugaagcaugccaaugauucuagcuccagcaccgaaauugggucuaaagcuaacuccaucaagcaacgcaaaccuaaacuucugcucccgcccacagagagcggauccgaaucuagcauuaccauccugaaaggcgagauccugcuccuggaauguuuugccgaggggcuuccuacgccccaggucgacuggaauaagauuggaggcgaucugccuaaggggagagagaccaaagaaaacuacggaaagacacucaaaaucgagaauguguccuaccaggacaagggcaacuaucggugcaccgcgagcaacuuccugggcacagccacccacgauuuucacgugauugucgaagaacccccgcgcuggacgaaaaagccucagucugcuguuuacuccacagggagcaauggaauccuucugugugaagccgagggcgagccccaaccuaccauuaaguggagagugaacgggucucccguggacaaucauccuuucgcuggagacgucguguuuccccgggaaaucagcuucacaaaccuccagccgaaucacaccgccguuuaucagugcgaggcguccaacgugcauggcaccauccuggccaaugcuaacauugaugucguggacguucgcccucugauccaaacaaaagauggggaaaauuacgccacgguggucggauauucugcuuuucuccacugugaguucuuugccagccccgaggccguggucuccuggcagaagguggaagagguuaaaccccuggaaggcagacgguaccacauuuaugagaacggcacccuucagaucaaucgcacaaccgaagaggacgcugggagcuacucuugcuggguggagaacgcgauuggaaagacagccgucaccgcuaaucuggauaucagaaacgccacgaaacuccggguguccccuaagaauccgcgcauucccaagcugcauaugcuugaacugcacugugagagcaaaugcgacucucaucucaagcacucccugaaacugagcugguccaaggauggcgaagccuucgagaucaacgggacagaagacggaagaaucauuaucgauggcgcuaaccucaccauuucuaauguuacccuggaggaccaggggaucuacugcuguagcgcccauacagcgcuugauuccgcugccgacauuacccaagugacaguccuggacgugccugaucccccugagaaccuccaccugucugaacggcagaauagaagcgugcgccugacgugggaggccggcgcugaccacaacuccaauaucagcgaauauaucguugaguuugaaggaaacaaagaggagcccggccggugggaggagcuuaccagaguccaggggaagaagacaaccgugauucucccucuggcccccuucgugcgcuaccaguuucgggucaucgcugugaaugaaguuggaagaucucaaccgucccagccuagcgaucaucacgagacacccccugccgcgcccgaccgcaacccgcagaauauucgggugcaggccucucaaccuaaagagaugaucauuaagugggaaccccugaaauccauggagcagaacggcccugggcucgaauauagagucaccuggaagccccagggagcucccguggagugggaagaggagacgguuaccaaucauacacugcgcgugaugaccccugccgucuacgcuccguaugaugugaaaguucaggccaucaaccaacuuggcagcgggcccgacccucagucugugacacuguacagcggcgaagauuaucccgacaccgcgccugucauccacggaguggaugugauuaauuccacgcucgucaagguuacauggagcaccgugcccaaagaccgggugcacggcagacugaagggguaccagaucaacugguggaagacaaaaucucugcuugauggacggacccauccuaaggaggucaauauucuccgcuucuccggccaaagaaacagcgggauggugccgucccuggacgccuucucugaauuucaccugaccguucucgcuuacaacagcaaaggagccggccccgaguccgaaccuuauaucuuccagacacccgagggggugccugagcagcccacguuucugaaggucauuaaaguggauaaggacaccgcuacacuuucuuggggccugccgaagaaacucaauggaaaccugaccggcuaccugcuucaguaucaaaucaucaaugacacauacgaaauuggggagcucaacgauaucaauauuaccacgccuagcaagcccuccuggcaucugucuaaccugaaugccacaaccaaauauaaguucuaccuccgggccugcaccagccagggauguggcaaacccaucacagaagaguccagcacccugggggaaggaaaguaugcuggccuuuacgacgauauuucuacacaggggugguuuaucggccugaugugcgcgauugcccuccugacgcugcuucuccugaccguuuguuucgugaagagaaaccgcggaggcaaauacuccgucaaggagaaagaggaccugcacccugaucccgaaauccagagcgugaaggacgagacauuuggggaauauucugauuccgacgagaaaccucucaagggaagccugcggucucuuaauagagauaugcaaccgaccgaguccgcugacagccugguugaauacggcgagggggaucauggacucuucuccgaagacggcagcuuuaucggcgccuaugccgggucuaaggagaaaggaagcguggaauccaacggcucuagcacagcuaccuucccccugcgcgccuga

SEQ ID NO: 67417 - RNA, 1962 nt, Artificial Sequence
  derived and/or modified sequence opt5 from CHM__Homo_sapiens__NP_000381
auggccgacacccugcccagcgaguucgaugugaucgucauuggcacagggcucccugaauccaucauugcugccgcgugcucuagaagcggacggcgcguucugcacguggacuccagaucuuacuauggcgggaacugggcuagcuuuuccuucucuggacuucugagcuggcucaaggaguaccaggaaaauuccgauaucgugagcgacucuccggucuggcaagaucagauucuggagaacgaagaggccaucgcccuuucccggaaagacaagacgauccagcauguggagguguuuuguuaugcuagccaggaucugcacgaagacguugaggaagccggcgcucuccaaaagaaucaugcccuggucaccucugcgaacuccacagaggccgcugauagcgccuuccugcccaccgaggacgaaucucucuccacaaugagcugcgagaugcugaccgaacagacaccuuccucugaucccgagaaugcucuugaagugaacggggccgagguuaccggagagaaggaaaaucacugugacgauaaaacgugcgugccuagcaccuccgcggaggacaugagcgaaaacguccccauugccgaggacacaaccgaacagccuaagaagaaucgcaucacauacucucagauuaucaaagagggcagacgguuuaacauugaucugguguccaagcuccuguauagccgcggccuucugaucgaccuccugauuaaaucuaaugugagcagauacgcugaguucaagaacaucacccggauccuggccuuucgcgaagggagagucgagcaaguuccguguucccgggcugauguguucaauucuaaacagcucacgaugguggaaaagcgcaugcugaugaaguuucuuacauucugcauggaguaugaaaaauaccccgacgaguacaagggauaugaggaaauuaccuuuuacgaguaucugaaaacacagaagcucaccccuaaccugcaguacaucgucaugcauagcauugccaugaccuccgaaacagccagcucuacgaucgauggccuuaaagcuaccaagaauuuccugcacugucucgggagauauggaaacacacccuuucuguucccucuguacggccaaggggagcucccccagugcuucugucggaugugcgcgguguuuggaggcauuuauugucugcgccacuccguucagugccuuguggucgacaaagagagcagaaagugcaaggccaucaucgaucaauucggccagcggauuaucucugaacauuuucugguggaggacuccuacuucccggaaaacauguguagcagaguucaguaccgccagauuucccgggcugugcucaucaccgauagaucuguccugaaaacagacagcgaucaacagauuuccauccuuaccgugccugccgaggaacccgggacguuugccguccgcgugaucgagcugugcucuagcacaaugaccuguaugaagggaaccuaucucguucaccugacaugcaccuccagcaaaacagcucgggaggaccuggaaucugugguccagaaacucuucgugccuuacacggagauggaaauugagaaugaacagguugagaaacccagaauccugugggcccuuuauuuuaacaugcgcgacuccagcgauauuucucgguccuguuacaaugaccugcccagcaacguguaugucugcucuggcccugauugugggcucggaaaugacaacgcggugaagcaagcugagacccuguuccaggaaaucugcccgaaugaggauuuuugucccccucccccuaaccccgaagacauuauccuggauggcgacagccuucagccggaggccuccgaaagcucugccauuccugaggcuaauuccgagacauucaaggaaagcaccaaccucgggaaucuggaggaauccucugaguga

SEQ ID NO: 67418 - RNA, 1971 nt, Artificial Sequence
  derived and/or modified sequence opt5 from CHML__Homo_sapiens__NP_001812
auggccgacaaccugcccaccgaguucgauguggucaucauuggcacagggcucccugaaagcauccuggcugccgcgugcuccagaucuggacagcggguucuucacauugacagccgcuccuacuauggcgggaauugggcuucuuuuagcuucuccggacugcucucuuggcugaaggaguaccaacagaacaaugauaucggcgaagagagcacggugguguggcaggaccuuauucaugaaaccgaggaggccaucacacugcggaaaaaggaugaaaccauccagcacacagaggccuuuugcuaugcuucccaagacauggaagauaacgucgaggagauuggggcccuccagaaaaauccgagccugggagugucuaacaccuucacagaaguucuggacuccgcucuccccgaggaaagccagcugucuuacuuuaauuccgaugagaugccugccaagcauacccagaaaagcgacacggaaaucucucuugaggugaccgaugucgaggaauccguggagaaggaaaaguauugcggcgacaaaacauguaugcacaccguuagcgauaaggacggcgacaaagaugaguccaagucuacaguggaagacaaagcggaugagcccauuagaaaccgcaucaccuacagccaaauugucaaggaggggagacgguucaauaucgaccugguguccaagcuccuguauagccagggacuucugauugaucuccugaucaaaucugacgugucccgcuacgucgaauuuaagaacguuacgagaauccuggccuuccgggagggcaaaguggaacaggugccuugcagccgcgcugaugucuuuaauucuaaggagcucacaaugguggagaaaagaaugcugaugaaguuccuuaccuuuugucuggaauacgagcagcaucccgacgaauaucaagccuuccggcagugcagcuuuuccgaguaccucaaaacaaagaagcugaccccuaaccuucagcacuucguucugcacucuauugcuaugaccagcgaauccagcuguacaacgaucgaugggcucaaugccaccaaaaacuuccugcaaugccugggacgcuuuggcaauacaccguuccucuuuccccuguaugggcagggagagauuccucagggcuucuguagaaugugcgcgguguuuggcgggaucuacugucuucggcauaagguccagugcuucgugguugacaaagagucuggacgcugcaaggccauuaucgaucacuuuggccaaagaaucaacgcuaaauauuucauuguggaagacuccuaccugagcgaggaaaccuguucuaacguccaguauaagcagaucucccgggccgugcucauuacagaccagagcauccugaagaccgaucuugaccaacagacguccauucugaucgugcccccugcugagcccggggccugcgccgucagaguuacagaacucuguucuagcaccaugaccugcaugaaagauacauaccuggugcaucugaccuguuccucuagcaagacagcucgcgaggaccucgaguccgucgugaaaaagcuguuuacgccguacaccgaaacagagaucaaugaagaggaacuuaccaaaccucggcugcucugggcgcuguauuucaacaugagagauagcucuggaauuucccgcagcucuuacaauggccugcccuccaacguuuaugugugcagcgggccugacuguggacuuggcaaugagcacgccgucaagcaggcugagacacucuuucaggaaaucuuccccaccgaggaauuuugucccccuccgcccaacccugaggauauuaucuucgacggcgaugacaagcaacccgaagccccugggacgaauaacguggugauggccaaacuggagucuagcgaggaauccaagaaucuggagagccccgaaaaacaccuccagaacuga

SEQ ID NO: 67419 - RNA, 723 nt, Artificial Sequence
  derived and/or modified sequence opt5 from CHMP1A__Homo_sapiens__NP_001076783
auggacgugcacggcgaggccgcuggggaagccggacaggagggcggggaaggacugcaaggcggggcgggacagagcgaggaaggccccuccgcugagaagugcagagucuguccuugcguuugucgggagcgccauccgcaggaagagagacggugcgaacucgccucugauggcgugccccgcagacggagcgggcugcagggagccgacuccugugauuacgagggcggggaccaagaguauggaccuggcgaucagucucccgggcagggaccugaacaccauggccccgcugagggccuucugagcgacggacaggugcgcgccgcuggggccgaaccuggcagaccguacaucggggauggaggccuccacgagcuggggcaucaccccgaccacgcggccggagcuggcggccaaccucaucacgccgaucggcgcggggaauggcccggaggcgcugggccugcccagcccgcggccagaggacggcuuugccgcggcagagagcugugugcucagccugggggcccggccgucaccgaggugggacggcucgaggaacuggcuguuccccgcagaugcgccccuccccugccccgggacgugcucgaaggcuccuguccucugccgacagccucuugccuuugugcugaucccgcggggcugagaccugccgcuacgcuccgccugagccccgcccggccugccuggcccuga

SEQ ID NO: 67420 - RNA, 600 nt, Artificial Sequence
  derived and/or modified sequence opt5 from CHMP1B__Homo_sapiens__NP_065145
augagcaacauggagaagcaccuguucaaucucaaauuugccgcuaaggaacuguccagaucugccaaaaagugcgacaaagaggaaaaggcggagaaggcuaaaaucaagaaagccauucagaagggcaacauggaaguggcccggauccaugcugagaaugccauucgccagaaaaaccaagcugucaauuuccuuagaaugagcgcccggguugaugcgguggccgcucgcgugcagaccgccgucacaauggggaaggugacgaaguccauggcuggaguugugaaaucuauggacgccacccugaagacaaugaaccucgagaaaaucagcgcgcugauggauaaguuugaacaccaguucgagacccuugacguccaaacacagcagauggaagauaccauguccucuacaaccacgcugaccacaccccagaaucaaguggacaugcuccugcaggagauggccgaugaggcuggccuggaccucaacauggaacugccucaggggcagaccggaagcguuggcacauccguggccagcgcugagcaagaugaacuuucucagagacuggcccggcuccgcgaccaggucuga

SEQ ID NO: 67421 - RNA, 519 nt, Artificial Sequence
  derived and/or modified sequence opt5 from CHMP2B__Homo_sapiens__NP_001231573
auggagcuggaaaucaagaaaauggccaagauuggcaacaaagaggcuugcaaggugcucgccaaacagcugguccaccuuagaaagcaaaagacccggacauucgcgguuagcuccaaagugacgucuaugagcacccagacaaaggugaugaacucccagaugaaaauggcuggggccaugucuaccacagccaagaccaugcaggcugucaauaaaaagauggacccccaaaagacacugcagaccaugcagaauuuucagaaagaaaacaugaagauggagaugacggaagagaugaucaaugauacccucgacgauauuuucgacggaagcgaugacgaggaagagucccaagauaucgugaaccagguucuggacgaaauuggcaucgagaucucugggaaaauggccaaggcuccuagcgccgcgcgcucccuuccgagcgccucuacauccaaagcuaccauuagcgaugaggaaaucgagagacagcugaaggcccucggaguggacuga

SEQ ID NO: 67422 - RNA, 471 nt, Artificial Sequence
  derived and/or modified sequence opt5 from CHMP3__Homo_sapiens__NP_001005753
augaucagaagccggaaggccguguccaaacuguacgcuucuaaggcccacaugaacagcguccucaugggcaugaaaaaucagcuggcgguucuucgcguggcugggucccugcaaaagucuaccgaggugaugaaagccaugcagagccucgucaagauucccgaaauccaggccacaaugagagagcuguccaaggaaaugaugaaagcuggaauuaucgaggaaaugcuugaggacacguucgagucuauggaugaccaggaagagauggaagaggaggccgaaauggagauugaucggauccuguuugaaaucaccgcuggcgcccucgggaaggcgccuagcaaagugacagacgcccugccggagcccgaaccucccggagcuauggccgcuuccgaggaugaggaagaggaagaggaagcccuggaggcgaugcaaagccgccucgccacccugagaucuuga

SEQ ID NO: 67423 - RNA, 798 nt, Artificial Sequence
  derived and/or modified sequence opt5 from CHMP4A__Homo_sapiens__NP_054888
augagcagacggcgccccgaggacggccuggggaaggccggaccuugcgugaugagacaccauccgccccgguccaaagcugaagucuggcgcacccucagaggcgggggaggccgcggggagcuggccaugucuggacuuggccggcuguucggcaaggggaaaaaggaaaaaggaccuacacccgaggaagcgauccagaagcucaaggagacggagaaaauucugaucaagaaacaagaauuucuugagcagaagauucagcaggaacugcaaaccgcuaaaaaguacggcacaaagaacaaaagagccgcccuccaggcucugcggcgcaagaaaagauucgagcagcagcuggcccaaaccgaugggacacucagcacccuggaguuucagcgggaagcuaucgagaaugccacaaccaacgcggaaguucuucgcacgauggagcuggccgcucaguccaugaagaaagccuaucaggacauggauauugacaagguggaugaacucaugaccgacaucacagagcaacaggagguggcucagcaaaucucugaugccauuagcagaccuaugggauucggcgacgaugucgacgaagaugagcugcuugaagaacuggaagaacucgagcaggaggagcuggcgcaggaacugcucaaugugggggacaaagaggaggagcccuccguuaagcugccuucugugccgagcacccaccuucccgccggaccugcucccaaggucgaugaggacgaagaggcccugaaacagcucgcugaauggguguccuga

SEQ ID NO: 67424 - RNA, 675 nt, Artificial Sequence
  derived and/or modified sequence opt5 from CHMP4B__Homo_sapiens__NP_789782
augagcguguucggcaagcuguuuggggccggaggcgggaaagcuggaaagggcgggcccaccccucaggaggccauccaaagacuccgggacacagaagagaugcuguccaaaaagcaggaguuccuugagaaaaagauugaacaggagcugacggcggcuaagaaacacggaaccaagaacaaacgcgccgcccuccaggcucugaagcggaaaaagagauacgagaagcaacuugcccagaucgauggcacacugucuaccauugaauuucagcgcgaggcucucgaaaaugccaacacaaauaccgagguccugaaaaacaugggcuaugcggccaaggcuaugaaagccgcucaugacaauauggauaucgacaagguugaugagcugaugcaggacauugccgaucaacaggaacucgcggaggaaaucagcacagccaucuccaaaccggugggguucggagaggaauuugacgaggaugagcugauggcugaacuugaggaacuggagcaggaagaacucgacaagaaccugcuugagauuucuggccccgaaaccgugccucugcccaaugucccuagcaucgcccuccccuccaaaccugcuaagaagaaagaggaagaggaugacgauaugaaggaacuggagaacugggccgggucuauguga

SEQ ID NO: 67425 - RNA, 702 nt, Artificial Sequence
  derived and/or modified sequence opt5 from CHMP4C__Homo_sapiens__NP_689497
augagcaagcugggcaaauucuuuaaagggggaggcuccucuaaaagcagagccgcucccuccccucaggaggcccucgugcggcugcgcgaaaccgaggaaaugcuugggaagaaacaagaguaccuggaaaacagaauccagcgggagauugcgcucgcuaagaagcacggaacacagaauaaacgcgccgcccugcaggcucuuaagagaaagaagcgguucgagaaacaacugacgcagaucgacggcacccucucuacaauugaauuucagcgcgaggcccuggaaaacagccauaccaauacagagguccugagaaacaugggguucgcugccaaggcgaugaaguccguucacgagaauauggaucucaacaaaaucgacgaucugaugcaggaaauuaccgagcaacaggacaucgcccaggaaaucucugaggcuuuuagccagcgggugggauucggcgaugacuuugaugaagacgagcuuauggccgagcuggaggaacucgaacaagaggaacugaauaagaaaaugacaaacauucgccuuccgaaugugcccuccagcucucugccugcucagcccaacagaaagccuggcauguccagcaccgcccggcgcucuagagcggccuccagccagcgggcugaggaggaagaugacgauaucaaacaacucgccgcuugggccacguga

SEQ ID NO: 67426 - RNA, 516 nt, Artificial Sequence
  derived and/or modified sequence opt5 from CHMP5__Homo_sapiens__NP_001182465
augaacagacuguucggcaaggccaaacccaaggcuccuccgcccagccucaccgacugcaucgggacaguggauucccgggccgagucuauugacaaaaagaucagccgccuggaugcggaacuugucaaauacaaggaccagauuaagaaaaugagagagggaccugcuaagaauaugguuaaacaaaaggcccugcgggugcucaaacagaagcgcauguaugaacagcagagagauaaccuggcccaacaguccuuuaauauggagcaggcuaacuacacgauccagucucuuaaggacaccaaaacaaccguggaugccaugaagcugggcgucaaagaaaugaagaaggcuuauaaacaagugaaaauugaccagaucgaggaucuccaggaccagcuggaggauaugauggaagacgccaaugagauccaagaagcgcugagccgguccuacgggacacccgagcucgaugaggacgaccuggaagccggauggucuagcggcggguga

SEQ ID NO: 67427 - RNA, 1302 nt, Artificial Sequence
  derived and/or modified sequence opt5 from CHN1__Homo_sapiens__NP_001020372
auggcccugacccucuucgacacagaugaguacagacccccuguguggaaaagcuaucuguaccagcuucaacaggaagcuccgcacccccggcgcaucacgugcaccugugaggucgaaaacagaccuaaguauuacggccgggaguuucaugggaugauuucccgcgaagccgcggaccagcugcucaucguugcugagggaucuuaucugauuagagagagccagcggcaacccggcacauacacccuugcccugcgcuucgggucccagacaagaaauuuucggcucuauuacgauggaaagcacuucgugggcgaaaaacgcuuugagucuauccaugaccuggugaccgaugggcugauuacacucuacaucgaaaccaaggccgcugaguauaucgccaaaaugacgauuaacccuaucuacgagcacgucggauauaccacacugaauagagaacccgcuuacaagaagcauaugccugugcuuaaagagacccacgacgaacgggauagcacaggccaggacggcguuuccgagaagcgcgugcacaccuucagagggccgcauuggugcgaauauugugccaacuuuauguggggacugauugcgcagggcgucaaaugcgccgauugugggcucaaugugcacaagcaaugcucuaaaaugguucccaacgacuguaagccugaucugaagcaugugaaaaaggucuacagcugcgaccuuacgacacuggugaaagcucacaccacaaagcggcccaugguggucgauauguguauccgcgagauugaguccagaggacucaauagcgaaggccuguaucggguuucuggguucuccgaccugaucgaggacgugaaaauggccuuugauagagacggagaaaaggcugauauuagcgugaacauguacgaggacaucaauaucauuaccggcgcccucaaacuguacuuccgcgaucuuccuaucccccugauuaccuaugacgcguacccgaaguuuaucgaaucugccaagauuauggauccugacgagcagcucgagacacugcacgaagcucuuaaacugcugcccccugcccauugcgagacgcuccgguaucugauggcucaccucaagagagucacccugcaugaaaaagagaaccuuaugaaugccgaaaaccugggcaucguguucgggcccacacucaugcgcucccccgagcuggaugccauggcugcgcuuaaugacauccgguaccagagacugguuguggagcuccugauuaagaacgaagauauccuguuuuga

SEQ ID NO: 67428 - RNA, 999 nt, Artificial Sequence
  derived and/or modified sequence opt5 from CHN2__Homo_sapiens__NP_001035025
auguucagcgaggaacuguggcucgagaacgaaaagaaaugcgccguggucagaaaguccaaacagggccggaagcgccaagagcugcuugcuguugccuuuggggugaaagugggagucaagggcggguuccuguggcccccucucaagcuguuugcguguucucagaucagcucccuugugagacgggcugcccugacccacaaugacaaccauuucaauuacgagaaaacacacaacuuuaagguucauacguuccgcggaccgcacuggugcgaauauugugccaauuuuauguggggccucauugcucagggggugagaugcucugauuguggacugaacguccauaaacagugcagcaagcacgugcccaaugacugucaaccugaucugaaacggaucaagaagguuuacugcugugaccucaccacacuggugaaagcccacaacacccagcgccccauggucguggauauuugcaucagagagauugaagcucggggccuuaaguccgagggccuguaucgcgugucuggguucacagaacauaucgaggacgucaaaauggccuuugauagagacggagagaaggcggauaucagcgccaauguuuacccugacauuaacaucauuaccggcgcucucaaacuguauuuccgggaucuucccaucccugugauuacauacgacaccuauuccaaguuuaucgaugccgcuaaaauuagcaaugccgacgaacgccuggaggcggugcacgaaguccucaugcugcugccgcccgcccauuacgagacgcucagauaccugaugauccaccuuaagaaggugaccaugaacgaaaaagacaauuucaugaacgcugagaaucuggggaucguuuuuggaccuacacucaugcggcccccugaggauucuacccugacaacccuucacgacaugcgcuaucagaagcugauugugcagauccucauugaaaacgaggauguccuguucuga

SEQ ID NO: 67429 - RNA, 765 nt, Artificial Sequence
  derived and/or modified sequence opt5 from CHODL__Homo_sapiens__NP_001191103
augaccgccggcagcgcucacucccagaaggugugcuucgccgacuuuaaacaucccuguuacaagauggcguauuuccacgagcugucuagcagagucuccuuucaagaagcucggcucgccugcgagucugaagggggaguucugcuuagccuggagaacgaagccgagcagaaacucaucgaguccaugcugcagaaucuuacaaagccuggcacggggauuucugauggagacuucuggaucggccuguggcgcaacggggauggacagaccagcggcgcuuguccggaccucuaccaaugguccgauggcagcaauucucaguauagaaacugguacacagacgaacccuccugcgggagcgagaaauguguggugauguaucaucagccuaccgccaaucccggacugggcgggccuuaccuguaucaguggaacgaugaccggugcaauaugaagcacaacuacauuuguaaguacgaacccgagaucaauccuacagcuccggucgagaaacccuaucucaccaaccaaccuggagauacacaucagaaugugguugugaccgaagccggcauuauccccaaccugaucuacgucgugauuccuacgaucccccuucugcuccugauucuuguugcguuugggaccugcuguuuccagaugcugcacaagucuaaaggacgcacaaagaccuccccgaaucagagcacacucuggaucucuaaauccaccagaaaggagagcggcauggaaguguga

SEQ ID NO: 67430 - RNA, 942 nt, Artificial Sequence
  derived and/or modified sequence opt5 from CHORDC1__Homo_sapiens__NP_001137545
auggcccugcucugcuacaacagaggcugugggcagcgguucgaccccgagaccaauagcgaugacgcuugcacauaucacccuggagugccggucuuucaugaugcccugaagggcuguacgaaagggcgccacaacuccgaaaagcccccugagcccguuaaaccugaagugaagaccacagagaaaaaggaacuuugcgagcugaagcccaaauuccaagagcauaucauucaggcgccuaagccgguggaagcuaucaaaagacccucuccugacgagcccaugaccaaucucgaacugaagauuagcgccucccuuaaacaggcccuggauaagcucaagcugucuagcggaaacgaggagaauaaaaaggaagaggacaacgaugaaaucaaaauuggcacauccuguaagaaugggggaugcucuaaaaccuaccagggccuggagagccucgaagaggucuguguguaucacuccggcguuccuaucuuucaugaggggaugaaguacuggagcugcugucggcgcaaaacaucugacuucaacaccuuucuggcucaagaaggaugcacgaagggcaagcacauguggaccaaaaaggaugccgggaaaaaggugguccccuguagacacgacuggcaucagacaggaggcgaggugaccaucuccguuuaugcuaaaaauagccuuccggaacugucucggguggaggccaacuccacacuccugaauguccacauuguguucgaaggggagaaggaguuugaucagaacgugaaacuuuggggagucaucgacguuaagcgcagcuacgugaccaugacggcgacaaagauugaaaucaccaugagaaaagccgagccuaugcagugggcuucucuggaacuccccgccgcuaagaaacaagagaagcagaaggaugccacaaccgacuga

SEQ ID NO: 67431 - RNA, 588 nt, Artificial Sequence
  derived and/or modified sequence opt5 from CHP1__Homo_sapiens__NP_009167
augggcagcagagccuccacccugcuccgggacgaggaacuggaggaaaucaagaaagagacaggguucucucacagccagauuacgcgccuuuacuccagauuuaccucucuggauaagggagaaaacggcacacucagccgggaggacuuccaacgcauccccgagcuggcuauuaauccucuuggggauagaaucauuaacgccuuuuucccggaaggagaggaccaggugaauuuucggggcuucaugcgcacccuggcgcauuuuagacccaucgaagauaacgagaaauccaaggacgucaaugggccugagccccucaacucucggagcaauaaacugcacuucgcuuuucgccuguaugaucucgacaaggaugaaaagaucuccagagacgagcugcuucagguucugcggaugauggugggagugaacauuagcgaugaacagcucggcucuaucgccgaccgcacaauucaagaggccgaucaggacggcgacuccgcuaucagcuucaccgaauuugucaaagugcuggagaagguugauguggagcagaaaaugucuauuagauuccuucauuga

SEQ ID NO: 67432 - RNA, 591 nt, Artificial Sequence
  derived and/or modified sequence opt5 from CHP2__Homo_sapiens__NP_071380
augggcagcagauccucucacgccgcugugauccccgacggggauagcauuagacgcgagaccggauucucccaggccucucugcucagacugcaucaccgguuucgcgcgcuugacagaaacaagaaaggcuaccugagccggauggaucuccaacagaucggggcucuggccgucaauccucuuggagaccgcauuaucgaauccuucuuuccggauggcucucagagaguugacuuccccggguuugugcgggugcuggcccauuuccgcccugucgaggaugaagacacagagacgcaggaucccaagaaaccugaaccccucaacagcagacggaauaagcugcacuaugcuuuucaacuguacgaccucgaucgcgacggaaaaauuuccagacaugagaugcuucaggugcugcggcugaugguuggcgugcaggucaccgaggaacagcucgagaacaucgccgaucgcacagugcaagaagcugacgaggacggcgauggggccguuagcuucguggaguuuaccaagucucuggaaaagauggacgucgagcagaaaauguccauccggauucuuaaguga

SEQ ID NO: 67433 - RNA, 2328 nt, Artificial Sequence
  derived and/or modified sequence opt5 from CHPF__Homo_sapiens__NP_078812
augagagccagccugcuccuguccgugcuucggcccgcuggcccugucgccguugggaucucucugggauucacccucagccugcuuuccgugacauggguggaggaaccgugcggccccgggccuccccagccuggagacucugagcugcccccucgcggcaacacgaaugcggcuagacggccgaacagcguccaacccggggccgaacgcgagaagccuggagccggcgaaggcgcuggggagaauugggagcccagagugcucccuuaccaccccgcccagccgggacaggcugccaaaaaggcgguucggacccgcuauauuuccacagaacugggcaucagacagcggcugcucguggccguccugaccucucaaacaacccuuccuacacuggggguggcuguuaaccgcacccucggacauagacuggagcggguggucuuucuuacgggcgcccgcgggagacgggcucccccuggaauggccguggugacccugggcgaggagcgccccauuggccaccuccaucuggcgcugagacaccuccuggagcagcauggggaugacuucgauugguuuuuccuuguccccgacacaaccuacacagaagcccacggacuggcucggcucaccggccaccugagccuugccuccgcugcccaucuguaucucgggagaccucaggauuuuaucggaggcgagccgacgcccgggcgcuacugucacggaggcuucggcguucugcugagccggaugcuccugcagcaacuuagaccucaucuggaagggugccgcaaugacauugugucugcccggcccgaugaguggcucggaagauguauccuggacgcuacaggcguggggugcaccggagaucacgaaggcguccacuauucccaucuugagcugagcccuggggagcccgugcaggaaggcgacccgcacuuucgcucugcgcucacagcccauccuguucgggaucccgugcacauguaccagcugcauaaagccuucgccagagccgagcuggaacgcaccuaucaggagauccaagaacuccagugggagauucagaacaccucccaccuggcugucgacggagaucgggccgcggcuuggccugugggcauccccgccccuagcagacccgccucucgcuuugagguucuucggugggacuacuucacagaacaacacgcuuuuuccugugccgacgggagcccgagaugcccucugcggggagcugaucgcgccgacguggcggauguccucggcacggcccuggaggaacugaauagacgguaccaucccgcucuuagacuccagaagcagcagcuggugaacggguaucgccgguucgaccccgccagaggaauggaguacacccuggaucuccaacuggaagcucuuacaccucagggcgggcgcagaccgcugacccggcgcguccagcuccugagaccccugucccggguggagauucuuccuguucccuaugugacagaggccucucgccucaccguccugcugccucucgcggccgcugaaagagaccuggcccccggcuuucuugaggcuuucgccacggccgcucuggaaccuggagaugcggccgcugcccucacacugcugcuucucuacgagccccggcaggcccaacgcguggcucacgccgacguuuucgcgccggugaaagcucaugucgccgagcuggaaagacgguuuccuggcgcccgcgugcccuggcugagcgugcagaccgcugccccuagcccccucagacugauggaucuucuguccaagaagcacccgcucgacacccuguuccugcuugcggggccugauacaguucucacccccgacuuucugaaucgguguagaaugcacgcuaucucuggauggcaggccuucuuuccuaugcauuuccaggccuuucaccccgcugucgcucccccucaaggcccggggcccccugagcugggacgcgacacaggccgguucgauagacaggcugccuccgaagcgugcuuuuauaacagcgacuacguggccgcucgcgggcggcucgccgcugccucugagcaggaagaggagcugcuugaaagccuggauguguaugaacucuuccugcauuuuuccucucugcacguccuuagagccguggaacccgcucugcuccagcgcuaccgggcgcaaacguguagcgccagacuguccgaggaccucuaccaucgcugccugcagagcguucuugaaggccugggaucucggacccagcucgcuaugcugcuguucgagcaagagcagggcaauuccacauga

SEQ ID NO: 67434 - RNA, 1221 nt, Artificial Sequence
  derived and/or modified sequence opt5 from CHPT1__Homo_sapiens__NP_064629
auggccgcuggcgccggggcgggaagcgcucccagauggcugcgggcccucuccgagccucugucugccgcucagcuucgcagacuggaggagcaccgguacagcgccgcuggcgugucccuccuggaaccgccccuucaacuguauuggaccuggcuccugcaguggaucccucuguggauggcccccaacucuauuacacuccuggggcuugcggucaauguugugacgacccuggugcucaucagcuacugcccuacagccaccgaggaagcucccuauuggacauaccugcuuugugcccugggacucuucauuuaucagucccuggacgcuaucgauggcaagcaggcccgcagaaccaacucuugcagcccucugggggagcucuuugaccauggaugugauucccugagcacagucuucauggcggugggcgccucuauugcugcccggcuuggcaccuacccggacugguuuuucuuuugcuccuucaucgggauguuuguuuucuauugugcucacuggcaaacguacgugagcggaaugcugcgcuuuggcaaagucgaugugaccgagauccagauugcccucguuaucguguucguccugucugccuuugggggagcuacaaugugggacuacaccauucccauccuugaaauuaagcugaaaauccucccugugcugggcuuccucgggggagugaucuuuuccugcagcaauuauuuccaugucauucugcacggcggcguugggaagaacggaucuacaaucgcgggcaccuccgugcugagccccgggcuucauauuggacugaucauuauccucgccauuaugaucuacaaaaaguccgcuacggauguguucgagaagcacccuugucuguauauccuuauguuuggcugcgucuucgccaaagugucucagaagcugguuguggcccacaugacaaaaagcgaacucuaccugcaggacaccgucuuucuggggcccggacuccuguuccuugaucaauauuuuaauaacuucauugacgaguacgugguucuguggauggcuauggugaucuccagcuuugauauggucauuuauuucucugcccucugucugcagaucuccagacaucugcaccuuaauauuuuuaagacagcgugccaucaggcuccggaacaggugcaaguccucagcucuaaaagccaccagaacaauauggacuga

SEQ ID NO: 67435 - RNA, 396 nt, Artificial Sequence
  derived and/or modified sequence opt5 from CHRAC1__Homo_sapiens__NP_059140
auggccgacguggucguuggcaaggauaaagggggagagcagagacugaucagccucccccugucccggauucgcgugaucaugaagucuagcccugaaguguccucuauuaaccaagaggcucuuguccugaccgccaaagcgacagaacucuucgugcagugccuggcuacguacagcuauagacacggcuccgggaaggagaaaaagguucuuaccuacucugaccuggccaauacagcccagcagagcgaaaccuuucaauuccucgcugauauccugccgaagaaaauucuggccuccaaguaucucaaaaugcugaaggaggagaaacgggaagaggacgaagagaacgauaaugacaacgagagcgaucaugacgaagcugauucuuga

SEQ ID NO: 67436 - RNA, 2865 nt, Artificial Sequence
  derived and/or modified sequence opt5 from CHRD__Homo_sapiens__NP_001291401
augcccagccugccugccccgcccgcuccucuccugcuucugggccuccugcuucugggguccagacccgcccggggagcgggcccugagcccccugugcucccgauccgcucugaaaaggagccccugccugucagaggggcugccggaugcaccuucggcgggaaaguuuacgcccuggacgaaacauggcaccccgaucucggagagccuuuuggcgugaugcggugugugcugugcgcuugugaagcuccccaguggggccgcagaacgcgggggccgggacgcgucagcugcaagaacauuaaaccugagugucccaccccugccugcggccaacccagacagcuucccgggcauuguugccagacauguccucaggagcgguccucuagcgaacgccaaccguccggacugucuuucgaguaucccagagacccugaacaccggagcuacuccgaucgcggcgagcccggggccgaggaaagagcgcggggagacggccauaccgauuuuguggcccuccugacaggcccucgcagccaggcuguugccagagcucgggugucucuucugagauccagccuccgcuucucuaucuccuaucggagacuggaccgccccacccggauuagauuuagcgauucuaauggguccguccuguucgagcacccggccgcgccuacacaggacggacucgugugcggcguuuggcgcgccgugccccggcugagccuuagacugcuccgcgcugaacagcugcaugucgcccuugugacccugacgcacccuuccggggagguguggggaccccucauccggcacagagcucuggccgccgaaaccuuuucugcuauucugacacucgagggcccuccccaacagggggucggaggcaucacccugcuuacacugagcgauaccgaggacucccuccauuuccugcuucuguuucgcggccuccuggaaccgcggagcgggggacugacgcagguuccucucagacugcagauccuucaccaaggccagcugcuccgggagcugcaggcgaacgugucugcccaagaacccggguucgcugaggugcugcccaaucuuacaguccaggaaauggauuggcucgugcugggagagcugcagauggcccucgagugggccggccgcccugggcugagaauuuccggccauaucgcugccagaaagagcugugacguucuucagucugugcugugcggagcggaugcucucauuccgguccaaaccggcgccgccgggagcgcuucccugacacugcuuggaaacggcucucucaucuaccaggugcagguuguggggaccagcuccgaagucguggccaugacccuggagacaaaaccccagcggcgcgaccaacggacgguccugugccacauggcuggacuccagccuggcgggcacaccgccgugggcauuugucccggacugggcgcgagaggggcccauaugcuucugcagaaugaacucuuucugaacguuggaacaaaggacuucccugauggcgagcugcgcgggcacguggcugcccuucccuauugcggacauagcgcuagacacgacacccucccugucccccuggccggcgcgcuggugcucccgccuguuaagucucaggccgcugggcaugccuggcugucccuugauacacacugucaucugcacuacgaagugcuccuggcuggccugggaggcagcgagcaagggaccgucacggcccaccuucucggacccccuggcacacccgggccgcggcgccugcugaaaggauuuuauggcucugaggcccaggggguggugaaggaccucgaaccugagcugcuuagacaucuggcuaaaggcauggcgucccucaugaucaccaccaagggaagcccccggggcgaacugcgcgggcagguucacauugccaaucagugcgaggucggaggccugagacuugaggcugccggggccgaaggagugcgggcucugggcgccccugauacagcguccgcugccccucccgugguccccggccucccggcccuggcucccgccaaaccugggggacccggccgcccuagagaccccaacaccuguuucuucgaggggcaacagcggccucacggagcgcgcugggcuccgaauuacgauccccucugcucucuguguacaugccagagacggacggugaucugugacccuguugugugucccccucccagcugcccgcauccuguccaagcccccgaucagugcugccccguguguccugaaaagcaggacguuagagaucuucccggccugccucgcucccgggacccgggggagggaugcuacuuugacggcgauagaucuuggcgcgccgcuggcacccgguggcaccccguggucccucccuucgggcucaucaagugugccgugugcacauguaaaggaggcaccggggaaguucauugcgagaaggugcaguguccuagacuggcuugcgcccaacccguccgcgugaacccgacagacuguugcaaacaguguccugugggaagcggcgcgcacccccagcugggggauccuaugcaggccgacggaccccggggcugcagauuugcuggccaaugguucccugagucccagagcuggcaucccucugucccgccuuuuggggaaauguccugcauuaccugucgcugcggagccggcguuccccacugugagcgggaugacugcagccuuccccugucuuguggguccggaaaggaaagcagaugcuguucucggugcacggcucaccgcagaccuccggagacccggacagaucccgaacucgagaaagaggccgaaggcagcuga

SEQ ID NO: 67437 - RNA, 1137 nt, Artificial Sequence
  derived and/or modified sequence opt5 from CHRDL1__Homo_sapiens__NP_001137455
augagaaagaaauggaagaugggcgggaugaaauacaucuucagccugcucuuuuuccugcuucuggagggaggcaagaccgaacaggugaaacacuccgagacauauugcauguuucaagacaagaaguaccgggucggggaacgcuggcaucccuaucucgagccuuacggacugguuuauugugugaacugcauuuguucugaaaauggcaacgugcuuugcagcagaguccgguguccgaaugugcacugccugucccccguucauaucccucaccucuguugcccccgcuguccuggggauggagagcugucuugggagcauagcgacggcgauauuuucagacagcccgccaaccgggaagcucgccacuccuaccacagaucucauuaugacccuccgcccagccggcaggccggcgggcugucccgcuuuccuggagcgagaagccaccggggcgcucucauggauucucagcaagccuccgggacgaucgugcagauugucaucaauaacaaacauaagcacggacaggugugcguuagcaauggcaaaaccuacucucacggggaguccuggcaucccaaccugcgcgccuucggaaucguggaauguguccuuugcacaugcaaugugaccaagcaggaguguaaaaagauucacugcccuaacagauaccccuguaaguauccgcaaaagaucgacggcaaaugcuguaaagugugcccuggcaagaaagcuaaggaggaacugcccgggcagagcuuugauaauaaaggauacuucuguggcgaggaaacaaugccugucuaugagucuguuuuuauggaagacggggagaccacacggaagauugcccucgagaccgaacgcccuccccagguggaggugcaugucuggacgaucagaaagggcauucugcagcacuuccauaucgagaaaauuuccaagcggauguuugaagaacuuccccacuucaaacuggugaccagaacaacccucagccaauggaagaucuuuacagagggagaggcucagaucucccagaugugcucuagccgcguuugucggaccgaacuggaggaucuggugaaaguccucuaccuggaaagauccgagaaggggcacugcuga

SEQ ID NO: 67438 - RNA, 1239 nt, Artificial Sequence
  derived and/or modified sequence opt5 from CHRFAM7A__Homo_sapiens__XP_011520455
augcagaaguacugcaucuaucaacacuuccaguuucagcugcucauucagcaccuguggaucgccgcuaacugugacauugccgaugagagauucgacgcgaccuuucacacaaaugugcuugucaacagcuccggccauugccaauaccugcccccugggaucuucaaaucuagcuguuauauugauguucggugguuuccguucgacgugcagcacugcaagcucaaauuuggauccuggucuuacggcggguggagccuggaucuucagaugcaggaagcugacaucuccggauauauccccaauggcgagugggaucugguggggauuccuggaaagcgcucugaaagauucuacgaguguugcaaagaacccuauccugacgucacguuuaccgugacaaugcggcgcagaacccucuacuacggccugaaccugcucauccccuguguucugauuagcgcccuugcccugcucguguuccugcuuccugcugauuccggcgagaagaucagccuggggauuacaguccuccugucucugaccguguuuaugcuccugguugccgagaucaugccggcuacauccgacagcgugccccuuauugcccaauauuucgcgucuaccaugaucaucgucggacuguccgugguggucacgguuauugugcuccaguaccaucaccacgauccugacggcgggaagaugcccaaauggacccgggugauccugcuuaauuggugcgccugguuucugcgcaugaagagaccuggagaagauaaaguccggcccgcuugucagcauaagcagcgcagaugcagccucgccucuguggagauguccgcuguugccccgccucccgcgagcaacggcaaucugcuguauauuggguuccggggacucgacggcgugcacugugucccuacacccgacuccggcgugguuugcgggcgcauggccugcucucccacccaugaugaacaucugcuucacggaggccaaccuccggagggggaccccgaucuggcuaaaauccucgaggaagugagauacauugccaaccgguuccgcugucaggacgagagcgaagcugucugcuccgaguggaaguuugccgccuguguggucgauagacugugccuuauggcuuucagcguguuuacaaucaucuguaccauuggaauccugaugucugcgccuaauuucguugaagccguguccaaggacuuugcuuga

SEQ ID NO: 67439 - RNA, 1383 nt, Artificial Sequence
  derived and/or modified sequence opt5 from CHRM1__Homo_sapiens__XP_011543044
augaacaccagcgcucccccugccguguccccgaauaucacaguccuggcccccggcaaggggccuuggcagguugcguucauuggaaucacgaccggccuccugucucuugcuacagugaccgggaaccugcucgugcugauuagcuuuaaagucaauacagagcuuaagaccgugaacaauuacuuccugcucucccuggccugcgccgaccugaucauuggaacauuuucuaugaaccucuauaccacguaccugcuuaugggccacugggcucuggggacccucgccugugaucuguggcuugcucuggacuauguugccagcaaugcguccgugaugaaccuccugcugaucucuuucgauagauacuuuagcgucacacggccccucuccuaucgcgccaaaagaaccccucggcgcgcugcccugaugaucggacuugcuuggcuggugagcuucguucucugggcccccgcgauucuguuuuggcaauaccuugugggcgaaagaacaguccuggccggccagugcuauauccaguuccucucucagccuauuaucaccuuugggacggcuauggccgcuuucuaccugccggugacagugauguguacccuguacuggcggauuuaucgcgagacagaaaauagagcccgggagcucgccgcucugcaaggauccgaaacccccggcaaagggggaggcucuagcuccagcucugagcgcucccagccuggggcggagggaagccccgaaaccccucccggcagaugcugucggugcugucgcgccccgagacuucugcaggcuuacuccuggaaagaggaagaggaggaagacgagggcucuauggaaagccucacauccagcgagggggaggaaccuggaucugaggucguuaucaagaugcccaugguggauccugaagcccaggcccccacgaagcaacccccucgguccagcccgaacaccgugaaacgccccacaaagaaaggcagagaccgggcugggaagggacagaaaccuagaggcaaggagcagcuggccaagcgcaaaaccuuuucucuugucaaggaaaagaaggcggcucggacacugagcgccauucuccuggccuucauccugaccuggacgcccuauaauaucauggugcucguuuccacauuuugcaaagauugugugccugagacccugugggaacuuggguacuggcugugcuaugucaacucuaccauuaaucccauguguuacgcucucugcaacaaggccuucagagacacauuccgccugcugcuucucugccggugggauaaaagacgcuggcggaagaucccgaagagaccuggaagcgugcaucgcacccccucccggcaguguuga

SEQ ID NO: 67440 - RNA, 1401 nt, Artificial Sequence
  derived and/or modified sequence opt5 from CHRM2__Homo_sapiens__XP_011514073
augaacaauagcaccaacuccucuaauaacagccuggcccucacaucccccuacaagacguucgagguggucuuuaucguucugguggcuggcucucuuagccuggugaccauuaucgggaauauucucgucaugguguccaucaaaguuaacagacaccuucagacagugaauaacuauuuccuguuuucucuggccugcgcggaccucauuaucggagucuucagcaugaaucuguacacccuguauacagugaucggcuacuggccucucgggccgguugugugugaucuguggcuugcucuggacuaugucguguccaacgccagcgugaugaaucuccugauuaucucuuuugaucgguacuucugcgucaccaagccccuuacauauccuguuaaacgcaccacgaagauggccggaaugaugauugcugccgcuugggugcuguccuuuauccucugggcccccgcgauucuguucuggcaauuuaucgugggcgucagaaccguggaagacggggaguguuacauucaguucuuuagcaacgccgcuguuacauucggaaccgccaucgcugccuuuuaccugccugugaucauuaugacaguccucuauuggcauaucucucgggcguccaaaagccgcauuaagaaggauaaaaaggaacccguggccaaucaggacccuguuucuccgucccuggugcagggcagaaucgucaaacccaacaauaacaacaugccuagcuccgaugacggccuugagcacaauaagauucaaaacgggaaagcuccccgggauccugugaccgaaaauugcguccagggagaggagaaggaaucuagcaacgacuccacgagcgugucugccguugcuuccaauaugcgcgaugacgagaucacacaggaugaaaacaccgugagcacaucucugggccauagcaaggacgaaaauuccaaacagaccuguaucagaauugggaccaagacacccaaaucugacagcugcacgccgaccaacacaaccgucgaggugguuggauccagcggccaaaauggggaugagaagcagaacaucguggcccggaaaauugucaagaugacaaaacagccugccaagaagaaacccccucccucucgcgagaagaaagugaccagaacgauccucgcuauucugcuugcguucaucaucacaugggcccccuacaaugugaugguucugauuaacaccuucugugcuccuugcaucccgaauaccgucuggacaauuggauauuggcucuguuacaucaacuccaccauuaaucccgccugcuaugcccuguguaacgcuacauuuaagaaaacguucaagcaucugcucaugugccacuacaagaacaucggcgccacccgguga

SEQ ID NO: 67441 - RNA, 1773 nt, Artificial Sequence
  derived and/or modified sequence opt5 from CHRM3__Homo_sapiens__NP_000731
augacccugcacaacaauagcacaacgagcccccucuucccuaacaucucuagcuccuggauucauucuccgagcgacgccggccugcccccugggaccgugacacacuuuggauccuacaaugucucuagagcugccggcaacuucagcucccccgaugggaccacagacgauccucuuggaggccauaccguuuggcaagugguguuuaucgcguuccugacagggauucucgcucuggucaccaucauuggaaauauccuugugaucguuagcuuuaaggugaacaaacagcugaagacggucaauaacuauuuccuccugucucuggccugcgccgaccucauuaucggcgugauuuccaugaaucuguuuaccacauacaucauuaugaaccggugggcucuuggcaaucuggccugugaucucuggcuggcuaucgacuauguugccagcaacgcgucugugaugaaucuucuggucauuuccuucgaucgcuacuuuagcaucaccagaccccucacauaucgggccaaacgcaccacgaagagagcuggggugaugaucggacuggccugggugauuucuuucguccugugggcuccugccauccucuuuuggcaguacuucguuggcaaacggacagugccgcccggggagugcuuuauucaguuccuguccgaaccuaccaucacauucggaaccgcgauugccgcuuuuuauaugcccgugaccaucaugacaauccuuuacuggcgcauuuacaaggagacggaaaagagaaccaaagagcuggccggccuccaggcuagcgggacagaagccgagaccgagaacuucguccacccuacaggauccucucggagcuguuccagcuaugaacugcaacagcagucuaugaagcgcuccaauagacggaaauacggccgcugccauuuuugguucaccacgaaguccuggaaacccucuagcgagcagauggaccaagaucacuccucuagcgacuccuggaacaacaaugaugccgcugcgagccuugaaaacucugccuccagcgacgaggaggauaucggcucugaaacaagagcuauuuauuccaucgugcugaagcucccggggcacagcaccauucucaauuccaccaagcugccuucuagcgacaaccugcagguucccgaggaagaacugggaaugguggaccuugaacggaaagccgauaagcugcaggcccagaaauccgucgacgauggcgggucuuuuccuaagagcuucuccaaacuccccauccaacuggagagcgcuguggacacagccaagaccucugauguuaauuccagcgugggaaaaucuacagcgacgcuuccccuguccuuuaaggaggcuacccucgccaagcgcuucgcccugaaaacaagaagccagaucaccaagcggaaaagaaugucucuggucaaggagaaaaaggcugcccagacacucagcgcuauucugcuugccuuuaucauuaccuggacgccuuacaacaucauggugcuggucaauaccuucugugacuccugcauuccgaagacauuuuggaaccucggcuauuggcuguguuacaucaauagcaccgugaaccccguuugcuaugcgcuguguaauaaaacauuccgcaccacguuuaagaugcuucuccugugccaaugugauaaaaagaaacggagaaagcagcaguaccagcaacgccagucugugauuuuccauaagcgggccccugagcaggcucuguga

SEQ ID NO: 67442 - RNA, 1440 nt, Artificial Sequence
  derived and/or modified sequence opt5 from CHRM4__Homo_sapiens__NP_000732
auggccaacuucacccccgugaauggcagcuccgggaaccagucugucagacugguuacaagcuccucucacaaucgguacgagacgguggaaaugguguuuaucgcuaccgucacaggaagccucucccuggugaccguugugggcaacauucuugucaugcugucuaucaaggugaaucgccaacuccagacaguuaacaauuauuuccuguuuagccuugccugcgcggaccugauuaucggggcuuucuccaugaaccucuacaccguguauauuaucaaaggauacuggccucugggcgccgucgugugugaucuguggcucgcccuggacuauguggucagcaaugcuucuguuaugaaccuucugaucauuuccuuugauagauacuucugcgugacaaagccgcucaccuaucccgcccggcgcacgaccaaaauggcugggcugaugaucgccgcggccugggugcuuagcuuuguccugugggcuccugccauucucuucuggcaguuugugguuggaaagagaacagugcccgacaaucaguguuucauccaauuucugucuaacccugcugucaccuucggcacagccauugcggccuuuuaccugcccgugguuaucaugaccgugcucuacauucauaucucccuggcuagccggucucgcguccacaaacauagaccugagggcccgaaggaaaagaaagccaagacgcuugcuuuccugaaaagcccccucaugaagcaguccgugaaaaagccucccccuggggaggccgcccgggaggaacugcgcaauggaaaacuugaggaagcucccccgccugcgcugcccccuccucccagacccgucgccgauaaggacacauccaacgagucuagcuccggcagcgcuacccagaauacaaaggaacggccggccaccgagcucucuaccacagaggccacgacccccgcuaugccugcgcccccucugcagccccgcgcccugaacccggcuuccagauggagcaaaauccaaauugugacaaagcagaccgggaacgaaugcguuacagccaucgagauugugccugccacccccgcuggaaugcggccugccgcuaaugucgcccgcaaauucgcgucuaucgccagaaaccaggugcggaagaaaagacagauggcugcccgcgaacggaagguuacgagaacaauuuuugcuauccuccuggccuucauccuuaccuggacccccuauaaugugaugguccuggugaacacauuuugucaaagcugcauuccugauaccgugugguccaucggcuacuggcucuguuauguuaauucuacaauuaaccccgcgugcuacgcccuguguaaugcuacguucaagaaaaccuuucgccaccuucugcucugccaguaucggaacaucgggacagccagauga

SEQ ID NO: 67443 - RNA, 1599 nt, Artificial Sequence
  derived and/or modified sequence opt5 from CHRM5__Homo_sapiens__XP_005254198
auggagggcgacagcuaccacaacgccaccacagugaaugggacgcccgucaaccaucagccucuggaaagacaccggcucugggagguuaucaccauugcugccgugacagcgguggucucccugaucaccauugugggaaauguucuugugaugaucucuuucaaggucaacagccaacugaaaacagugaauaacuauuaccuccugucccuugcuugcgccgaucugauuaucggcaucuuuucuaugaaucucuauaccacauacauucugauggggcgcugggcccugggaagccucgcuugugaccuguggcuugcccuggauuauguugcuuccaacgccucugugaugaaucuccuggucaucagcuucgacagauacuuuuccauuacccggccgcuuacguaucgcgcgaagagaacccccaaacgggccggcaucaugauugggcuggcuuggcucaucagcuucauucugugggccccugcuauccugugcuggcaguaccucgugggaaagcgcacagugccccuggaugaaugucagauccaguuucuuucugagccuaccauuacauucggcaccgccaucgcggccuuuuacauucccgucuccguuaugacgauccuguauugcagaauuuaccgggaaacagagaaacgcaccaaggaccucgcugaucugcaaggcagcgacucugugacaaaggccgagaaaagaaagccugcucaucgggcccuuuuccgcuccugucugagaugcccgcggcccacccucgcccagcgcgaaagaaaccaggcuagcuggucuuccagccggagauccaccucuacaacggggaaaccuagccaggcgaccggacccuccgccaauugggcuaaggccgagcaacugacaaccuguagcucuuauccuuccagcgaagaugaggacaaacccgccacagauccggugcugcaggucguguacaagucucagggcaaggagagcccuggggaagaguuuuccgcugaagagaccgaagagacguucguuaaagccgagacagaaaagucugacuaugauacccccaacuaccuccugagcccugcggcugcccaccgccccaaaucccagaagugcguggccuauaaauuucggcuugucgugaaggcugacggaaaucaagagaccaacaauggcugucauaaaguuaagaucaugcccugcccuuucccgguggccaaggaacccagcacaaaagggcugaacccuaaccccucucaccagaugaccaagagaaaacgcgucgugcucgucaaggagcggaaagcugcccagacacuguccgcgauccuucuggccuuuauuaucacguggaccccuuacaauauuauggugcucguuagcacauucugugacaagugcgugcccgucacccuguggcaccugggauacuggcucugcuaugugaacucuacaguuaauccgaucuguuacgcucugugcaacagaaccuuccgcaagacguuuaaaaugcuucugcucugucgguggaagaaaaagaaaguggaagagaagcuguauuggcaaggcaauuccaagcugccuuga

SEQ ID NO: 67444 - RNA, 1353 nt, Artificial Sequence
  derived and/or modified sequence opt5 from CHRNA10__Homo_sapiens__NP_065135
augggccugagaagccaccaucucucccuggggcuucugcuccuguuccuucugcccgccgagugccucggagcugaaggccggcuggcccugaagcucuuucgcgaccuguucgcgaacuacaccucugcucuuagaccuguggccgauacagaccagacgcugaaugucacccucgagguuacacugagccaaaucauugauauggacgaacggaaccaggugcuuacccuguaucucuggauccgccaggaguggacagaugccuaccugagaugggacccgaaugcuuaugggggacuggaugccauucggauccccuccucucucguguggcgcccugacauuguccuguacaacaaagcugaugcccagcccccuggcagcgcguccaccaaugugguucuuagacacgacggggccgugcggugggaugcucccgccaucacacgcucuagcuguagagucgacguggcugccuuuccuuucgaugcgcaacauugcggacugaccuuuggcuccuggacgcacggcgggcaucagcucgacguucggccgcgcggagccgcugccagccuggcugacuucguggaaaacgucgaguggagagugcuuggcaugcccgcccggcgcagagugcugaccuauggguguugcucugagccuuaccccgaugucacauuuacccuccugcugcggagacgcgccgcugcguauguuuguaaucuccugcuuccuugcgugcugaucucccuccuggcuccccuugccuuccaucugccggccgacagcggagaaaaggugucucucggcgucacagugcugcuggcccucaccguuuuucagcugcuucuggcugaguccaugccucccgccgaaagcgugccucucauugggaaauacuacauggcgacgaugacaauggucaccuucucuacagcucugaccauccugauuaugaaccuucacuauuguggacccuccgugcggcccguuccugccugggccagagcucuccugcugggccaccucgcccgcggccugugcgugcgggagagaggggagccguguggacagagccggcccccugaacuuucccccucuccucaaagccccgagggcggggcuggaccgccugccggccccugccacgaaccucgcugucugugcagacaggaggcgcuccugcaucacgucgccaccaucgcuaauacauuucgcucccaccgggccgcucagagaugccaugaagauuggaagcgccuggcccgggugauggacagauucuuucuugcgauuuucuucagcauggcccucgucaugucucugcuggugcucguucaggcucuguga

SEQ ID NO: 67445 - RNA, 1374 nt, Artificial Sequence
  derived and/or modified sequence opt5 from CHRNA1__Homo_sapiens__NP_000070
auggagcccuggccucugcuccugcuuuucagccugugcuccgccggccucgugcuggggucugaacacgagaccagacuugucgcuaagcuguuuaaagacuacagcuccguugugcggccgguggaagaucaucgccaggucguggagguuacagugggacuccaacugauccagcugauuaacgucgacgaagugaaucagaucguuacgaccaacgugagacucaagcagcaaugggucgauuauaaucugaaauggaaccccgacgauuacggcggggugaagaaaauucacaucccuucugagaagauuuggcggcccgaccuugugcuguauaauaacgccgauggagacuucgcgaucgucaaguuuacaaaaguucuccugcaguacaccggccauaucacauggaccccucccgcuauuuucaagagcuauugugagaucauugugacacacuuuccuuucgaugaacagaauugcuccaugaaacuugggaccuggacguacgacggaucuguggucgccaucaacccggagagcgaucagcccgaccuguccaauuuuauggaaagcggcgagugggugauuaaggagucucgcggcuggaaacauuccguuaccuauagcuguugcccugauacacccuaccucgacaucaccuaccacuucgugaugcaaagacugccucuguauuuuauugucaacgugaucauccccugucuccuguucucuuuucuuacagggcugguuuucuaccucccgaccgacuccggagaaaagaugacgcugagcauuucugugcuucugucccucacagucuuucugcuggugaucgucgagcucauuccuagcaccuccucugccgugccccugaucggcaaguauaugcuuuucacaaugguuuucgugauugcuagcaucaucauuaccgucaucgugauuaauacccaccaucgguccccuagcacacacguuaugcccaacugggugcgcaaagucuuuaucgauacgauucccaauaucauguucuuuucuaccaugaagagaccuucccgggaaaaacaggacaagaaaaucuucacagaggauauugacaucagcgauauuucugggaagccgggacccccucccaugggcuuucauagcccucugaucaaacaccccgaagugaaguccgccauugaggggaucaaguacauugcugagaccaugaaaucugaccaggaaagcaacaaugccgcggccgaguggaaguauguggcuaugguuauggaucacauccuccugggagucuucaugcuugugugcaucauuggcacacuggccguguuugcuggccgccucaucgaacugaaccagcaaggguga

SEQ ID NO: 67446 - RNA, 1590 nt, Artificial Sequence
  derived and/or modified sequence opt5 from CHRNA2__Homo_sapiens__NP_000733
augggccccagcugccccguguuccuguccuuuaccaagcucucucugugguggcuucugcucacaccggccgggggagaggaagcuaaaagacccccuccccgggccccuggcgacccccugagcuccccuucuccgacggcgcuuccccaagggggaagccacaccgagacagaagaucgccuguucaagcaucucuuuagaggcuacaaccggugggcucgcccuguccccaauaccuccgacguugugaucgugagauucgggcugucuauugcccagcugaucgaugucgacgagaaaaaccagaugaugacaaccaauguguggcucaagcaggaauggagcgauuauaaacugcgguggaacccuacagacuuuggaaauauuaccucccuucgcguucccagcgagaugaucuggauuccggauaucgugcuguacaacaaugccgacggcgaguucgcugucacgcacaugaccaaggcccaucucuuuucuacaggcaccgugcacuggguuccucccgcuaucuauaaguccagcuguucuauugaugugacauucuuuccuuucgaccagcaaaacugcaaaaugaaguuuggguccuggaccuacgauaaagccaagaucgaccuggaacagauggagcagacggucgaucuuaaagacuauugggaaagcggagagugggcgauugugaaugccacaggcaccuacaacucuaagaaguaugacuguugcgcugagaucuaccccgaugugacauacgccuucgucauuagacggcugccccucuuuuauaccaucaaucugauuaucccuugucugcucaucuccugccugaccguucuuguguucuaccugccgagcgacuguggggaaaagauuacacucugcaucuccgugcugcuuucucugacggucuuccuccugcugauuaccgagaucauucccagcacaucccucgugaucccucugaucggagaauaucuucuguuuaccaugauuuucguuacacucagcaucgugauuaccgucuuugugcugaacguucaucaccgcucucccuccacgcacacaaugccucauugggugagaggcgcccuucuggggugugucccccgguggcuccugaugaaucgcccgccucccccuguggagcugugccacccccucagacugaaacuuagcccuucuuaccauuggcuggaaagcaacgucgaugcugaggagcgggaagugguuguggaggaagaggaccgcugggcgugugccggacacgucgcucccuccgugggcacccucugcucucacggccaucugcacagcggggccuccggaccgaaagcugaagcccugcuucaggagggcgagcuccugcugagcccucauaugcaaaaggcccucgaagggguucacuauaucgcugaucaucugagaucugaggacgcggauuccagcgugaaagaagacuggaaguacgucgccauggugauugaucggaucuuccuuuggcuguuuaucauugugugcuuccucggaaccaucggccuguuucugccucccuuccuugcugggaugauuuga

SEQ ID NO: 67447 - RNA, 1518 nt, Artificial Sequence
  derived and/or modified sequence opt5 from CHRNA3__Homo_sapiens__NP_000734
augggcagcgggccccugucccucccucuggcccuuucuccgcccagacugcuccugcuucugcuccugagccugcucccuguggcucgggccuccgaggcggaacaccgccuguucgagagacuuuuugaagacuacaacgagaucauucggcccgucgcuaauguuucugauccugugaucauucauuucgaagugagcaugucccagcuggucaagguggacgagguuaaccaaaucauggagaccaaucucuggcugaaacagauuuggaacgauuauaaacuuaaguggaaucccucugacuacggaggcgccgaauuuaugcgcgugccugcccagaagaucuggaaaccggauaucguccuguauaacaaugcugugggggacuuccagguugaugacaagacaaaggcccuccugaaauacacgggagaggugaccuggauucccccugcuaucuuuaagagcuccugcaaaauugaugucacauauuuccccuuugacuaccaaaacuguaccaugaaguucggcagcuggucuuaugauaaagccaagaucgaccuggugcucauuggguccagcaugaaucugaaggauuacugggaaucuggagagugggcgaucauuaaagccccuggcuacaagcacgacaucaaauauaacugcugugaggaaaucuaccccgacauuacauauucccuuuacaucagacggcugccgcucuuuuauaccauuaaucugaucauuccuugccuucugaucagcuuccucacagugcuggucuuuuaccugcccucugauuguggcgagaagguuacccucugcaucuccgugcugcuuagccugacgguguuccuccuggucauuaccgaaacaaucccuuccaccucucuugugauuccccugaucggggaguaucuccuguuuacaaugauuuucguuacccugagcaucgugaucacggucuucgugcucaacguucauuaccgcacacccaccacacacaccaugccuuccugggugaaaaccgucuuucugaaucuucugccgagagugauguucaugacacggcccacgagcaacgaaggaaaugcucagaagccucgcccccucuacggcgccgagcugucuaaccugaacuguuuuuccagagcugagagcaaagggugcaaggaaggauauccuugucaggacggcaugugcggguacugucaucaccggcgcauuaagaucucuaauuucagcgccaaccuuaccagauccucuagcuccgagagcgucgaugcggugcucucucuguccgcccugagccccgaaauuaaagaggcuauccagucuguuaaguauauugccgaaaauaugaaagcucaaaacgaggccaaggagauccaggacgauuggaaauacguggccauggucauugaccggaucuuucucuggguguucacacugguuugcauccuuggaaccgcuggccuguuucuccagccgcugauggcgcgcgaagaugccuga

SEQ ID NO: 67448 - RNA, 1884 nt, Artificial Sequence
  derived and/or modified sequence opt5 from CHRNA4__Homo_sapiens__NP_000735
auggagcugggcgggcccggagccccuagacuccugccgccccuucugcuccugcuuggcaccgggcugcuccgggcuagcucccacguggaaacacgcgcccaugcggaggaaagacugcugaagaaacucuucucuggauacaacaaguggagccggccugucgcuaauaucuccgacguugugcuggugcgcuuuggccuuucuauugcccagcugaucgaugucgacgagaaaaaccaaaugaugacgaccaauguguggguuaagcaggaauggcacgauuauaaacucagaugggaccccgccgauuacgagaacgugacaagcauucggaucccuuccgagcugauuuggcgccccgacaucguccuuuauaauaacgcugauggggacuucgccgugacccaucugacaaaggcucaccucuuucaugauggaagaguucaguggaccccuccggccaucuacaagucuagcugcuccauugacgugacauucuuucccuucgaucagcaaaauuguaccaugaaauuuggcagcuggacguaugacaaggcgaaaaucgaucuggucaacaugcacucucggguggaccagcuggacuucugggaauccggcgagugggugauugucgaugccguugggaccuacaauacacgcaaguaugaaugcugugcugagaucuacccugacauuaccuacgccuuugugaucagacggcucccccuguucuauacaauuaaccuuaucaucccuugccugcucauuagcugucugaccgugcuugucuuuuaccugcccucugagugcggagagaaaaucacgcucuguauuuccgugcugcugagccucacaguuuuccugcuucugaucaccgaaauuaucccgucuacaucccucgugaucccucugauuggcgaauaucuucuguuuaccaugaucuucgucacccucagcauugugaucacaguuuucgugcugaauguccaccaucgcucccccagaacgcacaccaugccuacaugggugcggcgcgucuuucuggauauugugcccagacuccugcuuaugaagcggcccucuguugugaaggacaacugcagacgccugaucgagagcaugcauaaaauggcuuccgccccucgguucuggccggaacccgagggggagccucccgcgaccagcggaacacagucucuccacccucccuccccgagcuuuugugucccucuggaugugcccgccgaaccuggccccucuugcaagagcccuuccgaccagcugcccccgcaacagccucuugaggcugaaaaagccucuccccaccccagcccugggccguguagacccccucauggaacccaggcucccggccucgccaaggcccgcucccugagcguucagcacaugucuuccccuggcgaggcuguggaagggggaguccggugcagaagccgcucuauccaauacugcgugccccgggaugacgcggccccugaggcugauggccaggccgccggggcucuggccuccagaaauacgcauagcgcggagcugcccccgccugaccagcccuccccuuguaaaugcacauguaagaaagaacccucuagcguguccccgucugcuaccguuaagacccgcagcacaaaggccccucccccucaccucccccuuucccccgcccugacccgggcugucgagggagugcaauauauugccgaucaucucaaagcugaagacacagacuucagcgugaaggaggauuggaaauacgucgccauggugaucgacagaauuuuucuguggauguucaucauuguuugccugcuuggcacgguggggcucuuucugccuccguggcuggcgggaaugaucuga

SEQ ID NO: 67449 - RNA, 1407 nt, Artificial Sequence
  derived and/or modified sequence opt5 from CHRNA5__Homo_sapiens__NP_000736
auggccgcuagaggcagcgggccccgggcccugcgccuccugcuucuggugcagcucgucgcgggaagaugcggccuggcuggggccgccggaggcgcucaacgggggcuuuccgagccuucuagcaucgccaagcacgaagacucccugcucaaagaucuguuccaggacuacgagcgcuggguuagaccgguggaacaucugaacgauaagauuaaaaucaaguuuggacucgcuauuucucagcugguggacgucgaugagaaaaaucagcuuaugaccacaaacguguggcugaagcaagaauggaucgacguuaagcuccgguggaaucccgaugacuauggcggcauuaaagugauccgcgucccuagcgauuccguguggacgcccgacaucguucuguucgauaacgccgacgggagauuugagggaaccucuacaaagaccgugauucgguacaauggcacagucaccuggacaccucccgcgaacuauaaaagcuccuguaccaucgaugugacguucuuuccuuucgaccuucagaauugcagcaugaaguuugggucuuggaccuacgacggaucccagguggauauuauccuggaggaccaggaugucgacaaacgcgauuucuuugacaacggcgaaugggagauuguuagcgccacagggucuaagggaaauagaaccgauuccuguugcugguauccguacgugacauauagcuucgugaucaagcggcucccccuguuuuacacccuguuccucauuaucccuuguaucggccugucuuuucuuacgguccugguguucuaccuccccuccaacgaaggcgagaaaauuugccuguguacaagcguucuugugucccugaccgucuuccuccuggugaucgaggaaauuaucccuucuagcuccaagguuauuccccugaucggggaguaucucguguuuacaaugaucuucgucacccugagcauuauggugaccgucuuugcuaucaauauucaccauagaucuuccagcacacacaacgccauggcuccgcuugugcgcaaaaucuuccugcauacgcucccuaagcugcuuugcaugcggucucacguugaccgcuacuuuacccaaaaagaagagacagaaagcggauccggccccaagucuagcagaaauacccuggaggccgcgcucgauuccauucgguauaucacaagacacaucaugaaagagaacgacgugcgcgaagucguggaggauuggaaguucauugcccagguucuggaccggauguuucuguggaccuuccucuuugugagcaucgucgggucucugggacuuuucgugccugugauuuacaagugggcuaauauccugauucccguucauaucggcaacgccaacaaauga

SEQ ID NO: 67450 - RNA, 1440 nt, Artificial Sequence
  derived and/or modified sequence opt5 from CHRNA6__Homo_sapiens__NP_001186208
augcugaccagcaagggccagggguuccuccacggaggccugugccuuuggcuguguguguuuacacccuucuuuaaagggugcgucggaugugccacggaggaaagacucuuccauaagcuguuuucccacuacaaccaauucauccggccuguugagaaugugucugacccggugaccguccauuuugaaguggcuauuacacagcuugccaacguuaucuggaaugauuauaaacugcgcugggaccccauggaguacgauggcauugaaacccucagagugccugcggacaagaucuggaaacccgauauuguccuguauaacaaugcugugggggacuuccagguugagggaaagacaaaggcccugcucaaauacaacggcaugaucaccuggacaccucccgccaucuuuaagagcuccugcccuauggauauuaccuucuuuccguucgaccaccagaauuguucucugaaauuuggcagcuggacguaugauaaggcugagaucgaccuucugauuaucggguccaaaguggauaugaacgacuucugggaaaauucugagugggaaauuaucgaugccagcggauacaagcaugacauuaaguauaacugcugugaggagaucuacaccgacaucacauacuccuucuauauucggcgccuccccauguuuuacaccaucaaucugauuaucccuugccuuuucauuagcuuucugacaguccucguguucuaucugcccucugauuguggcgaaaaagugacccugugcaucuccguccuccugagccuuacgguuuuucugcucgugaucacagagaccauuccuucuacaucccugguggucccccuugugggggaauaccuccuguucaccaugaucuuuguuacccugagcauuguggucacaguguucguucugaacauccacuauagaacgccgaccacacacaccaugccucggugggugaagacagucuuucucaaacugcuuccccaagugcugcucaugcgcuggccucuggacaagaccagaggaacgggcucugaugcugucccccgggggcuugcccgcagacccgcgaaaggaaagcuggccucccauggcgagccucggcaccucaaagaauguuuccauugccacaagagcaaugagcuggcuacauccaagcgcagacugucucaccagccgcuccagugggugguugagaacagcgaacauucccccgagguggaagacgucauuaauagcgugcaguuuaucgccgagaacaugaaaucucacaacgaaaccaaggagguugaggaugacuggaaauacguggcuauggucguggaucggguguuccuguggguuuuuaucauugucugcguguucggcaccgccgggcuuuuccugcaaccucuccugggaaauacaggcaaguccuga

SEQ ID NO: 67451 - RNA, 1509 nt, Artificial Sequence
  derived and/or modified sequence opt5 from CHRNA7__Homo_sapiens__NP_000737
augagaugcagccccggcgggguguggcuggcccucgcugccucccugcuucacgucucucugcagggagaguuccaacggaagcucuacaaagaacugguuaagaacuauaauccucuugagcgcccgguggcgaacgacagccagccccugaccguguacuuuucccucucucugcugcagaucauggaugucgacgagaaaaaucaggugcucacaacgaacauuuggcugcaaaugagcuggaccgaucauuaucuucaguggaauguuuccgaauacccuggcgugaagacagucagauuccccgacgggcagaucuggaaaccugauauucugcucuauaacucugcugacgaacgguuugaugccaccuuccacacaaaugugcugguuaacagcuccggacauugucaguaccuucccccuggcaucuuuaagagcucuugcuauauugacgugcgcugguucccguuugauguccaacacuguaagcugaaauucggguccuggagcuacggaggcuggucucucgaccugcagaugcaggaggccgauaucuccggcuacauccccaauggggagugggaccuggugggcauuccuggaaagagaagcgaacgguuuuaugagugcuguaaagaacccuacccugaugugaccuucacagucaccaugcgcagacggacgcucuauuacgggcugaaccuucugauccccugcguucucauuucugcucuggcccuucugguguuucuccugccggcugacuccggagagaagaucagccugggcauuaccgugcuccugucccuuacagucuucaugcugcucguggccgagaucaugccugcgaccucugacagcguuccccugauugcccaguauuuugcuuccacaaugaucaucguggggcuuagcgucgugguuaccgugauuguccugcaauaccaucaccacgauccugacggaggcaaaaugcccaaguggacgcgcgugauccuccugaauuggugugccugguuccugagaaugaagcggcccggcgaagauaaaguccgcccugcuugccagcauaagcagagacgguguucucucgccuccguggagaugagcgcgguugccccgcccccugcuucuaacgggaaucugcuuuauauuggauuccgcggccuggacggggugcacugcguccccacaccugauagcggagugguuuguggcagaauggccugcucccccacccaugacgaacaccuccugcacgggggacaaccgccugagggcgaucccgaccuggcuaaaauccuugaagaggugcgguacauugccaacagauuucgcugccaggaugagucugaagccgucuguagcgaguggaaguucgcugcgugcgugguggaccggcucugucugauggccuuuuccguuuucacaaucaucugcaccauuggcauccugaugagcgcuccuaauuuugucgaagccgugucuaaagauuucgccuga

SEQ ID NO: 67452 - RNA, 1506 nt, Artificial Sequence
  derived and/or modified sequence opt5 from CHRNB1__Homo_sapiens__NP_000738
augacccccggcgcccugcucaugcugcuuggggcucugggagccccucucgcgccgggcgugagagggagcgaggcugaaggacggcugcgcgagaaacuuuucuccggcuacgacucuagcgucagacccgcccgggaaguuggggaucgcgugagaguguccgucggacugauccucgcccagcugauuucucugaacgagaaagacgaagagaugagcacaaagguguaucucgaucuggaguggacggacuaccggcuuuccugggauccugcugaacacgacggcaucgauucucugcgcauuaccgccgagagcguuuggcuccccgacgugguccugcuuaauaacaaugauggcaacuuugacguggcucuggauaucuccguuguggucagcucugacggguccgugagauggcaaccucccggaauuuaucggagcucuugcuccauccaggugacauacuucccuuuugauuggcagaauuguaccauggucuucagcucuuauuccuacgacagcuccgaaguuucucuccagacaggccuggggccggacggacaaggccaccaggagauccacauucaugaggggaccuuuaucgaaaacggacagugggagauuauccacaaacccagccgccugauucagccucccggcgauccuagaggcgggcgggaaggacaacgccaggaggugaucuucuaucucauuaucagacggaagccccuguuuuaccuugugaaugucaucgccccgugcauucugaucacacuccuggcgauuuucguguuuuaccuuccucccgacgccggcgaaaagauggggcuguccaucuucgcucuccugacccugacgguuuuucuccugcuucuggccgauaaggugccugagaccagccucucuguccccauuaucaucaaguaucugauguucacaauggugcuuguuaccuuuuccgugauucugagcgucgugguccucaaccugcaucaccgcucuccccacacacaucagaugccucugugggugagacagaucuucauucacaaacucccgcuguaccuucggcugaagagacccaaaccugagcgcgaccucaugcccgaaccuccccauuguagcuccccgggaucuggcugggggcggggaaccgaugaguauuucaucagaaagccucccagcgacuuucuguucccuaaacccaaucgcuuucaaccugaacuguccgcucccgaucuucggagauucauugacggcccgaaccgcgccguugcgcuccugccugagcugcgggaaguggucagcucuaucuccuacaucgccagacagcuccaggagcaagaggaucacgacgcucugaaggaagauuggcaguuuguggccaugguuguggaccgccuuuuccuguggacguuuauuaucuucacaagcgucggcacccucgugauuuuucuggacgcuacauaucaucugcccccucccgauccguuccccuga

SEQ ID NO: 67453 - RNA, 1509 nt, Artificial Sequence
  derived and/or modified sequence opt5 from CHRNB2__Homo_sapiens__NP_000739
auggccagacggugcggccccguggcucugcuccugggguucggacuucugcgccucuguagcggcgucugggggaccgacacagaggaaagacugguugagcaccuucuggauccuucccgguacaacaagcucauccgcccggccacgaauggaucugaacuggugaccgugcagcugauggucagccucgcgcaacugauuuccgugcaugagagagaacagaucaugacaaccaacguuuggcuuacacaggagugggaggacuaucggcugaccuggaaacccgaagaguuugauaauaugaagaaagugcgccucccuucuaagcacauuuggcugcccgacgucgugcuuuacaacaaugcugauggcauguaugaaguuagcuucuacuccaacgccguggucucuuaugacgggagcaucuuuuggcugccucccgccauuuacaaauccgcuugcaagaucgaggugaagcauuucccuuuugaucagcaaaauuguacaaugaaauucagaagcuggaccuaugaccggacggagaucgaucucgugcugaagucugaagucgccucccuggacgauuuuaccccgagcggagagugggacauuguugcucuccccggccgcagaaacgaaaauccugaugacucuacauacguggacaucaccuacgauuucauuauccggcgcaaaccccuguuuuauacaauuaaccuuaucauuccuugcgugcugaucaccucccucgccauccuggucuucuaccuucccagcgacuguggcgagaagaugacgcugugcauuucugugcuccuggcgcugacaguuuuucuccugcuuaucuccaaaauugugccgccuaccagccuggaugucccccucguggggaaguaucugauguucacaaugguucuugugaccuuuuccaucgucaccucuguguguguccugaaugugcaccauagaagcccuacaacgcacaccauggcccccuggguuaagguggucuuccucgaaaaacugcccgcucuccuguucaugcagcagccucggcaccauugcgcccgccagagacugcggcuuagacgccggcaaagagagcgcgagggagcuggcgcccuguuuuuccgggaagcgccgggggccgacuccuguacaugcuuugugaacagagcuagcguucagggacucgccggcgcuuucggggccgagcccgccccuguggcuggacccggccgcucuggcgaaccuugugggugcggacugcgggaggcggucgauggcgugagauuuauugccgaccacaugcgcuccgaagaugacgaucagagcgugucugaggacuggaaguacguugcuauggucaucgaucggcuguuccuuuggaucuuuguguucgugugcgucuuugggaccauuggaauguuccuccagccccuguuucaaaauuauacaaccacgacauuccugcauagcgaccacuccgccccgucuagcaaauga

SEQ ID NO: 67454 - RNA, 1377 nt, Artificial Sequence
  derived and/or modified sequence opt5 from CHRNB3__Homo_sapiens__NP_000740
augcugcccgacuucaugcucgugcugaucguccuuggcauuccuagcuccgccaccacaggguuuaacucuaucgcugagaaugaagaugcccugcucagacaccuguuccagggauaccaaaaguggguucggccggugcuucauagcaacgacacgauuaaaguguauuuuggccugaagaucucccagcucgucgauguggacgagaaaaaucagcugaugaccacaaacguuuggcugaagcaggaauggaccgaucacaaacuccgcuggaaucccgacgauuacgggggcauucauucuaucaaggugccuagcgagucccuguggcuucccgacaucguccuguucgaaaacgcggauggaagauuugaggggucucucaugacaaaggugauuguuaaaagcaauggaaccguggucuggacaccucccgcuuccuauaagagcucuugcaccauggacgugacguucuuuccuuucgaucggcaaaacuguuccaugaaauuuggcagcuggaccuacgacggcacaaugguggaucugauccuuauuaaugagaacgucgaccgcaaggacuucuuugauaauggggaaugggagauccugaacgccaaaggaaugaagggcaauagacgggacgggguuuauucuuacccguucauuaccuauuccuuugugcuccgcagacugccccuguucuacacacucuuccugaucauuccuugccuuggacugagcuuucucaccgugcuggucuucuaccuucccucugaugaaggcgagaagcugucccucagcacguccgugcugguuucucugacaguguuucuccuggucaucgaggaaaucauuccuagcuccagcaaagugaucccccuuauuggggaguaucuccuguucaucaugauuuuuguuacccugucuaucaucgugacagucuucgugauuaacguccaccaucgguccagcucuaccuaccacccgauggccccuugggugaagcgccuuuuucugcagaaacuccccaagcugcuguguaugaaagaccacguugauagauauagcuccccugaaaaggaggaaucucagcccguggucaaaggaaaggugcucgagaagaaaaagcagaaacaacugagcgacggcgagaagguucuuguggcuuuccuggaaaaagccgcugauuccauccgguacauuagccgccaugucaagaaggagcacuuuaucucucagguggugcaggacuggaaauucguugcccagguccucgauagaauuuuucuguggcuguuccuuaucguguccgugaccggcagcguccucaucuuuacacccgcgcugaagauguggcugcauucuuaucacuga

SEQ ID NO: 67455 - RNA, 1497 nt, Artificial Sequence
  derived and/or modified sequence opt5 from CHRNB4__Homo_sapiens__NP_000741
augagacgggcccccagccugguccucuucuuucugguggcucuuugcggccgcgggaacuguagaguugccaaugcggaggaaaagcugauggacgaucuccugaacaaaacccgguacaauaaccuuauccgcccugcuacauccucuagccagcugauuuccaucaagcuccaacugucucuggcccagcucauuagcgugaaugagagagaacagaucaugacgaccaacguguggcugaaacaggaguggacagacuaucggcuuaccuggaacuccucucgcuacgaaggagucaauauucugagaaucccggccaagcggaucuggcuccccgauauugugcuguauaauaacgcugacggcacauacgagguuagcguguauaccaaucuuaucguccgcuccaacgggagcgugcuguggcucccucccgccauuuacaaaucugcuugcaagaucgagguuaaguauuucccuuuugaucaacagaauuguacacugaaauucagauccuggaccuacgaccacacggaaauugauauggugcugaugacccccacagccagcauggacgauuuuaccccuucuggagagugggacaucgucgcgcucccgggccggcgcacagugaacccccaggauccuuccuacguggacgucaccuaugauuucauuaucaagagaaaaccccuguuuuacacgaucaaucuuauuaucccuugcguucugacaacccuccuggccauucuuguguucuaucugcccagcgacuguggggaaaagaugacacucugcaucucugugcugcuggcucucaccuuuuuccugcuucugauuuccaaaaucgucccgccuaccagccucgacgugccccugaucggaaaguaccuuauguuuacaaugguucuggugacguucuccauugucaccucuguguguguucucaacgugcaucaccggagcccuuccacacauaccauggcccccugggucaagcgcugcuuucugcacaaacugcccacauuccucuucaugaagagaccuggcccggauagcucucccgcucgggccuuuccucccuccaaaagcugugugaccaagccugaggcgacggccacaucuaccagccccuccaacuucuauggcaauucuauguacuuugucaacccggcuagcgccgcuuccaaaagcccugccgggucuacccccguggccaucccuagagacuucuggcugcgcuccagcggacgguuuagacaggauguucaagaggcucuugaaggcgugucuuucauugcgcagcauaugaagaaugacgaugaggaccaguccgucguggaagauuggaaauauguugccaugguggucgaccgccuguuucucuggguguucauguuugugugcguucuggggacagucggacuguuccuucccccucucuuucagacccacgcugccagcgagggccccuacgccgcucaacgggauuga

SEQ ID NO: 67456 - RNA, 1554 nt, Artificial Sequence
  derived and/or modified sequence opt5 from CHRND__Homo_sapiens__NP_000742
auggagggccccgugcugacccucgggcugcuugccgcucuggccgucugcggaagcuggggccucaacgaagaggaaagacugauccggcaccuuuuccaggagaagggguacaauaaagaacugcgcccuguugcgcauaaggaggaguccguggacguggcucucgcccugacacugucuaaccucauuagccugaaagaagucgaggaaacgcuuaccacaaauguguggaucgagcacggauggaccgauaacagacugaaguggaaugccgaggaauuuggcaacauuuccguucuccggcugccgcccgacaugguguggcuuccugagaucguccuggaaaauaacaaugaugggucuuuccaaauuagcuauuccuguaacgugcucguuuaccauuauggauuuguguacuggcugcccccugcuaucuuccgcucuagcugccccaucuccgucacauauuuuccuuucgacuggcagaauuguagccugaaauuuucuucccucaaguacaccgccaaggagauuacacugagccuuaaacaggaugcuaaggaaaacagaaccuauccgguggaguggaucauuaucgaccccgagggcuucacggaaaauggcgagugggaaauugugcaccggccugcccgcgucaacguugaucccagagcgccucuggacucucccucccggcaggauaucaccuuuuaccucauuauccgcagaaaaccgcuguucuacaucauuaauauccuugugccuugcgugcugauuagcuuuauggucaaccucguguucuaucugcccgccgacucuggggagaagacauccguugcuaucagcgugcugcucgcccaauccgucuuucugcuucugauuucuaaacggcucccugcuaccagcauggccaucccccugaucggaaaguuccuucuguucggcauggugcucguuacaaugguggucgugauuugugucaucgugcugaacauucauuuucgcacccccuccacgcacguucugagcgaaggggugaagaaacucuuccuggagacacuuccugagcugcuccacaugucuagaccggcggaagauggacccuccccuggcgcccugguccggcgcagcucuagccugggguacaucuccaaggcugaggaauauuuucuucucaaaucuagaagcgaccugauguucgagaagcaguccgaacggcauggacuggccagacgccucaccacagcucggagacccccugccagcucugagcaggcccagcaagagcuguuuaaugaacuuaaacccgcuguggauggcgcgaacuucauuguuaaucacaugcgcgaccagaacaauuacaacgaggaaaaggacuccuggaaucggguggccagaaccgucgaucgccugugccucuuuguggugaccccgguuauggucgugggcacagcuuggaucuuccugcaggggguguauaaccagccucccccucaacccuuuccuggagaccccuacagcuauaauguccaggauaaacgguucaucuga

SEQ ID NO: 67457 - RNA, 1482 nt, Artificial Sequence
  derived and/or modified sequence opt5 from CHRNE__Homo_sapiens__NP_000071
auggccagagcuccccugggcgugcuccugcuucuggggcuccugggacggggcgucgggaagaacgaggaacuucgccuguaccaccaucucuucaauaacuaugacccuggaagcagaccgguucgggagcccgaagauaccgugacaaucucccugaaagugacgcugaccaaucucauuucucugaacgagaaggaagagacacuuaccacaagcgucuggaucggcauugacuggcaggauuaccgccugaauuauuccaaagacgauuuugggggaaucgagacccucagagugccuucugaacugguuuggcuucccgagauugugcuggaaaacaauaucgacggccaauucggcgucgccuacgaugcgaacgugcucguuuaugaagggggaagcgugacauggcugccucccgcuaucuaccgguccgucugcgccguggaggugaccuauuuuccuuucgacuggcagaauuguucucugauuuuucgcagccagacguacaacgccgaagaggucgaguucaccuuugcuguugauaaugacggcaagacaaucaacaaaauugauaucgacaccgaggccuacacagaaaauggggagugggcuauugauuucugcccgggagugaucagacggcaccauggcggggccaccgacggacccggcgagacggacgugauuuauucccucaucauccgcagaaagccucuguuuuacgucauuaacaucauugugcccuguguucuuaucagcggccuggugcuccuggcguauuuccuuccugcccaggcugggggacaaaagugcacagucucuauuaaugugcugcucgcccagaccguuuuucuguuccugaucgcucagaaaauccccgaaacaucccucagcgugccgcugcuuggccgguuucugauuuucgucaugguggucgccacccucaucgugaugaacuguguuauugugcugaacgucucucagcgcaccccuacaacgcacgcgaugucccccagacuucggcaugugcugcucgagcugcugccucgccuccuggggucucccccucccccggaagcccccagagcugccagcccuccccggagagcuuccagcguuggacuucugcuccgcgccgaggaacugauccugaagaaaccucgguccgagcuuguguucgagggccaaagacaccgccaggggaccuggacagccgcuuuuugccagucucucggagcggccgcucccgaaguccgguguugcguggaugccgugaauuucguugccgagagcaccagagaccaggaagcuacaggcgaggaagucuccgauugggugcgcaugggcaacgcccuggacaauauuuguuuuugggcggcucugguccucuucagcguggggucuucccugaucuuucuuggagccuacuucaaccgggugccggaucugccuuaugcccccugcauccaaccuuga

SEQ ID NO: 67458 - RNA, 1554 nt, Artificial Sequence
  derived and/or modified sequence opt5 from CHRNG__Homo_sapiens__NP_005190
augcacggcgggcagggaccccugcuccugcuucugcuccuggccgugugccuuggcgcucaagggagaaaccaggaggaacggcugcucgccgaccugaugcagaauuacgauccuaaccugcgcccggcggagagagacagcgaugucguuaaugugucccucaagcugacccuuacaaaccugaucucucucaaugaacgggaggaagcucugacgaccaacguguggauugagaugcaguggugugacuaucgccuuagaugggauccccgggacuacgagggacuguggguccuccgcgugccuagcacaaugguuuggagacccgauaucgugcuggaaaauaacgucgacggcguguucgagguugcccuguauugcaaugugcucgucuccccugauggguguauuuacuggcugcccccugccaucuuucggucugcuugcagcauuuccgugaccuauuucccguuugacuggcaaaacuguucucuuaucuuccagagccagacauacuccaccaaugaaaucgaucugcagcucagccaagaggacggacagacaauugaguggaucuuuauugaucccgaagccuucaccgagaacggcgaaugggcuauccagcaucgcccugccaaaaugcugcuugaccccgcggccccugcucaggaggccggccaccaaaagguggucuuuuaucugcucauucagagaaaaccccuguucuacguuaucaauauuaucgcuccgugcgugcugaucucuuccguggccauucucauccauuuucugccugcgaaggccgggggacagaaauguacggucgcuauuaacgugcuucuggcccaaaccguuuuccucuuucugguggcuaagaagguccccgaaacaagccaggccgugccucuuaucucuaaauaccugaccuuccuccugguugugacaauucugaucgucgugaaugccgucgugguucucaacgugucccugcggagcccccacacccauucuauggcucgcggcgucagaaagguguuucuucggcugcucccccagcugcugcgcaugcacguuagaccucuugcgccggccgcugugcaggacacgcaaucccggcuccagaacgggagcuccggauggucuaucacaaccggcgaggaggucgcccugugccugcccagaagcgaacuccuguuccagcaguggcaacgccaggggcuuguggccgcugcccuggagaaacucgaaaagggaccugagcugggccugucccaguucuguggcagccuuaaacaggcggcucccgccauucaagccugcguggaggcuuguaaucucaucgccugcgcucggcaccagcagucucauuuugauaacgggaaugaagagugguuccugguuggaagaguccuggaccgcgugugcuuucucgccaugcugucccuuuucauuuguggcacagcggggaucuuucugauggcccacuauaaccgggugccugcucuccccuucccgggagauccuagacccuaccugccuagccccgacuga

SEQ ID NO: 67459 - RNA, 1071 nt, Artificial Sequence
  derived and/or modified sequence opt5 from CHST10__Homo_sapiens__NP_004845
augcaccaucaguggcugcuccuggccgcuugcuucugggugaucuuuauguucauggucgccagcaaguuuauuacccuuacauucaaagaccccgauguuuacuccgcgaagcaagaguuucuguuccucacgaccaugccugaagugagaaaacugccggaggaaaagcacauccccgaggaacuuaaaccuacaggcaaggagcugcccgacucucagcucgugcagccucuggucuauauggagcggcuggaacucauucgcaacguguguagagaugacgcucugaagaaucuuagccauacccccguuuccaaauuugugcuggaucggaucuucgucugcgacaagcacaaaauucucuuuugucagacaccuaagguggggaacacccaauggaaaaagguucugaucgugcuuaauggagccuucucuagcaucgaggaaauuccggagaacgucgugcaugaucacgagaagaauggccugccccgccucuccucuuuuagcgacgccgaaauccagaaaagacugaagacauacuucaaauuuuucauugugcgggauccuuucgagcgccugaucuccgcuuuuaaggacaaauucguccacaaccccagauuugaaccuugguaucggcaugagauugcccccgggaucauucgcaaguacagacggaaucgcaccgaaacgagaggaauccaguucgaggauuuuguucgguaucucggcgacccgaaccaccgcuggcuggaucuucaguucggggaccauaucauucacugggugaccuacguggagcugugcgcuccuugugaaaucauguauagcgucauuggacaccaugagacacucgaagacgaugcccccuacauccugaaagaggcgggcauugaccaccuugugucuuacccuaccaucccucccggcaucacaguuuauaauagaaccaagguggaacauuacuuucuggggauuuccaagcgggauaucagacgccucuaugcccgguucgagggagacuuuaaacuguucggcuaccaaaagcccgauuuucugcucaacuga

SEQ ID NO: 67460 - RNA, 1044 nt, Artificial Sequence
  derived and/or modified sequence opt5 from CHST11__Homo_sapiens__NP_001167453
augaagcccgcccugcucgaggugaugagaaugaaccggaucugccgcaugguccuggcuaccugucuuggcagcuucauucugguuaucuuuuacuuccagauuaugagacggaauccuuuugggguggacaucugcugucgcaaaggauccagaucuccgcuccaagaacuguauaaccccauucagcuugagcugagcaauacagccgugcuccaccagaugcggcgcgaucaggucacggauaccugcagagcgaacuccgcuacaucucggaagcgcagagugcugaccccuaaugaccugaaacaucucguuguggacgaagaucacgagcugaucuacuguuauguccccaagguggccugcacaaacuggaaacggcuuaugaugguucugaccggccgcgggaaguacagcgacccuauggaaauccccgccaaugaggcucauguguccgccaaccucaagacacugaaucaauauucuauuccugagaucaaccacagacuuaaaagcuacaugaaguuccuguuuguccgggaaccguucgagcgccucguguccgcuuauagaaauaaauuuacccagaaguacaacauuagcuuccauaaacgguacggaacgaagaucauuaagagacagcgcaaaaaugccacccaggaagcgcugcggaagggcgaugacgugaaauuugaggaguucgucgccuaucugaucgauccccacacacaaagagaggaaccuuuuaacgaacacuggcagaccguuuacucucucugucaucccugccacauucauuaugaccugguggggaaguacgagacacuugaagaggauuccaauuaugugcugcagcucgcuggagucggcagcuaccugaaauucccuaccuaugccaagucuacgcgcacaaccgacgagaugacaaccgaauuuuuccagaacaucuccagcgagcaccaaacccagcuuuacgaaguguacaaacuggauuuccucauguuuaacuauucuguucccuccuaccugaagcuggaguga

SEQ ID NO: 67461 - RNA, 1245 nt, Artificial Sequence
  derived and/or modified sequence opt5 from CHST12__Homo_sapiens__NP_001230724
augaccaaggccagacuguuccggcucuggcuggugcuuggcagcgucuuuaugauccugcucauuaucguuuacugggacuccgcuggggccgcgcacuucuaucugcauacaucuuuuagccgcccccacacgggaccuccgcuucccaccccuggccccgauagagaccgggagcugacagcugauuccgacguggaugaguuccucgacaaauuucugucugccggggugaagcagagcgaucugccucgcaaagaaaccgaacaacccccugccccgggauccauggaggaaucugucagaggcuacgacuggagcccccgggaugcucgcagauccccugaccaggggcggcagcaggccgagcgcagaagcgugcuccggggauucugcgcuaacucuucccuggccuuucccacaaaggagcgcgcguucgaugacauuccuaauagcgaacuuucucaucugaucguugaugacagacacggcgccauuuauuguuacgugcccaaagucgcuugcaccaacuggaagcgggugaugaucguucucuccggcagccugcuucaucgcggggccccguauagagacccucugcggauccccagagagcacgugcacaaugcuucugcccaucucacauuuaacaaguucuggcgccgguacggaaaacuguccagacaccugaugaaggucaaacucaagaaauauaccaaguuucuguucgugcgcgauccuuuugugcggcuuauuagcgcguucagauccaaguucgaacuggagaaugaggaauuuuaccgcaaauucgccguccccaugcuccggcuguacgcuaaccauacgucucuucccgccagcgcuagagaggccuuucgcgccggccugaagguuuccuucgcuaauuuuauccaauaucuccuggacccucacaccgaaaaacuggcgccguucaacgagcacuggagacagguguaccggcucugucaucccugccagauugauuaugacuuuguggggaagcuggaaacacuugaugaggacgccgcucagcugcuccaacugcuucaggucgaucgccagcugcgguucccucccagcuacagaaaucggaccgccucuuccugggaggaagacugguuugccaaaaucccucucgcuuggcgccagcaacuguauaagcuguacgaggccgauuucgugcucuuuggauaucccaaaccggaaaaccugcuuagagacuga

SEQ ID NO: 67462 - RNA, 1026 nt, Artificial Sequence
  derived and/or modified sequence opt5 from CHST13__Homo_sapiens__NP_690849
augggcagacggugcugucgcagacgggugcuggccgcugccugccucggggcggcucugcuucugcucugugccgcuccccgcagccugagaccugccuucggaaaccgggcccuuggcuccucuuggcucgggggagagaagcgcagcccgcugcagaaacuguacgaccuggaucaagaccccagauccacccucgcuaagguccaccggcagcgcagagaucugcuuaauucugccugcagccggcauucccgcagacagcggcugcuccagccugaagaccugcgccacguucuuguggaugacgcgcauggccugcucuauuguuacgugcccaaagucgccugcacaaacuggaagagagugcugcuggcucucucugggcaagcccggggagauccuagagcuaucagcgcccaggaggcgcacgcccccggccgccugccuucccuugcugacuuuagcccggccgaaauuaaucggagacugcgcgcuuaucucgccuuccuguuuguucgggagcccuucgaaagacuugccucugcuuaccgcaacaaacuggcgcggccuuauuccgccgcuuuucagagacgcuacggcgcccggaucgugcagagacuccgcccccgggcccugccugaugcuagagcccgggggcaugacguccgcuucgcggaguuucuggcuuaucuccuggaucccagaacgcggagagaggaaccguucaaugagcacugggaacgcgcccacgcccuuugucauccuugccggcugagauacgacgugguuggaaaguuugagacccucgcugaggaugccgcuuucgugcugggccuugccggggcgagcgaccugucuuuucccggaccuccccgccccagaggcgccgcugccucccgggaccucgcugcccgccuguucagagauauuagcccuuuuuaccaacggcgccuguucgaccucuauaagauggauuuccugcuuuuuaacuacucugcgccguccuaucugagacuccuguga

SEQ ID NO: 67463 - RNA, 1131 nt, Artificial Sequence
  derived and/or modified sequence opt5 from CHST14__Homo_sapiens__NP_569735
auguuccccagaccucugaccccgcucgccgcucccaacggcgccgagccucuggggcgggcgcuucgcagagcuccccugggacgggcccgcgccggccucgggggaccuccccugcuucugccuagcaugcucauguuugcugugaucgucgccuccucuggccugcugcucaugauugaaagagggauccuggcugagaugaagccgcuuccccugcacccucccggacgggaaggcacagccuggcgcggcaaagcgccuaagcccgggggacucagccugagagccggcgacgcugaucuucagguucggcaagacgugcgcaauagaacgcugcgggccgugugcgggcagccgggaaugccucgcgaucccugggaccucccugucggccagagacggacccugcugcgccauauucucguguccgauagauaccgguuccuguauuguuacguucccaaaguggcuugcucuaacuggaagagagucaugaaagugcuugccgggguucuggacagcguggauguccgccucaagauggaccaccgguccgaucugguguuucuugcggaccugagacccgaggaaauccgcuaucggcuccagcauuacuucaaguuucuguucgugagagagccucuggagcgccuccugucugccuaucggaauaaauuuggagaaauuagagaguaccaacagcgcuauggcgcugaaaucguccggagauaccgcgccggcgcugggccgagccccgccggagaugacguuacauucccugaguuucuucgguaccugguggaugaggaccccgaaagaaugaacgagcacuggaugccuguguaucaucucugucagcccugcgccguccacuacgacuucgugggcuccuaugaacggcuggaggcugaugcgaaucagguucuugaaugggugcgcgccccgccucacgucagauuucccgcucggcaagccugguacagaccugccagccccgagucucugcauuaucaccucuguuccgcuccucgcgcccugcugcaggacgugcuccccaaguacauccuggauuucagccuuuuugcguauccgcugccuaacguuaccaaagaggcuugccagcaguga

SEQ ID NO: 67464 - RNA, 1521 nt, Artificial Sequence
  derived and/or modified sequence opt5 from CHST15__Homo_sapiens__NP_001257694
augagacacugcaucaacuguugcauucagcugcuccccgacggcgcccauaagcaacaggugaauugucaagggggaccucaccauggccaccaggcuugcccgaccuguaaaggggagaacaagauccuguuccgggucgauagcaaacagaugaaucuucuggccguucucgaagugcgcacagagggaaacgaaaauuggggcggguuucugagauucaagaaaggaaagcggugcucccuuguguuuggccugauuaucaugacgcucgucauggcgucuuacauucugagcggcgcucaucaggagcugcucaucuccucucccuuccacuaugggggauuuccuagcaaccccucccugauggacucugaaaauccuagcgauaccaaggagcaccaucaccaguccagcgugaacaauaucucuuacaugaaagacuaucccuccauuaaacuuaucauuaacagcaucacaacccgcauugaguucacaaccagacagcugccugaucucgaagaccugaagaagcaagagcuucauauguuuucuguuaucccgaauaaauuccugcccaacuccaagagcccuuguugguacgaagaguuuucuggccagaauacaaccgaucccuaucucacgaacuccuacgugcuguauagcaagcgguuccgcuccaccuuugacgcccugagaaaagccuucugggggcaccucgcucacgcccauggaaagcacuuucggcugcgcugccuuccucauuucuacauuaucggccagcccaaaugugggacaaccgaucuguacgacagacuccggcugcacccggaggucaaguucucugcuaucaaagaaccucauugguggacacgcaagagauuuggaauugugcggcuucgcgauggccugagagaccgguaucccguugaggauuaccucgaccuguucgaccuggccgcgcaccagauccaccaaggccuccaggccagcuccgcuaaagaacagagcaagaugaauaccauuaucauuggggaggccucugcuuccacgaugugggauaacaacgccuggacauuuuucuaugacaauagcaccgauggagaaccucccuuucugacacaagacuucauccaugcguuucagcccaacgccagacuuaucgugaugcugcgcgauccugucgagcggcucuacucugacuaucuguacuucgcuagcuccaauaagucugccgaugacuuucacgagaaagugaccgaagcccuucagcuguucgagaacugcaugcucgauuauagccugagagcuuguguguacaauaacacccugaauaacgccaugccggucugcacacccccuccccgcacgccucgggcuggccccuggcagaaggaacucguuugcuguuacuaugcguccgggauugugggacugagauuuagcaucggcaccgagcgcucugugcuuaugugcaaauguugcuccccgcuguucauggacgucaaggccgaaaauuga

SEQ ID NO: 67465 - RNA, 1236 nt, Artificial Sequence
  derived and/or modified sequence opt5 from CHST1__Homo_sapiens__NP_003645
augcagugcagcuggaaggccgugcugcuccuggcucuugccuccaucgcgauucaauacaccgcuaucagaacauucacggccaaaucuuuucacaccugucccggccuggccgaggcugggcucgccgaacggcugugcgaggaaagcccuacauucgcuuauaaccuuucccgcaagacccauauucugauccucgccacaaccagaucuggaagcuccuuugucggccagcuguucaaucagcaccuggacguguuuuaccucuucgagccgcuguaucaugugcagaacacacuuauuccccgguuuacccaagggaaaucuccugcggaucgcagagugaugcugggagccagccgggaccuccugcgcucccuuuacgauugugaccuguauuuccucgaaaauuacaucaagcccccucccgucaaccacacgaccgauagaaucuuucggcgcggcgcuagcagagugcugugcucucggccuguuugugacccgcccgggccugccgaucuggugcucgaggagggagacugcguccgcaaauguggccugcuuaaucugacaguggcugccgaagcgugcagagagcggucccauguugccauuaagaccgugcgcguccccgaagugaacgaucucagagcucugguggaggacccucggcuuaaucugaaggucauccagcucguuagagauccccgcggcauucuggccagccggucugagacauucagagacaccuaucgccuguggcggcucugguacgggacgggaagaaaaccguacaaccuggaugugacacagcuuaccacagugugugaagacuuuuccaauagcgucucuaccggccugaugcgcccucccuggcucaaggggaaauauaugcuggugcgguacgaggaccuugcuagaaacccuaugaagaaaaccgaagagaucuauggauuccugggcauuccccucgauucccacguugcccgcuggauccagaauaacacaagaggggaccccacgcugggaaagcacaaguacggcaccgugcggaauagcgccgcuacagcggaaaaauggcgcuuucggcuguccuaugauauugucgccuucgcucaaaacgccugccagcagguucucgcccagcugggcuacaagaucgcugccucugaggaggaacuuaaaaauccuagcguuucccugguggaggaaagagacuuccggccguuuagcuga

SEQ ID NO: 67466 - RNA, 1593 nt, Artificial Sequence
  derived and/or modified sequence opt5 from CHST2__Homo_sapiens__NP_004258
augagcagauccccucagcgggcccugcccccgggcgcucucccccgccugcuucaagccgcgccugcugccgcccccagagcucugcucccucaguggccccggcgcccugggagacgguggccggccucuccccugggaaugaagguguuccgcagaaaagcucuuguccugugcgccggcuacgcgcuccugcugguucucaccaugcugaaccuucuggacuauaaguggcacaaagagccucuccagcaguguaaucccgaugggccucugggagccgcugccggcgcugccgggggaagcuggggccggcccggcccgccucccgcggggccuccccgcgcccaugcuagacuugaccugcggacacccuaccgcccuccggccgcugccgugggagccgcucccgcggccgcugccggcauggccgggguggcugccccucccggaaacggcacgagagggaccggaggcgucggcgauaagcggcaacucguguauguuuuuacaaccuggcgcuccgggucuagcuucuuuggagaacuguucaaucagaacccugagguguuuuuccuguacgaacccgucuggcacguguggcagaaacucuauccgggcgacgcgguuucccugcagggggcugccagagauaugcuuucugcccuguaccggugcgaccucagcguguuucaacuguauuccccugcuggaagcggcgggagaaaucuuacaacccugggaaucuucggcgccgcuacaaacaaggucguguguucuagcccccucugcccugccuaccgcaaggagguggucggccugguugaugaccggguguguaaaaagugucccccucagagacuggcgcgcuuugaagaggagugccggaaauacagaacccucgugauuaaggggguccgcguguucgauguugccgugcuggcuccccuucugcgggacccggcccucgaucugaaagucauccaucuugugagagacccucgcgcuguugccuccucucggauuagaucccgccacggacugauccgggaaagccuccagguggucagaucucgggauccccgcgcgcauagaaugcccuuucuggaggccgcuggccacaagcugggggccaagaaagaaggagugggcgggccugcugacuaucacgcccucggcgccauggaggucauuugcaauuccauggcuaagacgcugcagaccgcgcuucaaccgcccgacuggcugcagggacauuaccucgugguucgguaugaggaucuggugggcgacccugucaaaacacugagacgcguguacgauuucguugggcuucucgugagccccgaaauggagcaguuugcccugaacaugaccuccggaucuggcagcuccagcaagccuuucgucgugucugcucggaaugccacacaagccgcuaacgccuggagaaccgcgcugacguuccagcagaucaaacagguggaagaguuuuguuaucaacccauggcuguucucggguacgaacgcgucaauuccccugaggaggugaaggaccugagcaaaacacuucugagaaagccccggcucuga

SEQ ID NO: 67467 - RNA, 1440 nt, Artificial Sequence
  derived and/or modified sequence opt5 from CHST3__Homo_sapiens__XP_006718138
auggagaagggccugacccucccccaggacugcagagauuucgugcacagccugaaaaugcgguccaaguacgcccuuuuucuggucuucguugugaucguguuugucuucauugaaaaagagaacaagaucauuucucgcgugagcgacaaacucaagcaaaucccucaggcucuggccgaugcuaauuccacagacccggcgcuuauucuggccgaaaacgccucucuccugagccuguccgagcucgauucugcuuuuagccagcugcaguccagacuucggaaucugagccuccaacuggggguugaacccgccauggaggcugccggagaggaagaggaagaacagcgcaaggaggaggagccucccagaccugcgguggccggcccccggcgccauguccuucugauggcuacgaccagaacagggucuuccuucgugggagaauuuuucaaccagcagggcaauaucuuuuaucucuucgagccucuguggcacaucgaacggaccguuagcuuugagcccgggggagccaacgcugccggcucugcgcugguguaccgcgacguccucaaacaacuguuccuuugugaucuguaugugcucgagcauuuuauuacaccgcugccugaagaccaccuuacccaguucauguucagacggggcuccagccgcucucugugcgaggaucccguguguacaccuuuugucaagaaaguuuucgaaaaguaccauugcaaaaauagacggugugggccccucaacgugacccuggccgcugaggccugccgcagaaaggaacacauggcucugaaggccgugcggaucagacagcucgaguuucugcagccgcuugccgaggacccucgccuggaucuccgggucauucaacuggugagagacccccgcgcuguucuugcgucccggaugguggccuucgcuggaaaauauaagacguggaaaaaguggcuggaugacgaaggccaggacgggcucagagaggaagagguccagcgccugcggggaaauugugaaagcaucagacuguccgccgagcucggccugcgccaaccugccuggcuucgggggagauacaugcuggugcgcuaugaggauguugcucggggaccccuccagaaagccagagaaauguaccgguuugcgggcauuccccugaccccucagguggaggacuggauccagaagaacacacaagcugcccacgauggcucugggauuuacagcacccagaaaaauuccagcgaacaguucgagaaguggcgcuuuucuaugccguucaagcuggcccaggucgugcaagcugccugcggacccgcuaugagacuuuuuggcuauaaacucgcccgggacgcggccgcucugacaaacagauccgucagccugcucgaggaacgcgggaccuucugggugacguga

SEQ ID NO: 67468 - RNA, 1161 nt, Artificial Sequence
  derived and/or modified sequence opt5 from CHST4__Homo_sapiens__NP_005760
augcugcuccccaagaaaaugaagcugcuucuguuccucgugagccagauggccauccuggcucuuuucuuccacauguacucccauaacauuucuagccuguccaugaaagcccaaccugagagaaugcacguccucguucugucuagcuggcgguccggcucuagcuuuguggggcagcuguucggacagcauccggacguguuuuaucucauggaacccgcguggcacgucuggaugaccuucaagcaguccacagcuuggaugcugcauauggccgugcgcgaucuuaucagagccguuuuucugugcgacaugagcguguucgaugcuuacauggagccuggcccccggcgccaaucuucccucuuucagugggaaaauagcagagcccuguguucugcuccugccugcgacauuaucccccaggaugagauuaucccucgggcgcacugucgccuucugugcucccagcaaccguucgaagucguggagaaagccuguagaagcuauucucacguugugcucaaggagguccgguuuuucaaccugcagucccuguacccccuccugaaggacccuagccuuaaucugcauaucgugcaccucgugcgcgaucccagagcugucuuucggucccgcgaaagaacgaaaggggaccugaugauugauucucggaucguuaugggacagcaugagcagaaacuuaagaaggaagaccaaccuuauuacgugaugcaagugauuugccagagccagcuggagaucuauaaaaccauucagucccuccccaaggcccugcaggagcgcuaccugcucgucagauacgaagaucuggcucgggccccgguggcgcagacaagcagaauguaugaguucguuggccuugaauuucugccucaccuccaaaccugggugcacaacaucacacgcgggaagggaaugggcgaccaugccuuucacaccaaugcucgggaugcccugaacgucucucaggcuuggagauggucccuucccuacgagaaagugagccgccugcagaaggccuguggcgacgccaugaaucuccugggguaucggcauguuagaucugaacaggagcaacgcaaccugcuccuggaccuucugagcacauggaccgugccugagcagauucacuga

SEQ ID NO: 67469 - RNA, 1236 nt, Artificial Sequence
  derived and/or modified sequence opt5 from CHST5__Homo_sapiens__NP_078809
augggcaugagagcccgggugcccaaggucgcucacagcacccgcagaccuccggccgcgcggauguggcugccccgcuucuccucuaaaacaguuacggugcuccugcuugcucagaccacaugccugcuccuguuuaucauuagcagaccugggcccuccucuccugccggaggcgaggaccgggugcauguccuugugcugagcuccuggcgcucugggagcuccuuccucggacaacuguuuagccagcaccccgauguuuucuaccugauggaaccugccuggcauguguggaccacacucucucagggcuccgcugccacccugcacauggcugucagagaccuuaugcggagcaucuuucugugugauauggacguguucgaugccuauaugccgcagucucgcaaccucuccgcguuuuucaauugggccacaagcagagcucugugcucucccccugccuguuccgcuuuuccccgggggaccauuagcaagcaagacguuugcaaaacgcuuuguacccgccagccuuucucccuggccagagaggcgugccggucuuacagccaugugguccucaaggaagugcgcuuuuucaaccuccaggugcuguauccccugcuguccgauccggcccuuaaucugagaaucguccaccucguucgggacccuagagcugugcugcgcagccgggaggccgcuggacccauucuugccagagauaacggcaucgugcugggcacaaaugggaaaugggucgaagccgacccucaccuccgccugauccgggagguguguagaucucauguucgcauugcugaggcggccacccugaagcccccucccuuucuccggggaagauaccgccuggugcgguucgaagaucuugcuagagagccgcuggccgaaauccgcgcccucuaugcuuucacaggccugacccuuacgccccagcuggaggccuggauucacaacaucacacauggguccggaauuggcaagccuaucgaggcguuucacaccagcucucggaaugcuagaaacgucagccaagccuggcggcacgcccuccccuucacaaaaauucugcgcgugcaggaaguuugcgcuggggcccugcagcuccugggauacagaccuguguauuccgcugaccagcaacgggaucuuacccuggaccucguccugcccagaggcccggaccauuuuucuugggccagcccugauuga

SEQ ID NO: 67470 - RNA, 1188 nt, Artificial Sequence
  derived and/or modified sequence opt5 from CHST6__Homo_sapiens__XP_011521387
auguggcugcccagagugagcuccaccgccgucacagcucuccugcuugcccagacguuccugcuccuguuucuuguuucucggccuggcccgagcucccccgcugggggagaggcucgcgugcacgugcugguccucucuagcuggagauccggcucuagcuucguggggcaacuguuuaaccagcauccugacguuuucuaccugauggaacccgccuggcacguguggaccacacucucccagggaagcgccgcuacccugcauauggccguccgggaucuugugcgcucuguuuuucugugcgacauggauguguucgacgcuuaucucccuuggagacggaaucuguccgaucuuuuucagugggccgucagccgcgcgcuguguucucccccugccugcuccgcuuucccgagaggcgccaucagcucugaggcuguguguaagccccucugcgcccggcaauccuuuacacuggcgcgcgaagccuguagaagcuacucccacgugguccugaaagagguucgguucuuuaaccuccaggugcuguauccucuucugucugaccccgcucucaaucugcgcauugugcaucuugucagagauccucgggccgugcugcgcagcagagaacagaccgcuaaggcccucgcccgggacaacgggaucguucugggaacaaauggcaccuggguggaggcugaucccggccugagagucgugcgcgagguuugccggucccacgugagaauugcggaagccgcuacgcucaaaccgccucccuuccugcgcgggcgguacagacuuguccgcuuugaggaccuggcccgggaaccucucgccgagaucagagcucuguaugccuucaccggacuuagccugacaccccagcucgaggcguggauucacaacaucacccauggcucugggcccggagcucgccgggaagccuucaagacauccagcagaaaugcccugaacgugucucaagcguggcgccacgcccugccuuuugcuaaaauccggagaguccaggagcucugugccggcgcgcugcagcuucugggguaccggccgguguauagcgaagaugagcagcgcaaucucgcccuggaccugguucuucccagaggacucaacggcuucaccugggcuuccucuacggccagccauccucggaauuga

SEQ ID NO: 67471 - RNA, 1275 nt, Artificial Sequence
  derived and/or modified sequence opt5 from CHST8__Homo_sapiens__XP_011525528
augacccugagacccggcacaaugcggcucgccugcauguucagcuccauccugcuuuuuggggcugccggacugcuccuguucauuucucuucaggacccuacggagcuggcgccgcaacaggugcccggcaucaaguuuaacauucgcccuagacagccccaccaugaucucccucccgggggaagccaggacggcgaucugaaagaaccuaccgagcgggucacacgcgaccuguccucuggggcuccgagaggacggaaucuccccgccccugaucaaccccagccuccccugcagcgcggcaccagacuucggcugcgccagagacggcgcagacuccugaucaagaaaaugccggccgcugccacaauuccugcuaacagcuccgacgcccccuucauccggccuggccccgggacccuugauggacgcuggguuucucugcacagaagccaacaggaacggaagagagugaugcaggaggcgugugccaaauaccgcgcuuccagcucucggagagccgugacaccccgccaugucucccggaucuuuguggaagacagacaccgcguucucuauugcgaggugccuaaggcuggcuguagcaauuggaagcggguccugauggugcuggccgggcucgcgucuuccaccgccgauauucagcauaacacgguucacuacggaagcgcucugaaaagacuugacaccuucgaucgccaaggcauccugcaccggcucucuacauauaccaagaugcuguuugugagagagccguucgaacgccuugucuccgccuuucgggacaaauucgagcaucccaauagcuacuaucacccuguguuugggaaggcuauucuggccagauaccgggccaacgcuucccgcgaagcgcucagaacaggaucuggcgugcgguuccccgaguuuguccaguaucugcuggauguucauagaccugugggcauggacauccacugggaccacgugagccgccucugcucccccugucugauugauuacgacuucgucgggaaauucgagagcauggaagaugacgccaacuuuuuccuuucucugauccgggcuccgagaaaucucaccuuuccucgcuucaaggauagacauucccaggaggcccggacgacagcccgcauugcucaccaauacuuugcccagcugagcgcgcuucagagacagcggaccuaugacuucuacuauauggauuaccugauguuuaauuauucuaagcccuucgcugaccucuacuga

SEQ ID NO: 67472 - RNA, 225 nt, Artificial Sequence
  derived and/or modified sequence opt5 from CHST9__Homo_sapiens__NP_001243245
augcagcccagcgagauggugaugaacccuaagcaagucuuccuguccguucucaucuuuggcguggccgggcugcuucuguucauguaccuccagguguggauugaggaacagcacaccggaagagucgaaaaacggcgcgagcagaaggugacaucuggcugggggccgguuaaauaucugagacccgugccucggaucaagccccaagucagccaugcuuga

SEQ ID NO: 67473 - RNA, 2409 nt, Artificial Sequence
  derived and/or modified sequence opt5 from CHSY1__Homo_sapiens__NP_055733
auggccgcuagaggccggcgcgccuggcugagcgugcuccuggggcuuguccugggauucguucucgcguccagacuggugcuuccccgggcuucugagcugaagcgcgccggcccuagacggcgcgccagcccggaagggugcagauccggacaggcugccgcuucucaagccggcggggcgcggggagacgcccgcggcgcucagcucuggcccccuggcagcgaucccgacgggggaccuagagaucggaacuuucuguucgugggcgucaugaccgcccagaaauaccugcagacacgcgcuguggccgcguauagaacgugguccaagaccauccccgggaaaguucaauuuuucucuagcgagggauccgacacaagcgugccuauuccggucgugccccuccggggcguugaugacucuuacccuccccagaagaaauccuuuaugaugcugaaguauaugcacgaucauuaccuugacaaguaugaaugguucaugcgcgccgaugacgauguguacaucaaaggggacagacuggagaauuuucuccggagccugaacucuuccgaaccucuuuuccugggacagaccggccucggcacaaccgaggagauggggaagcuggcucuggaacccggagagaauuuuuguaugggcgggccgggagucauuaugagcagagaagugcuccgccggauggugccucacaucggcaaaugccugagagagauguauacaacccaugaggaugucgaaguugggcgcugugugcggagauucgccggagugcagugcgucuggucuuacgagaugcaacagcuuuucuacgaaaacuaugagcagaauaagaaaggcuacauucgcgaccugcacaacuccaagauccaucaggcuaucacgcuccaccccaauaagaacccucccuaucaauaccggcugcacagcuauaugcuuuccagaaaaauuucugaacugcgccaucggaccauccagcuccacagagagauugugcugaugagcaaguacuccaauacagagauccauaaagaagaccugcagcucggcauucccccuagcuucaugcgcuuucaaccgcggcagagagaggaaauccuggagugggaauuucuuaccgggaaguaucuguacucugccguugauggacagcccccucggcgcggcauggacuccgcccagagagaggcucucgaugacauugugaugcaagucauggagaugaucaacgcgaaugccaaaacacgggggagaaucauugauuucaaggaaauccaguacggauaucgccgggugaaccccauguacggcgcugaguauauucuggaccuucugcuccuguacaaaaagcacaaggggaaaaagaugaccguuccugugagacgccacgccuaucugcagcagacguuuagcaaaauccaauucgucgaacaugaggaacucgaugcccaggagcuggcuaagagaauuaaucaggagucuggcagccuuuccuuucugucuaacagccucaaaaagcuggugcccuuccagcugccgggauccaagagcgaacacaaagagccuaaggacaaaaagaucaauauccuuauuccccucucuggccgguuugauauguucguccgcuuuauggggaacuucgagaaaacaugucugaucccuaaccaaaaugugaagcugguugugcuccuguuuaacuccgacagcaaucccgauaaggccaaacaggucgaacuuaugagagacuaccggauuaaguauccuaaagcggacaugcagauccugcccgugucuggagaguucucccgcgcucucgcccuggaaguuggcagcucccaguuuaacaaugagucucugcuuuucuuuugcgauguggaccucgucuucaccacagaguuccugcaaagaugucgggccaacaccgugcuggggcagcagauuuacuuuccgaucaucuucagccaauacgauccuaagauuguguauuccggaaaaguucccucugacaaucauuuugcuuucacccagaagacaggcuuuuggcgcaacuacggguucggcaucacgugcauuuauaagggagaucucgucagagugggcggguuugacgugagcauccagggauggggccuggaagaugucgaccuuuucaauaaagugguucaggccgggcugaagaccuuucggucccaagaagugggagucgugcacguucaucaccccguguucugugauccuaaccucgacccgaaacaguacaagaugugccugggcagcaaggcuucuacauauggguccacccagcagcuggccgagauguggcuugagaaaaaugaucccagcuacucuaaauccagcaacaauaacggcucuguccgcacagcguga

SEQ ID NO: 67474 - RNA, 2649 nt, Artificial Sequence
  derived and/or modified sequence opt5 from CHSY3__Homo_sapiens__NP_787052
auggccgugagaagccggcgccccuggauguccgucgcucugggccucguucugggguucaccgccgcgucuuggcuuaucgcuccuagaguggccgagcugagcgaacggaagcgcagaggauccucucucugcagcuacuauggccgguccgccgcugggccgcgcgccggagcucagcaaccccugccucagccccagucuagaccucggcaggagcaaucucccccuccggcccgccaggaccuucaggggcccccucugcccgaagcggccccugggauuacauccuuuagaagcucucccuggcagcaaccgccuccccuccagcagcggcgcagaggacgggagccugaaggcgcuacgggccugcccggggcccccgcugccgagggagagccugaagaggaagauggcggggcggccggacagcgcagagacggccggccgggguccagccacaacggaucuggcgauggcggggcugccgcucccuccgccagaccucgcgacuuccuguacgugggagucaugaccgcccaaaaauaucucggcagccgggcucuggcggcccagagaacaugggcucgcuuuauccccgggcggguggaguucuuuucuucccagcaaccucccaaugccggacagccgccucccccucuucccguuauugcccugccuggcguggaugacagcuaucccccgcagaagaaauccuucaugaugaucaaguacaugcaugaucacuaccucgacaaauaugagugguuuaugagagcugaugacgaugucuacauuaagggggacaagcuggaagaguuccuucgcucucugaacagcuccaaaccucucuaccugggacagaccggccugggcaauaucgaggaacucgggaagcugggacuugaacccggcgagaacuuuuguaugggcggacccggcaugaucuucagccgggaggugcugagacgcaugguuccucauauuggggaaugccuccgggagauguauacaacccacgaagauguggaggucggcagaugugugcgccgguuuggaggcacacaaugcguguggucuuacgaaaugcagcagcuguuccaugagaauuaugagcacaacagaaaaggguacauccaggaccuucacaauuccaagauucaugccgcgaucacccugcacccgaacaaacggcccgcuuaucaauaccgccuccauaauuauaugcugagcagaaagauuucugaacugcgguacagaacgauccagcuccaccgcgagagcgcccugauguccaaacuuucuaacaccgaagucagcaaggaggaccagcagcugggaguuauuccuuccuuuaaucacuuccaaccccgggaaagaaacgaggugaucgagugggaguuccucacaggcaagcugcuuuacagcgccgcugaaaaucagccuccccgccagucucuguccagcauccucagaaccgcccuggaugacacagugcugcaggucauggaaaugauuaacgagaaugcuaaaucucgggggcgccucaucgauuuuaaggagauucaauauggauacagacgggugaacccuaugcauggcguugaauauauccuggaccuucugcuccuguacaaacgccacaaggggagaaaacugaccgugcccguccggcgccaugccuaucuucagcaacucuucuccaagccguuuuucagagagacggaggaacuggaugugaacagccugguugaauccauuaauucugagacacagagcuuuuccuucaucucuaacagccucaagauccuguccagcuuucagggcgcgaaagagaugggaggccacaaugaaaagaaagugcauauucuugucccucugaucgggcgguacgacauuuuccuccgcuuuauggagaacuucgaaaauaugugucugauccccaagcagaacgugaaacuggucauuauccuuuuuagcagagauuccggacaggacagcucuaagcacaucgagcucauuaagggcuaucaaaauaaauacccuaaggccgaaaugacccugauccccaugaaaggggaguucucccggggacugggccucgagauggcuagcgcccaguuugauaacgacacacugcuucuguucugcgauguggaccucauuuucagagaagacuuucugcagcgcugucgggauaauaccauccaggggcaacagguuuacuauccgauuaucuucucucaguacgacccuaaggugaccaacggcggaaaucccccuacagaugacuauuuuauuuucagcaaaaagacgggcuuuuggagagauuacggguauggaauuaccugcaucuacaaguccgaccugcuuggcgcugggggauucgauacaagcauccagggcugggggcucgaggacgucgaucuguauaacaaagugauccugucuggccuccgccccuuucggucccaagaaguuggagugguccacauuuuccaucccgugcacugugacccuaaucuggauccgaagcaguacaaaaugugccuuggcagcaaggccuccaccuuugcgucuacaaugcagcuggccgagcucuggcuggaaaaacaucugggggugagauacaaccgcacccuuagcuga

SEQ ID NO: 67475 - RNA, 2928 nt, Artificial Sequence
  derived and/or modified sequence opt5 from CHTF18__Homo_sapiens__NP_071375
auggaggacuacgaacaggagcugugcggcguggaagaugacuuccacaaccaauuugccgcugagcucgaaguccuggccgagcuugagggggcgagcacccccuccccuucuggaguuccgcuguucacagcuggcagacccccucggacguuugaagaggcccucgcccgcggggaugcugccagcucccccgcuccugccgcgucugugggaagcucccagggcggggccagaaagcgccagguggacgcugaucugcagcccgccggaucucuuccucaugcuccgcggaucaaaagaccccggcugcaagucgugaagcgccucaauuucagaagcgaagagauggaggaaccucccccucccgacuccagcccgaccgauauuacaccucccccuucucccgaggaccuggccgaacuguggggccacggcguuuccgaggcggccgcugauguggggcucacccgggccagccccgcugcccgcaacccuguccugagacggccgcccauccuugaagacuaugugcauguuacaucuaccgagggagugcgcgccuaccugguccucagagcugauccuauggcgcccggcgugcaggggucccugcuucacgugccuuggcggggaggcgggcagcuggaccuccugggagucagccuggccucucucaaaaagcagguugauggcgagcgcagagaacggcugcuucaagaggcucagaaacuguccgacacacuccauagccugagauccggcgaagaggaagccgcccagccccuuggggcuccggaggaggaaccuaccgacggacaggaugccucuagccacugucuguggguggacgaguuugcgccccgccacuauacggaacuccuguccgaugacuucaccaaucggugccugcucaaguggcugaaacuuugggaucugguggucuuuggccaugagagaccuagccgcaagccccggccuucuguggaacccgcuagaguuuccaaggaggccacagccccggggaaauggaaaagccacgagcaagugcucgaagagaugcuggaagcuggacuugacccuucucagcgccccaagcagaaggucgcccugcucugugggcccccugggcugggaaagaccacacuggcucaugugauugcccggcacgcgggcuacagcguuguggagaugaacgccuccgaugacagaucuccggaggucuuccgcacccggaucgaagcugccacgcaaauggagagcgugcucggcgcugggggaaaacccaauugccuggucauugaugaaaucgacggcgccccuguggcggccaucaacguucuucuguccauucucaauagaaaggggccccaggaggugggaccucagggccccgcugucccuagcgggggcggacgccggagacgggccgaaggcgggcugcugaugcgccccaucauuuguaucugcaacgaucaguuugcuccgucucuuagacaacucaaacagcaggccuuccugcugcacuuuccucccacacucccuucccggcuggugcagagacuucaagagguuagccugcgccagggaaugcgggccgaccccggcgugcucgcugcgcugugugagaagaccgacaaugauauuagagccugcaucaacacacugcaguuccuuuauucucgcgggcagagagaacucuccguccgggacgugcaagcuacccgcgugggacugaaagaucagagacggggccuguuuagcguuuggcaggaggucuuccagcucccgcgcgcccaaagacggcgcguggggcaggacccugcccugcccgcugauacccuucugcucggcgacggagaugccggcucccugacaucugcgagccagagauucuaccgggugcugcaugcugccgccuccgcuggggaacacgagaaggucgugcaaggacuuuuugacaauuuccuccgccugagacugcgggauucuagccucggcgccguuuguguggcgcuggacuggcuugcuuuugaugaccugcucgccggggccgcucaucacucccagagcuuccagcugcugagauauccucccuuucuucccgucgccuuccaugugcucuuugcuucuucccacacgccucgcauuaccuucccgagcucucagcaagaagcccagaaccggaugucccagaugagaaaucugauccagacacugguuagcggaaucgcgcccgccacccgcucucgggcuacaccucaagcccuccugcuugaugcucugugccuccugcuggacauucuugcccccaaacugagaccugugagcacccagcucuacuccacgcgcgagaagcagcagcuggccagccucgucggcacaaugcuggcuuacucucuuaccuaucggcaagagagaacccccgacgggcaguacaucuaucgccuggaaccuaacguggaggaacucugucgguuuccggagcugcccgcgagaaagccucugacauaccagaccaaacaacuuauugcccgggaaaucgagguugagaagaugcgcagagcugaagccuccgcccggguggagaauagcccccaggucgauggcuccccucccggacuggaaggccuccugggcggaauuggcgagaaaggggugcaccgcccggcuccuagaaaccaugagcagcggcucgaacacaucaugagacgcgccgcgcgggaggaacagcccgagaaggacuucuuuggaagaguggucguucgcucuacagcugugcccagcgccggcgauacggccccugaacaagacuccguggagcggagaauggggaccgcugucggccgcucugaggugugguuccgguuuaacgaaggaguuagcaaugccgugagacgcucccuguauaucagagaucuucuguga

SEQ ID NO: 67476 - RNA, 750 nt, Artificial Sequence
  derived and/or modified sequence opt5 from CHTOP__Homo_sapiens__NP_001193541
auggccgcucagagcgcccccaaggugguccugaaauccaccacaaagaugucucucaacgagagauucacgaauaugcugaaaaacaagcaaccuaccccgguuaauauccgggcgagcaugcagcagcagcaacagcuugcuuccgcccgcaacagacggcuggcccagcagauggaaaaucgccccucugugcaagcugcccucaaacugaagcaaaagagccuuaaacagagacugggcaaguccaacauucaggcucggcucgggcgcccuaucggagcccuggcgagaggcgccauugggggacggggccugcccaucauucagcgcgggcucccuagaggaggccugcggggcgggcgcgcuacaagaacccuucugcggggaggcaugucucuccgcgggcagaaucugcuuagaggaggccgggccguggcucccagaauggggcugcgccggggaggcgucagaggccgcgggggaccuggccggggagggcucggcagaggggccaugggacgcggcggcaucgggggacggggcagagggaugaucggacgcggcagagggggcuuuggaggccgggggcgcggacggggcagagggcggggagcgcuggcccgcccggugcugacaaaagagcagcucgacaaccaacuggaugcuuacaugagcaagaccaaaggccaccuugacgccgaacuggaugcuuauauggcccagacagaccccgagaccaaugauuga

SEQ ID NO: 67477 - RNA, 420 nt, Artificial Sequence
  derived and/or modified sequence opt5 from CHURC1__Homo_sapiens__NP_001190992
augagacagcccuaccugagcucccgggaggugucuagcucccgcaagagauggcggaccuucccugucgacugcguugccauguguggcgauugcguggaaaaagaguauccgaaccgcgggaauacaugucucgaaaacggaucuuuucugcuuaauuucacgggcugcgcuguguguagcaagagagacuuuaugcugaucaccaacaaaucccucaaggaggaagauggggaggagauugucacauacgaccaccugugcaaaaauugucaucacgugaucgcccggcaugaauauaccuucucuauuauggaugaguuucaagaauacacaaugcuuugccugcucuguggaaaggcggaggacaccaucagcauucugcccgaugacccucgccagaugacacuccuguucuga

SEQ ID NO: 67478 - RNA, 1020 nt, Artificial Sequence
  derived and/or modified sequence opt5 from CIAO1__Homo_sapiens__NP_004795
augaaggacagccuggugcuccugggcagaguccccgcccacccugauucccggugcugguuccuugcuuggaacccggccgggacccugcucgcgucuuguggaggcgaccgcagaauccggauuugggggacagagggagauagcuggaucugcaaauccguucugucugaaggccaucagcgcacggugagaaagguggcuuggagccccugugggaauuaccuugccuccgccucuuuugacgcuaccacaugcauuuggaaaaagaaccaagaugacuucgagugugucaccacacuggaaggacacgagaaugaagugaaaagcguugccugggcuccuuccggcaaccuccuggcgaccugcagccgggauaagucugugugggucugggagguggacgaggaagaugaguaugaauguguuuccgugcugaauagccauacacaggacgucaagcacgugguguggcaucccucucaggagcuccuggccuccgccagcuacgaugacaccgucaaacuuuaucgcgaggaagaggaugacuggguuugcugugcuacgcuggaaggccacgagucuaccguguggucccucgccuuugacccuagcgggcagagacuggcuuccugcucugaugaccggacagugcgcaucuggagacaauaccuucccggaaacgaacagggcgucgccuguagcggguccgauccuagcuggaagugcauuugcacccugucuggauuccacucccggacaaucuaugacaucgcguggugucagcucaccggcgcccuggcuacggccugcggggaugacgcuauucgcguguuucaggaggauccgaauagcgacccccaacagccuacauucucucugaccgcccaucuccaccaggcccauagccaggauguuaacuguguggcuuggaaucccaaagagccuggacugcuugcguccugcucugacgauggcgaagucgccuuuuggaaguaccaaagacccgagggccuguga

SEQ ID NO: 67479 - RNA, 939 nt, Artificial Sequence
  derived and/or modified sequence opt5 from CIAPIN1__Homo_sapiens__NP_064709
auggccgacuucggcaucagcgcugggcaguuuguggccgucguuugggauaaguccucucccguggaggcgcugaaaggacucguggacaagcugcaagcucuuaccggcaacgaagggagagucagcguggagaauauuaaacagcugcuccaguccgcccacaaggaaucuagcuucgauaucauucuguccggacuuguuccuggcucuacaacgcugcauagcgccgagauccucgcugaaauugcccggauccugcgccccgggggaugccuguuucucaaagagccgguggagaccgcugucgacaacaauuccaaggugaagacagccagcaaacuguguucugcgcuuacccuguccggccucguugaagugaaggagcugcagagagaaccucuuacacccgaggagguccaaagcgugcgggaacaccugggccaugagucugauaaccuccuguucgugcagaucaccgggaaaaagccuaauuuugaagucggauccagccgccagcugaaacucucuauuacaaagaaguccagccccuccguuaaaccugccguggacccggcugccgcuaagcuguggacccuuucugccaacgauauggaggacgauagcauggaccugaucgauuccgacgaacuccuggaucccgaggaccuuaaaaagccugaccccgcgagccugagagccgcuucuugcggcgaggggaaaaagcggaaagccuguaagaauugcacguguggacucgcugaggaacuggaaaaggagaaaucccgcgaacagaugagcucucaaccuaagagcgccugcggcaacuguuaccugggggaugccuucagaugcgcuuccugucccuaucucggaaugccggcguuuaaaccuggcgagaaggugcugcuuucugacagcaaucugcacgaugccuga

SEQ ID NO: 67480 - RNA, 576 nt, Artificial Sequence
  derived and/or modified sequence opt5 from CIB1__Homo_sapiens__NP_006375
augggcgggagcggauccagacugucuaaggagcuccuggccgaauaccaggaccuuaccuuccugacaaaacaagagauccuccuggcucaccggcgcuuuugcgaacuucugccccaggagcagagaagcguggaauccucucuccgggcccaggucccuuucgagcaaauucugagccugccggagcucaaggcgaaccccuuuaaagaacgcaucuguagaguuuucuccacgucuccugcuaaggauagccuguccuuugaggacuuccuugaucugcucagcguguuuucugacaccgccacacccgauauuaaaucccauuaugccuuccggaucuuugacuucgaugacgauggcacccugaaucgcgaagaccuuagcagacuggugaacugccucacaggggagggagaggauacccggcugucugcuuccgaaaugaagcagcugauugacaauauccucgaggaaagcgauaucgaccgcgacggcacaauuaaccugucugaguuucagcacgucaucuccagaagcccugauuucgccuccucuuuuaagauugugcuuuga

SEQ ID NO: 67481 - RNA, 564 nt, Artificial Sequence
  derived and/or modified sequence opt5 from CIB2__Homo_sapiens__NP_006374
augggcaacaagcagaccaucuucacagaggaacaacuggacaauuaccaggauugcacguuuuucaacaaaaaggacauucucaaacugcacagcagauuuuaugagcuugcccccaaucuggugccuauggauuaccggaaguccccgaucguccauguucccaugucucucauuauccagaugccugaacugcgcgagaaccccuucaaagaaagaauuguggcugccuuuagcgaggacggggagggaaaucuuaccuucaacgauuuuguggacauguucuccguccugugugaaucugcgccucgggagcucaaggcuaauuaugccuuuaagaucuacgauuucaacacagacaauuuuaucugcaaagaagaucuggagcugacccucgcccgccugacaaagagcgagcuugacgaagaggaagugguucuggugugugauaaagucauugaggaagcugaccucgauggcgacgggaagcugggauucgccgacuuugaggauaugaucgcuaaagcccccgacuuccuuuccaccuuccacauuagaaucuga

SEQ ID NO: 67482 - RNA, 4827 nt, Artificial Sequence
  derived and/or modified sequence opt5 from CIC__Homo_sapiens__NP_055940
auguacagcgcccacagaccccugaugccugcuuccucugccgcgagccggggccucgggauguucguguggaccaacgucgagccgcgcuccguugcuguguuucccuggcauucucuggugccuuuccuugcccccagccagccugaccccuccguccaaccuucugaagcccagcagccggcuagccaccccguggccuccaaucagagcaaggagccugcugaaucugccgcgguugcccaugagagacccccuggaggcacaggguccgcugaucccgaacggccgccuggagccacgugccccgagagcccuggccccgggcccccucacccgcugggaguggucgagucuggcaaaggacccccucccaccacagaagaggaggcuuccgggccucccggagaaccgcgccucgacagcgagaccgaaucugaucaugacgaugccuuucuguccaucaugagcccugagauucaacuuccccugccucccggcaagagacggacacagucccucucugcgcugccuaaagaacgcgacagcuccagcgagaaggaugggagaucucccaacaaacgggaaaaggaccacauccgcagaccgaugaaugccuucaugaucuuuuccaagcggcaccgcgcucuggugcaucagagacacccuaaccaggauaaucggaccguuagcaaaauucucggagaguggugguaugcccugggccccaaggagaaacaaaaguaccaugaccuugcuuuccaggugaaagaagcccacuuuaaggcccaccccgauuggaagugguguaacaaagaccgcaagaaaucuagcuccgaggcuaagccuacaucucuggggcucgcgggaggccauaaagaaaccagagagcggagcauguccgaaacgggcaccgccgcugccccgggggucagcucugagcugcuuuccguggccgcucagacacugcucagcucugauaccaaggcccccggauccagcuccugcggcgcggagagacugcacacagucgggggaccuggcucugcucgcccccgggccuucagccauuccggggugcacucucuggacggaggcgaaguugacagccaggcccuccaagagcugacccagaugguguccggcccugcuagcuauucugggcccaaaccuuccacgcaguacggagcccccggcccguuugcugccccuggggaaggaggcgcgcuugccgcuacagggagacccccucugcuccccacccgcgccagccggucucaaagagcugccuccgaggauaugacaagcgacgaggaacgcauggugauuugugaggaagagggcgaugacgaugucaucgcggacgauggauucggcaccaccgacaucgaucugaagugcaaggaacgggugacagacucugagagcggggauuccagcggagaggacccggaaggcaauaaaggguuuggaagaaagguuuucucuccugugauucgcuccagcuuuacgcauugucggcccccucuugaccccgagcccccuggcccgcccgauccucccgucgccuucgggaaaggcuauggauccgcuccuucuagcuccgccucuagccccgcuuccucuagcgccuccgccgcuaccagcuucucucugggcuccgggacauuuaaggcgcaggaaagcggacagggcucuaccgccgggccucucagaccgcccccucccggagcuggcgggccugccacacccuccaaagccacccgcuuccugccgauggacccugcuacguuucggagaaagcggcccgagagcgugggcggacuggaacccccuggccccucuguuaucgccgcgccuccguccgggggaggcaacauucuccagacacuggugcuucccccuaauaaggaggagcaagaagggggaggcgcucgcguccccagcgccccugcccccucccuggcuuacggggccccggcggcuccucucagcagacccgccgccaccauggugaccaacgucgugcggccuguuucuagcacacccgugccuaucgcuuccaaacccuucccgaccucuggcagagccgaggcuagcccuaaugauacagccggagcgcgcacggaaaugggcaccgggucccggguccccggaggcucuccccugggggugagccuuguuuauuccgacaagaaaucugccgcugccacaagcccugcuccgcaccugguggccggaccccuccugggcaccgucggcaaggccccugcuacagugaccaaccugcucguggggacgcccggauacggcgcgccugcucccccugccguucaguuuauugcccagggggccccgggaggcgggaccacagcuggauccggcgccggcgcggggagcggacccaauggcccugucccccuggggauccuucagccuggagcucugggcaaagccgggggaauuacccaagugcaguacauccuccccacacugccgcagcagcugcaaguggccccugcucccgcccccgcgccuggcaccaaggcugccgcccccucuggcccugcuccgacgacauccaucagauucacccuucccccugggacaagcaccaacggaaagguccucgccgcuaccgcccccacaccuggcauucccauccugcagucugugccguccgcgccucccccuaaagcccagagcguuucccccgugcaggcuccuccucccgggggaucugcccaacugcuccccggcaagguccuggugccccuugcugcccccagcauguccguucgcgggggaggcgccggccagccucugccgcucgugucucccccuuuuagcguccccgugcagaauggggcucaaccucccuccaaaauuauccagcugacgccuguucccgugagcaccccgucuggacuggucccuccccuuagcccugcgacacuccccggcccgaccucccagccucagaaggugcugcugcccucuagcacaagaauuaccuaugugcaauccgccgggggacacgcucucccccugggcacgucuccugccagcucccaggccgggacagucaccagcuacggacccaccucuuccguugcucuuggcuucacaagccugggcccuuccgggccggccuuugugcagccccuccugucugcgggacaggcuccucugcuugcccccggccaagugggggucagcccugugcccuccccucagcucccgcccgccugcgcugccccuggaggccccguuaucaccgcguucuauucugggagcccugcccccacauccagcgcuccgcuggcccagccuucucaggcuccgcccucccugguguacacggucgccaccagcacaaccccucccgcugccacaauccucccuaaaggaccgcccgcgccugccaccgcuacgcccgccccuaccucucccuuuccguccgcuacagccggcagcaugaccuauucucugguggccccuaaggcucaacggcccagcccuaaggcgccccagaaaguuaaggccgcuauugccuccaucccggugggcucuuucgaggccggggcuagcggacgcccuggccccgcccccagacagccucuugaacccgggccuguccgggagccgacagcgcccgaguccgaacuggagggacaaccuacacccccugcucccccuccgcuccccgaaaccuggaccccuacggcccgcagcuccccuccccugcccccgccugccgaggaaagaacaucugcuaaaggccccgagaccauggccagcaaguuucccuccucuagcuccgauuggcgggugccugggcagggacuggagaaccgcggcgaacccccuaccccgcccucuccugcgcccgccccugcuguugcccccggcgggagcuccgagucuagcuccggcagagcugccggcgacacaccggaacggaaagaggcugccgggaccggaaagaaagugaagguccgcccucccccucuuaagaaaacguucgauagcguggacaacagagugcucucugaggucgauuucgaggaacgguuugcggaacugcccgaguucagaccugaagagguucugcccuccccgacacuccagagccuggccaccucuccccgcgcuauucuuggcuccuaccggaagaaaagaaagaauagcacagaccuggauuccgccccugaggaccccaccagcccuaaacgcaagaugcggagacgcucuagcuguuccucugaaccgaacacacccaagagcgcuaaaugcgagggggauaucuuuaccuucgaccggacgggcaccgaagccgaggacgugcucggagaacuggaguaugauaaggugccuuacuccucucugagacgcacacuugaccagcggagagcccuggucaugcaacucuuucaggaucauggcuucuuucccagcgcgcaggcuaccgccgcuuuccaggcccgguacgccgacauuuuuccuuccaaagugugucugcaacucaagauccgcgagguuagacagaaaaucaugcaggcugccacacccaccgaacagccucccggggcggaggccccgcugccugugcccccucccacgggaacagcugccgcuccggccccuacccccucucccgcgggcgggccugaucccacaagcccuuccagcgacucuggaaccgcccaagcugccccgccccuuccucccccucccgaauccggcccggggcagccuggcugggagggagcuccccagccuucucccccucccccgggccccagcaccgccgcuacagggcgguga

SEQ ID NO: 67483 - RNA, 660 nt, Artificial Sequence
  derived and/or modified sequence opt5 from CIDEB__Homo_sapiens__NP_001305736
auggaguaccugagcgcccucaaccccuccgaccugcuuagaucugugagcaauaucuccucugaguucggccggcgcgucuggaccagcgcuccuccgccccagagaccuuuucggguuugcgaucacaagcgcacaauuagaaaagggcugacggccgcgacccggcaagaacuccuggcuaaggcccuugaaacacugcuccugaacggagugcugacccucgugcuggaggaagacggcacagccgucgauuccgaggacuucuuucagcuucuggaggaugacaccugucucauggugcugcagucugggcagagcuggucccccacacgcagcggaguucuuucuuauggccuggggagagaacggccuaaacauuccaaggauaucgcucgcuucaccuuugacguguacaaacaaaaucccagagaucucuucggaagccugaacgucaaggccacguuuuauggccuguacucuauguccugcgacuuccagggccucgggccuaagaaagugcugcgggagcuucugcgcuggaccagcacacuccugcagggacuuggccacaugcugcucgggauuucuuccacccugagacaugcuguugaaggagccgagcaguggcaacagaagggccggcugcacagcuauuga

SEQ ID NO: 67484 - RNA, 747 nt, Artificial Sequence
  derived and/or modified sequence opt5 from CIDEC__Homo_sapiens__NP_001186480
auggaguacgccaugaaaagccugucccuccuguaucccaagucucuuagcagacacguguccguccggaccucuguugugacacagcaacugcucagcgaaccuuccccgaaggcuccccgcgccagaccuugccgggugucuacggcggaccgcagcgucagaaaaggcaucauggcuuacucccuggaggaucuucugcucaagacccggaaccccgaagcccgcagccaggaggugagagacacacugaugcuggccgauaaaccuuucuuucucguucuggaagaggacgggaccacaguggagaccgaagaguauuuccaggcucuugccggagauacagucuuuauggugcugcagaagggccaaaaguggcagcccccuucugaacaggggacccggcauccgcucucccugagccacaaacccgcuaagaaaauugacguugcccgcgugacguucgaucuuuacaagcugaauccucaggacuuuaucggaugucucaacgucaaagcgaccuucuaugauacauacucucuguccuaugaccugcauugcuguggcgccaagagaauuaugaaggaggcuuuucggugggcccucuucagcaugcaagcuaccgggcacgugcugcuuggaacaucuugcuaccugcagcagcuccuggaugccaccgaggaaggccagcccccuaaaggcaaggcguccagccuuauccccacgugucugaaaauucuccaauga

SEQ ID NO: 67485 - RNA, 3393 nt, Artificial Sequence
  derived and/or modified sequence opt5 from CIITA__Homo_sapiens__NP_000237
augagaugccuggcccccagaccugcuggcagcuaccucuccgagccgcaggggucuagccaaugugccaccauggaacugggaccccuugagggcggguaucuggaacuccugaacuccgacgcggauccucuuugccuguaccacuucuaugaccagauggaucucgcuggagaggaagagaucgagcuguacucugaacccgacacagauacgauuaauugugaccaguuuagccgccugcucugcgauauggagggcgacgaagagaccagagaggccuaugccaacaucgcugaacuggaucaguacguguuccaagacucccagcuugaggggcugucuaaggauauuuuuaaacauaucggaccugacgaagucauuggcgagagcauggaaaugcccgccgagguuggccagaagucccagaaacggccuuucccggaggaacuccccgcugaucugaagcacuggaaaccugccgagcccccuacaguggugaccgggagccuucuggucggacccgugucugacuguuccacacucccgugccugccucugcccgcgcucuuuaaucaagaaccugccagcggccagaugcgccuggagaagaccgaccagauccccaugcccuucucuuccagcucucuuuccugucugaaccucccugaagggccgauccaguuuguucccacaauuagcacccugccucauggacuuuggcaaaucuccgaggcuggcacgggggugucuagcauuuucaucuaucacggagaggucccccaggccucccaggugccucccccgagcggcuuuaccguucauggccugccuacaucucccgauagaccuggguccaccagccccuucgcuccuucugccacagaccuccccagcaugccggaaccugcgcugaccucccgggccaauaugacggagcacaagacaucucccacccaaugccccgcugccggagaagugagcaacaaacugccuaaguggccggagcccgucgaacaguuuuaccgcucccuccaggauacauacggcgcugagccugccgggcccgacggcauucugguggagguggaucuuguccaggccagacuggaacggucuagcuccaaaagccucgagcgcgaacuggcuaccccugacugggcggagagacaacuugcccagggagggcuggcugagguucuccuggccgccaaggaacaccggcgccccagagagacccgggugaucgcugugcugggaaaagccggccagggcaagucuuauugggcgggggcugucucccgcgccugggccuguggaagacucccucaguacgauuucguguuuagcguucccugccauugucugaaucggccgggcgacgcuuaugggcuucaagaucugcuguucucccugggaccucagccccugguggccgcugacgaagucuucucucacauucuuaagagaccugaucgcgugcuccugauccuggacggcuuugaggaacucgaggcccaggacggguuccugcauagcacaugcggccccgcgccggccgagccuugcucccuucggggacugcucgcuggccuguuucagaaaaagcugcuuagaggguguacgcuccugcugaccgcccgcccccggggaagacucguucaaucucugagcaaagcugaugcccuuuucgaacuguccggcuuuagcauggagcaggcgcaggccuacgugaugcgcuauuucgaaucuuccgggaugacagagcaccaggaccgggcucucacccugcugagagaucgcccucuucuccugagccacucucauucccccacacugugccgggccgucugucaacucagcgaagcucugcuugagcugggagaggacgccaagcuccccucuacccugacgggccuguacguggggcuucucggcagagccgcucuggauagcccuccgggagcgcuggccgaacucgcuaaacuggccugggagcuuggccgccggcaccaguccacacugcaggaagaccaauuucccagcgccgaugucagaaccugggcuauggccaaggggcucgugcagcauccuccccgggcggcugagucugaacuggccuucccuuccuuucugcuucagugcuuccugggagcccucuggcuggcucucagcggcgagaucaaagacaaggagcugccccaguaucuugcccugaccccucgcaagaaaagaccguacgauaacuggcucgaagggguuccccgguuucuggcgggacugauuuuccaaccucccgcuagaugucuuggcgcccugcucgggccuuccgccgcugccucuguggaccgcaagcagaaaguccuggcucgguaccucaagagacugcagcccggcacacuucgcgccagacagcugcucgagcugcugcacugcgcgcaugaagccgaggaggcuggaaucuggcaacacgugguucaggaacuuccgggccggcugagcuuucucgggacccgccugacaccucccgaugcccacgugcucggaaaagcucuggaggccgccggccaggacuucucccuugaucugagaucuacggggauuugucccagcggacugggcucccucgucgggcugucuugcgugacccgguuccgcgcugcgcuuagcgacacaguggcccugugggaaucccuccagcaacauggcgagaccaagcugcuccaggcugccgaagagaaguuuacaaucgagccuuucaaagccaagagccugaaagacguugaagaucuuggaaagcugguccagacccaaagaacgcggucuuccagcgaggacaccgcuggcgaacugcccgccgugcgcgaucucaaaaagcuggaguuugcgcuugggccugugucuggaccgcaggcuuuccccaagcugguccggauucucacagccuuuuccagccugcagcaccucgaccuggaugcccuuucugaaaauaaaaucggcgacgagggggugucccagcugagcgcuaccuucccucaacugaagucccucgagacacugaaccuuagccagaauaacaucaccgaucugggagccuauaaacucgcggaagcucugcccucucucgccgccagccugcuucggcugucccuguacaauaacuguauuugcgacguuggcgcugagucucucgcccgcgugcugccugauauggucagccuuagagugauggacguucaguauaauaaguuuacggcugccggcgcgcagcaacuggccgcuucccuccggagauguccccauguggaaacacuggccauguggaccccgacaaucccuuucucuguccaggagcaccuccagcagcaagauagccgcauuucccuccgguga

SEQ ID NO: 67486 - RNA, 3471 nt, Artificial Sequence
  derived and/or modified sequence opt5 from CILP2__Homo_sapiens__NP_694953
auggccagccugcucccccugcuuugccuguguguggucgcugcccaccucgcgggcgcuagagacgccaccccuacagaggaaccgauggccacggcucuggggcuugagcggcgcuccguuuacaccggacagcccucuccugcccuggaagauugggaggaagcuagcgaguggacauccugguucaacguggaccaucccggcggggauggagacuuugagucucucgccgcgaucagauucuauuacggcccugcccgggugugcccccgcccucuggcucuggaagccagaaccacagauugggcucucccgagcgccgucggggagcgggugcaccugaaucccacccgcggauuuuggugucuuaacagagaacaaccucggggccgcagaugcuccaauuaucauguucgguuccgcuguccccuggaggcgucuuggggcgccugggggccuuggggacccugcagcggcuccugugggccgggaagacggcuccgcagacggcacugcccuagccccgcuggcgacgccuguccugggagaccccuggaggcucagaagugcgugcgcccccgguguccuggaugcucucuugauacaugcgaauguccggaccauauucugcucggcuccgucgugacccccagcggccagccucugcugggggccagaguuucucuccgcgaucagcccggaacgguggccaccuccgacgcucacggcacauuucgggucccuggggugugcgcggauagcagagccaacauccgcgcucaaauggacggauucucugccggcgaggcccaggcucaggccaauggguccauuagcguggucaccaucauucuggauaaacuugaaaagcccuaccugguuaaacacccggagucccgggugagagaagcgggacagaacgugacauuuuguugcaaggcuucuggcaccccuaugcccaaaaaguauagcugguuccauaauggcacgcuccuggaccgccgggcccacggguacggagcccaucuugagcugagaggccuccgcccugaccaagcugggaucuaucacuguaaggccuggaacgaggcuggagccguccgguccggcacagcgagacugaccgugcuggcccccgggcagccugcuugcgauccccggccgcgcgaauaccucaucaaacugccugaggacuguggccagcccggaagcggccccgccuaccuugauguugggcugugcccugacacaagauguccgucucucgcuggauccagcccccggugcggcgaugccucuagcagauguugcuccgugcgccggcuggaaagacgcgagauucacugcccuggguauguccuucccgugaagguuguggcggaauguggaugccagaaaugucugccucccagaggccucguccgggggcgcguggucgccgcugacucuggcgagccucugagauuugcccggauccugcucggacaagagcccauuggcuucaccgcuuaccagggggauuuuaccaucgaagugccgccuagcacacagcgccugguugugacguucgucgaccccuccggagaguuuauggaugccgugagaguucuuccuuucgacccccggggcgccgggguguaucaugaagucaaggcuaugcgcaaaaaggcgccggugauucugcacaccagccaaucuaauacaaucccucucggagagcuggaagaugaggccccucugggcgagcuugugcucccuuccggggcuuucagacgggccgacggcaagcccuacagcggacccguugaagcccgcgucaccuuuguggacccuagagaucugacaucugcugccuccgcgccgagcgaccugcgguucguggauuccgacggcgagcucgcuccccugagaaccuaugggauguuuucugucgaucuucgcgccccuggaagcgccgaacagcuccaggugggccccguugcugugcgggucgccgcgucccagauucauaugccugggcacguggaggcucugaaacuguggucucugaaccccgagacgggacuuugggaagaggaaagcggcuucagacgcgagggguccagcggcccucggguuagacgcgaagaacggguguuucucgucggaaauguggagaucagagaacgccggcuguucaaccuggacguuccggagagacggcgcugcuuugugaaggucagagccuacgccaaugauaaauucacacccucugaacaaguggagggcguggucguuacccucgugaaccuggaaccugcucccggguuuuccgccaauccucgggcuuggggacgcuucgacagcgccgugaccggccccaacggggcgugucuuccggccuuuugcgaugcugacagaccugaugccuauacagcucuggucaccgccacacucggaggcgaggagcuggaacccgcccccucucugccucggccccuuccugcuacggugggcguuacccagccguaccucgacagacugggguaccgccggacagaucaugacgaccccgcguucaagagaaacggauuucgcaucaaucuggccaaaccucggcccggcgauccugcugaggccaacgggcccguguauccguggagaucccuccgcgaaugucagggagccccugucaccgcuagccacuuccgguucgccagaguggaggcggacaaguacgaauauaauguugugcccuuucgcgagggcacacccgcuucuuggaccggggaucugcuugccugguggcccaacccucaggaguucagagccugcuuucugaaagucaagauucaaggaccccaggaauacauggugcggagccacaaugcuggcggcucccauccgcgcacgagagggcagcucuauggacugcgggacgcccgcagcguuagagauccugagcggcccggcaccucugcggcuuguguggaguucaagugcuccgggaugcuguuugaccagagacaagucgaucgcacacuugugaccaucaugccccagggaagcugucggagaguggccgucaacggccuccugcgcgacuaccugacacggcacccuccgcccguuccugccgaggaucccgcugccuucuccaugcucgcuccucuggacccccuugggcauaauuauggaguguacaccgugacggaucagucuccuagacuggccaaagagauugcgaucggccggugcuuugacggcagcuccgauggguucucucgcgaaaugaaggccgacgcuggaacagccgucaccuuucagugcagagagccgcccgcuggccggccuagccucuuccaacgccugcuggaaucccccgccacagcccuuggggacauuagacgggagaugucugaagcugcgcaggcccaggcucgcgccagcggaccucugagaacccggcgcggcagagugcggcaauga

SEQ ID NO: 67487 - RNA, 3555 nt, Artificial Sequence
  derived and/or modified sequence opt5 from CILP__Homo_sapiens__NP_003604
auggugggcaccaaggccugggucuucagcuuucugguucucgaggugacauccgugcuggggagacagacgaugcuuacccaaucuguccggcgcgugcagcccggaaagaagaacccuagcaucuucgcuaagccggccgacacacuggaaucccccggcgaguggaccacaugguuuaauauugauuacccugggggaaagggcgacuaugaaagacucgaugcgauccgguucuacuauggggaccgcguuugcgcuagaccccugcggcuugaggcccgcaccacagauuggaccccugccggaucuacgggccaggugguccacggcagccccagagaaggguuuuggugucugaaccgggagcagcgcccuggacaaaauugcuccaacuacaccgugagauuccucuguccgcccggcucucugcggcgcgacacagagagaauuuggagcccuuggucccccuggagcaaaugcucugcugccugugggcagaccggaguucagacacggacccgcaucugccuggcugaaauggugucccucuguagcgaggccucugaagagggccagcauugcauggggcaagauuguacggcgugcgaccugacauguccuaugggacaggucaaugccgauugcgacgcuugcaugugucaggauuuuaugcuucacggcgccgugucccugcccggcggggcuccggccagcggagcggccauuuaucuccugaccaagacaccuaaacuucugacccagaccgacucugauggcagauuccggauccccgggcucugcccugacggaaaauccauccugaagauuacaaaagugaaguuugcucccaucguccugacgaugcccaaaaccagccucaaggccgcuacaauuaaggccgaguucguuagagccgaaaccccuuacauggugaugaacccggagacaaaagcucgccgggcgggccaauccgugucucuguguugcaaggccaccgggaaacccagaccugacaaguauuuuugguaccauaaugauacgcuucuggaccccagccucuacaaacacgaauccaagcugguccuucgcaaacugcagcagcaucaagcuggagaguauuucuguaaggcccagagcgaugccggcgcugugaagucuaaaguugcccagcucaucgugauugcguccgacgaaacaccuugcaaccccgucccggagagcuaccugauccggcugccucacgauuguuuucagaaugcuaccaacucuuucuauuacgacgugggcagaugccccguuaagaccugugccgggcaacaggauaauggcauucgcugccgggacgccgugcagaacuguugcggaaucagcaaaacagaggaaagagagauccagugcuccggguauacccucccuacaaaggucgcuaaagaauguucuugccaacgcuguacggagacccggagcauugugagaggacgcgucuccgccgcugauaauggcgaacccaugcgguucgggcacguguacaugggcaacagcagaguuucuaugacaggauauaagggcaccuuuacacugcaugugccucaggacaccgagcggcuuguccugacguucguggaucgccuccagaaguuuguuaauaccacaaaagugcugcccuucaacaagaaaggguccgccgucuuucacgagaucaagaugcuuagacggaaagaaccgauuacccuggaggcgauggaaacaaacaucauuccucucggagagguggugggcgaagaccccauggccgagcuggagauccccagcagaucuuucuaccgccagaauggggaaccuuacaucggaaagguuaaggcuuccgucaccuuucuggacccgcggaacauuagcacggccacagcugcccaaaccgaucucaauuucaucaacgacgagggcgauacauuuccccugagaaccuaugggauguucuccguggacuuucgcgaugaagugaccucugagccucuuaaugcgggcaaagucaaggugcaucuggacagcacacagguuaaaaugcccgagcacauuuccacggugaagcucuggucucugaacccugauaccggacugugggaagaggaaggcgacuucaaauuugagaaucagagacggaacaagcgcgaagauagaacauuccuugucgggaaucucgagauccgggagcgcagacuguucaaccuggacgugcccgaaagccggcgcugcuuuguuaaggugagagccuaccgguccgagcgcuuccucccuagcgaacagauucaaggagucgugaucucuguuaucaaucuggagcccagaaccggcuuucuuuccaacccgcgggcuugggggagauucgauagcgugauuacaggaccuaauggcgccuguguccccgcuuuuugcgacgaucagucuccugacgccuauuccgccuacgugcuggcuagccucgcgggggaagaacugcaggccguggagucuagccccaaauucaacccgaaugcuaucggcgucccucaacccuaucugaacaaacuuaacuaccgccggaccgaccacgaagauccuagaguuaagaagacggccuuucagauuuccauggccaaaccccgccccaauagcgcugaggaaucuaacggaccuaucuaugccuucgagaaucuccgggcgugugaagaggcuccgcccuccgccgcccauuuuagauucuaccagauugagggcgaccgcuacgauuauaacacagugccuuuuaaugaagacgaucccaugagcuggaccgaggacuaccuggcuugguggccuaagcccauggaguuccgggccugcuauaucaaagugaagauugucgggccucuggaggugaacguuagaucccgcaauaugggaggcacccaccggcagacaguggggaagcucuacggaaucagagauguccggucuacccgcgacagagaucaaccgaacgugagcgcggcuugucuggaguuuaaaugcuccggcaugcuuuaugaccaggaucggguugaccgcacacuggugaaggucaucccccaggggucuuguagacgggccagcgugaauccuaugcuccaugaauaccugguuaaccaucugccccuugccgugaauaacgauacguccgaguauaccaugcucgcuccucuggacccccugggccacaauuacggaauuuacacagucaccgaccaggauccgagaacagccaaagaaaucgcucucggccgcugcuucgacgggaccucugauggaagcucccggauuaugaaaagcaacgugggcguggcccugacguucaauugcgucgagagacaaguugggcgccagucugcguuucaguaucuucaguccaccccugcccaaagccccgcugccggaacagugcagggccgggugcccucuagacgccagcaacgggcuuccagaggcgggcagcgccagggaggcgucguggccagccugagauucccucggguugcccagcaaccccucaucaacuga

SEQ ID NO: 67488 - RNA, 639 nt, Artificial Sequence
  derived and/or modified sequence opt5 from CINP__Homo_sapiens__NP_116019
auggaggccaagacccugggcacagugacgcccagaaaaccuguccucagcguuuccgcucggaagaucaaagacaacgccgcggauuggcacaaucugauucuuaagugggaaacccugaacgacgcuggguucacaaccgccaauaacaucgccaaucucaaaauuucucugcuuaacaaggauaagaucgagcuggacagcuccucuccggcuagcaaagaaaaugaggaaaaggugugccucgaguacaacgaggaacuggagaaacugugugaggaacuccaggccacacuggauggacuuaccaagauucaagugaaaauggagaagcuguccucuacaaccaagggcaucugcgaacucgagaauuaucauuacggggaagagagcaaaagacccccucuguuucacacguggcccaccacacauuucuaugaagucucccacaaacuucuggagauguaccgcaaggagcuccugcugaagcggaccguggcuaaagaacucgcccauacaggagacccugaucugacccuuagcuaucugucuauguggcuccaccagcccuacguugaguccgacagccgccugcaccuugaaucuaugcugcucgagacgggccauagagcgcuguga

SEQ ID NO: 67489 - RNA, 1200 nt, Artificial Sequence
  derived and/or modified sequence opt5 from CIPC__Homo_sapiens__NP_219494
auggagagaaagaaccccagccgggaauccccucgcagacugucugccaaagugggcaaggggaccgagaugaaaaaggucgcucggcagcucggaauggccgcggcugaaagcgacaaagauuccggcuucucugacgggagcuccgagugccugucuagcgccgaacaaauggaguccgaggauaugcuuagcgcccugggauggucucgcgaagacagaccgcggcaaaauuccaagacagcuaagaacgccuuucccacgcucagcccuaugguugugaugaaaaaugugcuggucaagcaggggucuuccagcucucagcuucaauccuggaccgugcagcccagcuucgagguuaucuccgcucagccucagcugcucuuucugcaucccccugugccgucucccgucagcccuugucacacaggcgagaaaaaguccgauagccgcaacuaccugcccauucucaauucuuauaccaaaaucgccccucaccccggaaagagaggccugucccuuggcccggaagagaaggggacaagcggagugcagaaaaagauuugcaccgaacggcugggcccuucucucagcuccucugagcccacaaaagcgggggccguuccuagcucccccagcacccccgcuccuccgucugccaagcuggcugaagacuccgcccuucagggagugcccagccuggucgcgggcgggucuccucagacgcuccagcccguguccagcucccauguggccaaagcuccuucucugaccuucgccagccccgcuuccccggucugugccucugauagcacacugcacggacucgaguccaacagcccucugucuccccuuuccgccaauuacagcucuccucugugggcugcggaacaucucugccgcucccccgacaucuuuagcgagcaaagacagucuaagcaccggcgcuuccagaacacccugguugugcuucacaaaagcggccugcucgagauuacacugaagaccaaggaacugaucagacaaaaucaggccacacagguggagcucgaucagcugaaagaacaaacgcagcuuuuuaucgaggcuaccaagucccgggccccucaggccugggcuaaacugcaggccagccucacacccgggucuuccaacaccggcagcgaccuggaagcguucuccgaucauccggcuauuuga

SEQ ID NO: 67490 - RNA, 1353 nt, Artificial Sequence
  derived and/or modified sequence opt5 from CIR1__Homo_sapiens__NP_004873
augggcaagagcuucgccaacuuuaugugcaaaaaggacuuccaccccgcuuccaaaucuaauaucaagaaaguguggauggccgagcagaagauuagcuacgauaagaaaaagcaagaagaacugaugcagcaguaucucaaagaacaggaguccuacgacaacagacugcuuaugggggaugaacgggucaagaauggacugaacuuuauguaugaggcgccuccgggcgcuaaaaaggagaauaaggaaaaagaggaaaccgagggggagacagaauacaaguucgaguggcaaaaaggagcuccccgcgaaaaguaugccaaagacgauaugaacaucagagaccagccuuuuggcauucagguucggaaugugcgcuguaucaagugccauaaaugggggcacgugaacacggauagagaguguccccucuucggacugucuggcauuaaugccagcuccgucccuaccgacggcucugggcccagcaugcauccuuccgaacuuaucgccgagaugcggaacagcggauuugcucugaagcgcaaugugcucggcagaaaccugacagccaaugauccgucucaggaguacguugcguccgaaggggaggaagaccccgagguggaguuccucaagagccugaccacaaaacaaaagcagaaacugcuucggaagcuggaucgccucgagaaaaagaagaaaaagaaagacagaaagaaaaagaaguuucagaaaucucgguccaagcacaaaaagcauaaaagcagcuccagcuccucuagcuccucuucuuccagcucuagcaccgagacauccgaaucuagcuccgagagcgaaucuaacaauaaggagaagaaaauccagcgcaagaaaagaaagaaaaacaagugcuccggacacaacaauagcgauucugaagagaaagacaaguccaagaaacggaagcugcacgaggaacuuagcuccucucaucacaaccgcgagaaagccaaggaaaaaccuagauuccugaagcaugagagcucccgggaggacucuaaguggagccacuccgauagcgacaaaaagucuagaacccacaaacauucccccgaaaagcgcggcagcgagcggaaagaagggucuuccagaagccacggacgcgaggaacggucuagacgcagccgguccagaagcccuggcucuuauaagcaacgcgagacgcggaagagagcucagcgcaaucccggcgaggaacagucccggagaaacgauagccggucccaugggaccgaccucuaccgcggagagaaaauguacagagaacacccgggcgggacacauaccaaggucacacaacgggaguga

SEQ ID NO: 67491 - RNA, 507 nt, Artificial Sequence
  derived and/or modified sequence opt5 from CIRBP__Homo_sapiens__NP_001287744
auggccagcgacgagggcaagcuguucgucgggggacucuccuuugauaccaacgaacagucucuggagcaaguguucagcaaauacggccagaucuccgaaguugugguggucaaggacagagagacacagcggucucgcggguuuggauucgugacguuugaaaauauugaugacgcuaaagaugccaugauggcgaugaacggcaagagcguugacgggagacagauccggguggaucaagcuggaaaauccucugacaaucgcagcagaggcuaucggggcggguccgccggaggccgcggguucuuuagaggaggccgggggcgcggaagaggcuucagccggggcgggggagaucgcggcuacgggggaaacagauuugagucucgguccggcggguauggaggcagccgcgacuacuauucuuccagaagccagucuggcggguacuccgaucggagcuccggaggcucuuauagagacagcuacgauuccuacggguga

SEQ ID NO: 67492 - RNA, 2061 nt, Artificial Sequence
  derived and/or modified sequence opt5 from CIRH1A__Homo_sapiens__NP_116219
augggcgaguucaaggugcacagaguccgguuuuucaacuacguucccagcgggauccgcugcguggccuauaauaaccaguccaauagacuggcugugucucggaccgacggaacagucgaaauuuacaaccucagcgccaauuauuuucaagagaaauucuuuccuggccaugaaucccgcgcgacggaggcucuguguugggccgaagggcagagacuuuucucugccggacugaacggcgagaucauggaguacgaucuccaggcucugaauauuaaguaugccauggacgcuuuugggggaccgaucuggagcauggccgcgucccccucuggcagccagcuucuggugggcugcgaagauggguccguuaaacucuuccaaauuaccccugacaagauccaguuugagcggaacuucgaucgccagaaaagcagaauccugucucuguccuggcaccccagcggaacacauauugccgcuggcucuaucgacuacauuuccguguuugaugucaagagcgggucugccgugcacaagaugaucguugaccggcaguauaugggaguguccaaacgcaaguguauugucuggggcguggcuuuccucagcgaugggaccaucauuuccguggacucugccggaaaaguccaauuuugggauagcgcgacaggcacccugguuaagucccaucuuaucgccaaugcugacgugcagagcaucgccguggcugaucaggaagacucuuucgucgugggcacagccgaggggaccguuuuccacuuucagcuggugccugucacguccaacagcucugagaaacaaugggugagaaccaagcccuuccagcaccauacacacgacguucggaccguggcccauagcccuacagcucucauuuccggaggcaccgauacgcaccuggucuuucgcccgcuuauggaaaagguggaggucaaaaauuacgacgcggcccugagaaagaucacauucccccaccggugccucauuucuuguagcaaaaagcgccagcugcugcucuuucaauucgcucaucaccuggaacuuuggagacugggguccaccguggccacaggcaaaaacggagauacccucccucugagcaagaaugccgaccaucuucugcaccucaaaaccaaggggcccgagaacaucauuugcucuuguaucuccccuugcggaagcuggaucgcuuacucuacaguuucccgguuuuuccuguauagacugaauuacgaacaugauaacauuagccucaagcgcguguccaaaaugcccgccuuucugcggucugcgcuucagauccuguucagcgaggacuccacgaagcucuuugucgcuucuaaccagggcgcccugcacauugugcagcuuagcggcggguccuucaaacaucugcacgccuuucaaccgcagagcggaaccguugaggcuaugugucuccuggccgugucuccugauggcaauuggcuggcugccuccgggacaagcgcgggaguccacguguauaacgugaagcagcucaaacugcauugcaccguucccgccuacaauuucccugucacagcuauggccaucgcucccaacaccaauaaccuugugauugcccacucugaccagcaaguguucgaauauuccauccccgauaagcaguacacggacuggagcagaacaguccagaagcagggcuuucaccaucuguggcuccaacgcgauaccccuaucacccacauuucuuuccauccgaaacggcccaugcacauccugcugcaugacgcguauauguuuuguauuaucgacaagagccuuccucuccccaaugauaaaacacugcuguacaacccuuuucccccgaccaaugaguccgacgugauuagacgccggacagcccacgcuuucaagaucagcaaaauuuacaagccucuccuguucauggaucuucuggacgaaagaacgcucguugccguggagcgcccccuggaugacaucaucgcucagcugccucccccuauuaagaaaaagaaauuugggaccuga

SEQ ID NO: 67493 - RNA, 327 nt, Artificial Sequence
  derived and/or modified sequence opt5 from CISD1__Homo_sapiens__NP_060934
augagccugaccuccucuagcuccgugagagucgaguggaucgccgcuguuacaauugccgcgggcacggcugccaucggguaccucgccuauaagcgguucuacgugaaagaccaccgcaacaaggcuaugauuaaucugcauauccagaaagauaaccccaagauugugcacgccuuugacauggaagaucuuggagacaaagcugucuauugcagauguuggcggucuaagaaguucccuuuuugcgauggcgcccauaccaaacacaaugaggaaacaggggacaacgugggaccgcugaucaucaagaaaaaggagaccuga

SEQ ID NO: 67494 - RNA, 408 nt, Artificial Sequence
  derived and/or modified sequence opt5 from CISD2__Homo_sapiens__NP_001008389
auggugcuggagagcgucgccagaaucguuaaggugcagcuccccgcuuaccugaaacggcuuccugugccggaauccauuaccggcuucgcccgccugacagucucugaguggcucagacugcuucccuuucugggggugcucgcgcugcugggauaucucgcuguucggccuuuccugcccaagaaaaagcaacagaaagacagccuuaucaaccugaagauucagaaggaaaauccuaaaguggucaacgagaucaauauugaagaucucugccugacgaaggccgccuacugucgcugcuggagauccaaaaccuuucccgcuugugacggcucucacaacaagcauaaugagcuuacaggggauaacgugggaccucugauccucaaaaagaaggagguuuga

SEQ ID NO: 67495 - RNA, 828 nt, Artificial Sequence
  derived and/or modified sequence opt5 from CISH__Homo_sapiens__NP_037456
auguaccuggagcacaccagccauugcccccaccaugacgaugacacagccauggauacgccucucccgagaccccggccucugcuugcuguggaacgcaccggccagagaccccugugggccccuucccucgagcugcccaagccugucaugcaaccgcuucccgcgggggcuuuccuggaagagguugccgaaggaaccccugcccagacagagucugagcccaaagugcucgacccugaagaggaucugcuguguaucgcuaagacauuuagcuaucuccgggaauccggcugguacugggggucuauuaccgccagcgaggcucgccagcaucugcagaaaaugcccgagggaacauuccuugugagagacuccacccacccgucuuaucuguuuacgcucagcgucaagaccacacggggcccuaccaacgugcgcaucgaauacgccgauuccagcuucagacuggacucuaauugccuuucccggccccgcauucuggcguuuccugauguugugagccucguccaacacuauguggccucuuguacagcugacaccagauccgauagccccgaccccgccccuacgccggcucugcccaugccuaaagaggaugcccccucugacccugcgcugcccgccccgccucccgcuacagccguucaccucaagcuggugcagccuuucguccggcgcuccagcgcuagaucccuucagcaucugugccggcucgugaucaaccgccugguggccgacgucgauugucuuccccugccuagacggauggccgacuaccucagacaguaucccuuucaacuguga

SEQ ID NO: 67496 - RNA, 660 nt, Artificial Sequence
  derived and/or modified sequence opt5 from CITED1__Homo_sapiens__NP_001138357
auggagcccagcgcccagcaacugcagcucgcugccucccugccugcgaaccuuucuaauuucugccagggcagcgaaaugccgaccacauccagacccgcucuggacgugaaagggggaacgucuccugccaaggaggaugccaaccaggaaaugagcuccgucgcuuacucuaaucucgccguuaaggaccggaaagcuguggccauccugcacuaucccggcguggcgagcaacgggaccaaggccuccggagcuccuacaucuagcuccggcagccccauugggucuccuaccacaaccccgcccacaaaaccucccuccuuuaaucuucauccugcuccccaccuccuggccagcaugcaucugcaaaagcugaacucucaguaccagggaauggccgcggccaccccgggccagccuggcgaggcugggccccuccaaaauugggauuucggagcccaggcuggcggggccgaaucccugagcccuuccgccggagcucagucucccgcgaucauugacagcgaucccgucgacgaggaggugcuuaugucccugguuguggaacucggccuggaucgcgccaacgagcuuccugaacuguggcucgggcagaaugaguuugacuucacggcugauuuuccgagcucuuguuga

SEQ ID NO: 67497 - RNA, 813 nt, Artificial Sequence
  derived and/or modified sequence opt5 from CITED2__Homo_sapiens__NP_001161860
auggccgaccacaugauggcuaugaaccauggcagauuccccgaugggaccaauggacugcaccaucacccugcccaucggaugggcauggggcaguuuccgagcccccaccaccaucaacagcagcagccucaacacgcguucaacgcucucaugggagagcauauccacuacggcgccgggaauaugaacgccacauccgggauucgccacgcuaugggccccggcacggugaaugggggacauccucccucugcccuggcuccugccgcgagauuuaacaauagccaguucaugggcccgcccgucgccucccagggaggaucucuuccugcuagcaugcagcugcaaaagcucaacaaucaguauuuuaaccaccaucccuacccucacaaucauuauaugcccgaccugcacccggccgcuggccaccagaugaacgggaccaaucagcauuuccgggauugcaacccuaaacacuccggaggcucuagcacacccggcggguccggaggcagcucuaccccugggggauccggcucuagcuccgggggaggcgccggcagcucuaauuccgggggaggcagcggguccggaaacaugcccgcgucuguugcccaugugcccgcugccaugcuuccuccgaacgugaucgacacagauuuuauugacgaagagguccugaugagccucgugaucgaaaugggccuggaucgcauuaaggagcugcccgaacucuggcuggggcaaaaugaguucgacuuuaugaccgauuucguuuguaaacagcagccuuccagagugagcugcuga

SEQ ID NO: 67498 - RNA, 6210 nt, Artificial Sequence
  derived and/or modified sequence opt5 from CIT__Homo_sapiens__NP_001193928
augcugaaguucaaguacggagccagaaacccccucgacgcuggggccgcggagccuaucgcuagccgggccucccgccugaaucucuuuuuccagggaaagccucccuuuaugacccaacagcagaugucuccccugagcagagaaggcauucuugaugcccuguucgugcuuuuugaggaaugcucccagcccgcucugaugaagaucaagcacgucucuaacuucguucggaaauauagcgacacaauugccgagcuccaagaacugcagccuuccgcuaaggauuuugaggugcgcucucuggugggguguggacauuucgccgagguccaggugguuagagaaaaggcgacgggcgacaucuacgccaugaaggugaugaagaagaaggcucuccuggcccaggagcaagucagcuuuuucgaagaggagcggaauauucuuucccgcagcaccucucccuggaucccucagcugcaguaugcuuuucaggauaaaaaccaccucuaccuggugauggaauaucaacccgggggagaccuucugucccuccugaauagauacgaggaucagcuggacgaaaaccucauccaguucuaucuggccgagcuuauucuggcgguucauagcgugcaccucaugggcuacguccaucgggauaucaagcccgaaaauauucugguggaccgcacgggccacaucaaacuuguggauuuugggucugccgcuaaaaugaacuccaauaagauggucaacgccaaacugccuauuggaacccccgacuacauggcuccugagguucucacagugaugaauggcgaugggaagggaaccuauggccuggacugcgacugguggagcgugggggucaucgccuacgagaugauuuauggaagaucucccuucgccgaaggcacauccgcucggaccuucaacaauaucaugaacuuucaacgcuuccugaaauuuccggaugacccuaaggugagcuccgauuuccucgaccugauccagucucuucuguguggccagaaagagagacucaaguuugaagggcugugcugucaccccuucuuuagcaagauugauuggaauaacauccggaacuccccuccgcccuucguuccuacgcuuaaaagcgacgaugacaccucuaauuuugaugagccggaaaagaacuccugggugagcucuagccccugccagcuguccccuucuggauucagcggcgaggagcuccccuuugucggguucuccuacagcaaagcgcugggcauucugggccgcucugaauccgugguuagcgggcucgacucuccugccaagacauccagcauggagaaaaagcugcuuaucaaguccaaagaacugcaagauucucaggacaagugucauaaaauggagcaggaaaugaccagacuccaccggagagugagcgaggucgaggcugugcugucccagaaggaagucgagcugaaagccucugaaacacaacgcagccuucucgagcaggaccuggccaccuauauuacggagugcuccagccugaagcggucucucgaacaggcuagaauggaggugucccaggaagaugacaaggcccugcaacuucugcaugauauccgcgagcagagccggaaacuccaggaaaucaaggagcaggaguaccaagcgcagguugaagagaugagacugaugaugaaucagcuggaagaggaccuugugucugcucgccggagauccgaucucuaugaaagcgagcugcgcgagucucggcuggccgccgaagaguuuaaaagaaaggcuacagaaugucaacacaaacuccugaaggccaaggaccagggaaaacccgaggucggcgaauacgcuaaacuugagaaaauuaacgccgagcagcagcugaagauccaagaacuccaggagaaacuggaaaaggcggugaaagccagcaccgaggcuacagagcugcuucagaauauucgccaggccaaggaacgggcugagagagaacucgagaagcugcaaaaccgggaagauuccagcgagggcauccgcaaaaagcugguugaggccgaagagagacggcacucucucgaaaauaaagugaagagacuggagaccauggaacgccgggagaacagacuuaaagacgauauucagaccaagucccagcagauccaacagauggcggacaagauccuggagcucgaagagaaacaucgcgaagcccaggucagcgcucaacaccuggaggugcaucugaagcagaaagaacagcacuacgaggagaagauuaaagugcuugauaaucagaucaagaaggaccucgccgauaaagaaacacuggagaacaugaugcaaagacaugaagaggaggcucacgaaaaggggaaaauucuguccgagcagaaggccaugaucaaugccauggacucuaaaauucggagccucgaacagcgcaucguugagcuguccgaagcuaacaaacuugcggccaauucuagccuguucacgcagagaaacaugaaggcucaagaggagaugauuuccgaacuccggcagcagaaauucuaucuggagacccaggccggaaagcuggaagcccaaaaucgcaaacuugaggaacagcuggagaagaucucucaccaggaccauagcgauaaaaacagacuccuggagcucgaaacacggcugcgcgaggucucccuugaacacgaggaacagaagcuggagcucaaaagacaacugaccgagcugcagcuuagccugcaggaacgggagucucaacucacagcucugcaggccgcgcgcgcugcccucgaaucccagcugagacaggccaagaccgagcuugaggaaacgacagcugaggccgaagaggaaauccaagcgcugaccgcucaucgggacgagauucagagaaaguuugaugcccuccgcaacagcugcaccgugaucacagaccuggaggaacagcugaaucagcuuaccgaggauaacgccgaacugaauaaccaaaauuucuaccucucuaaacagcuggacgaggcuuccggcgccaacgaugaaauugugcagcuccggagcgaggucgaccaccugagacgcgagaucacagaacgggagaugcagcuuacgucucaaaagcagaccauggaagcucugaaaacaaccuguacaaugcuggaggaacaggugauggaucucgaggcccugaaugacgagcuucuggaaaaggagagacaaugggaagcguggcgcuccguucucggggaugagaaaagccaguuugagugccgggugagagaacugcagcgcaugcucgacaccgagaagcagucccgggccagagcugaucaacggauuacggaaagccgccaggucguggagcuggccguuaaggaacacaaagcugagauccuugcccugcagcaggcccugaaggagcaaaaacucaaggcugaaucucugagcgacaaacuuaacgaccuggagaagaagcaugcgaugcucgaaaugaaugccagaucccugcagcagaaacucgagaccgaacgggagcugaagcagcgccuucuggaggaacaagcuaaacugcagcagcagauggaucuccaaaagaaccacaucuucagacugacacagggacuucaggaggcccuggaccgggccgaucuccugaaaaccgaaagaucugaccucgaguaucaacuggaaaauauucaggugcuuuacagccaugagaaggucaagauggagggcacaaucucccagcagaccaaacugauugauuuucugcaagcuaagauggaccagccggccaaaaagaaaaagggccucuucucucgccggaaggaagauccugcgcugcccacacaggugccucuucaguauaacgagcugaaacucgcucuggaaaaggagaaagccagaugcgccgagcuggaagaggcucuccaaaagacacgcaucgaacuucggagcgccagagaggaagcggcucaccgcaaagccaccgaccauccccacccuuccacacccgccaccgcucggcagcagauugccaugucugcuaucguuagaagcccggagcaccagccuuccgccaugagccugcuggcgccgcccucuucccgcagaaaggagagcucuaccccugaagaguuuucccggcgccucaaagaaagaaugcaucacaauaucccgcaucgguucaacguggggcugaauaugcgcgccacaaagugugcugucugccuugauacggugcacuuuggaagacaagccagcaagugucuggagugccaggugaugugucaucccaaaugcuccaccugucucccugcuacaugcggccugcccgccgaauacgccacccacuucacagaggcuuuuugucgggacaagaugaacucuccugggcugcagaccaaagagcccagcuccagccuccaccuugaaggauggaugaaggucccuagaaacaauaaacgcggccaacaggggugggaucggaaguauauuguucuggagggaucuaaggugcugaucuacgacaacgaagcgagagaggccggccagcgccccguggaagaguucgagcucugccugccggacggggaugucuccauucauggcgcugugggagccagcgaacuugccaauacggcuaaagccgacguuccuuacauccugaagauggagucucacccccauacaaccuguuggccuggccggacccucuaucugcuggcgcccagcuuuccggauaaacagagaugggugacagcucucgaauccgucguggccgggggacggguuucucgcgagaaggccgaggcugacgccaaacuucugggcaacagccugcucaagcuggaaggggaugacagacuugauaugaauugcacccugccuuucuccgaccaagugguccucgugggaacagaggaaggccuguacgcgcugaacguucucaaaaauucucuuacgcacgugcccgggauuggcgccgucuuccagaucuauaucauuaaagaucuggagaagcugcucaugaucgcuggagaggaacgggcccugugccuuguggacgugaaaaaggucaaacagagccuggcucagucccaccucccugcccaacccgauauuagccccaacaucuuugaggcuguuaagggcugucaucuguucggggccggaaagauugaaaauggccugugcaucugugcggccaugccuucuaaaguggugauucuccgcuacaacgagaaucuuuccaaguauugcaucagaaaagaaaucgagaccagcgaaccguguuccugcauucacuuuacaaacuacucuauccugauugggaccaauaaguucuaugagaucgacaugaaacaguacacacuggaggaauuucucgauaagaacgaccauagccuggcucccgccgucuucgcugccuccucuaauagcuuuccuguguccauuguucaggugaacagcgccggacagcgggaggaauaccuucuguguuuccacgaguuuggcgucuucguggacucuuaugggcgcagaucccggaccgaugaccucaaauggagccgccugccccuggcuuuugcguacagagaaccuuaucucuucguuacgcauuucaacucucuugaggugaucgagauccaagcccgguccagcgcuggcacccccgccagagccuaccuggauauuccuaauccgcgcuaucugggacccgcuaucucuagcggcgccauuuaccucgcguccucuuaucaggacaagcugcgggucaucugcuguaaggggaaccuugugaaagaaagcggaacagagcaccacagaggcccuuccaccagccgcuccucucccaauaagcgggggccucccacauacaacgaacauauuaccaaaagagucgccagcuccccggcuccucccgagggacccucucacccucgcgagcccagcacaccucaucgguacagagaaggccgcaccgagcugcggagagauaaguccccgggccgcccccucgaacgggagaaaucuccugggagaaugcugagcacgcgcagagaacggucccccggacgccuguuugaggacagcucuagaggccggcucccugccggggcugugagaacaccccuuucccagguuaauaaggugugggaucaaagcucugucuga

SEQ ID NO: 67499 - RNA, 2457 nt, Artificial Sequence
  derived and/or modified sequence opt5 from CIZ1__Homo_sapiens__NP_001124490
auguucagccagcaacagcagcagcaacugcagcagcagcaacagcagcuccagcaacugcagcagcaacagcuucagcagcaacagcugcagcagcaacagcuccugcagcuucagcaacugcuccagcaguccccuccccaggccccgcugcccauggcugugucuagaggccugccuccccaacagccucagcaaccccuccugaaccuucaggggaccaauagcgccucccugcucaacggaucuaugcugcagcgggcgcuucugcuccagcaacugcagggcaaucugcgcggguacggaauggcuagcccuggccucgccgccccgucccugacacccccucagcuugcuacgcccaaccugcagcaauuuuucccucaggccaccagacagucucuccuggggcccccgccugucggaguucccaugaauccuagccaguuuaaccuuuccggccggaauccccaaaagcaggcucgcacaagcagcuccaccacacccaacagaaaagacucuucuucccagaccaugccuguggaggauaagagcgacccgcccgaaggcucugaggaagccgcggagccucggauggauacacccgaagaccaagaucugccucccugcccggaggacaucgccaaagagaagcgcaccccugcucccgaaccugagcccugugaagccuccgagcucccugcuaaaagacugcggagcuccgaggaacccacggagaaggaaccgccugggcagcuccaggugaaggcccagccccaagcgcgcaugaccguccccaaacagacacagaccccugaucugcugccggaggcccuugaagcucaggugcugcccagauuccaaccucggguucuccaggugcaggcccagguccaaucucagacacagccccgcauuccuagcaccgacacacaggugcaacccaagcugcagaaacaggcucaaacgcagaccuccccugagcaccuuguucugcagcagaagcaagugcagccccagcuccagcaagaggccgaaccgcagaaacagguccagccucaagugcauacacaggcccagcccagcgugcaaccucaggagcaucccccggcucaggucucuguucagccucccgaacaaacccacgagcagccucacacccagccccaggugucccugcuggcgcccgaacaaacaccuguggucgugcauguuugcggacucgagaugccgcccgaugccguggaggcuggcgggggaauggaaaagacgcugccugagcccgucggcacccaggugagcauggaagagauccagaaugaaucugccugugggcuugacguuggagagugcgagaacagagcccgggaaaugccuggcguguggggcgcugggggaagccugaaggucacaauucuccaguccucugauagccgcgccuuuuccaccgugccccugacaccugucccgagacccagcgacucuguguccagcaccccugcggcuacgucuacacccuccaaacaagcccugcaguucuuuuguuauaucugcaaggccagcuguuccucucagcaggaguuccaagaucacaugagcgaaccucagcaccagcaacggcuuggcgagauucagcauaugucccaggcuugccuccugucucugcuccccguuccgagagacgugcuggagaccgaagacgaggaaccuccuccccgccggugguguaauaccugccagcuuuacuauaugggggaucugauccaacacagacgcacacaggaccauaaaaucgccaagcagagccuccggcccuuuuguaccgucugcaacagauacuucaaaacaccccgcaaguuuguggagcacguuaaaucccagggacacaaggauaaggcuaaagaacuuaagagccuggagaaagagauugccggccaagacgaagaucauuucaucacgguggacgcggucgggugcuuugagggagaugaagaggaagaggaggacgaugaagacgaggaagagauugaaguggaggaggaacuguguaaacaggugcggucuagagauaucucccgcgaggaauggaagggcagcgagaccuauucuccuaauacagccuacggcguugacuuccucgucccggugaugggguauauuugccggaucugucacaaguucuaccauuccaacagcggagcucagcugucucacugcaagagccugggccauuuugagaaucuccagaaauacaaggccgcuaaaaaccccuccccuaccacaagacccgugagccgccggugugccauuaacgcgagaaaugcccugaccgcucuuuucacgucuuccgggcggccucccagccaaccgaacacccaggacaagacaccuuccaaagucaccgcccgccccucucagccuccccugccuagacggagcacaagacucaagaccuga

SEQ ID NO: 67500 - RNA, 2052 nt, Artificial Sequence
  derived and/or modified sequence opt5 from CKAP2__Homo_sapiens__NP_001091995
augagcacccccgccgugccucaggaccugcaacucccgcccucccagagagcucagucugccuucaaggagcagcggcgccaaaaacugaaggaacaccuucugagacggaaaacacucuuugcguacaagcaggagaacgaaaugcugagcuccucucgcgaucagagagucguuacgagcgaggaccaggugcaagaaggcaccaaagugcuuaagcugaagacaaaaauggcugauaaggagaauaugaaacggccugccgaguccaagaacaauaccgucguggggaaacauugcaucccccucaagccuucuaacgaacugacaaauagcaccguugugauugacacacacaagcccaaagauuccaaccagaccccucaucugcuccugacggaggacgauccgcagagccagcacaugacccuuucucaagccuuccaucugaagaauaacuccaaaaagaaacagaugacaaccgaaaagcagaaacaagacgcuaauaugcccaagaagccuguccucggaagcuaucgcggccagaucgugcagucuaaaauuaacuccuuuagaaagccccugcagguuaaagaugagagcucugccgcuacaaagaaacuuuccgccaccaucccuaaggcgacgaagccccaaccggugaauacaagcuccgucaccgugaaaucuaaccggagcuccaauaugacagccaccaccaaguucgugagcacaacgucucagaacacccagcugguccgcccucccauuagaucccaccacagcaauacacgggacaccguuaaacaggggaucucucgcacaagcgcuaacgugaccaucagaaagggaccucaugagaaagaacuccugcaauccaagacggcccugucuagcgugaagacauccagcucucagggcauuauccggaacaaaacccucucccgcagcauugcuucugaggucaucgccagacccgcgucccugagcaaugauaaacuuauggaaaaguccgagcccguggaccagcggagacacaccgccgggaaggcuauuguugauucucgcagcgcccagccuaaagaaacauccgaggagcggaaggcuagacugucugaauggaaggccggaaaaggccgcgugcucaagcggccgcccaacagcgucgugacccaacaugagccugccggccagaaugaaaaacccguuggguccuuuuggacaacgauggcugaggaagacgagcagagacuguucaccgagaaggugaacaauacauuuagcgaaugucuuaaccugaucaaugagggaugcccuaaagaagacauucucgucacccugaacgaucugaucaagaauauccccgacgcgaaaaagcucgugaaguacuggauuugucuggcccuuaucgagccgauuacaucuccuaucgaaaacauuaucgcuaucuaugagaaagccauucuggccggcgcucagcccaucgaggaaaugcgccacaccauugucgauauccucacgaugaagucccaagagaaagccaaucugggggaaaacauggaaaagagcugcgcgucuaaagaggaggugaaggagguuuccauugaagacaccggaguggaugucgacccugagaaacuugaaauggagagcaagcugcaccggaaucuccuguuccaggauugugagaaggaacaggacaacaaaacaaaggaucccacccaugacgugaaaacaccuaauaccgagacgagaacaucuugccugaucaaguacaacguuagcaccacacccuaucuccaauccgugaagaaaaagguccaguuugauggcaccaacagcgcuuucaaagaacugaaguuucuuaccccggugcgccggucuagacgccugcaggagaaaacauccaagcucccugacaugcugaaggaccacuaccccugugugagcucccuggaacagcuuacggagcucgggcgggagaccgaugccuucguuugcagacccaaugccgcucugugucgggucuauuacgaagccgacacaaccuga

SEQ ID NO: 67501 - RNA, 2238 nt, Artificial Sequence
  derived and/or modified sequence opt5 from CKAP2L__Homo_sapiens__NP_689728
auggugggccccgggccuaccgccgcugccgcggucgaggaaagacagcggaagcugcaagaguaccucgcugccaaaggaaagcugaaaagccagaacacaaagccguaucuuaaauccaagaauaacugccagaaucagcccccuucuaagagcacgauccgccccaaaaacgacguuaccaaucacguggugcugccugucaagcccaaaagauccauuucuaucaagcuccaaccucggccgcccaacacagccggcagccagaaaccuaagcuggaacccccuaaacuucuggggaagcgccucaccuccgagugugugucuagcaaucccuacuccaagccgagcucuaaauccuuccagcagugcgaagcuggaagcucuacaaccggcgagcuguccagaaagccuguugggagccugaacauugagcaacucaaaacaaccaagcagcagcugacggaucagggaaauggcaaauguaucgacuuuaugaacaauauucauguggaaaacgagucucuugauaauuuccugaaggaaaccaacaaggagaaucuccuggacauccuuacagagcccgaacggaaaccugaucccaagcuguauacccgcuccaaacccaagacagacagcuacaaccaaaccaaaaacucccucgucccuaagcaggcccugggcaagucuagcguuaauuccgcugugcugaaagauagagugaacaagcaguuugucggggagacgcaaagccggacauucccggugaaaucucagcagcucucccgcggagccgaccuggcgagacccggcgugaagccuagccggaccguccccucucacuuuauccgcacacuuagcaaaguucaguccucuaagaagccuguggugaaaaauauuaaggauaucaaagucaacagaagccaauaugaacggcccaaugagaccaagauucgcuccuacccggugaccgaacagagaguuaaacauacaaagccucggacguaucccagccugcuccagggggaguacaacaauagacacccuaacaucaagcaggaccaaaaaucuucccaggugugcauuccccagaccagcuguguccugcagaagucuaaagccaucucccaacgcccuaaucuuacagugggacgguucaacagcgcuauucccuccaccccgucuaucagaccuaauggcacaagcgggaacaagcauaauaacaauggauuucagcagaaagcccagacccuggauuccaagcucaaaaaggcuguuccccaaaaccacuuccugaacaagacggcccccaaaacacaggcggacgugaccaccgucaauggcacacagaccaacccuaauaucaagaaaaaggccacagcugaggaucgccggaaacaacuggaagaguggcagaagucuaagggcaaaacguacaagagaccgcccauggaacucaaaaccaagcgcaaagugauuaaggagaugaacaucagcuuuuggaaguccauugaaaaagaggaggaagagaagaaagcccagcuggaacuuagcucuaagaucaauaacacacugaccgagugccucaaucugauugaagggggagucccuuccaacgagauccuuaauauccugagcucuauucccgaggcugaaaaauucgccaaguuuuggaucuguaaggccaaacuccuggcuuccaagggcacauucgacgugauugggcuguaugaggaagcgaucaaaaacggagccaccccuauucaggagcuccggaagguugugcugaauauccuucaagacagcaacagaacgaccgagggcaucacaucugauagccuggucgcugaaaccuccauuacaagcguggaggaacucgccaaaaagauggagucuguuaaauccugccugagccccaaggaacgcgaacaggugaccgccacgccucggaucgcuaaggccgagcagcacaauuaccccgggauuaaacugcagaucggaccgauuccuagaaucaacggcaugcccgagguccaagacaugaaguuuauuacaccugugcgccgguccucuagaaucgagcgggcggugagccgcuaucccgaaaugcuucaggagcaugaucucguugucgcuucccuggacgaacugcucgagguggaggaaaccaaauguuucaucuucagacggaaugaggcccugccggugacacuuggcuuucagaccccugaaucuuga

SEQ ID NO: 67502 - RNA, 1809 nt, Artificial Sequence
  derived and/or modified sequence opt5 from CKAP4__Homo_sapiens__NP_006816
augcccagcgccaagcagagaggcuccaaagggggacacggcgcugccucucccagcgagaagggggcgcauccguccggaggcgcugacgauguggccaaaaagcccccucccgccccucaacagcccccuccgcccccugcuccccacccucagcagcauccccaacagcacccgcagaaccaggcccaugggaaaggaggccaccggggcgggggaggcgggggaggcaagucuagcuccucuagcuccgcuagcgccgcggccgcugccgcugccgcgucuuccagcgccucuugcucccgcagacuggggcgggcucucaauuuccuguuuuaccuugcccuggucgcugccgccgcuuucagcggaugguguguucaccaugugcucgaagaggugcaacagguccgcagaucucaccaggacuuuucccggcagcgcgaagaacugggccaaggccuucaggggguggaacagaagguucaaagccugcaggcgaccuucggaacauuugaguccauccucagaucuagccagcauaaacaggaucugacggagaaggccgugaaacaaggcgaauccgaggucagccggauuucugaagugcugcagaagcuccagaacgagauccugaaagaccuuuccgaugggauucacguugugaaggacgcucgcgagagagauuucaccagccuggaaaauacagucgaggaacggcucaccgagcugacaaagucuaucaacgacaauauugccaucuuuaccgaagugcagaaacgcagccaaaaggagaucaacgauaugaaagccaagguggcuucccuugaggaaucugagggaaauaaacaggaccugaaggcccucaaagaagcggucaaggagauucagacaagcgcuaaguccagagaaugggauauggaggcccugcggagcacccugcagacgauggagucugacaucuauaccgaaguucgcgagcucgugucccugaaacaagaacagcaggccuucaaggaggcugccgauacagaaagacuugcucugcaggcccucaccgagaaacugcuucggagcgaggaaucuguguccagacugccugaggaaauucgccggcucgaggaggaacugagacaacucaagagcgacucccacggccccaaagaggacgggggauuucgccauucugaagcguucgaggcccugcagcaaaagagccagggccuggauucccggcuucagcacgucgaagacggcgugcugucuaugcagguugcuagcgccagacagacagagucccucgagagccugcuuucuaagucccaagaacaugagcagcgccuggcugcccuccaggggcggcuggaaggacugggcagcucugaggcggaucaggacgggcucgccuccaccgugagaagccugggagaaacgcaacuuguccuguacggcgauguggaggagcucaaacgcucuguuggggaacugccuagcacaguggagucccugcagaagguccaggaacaggugcacacccuucucagccaagaccaggcucaggccgcucggcugccuccccaagauuuucuggacagacucucuucccuggauaaccuuaaagccagcgucucccagguggaggccgaccugaagaugcuccgcacagcuguugauucucugguggcguauagcgucaaaaucgaaaccaaugagaacaaucuggaguccgccaagggccuucucgacgaccugcggaacgaucuggacagacucuucgugaagguugagaaaauucaugagaagguguga

SEQ ID NO: 67503 - RNA, 6099 nt, Artificial Sequence
  derived and/or modified sequence opt5 from CKAP5__Homo_sapiens__NP_001008938
augggcgacgauagcgaauggcugaagcuccccguggaccagaaaugcgaacacaagcuguggaaagccagacuuuccggguacgaagaagcucugaagaucuuccagaagauuaaggaugagaagucuccugaauggagcaaauuucucggacugaucaagaaauucgucaccgacuccaaugccguugugcagcuuaagggccuggaggcggcucucguguaugucgagaaugcccauguggccgggaaaacaacgggagaaguugugucuggcgucgugagcaagguuuuuaaccagccgaaggcuaaagccaaggagcuggggauugaaaucugucugauguacauugagaucgagaaaggagaagcugugcaggaggaacuccugaagggccuugauaauaaaaaccccaagaucauugucgccugcaucgagacccugcggaaagcgcucuccgaguucggcucuaagauuauccugcuuaagccuauuaucaaagugcugcccaagcucuuugagagccgcgagaaagccgugagagacgaagcuaagcugauugccgucgagaucuaucgguggauccgcgaugcucugagaccuccccuccaaaauauuaacuccguucagcugaaagaacuugaggaagagugggugaagcugccuacaagcgccccgcggcccacccgcuuccucagaucucagcaggagcuggaagcgaaacuugagcaacagcaguccgccgggggagacgcugaaggcgggggagaugacggcgaugaggugccucagaucgacgccuacgaacugcucgaggcugucgagauucugagcaaacugcccaaggauuuuuaugacaaaaucgaagccaagaaauggcaagagcggaaggaagcccucgagucuguggagguucugauuaagaauccuaaacuugaagcuggggacuacgcggaucuggugaaggcccucaaaaaggucgugggaaaagacacaaacguuaugcugguggcucuugccgccaagugucugaccggccucgcugucggccugcgcaagaaauucgggcaguaugccggacacgugguccccacaauccuggagaaguuuaaagaaaagaaaccgcaagucguucaagcgcuccaggaggcuaucgaugccauuuuccugaccacgacccuucagaauaucuccgaagacgugcuggccgucauggauaacaagaauccuacaauuaaacagcaaaccagccucuuuaucgcuagaucuuuccggcauugcacagccuccacccugcccaagagccugcuuaagccuuuuugugcugcccuccugaaacacauuaacgacuccgcgcccgaggugcgcgaugccgcuuucgaggcccugggcacggcucucaagguugugggggaaaaagccgucaaucccuuccuggcggacguggauaaacuuaaacuggacaagaucaaggagugcucugaaaaaguggagcucauccauggaaagaaagccggccuggcugccgauaagaaagaauuuaagccucugccggggagaacagcugccagcggagccgcuggcgacaaggacaccaaagauauuuccgcgcccaagccuggcccccuuaaaaaggccccugcugccaaagccgggggacccccgaagaagggcaaaccugcugcccccgggggagcgggcaacacagggaccaagaauaaaaagggccucgagaccaaagagaucguugaaccugagcugagcauugaagucugugaggaaaaggcuucugccgugcugcccccuacaugcauccagcuccuggacuccagcaacuggaaagagcggcuugccuguauggaggaguuccagaaggcuguggagcugauggaucgcacggaaaugcccugccaggcccucgucagaaugcuggcgaagaaaccgggauggaaggagaccaacuuucaagugaugcagaugaaacugcacauuguugcucuuaucgcccagaagggcaauuucucuaaaacaagcgcccaggugguccucgacgggcugguggauaagauuggagacguuaaguguggcaacaaugcuaaagaggccaugaccgcuaucgccgaagcgugcaugcugccuuggacagccgagcaaguggucuccauggcuuuuucucagaagaaccccaaaaaucagagcgaaacccucaacuggcuguccaaugccaucaaggaguucggguuuagcggacuuaacgugaaggcuuucauuucuaauguuaagacggcccuggccgcuacaaaccccgcggugcggaccgccgcuaucacccuccugggcgucauguaccuguacguggggccuucccuuagaauguuuuucgaagaugagaagccggcccuccugagccagauugacgccgaguuugagaagaugcaaggccagucucccccugcucccacacgcggaaucuccaagcacagcaccuccggcacagaugagggggaagacggagaugagccugacgauggcucuaaugacguggucgaccugcucccccggacggaaauuagcgauaaaaucaccuccgagcugguuucuaagaucggggacaaaaacuggaagauuagaaaggagggacuugaugaaguggccggcaucauuaaugacgcgaaauucauccagccuaacauuggggagcugcccacagcucucaagggccgccugaaugauagcaacaaaauccuggugcaacagacccuuaacauccugcagcagcucgccgucgccaugggaccgaauauuaagcaacaugugaaaaaccugggcaucccuauuaucacaguucucggggacuccaagaauaacgugcgggcugccgcgcuggcuaccgucaaugccugggccgaacagacgggaaugaaggaguggcuugaaggcgaggaucugagcgaggaacucaaaaaggagaaccccuuucugagacaggaacugcuuggguggcuggcugagaaacucccuacccugcgcucuacacccaccgaccucauucugugcgugccgcaccuuuauuccugucuggaggaucggaauggagacguuagaaagaaagcccaggaugcucucccuuucuucaugaugcaucugggcuacgaaaagauggccaaagcgacagggaagcugaagcccaccagcaaagaccaagugcuugccaugcuggagaaggcuaaagucaacaugccugccaagcccgcucccccuacgaaagccacaucuaagccgaugggcggauccgcccccgcuaaguuucagccugcgagcgcccccgcugaagauugcaucucuagcuccaccgagccuaaacccgacccuaagaaagccaaggccccgggccucagcucuaaagcuaaguccgcccaggggaagaaaaugcccagcaagacaucccugaaagaagacgaggauaagucuggaccuaucuucauugugguucccaauggcaaagagcagcgcaugaaggacgaaaaggggcucaaagugcugaaguggaacuuuaccaccccucgggaugaguauaucgaacaacuuaaaacacagaugagcuccugugucgcgaaguggcugcaggacgagauguuccacucugauuuucaacaccauaauaaagcucuggccgugaugguggaccaccucgaaagcgagaaggagggagucauuggcugccuggaucuuauccugaaauggcucacgcugagauucuuugacaccaacacauccguucucaugaaggcccuggaauaccuuaagcugcuguucacccuccugucugaggaagaguaucaucuuacagaaaaugaggcuagcuccuuuauucccuaccugguggugaaagucggcgagccgaaggaugugauccgcaaagacguucgggccauucucaacagaaugugucugguguauccugcgagcaagauguuccccuuuaucauggaagggaccaaaucuaaaaauuccaagcagcgggccgagugccucgaagaacugggaugucuugucgagagcuacggcaugaacgugugccagcccacgccugggaaagcucugaaggaaaucgccguucacauuggagaucgcgacaacgcugugagaaaugccgcucugaacacaaucgucaccguguacaauguccauggcgaccagguguucaaacucauugggaaccugucugagaaggauauguccaugcuugaagaacggaucaaaagaagcgccaagcgccccucugcggccccuauuaagcaaguugaagagaaaccgcagcgggcucagaauaucuccagcaacgccaauaugcugagaaagggacccgcugaggacauguccagcaaacucaaccaggcccgcucuaugagcggccacccugaagccgcucaaauggugagacgggaguuucagcuggaucucgacgaaaucgagaaugauaacggcaccguccgcugugaaaugcccgagcuggugcagcacaaacuugacgauauuuucgagccuguucugauccccgaaccgaaaauuagagcgguguccccucauuucgacgauaugcacucuaauacagccagcaccaucaacuuuauuaucucccaggucgcuucuggggacaucaauacaagcauucaagcccugacgcagaucgaugaggugcuccggcaggaagacaaggccgaggcuauguccggacauauugaucaguuccugaucgccaccuuuaugcaacuucgccugauuuauaacacacacauggcggacgaaaagcucgagaaagacgagaucauuaagcuguacucuugcaucaucggcaauaugauuagccuguuccagaucgaaucccucgccagagaggcuagcaccggggugcuuaaagaucugaugcacggacugauuacacucaugcuggacucucggaucgaagaucuugaggagggccagcaaguuauucgcuccgucaaccugcucguggugaagguccuggaaaagagcgaccagaccaacauccugucugcccuccuugugcugcugcaggauucccuccuggcuacggccagcucccccaaguuuucugagcuuguuaugaaaugucuguggagaauggugcggcuccugccugacaccaucaauagcauuaaccuggaucgcauccuccuugacauucauaucuucaugaaggucuuucccaaggagaaacugaagcagugcaaauccgaguucccuauuagaacacugaagacccuccugcacacacuuugcaaacugaaggggcccaagauccucgaucaucugaccaugaucgacaauaaaaacgaaagcgagcuggaggcgcaccucugucggaugaugaagcauucuauggaucaaacaggauccaaaagcgacaaggaaaccgagaaaggcgccucuagaauugaugaaaagagcuccaaggcuaaagugaaugacuuucuugccgagaucuucaagaaaauuggcucuaaggaaaacacgaaagaggggcuggcugagcuguaugaauacaagaagaaauauagcgacgccgauaucgagccguuucucaagaacuccucucaguucuuccagagcuacguugaacgcggacugcgggugauugagauggaaagagagggcaaagggcgcaucuccacaagcaccggaauuucuccucagauggaggugaccugcgugcccacacccaccuccacgguuagcuccaucggcaacacaaauggggaagaggugggaccuucugucuaucuugaacggcugaagauccucagacaacgcuguggccuggacaacaccaaacaggaugaccggccgccccugacaagccuccuuuccaagccugcugugcccaccguggccucuagcacagauaugcugcacuccaagcugagccagcucagagagucucgcgagcagcaccaacauuccgaccuggauagcaaucagacccacucuuccggcacggucaccagcucuagcuccacagcgaacauugacgaucuuaaaaagcggcuggaaagaaucaaaucuagccggaaguga

SEQ ID NO: 67504 - RNA, 1146 nt, Artificial Sequence
  derived and/or modified sequence opt5 from CKB__Homo_sapiens__NP_001814
augcccuucagcaacucccacaaugcccugaagcucagauuuccugcugaggacgaguucccggaucugucugcccauaacaaucacauggcgaaagugcuuacccccgaacuguacgcugaacuccgggccaagagcacaccuuccggcuuuacgcuggacgaugucauccagaccgggguugacaaccccggacauccuuauauuaugacagugggcugcguggccggggaugaggaaucuuacgaggucuucaaagaccuuuuugaucccaucauugaggaccgccacggaggcuauaagccuagcgaugaacauaaaaccgaccugaauccggauaaccuccaagggggagacgaucuggaccccaauuacgugcuguccucuagaguucggacaggccgcagcaucagaggcuucugucucccuccccacugcucccgcggggagcggagagcuauugaaaagcuggccguggaggcucuuagcucucuggacggagaucucgccggccgguauuacgcgcugaaguccaugaccgaggccgaacagcagcagcuuaucgacgaucacuuucuguucgacaaaccugucagcccccuccugcuggcuucugggauggcccgcgauuggccggacgcuagaggaaucuggcauaacgauaauaagacauuucucguguggguuaacgaggaagaccaucugcgggugauuuccaugcaaaaaggcgggaauaugaaggaggucuucacccgcuuuuguacgggacuuacccagaucgaaacacuguucaaaagcaaggauuaugaguuuauguggaacccucaccucggcuacauucugaccugccccucuaaucuuggcacagggcugagagccggagugcacaucaagcucccuaaccugggcaaacacgagaaguucuccgaagugcugaaacggcuccgccugcagaagagagggaccggaggcgucgacacggcggccguugggggaguguucgaugugagcaaugcugaccggcuuggcuuuuccgaggucgaacuggugcagaugguuguggacggcgucaaacuccugauugagauggaacaaagacuugagcaggggcaggccaucgaugaccugaugcccgcucagaaguga

SEQ ID NO: 67505 - RNA, 342 nt, Artificial Sequence
  derived and/or modified sequence opt5 from CKLF__Homo_sapiens__NP_001035228
auggacaacgugcagcccaagaucaaacacagaccuuucugcuuuagcgucaagggccauguuaaaaugcugcggcucgcccugaccgugacauccaugacguucuuuauuaucgcucaagccccggagcccuacauugugaucaccggguucgaagucacagugauucuguuuuucauccuucucuauguucugcgccuugauagacugaugaaguggcucuuuuggccucugcuggacaucauuaauucucucgugaccacagucuucaugcugaucgugagcguucuugcgcugauucccgagaccacaacccucacggugggaggcgggcuguuuuga

SEQ ID NO: 67506 - RNA, 1146 nt, Artificial Sequence
  derived and/or modified sequence opt5 from CKM__Homo_sapiens__NP_001815
augcccuucggcaacacccacaauaaguuuaaacugaacuacaagccugaggaagaguauccggaccucagcaaacauaauaaccacauggccaaggugcugacacuugaacuguacaaaaagcucagagauaaggagacgcccuccggguucaccgucgacgauguuauccagacaggaguggacaauccuggccaucccuuuauuaugaccguggggugcgucgcuggagaugaagagucuuaugagguguucaaagaacuguuugacccuaucauuagcgaucggcacggcggguacaagcccacagacaaacauaagaccgaucuuaaccacgagaaucugaaaggaggcgacgaucucgacccuaacuauguucuguccucucgcgugagaacaggccggagcaucaagggguacacccugccgccccacuguucccgcggagaaagacgggccgucgagaagcucucuguggaggcgcugaauagccuuacgggcgaguucaaagggaaguauuacccucugaaauccaugaccgagaaggaacaacagcagcucauugaugaccauuuucuguucgacaaacccguuagcccucuucugcucgcuucuggaauggcccgcgauuggcccgacgccagaggcaucuggcacaacgauaauaaguccuuucuggugugggucaacgaggaagaccaucugcgggugaucagcauggagaaagggggaaauaugaaggagguguuccgcagauuuugcgucggccuccagaagauugaagagaucuucaaaaaggcuggccacccguuuauguggaaccaacaccugggguacguucuuacauguccuucuaaucugggaaccggccuccgcgggggagugcaugugaaacuggcccaccuuuccaagcaucccaaauucgaagagauucugacacggcucagacugcagaagcggggcaccgggggagucgauacggcugccgugggcagcguuuucgacgugucuaacgcggaucgccugggcuccagcgaagucgaacaggugcagcucguuguggacggggucaagcugaugguggagauggaaaagaaacuugagaaaggacaauccaucgaugacaugauuccugcccagaaguga

SEQ ID NO: 67507 - RNA, 777 nt, Artificial Sequence
  derived and/or modified sequence opt5 from CKMT1A__Homo_sapiens__XP_005254555
augcccgugaaggucagaaccggccggagcauccgcgggcugucccucccuccggccugcacaagagcugagcggcgcgaaguugagagagugguggucgacgcccugucuggacuuaaaggcgaucuggcggggcgguacuaucgccucagcgaaaugacggaggcugaacagcaacagcugauugacgaucacuuccuuuuugacaagcccguguccccucugcucaccgccgccggaauggcuagagauuggcccgacgcccggggcaucuggcauaacaaugagaaaucuuuccugauuuggguuaacgaggaagaucacacacgcgugaucagcauggagaaagggggaaauaugaagagagucuuugaacgguucugucgcggccugaaggagguggagagacucauucaggaacggggcugggaguuuauguggaacgaacgccugggguacauccuuaccugcccuuccaaucugggaacaggccucagagcugggguucauaucaagcugccccuucugucuaaagacagccgguucccuaagauucucgagaaccugagacugcagaaacgcggaaccggcgggguggauacagccgcgaccggaggcgucuuugacaucuccaaucucgaucggcugggcaagagcgaaguggagcuugugcaacuggucauugacgggguuaacuaucucaucgauugugagagacgccuggaacggggacaggacauuagaaucccgacgcccgugauucacaccaaacauuga

SEQ ID NO: 67508 - RNA, 1347 nt, Artificial Sequence
  derived and/or modified sequence opt5 from CKMT1B__Homo_sapiens__XP_011519498
auggccggccccuucagcagacugcucuccgcucggccugggcugcgccuucuggcccucgcgggagcuggcucucuggccgccggguuucuucugagaccggagcccgugcgggcugccagcgaacgcagacggcucuacccucccucccagaccuggccuacaggacaacugcccggcaacugcacgcgcucuagacggcuguguccuccgagcauggucaccggguauccccucccuuccgcugaguaccccgaccugcgcaagcacaauaacugcauggccucucaucuuacacccgcgguuuaugccagacugugugauaaaaccacacccaccggauggacacucgaccagugcauccagaccggcguggauaauccgggccacccuuucauuaagacgguggggauggucgcuggagacgaagagaccuacgaaguguuugccgaucuguucgaccccguuauccaggagcggcauaacggcuaugauccucgcacaaugaaacacaccacagaccuugaugcuagcaagauuagauccggguacuuugacgagcgguaugugcugagcucucgcgucagaaccggacgguccaucagaggccucagccugccucccgccuguacgcgcgcggaacggagagagguggaacgcguuguggucgaugcccugucugggcucaaaggagaccuggcuggccgguacuacagacuuuccgagaugacagaggccgaacaacagcagcugauugaugaccauuuccucuuugacaagccugugagcccgcugcuuaccgcugccggcauggcccgcgauuggcccgacgcucgggggaucuggcacaauaacgagaagucuuuccugaucugggugaaugaagaggaucacacaagagucauuuccauggaaaaaggaggcaacaugaagcgcguuuuugagcgguucugcagagggcucaaagagguggaacgccugauccaggagcggggaugggaauuuauguggaaugagagacugggcuauauucucaccuguccuagcaaccuggggaccggacuucgggcgggcgugcauaucaagcugccccuccuguccaaagacucucgcuucccuaagauucuugaaaaucugagacuccaaaagcggggcacagggggagucgauacggccgcuaccggcgggguguuugacaucagcaaccuggauagacugggaaaauccgagguugagcucgugcagcuggucauugacggcgugaauuaccuuaucgauugcgaacgccggcuggagagagggcaggacauccgcauucccacaccgguuauccacaccaagcauuga

SEQ ID NO: 67509 - RNA, 1260 nt, Artificial Sequence
  derived and/or modified sequence opt5 from CKMT2__Homo_sapiens__NP_001093206
auggccagcaucuucuccaagcugcucaccggcagaaacgcuucucugcuuuuugccacaauggggacgagcgugcugaccacaggauaccuccugaaucggcagaaagucugcgcggagguucgcgaacaacccagacuuuucccuccguccgcugacuaucccgaucugcggaagcacaacaauuguauggccgagugccucaccccugccauuuacgcuaaacugcgcaacaaggugacacccaauggcuauacccuggaccaguguauccagacagggguggauaacccuggacaucccuuuauuaaaaccgucggcaugguggccggggacgaagagucuuacgaaguuuucgcugaucucuuugacccugugaucaagcugagacacaauggauaugauccgcgggucaugaagcauacgaccgaccuugaugccagcaaaauuacacagggccaauucgacgagcacuacgugcuguccucucgcguuagaaccggccggagcauccgcgggcucucccugcccccugcgugcacaagagccgagcggcgcgaaguggagaacgucgcuaucaccgcccuugaaggacugaagggcgaucucgcugggagauauuacaaacugagcgagaugacggagcaggaccagcagcggcugauugaugaccauuuucucuucgacaagcccgugucuccucugcuuacaugugccggaauggcgcgcgauuggcccgacgccagaggcaucuggcacaauuacgauaaaaccuuucugauuuggaucaacgaagaggaccacacacgggugauuuccauggaaaaagggggaaauaugaagagagucuucgagcgcuuuugccggggccucaaggaaguugagagacugauccaagagcgcggcugggaguucauguggaacgaacggcuuggguauauucugaccuguccgagcaaucucggaaccggccugagagcuggggugcaugugcgcaucccuaagcugucuaaagauccccgguuuuccaagauccucgaaaaccugagacuucagaaacgcggaacaggcggggucgacacggccgcuguggccgauguuuacgacauuagcaauaucgaucggauuggaagaucugagguggaacugguccagaucgugauugacggcguuaacuaucucguggauugcgagaagaaacuggagcgcggccaggacaucaaggucccuccuccccuuccccaauucgggaagaaauga

SEQ ID NO: 67510 - RNA, 240 nt, Artificial Sequence
  derived and/or modified sequence opt5 from CKS1B__Homo_sapiens__NP_001817
augagccacaagcagaucuacuauuccgacaaauacgaugacgaggaguucgaauauagacaugugaugcugcccaaggauauugccaaacucgucccuaagacccaccugaugucugaaagcgaguggcggaaccuuggcguucaacagucccaggggugggugcauuacaugauccacgaaccggagccccauauucugcucuuucgcagaccucugcccaaaaagccuaagaaauga

SEQ ID NO: 67511 - RNA, 240 nt, Artificial Sequence
  derived and/or modified sequence opt5 from CKS2__Homo_sapiens__NP_001818
auggcccacaagcagaucuacuauagcgacaaauacuucgaugagcauuaugaauacagacacgugaugcugccccgggagcucuccaagcaagucccuaaaacccaucugaugucugaagaggaauggcgcagacuuggcguucagcagagccuggggugggugcacuauaugauucaugagccggagccccacauccuccuguuucggcgcccucuucccaaggaccagcaaaaauga

SEQ ID NO: 67512 - RNA, 4440 nt, Artificial Sequence
  derived and/or modified sequence opt5 from CLASP1__Homo_sapiens__NP_001135745
auggagcccagaauggaaagcugccuggcccaggugcuccaaaaggacgucggcaaacggcugcagguugggcaggagcuuaucgauuacuucuccgacaagcagaaaucugcugaucuggaacacgaccaaaccaugcucgauaagcugguggacggacuugccacaagcugggugaacuccucuaauuauaaagucgugcugcucggcauggauauucugagcgcgcugguuacgcgccuccaggacagauuuaaggcucagaucgggaccgugcugccuucccuuauugaucggcugggagacgccaaggauucuguccgcgagcaggaccaaacacuccugcuuaaaaucauggaucaggccgcuaacccgcaguacgugugggacagaaugcugggcggguucaagcauaaaaauuuucggacccgcgaaggaauuugucucugccugaucgccacacugaacgcuagcggcgcccagacccucacacuguccaagaucguuccccacauuuguaaucuucugggcgacccuaacagccaagugagagaugcggccaucaauucucucgucgagauuuaucggcaugugggggagcgcgugagagcugaccuguccaaaaagggacuuccccagagccggcugaacgucaucuucaccaaguuugaugaaguucagaaaucuggcaauaugauucaauccgccaacgacaagaauuucgaugacgaggauagcguggacgggaaccgcccuucuuccgcuagcuccacgucuagcaaagcgcccccuuccagcagacggaaugugggaaugggcaccacacgcagacucgggucuuccacccugggaagcaagucuagcgccgccaaagaaggcgcuggcgccgucgaugaggaggacuuuaucaaggcuuucgaugacgugccgguugugcagauuuacuccucucgggaccuggaagagagcaucaacaaaaucagagaaauucucuccgaugacaagcacgauugggagcagcgcgucaaugcccugaagaaaauccggagccuucugcucgccggggcugcggaauaugacaacuuuuuccagcaucugagacuucuggauggagccuuuaagcucucugcuaaagaccugcgcucccaagugguucgggaggccugcauuacacugggccaccucagcucugugcuggggaacaaguucgaucacggagccgaggcuaucaugcccaccauuuuuaaucuuaucccuaacuccgccaaaaucauggcgacgagcggcgucguggcugucagacugauuauccgccauacacacauuccccggcucaucccugugauuaccuccaauuguacaucuaagagcguugccgugagacgccggugcuucgaguuccuggaccugcuucuccaggaauggcagacccauucccuggaaagacacaucucuguccuggccgagaccaucaagaaagggauucacgaugcugacagcgaagcccgcaucgaggcucggaaguguuacuggggauuucauucccacuucagcagagaggccgaacaucucuaucacacacuggagucuuccuaccagaaagcgcuucaaagccaucugaagaacucugauuccauugugagccucccccagucugaccggagcuccagcagcucccaggaaagccugaaucgcccgcuguccgccaaaagaucuccuacgggcagcaccacaucccgggcuucuaccguuagcacaaaguccgugucuaccacgggcagccuucagagaucccgcagcgauaucgacgucaacgccgcugccucugcgaaguccaaagugucuucuuccagcgggacaacccccuuuucuuccgccgcugcccucccucccggaagcuacgcuucccuggacggcaccacaaccaaggccgaggggcggauuagaacacgcagacaaagcucuggaagcgccacgaauguggcuuccacccccgauaaccggggccgcucuagagcgaaaguugucagccagucccagcggucucgcagcgccaauccugcuggggccggcuccagaucuagcuccccgggaaagcugcucggcagcggguauggaggccugacagggggaucuucccgggggcccccugugacccccagcucugaaaaacgcuccaagaucccuagaagccagggcugcucccgggagacaucucccaaccgcauuggccuugacagauucggacugggccaaccggggcggaucccuggaagcgugaaugccaugagaguccucuccaccagcacggaucuggaggcugccguggcggacgcucugcuucucggcgauucucgcuccaagaaaaagcccguucggagacgcuacgaaccuuaugggauguacagcgacgaugacgccaacucugaugccagcuccguguguucugagcggagcuauggauccagaaauggcgggaucccccacuaccugcgccagaccgaagacgucgcugaggugcugaaccacugcgccucuagcaauugguccgagcggaaagaaggccuccugggacuucagaaccugcucaagagccaaagaacacugucucgcguugagcugaaacggcuuugugaaauuuuuaccagaauguucgcggauccucauuccaagcggguguuuagcauguuccucgagacacuggucgacuuuaucauuauccacaaagaugaccugcaggacuggcuguucgugcuccuuacccagcugcucaagaagaugggcgcugaucugcugggguccguucaggccaaagugcaaaaggcccuugacgucacgcgcgauucuuuucccuucgaccagcaguuuaacauucugaugagauucaucguggaucagacacaaaccccgaaucucaaagugaaggucgcuauccugaaauauauugaaagccucgcccggcagauggacccuacagauuucguuaacuccucugagacccgccuggcugugagcagaaucauuaccuggacaacggagcccaaguccagcgacgugcggaaggccgcgcagaucguccuuauuucucuguuugaacucaauacccccgaguucacaaugcugcugggagcccuuccuaaaaccuuucaggauggcgcuacaaagcugcuccauaaccaccugaaaaauuccagcaacaccucugugggguccccgagcaauacgaucggaagaacacccucucgccacaccagcucccggaccucuccucucacaagccccaccaacugcucccauggcgggcugagcccuuccaugcuugacuacgauacagaaaaucugaacucugaggaaaucuacagcucccucagaggcguuacggaggccauugagaaguucucuuuucgcagccaagaagaccugaaugagcccaucaaacgggacggaaagaaggaaugcgauauuguguccagagacggcggggcugccucuccugccaccgagggacgcggcgggagcgaagucgagggaggccggacagcucuggauaacaaaaccucccuucugaauacacagcccccgagagcguucccuggcccccgcgccagagacuauaacccuuaccccuauagcgaugcuaucaauaccuacgacaagacggcccucaaagaggccguguuugaugacgauauggaacagcugcgggacguuccgauugaucacucugaccucguggcugaucugcuuaaggagcuguccaaccauaacgaacgcgucgaggagagaaaaggggcccugcucgaacugcuuaagaucacccgggaggacagccugggagugugggaggaacacuucaagacaauccuccugcuccugcuugaaacccugggcgacaaagaucauucuauucgcgcgcuggcucucagaguucugcgggagauccuuagaaaucaaccugcccgcuuuaagaacuaugccgagcugacaauuaugaaaacccucgaagcucacaaggacucccacaaagaggugguccgggccgcggaagaggcugccagcacacuggccucuuccauccaucccgaacaguguauuaaggugcucugcccuaucauucagaccgcugauuaccccaucaaucuggccgcuaucaaaaugcagacgaagguggucgagagaauugccaaggagagccuucugcaacugcucguugacaucauucccgggcugcuucagggauaugauaacacagaauccagcgugcgcaaagcgucuguguucugucuggucgccaucuacagcgugauuggcgaggaccucaagccucaccuggcucagcucaccggguccaaaaugaagcugcuuaaucuguacaucaaacgggcccagaccacaaacucuaauagcuccucuagcuccgauguuucuacccauagcuga

SEQ ID NO: 67513 - RNA, 3885 nt, Artificial Sequence
  derived and/or modified sequence opt5 from CLASP2__Homo_sapiens__NP_001193973
auggccaugggcgacgauaagagcuucgacgaugaggaauccguggacgggaacagacccucuagcgcugccuccgcguuuaaagucccugcuccgaagaccucuggaaaucccgccaacagcgcccggaaaccuggcuccgcugggggacccaagguuggcggggccucuaaagagggaggcgcuggcgccguggaugaagacgauuucaucaaggcguuuacagacgugccuagcauucagaucuacuccagccgcgagcuggaagagacgcucaauaagauuagagagauccugucugaugacaaacacgauugggaccaacgggccaacgcucuuaagaaaauucgcucccugcucgucgccggggcugcccaguaugauugcuucuuucagcaucugagacuucuggacggagcgcucaagcugagcgccaaagaccugcggucucaggugguucgcgaagcguguaucaccguggcccaccucuccacaguccugggcaauaaguucgaucauggggcugaggccaucgugcccacccuuuuuaaccugguuccuaauagcgccaaggugauggcuacaucuggaugcgcggccauuagauucaucauucggcacacccaugucccgcgccucaucccccugauuacauccaacuguaccagcaaauccgugccugugagacggcgcucuuuugaguuccuugaccugcuccugcaagaauggcagacgcacagccuggagagacacgcugccguccucguugaaaccaucaagaaaggcauucaugaugccgacgcugaggcccggguggaagcgcgcaagacauacauggggcugagaaaucacuuucccggagaggcugaaacccuuuauaacucccuggagccuagcuaccagaaaucucuccagacauaucugaaguccagcggcucuguggccagccuuccccaauccgaucggucuagcuccagcucucaggagucccugaauagaccguucagcucuaaaugguccaccgccaacccuagcacggucgcuggccgcguguccgccgggucuagcaaggcuuccucucuccccggaagccugcagcgguccagaagcgacaucgauguuaaugccgcggccggcgcuaaggcccaucacgcugccgggcagucugugcgcuccggacggcugggcgcgggggcccucaacgcuggaagcuacgccucucuggaagacacauccgauaaacuugacggcaccgcuagcgaggauggcagaguccgcgccaagcugucugccccucucgcugggaugggaaaugcgaaagccgacagccggggcagaucccgcacaaagauggugagccaaucucagcccgggucccggagcggaucccccggcagaguucugaccaccacagcucuuucuacggugagcuccgggguccagcgcgugcuggucaacucugccagcgcccaaaaacgguccaagaucccuagaucucagggcugcagccgggaggcuuccccgagccgccucucuguggccagauccagccggauucccagaccuucuguuucccagggauguagccgcgaagcgucucgggaauccagcagagacaccucccccgugcgcagcuuucagccucuggcuucuagacaccauagccgguccacaggcgcccuguaugcccccgaggucuacggggcuucuggaccgggcuacgggaucagccaauccucucgccucagcuccucugugagcgccaugagaguucugaacaccggauccgauguggaggaagcggucgcugacgcccuuaagaaaccugcccggcgcagauaugagagcuacggcaugcacucugaugacgaugcuaauuccgacgccagcucugcuugcuccgaacggagcuauuccucucgcaacgggagcauucccacauacaugagacagaccgaggauguggccgaagugcugaaucggugugcguccagcaacuggucugagcgcaaggagggccuccugggacugcagaaucuucucaaaaaccagagaacgcugucccggguugaacugaagagacucugcgagaucuucacacgcauguucgccgacccucauggcaaacgggucuuuagcauguuccuggaaacccuuguggauuuuauucaagugcacaaggacgaucugcaggacuggcuuuucguccugcugacccagcuucucaagaaaaugggggcugaucugcugggaucugugcaggccaagguucaaaaagcucucgacgugacaagagagagcuuucccaaugaccugcaguucaacauccuuaugcgcuuuaccgucgaucagacacagacgccuucccugaaggugaaaguugccauccucaaguauauugagacccuggccaagcaaauggaccccggcgauuucaucaauucuagcgaaacacggcuggcuguguccagagucauuaccuggacaaccgagccgaaaucuagcgacgugcgcaaggcggcccaguccguucuuaucagccucuuugaacugaacacgccugaguucaccaugcugcucggggcucugcccaaaacauuucaggauggagccaccaagcuccugcauaaucaccuccggaacacaggcaaugggacccaaucuuccaugggcagcccccugacgagaccuacaccgcgcucccccgccaacuggucuagcccucugaccucccccacaaauaccucucagaacacccuuagcccuuccgcuuucgacuacgauacagaaaacaugaauagcgaggacauuuauucuucccuccggggagugacggaggccauccagaacuuuagcuucagaucucaggaagauaugaaugagccccugaaacgggacuccaagaaagaugacggcgauagcaugugugggggaccuggcaugucugacccccgcgcugggggagacgcuaccgauagcucccaaacagcccuggacaacaaggccucucuccugcacagcaugccgacccauuccagcccuagaucccgggauuacaaucccuacaacuauucugacagcaucuccccuuucaauaagucugcucuuaaagaagccauguuugaugacgaugcggaccaguuccccgaugaccugagccucgaucacuccgaccuggucgcugagcugcuuaaggaacugucuaaccauaaugagcgcguggaggaaagaaaaauugcccucuacgagcugaugaagcucacacaggaagagagcuuuuccgugugggacgaacacuucaaaaccauccugcuucugcuccuggagacgcugggcgauaaggagccgacaauucgggcccuugcucugaagguccucagagaaauccugcgccaccagccugcccgguuuaaaaacuaugcugagcucaccguuaugaagacccuggaagcccauaaagacccccacaaggagguggugagaagcgcggaggaagccgcuucuguccuugccacauccauuagcccugagcaaugcaucaaagugcugugucccauuauccagaccgcugauuaccccaucaaucucgccgccauuaagaugcagacaaagguuaucgaacgcgugucuaaagagacgcugaaccugcuucugccugaaauuaugccggggcucauccagggcuaugacaauuccgagagcucuguccggaaggcuugcguguucugccugguugcggugcaugccgucauuggagaugagcucaaaccccaccugucccaacuuaccggcagcaagaugaaacugcugaaccucuacaucaagagagcucagacaggguccggaggcgccgacccuaccacagaugugagcgggcagucuuga

SEQ ID NO: 67514 - RNA, 1851 nt, Artificial Sequence
  derived and/or modified sequence opt5 from CLCA2__Homo_sapiens__XP_011540750
augacccagagaagcaucgccggccccauuugcaaccugaaguucgugacacuccuggucgcucuuuccucugagcugccuuuucucggggccggaguucaacugcaggacaauggcuacaacgggcuucugaucgcgauuaauccccaggugccggaaaaccagaaucucaucagcaacauuaaagagaugaucacggaggcuuccuucuaucuguuuaaugccaccaagcggcgcguguucuuuagaaacaucaaaauucugaucccugccacauggaaggcuaauaacaauucuaaaauuaagcaagaaagcuacgaaaaggccaacgucaucgugaccgauugguauggagcucacggcgacgaucccuacacacuccaguaucggggguguggaaaagagggcaaguacauucauuucaccccuaauuuucugcuuaacgacaaucugacagccggcuaugggucccgcggaagaguuuucgugcacgagugggcgcaucuccgguggggcgucuuugaugaauacaacaacgacaaacccuucuacaucaaugggcagaaccagauuaaggugacccgcugcucuagcgauaucacgggaaucuuuguuugugagaaaggcccuugcccgcaagaaaauuguauuaucuccaagcuguucaaggaggggugcaccuuuauuuauaacagcacacagaaugccaccgcuucuaucauguucaugcagucccuuagcucuguggucgaguucuguaacgccuccacacacaaucaggaagcucccaaccugcaaaaucagaugugcagccucagaucugccugggacgugauuaccgauuccgcggacuuucaucacagcuucccuaugaacggaacggagcugcccccucccccgacauuuucccuggugcaggccggcgauaaagucguuugucucgugcuggacgugucuagcaagauggcugaagccgaucggcuucugcaacuccagcaggcugccgaguucuaccugaugcagaucgucgaaauccacaccuuugugggcauugccuccuucgacagcaaaggggagauccgcgcucaacuucaucagauuaauucuaacgacgauagaaagcugcucguuuccuaucugccuacaaccgugagcgcgaaaaccgacaucucuauuugcagcggacugaagaaaggcuuugaggucguggaaaagcucaaugggaaggccuacggauccguuaugauccuggugacaucuggcgaugacaaacuucuggggaacugucuccccacgguccugagcuccggaagcaccauccacucuauugcucuuggcuccagcgccgccccuaaucuggaggaacucucucggcugacaggcgggcugaaguucuuugugcccgauaucuccaacagcaacuccaugauugacgcuuucucucgcaucagcuccggaaccggcgauauuuuucagcagcauauccaacucgagucuacaggggaaaaugucaaaccccaccaccagcugaagaacaccgugacgguugacaauacagugggaaacgauaccauguuccuugucaccuggcaggccagcggcccuccggagauuauccuguuugaccccgaugggagaaaauauuacacaaauaacuucaucaccaaucucacauuccggacggcgucccuguggauuccuggcaccgcuaagcugcgcagauuugccuucauccccgacggacggcuuaaccucagcgugguugacuuugauacacuggcccuguuccucuuucugauuuauugccuuggccauaaggugaaagggaauaacaaggucuacuuccacuga

SEQ ID NO: 67515 - RNA, 2607 nt, Artificial Sequence
  derived and/or modified sequence opt5 from CLCA4__Homo_sapiens__XP_011539317
auggaggacauggugaccacagccagcacguaccuguucgaagcuaccgagaagagauuuuucuuuaaaaacgucuccauccucauucccgaaaauuggaaggagaacccucaguauaaacggccgaagcacgaaaaucauaaacacgccgauguuaucguggcgcccccuacacugcccggccgcgacgagccuuacaccaagcaauucacagagugcggggaaaagggagaguauauucauuuuacccccgaucuucugcucggcaaaaagcagaacgaauacgggccuccgggaaaacuguucgugcacgagugggcucaucuuagauggggcgucuuugacgaguauaaugaagaucagcccuucuaccgggccaagucuaaaaagaucgaggccacacgcuguagcgcugggauuuccggaagaaaccggguguauaagugccagggcggcucuugucugagccgcgccugcagaaucgacuccaccacgaaacucuacgggaaggauugucaauuuuucccugacaaaguucagaccgaaaaggcuucuaucauguuuaugcagagcauugauuccguggucgaguucugcaaugagaaaacacacaaccaggaagcccccagccugcaaaauaucaaguguaacuuucggucuaccugggaggugauuuccaauagcgaagacuucaaaaacacaaucccuaugguuacgcccccgccucccccuguguucucucugcucaagauuucccagcgcaucgucugccuggugcuugauaagagcggaucuaugggcgggaaagacagacugaaucggaugaaccaggcggccaagcacuuucuccugcagaccguggagaauggauccugggucggcaugguucauuucgauagcacagcuaccauugugaacaaacuuauccaaaucaaguccucugacgaacgcaacacacugauggccgggcuccccaccuacccccugggaggcaccagcauuuguuccggcaucaaauaugcuuuucaggugauuggggagcugcacagccagcucgacggaucugaaguccugcuucugacagauggcgaggacaauacggccuccagcugcaucgaugaggugaagcaaucuggggcgauuguucauuucaucgcccucggcagagcugccgacgaagcugugaucgagaugagcaagauuaccggagggucccacuuuuacgucucugaugaagcccagaacaauggacugaucgacgccuucggcgcucuuacaagcggcaacaccgaucugucccagaaaagccuccagcuggagucuaaggggcugacacucaauuccaacgcguggaugaaugacaccgugauuaucgauagcacgguuggaaaagacacauuuuuccugauuaccuggaacucucuuccuccguccaucagccugugggaucccuccggcaccaucauggaaaauuuuacaguggacgccaccucuaagauggcuuaucucagcauuccugggacagccaaagucggaacgugggccuacaaccugcaagcuaaggccaaucccgagacccuuacaaucaccgugacaucccgggcggcuaacucuagcgucccucccauuaccgugaaugccaagaugaacaaagacguuaauuccuucccgagcccuaugaucguguaugccgagauucugcagggcuacguccccgugcucggggcuaacguuacggccuuuaucgaaucucagaacggccacaccgaggugcuggaacugcucgauaauggagcuggcgccgacuccuucaagaacgauggggucuauagccgcuacuuuacagcguacaccgagaauggaagauauucucugaaagugcgggcccauggcggggcuaacacagccagacuuaagcugcgcccuccccucaaucgggcugccuacauuccuggaugggugguuaacggcgagaucgaagcgaaucccccgagaccugagaucgacgaagauacccagacgacacuggaggacuucucccgcaccgccagcgggggcgcuuucgucgugucucaagugcccagccugccccuuccugaucaguauccgcccucccagauuacagaccucgaugccaccguccacgaagacaaaaucauucugaccuggacagcuccuggagauaacuuugacgugggcaagguucagcgguacaucauuagaaucagcgccucuauccuggaucuccgcgacuccuucgacgaugcccugcaagugaauacgaccgaccuuagccccaaggaggcuaacuccaaagagucuuuugcguucaagccugaaaauauuagcgaggaaaacgccacacauaucuuuauugcuaucaaauccauugauaagucuaaucugaccagcaaagucuccaacaucgcccaggugacacucuucaucccccaggccaauccugacgauauugaccccaccccgacgccuacacccaccccuacccccgauaagucucacaacagcgggguuaacaucuccacacuggugcugagcgucauuggaucugugguuaucgugaauuuuauucuuuccaccacaaucuga

SEQ ID NO: 67516 - RNA, 648 nt, Artificial Sequence
  derived and/or modified sequence opt5 from CLCF1__Homo_sapiens__NP_001159684
augcuggccugccucuguaccgugcuguggcaccuucccgcugucccugcccugaacagaacaggcgacccggggcccggaccuagcauccagaagacguacgaucucacccgguaucuggagcaucaacuucgcucccuggcgggcacauaccucaauuaucuggggcccccuuucaacgaacccgacuuuaauccuccgagacugggagcugagacccucccccgggccacaguugaucuggaaguguggcgcucucuuaacgacaaacugagacucacccagaauuacgaggccuauagccaucugcuuugcuaccugcggggccucaaccgccaggcugccacagcugaacugagacggucccuggcccacuucuguaccucucuccaggggcugcuuggaagcauugcgggcgugauggccgcucugggcuauccucucccccaaccucugcccgggacggagccgaccuggacaccuggacccgcccacuccgauuuucuucagaagauggacgauuucuggcugcucaaagagcugcagaccuggcuguggcgcucugcuaaggacuuuaauagacucaaaaagaagaugcagccucccgccgcggccgucacacugcaucuuggcgcucacggguucuga

SEQ ID NO: 67517 - RNA, 429 nt, Artificial Sequence
  derived and/or modified sequence opt5 from CLC__Homo_sapiens__NP_001819
augagccugcuccccgugccuuacaccgaggccgcuucccugucuacaggcagcacggucaccaucaaggggagaccgcuugccugcuuccugaacgaacccuaucuccagguugacuuucacacagagaugaaagaagaguccgauauuguguuccauuuucaaguguguuucggacggcgcgucgugaugaacucuagagaauacggcgcguggaagcagcagguugagagcaaaaauaugccuuuucaggacgggcaagaguucgaacuguccaucucugugcuucccgauaaguaucaggucauggugaauggacagagcuccuacaccuuugaccaccggauuaaaccugaggcuguuaagauggugcaggucuggcgcgauaucagccugacaaaguucaacgugucuuaucucaaaagauga

SEQ ID NO: 67518 - RNA, 2967 nt, Artificial Sequence
  derived and/or modified sequence opt5 from CLCN1__Homo_sapiens__NP_000074
auggagcagagcagaucccaacagcggggcggggaacagucuugguggggaagcgacccccaguaccaauauaugccuuucgagcacugcaccuccuacggccugccgucugaaaacgggggacuccagcaucgccugagaaaggaugccggcccccggcacaaugugcauccuacacagaucuaugggcaccauaaagagcaguuuagcgaccgcgaacaagauauuggaaugcccaagaaaacgggcuccucuagcaccgucgacuccaaggaugaggaccacuacagcaaaugucaggauugcauccacagacuuggccagguugugcggcgcaagcugggggaggacuggauuuuccucgugcugcuuggacugcucauggcucuggucucuugguccauggauuaugugagcgccaagucucugcaggcguacaaaugguccuaugcucaaaugcagccuagccucccccugcaguuucuuguuugggugacauucccucugguccucauccuguuuucugcccuuuucugucaucugauuuccccgcaagccgugggcagcgggauccccgaaaugaagaccauccucagaggaguugugcugaaagaguaccugacaaugaaggcuuuugucgccaaagugguggcucucaccgccggccugggguccggcauuccugucggaaaggaaggccccuucguucacaucgcgucuauuugcgccgcugugcuuagcaaguuuauguccguguucuguggggucuacgagcagccuuauuacuauagcgacauccugacagugggaugcgccguuggcgugggguguugcuuuggaacaccccucggcgggguccuguucucuauugaggugacguccaccuacuuugcuguucggaacuauuggcgcggauucuucgccgcgacauuuagcgccuucguguuuagaguccuugcuguguggaauaaagaugccgucaccaucacagcucuguuccggaccaacuuucgcauggacuucccguuugaucucaaggaacugccugccuucgccgcuauuggcaucuguugcggccugcucggggcgguguuuguuuaccugcauagacaggugaugcuuggaguccggaaacacaaggcccugucucaguuccucgcuaaacaccgccugcuuuaucccggcaucgugacguuuguuauugccagcuucacauuuccucccgggaugggacaauucauggccggcgagcugaugcccagagaagcuaucuccacccucuucgacaauaacacaugggugaagcaugccggggacccugagucucugggccagagcgcggucuggauucacccgcgggugaaugugguuaucauuaucuuucuguucuuugucaugaaauucuggauguccaucguggcuaccaccaugcccauuccuuguggaggcuuuaugcccguguucguccucggggccgccuuuggaagacuggugggcgaaaucauggcuaugcuuuucccugaugggauucuguuugacgauaucauuuacaagauccuccccggaggcuacgccguuaucggggcugccgcgcugacaggcgccgugagccauacggucucuaccgcugugauuugcuucgagcugacaggacagaucgcccacauucuuccgaugaugguugcugugauccucgccaacauggucgcgcagucccugcaaccuagccuguaugacucuauuauccaggugaagaaacuccccuaccugccugaucuuggcuggaaucagcuguccaaguauaccauuuuuguugaggacaucauggugcgcgaugucaaauucgugagcgccuccuacacauauggggaacuccggacccugcugcagacgacaaccgugaagacccuuccccucgucgacucuaaagauagcaugauccugcugggauccguugagagaucugaacuccaagcucugcuucagcgccaucugugcccugagcggagacuccgcgccgcucaggaaauggcccggaagcugagcgagcugcccuacgacggcaaggccagacuugcuggggagggacucccgggcgcgccucccgggcgccccgaauccuuugccuucguggaugaggacgaagacgaggaucugagcggcaaaucugaacugccuccgucccucgcucugcaccccagcacaaccgccccucuuucucccgaggagccuaacggaccccugccuggccacaagcagcaacccgaagccccggagccugcugggcagcggcccuccauuuuccagagccuccugcauugucugcuuggcagagcccgcccuaccaaaaagaaaacgacccaagacucuacagaucucguggacaauaugagccccgaagagaucgaggcgugggaacaggagcagcugucccagccggucugcuuugauagcuguugcauugaccaaucuccuuuccagcugguggaacagaccacacuccacaagacccauacgcuguuuucccuucugggacuccaccuggcuuauguuaccagcauggggaagcugcggggagugcuugcccuggaggaacuccagaaagccaucgagggccacacaaaguccgggguccaacugagacccccucucgcuucuuuccggaacaccacaagcacccgcaaauccacgggcgccccucccucuagcgcggagaauuggaaccugcccgaagauagaccgggagcuacaggcaccggggacgugauugccgccucccccgagacaccuguucccucuccuagccccgaaccuccgcuuucccuggcucccggaaagguggagggcgaacucgaggagcuggaacuggucgagagcccugggcuugaagaggaacuggccgauauccuccagggacccucucugcgguccaccgacgaggaggaugaagacgagcucauccuguga

SEQ ID NO: 67519 - RNA, 2646 nt, Artificial Sequence
  derived and/or modified sequence opt5 from CLCN2__Homo_sapiens__NP_001164558
auggccgcugccgcggcugaggaaggcauggagcccagagcccugcaguacgaacaaacccucauguaugggcgguacacacaggaccugggagccuucgcuaaggaggaagccgcucgcaucagacuuggcgggccugagccguggaaaggacccccuagcucccgggccgcgcccgagcugcucgaauauggccgcucuagaugcgcccggugucgcgugugcagcgucagaugucacaaguuucugguuucccgggugggggaggauuggauuuuccuugugcugcucggacugcugauggcucucgucucuugggugauggacuacgccaucgcugccugccugcaggcgcagcaauggaugagccgcggccuuaacacguccauucugcuccaguaucuggccuggguuaccuacccugugguccuuaucacauuuucugcuggcuucacccagauucuggcuccccaggccguggggagcggaaucccugaaaugaaaacaauccucagaggcguugugcugaaggaguaucugacccucaaaacauuuauugccaaggucaucgggcugaccugugcccuuggauccggcaugccgcuggggaaggagggacccuucgugcauauugcuagcaugugcgcggcccuccugucuaaauuucuuucccuguucggcggcaucuacgaaaaugagagccggaacacggaaaugcucgcugccgccugugcugugggggucggaugcuguuuugccgcgccuauuggcgggguucuguucucuaucgaggugaccuccacauuuuucgcugugcgcaauuacuggagaggauuuuucgccgccaccuucagcgcuuuuauuuuccggguccuggccguguggaaccgcgaugaagagacaaucaccgcucucuuuaagacgagauuccggcuggacuuucccuucgaucuucaagagcugccugccuuugcgguuaucggcauugccucuggguucggaggcgcucucuuuguguaucugaauagaaaaaucguccaggugaugcgcaagcagaaaacaauuaaccgguuccuuaugagaaagcgccugcucuuucccgcccugguuacccugcucaucuccacacugaccuucccgccuggcuuugggcaguucauggcuggacaacuuagccagaaggaaacccuggugacacucuucgacaaucggacgugggucagacagggccugguggaggaacuggagcccccuuccaccucucaagccuggaacccuccccgcgcgaaugucuuucuuacacucgugauuuucauccugaugaaauuuuggaugagcgcccuggcuaccacaauccccguuccgugcggggccuucaugcccguguuugucauugauggaauccacaccgacuccagcacguaccggauugugccuggcggguaugcuguugugggcgccgccgcucucgcgggagccgucacacauaccgugucuaccgcugugaucguuuucgaacugacaggccagauugcccacauccuucccgucaugaucgccgugauucuggcuaacgccguggcgcagucccuccagccuagccuguacgauucuaucauuagaaucaagaaacugcccuaucuuccggagcucggguggggacgccaucaacaguaccgggucagaguggaggacauuaugguucgcgaugugccucacgucgcucugagcuguaccuuucgggaccugagacucgcccugcaccggacaaagggccgcaugcuugcccugguggaaucccccgagucuaugauccuccuggggagcauugaaagaucccagguuguggcucugcuuggagcccagcucagcccugcgcggagacgccaacauaugcaggagcggagagcuacgcagaccucuccccuguccgaucaggaaggcccucccacaccggaggccagcgucugcuuccaagugaauaccgaggacucugccuuuccugcugcccgcggggaaacacacaaaccccugaagcccgcucucaaaagaggcccuuccguuacccggaaccugggagagagcccgacgggcuccgccgaaucugcggggaucgcccuucgcagccuguucugcggaucucccccucccgaggcugccuccgagaagcucgaaagcugugagaagagaaaacugaagcgggugcgcaucucccuggcuagcgacgccgaucuugaaggcgagaugucuccugaagagauucucgagugggaggaacagcagcuggacgaacccgucaauuuuuccgauugcaaaaucgacccugcccccuuccagcugguggagagaaccagccuccauaagacacacaccaucuuuucucugcuugggguggaucacgcuuaugucacauccauuggacggcugauuggcaucguuacccucaaagaacugcgcaaggcgaucgaggggagcgugacggcccaaggcgugaaggucagaccgccucuggcuucuuuccgggacagcgccacauccagcucugauaccgagacaaccgaagugcaugcccuuuggggaccccacucccgccauggccugccuagagaggggagccccuccgacucugaugacaaaugucaguga

SEQ ID NO: 67520 - RNA, 2376 nt, Artificial Sequence
  derived and/or modified sequence opt5 from CLCN3__Homo_sapiens__NP_001230301
auggagagcgaacagcuguuccacagaggcuacuaucggaacuccuacaauucuaucaccagcgccuccucugacgaggaacuccuggauggggcuggagugauuauggacuuucaaacaagcgaggaugacaaccuucuggauggcgacacggccgucgggacccauuauacaaugaccaauggaggcuccaucaacucuagcacacaccuccuggaucuucuggacgaacccauuccugggguuggaaccuacgaugacuuccauacaaucgauugggugcgcgagaagugcaaagacagagagcggcaccgcagaauuaauuccaagaaaaaggaaagcgcgugggagaugaccaaaucucucuaugaugcuugguccggcuggcugguggucacgcugaccggccucgccagcggggcccuggcuggacuuaucgacaucgccgcugacuggaugacagaucugaaggaaggcauuugucucucugcccugugguacaaccaugagcagugcuguuggggguccaaugagaccacauuugaggagcgggacaagugcccgcaguggaaaaccugggcggaacuuaucauuggacaggccgagggccccgggagcuauaucaugaacuacauuauguacaucuucugggcucugucuuuugccuuccucgcugugucccugguuaagguguuugccccuuaugcguguggaagcggcauucccgaaaucaaaacgauccuguccggcuucauuauccgcggguaccucggaaaguggacacugaugauuaaaaccaucacacuuguccuggccguggcuucuggccucagccuggggaaggagggaccucuuguucacguggccugcuguugcggcaauauuuuuagcuaucuguuccccaaguacagcaccaacgaggcuaaaaagagagaagucucuuauuacuuuccucucaaaacccuguggcgguccuucuuugccgcccugguggcugcguucgugcuccgcagcaucaauccguucgggaacucuagacugguccuguuuuauguugaguaccacacacccugguaccuguucgaacucuuuccuuucauccugcuuggaguguuuggcggccuguggggagccuucuuuauucgggcuaauaucgccuggugucgcagacggaaguccacgaaauucgggaaguaucccgugcucgaggucauuaucguggccgcuauuaccgccguuaucgcguuuccuaaccccuacacacgccugaauaccuccgaacugaucaaagaacucuucacagauugcggcccgcuggagucuagcucccuuugugacuauagaaacgauaugaacgcuagcaagauuguggacgauaucccugaccggcccgccgggauuggagucuacucugccaucuggcaacugugccucgcucugauuuuuaagaucauuaugaccguguucacguuuggcaucaaaguuccuuccgggcuguucauccccagcauggccauuggcgcuaucgccggaagaauugugggcaucgcggucgaacagcuugccuauuaccaucacgauugguucauuuuuaaggaguggugcgaagugggggcugacuguaucacacccggacucuaugccauggucggcgcugccgcgugccuugggggagugacccgcaugaccguuucucugguggucaucguguucgagcucacaggcgggcuggaauacauuguuccucuuauggccgcugugaugaccuccaaaugggucggcgaugccuuuggacgggagggcaucuacgaggcucauauuagacugaauggguauccguuccucgacgccaaggaagaguuuacacacacgacccuggccgcugacgugaugcgcccccggagaaacgauccuccccuggcggugcuuacacaggacaauaugaccguugaugacaucgaaaacaugauuaaugagacaagcuacaacggauucccugucaucauguccaaagagucucagcgccucgugggcuuugcccugcggagagaucugaccaucgcuauugaaagcgcccgcaagaagcaagaggggaucgugggauccucucgggucuguuucgcccagcacacgcccagccucccggcugaauccccuagaccccugaaacuucgcagcauucuggacaugucuccuuuuaccgugacagaucauacccccauggagaucguuguggacauuuuccggaagcucggccugagacagugccuggucacacacaaugggcggcuucucggcaucaucaccaaaaaggauauucugcgccauauggcccagacggcgaaccaagacccugcuuccaucauguuuaauuga

SEQ ID NO: 67521 - RNA, 2001 nt, Artificial Sequence
  derived and/or modified sequence opt5 from CLCN4__Homo_sapiens__NP_001243873
augaccgaccugaaggagggcgugugccucagcgccuucugguacucccacgaacaguguugcuggacaucuaacgagacgaccuuugaagauagagacaaauguccccuguggcaaaaguggagcgagcuucuggucaaucaguccgaaggggcuucugccuauauccucaacuaccugauguauauucuuugggcgcugcuguucgcuuuucuggccguuagccuggugcggguguucgccccuuacgcuugcggauccggcaucccggagauuaaaacaauccucucuggguuuauuauccgcggauaucugggcaaguggacccuucugaucaaaacagucacccucgugcugguugugagcuccgggcuuagccugggaaaggagggcccccucguccauguggccuguugcuguggcaauuucuuuucuucccuguucagcaaguacucuaaaaacgaagggaagagacgggagguucuguccgcugccgcggccgcuggagugagcgucgccuuuggcgcuccuauugggggaguccucuucucucuggaagagguguccuauuacuuuccccuuaaaacacuguggcgcagcuucuuugccgcgcucguggccgcuuucacccugagauccaucaauccuuucggcaacucucggcuuguucuguuuuacguggaguaucacacgcccugguacauggccgaacucuucccuuuuauucugcuggggguguucggaggccucuggggcacccuguuuauccgcugcaauauugcuugguguagacggcgcaagacaaccagacuugggaaauauccgguccuggaggugaucguugugacagccauuaccgccaucaucgcuuaccccaacccuuauacgcggcagagcacauccgaacucauuagcgagcuguucaaugauugcggagcgcuugaaucuucccagcugugugacuacaucaacgaucccaauaugacccgcccugucgacgauauucccgacagaccggccggcguggggguuuauacagcuauguggcaacucgcccuggcccugaucuuuaagauuguggucaccaucuucaccuuuggaaugaagaucccuagcggccucuucauucccucuauggcugugggggccaucgcgggacggauggucggcauuggcguggagcagcuggcuuaccaucaccaugauuggaucauuuuucgcaacuggugcagaccuggggccgacugcguuacacccggacuuuacgccauggugggcgcugccgcuugucucgggggagucacgcggaugaccgugagccucguugugaucauguucgagcugacaggcgggcuggaauauaucgucccccuuauggccgcggccgugaccuccaaauggguggcugaugccuuuggcaaggagggaauuuacgaagcucacauccaccucaauggcuauccuuuccuggacguuaaagaugaguucacacauagaacccuggccacggacgucaugcgcccgcggagaggggaacccccucucucugugcugacacaggacagcaugaccguggaggaugucgagacccuuauuaaggaaacagacuacaacggauuucccgugguugugucccgcgauagcgagcggcugaucggcuucgcgcagagacgcgaacucauucuggccaucaaaaaugcucggcaaagacaggaggggauugucucuaacuccaucauguauuuuaccgaggaaccucccgagcugccggccaacagcccucacccccuuaagcuccgccggauccugaaucugucuccuuucacagugacggaccauacccccauggaaacaguuguggauauuuuuagaaaacucggacugcgccagugccuugucacccgguccggcagacugcucgggaucauuacaaagaaggacgugcugcggcacauggcucagauggccaaccaagauccugagagcaucauguucaauuga

SEQ ID NO: 67522 - RNA, 2451 nt, Artificial Sequence
  derived and/or modified sequence opt5 from CLCN5__Homo_sapiens__NP_001121370
auggccauguggcagggcgcuauggacaacagaggguuccaacagggauccuuuuccucuuuccagaauagcuccucugaugaggaccugauggauauccccgccaccgcgauggacuuuagcaugcgggaugacgugccuccgcucgaucgcgaagucggcgaggacaaguccuacaacgggggaggcauugggucuagcaauagaaucauggauuuccuggaggaacccauuccuggaguuggcacauaugacgauuuuaacacgaucgacugggugcgggaaaaaucccgcgauagagaccggcaccgcgagauuaccaauaagagcaaagagucuacaugggcucuuauccauuccgugagcgacgccuucucuggcuggcugcucaugcugcuuaucgggcugcucuccggaagccuggccggccugauugauaucucugcucacuggaugaccgaccucaaggaagggauuugcacaggaggcuuuugguucaaccaugagcacuguugcuggaauagcgaacaugucaccuuugaggagagagauaaaugucccgaauggaacagcuggucccagcugaucauuucuacagacgagggggccuucgcuuacaucgugaauuauuuuauguacguucuuugggcccuucucuucgcguuucuggccgugagccuugucaagguguucgcuccuuaugccugcggauccggcauucccgaaaucaagaccauccugagcggcuucauuauccggggguaccucggaaaauggacgcugguuauuaagaccaucacacuggugcucgcugucucuuccggccugagccuugggaaagagggaccucuggugcacguggccuguugcuguggcaacauucucugccacuguuuuaauaaguaucgcaaaaacgaagcgaagagacgggagguccugucugccgcugccgcugccgggguuagcguggccuucggagcuccgaucggcggcgugcuguuuucccuggaggaagucucuuacuacuucccccucaagacccuguggcgcagcuuuuucgcggcccugguggcugccuuuacacucagauccaucaauccuuucgggaacagccggcugguucuguuuuauguggaguuccauacccccuggcaccuguuugaacucgucccuuucauucugcuuggaaucuuuggcgggcuguggggagcccucuucauucgcacgaauaucgcuuggugcagaaaacggaagacaacccaacugggcaaauaccccgugauugagguucugguggucacagccaucaccgcgauccucgcuuucccgaacgaauauaccagaaugucuacauccgagcugauuagcgagcuuuuuaacgauugugggcugcucgacucuuccaagcugugcgauuacgaaaaucgcuucaacacgagcaaaggcggagagcugccugaccggcccgccggcgugggggucuauuccgccauguggcagcuugcucucacccugauccugaagauugugaucacaauuuuuaccuucggaaugaaaaucccuucuggccucuuuauucccagcauggccguuggggcuaucgccggaagacugcuuggcguggggauggaacagcuggcguacuaucaucaggaguggacagucuucaauuccuggugcucucaaggcgccgauuguaucacccccggacucuacgcuauggugggcgccgcugccugccuugggggaguuacgcgcaugacagugagccuggucgugauuauguuugaacuuaccggcgggcucgaguacaucgugccucugauggcggccgcuaugaccuccaaguggguugccgacgcucugggacgggagggcauuuaugaugcccacaucagacucaacggguacccguuccuggaagccaaggaggaauuugcucacaaaacacuugcgauggacgucaugaagccccgccggaaugacccucugcucaccgugcugacacaggauagcaugacgguggaggacgucgagaccauuaucucugaaacaaccuauuccggcuuccccgugguugugagcagagagucucagcgccuggucggauuugugcuucggagagaucucaucauuuccaucgaaaacgcccgcaaaaagcaggacggcguugugagcacaucuauuaucuacuucaccgagcauagcccuccccugccgccuuauacgcccccuacccugaaacuccggaauauucuggaucuuucccccuuuacagucaccgaccugacaccuauggaaaucgugguugauaucuucagaaagcucgggcugcggcaaugucuggugacccacaacggacgccuucucggcauuaucacgaagaaagacguccugaagcauauugcucagauggccaaucaggaucccgacagcauccuguucaacuga

SEQ ID NO: 67523 - RNA, 2610 nt, Artificial Sequence
  derived and/or modified sequence opt5 from CLCN6__Homo_sapiens__NP_001277
auggccggcugcagagggagccuguguugcuguugccggugguguugcuguugcggagagcgcgaaaccagaacacccgaggaacucacgauccugggcgagacccaggaagaggaggacgaaauucuuccucggaaggauuacgagucccuggacuaugaucgcuguaucaacgacccguaccucgaagugcuggagacaauggauaauaaaaaggggagacgguaugaggcugucaaauggaugguuguguucgccauuggagugugcaccggccuugucgggcuguuuguggacuucuuuguucgccucuucacacaacugaaguuuggagugguccagaccucuguggaagaguguagccagaaaggcugccuggcgcucucccugcuugaacugcucggcuucaaccugacauuuguuuuccuugcuucucugcucgugcugaucgagcccgucgccgccgggagcggcauuccugaagugaagugcuaccugaauggagugaagguccccgggaucguuagacuccggacccugcuuuguaaagugcugggagugcucuuuuccgucgcuggcgggcuguucgugggaaaggagggcccuaugauccacucuggcagcguugugggggccggacuuccccaguuucaauccauuagccugcgcaaaauccaguucaacuuuccuuauuucagaucugaucgggacaagcgcgauuucgucuccgcuggcgccgcggccgggguggcugccgcuuuuggagccccgauuggcgggacccucuucagccuggaggaaggaucuuccuuuuggaaucagggccugacguggaaaguucucuucugcagcaugucugcgacauuuacccugaacuucuuuagauccggcauccaguucgggagcuggggauccuuucaacuucccggccugcucaauuucggggaguuuaaguguucugacagcgauaagaaaugccaucuguggacagccauggaccuuggauucuuuguggucaugggcgugauugggggccugcucggagcuaccuucaacugucugaauaagcggcuggccaaauaccgcaugagaaacguccacccuaagcccaaacucgugcggguucuggaaucccuucuggugagccucgucacgacagugguuguguucgucgcuucuauggugcugggcgagugcagacagauguccagcucuagccagaucgggaaugauuccuuucagcugcaagugaccgaagacguuaacucuagcauuaagacauucuuuuguccuaaugacaccuauaacgauauggccacccuuuucuuuaauccccaggaguccgccauccuccagcuguuccaucaagacggaacauuuagcccggucacgcuggcucucuucuuugugcuguacuuccuucuggcgugcuggaccuacggcaucucugugccuuccgggcucuuuguccccagccugcuguguggagccgcuuucggccgccuuguggccaacguucucaaaucuuauauugggcugggccacaucuacuccggaacauuugcccugauuggcgcugccgcguuccucgggggagugguccggaugaccaucagccugacagugauucuuaucgaguccaccaacgaaaucacguauggccugccuauuaugguuacacucaugguggcuaaguggaccggggauuucuuuaauaagggaaucuacgacauucaugucggccugagaggggugccccugcuugagugggaaaccgagguugaaauggauaaacuccgcgccucugacaucauggagcccaaccugacauauguguacccucacacccggauucagagccuggucuccauccucagaacaacggugcaccaugccuucccgguggucaccgagaaucgcggcaacgaaaaggaguuuaugaaaggaaaucagcugaucucuaacaauauuaaguucaaaaagagcuccauccuuacacgggcuggcgaacagagaaagcgcagccaaucuaugaaauccuaucccagcucugagcugcggaacaugugcgaugagcacauugccuccgaggaaccugcugaaaaggaggaccuccugcagcagaugcuggaaagacgcuacacccccuacccuaaucuuuaucccgaucagagcccgucugaggacuggacaauggaggaacgguuuagaccucucaccuuccaugggcugauccugcggagccaacucguuacgcugcuugugcgcggaguguguuacuccgagagccagucuuccgccagccagcccagacuguccuaugcggaaauggccgaggauuacccucgguaucccgacauucacgaccucgaucugacccugcuuaacccuagaaugaucgucgacgugacacccuacaugaauccgucuccuuuuaccguuagccccaacacacacgugucccaggucuucaaucuguuucgcaccaugggccuccggcaucugcccgugguuaacgcugugggggaaauugucggaaucaucacgagacacaaucucacauaugaguuccugcaagcccgccuuagacagcauuaccagaccauuuga

SEQ ID NO: 67524 - RNA, 2346 nt, Artificial Sequence
  derived and/or modified sequence opt5 from CLCN7__Homo_sapiens__NP_001107803
auggccaacgugagcaagaaagucuccuggucuggcagagaccgggaugacgaggaagcugcgccccugcuccgcagaaccgcccggccugggggaggcacaccgcugcuuaauggggcuggacccggcgccgcccgccaggauauggacccuccccacccuuuccccaaggagaucccucauaacgaaaaacugcucagccugaaguacgagucccuugauuaugacaauucugaaaaccaacuguuucucgaggaggaaagacggauuaaucacacggcuuuccgcaccguugagaucaaaagaugggugauuugcgcccugaucgggauucugacaggacucguggcuuguuuuaucgauaucgucguggaaaaccuggccggccuuaaguaccggguuauuaagggcaauaucgacaaauucaccgagaagggaggacugagcuuuucccuccugcuuugggcgacacugaacgccgcuuucgugcucgucggcucugugauuguugccuuuaucgagccgguggcugccgggagcgggauuccccagaucaaaugcuuccugaauggcgucaagauuccucauguggugcgccugaaaacccucgucaucaagguuuccggggugauccugagcguggucggaggccuugcggugggcaaggaagggcccaugauucacucuggauccguuaucgccgcuggcauuagccaggggagaucuacaucccugaaacgggauuuuaagaucuucgaguauuuucgcagagacaccgaaaaacgggauuucgugagcgccggagcugccgccggcgucucugcugcguuuggggccccugugggaggcguucucuucucccuggaggaaggcgcuagcuucuggaaccaguuucuuacguggcgcauuuucuuugccuccaugaucucuaccuucacacugaauuuugugcucagcaucuaccaugggaacaugugggaccuguccagccccggacugauuaauuucggcagauuugauucugagaagauggccuauaccauccacgagauuccggucuucaucgcuauggggguggucggaggcgugcucggggccguuuuuaacgcgcugaauuacuggcuuacaauguuccggauuagauauauccaccgcccuugucugcaagugaucgaagcuguccucguggccgccguuaccgcuacgguggccuuuguccugauuuacuccagccgggacugccagccccuucagggcggaucuaugagcuacccucugcaacucuucugugcugacggcgaguauaacuccauggccgcggccuuuuucaacacacccgaaaaaucuguggugagccuguuccaugaucccccuggguccuacaauccgcugacccucggacuguuuacacuuguuuauuucuuucuggcuugcuggaccuacggccucaccgucagcgccgggguguucauccccucucugcugauuggagcugccuggggcagacuuuuugggaucucccucagcuaucugacaggcgcggccauuugggcugacccuggaaaguacgcccugaugggcgcugccgcccagcucgggggaaucgugcgcaugacgcugucucuuaccgucauuaugauggaggcuacauccaacgugaccuauggcuuccccaucaugcugguucucaugacagcgaaaaucgugggggaugucuuuauugaaggacuguacgacaugcacauccagcugcagagcgugccuuuccuucauugggaggcccccguuaccucccacucucucacggcucgggaggugaugagcacaccggucaccugucugagacgccgggaaaaggugggcguuauuguggauguccuguccgacaccgccucuaaucacaacggguuuccugugguggagcaugccgaugacacacagcccgcuagacuccaaggccugauccuucgcagccagcugauuguccuccugaagcacaaaguuuucguggaacgguccaaucugggacuugugcagagacgccuccggcugaaggauuuuagagacgccuacccucgguuucccccuauccaaagcauccaugucucucaggaugagcgcgaaugcaccauggaccuguccgaguucaugaaccccagcccguauacagugccucaggaggcgucucuccccagaguuuucaaacuguuccgggcucuuggccugagacaccucguggucguggacaaucgcaaccagguuguggggcuggucacgcggaaggaucuggccagauaccgccuuggaaaaagaggccucgaggaacugucccuggcccaaaccuga

SEQ ID NO: 67525 - RNA, 1905 nt, Artificial Sequence
  derived and/or modified sequence opt5 from CLCNKB__Homo_sapiens__XP_011538921
augacccugggcgugcucauggcccuggucagcugcgcuauggaccuugccguugaguccguggugagagcgcaccaguggcuguaccgggaaaucggggauucucaucuccugcgcuaucuuagcuggacagucuaccccguggcucugguuuccuucucuagcggauuuucccaaucuauuacgccuagcuccggcgggagcggaaucccggaggugaagaccaugcucgccggcgucgugcuggaagacuaucuggauauuaaaaacuucggggccaagguugugggacucucuuguacacuggcuugcggcuccacccuuuuucugggcaaagucgggcccuucgugcaccucagcgugaugauggccgcuuaccugggaagaguccggacaaccacaaucggcgagccugaaaauaagucuaaacagaacgagaugcuuguugccgcggccgcuguggggguggccaccgucuuugcugcccccuucuccggagugcuguuuagcauugagguuaugucuucccauuucagcgugugggacuauuggcgcggcuuuuucgcggccacguguggggcuuuuauguucagacuccuggccgucuuuaauuccgaacaggagaccaucacaucucuguacaagaccagcuuccggguggauguuccuuucgaccuccccgaaaucuuuuucuuuguggcucugggaggccuuugcggcauucugggguccgccuaucucuucugucagcgcaucuuuuucggauuuauuagaaacaaucgguucagcucuaagcugcuugccacauccaaaccugucuacagcgcucuggcgacccucgugcuggccucuaucacguacccgcccagcgcuggccgcuuucuggccuccagacucucuaugaagcaacaccuggauagccuuuucgacaaccauuccugggcccugaugacacagaauagcucuccucccuggccugaggagcucgauccccagcaccuguggugggaaugguaucacccgcgguuuaccauuuucgggacacuugccuuuuuccuggucaugaaauucuggaugcucauccuggcuaccaccauuccuaugcccgcgggauacuuuaugccuaucuucguguauggcgcugccaucgggcgccuguuuggagagacacucuccuucauuuuucccgaaggcaucguugccggcgggauuacgaaccccaucaugccuggaggcuacgcucuggccggggcugccgcguucagcggagccgugacccauacaauuucuaccgcccuucuggcuuuugaggucacaggccagaucgugcacgcucucccgguucugauggccgugcuggcggccaaugcuaucgcccaauccugccagcccagcuucuaugacgggaccgucauugugaagaaacuuccuuaccuccccagaauccugggccggaacauuggaucccaucgcgugagaguugaacacuuuaugaaucacucuaucacgacacuggcuaaggauaugccucucgaggaggucgugaagguggucaccagcaccgacguggccaaauauccccugguugaauccacagagucucagauucuugugggcaucguccggagagcccagcuggugcaagcucucaaggcggaaccgccuagcugggcccccgggcaucagcagugucugcaagauauccuggcugccggaugcccuaccgagcccguuacacuuaaacucuccccugaaacgagccugcacgaggcccauaaccuguucgagcuccugaaucuucacucucuguuugugaccucccgcggccgggcugucgggugugugagcuggguugaaaugaagaaagccauuucuaaccucacaaaucccccggcgccuaaguga

SEQ ID NO: 67526 - RNA, 624 nt, Artificial Sequence
  derived and/or modified sequence opt5 from CLDN10__Homo_sapiens__NP_001153572
augagcagagcccagaucugggcucugguguccggcgucgggggauucggcgcccucguugcggcuaccacaucuaacgaguggaaggugacgacccgggccagcuccgugauuacagccaccugggucuaccaagggcuguggaugaauugcgcuggauauauccaggccugucgcggccuuaugauugcugccgugucucugggguuuuucggaagcaucuuugcccucuucggcaugaaaugcacaaagguuggcggguccgacaaagcgaaggcuaaaauugccugucuggcuggaaucguguuuauccuuucuggccugugcagcaugaccggguguucccucuacgccaacaagauuacaaccgaguucuuugauccccuguucgucgaacagaaguaugaacugggagcggcccucuuuaucggcugggcuggggccagccugugcauuaucggaggcgugauuuucuguuuuucuaucuccgacaauaacaaaacgccuagauacaccuauaauggcgcuacaagcguuaugucuucccggaccaaguaccacgggggagaggauuucaaaacaaccaacccgagcaagcaguuugacaaaaaugccuauguguga

SEQ ID NO: 67527 - RNA, 624 nt, Artificial Sequence
  derived and/or modified sequence opt5 from CLDN11__Homo_sapiens__NP_005593
augguggccacaugccugcaggucguuggcuucgugaccagcuuugugggguggaucggagucauugugacgaccuccacaaacgacuggguugugaccuguggcuacacaaucccuaccugcagaaagcucgaugagcuggggucuaaaggacuuugggcugacugugucauggccacaggccuguaucacugcaagccccucguggauauucugauccuuccgggguacguucaagcgugucgggcucugaugauugccgccagcgugcucggacugcccgcuauccugcuccugcuuaccguccugccuugcauccgcaugggccaggaacccggcguggccaaauauagacgggcucagcucgccggggugcugcuuauucugcucgcgcugugugcccuggucgcuacgaucugguucccuguuugcgcccaucgcgagaccacaauuguguccuuuggauacucucucuaugcuggcuggaucggggccgugcugugucuugucggaggcugcgugauucuguguugcgcgggggacgcccaggcuuucggagaaaauagauuuuacuauaccgccggcagcuccucucccacacacgcuaagagcgcccauguuuga

SEQ ID NO: 67528 - RNA, 720 nt, Artificial Sequence
  derived and/or modified sequence opt5 from CLDN14__Homo_sapiens__NP_036262
auggccagcaccgcugugcagcugcucggcuuccugcuuuccuuucuggggauggucggaacacucaucacgaccauucugccccacuggagacggacagcccauguuggcaccaacauccuuacagcggugucuuaccugaaggggcucuggauggagugcguguggcacagcaccggaauuuaucaaugucagaucuaccgcucccugcuggcucucccucaggaccugcaggccgccagagcucuuauggucauuucuugccugcucagcggcaucgccugugcuugcgccgugaucgggaugaaauguacacggugcgcgaagggaaccccggccaaaacgaccuucgcuauucugggcggcacacuuuuuauccuggccgggcuccuguguaugguugcuguguccuggaccacaaaugaugucgugcaaaacuucuauaauccccugcucccuucuggaaugaaguuugaaauuggccaggcccuguaccuuggguucaucagcuccagccugucucucauuggaggcacccugcuuugccuguccugucaggacgaggcgcccuaucgcccuuaccaggcucccccuagagccacgacaaccacagccaacaccgcuccggccuaucaacccccugccgcuuacaaagauaaucgggcgcccagcguuaccucugccacacauuccggguaccgccucaacgacuauguguga

SEQ ID NO: 67529 - RNA, 687 nt, Artificial Sequence
  derived and/or modified sequence opt5 from CLDN15__Homo_sapiens__NP_001172009
augagcauggccguggagaccuucggcuuuuucauggcuacagucgggcugcucaugcugggaguuacgcuucccaacuccuacuggagagugucuaccgugcacggcaaugucaucacaaccaacacaauuuuugaaaaucugugguucagcugcgccaccgacucccucgggguguauaacuguugggaguuuccuucuaugcuggcgcuuagcggauacauccaggcuugccgggcccugaugauuacagccauccuccugggcuuccuggggcuccugcuuggaauugcuggccugcgcuguaccaauaucggcgggcucgaacuguccagaaaggccaaacuugcugccacggcgggagcccugcauauccucgcuggcauuugcgggaugguugccaucucuugguaugcuuuuaacauuacccgggauuucuuugacccgcuguaccccggaacaaaguaugagcugggcccugcccucuaccugggguggagcgcgucccuuaucagcauucugggaggccucugucugugcucugccuguugcuguggcuccgaugaagaccccgcugccagcgcucgcagaccuuaucaagcccccgugucugucaugccuguggccaccuccgaucaggagggggacagcucuuucggaaaauacggccggaaugcuuacguuuga

SEQ ID NO: 67530 - RNA, 918 nt, Artificial Sequence
  derived and/or modified sequence opt5 from CLDN16__Homo_sapiens__NP_006571
augaccagcagaacaccccugcucgugacggccugccuguacuauuccuacuguaacucucggcaccuucagcaaggcguccgcaagagcaaaagaccuguuuucucccauugccaggugccggagacccagaagacagacacccggcaccugucuggggcucgcgccggagugugucccugcugucauccugauggccuccuggcgacaaugagagaccuucugcaguauaucgcuugcuuuuucgccuuuuucagcgccggguuucucauugucgcuaccuggacagauuguuggauggugaaugccgacgauucccuggaaguuucuaccaaaugccggggacuguggugggagugugugacgaacgcuuucgacggcaucagaaccugcgaugaauacgacagcauucucgccgagcacccccugaagcucgucgugacacgcgcgcugaugaucaccgccgauauucucgcuggguuuggauuccugacacuucugcucggccuggacuguguuaaauuucugccugaugaacccuauaucaaggugcggaucugcuucgucgccggcgcuacccuccugauugccgggacgccuggaaucauuggcuccgugugguacgcgguggacgucuauguugagcgcagcacacuugugcugcauaauaucuuucucgggauucaauacaaguucggauggucuugcuggcugggcauggccgggucccuuggauguuuucuggcuggcgccgugcuuaccugcugucuguaccuguucaaagaugucggcccggagagaaacuaucccuacagccuccggaaggcuuauucugccgccgggguguccauggcuaaaagcuacucugcgccucgcacagaaaccgccaagauguaugcuguugacaccagaguguga

SEQ ID NO: 67531 - RNA, 786 nt, Artificial Sequence
  derived and/or modified sequence opt5 from CLDN18__Homo_sapiens__NP_001002026
auggccgugaccgcuugccagggccugggguucgucguuagccucaucggaauugccggcaucauugcggcuacauguauggaccaaugguccacgcaggaucuguacaacaaucccgugaccgccguguuuaacuaucaggggcuuuggagaucuugcguccgggagagcuccggauucacagaaugucgcggcuacuuuacccugcucgggcugccugccaugcuucaggcugugagagcccugaugaucguuggaauugugcucggcgcuaucggccugcuggucucuaucuucgcccucaagugcauucggaucgggagcauggaggacuccgcgaaagccaauaugacacugaccucuggaauuauguuuaucgugagcggccuuugugcuauugccgggguuuccguguucgcuaacaugcuggucacaaauuuuuggaugagcaccgccaacauguauacgggaaugggcgggauggugcaaaccgugcagacacgcuacaccuucggagcggcccucuuugucggcuggguugcuggcgggcugacacuuaucggaggcgugaugaugugcauugccuguagagggcuggcuccggaagagaccaauuauaaggccgugucuuaccacgccuccggacauagcgucgcuuauaaacccggcggguucaaggcgucuacgggauuuggcuccaacaccaaaaauaagaagaucuacgauggcggggcccggacagaagacgaggugcagagcuacccuucuaaacacgauuauguuuga

SEQ ID NO: 67532 - RNA, 636 nt, Artificial Sequence
  derived and/or modified sequence opt5 from CLDN1__Homo_sapiens__NP_066924
auggccaacgcuggccugcagcuccugggguucauccuugccuuucugggauggauuggcgcgaucgugagcaccgcucucccccaauggagaauuuacuccuaugccggggacaauaucgucacagcccaggcuauguacgagggacuguggaugucuugcguuagccaguccacgggccagauucaauguaagguguucgauucucuucugaaccucagcuccacccugcaggccacacgggcucugaugguggucgggauccuccugggagugaucgccauuuuuguugcgaccgugggcaugaaaugcaugaagugucuugaagacgaugagguccagaaaaugcgcauggccgugaucggcggggcuauuuuccugcucgccggacuggcuauccuuguugccacagcgugguauggcaauagaauugugcaggaauuuuacgacccuaugaccccggucaacgcccgguaugaguucgggcaagcucuguuuacaggaugggccgcugccucucucugccugcugggcggggcccuccuguguugcagcuguccccgcaagaccacguccuacccuacccccagaccuuaucccaaaccugcuccgagcucuggaaaggauuacguguga

SEQ ID NO: 67533 - RNA, 879 nt, Artificial Sequence
  derived and/or modified sequence opt5 from CLDN23__Homo_sapiens__NP_919260
augagaacccccguggucaugacacugggcaugguucucgccccuugcgggcugcuucugaaccucacgggaacccuggcuccgggcuggcggcuugugaagggguuccugaaucagcccguggacgucgagcucuaccaaggacugugggauaugugucgcgaacagagcuccagagagcgggaaugcggccagacagaccaguggggguauuuugaggcccaaccugugcugguugcgcgcgcucucauggugaccucucuggccgccacaguccuuggacugcuccuggcuagccuuggcgugagauguuggcaggaugaacccaacuucguucuggccggccucuccggggugguccuguuuguggcuggacugcucggccugaucccugugucuugguacaaucacuuccuuggggaccgggauguccugcccgccccugcgagcccgguuaccguccagguguccuauucucucgugcugggauaccuuggcagcugccugcuccugcucgggggauuuucccuggcccugagcuucgcucccuggugugacgagcgcugcagacggcgcagaaaaggcccuucugccggcccccggcgcuccagcgugucuacaauucagguugaguggccugaacccgaucuugcuccggccaucaaguauuacuccgacgggcaacauagaccucccccugcgcagcaccggaaacccaagcccaaaccuaaggugggauuuccgaugccccgcccuagacccaaggccuauaccaacagcgucgaugugcuggacggcgaggggugggaaucucaggaugcuccuuccuguagcacgcaucccugcgacuccucucucccgugugauagcgaccuguga

SEQ ID NO: 67534 - RNA, 693 nt, Artificial Sequence
  derived and/or modified sequence opt5 from CLDN2__Homo_sapiens__NP_001164566
auggccagccugggccuccagcuggugggguacauccuuggacugcucggccugcuugggacccuggucgcuaugcuccugcccuccuggaagacaucuagcuauguuggagccuccauugugacggcggugggcuucucuaaagggcuguggauggagugcgcuacccacagcacaggaaucacccaaugugacauuuacuccacacuccugggccuuccugccgauauccaggccgcucaggccaugauggucaccucuagcgcuauuuccagccuggccugcaucaucucugugguuggcaugagauguacaguguuuugccaggaaucccgggcgaaggaccgcgucgccguggcugggggaguuuucuuuauucucggcgggcugcuuggauucaucccgguggccuggaaccugcauggcauucucagagauuuuuauagcccccuggucccugacucuaugaaauucgagaucggggaagcucuguaccucggaauuaucuccagccuguuuucucuuauugccggcaucauccuguguuucuccugcagcucccaacggaaucgcucuaacuauuacgaugcguaucaggcccagccccucgcuaccagaagcuccccucggcccggccagccuccgaaggugaaaagcgaguuuaauucuuacucccugacgggguacguguga

SEQ ID NO: 67535 - RNA, 912 nt, Artificial Sequence
  derived and/or modified sequence opt5 from CLDN5__Homo_sapiens__NP_001124333
augaccagagcccggaucggcugcuucgggcccggaggccgcgcuagagggacagagagcgccccugaaccguccaagcgggugcccccuggacgcucuuggcagacgcaagaggucagacagacccggggcgcgaacgggcugggaccccgcgcuggcagcgccggcgccaaagcuccugggcccgcccagggagcugcccagcacggccucgggggauccgcgggccugagaguucgggugucuccucuugccauggggagcgcugcccuggaaauucucggacuggugcuuugucuggucggcuggggcgggcucauccuggcuugcggacugccgauguggcaagugacagccuuucucgaccauaauauuguuaccgcgcagacaaccuggaagggccuguggauguccugugugguccagucuacagggcacaugcagugcaaaguguacgauagcguucuugcccuguccaccgaggugcaagcugcccgcgcucucacggucagcgccgugcugcuugccuucguggcucuguuugucacccucgcgggagcccaguguacaaccugcguugcucccggcccugccaaggccagaguggcucugacagggggagugcuguaucucuucuguggccugcuugcccuggucccccucugcugguuugcgaacaucgugguucgggaguucuacgacccuucugugcccgucucccagaaauaugaacugggcgcugcccuuuacauugggugggccgcuaccgcccugcucauggugggaggcugucugcugugcuguggggcuuggguuugcacgggacgcccggaucucagcuuuccugugaaguauucugcccccagacggccuacagcgaccggcgacuacgauaagaaaaauuaugucuga

SEQ ID NO: 67536 - RNA, 663 nt, Artificial Sequence
  derived and/or modified sequence opt5 from CLDN6__Homo_sapiens__NP_067018
auggccagcgcuggcaugcagauccugggggugguccucacccugcuuggauggguuaacggccugguguccugcgcccuccccauguggaaggugacagcguucauuggaaauucuaucgucguggcucaaguugugugggaggggcuguggaugagcugugucgugcaguccacgggccagaugcagugcaaaguuuacgacucucuucuggcccucccucaagaucugcaggccgcuagagcccugugugugauugcucuccuggucgcccuuuuugggcugcucguguaucuggcgggagccaagugcaccacauguguggaagagaaagacagcaaggcucggcuuguccugaccuccggcaucguuuucgugauuucuggcgugcucacacugaucccggucugcuggaccgcccacgcuaucauucgcgauuuuuacaacccccugguggccgaagcgcagaaaagagagcucggggccagccuguaucuuggaugggcugccuccggccugcuccugcuugggggaggccugcucuguugcacauguccuagcgggggaucucagggccccucccauuacauggcucgguauagcaccucugccccugccaucucccgcggccccagcgaauacccuacgaagaauuauguuuga

SEQ ID NO: 67537 - RNA, 438 nt, Artificial Sequence
  derived and/or modified sequence opt5 from CLDN7__Homo_sapiens__NP_001171952
auggccaacagcggccugcagcuccugggguucuccauggcccuucugggaugggugggccucgucgcuugcaccgcgaucccccaauggcagaugucuagcuacgcuggggacaauauuaucacagcccaggccauguauaagggacuguggauggauuguguuacgcaguccaccggcaugaugucuugcaaaauguacgacagcgugcuugcucuguccgccgcucuccaagccacaagagcgcugaugguggucucucuggugcucggguuucuggccauguucguugcuaccaugggaaugaaguguacacggugcggcggcgaugacaaagugaagaaagcccgcauugcuaugggagggggcaucauuuuuaucgucgccgggaugagccuugcgcugccuucccuccuggccggacagggccuuccguga

SEQ ID NO: 67538 - RNA, 678 nt, Artificial Sequence
  derived and/or modified sequence opt5 from CLDN8__Homo_sapiens__NP_955360
auggccacccacgcucuggagaucgccggccucuuccuugggggagugggcauggucgggacaguugcggugacggugaugccccaguggagagucagcgcuuuuauugaaaacaauaucgugguuuucgagaacuuuugggaaggacuguggaugaauugcgugcggcaagccaacauucgcaugcaguguaagaucuacgacucccugcucgcccugucuccugaucuucaggcugccagaggccugaugugcgcugccagcgucauguccuuccucgcguuuaugauggccauucuggggaugaaauguacccggugcacaggagacaaugagaaggugaaagcucauauccugcucaccgccggcaucauuuucaucauuacaggcaugguugugcugaucccggucucuuggguggcuaacgccauuauccgcgauuuuuauaauagcauugugaacgucgcgcagaagagagaacuuggggaggcccuguaccucggauggaccacagcucugguucuuaucgugggcggggcccuguucuguugcguguuuuguugcaaugagaaauccucuagcuaucgguacuccauccccagccaccgcaccacgcaaaagucuuaucauaccggaaagaaauccccuagcgucuacucuagaucccaguauguguga

SEQ ID NO: 67539 - RNA, 654 nt, Artificial Sequence
  derived and/or modified sequence opt5 from CLDN9__Homo_sapiens__NP_066192
auggccagcaccggccuggagcuccuggggaugacacuugcugugcugggauggcucggcacgcuggucuccugcgcccuuccccuguggaagguuaccgcguucaucgggaacucuauugugguggcucaggucgugugggaaggacucuggaugagcuguguugugcaauccacaggccagaugcagugcaaagucuacgacucucugcuggcccucccucaggaucugcaagccgcuagagcccuuugugugaucgcucugcuccuggcccuucuggggcuccugguugcgauuaccggagcccagugcacaaccuguguggaggacgaaggcgcuaaggcccggaucguccugacagcuggcgugauucuccugcuugccgggauccuggugcucaucccggucugcuggaccgcgcacgccauuauccaggauuuuuauaauccccugguugcugaggcccuuaaacgcgaacugggagcuagccucuaccugggcugggccgccgcugcgcugcucaugcuugggggaggccugcuguguugcacguguccucccccucagguggagagaccccgggggccucgccucggauauuccauuccgucuagaagcggcgccuccggccuggacaagcgggauuacguguga

SEQ ID NO: 67540 - RNA, 879 nt, Artificial Sequence
  derived and/or modified sequence opt5 from CLEC10A__Homo_sapiens__NP_006335
augaccagaacauacgagaacuuccaguaucuggaaaauaaggugaaaguccaaggcuuuaagaacgggccccucccucugcagagccuucugcagcggcucugcuccggaccgugucaucugcuucugucucucggccuggggcugcuccugcuuguuaucauuugcguggugggauuccagaauagcaaauuucaacgcgaccuggucacgcucagaaccgauuucuccaacuuuacaucuaauaccguggccgagauccaggcucugacaagccagggcuccucucuugaagagaccauugccagccugaaggcggaaguugagggguucaaacaggagcggcaagcugugcacuccgaaaugcuccugcgcguccagcagcuggugcaggaccucaagaagcugacaugucaaguugccacccuuaacaauaacggagaggaagccagcacggaggggaccugcugucccgugaauugggucgagcaccaggauucuugcuacugguuuucccauagcggcaugucuugggcugaagccgagaaauauugucagcugaagaacgcucaccucguggugaucaauuccagagaggaacaaaacuucguccagaaauaccugggcagcgccuauacauggaugggacuuucugacccugaaggcgcguggaaguggguugaugggaccgacuacgccacaggauuucagaauuggaaacccggccagccugaugacuggcaagggcauggacugggcggcggggaggauugcgcucacuuccaccccgacggacgguggaacgaugacgugugucagcgcccuuaucauugggugugcgaggccggccucgggcagaccucccaggaaagccacuga

SEQ ID NO: 67541 - RNA, 972 nt, Artificial Sequence
  derived and/or modified sequence opt5 from CLEC11A__Homo_sapiens__NP_002966
augcaggccgcuuggcugcucggcgcccugguggucccccaacuucugggguucggacacggcgcgagaggggcugagcgggaaugggagggaggcuggggaggggcccaggaagaggaacgcgagagagaggcccucaugcugaagcaucuucaggaagcucugggccucccugccggccgcggggacgagaacccggcuggaaccguugaaggcaaagaggauugggagauggaagaggaccagggggaagaggaagaggaggaagccacacccacgccuagcuccggacccucuccuagccccaccccugaggauaucgugacauacauucugggccggcuggcggggcucgacgccggacugcaccaacuucaugugagacugcacgcucucgauacccgggucguggaacugacacagggccuucgccagcugagaaaugccgcuggcgacacccgggaugccguucaggcgcuccaagaggcccaggggcgcgcugaaagagagcauggacggcuggagggcugccugaaggggcuccgccugggacacaaauguuuucuucuguccagagacuucgaagcccaggcugccgcccaggcucggugcacagcgcgcggcgggucucucgcccaaccggcugauagacagcagauggaggcccugacccgguaucuuagagccgcucuggcccccuacaacuggccuguguggcucggaguccacgaccgccgggcggaaggccuguaucuguuugagaauggccaaagagugagcuucuuugcuuggcaucgcucuccccggccugaacucggggcccagcccuccgccagcccgcacccucugucccccgaucagccuaacggaggcacgcuugagaauuguguugcucaggccagcgacgaugggucuuggugggaccaugacugccaaagacgccuguacuaugugugugaguuccccuuuuga

SEQ ID NO: 67542 - RNA, 828 nt, Artificial Sequence
  derived and/or modified sequence opt5 from CLEC12A__Homo_sapiens__NP_001193939
auguggaucgacuucuuuaccuacagcuccaugucugaagaagugacauaugccgaucugcaguuccaaaacagcuccgagauggaaaagauucccgagaucggcaaauuuggggaaaaggcuccuccggcccccucucacgucuggagaccugcggcucucuuccugacgcuucugugccuccugcuucugauuggacucggcguucuggccagcauguuucaugugacccugaaaaucgagaugaagaaaaugaauaagcuccagaacauuuccgaggaacugcagcggaauaucucucuucagcugaugagcaacaugaauaucuccaacaagauucgcaaucucagcacaacccugcaaacaaucgccaccaaacuuuguagagagcuguacucuaaggaacaggagcacaaaugcaagcccuguccucggcgcuggauuuggcauaaagacuccugcuauuuccucagcgaugacgugcagacauggcaggagucuaagauggcuugugccgcucaaaacgccucccugcugaagaucaauaacaaaaaugcgcucgaauuuauuaagagccagucuagauccuacgauuauuggcuggggcuuagccccgaggaagacuccacccggggaaugcgcgucgauaacaucauuaauucuagcgccugggugaucagaaacgcuccugaccugaauaacauguacugcggcuauaucaaccggcucuacguucaguacuaucacuguacguacaaaaagcgcaugauuugcgagaaaauggccaauccggugcagcugggguccaccuauuucagagaggcuuga

SEQ ID NO: 67543 - RNA, 1473 nt, Artificial Sequence
  derived and/or modified sequence opt5 from CLEC14A__Homo_sapiens__NP_778230
augagacccgccuucgcucugugccuccuguggcaggcccuuuggccuggccccgggggaggcgagcaccccaccgcggaccgggcuggguguagcgccuccggagccugcuacucucugcaucacgcuacaaugaagcgccaagccgcugaagaggccuguauccucagaggcggggcgcugagcacggugcgggccggagcugaacuucgcgccguccuggcucuccugagagccggcccuggccccgggggaggcuccaaagaucugcucuuuuggguugcgcuggagcggcgcagaucucauugcacccuugaaaacgagccucugcggggguucagcuggcucuccucugaccccggaggccuggagagcgauacacuucaguggguggaggaaccucagcgcuccuguaccgccagacggugcgcugugcugcaggccacagggggagucgaaccggcuggcuggaaggagaugcgcugucaccucagagccaauggcuaucugugcaaauaccaauuugaggugcugugucccgccccucggcccggggcugcgagcaaccucucuuaucgcgccccuuuccagcugcauuccgcugcccuugacuuuagcccgccgggaaccgaaguuucugcccugugcagaggccagcucccuauuuccgugacauguaucgcugaugagauuggggcccggugggacaagcugagcggagauguccuuugccccugcccuggcagauaccugcgcgcggggaaaugugcugaacuccccaauugccuggacgaucugggaggcuucgccugugagugcgccaccggcuuugaacucgggaaggacggacggucuugugugacguccggcgaggggcagcccacccugggaggcacagggguuccuaccagacgcccgcccgcuacagccaccagcccugugccccaacggacguggccuaucagagucgaugagaaacuuggcgaaacaccccuggugccggagcaggacaacuccgugaccucuauuccugaaaucccccgcuggggaagccaguccacaaugagcacccuccagaugucucugcaagcugaguccaaggccaccaucacaccuagcggcucugucauuagcaaguucaauuccacgaccucuagcgcgacaccccaggccuuugauuccagcucugcuguuguguucaucuuuguguccaccgccgucgugguucuugugauucugacaaugaccguccucgggcuggugaaacugugcuuccacgaaagcccuucuucccagccccggaaggagagcaugggaccgccuggccucgaguccgaccccgaacccgcugcccuggggucuagcuccgcgcacuguacgaacaauggaguuaaagugggcgacugcgaucuuagagaccgcgccgagggggcucugcucgccgaaucuccucugggcagcuccgaugcuuga

SEQ ID NO: 67544 - RNA, 2721 nt, Artificial Sequence
  derived and/or modified sequence opt5 from CLEC16A__Homo_sapiens__NP_001230332
auguucggcagaagccgguccugggucgggggaggccacgggaagaccucucgcaacauccauagccuggaccaccucaaauaccuguaucaugugcuuacaaagaauacgaccguuacagagcagaacagaaaucugcucguggaaaccauucgguccaucacagagauucugaucuggggagaucaaaacgacucuagcguguuugauuucuuucuugagaaaaauauguucgucuuuuuccugaacauucuccgccagaaguccggcagauacgugugcguucagcugcugcagacccucaauauccuguuugaaaacaucucucacgaaacaagccuuuauuaccugcucuccaauaacuaugugaauagcauuaucguccauaaauucgacuuuucugaugaggagauuauggccuacuauaucuccuuccugaagacccuuagccugaagcucaacaaucacacggugcacuuuuucuacaacgaacauaccaaugacuuugcucuguacacagaggccauuaaauucuucaaccaccccgaaucuaugguucggaucgcggugcgcaccauuacacugaacgucuauaagguggauaaucaagcuaugcuccauuacaucagagacaaaaccgccgugccuuauuuuuccaaccuggucugguucaucgggagccacguuauugagcuugaugacugugugcagacggaugaggaacaccggaaucgcggaaagcugucugaccucguggccgagcaucuggaucaccuucauuaccugaacgacauccucauuaucaauugcgaauuucugaacgacguccugacagaucaccuccugaauagacuuuuccugccgcucuauguguacucccuggagaaccaggacaaaggcggcgaacggcccaagauuagccuuccuguuucccuguaucuccugucucagguguuucugaucauccaucacgcuccccucgucaauagccuggccgaggugauucuuaacggggaucuguccgagauguacgcuaagaccgaacaagacauccagcgcagcucugccaaaccuuccauuagauguuucaucaagcccacagagacccucgaacggagccuggagaugaauaaacacaagggaaaacgcagaguucagaagcggccuaacuacaaaaaugugggcgaagaggaggaugaagagaaggggccgaccgaagacgcgcaggaggaugccgaaaaggcuaaagagauugagauggucaucauggaaagaucuaagcugagcgagcuugccgcuuccacaucugugcaagaacagaacacgaccgacgaggagaaaagcgccgcggccacaugcuccgaaagcacccaguggucucgccccuuucucgauauggucuaucaugcucuggacuccccugaugacgacuaccacgcccuguucgugcucugucugcuuuaugcuaugagccauaauaagggaauggaucccgagaaacuggaacggauccaacucccuguucccaacgccgccgagaagacaaccuacaaccacccgcuggcugaaagacugauucgcaucaugaauaacgcggcccagccugacggcaagauucggcuugcuacgcucgagcugucuugccugcuccugaaacaacaggugcuuauguccgccggguguaucaugaaggauguccaccuggccugccucgagggagcuagagaagagagcgugcaucugguucgccacuuuuauaaaggcgaagacauuuuccuggauauguuugaggacgaauaccgguccaugacaaugaagcccaugaauguggaguaucuuaugauggaugccucuauccuccugccucccaccggcacaccccugaccgggauugacuucgucaaaagacucccuuguggagauguggagaagacccgccgggcgaucagaguguuuuucaugcugcgcagccuuucccugcagcuccggggcgaaccggagacacagcugccccugacgagagaagaggaccuuaucaagaccgaugacguucucgaucugaacaauucugaccugauugcuugcacagucaucaccaaagacgggggaauggugcagcgguuccucgccguggauauuuaccagaugagccuggucgaaccugacgugucccgccuuggcuggggaguugugaaguuugccgggcugcuccaagauaugcaggucacaggcguggaggacgauagcagagcucugaacaucaccauucauaaacccgccucuuccccucacagcaagcccuucccgauccugcaggcuacguuuaucuucucugaccauauucgguguaucauugccaaacagagacuugcgaagggccgcauccaagcccggagaaugaagaugcagcgcauugcugcccugcucgaucugccuauccagcccaccacagagguucucggguuuggacugggcuccagcaccucuacacagcaccuuccuuucagauuuuacgaccaagggcggcgcggaagcuccgaucccaccgugcagagaagcgucuucgcuucuguggacaaaguuccuggcgaacccgccccgcggccugcgccccagcuggugcaccaugggggccgcucccggagcuuuucccucuggucucugugcgagcugcccuuccuuagccaaaagccuagacgccuggccgcuccggccuccuga

SEQ ID NO: 67545 - RNA, 591 nt, Artificial Sequence
  derived and/or modified sequence opt5 from CLEC1B__Homo_sapiens__NP_001092901
augcaggacgaggauggcuacaucacccugaacauuaagacaagaaaacccgcccucaucagcgcugugaugcaacggaauuaucugcagggggaaaacgagaaucgcacgggaacccuucagcagcuggccaagagauucugccaauacgucguuaaacaguccgaacucaagggcacauuuaaagggcacaaguguucuccuugcgacaccaacuggcgguauuacggagauagcuguuauggcuucuuucgccauaaucugacaugggaggaauccaagcaguacugcaccgacaugaacgcgacacuucugaaaauugauaauagaaacaucguggaguauauuaaggcucggacccaccucauccgcuggguggggcugucuagacagaaaagcaaugaggucuggaagugggaagacggauccgugaucucugagaacauguucgaauuucuggaggauggcaaaggcaauaugaacugugccuacuuccauaaugggaagaugcacccgacguuuugcgagaacaagcauuaccucaugugugaacggaaagccggaaugaccaagguugaccaacugcccuga

SEQ ID NO: 67546 - RNA, 525 nt, Artificial Sequence
  derived and/or modified sequence opt5 from CLEC2A__Homo_sapiens__NP_001124183
augaucaaccccgagcugagagacggccgggccgauggguucauucaccgcaucgugccuaagcucauucagaauuggaaaaucggacugaugugcuuucuuagcauuaucaucaccacagucuguauuaucaugauugcuacgugguccaagcaugccaaaccgguugcgugcucuggcgacuggcugggggugagagauaaguguuucuacuuuagcgacgauacccggaacuggacagcuuccaaaaucuucugcucucuccaaaaggccgaacuggcccagauugacacccaggaggauauggaauuucuuaagcgcuaugcuggaacagacaugcacuggaucggccugagcagaaaacagggggauuccuggaaguggaccaauggaacaaccuucaacggcugguuugagauuaucggcaaugggucuuucgccuuucucagcgcugacggagugcauuccagccggggcuucaucgauauuaaauggaucuguucuaagcccaaauacuuucuguga

SEQ ID NO: 67547 - RNA, 450 nt, Artificial Sequence
  derived and/or modified sequence opt5 from CLEC2B__Homo_sapiens__NP_005118
augaugaccaagcacaaaaagugcuucaucauugugggcguccugaucacaacgaacauuaucacccucauuguuaaacugacaagagacagccagucccuuugucccuacgauuggaucggguuucaaaauaagugcuauuacuucucuaaagaggaaggagacuggaacagcuccaaguauaauuguucuacccagcaugccgaucugacaaucauugacaacaucgaggaaaugaauuuucuccggcgcuacaagugcagcuccgaucacuggauuggccugaaaauggcuaagaacagaaccgggcaguggguggacggagccacauucaccaaaucuuuuggcaugcgggggagcgagggaugugcguaucuuuccgaugacggcgcugccacggcccgcugcuacaccgaaagaaaguggaucugucggaaacgcauucauuga

SEQ ID NO: 67548 - RNA, 585 nt, Artificial Sequence
  derived and/or modified sequence opt5 from CLEC2D__Homo_sapiens__NP_001004419
augcacgacagcaacaauguggagaaggauaucacccccuccgaacugccugccaacccgggcugccuccauucuaaagagcacagcauuaaggcuacacugaucuggagacuuuucuuucugauuauguuccucacgaucauugucugugggaugguugccgcgcuguccgcuauccgggccaauugccaucaggaacccucugugugucuucaagccgcuugcccugagagcuggaucggauuucagcgcaaauguuucuacuuuuccgacgauaccaagaacuggacaucuagccagagauucugcgacucccaggaugccgaccuggcucaaguggagagcuuucaggaacucaauuuccugcugcgguauaaaggccccucugaucacuggauugggcucucccgcgagcagggacagccuuggaaguggaucaacggcaccgaauggacaagacaacuggucaugaaggaggacggggccaaucuuuacguggcgaaaguuagccaggugccccggaugaacccucgcccggucauggugucuuaucccggauccagacggguuugucuguuugaauga

SEQ ID NO: 67549 - RNA, 645 nt, Artificial Sequence
  derived and/or modified sequence opt5 from CLEC2L__Homo_sapiens__NP_001073980
auggagcccgccagagaaccuccgagccgggcuagacccccucccccucuggccgcgcgccccgcuccugccccggccgcuccccggccucgcucccccgccgaggcugaagccagaggcccugaggggcuccugcggcgcucuggaagcggcuacgaaggguccaccucuuggaaggcggcccuugaggacacaacgaccagacugcuccugggagcuaucgccgugcuucuguucgcuauucucgucguuaugagcauccuggccuccaaaggcugcauuaagugugaggcgcccugcccggaagauuggcugcucuaugggcggaaauguuacuuuuucucugaggaaccucgcgacuggaacacaggaagacaguauugccacacccaugaggccgugcuggcugugauccaaagccagaaggagcuugaauuuauguucaaauuuacacggcgcgagcccuggauuggccugagacgggucggcgaugaguuccacugggugaauggggacccuuuugaucccgacaccuucacaaucgccggacccggcgaauguguuuuuguggaaccuacccgccucgucuccacggagugccugaugaccagaccguggguguguagcaagauggcuuacacauga

SEQ ID NO: 67550 - RNA, 609 nt, Artificial Sequence
  derived and/or modified sequence opt5 from CLEC3B__Homo_sapiens__NP_003269
auggagcuguggggcgccuaccuccugcuuugccuguucagccuccugacccaggugacaacggaacccccuacccaaaagccgaaaaagaucgucaacgcuaaaaaggacguugugaauacaaaaauguuugaggaacuuaaguccagacuggauacccucgcccaggagguggcgcugcugaaggaacagcaggcucuccaaacagucugucugaaagggaccaaggugcacaugaaaugcuuccuugccuuuacacagaccaagacguuccaugaggccucugaggacuguauuagccggggaggcacccuggggacaccccagaccggauccgaaaacgaugcucucuaugaguaccugcgccagucuguuggcaaugaagccgagaucuggcuugggcugaacgacauggcugccgagggaacauggguggauaugaccggcgcgagaauugccuauaaaaauugggaaacggagaucacagcucaaccugacggcgggaagaccgaaaacugcgccguccucagcggagcugccaauggcaagugguuugauaaacggugucgcgaccagcugcccuacauuugccaguucgggaucguguga

SEQ ID NO: 67551 - RNA, 714 nt, Artificial Sequence
  derived and/or modified sequence opt5 from CLEC4A__Homo_sapiens__NP_057268
augaccagcgagaucacauacgccgaagugagauucaagaacgaguuuaaauccucuggcauuaauacggcuagcuccgccgcgucuaaggaacggaccgcuccccacaaaagcaacacaggguucccuaagcugcucugcgccucccugcuuaucuuuuuccugcuccuggccauuagcuuuuucaucgcuuuugucauuuucuuucagaaauauagccaacuucuggagaagaagaccacaaaagaacucguucauaccacacuggagugugugaagaaaaauaugccgguggaggaaaccgccugguccugcugucccaagaacuggaaaucuuucucuuccaauugcuacuuuaucagcacggagucugcuuccuggcaggacagcgaaaaggauugugcccgcauggaggcgcaucugcucgucaucaacacccaggaggaacaggacuucauuuuucaaaaucugcaggaggaaucugccuauuucgugggacuuuccgauccugagggccagagacacuggcaguggguugaccaaacacccuacaacgaaagcuccaccuucuggcacccucgggagcccucugauccuaaugagcgcugcgugguccugaacuuuagaaagagcccgaaacgguggggguggaaugacgugaacugucucggaccccagcgcuccguuugcgaaaugaugaagauccaucuguga

SEQ ID NO: 67552 - RNA, 642 nt, Artificial Sequence
  derived and/or modified sequence opt5 from CLEC4C__Homo_sapiens__NP_569708
auggugcccgaggaggaaccucaggacagagaaaagggccuguggugguuccaacucaaagucuggagcauggccguuguguccauccugcuucugucugugugcuuuaccgucagcuccgugguuccgcacaacuucauguacucuaagacagugaaacggcucagcaagcugcgcgaguaucagcaguaccaucccucccuuacgugugucauggaagggaaagauauugaggacuggucuugcuguccuacccccuggaccagcuuucaguccagcugcuauuucaucucuacaggaaugcaauccuggacaaagagccagaagaauuguucugugaugggcgcugaucugguugugauuaacaccagagaggaacaggacuuuaucauucagaaucucaaacggaacuccagcuacuuccuggggcugucugauccuggaggccgcagacacuggcaaugggucgaccagacacccuauaaugagaacgugaccuuuuggcauuccggggaaccuaauaaccucgaugagcggugcgccaucaucaauuuccgcagcuccgaggaauggggauggaacgacauucacugucaugugccgcagaagucuaucugcaaaaugaagaaaauuuacaucuga

SEQ ID NO: 67553 - RNA, 648 nt, Artificial Sequence
  derived and/or modified sequence opt5 from CLEC4D__Homo_sapiens__NP_525126
augggccuggagaagccccagagcaaacucgaagggggaaugcacccucaacugaucccguccgugauugccgucguuuucauccuucugcucucugugugcuuuauugcuagcugucuggugacccaucacaacuucuccagaugcaagcggggcacagggguccauaaacuugagcaccaugccaagcugaaauguaucaaggaaaagucugagcucaaaagcgcggaaggauccacguggaauugcugucccauugacuggcgcgcuuuucagucuaacugcuacuucccucugaccgauaauaagacaugggccgagagcgagagaaacuguuccggcaugggggcccaccugaugaccaucagcacagaagcugagcagaauuuuaucauucaguuccucgaccggcgccugucuuauuuucuuggacugagagaugaaaacgccaaaggccaauggcgguggguggaccagacccccuucaauccucgcagaguguuuuggcacaagaacgagcccgauaauucccagggcgagaacugcguuguccucguguacaaucaggacaaaugggcuuggaacgauguuccuuguaauuucgaagccagccggaucugcaagauuccggggacaacccugaacuga

SEQ ID NO: 67554 - RNA, 660 nt, Artificial Sequence
  derived and/or modified sequence opt5 from CLEC4E__Homo_sapiens__NP_055173
augaacagcuccaagucuagcgagacccagugcacagaaagaggcuguuucuccucucaaauguuucuguggacgguggccgggauccccauucucuuccugagcgcuugcuuuaucacccggugugucguuacauuccgcauuuuucagaccugcgacgagaaaaaguuccagcuuccugaaaauuuuacagagcuguccuguuacaacuauggaucuggcagcgugaaaaauugcuguccgcucaacugggaauacuuccaguccagcugcuacuuuuucucuaccgauacaaucuccugggcccugagccuuaagaauuguucugcgaugggggcucaccugguggucauuaacucccaagaggagcaggaauuucucagcuauaaaaagcccaagaugagagaguucuuuaucggacugucugaccaggugguugaaggccaguggcaauggguggaugggaccccucugacgaaaucccucagcuucugggacgucggagagcccaauaacaucgccacccuggaggauugcgccacaaugcgggacuccucuaauccucgccagaacuggaaugaugugaccuguuuccuuaacuauuuuagaauuugcgaaaugguuggcaucaauccccugaacaagggcaaaagccucuga

SEQ ID NO: 67555 - RNA, 846 nt, Artificial Sequence
  derived and/or modified sequence opt5 from CLEC4G__Homo_sapiens__NP_001231785
auggacaccacaagauaccggcccuggggccgcugggugcacuggagcagacggccucuguuccucgcccuggcuguccuuguuacgaccgugcugugggccgugauccucuccauucugcuuucuaaggcgagcacagagcgcgcugcccugcucgaugggcaugaccugcugagaaccaacgccuccaaacagacagcugcccucggagcucugaaggaagaggucggcgauugccacucuuguugcagcgggacccaagcccagcuucagacaacccgggcggaacugggagaggcccaggcuaaacucauggaacaagaguccgcccugcgcgagcuuagagaacgggugacgcagggccuggcugaggccgggcgcggaagagaagacguucggaccgagcucuuucgcgcgcuggaggccgugagacugcagaauaacucuugugaaccgugccccacaagcuggcucuccuucgagggcagcuguuacuuuuucucugucccuaagaccacaugggcugccgcucaggaucauugcgccgacgccuccgcucaccuggugaucguuggcgggcuugaugaacaaggauuucugacccggaauacgcgcggcagaggguauuggcucggacugcgggcggugagacaucuuggcaaaguccagggguaucaguggguggacggagugagccugucuuucucccacuggaaccagggcgagcccaaugaugccuggggccgcgaaaacugugucaugaugcuccacacagggcuguggaaugacgcuccuugcgauagcgagaaggacggauggauuugugagaagcggcauaacugcuga

SEQ ID NO: 67556 - RNA, 1047 nt, Artificial Sequence
  derived and/or modified sequence opt5 from CLEC4M__Homo_sapiens__NP_001138376
augagcgacuccaaggagcccagagugcagcaacugggccuccuggggugccuuggacacggcgcccugguccuccagcugcuuucuuucaugcugcucgcugggguucugguggccauccuggugcaggucagcaaagugccuuccucucucagccaggaacaauccgagcaggaugcgauuuaccagaaccugacccagcuuaaggcugccguuggagaacugucugagaaaagcaagcuccaagaaaucuaucaggagcugacacagcuuaaagccgcugugggcgagcugccggaaaaguccaagcuccaggagauuuaccaagaacugacgcggcugaaagccgcugucggggagcuccccgaaaagagcaaacugcaggagaucuaucaggagcuuacccgccugaaggccgcggugggagaacucccugagaaaucuaagcugcaagaaauuuaccaggagcuuacagagcugaaggccgcuguuggcgaacuccccgagaaauccaagcugcaggaaaucuaucaggagcugacccaacucaaagccgcugugggcgaacugccugaccagagcaagcagcagcaaaucuaccaggagcuuacagaucugaaaaccgccuuugagagacucugucggcauugccccaaggacuggacauucuuucaggggaauuguuauuucaugucuaacucccagcgcaauuggcacgauagcgucaccgcgugccaagaagugagagcccagcugguggucauuaaaacggcugaggaacagaacuuucuucagcugcaaaccucucgguccaaucgcuucagcuggaugggacucuccgaccugaaccaggagggcacauggcaguggguugaugggucuccucugagcccguccuuucaaagauacuggaauagcggagaacccaacaauucuggcaacgaggacugugccgaguucuccgggagcggauggaaugauaaccggugcgacguggauaauuacuggaucuguaagaagccugcugccugcuuucgcgacgaauga

SEQ ID NO: 67557 - RNA, 567 nt, Artificial Sequence
  derived and/or modified sequence opt5 from CLEC5A__Homo_sapiens__NP_037384
augaacuggcacaugaucauuagcggccugaucguggucguucucaaggugguggggaugacccuguuccuucuguacuuuccccagauuuucaauaaauccaacgacggauuuacaacgaccagaucuuauggcacagucagccaaaucuucggguccucuagcccuuccccgaauggauuuauuaccacacggucuuacggcaccgugugccccaaggauugggaguucuaucaggcccgcugcuuuuuccucagcacauccgaaagcucuuggaacgaguccagagacuuuuguaaagggaagggaagcacccuggcuaucguuaauacgccugaaaaacuuaaguuccugcaggauaucaccgacgccgagaaguacuuuauuggccucaucuaucaucgggaagagaaacgcuggagauggauuaacaauucuguguucaacggcaaugucacaaaccagaaucaaaacuuuaauugugcgaccaucgggcugacaaagaccuucgaugcugccuccugcgacauuagcuaccggcgcaucugugagaaaaacgccaaguga

SEQ ID NO: 67558 - RNA, 630 nt, Artificial Sequence
  derived and/or modified sequence opt5 from CLEC6A__Homo_sapiens__NP_001007034
augaugcaggagcaacagccccagagcaccgaaaagagaggcuggcugucccuccggcuguggucuguggccgggaucagcauugcccuucuguccgcuugcuucaucgucucuuguguugugacauaccacuuuacguauggagagaccggcaaacgccucagcgaacugcauuccuaccacucuagccuuacaugcuucuccgaggggaccaaggugccugcguggggauguugcccggcuagcuggaaaucuuuuggcuccagcuguuauuucauuucuuccgaagagaaggucuggagcaaaucugagcagaacugcguggaaaugggggcccaucugguuguguuuaauacagaggccgaacaaaacuucaucguccagcagcucaaugaguccuuuagcuacuuccugggacuguccgacccccagggcaacaauaacuggcaauggauugauaagaccccuuaugagaagaaugugagauuuuggcaccucggcgaacccaaccauucugcugagcagugugccagcaucguuuucuggaaaccuacaggguggggauggaaugacgugaucugcgaaacccggcgcaacuccauuugugagaugaauaagaucuaccuguga

SEQ ID NO: 67559 - RNA, 606 nt, Artificial Sequence
  derived and/or modified sequence opt5 from CLEC7A__Homo_sapiens__NP_072092
auggaguaccaccccgaccuggaaaaccucgaugaggacggcuauacccagcugcauuucgauagccaauccaauacaagaaucgccguggucucugaaaaggggagcugcgcugccuccccuccguggcggcuuauugcgguuauccugggcauucucugucuggugauccuugugauugcugucgugcugggaacgauggggguucucucuagccccugcccucccaacuggaucaucuacgagaaauccuguuaucuguuuucuaugagccucaauuccugggacggaagcaagcgccagugcuggcagcugggcucuaaccugcuuaaaauugauuccagcaaugaacugggguucaucgugaagcaggucucuucccaaccugacaacagcuuuuggauuggacucucuagaccccagaccgaggugccuuggcugugggaggauggcuccacauucagcuccaaucuuuuucagauccggaccacagccacccaggaaaacccgucucccaauuguguuuggauucacgugagcgucaucuacgaccaacugugcuccgugccuagcuauucuauuugugagaaaaaguucuccauguga

SEQ ID NO: 67560 - RNA, 726 nt, Artificial Sequence
  derived and/or modified sequence opt5 from CLEC9A__Homo_sapiens__NP_997228
augcacgaggaagagaucuacaccagccugcagugggacucccccgccccugauacauaucaaaagugccucucuagcaacaaauguuccggcgcuugcugucuggugauggucauuucuugcguuuucuguauggggcuucugacggccagcaucuuucucggagugaagcugcuucagguguccaccauugcgaugcagcagcaagaaaaacugauccagcaggagagagcucuccugaauuucacagaauggaagcggucuugcgcccugcagaugaaauacugucaagccuuuaugcagaacagccucuccagcgcucauaauucuuccccgugccccaacaauuggauucagaaccgcgagagcuguuauuacgucucugagaucugguccaucuggcacaccagccaggaaaauugccugaaggagggcucuacacuucugcaaauugaauccaaggaggagauggacuucaucaccgggagccucagaaaaauuaagggauccuaugauuacugggugggccugucucaggacgggcauagcggacgguggcuuuggcaggauggcuccagcccuucucccggccugcucccugccgaacgcucccaaagcgcuaaccagguuuguggguaugugaaaucuaauagccugcuguccucuaacugcagcacauggaaguacuuuaucugcgagaaauacgcccucagauccagcgucuga

SEQ ID NO: 67561 - RNA, 576 nt, Artificial Sequence
  derived and/or modified sequence opt5 from CLECL1__Homo_sapiens__NP_001240679
auggugagcaacuucuuucacgucauccagguuuucgagaaguccgccacccugauuucuaaaacagaacauaucggcuuugugauuuacagcuggagaaaguccacgacccaccucgggucucggcgcaaauucgcuaucagcauuuaucuguccgaggugucucuucaaaaguacgacugccccuuuagcggaacauccuucgucguguuuagccuguuccucaucugugccauggcgggcgauguuguguaugcugacaucaaaaccgucagaacaucuccucuggaacuugccuuuccgcugcagcgguccgugagcuucaauuuuucuaccguucauaaguccugccccgccaaggauuggaaagugcacaaggggaaauguuacuggauugcugagacaaagaaaagcuggaacaagucucagaaugacugcgccaucaacaauuccuaucucauggucauucaggauaucaccgcuaugcugauuacguuccugcucuaccugcaaauggccuuucuucaguguguguauaucagcgacguguccgucuacccuaacuucuuccuguga

SEQ ID NO: 67562 - RNA, 1833 nt, Artificial Sequence
  derived and/or modified sequence opt5 from CLGN__Homo_sapiens__NP_004353
augcacuuccaggccuuuuggcugugccucggccugcuuuucaucagcauuaacgcugaguuuauggacgaugacguggaaaccgaggauuucgaagaaaauuccgaagagaucgacgucaacgagucugaacugagcuccgagauuaaguacaaaacaccccaaccuaucggggaaguuuauuuugccgagacguucgauucuggaagacucgcgggcugggugcugagcaaggcuaaaaaggacgauauggacgaggaaauuuccaucuacgaugggcggugggagaucgaggagcuuaaagaaaaucaggugccgggagaccgcggccugguccucaagucuagagccaagcaucacgccauuagcgcugugcuggccaaacccuuuaucuucgcugauaagccucugauuguucaguaugaggugaacuuucaggacgggaucgauuguggaggcgccuacauuaaacuccuggcggacaccgacgaucuuauccuggagaauuucuaugacaagacauccuacauuaucauguuuggccccgauaaaugcggggaagacuauaagcuccauuucaucuuucggcacaagcauccuaaaaccggagucuucgaggaaaagcacgccaaacccccugauguggaccugaagaaauucuuuacagaucgcaagacccaccuuuacacacugguuaugaacccggacgauaccuucgaggugcucgucgaccaaacgguggugaauaaaggcagccugcuggaagaugucguucccccuauuaagcccccuaaggagaucgaggaccccaacgacaaaaagccggaagagugggaugaaagagcuaaaauuccugaccccucugccgugaagccugaggauugggacgaauccgagcccgcucagaucgaggauagcucuguggucaaacccgccggguggcucgacgaugaaccuaaguuuauuccggaccccaaugcggagaagccugaugacuggaacgaagauaccgacggagagugggaggcuccccagauccugaauccugccugucggaucggcugcggggaauggaaacccccgaugauugauaacccuaaguacaaaggaguguggagacccccucuuguugacaaucccaacuaucagggcaucugguccccucgcaagauucccaauccggacuacuucgaggaugaccauccuuuucugcucaccagcuucucugcccugggccuugaacugugguccaugacaagcgauaucuauuuugacaacuucauuaucuguuccgagaaagaaguggcugaucacugggccgccgacggguggcgguggaagaucaugauugcuaacgcgaauaagcccggaguccucaaacaacugauggccgcugccgagggccaucccuggcuguggcucaucuaccuggugacagccgggguuccuauugcucuuaucaccucuuuuugcuggccgcgcaaggugaaaaagaaacacaaggauacggaguauaagaaaacagacauuuguaucccccagaccaagggaguccuggaacaggaggaaaaagaggaaaaggccgcgcucgagaaaccuauggaucuggaggaagagaagaaacagaacgacggcgaaaugcuugagaaggaagaggagagcgaacccgaggaaaaguccgaggaggaaauugagaucaucgaagggcaagaggaaagcaaucagucuaacaaauccggaagcgaggaugagaugaaggaagcugacgagucuacaggcagcggcgaugggccuauuaaauccgugagaaagcggcgcgucagaaaagacuga

SEQ ID NO: 67563 - RNA, 726 nt, Artificial Sequence
  derived and/or modified sequence opt5 from CLIC1__Homo_sapiens__NP_001279
auggccgaggaacagccccaaguggagcuguucgucaaggcuggcagcgacggggccaaaaucggaaacugcccuuuuucccagagacucuucaugguucuguggcuuaagggcgugaccuuuaaugugacaacggucgauaccaaacggcgcacagaaaccgugcagaagcugugucccgggggacagcucccguuccugcuuuacggcacagagguucacaccgacacaaacaaaauugaagaguuucuggaggcggugcucugcccucccagauauccuaagcuggcugcccugaaucccgaaucuaacaccgccgggcucgauaucuucgcuaaguuuagcgccuacauuaaaaauuccaacccugcucugaaugacaaccuugagaagggacugcucaaagcccugaagguccuugauaauuaucugacgucuccgcuccccgaagagguggacgagaccagcgcggaagaugagggcguuucccaacggaaauuccuggacggcaacgaacugacacucgccgauuguaaucugcuuccuaagcugcauaucgugcaggucgugugcaagaaauaccgcggguuuaccauucccgaggcuuucagaggagugcaccgguaucucucuaacgccuacgcucgcgaagaguuugccagcacauguccugacgaugaggaaaucgagcuggcguaugaacaggucgccaaggcucuuaaauga

SEQ ID NO: 67564 - RNA, 711 nt, Artificial Sequence
  derived and/or modified sequence opt5 from CLIC3__Homo_sapiens__NP_004660
auggccgagaccaagcugcagcuuuucgugaaagcuagcgaagacggcgaguccgucgggcacugccccucuugucaaagacuguuuaugguucuucugcucaagggagugccuuucacacugacgaccguggauacacggcgcagcccggacguccuuaaagauuuugcccccggcucccagcugccuauccuccuguacgacucugaugcgaagaccgacacacugcagauugaagauuuccucgaggaaacccuggggcccccugacuuucccagccuugcuccuagauaucgggaguccaacacagccggaaaugauguguuccauaaauuuucugccuucaucaagaacccgguucccgcucaggacgaggcccuguaccaacagcuccugcgcgcucuugccagacuggauagcuaucuccgggcgccucuggaacacgagcuggccggcgaaccccagcuccgcgaguccagacggcgcuuucuggacggggauagacuuacccuggcugacugcagccuccugccuaagcuccauauuguggacacggucugugcccacuuccggcaggcucccaucccggccgagcugcgcggagugagacgguaccucgauucugcgaugcaagaaaaagaguuuaaguauaccugcccucauuccgccgaaauucuggcugccuaccgccccgcuguucacccuagauga

SEQ ID NO: 67565 - RNA, 1233 nt, Artificial Sequence
  derived and/or modified sequence opt5 from CLIC5__Homo_sapiens__NP_001107558
augaacgacgaggauuacagcaccaucuaugacacaauucagaaugaaagaacguacgaggugcccgaucaaccugaagagaacgaauccccgcacuaugacgauguccaugaguaccugcggcccgagaaugaccucuaugccacccagcugaacacacacgaauacgauuucguuucuguguauaccaucaagggcgaggaaacaagccuugcuuccgugcagucugaggaccgcggguaccugcucccugaugagauuuacagcgaacugcaggaggcccaucccggagaaccucaagaggacagaggcaucuccauggaagggcuuuauucuagcacccaggaucagcagcugugcgcggcugagcuccaagagaauggauccgucaugaaagaagaccugcccagcccuucuuccuuuacaauucagcacagcaaggccuucucuaccacgaaauacuccuguuauagcgaugccgagggccuggaagagaaggaaggggcucauaugaacccggagaucuaccucuuugugaaagccggaaucgacggcgagucuauuggcaauugccccuucucccagcggcuguuuaugauccuuuggcugaaggggguuguguucaacgucaccacaguggaccucaagcgcaaaccugcugaucugcacaaucuugcccccggaacccacccucccuuucugacauucaacggcgacguuaagaccgaugugaauaaaauugaagaguuucucgaagagacgcugacaccggaaaaguauccuaaacuggcggccaagcauagagagagcaacaccgcugggaucgacauuuucuccaaguuuucugccuacaucaaaaauacaaagcagcaaaacaaugcugcccucgagcggggacugaccaaagcgcuuaagaaacuggaugacuaucucaacacaccccugccugaagagauugaugccaacaccuguggcgaagacaaggggagccgcagaaaauuccuugauggagacgagcugacgcucgcugauugcaaucugcugcccaagcuccacgucgugaagaucguggccaaaaaguaccggaacuacgacauccccgcugagaugaccggccuguggcgcuaucuuaaaaaugccuacgccagagacgaauuuacaaacaccugugcugcggauuccgagauugaacuggccuaugcugacgucgccaagcggcucagccgcucuuga

SEQ ID NO: 67566 - RNA, 2061 nt, Artificial Sequence
  derived and/or modified sequence opt5 from CLIC6__Homo_sapiens__NP_444507
auggccgaggcugccgaacccgagggcguggcgccugggccgcagggacccccugaaguccccgcuccucuggccgagagacccggcgaaccuggggccgcuggaggcgaggccgaggggccggaaggaagcgagggcgcugaagaggcuccccggggcgcggccgcuguuaaggaggccgggggaggcgggccugaccgcggacccgaagcugaggccagaggcacccgcggggcgcacggagaaacagaggccgaagagggcgcuccugagggcgccgaagugccccaagggggagaggaaacguccggcgcucaacagguggagggggccucuccgggacggggcgcccagggggaaccuagaggagaggcucagcgggagcccgaagauagcgcggccccugagcgccaggaagaggcugaacagagacccgagguccccgagggcuccgccucuggcgaagccggggacagcguggaugcugagggaccucucggcgacaacaucgaagccgaggggccggcgggagauuccguugaggcugaaggccgggugggggacucugucgaugccgagggccccgccggagacagcguggaugcugaaggcccucugggggacaauauucaggccgagggacccgcuggcgauuccguugacgccgaagggcgcgugggagauagcgucgacgcggagggcccugccggggacucuguggaugcugagggcagagugggagacuccgucgaagccggcgaucccgcuggggacggaguugaggccggcgugccggcgggggauagcguggaagccgagggaccugcuggcgacucuauggaugccgaagggcccgcuggccgggcccgcagagucuccggagagccucaacagagcggcgacgggucucuuagcccccaggccgaggcuaucgaaguggcggccggagaguccgcuggccgguccccuggggaacuggccugggaugccgcugaggaagccgagguucccggagugaaaggcucugaggaagcggcuccgggggacgcccgcgccgaugcuggcgaggacagagucggagacggcccucagcaagaacccggggaggaugaggaacggagagagcgcagccccgaaggaccucgggaggaagaggccgcgggcggggaggaagaguccccggacagcucuccccauggagaagccuccagaggcgccgccgagccugaagcucagcucagcaaccaccuggccgaggagggccccgcugaagggucuggagaggccgcgcgcgugaauggccggagagaagauggggaggccagcgaaccucgcgcucuuggacaggagcaugacauuacccuguucguuaaggccggcuacgauggggaguccaucggaaacugccccuuuucucaaagacucuucaugauucuguggcugaaaggcgugaucuuuaaugucacaaccguggaccucaagcggaaaccugcugaucugcagaaccuugcccccggcacaaauccgccuuucaugaccuuugacggggaagucaagacagaugugaacaagaucgaggaguuccuggaagagaaacucgcucccccucgcuaucccaagcugggaacccagcacccggaaagcaauuccgccggcaacgacguuuuugcgaaauucagcgccuuuauuaagaauacgaaaaaggaugcuaacgagauccaugaaaagaaucuucugaaagcccuccggaagcuggacaacuaccuuaauucuccucuccccgaugagauugacgccuauuccaccgaagacgugacagucagcgggagaaaauuccuggauggagacgagcuuacccuggcugauuguaaccuccugccuaagcugcacaucauuaaaaucguggccaagaaauaccgcgacuuugaguuccccucugaaaugacaggcauuuggcgguaucugaacaaugcguacgcuagagaugaguuuaccaacacgugccccgccgaccaggaaaucgagcacgccuauuccgauguugcuaagcggaugaaguga

SEQ ID NO: 67567 - RNA, 1932 nt, Artificial Sequence
  derived and/or modified sequence opt5 from CLINT1__Homo_sapiens__NP_001182484
augcugaacauguggaaggugagagagcucgucgacaaagccaccaauguugugaugaacuacagcgaaaucgaguccaaggugcgggaagcuacaaaugaugaccccuggggcccuucugggcagcugaugggagagauugccaaagcgacguucauguaugaacaauuuccggagcuuaugaacaugcuguggagccgcaugcucaaggauaauaaaaagaacuggagacgggucuacaagucccugcuucugcucgcuuaucugauccgcaauggcucugagagagugguuaccagcgcccgggaacacauuuacgaccugcgcucccucgagaacuaucauuucguggaugaacacgggaaagaccagggaaucaauauuagacagaaggucaaagagcugguggaguuugcccaggaugacgaucggcuucgcgaagagagaaagaaagcuaagaagaacaaagacaaguacguuggcgugucuagcgauuccgucgggggauuccgguauagcgaacgcuacgaccccgagccuaaaucuaagugggaugaagagugggacaaaaauaaguccgccuuucccuucagcgacaaacugggcgagcucucugauaagaucggcuccacaaucgacgauaccauuagcaaguuuagacggaaagaccgcgaagauucuccugagagaugcuccgacagcgaugaagagaagaaagcucggagagggcgcucccccaagggagaguucaaagacgaagaggaaacagugaccacaaagcauauccacauuacccaagccacggagaccacaaccacacggcauaagagaaccgcgaacccuucuaaaacgaucgaucugggcgccgcugcccacuacacaggggacaaggcuagcccggaucagaaugccuccacccacacaccccagagcucugugaaaaccuccgucccuagcucuaagagcuccggagaccuuguugaccuguuugauggcaccucucagagcacagggggauccgcggaccucuucggcggcuuugccgauuucgggagcgcugccgcuucuggauccuuucccagccaagugacggccaccucuggcaacggggacuucggagauugguccgccuucaaucaggcuccuagcggccccguggcguccucuggggaauuuuucggaagcgccucccagccggcugucgagcuggugucuggcagccaguccgcccugggcccucccccugccgcuagcaacucuuccgaccucuuugaucugauggggagcucucaagccacaaugaccuccagccagucuaugaacuucagcaugauguccacaaauaccguuggacuuggccugcccaugagccgcucucagccccuccaaaacguguccacgguccugcagaaaccuaauccgcuuuauaaccagaauacagacauggugcaaaagagcguuuccaagacccugcccucuaccuggagcgauccuuccgugaacauuucucucgacaaucugcugcccgggaugcagccuagcaaaccccagcagccgucccucaacacaaugauccagcaacagaauaugcagcagccuaugaacgucaugacccaaucuuuuggagcggugaaucugagcucccccagcaacaugcuuccuguccggccccagacaaaugcucugauuggcgggccuaugcccaugucuaugccgaacgugaugacgggcaccaugggaauggccccucucggcaauacacccaugaugaaccaguccaugauggggaugaacaugaauaucggaaugagcgccgcuggcauggggcugaccggaacaaugggcauggggaugcccaacaucgccaugaccucuggcacgguucagccuaagcaagaugcuuucgccaauuuugcgaacuucuccaaauga

SEQ ID NO: 67568 - RNA, 4317 nt, Artificial Sequence
  derived and/or modified sequence opt5 from CLIP1__Homo_sapiens__NP_001234926
augagcaugcugaagcccuccggccucaaagccccuaccaagauccugaaaccggggucuacagcucuuaagacgcccaccgccguggucgcgccuguugagaaaacaauuagcuccgaaaaggcuucuagcacccccuccucugagacacaggaagaguucguggacgauuuuagagugggagaacgggucugggugaacggcaauaagccuggguucauccaauuucugggagagacccaguucgcccccggccagugggccgggauuguucucgacgagccuaucggaaagaacgauggcagcguggcuggcguccgcuacuuucagugcgaaccgcugaaggggauuuucacaagacccuccaaacuuacccggaaggugcaagccgaggacgaagcuaauggacugcagacgaccccugccagccgcgcgacaucuccccucuguaccuccacagccagcaugguuucuuccagcccuucuacccccuccaacaucccgcagaaaccuagccagcccgcugccaaggagccuuccgcuacgccucccaucucuaaucugacaaagaccgccagcgaguccauuagcaaccugucugaagcgggcuccaucaaaaagggggagagagaacucaaaauuggagaucgggugcuggucggcgggacaaaggccggaguggugcgcuuucuuggcgagaccgacuucgcuaaaggcgaauggugcggggucgagcuggaugagccccucggaaagaaugacggcgccguugcugggaccagauauuuucaaugucagccgaaauacggacuguucgcccccgugcacaaggugacaaagaucggcuuuccuagcacgacccccgccaaagcuaaggcgaacgccguccggcgcgugauggcuacaaccucugccagccuuaaaagauccccuucugccagcucccugagcucuauguccagcguugcuucuuccgugagcucccggcccucucgcacagggcuccugaccgaaacgagcuccagauaugcccggaagauuucuggaacaaccgcgcugcaggaggcucucaaagaaaagcagcaacauaucgagcagcugcuugccgaacgcgaucuggagagagccgaggucgcuaaggccaccagccacgugggcgaaauugagcaggaacucgcucuggcccgggacggccaugaucaacacguucuugagcuggaagcgaaaauggaccagcucagaacaaugguggaggccgcugaucgcgagaaggucgaacugcugaaucagcucgaggaagagaaacggaagguggaggaccugcaguucagagucgaagaggaauccaucaccaaaggggaccuugagcaaaagagccagaucucugaagauccggagaacacacagacgaagcuggagcaugcccgcauuaaagaacucgagcagucccugcuuuuugaaaagaccaaagcugacaagcugcaacgggagcucgaagauacaagaguggccaccguuagcgagaaaucucgcaucauggagcuggaaaaggaccuggcgcuccgggugcaggaggucgccgaacugagacgccggcuugaguccaauaagccugcuggagauguggacaugagccugucucuccugcaggaaauuagcucccugcaggagaaacuugagguuacaagaaccgaucaccaacgcgaaaucacgagccucaaggagcacuucggcgcccgggaagagacccaucagaaagagauuaaggcucuguacacagccaccgaaaaacugucuaaggagaacgaaucccucaaaagcaagcuggagcacgccaauaaggaaaacuccgacgugaucgcucuuuggaaaucuaagcuggagacagcgaucgccagccaucagcaggcuauggaggaacucaaagucuccuucucuaaggggcugggaaccgagacggccgaauuugccgagcugaaaacacaaauugaaaagaugagacuugauuaucagcacgagaucgagaaucuccagaaccaacaggacagcgaacgggcugcccacgcgaaggagauggaagcucugcgcgccaaacugaugaaggugauuaaagagaaggaaaacucccucgaggccaucagaucuaaacuggauaaggcugaggaccagcaucuuguggaaauggaggacacccugaauaagcuccaggaagccgagauuaaaguuaaggagcuggaaguccugcaagcgaaaugcaacgagcagacaaaggugaucgauaauuucaccagccagcuuaaagcuaccgaagagaagcuccuggaccuggaugcccuccggaaggccuccagcgaaggcaaaucugagaugaagaaacugagacagcaacuugaggcugccgaaaagcagaucaaacaccuggagauugaaaagaacgcugaguccagcaaagccucuuccaucacacgcgaacuccaggggcgggagcugaagcugacgaaucuucaggagaaccucagcgaagugucucaagucaaggagacccuggaaaaagagcugcagauucucaaggaaaaauuugcggaggccuccgaggaagcugugagcguucagagauccaugcaagagacagugaauaagcugcaucagaaagaagaacaguucaacaugcuuagcucugaccuggagaagcuccgcgaaaaucuggccgauauggaggcuaaguuuagagaaaaagacgagcgggaagaacagcugaucaaggccaaagagaaacuugaaaacgauauugccgagaucaugaaaaugagcggcgacaauuccucucaacugaccaagaugaacgaugaacuccgccugaaggagagagacgucgaagaacuccagcugaaacuuacaaaggcuaaugagaacgcgagcuuccugcagaaauccauugaagauaugaccgugaaggccgagcagucucaacaggaagcugccaaaaagcacgaggaagagaagaaagagcucgaacggaagcugagcgaccuggagaaaaagauggaaacgucccauaaucagugucaggagcuuaaagcccgcuacgagagagcuacaucugaaaccaagaccaagcacgaggaaauccugcaaaaccuccagaaaacacugcucgauaccgaggacaagcugaaaggagcccgggaagagaacagcggccuucugcaggagcucgaggagcugcgcaagcaggcggacaaagcuaaggccgcccaaacagcugaagaugccaugcagaucauggagcagaugacgaaagaaaagaccgagacacuggcgucccuugaggacaccaagcaaacaaaugcuaaacugcagaacgaacucgauacccugaaggagaauaaccucaaaaauguugaggagcugaacaagagcaaagaacuucugacgguggagaaucagaagauggaggaauuuagaaaggagauugaaacccugaaacaggccgccgcucaaaagucucagcagcucuccgcccugcaggaggagaacgucaaacuugcugaggagcuggggcggagccgcgacgaagugacaucucaccaaaagcucgaggaagagagauccguucugaauaaccagcuccuggagaugaaaaagcgggaaagcaaguucaucaaagaugccgacgaggaaaaggcgucccuucagaaaucuauuagcaucaccuccgcccugcugacagagaaggaugcugaacucgagaaacugagaaaugaggugaccguccuucgcggagaaaacgccagcgcuaagucucugcauuccguggugcagacacucgagagcgacaaggucaaacuggaacucaagguuaaaaaucuggagcuucaacugaaggaaaacaaacggcagcugucuagcuccucuggcaauaccgauacgcaggccgacgaggaugagagagcccaagaaagccagauugacuuucucaacuccgugaucguggaucugcagcgcaagaaccaggaccuuaaaaugaaggucgagaugaugucugaagcugcgcugaaugggaacggagacgaucucaauaacuaugacagcgaugaccaagagaagcaguccaaaaagaaaccccggcuguucugcgauaucugugacugcuuugaucuccacgacacagaggauuguccuacccaggcccagaugagcgaagaucccccucauucuacccaccacggcuccagaggggaggaacgccccuacugcgagauuugugaaauguucggccauugggcuacaaauugcaacgacgacgagaccuuuuga

SEQ ID NO: 67569 - RNA, 3141 nt, Artificial Sequence
  derived and/or modified sequence opt5 from CLIP2__Homo_sapiens__NP_003379
augcagaagcccagcggacugaaaccuccggggagaggaggcaagcacuccucucccauggggcggaccagcacaggauccgccucuagcuccgcugccguggcggcuucuagcaaagagggcuccccucuccauaagcaaagcucugggcccuccagcucuccugccgccgcugccgcucccgaaaaaccuggaccgaaggccgcggaggucggcgacgauuuccugggcgacuuuguugugggggaacgcgugugggucaacggagugaagcccggcguugugcaguaccuuggggagacgcaguucgccccuggacagugggcuggcgucgugcuggaugaccccguugggaaaaaugauggagccgugggcggcgucagauauuuugaaugcccugcucuccaagggaucuucacccggcccuccaagcugacacgccagccgaccgccgagggaagcggcucugacgcgcacuccguggagagccuuacagcccagaaccugucccuccauucugggaccgcuacaccuccccugaccagcagagugauuccucugcgggaauccguccucaauagcucuguuaaaacgggaaacgaguccggcagcaaucugucugauagcggguccgugaagcgcggagaaaaagaccuuagacugggcgaucgggugcucgucggcgggaccaagacaggagugguucgcuacgugggcgagaccgacuuugccaagggggagugguguggagucgaacuggaugagccccuuggcaaaaacgacggggcuguggccggcacaagauauuuccagugucccccuaaguuuggacuguucgccccgauccacaaaguuauucggaucggcuuucccucuaccagcccugcuaaggcgaaaaagacgaaacgcauggccauggggguguccgcucucacacauagccccucuuccagcucuauuuccagcgucuccucuguggccagcuccgucggaggcagaccuucucggagcgggcugcugaccgaaacauccagccgcuacgccagaaagaucucuggaaccaccgcucuccaagaggcccugaaggaaaaacagcagcacaucgagcagcuucuggcggagcgggaucucgaaagagcugagguggccaaggccacaucccacauuugcgaaguugagaaagaaaucgcucugcuuaaggcccaacaugagcaguauguggcugaggccgaagagaaacugcagcgcgcgcggcuccuggucgaaagcgugagaaaggagaagguugaccugucuaaucaacucgaagaggagcgccggaaaguggaagaccugcaguucagagucgaggaagaguccauuacgaagggcgaucuugagacccagacacagcuggaacacgcccgcaucggggagcucgaacaaagccugcuucuggagaaagcucaggccgaacggcuccugagagagcuggcugacaaccgccucaccacaguggccgagaagucucgggugcugcagcuugaagaggaacugacccucagacgcggcgagauugaagaacugcagcaaugccugcuucauagcggacccccgccucccgaucacccugacgcggccgagauccuccggcugagagaacggcugcucuccgcuagcaaagagcaccagcgcgaaucuggcguucugagagauaaguacgagaaggcccuuaaggcuuaucaggccgaagucgacaagcugcgggccgcuaaugagaaauacgcgcaggagguggccgggcucaaggauaaagugcaacaggcuacguccgaaaacaugggacugauggacaauuggaaaagcaagcuggauucccuugccucugaccaucagaaaagccucgaggaucugaaggccacacugaacuccggccccggggcucagcaaaaagaaauuggagagcucaaggccgucauggagggcaucaaaauggaacaccagcuggagcuugggaaucugcaggcgaagcaugaccucgaaaccgcuaugcacgugaaagagaaggaagcccugagagagaagcugcaagaggcccaggaggagcuugcuggccuccagcgccauuggcgggcccagcuggaaguucaagcgucucagcacagacuggagcuccaggaagcucaggaccaacgcagagaugccgagcugcgggugcacgagcuugaaaaacuggacgucgaguaccgcggacaggcccaggcuaucgaauuucucaaggagcagauuagccuggccgagaaaaagaugcuggauuaugagagacuucaacgggcugaggcccagggcaaacaggaaguggagucccuccgcgaaaagcugcugguugcggagaacagacuccaagccguggaggcucuguguucuagccagcauacccacaugaucgaauccaaugacauuagcgaggaaacaauccggaccaaggagacagucgaagggcuucaggauaaacugaacaagcgcgacaaagaggugacggcccucaccucucagacagagaugcugagagcucaaguuuccgcccuggaaagcaagugcaaaucuggagagaagaagguggaugcccuucugaaagaaaagcggcgccucgaggcugaacuggagaccgucuccagaaaaacacaugacgcgagcggccagcucgugcugauuucucaggagcuucugcggaaggaaagaucccucaacgagcugcgcgugcugcuucuggaagccaaucggcacagcccugggcccgagagagaucucucccgcgaaguccacaaagcugaguggcggaucaaggagcagaagcugaaagacgauaucagaggacuccgcgaaaagcugaccggccuugacaaagaaaagagccugucugaucaacggagauacagccucauugacccguccucugccccugaacugcugcgccuucagcaucagcugaugagcacggaggacgcccuccgggaugcucuggaccaggcccaacagguugagaaacucauggaagcgaugagauccugucccgauaaggcucagaccaucgggaacucuggcagcgccaauggcauucaccagcaagacaaagcccagaagcaggaggauaagcauuga

SEQ ID NO: 67570 - RNA, 1581 nt, Artificial Sequence
  derived and/or modified sequence opt5 from CLK1__Homo_sapiens__NP_001155879
auggccgcuggcagacggcccgccagcgcgcuguggccugagcgcagaggguccccgcuccggggagaccugcuuggcuuccaaaacgugcgcgaacccucuagcugcggggagacccuguccggaaugagacacucuaagcggacauacuguccugauugggacgauaaagacugggauuauggcaaguggcgcagcuccucuagccauaaaagacggaagcgcucccacagcucugcucaagaaaauaaaagaugcaaguacaaccauuccaagaugugugacagccacuaucucgagucucgguccaucaaugaaaaagauuaccauagccgcagauauauugacgaguaccggaacgauuauacgcaggggugcgagcccggacaccgccagagagaccacgaaucucgguaccagaaucauuccagcaaguccucuggcagaagcggccgcuccagcuacaaaucuaagcaccggauccaucacuccaccagccacagacgcucucaugggaaaagccaccggagaaagcgcacacgguccgucgaggaugacgaagagggacaucugauuugucaaucuggcgauguucuuagcgccagauaugagaucguggacacccugggggaaggagccuuuggcaagguggucgagugcauugaccacaaagcugggggacgccauguggccguuaagaucgugaaaaacgucgaucgguacugugaagcugccagauccgagauccaggugcucgaacaccugaauacaaccgacccuaacagcacauuccgcugcguucagaugcuggagugguuugagcaccauggccacauuuguaucguguucgaacuccugggccuuucuaccuaugauuuuauuaaggagaauggguuccugcccuuucggcucgaccauaucagaaaaauggcguaccagauuugcaaguccgucaacuuccugcacagcaauaaacuuacgcacaccgaucugaagccugaaaacauccucuuugugcaaucugacuauacagaggccuacaauccgaagauuaaacgggaugaacgcacccugaucaaccccgacaucaagguggucgauuucggauccgcuacauaugacgaugagcaucacagcacccugguuuccacgagacauuaccgggccccugaggugauucucgcucugggcuggucucagcccugugacguguggagcaucgggugcauucuuaucgaauacuaucugggauuuacagucuucccuacccacgacuccaaagagcaucucgccaugauggaacgcauucugggcccccuuccgaagcacaugauccagaaaacaagaaagcggaaguacuuucaccaugauagacuggacugggaugagcacucuagcgcggggcgcuauguguccagacggugcaaaccucucaaggaauuuaugcugagccaggacguugagcaugagcgccuguucgaucucauccagaaaaugcuggaauacgaccccgccaagagaauuacccuucgggaggcucugaaacacccuuucuucgaucuccugaagaagucuaucuga

SEQ ID NO: 67571 - RNA, 1500 nt, Artificial Sequence
  derived and/or modified sequence opt5 from CLK2__Homo_sapiens__NP_001281267
augccccacccuagacgguaccauagcuccgagcgcggcucuagagggagcuaucgggaacacuaccgcuccagaaagcauaaacggcgcagaucucggagcugguccucuagcuccgaccgcaccagacggcgcagacgggaggauagcuaucacgugcgcucuagauccagcuacgacgaucggucuuccgacagacgcgucuaugaucggagauacugcggaagcuaucgccggaacgacuacucuagagaucgcggcgacgccuacuaugauacagacuaccggcauuccuaugaauaccagagagagaauagcuccuaucgcucucaacggagcuccagacgcaagcaccggagacggcgcagacggagcagaacguucucucgcuccagcucucagcacagcucccggagagcuaaaucuguugaagaugacgccgaggggcaucugaucuaccacgugggagauuggcuccaggagcgcuaugaaauugugagcacccugggcgaggggacauuuggaagagucgugcaguguguugaccaucggcgcggcggcgcgagaguggcucuuaagaucauuaaaaacgucgaaaaguacaaggaggccgcccggcuggagaucaaugugcucgaaaagauuaacgagaaggacccggauaauaaaaaccugugcguucaaauguucgacugguuugauuaccacgggcacauguguaucuccuucgaacuucugggacucagcaccuuugacuuccugaaggauaauaacuaucugcccuacccuauccaucaggugcgccacauggcuuuucagcucugccaggccgucaaauuccugcaugacaauaaacuuacacacaccgaucugaagcccgagaacauucucuuugucaauucugacuaugaacugacauacaaccuugagaaaaagagagaugagcgguccgugaaaagcaccgcugugcgcguuguggacuucggcucugccacguuugaucaugaacaccacuccaccaucgugagcacaagacauuaucgggcgccugaggucauucuggaacucggguggucccaacccugugacguguggucuaucggaugcauuaucuucgaguacuauguuggcuuuacccuguuccagacacacgacaaucgcgaacaucuggccaugauggagcggauucucgggccuaucccgagcagaaugaucagaaagacccgcaaacagaaguacuucuaccggggaagacuggauugggacgagaacacguccgcuggccgcuaugugcgggaaaauuguaaaccccuuagacgcuaccugacaucugaggccgaggaacaccaccagcucuuugaucugauugaaagcaugcuugaguaugagccugcuaagcggcugacccucggcgaagcccugcaacaucccuucuuugcgagacugcgcgccgagccucccaacaagcucugggacuccagccgggauaucucuagauga

SEQ ID NO: 67572 - RNA, 366 nt, Artificial Sequence
  derived and/or modified sequence opt5 from CLLU1__Homo_sapiens__NP_001020404
auguucaacaagugcagcuuucacuccucuaucuacagacccgccgcugacaauagcgccuccucucugugugcgauuaucugcuuccucaaccuggugauugagugugaucuugaaaccaauagcgagaucaacaaacugauuaucuaucucuuuucccagaauaaccggauccgcuucucuaagcugcuucugaaaauucucuuuuacaucagcauuuucuccuauccugaacugaugugcgagcaauacgucacauuuaucaagccgggcauucauuaugggcagguuagcaaaaagcacaucauuuacucuacguuccuguccaagaauuuuaaauuccagcuccugagaguguguugguga

SEQ ID NO: 67573 - RNA, 3009 nt, Artificial Sequence
  derived and/or modified sequence opt5 from CLMN__Homo_sapiens__NP_079010
auggccgcucacgagugggacugguuccagagagaggaacugaucggccaaauuagcgauauccgggugcagaaccuccaggucgaacgcgagaauguucagaagagaaccuuuacacgguggauuaaccugcaucuugaaaaaugcaaucccccucuggaggugaaggaccucuucguggauauccaagacgggaaaauucugauggcccuucuggagguccucuccggacgcaaccugcugcacgaauacaagucuagcucccauagaaucuuucggcucaauaacaucgcgaaagcucugaaguuccuugaggauucuaaugugaagcugguuagcauugacgccgccgaaaucgcugauggcaacccgucccucgugcuggggcuuauuuggaauaucauucuguuuuuccagaucaaagagcucacgggaaaccugucucgcaauagccccuccagcucucuguccccuggcagcgggggaaccgacucugauuccagcuuucccccuacacccaccgccgagagaucugucgcuauuuccgugaaggaccagcggaaagccaucaaggcgcuccuggccuggguucagcgcaaaacaagaaaguauggcguggcuguccaagauuucgccggcagcuggcgguccgggcuugcuuuucuggccgugaucaaggcgauugacccuucucucguggauaugaaacaggcccuggaaaacagcacccgcgagaaucuugaaaaggcuuucuccaucgcccaggacgcucugcacauuccgagacuccuggagcccgaagacaucauggucgauacaccugacgagcagagcauuaugaccuacguugcccaauuucuggagcgguuccccgaacucgaggccgaagauaucuuugacucugauaaagaggugccuaucgaauccacguucgugcgcauuaaggagacccccagcgagcaggaaucuaaagucuucgugcugacagagaacggagaaagaaccuauacaguuaaucaugagaccagccacccgccucccuccaagguguuugucugugacaaaccugaaucuaugaaggaguuccggcuugauggcgugagcucccacgcucugagcgacucuuccacggaguuuaugcaucagaucauugaucaaguucuccaagggggacccggcaagacaagcgacaucucugaacccuccccugagagcuccauucugucuagcagaaaagaaaacgggcgcuccaacucucuuccgaucaagaaaaccgugcacuucgaggcggauacauacaaggaccccuuuugcagcaaaaaucugucccucuguuucgagggaagcccucgggucgccaaggaaucucugagacaggacggccaugugcuggcugucgagguggccgaagagaaggaacagaaacaggaguccagcaagauccccgagucuuccagcgauaaaguugccggcgacauuuuucucguggaagggaccaacaauaacucucagagcuccagcugcaauggagcucuggagucuaccgcccgccacgaugaagagucccacagccuuuccccucccggcgaaaacacagucauggcggacucuuuccagaucaaggugaaucugaugacgguugaggcucucgaggaaggggauuauuuugaggccauuccgcugaaagccagcaaguucaacuccgaccugaucgauuuugcuucuaccagccaggccuucaauaaggugccuagcccccaugaaacaaaaccugacgaggaugcugaagccuuugagaaccacgcggagaaacuuggaaagcggucuauuaagagcgcccauaaaaagaaggacucccccgaaccucaagucaaaauggauaagcacgagccccaucaggacagcggcgaagaggcugagggguguccgucugccccugaagagacccccguggauaaaaagcccgaagugcacgagaaagcuaagagaaaauccacacgcccucacuacgaagaggagggagaagacgacgaucuccagggcguuggcgaggaacuguccucuuccccgcccagcucuugcgucucccuggagacccucgggagccauuccgaagagggacuggacuucaagccuucucccccucuuagcaaggugagcgugaucccccacgaucuguucuauuuuccucauuacgaggucccccucgccgcggugcuggaagccuacguugaggacccggaagaucugaaaaaugaggaaauggaccuugaggagccugaaggcuauaugcccgaucucgacucccgggaggaagaggcugaugggucucagagcuccucuagcuccucugugccuggagagagccugcccuccgccagcgaccaaguccuguaccucucuagaggcggggugggcacgacaccggcuuccgaaccugcuccccuggccccucacgaggaucaccagcagcgcgaaaccaaggagaacgaccccauggauagccaucagucucaagaaucccccaaucuugagaacauugccaauccucuggaggaaaacguuaccaaagagagcaucuccucuaagaaaaaggaaaagcggaaacacguggaccaugucgagagcucccucuucguggcgccgggaagcguucagucuuccgacgaucuggaagaggacagcucugauuauagcauccccuccagaacaucucacagcgacuccucuauuuaccugcgccggcauacccacagaagcuccgagagcgaucacuuuucuuaugugcagcuucggaacgccgcugaccucgaugaccgcagaaaucggauccugacaagaaaggccaacuccagcggcgaagccaugucccuggggucucauagcccucaauccgauucucucacgcagcugguccagcagcccgacaugauguacuucauucuuuuucuguggcuccugguguauugucugcuucucuucccucaacuggaugugagccgccuguga

SEQ ID NO: 67574 - RNA, 1122 nt, Artificial Sequence
  derived and/or modified sequence opt5 from CLMP__Homo_sapiens__NP_079045
augagccugcuccugcuucugcuccugguguccuacuaugucggcacccuugggacacacacggagaucaagagaguugccgaagagaaagugacccugcccugccaucaccagcucggacugccugaaaaggacacacuggauauugaguggcuccugaccgacaacgaaggcaaucaaaaaguggucaucacauacucuagccggcauguguauaacaaucuuaccgaggagcagaaggggcgcguugcuuucgccuccaacuuucuggcgggagaugcuucucuccagauugaaccgcugaaacccagcgacgagggcagauacacauguaaggugaagaauagcgggcgguaugucuggucucacgugauccuuaaaguucuggugcgcccuagcaagcccaaaugcgaacucgagggagagcugaccgaaggcuccgaucugacgcuccagugugaguccucuuccggcaccgaaccuauugucuacuauuggcaaagaauccgggagaaggaaggggaggacgagcgccugcccccuaaaagcagaaucgauuacaaccauccgggacgggugcuucugcagaaucucacaaugucuuacuccggccuguaucagugcaccgccgggaacgaagccggaaaggagagcugugugguccgcguuacagugcaguacgugcaaucuauuggcauggucgcuggggccgugaccggaaucguugcuggcgcccuucugauuuuccuccugguguggcugcucaucagacggaaggacaaagaacgcuaugaggaagaggagagacccaaugaaauucgggaggaugcggaagccccuaaggcucgccuggucaaacccuccagcuccucuagcggcuccagaagcucucgguccgggagcucuagcacgagauccacagccaacucugcuagccgcucccagcggacccuuagcacagacgccgcgccucagcccggacuggccacccaggcuuacucucucgugggcccggagguuagaggguccgaaccuaagaaagugcaccacgccaaucugaccaaggcugagacaacgcccagcaugaucccuucucaaucccgcgccuuucagaccgucuga

SEQ ID NO: 67575 - RNA, 1317 nt, Artificial Sequence
  derived and/or modified sequence opt5 from CLN3__Homo_sapiens__NP_000077
augggcgggugcgcuggaagcagacggcgcuucuccgacucugagggcgaagagaccgugcccgaaccuagacugccgcuccuggaucaccagggggcucauuggaagaacgccgucggauuuuggcuucugggccucuguaauaacuucagcuacguugugaugcuguccgcggcucacgacauccuuucucauaaacggacaagcgggaaucaaucccacguggaucccggaccuacgcccauuccucauaacucuagcucccgcuuugacugcaauagcgucucuaccgccgccgugcugcucgcugauauccugcccacacugguuauuaagcuccuggccccucuuggccugcaccuccugccguauucccccagagugcuugucagcggcaucugugcugccgggucuuucgugcugguugcguuuucccacagcgugggaaccucucucugcggcgucguguucgccuccauuagcuccgggcugggagaggugacauuucugucucucaccgcuuucuacccucgggccgucaucagcuggugguccagcggcacagggggagcuggccugcuuggcgcccugucuuaucucgggcugacccaggcgggacuuuccccgcagcagacgcugcucagcaugcugggcaucccugcccugcuccuggcuucuuacuuucuucugcucaccagccccgaagcccaagaccccgggggagaggaggaagcugaguccgccgcccgccagccucugauuagaacagaagcucccgagucuaaaccuggcagcuccagcucucuuucccugcgggagcgcuggaccguuuucaaggggcuccugugguauaucgugccccugguggucguguacuuugcggaauauuucauuaaccagggacucuuugagcugcuuuucuucuggaauacaagccugucucaugcccagcaauacagaugguaccagaugcucuaucaggcuggcguuuuugccucccggagcucccugcgcuguugcagaauccgguucaccugggcccuggcccuucuccagugucugaaccugguguuucuccuggccgaugucugguucggcuuucuucccucuauuuaccugguguuccucaucauucuguaugaagggcugcuuggaggcgcggcuuacguuaauacguuucacaacaucgcccucgagacaagcgacgaacaucgcgaguucgccauggcugcuaccugcaucuccgauacacuggggauuucucugagcggacuccuggcccuuccucugcacgacuuucucugucaacuguccuga

SEQ ID NO: 67576 - RNA, 1224 nt, Artificial Sequence
  derived and/or modified sequence opt5 from CLN5__Homo_sapiens__NP_006484
augagacggaaccugcgccucggccccagcuccggggccgacgcucagggacaaggcgccccuagaccggggcuggcggcuccccggaugcuucugccucccgccucucaggccagccgcggauccggcucuaccgggugcagccucauggcucaggagguggauacagcccagggagcugaaaugagacggggcgccggcgcggcccgcgggagagcuuccugguguugggcccuggcccuucuguggcucgcugucguuccuggauggucucgggugagcggcauccccucccgcagacacuggccugugccguacaagcgguucgacuuucgccccaaaccugaucccuauugccaagcgaaguacacguucuguccuaccgggagccccauuccggucauggagggagacgaugacaucgaaguguuuagacugcaggccccuguuugggaguucaaauauggcgaucugcucgggcaucugaagauuaugcacgacgcuaucggauuucggucuacacuuaccggcaaaaauuacacaauggaaugguaugagcuguuccagcucggcaacugcaccuuuccccaucugcgcccugagauggaugcccccuucugguguaaucagggggcugccugcuuuuucgaaggaauugacgaugugcacuggaaggagaacggcacacuuguccaaguggccaccaucuccgggaauauguuuaaccagauggcuaaguggguuaaacaggacaaugaaacgggaaucuacuaugagaccuggaacgugaaggcgagccccgagaaaggcgccgaaacaugguucgauucuuacgacuguuccaaguuuguccugagaaccuucaauaaacucgcugaguucggggccgaauuuaagaacauugagacaaauuacacccggaucuuccuguauagcggagaaccuacguaccugggcaacgagacaucuguguuuggcccgaccgggaauaagacacucggacuggccauuaaaagauucuauuaccccuuuaagccucaucuucccaccaaagaguuccugcucucccugcuucagaucuuugacgcugugauuguccacaagcaauucuaucuguuuuacaacuucgaauauugguuucucccuaugaaauuccccuuuaucaagauuaccuacgaggaaaucccgcugccuauccgcaauaaaacacugagcggccucuga

SEQ ID NO: 67577 - RNA, 936 nt, Artificial Sequence
  derived and/or modified sequence opt5 from CLN6__Homo_sapiens__NP_060352
auggaggccaccagacggcgccagcaccugggcgcuacagggggacccggcgcccaacucggggcgagcuuccugcaggcuagacauggauccgugucugccgacgaagccgcucggacggccccuuuucaccuugaucugugguucuacuuuacccuccagaacuggguccuggacuucggccgcccgaucgcuaugcuuguuuuuccccuggagugguucccucucaauaagcccagcgugggggauuauuuucauauggccuacaacgugauuacaccuuuccugcugcucaaacugaucgaaagaucuccccggacccuuccucgcuccauuacauaugucagcaucauuaucuuuaucaugggagcguccauucaccuggugggcgacucuguuaaucauagacuccuguucagcggcuaccagcaccaccuuuccgugcgggagaacccgaucauuaagaaucugaaacccgaaacccucaucgauagcuuugagcugcuguauuacuaugacgaguaccucgggcauugcaugugguacauuccuuucuuucugauccuuuucauguauuucucuggauguuuuacagccuccaaggcugaaagccugauucccggcccugcccuccugcuugucgcucccucugggcuguacuauugguaccucgugaccgagggacaaaucuucauccuguuuauuuucacguuuuucgccaugcuggcgcucguucugcaccagaaacgcaagagacuuuuucuggauuccaacggccucuuccuguuuagcucuuucgcccuuacccugcuccugguggcucugugggucgccuggcucuggaaugacccggugcugcggaagaaauauccuggggugaucuacguccccgaaccuugggcuuuuuauacacuucauguuuccagccgccacuga

SEQ ID NO: 67578 - RNA, 861 nt, Artificial Sequence
  derived and/or modified sequence opt5 from CLN8__Homo_sapiens__NP_061764
augaaccccgccagcgacggcgggaccuccgagucuaucuucgaucuggacuacgcuagcuggggaauuagauccacacucaugguggccggcuuugucuucuaucuggggguuuuuguggugugccaccagcuuucuagcucccugaaugcgacguaccggucucucgucgcucgcgaaaagguguucugggaucuggccgccaccagagcuguuuuuggagugcaaagcacagccgcuggccuuugggcccugcucggggacccuguccugcaugcggauaaagcccggggacagcagaacugguguugguuccacaucaccacagcuaccggcuuuuucugcuuugagaauguggccguucaucuguccaaccucauuuuccgcacauuugaccuguuccuugugauccaccaucuguuugcuuuccucggcuuccuggggugucuugucaaucugcaggccggacacuaucucgcgaugaccacgcugcugcucgaaaugagcaccccguuuacaugcgugucuuggaugcugcuuaaggccggcugguccgagagccuguucuggaaacucaaccaauggcugaugauucacauguuucauuguagaauggugcuuaccuaccacauguggugggucugcuucuggcauugggaugggcugguuucuucccucuaucugccccaccugacacucuuucuggugggacuugcucugcucacccugaucaucaauccuuacuggacgcacaagaaaacacagcagcuucugaaccccguggacuggaauuucgcccagccugaagcuaagagccggcccgagggcaacgggcaacuccugcgcaagaaaagaccuuga

SEQ ID NO: 67579 - RNA, 1287 nt, Artificial Sequence
  derived and/or modified sequence opt5 from CLNK__Homo_sapiens__NP_443196
augaacagacagggcaaucggaagaccacaaaagaggggagcaacgaccugaaguuccaaaauuuuucccuccccaaaaaccgcucuuggccuagaaucaauagcgccacgggacaguaccagcggaugaacaagccgcugcuugauugggaacgcaauuucgcugccgugcuggacggcgcgaaagggcacuccgaugacgauuaugacgaucccgagcucagaauggaagagaccuggcagucuauuaagauccugccugcucggcccauuaaggaaagcgaguacgccgacacacauuauuuuaaagucgccauggauaccccucuuccccuggacacacgcaccuccaucucuauuggacaaccuacauggaacacccagacgagacucgagcggguugauaagccgaucagcaaagacgugcgcucccagaauaucaagggcgaugcuagcgugcgcaaaaacaagauuccccugccucccccucggccccugaucacccucccgaagaaauaccagccucugcccccugaacccgagucuuccagacccccucuuagccaaagacacacauucccggaaguccagcggaugcccucucagauuucccugcgcgaccucagcgaggugcuggaggccgaaaagguuccucauaaucagagaaaacccgagucuacccaccuucuggaaaaccaaaauacacaggagaucccucucgcuauuuccagcuccucuuuuaccacgagcaaccauuccgugcagaaucgggaccacagagggggaaugcaacccugcagcccgcagcgcugucagccucccgccucuugcuccccucacgaaaacauccugcccuauaaguacacaagcuggcggccucccuucccgaaaagaucugaucgcaaggacguccagcauaacgagugguauauuggcgaguacagccggcaagcgguggaagaggccuuuaugaaagaaaauaaggauggcuccuuccugguuagagacuguucuaccaagagcaaagaggaaccuuacgugcucgcugucuuuuaugagaacaagguguacaaugugaaaauccgcuuccuggagcggaaccagcaguuugcccuugggacaggacugagaggcgaugaaaaguucgacuccgucgaggauaucauugaacacuauaaaaauuuucccaucauucucaucgacgggaaggauaagaccggaguucaucgcaaacagugccaccugacccaaccccuuccucugacacggcaccuccugccgcuguga

SEQ ID NO: 67580 - RNA, 714 nt, Artificial Sequence
  derived and/or modified sequence opt5 from CLNS1A__Homo_sapiens__NP_001284
augagcuuccugaaguccuuucccccuccgggccccgccgaggggcuccugagacagcaaccugacaccgaagcugugcuuaacggaaaaggccuggggacaggaacgcucuacaucgccgagucucggcugagcuggcuugauggcuccgggcugggauucucucucgaauaucccaccauuagccugcacgcgcugucccgcgacagaucugauugccucggcgagcaucuguacgucaugguuaaugcuaaguuugaagaggagagcaaagaaccuguggccgacgaggaagaggaggauuccgacgaugacguggaacccaucacagaguuccgguuugucccuagcgauaagucugcccuugaagcuauguucaccgccaugugugagugccaggcucugcacccggaccccgaagaugaggacuccgaugacuaugacggcgaggaauacgauguggaggcccaugaacaggggcagggagacauuccuacauuuuauaccuacgaggaaggccucagccaccugacagcggaggggcaagccacccuugagcgccuggaaggaaugcucucucaguccguuagcucucaguauaacauggcuggcgugagaacggaggauuccauccgggacuacgaagaugggauggaggucgacaccacacccaccguggccggacaguucgaagaugcugacguugaucauuga

SEQ ID NO: 67581 - RNA, 2541 nt, Artificial Sequence
  derived and/or modified sequence opt5 from CLOCK__Homo_sapiens__NP_004889
augcuguucaccgugagcugcuccaagaugucuagcaucgucgacagagaugacuccucuauuuuugauggccucguugaggaagacgauaaagacaaggccaaacgggugagccgcaacaaguccgagaaaaagagacgggaucaguucaaugugcugaucaaggaacuugggucuaugcugcccggaaacgcucgcaaaauggacaagagcacaguccuccaaaaauccauugauuuucugagaaagcacaaagagaucacggcccagagcgacgcgucugaaauucggcaggauuggaagccuaccuuccuuuccaaugaggaguuuacacagcugaugcucgaagcucuggacggcuucuuucuggccaucaugaccgaugggagcaucauuuacgugucugaguccguuacaagccuccuggaacaucuuccgucugaccugguggaccaauccaucuucaacuuuauucccgagggagagcacagcgaagucuauaagauccucuccacccaucugcuugagucugauagccugacaccugaauaccucaaauccaagaaucagcuggaguucuguugccacaugcugcgcggcaccauugaccccaaagaaccuagcacguaugaguacgugaaguuuaucgggaacuucaaaucucucaauuccguuagcucuagcgcccauaacggauuugagggcaccauucagagaacacaccggcccuccuaugaagaucgcguguguuucgucgcuaccgugagacuggccacaccucaguucaucaaggagaugugcaccguggaggaaccgaaugaagaguuuacgucucggcacagccuugaguggaaauuccuguuucucgaccaucgcgcucccccuaucauuggcuaccugcccuucgaaguccuugggacauccggauaugauuacuaccacguugacgaucuggagaaccucgccaagugucaugaacaccugaugcaauauggcaaggggaaaagcugcuacuauagauuucugaccaagggacagcaguggaucuggcuccagacacacuacuauauuaccuaccaucaauggaacucucggccugaguucaucguguguacccacacaguggucuccuaugcggaagugcgcgccgagagacggagagagcugggcauugaagagagccuucccgaaacggcugccgacaaaucucaggauuccgggagcgacaaucgcaucaauaccguuucccugaaggaggcucucgagcgguuugaucauucuccgacaccuagcgccuccucuagaagcucccgcaaaagcucucacaccgcgguguccgaccccagcucuacaccuaccaagauccccacggacacauccacacccccucggcagcaucugccggcccacgaaaagaugguccaaagacgcagcucuuucagcucccagagcauuaacucucaguccgugggaagcucccuuacccagcccguuaugucucaagcuaccaaucugccuaucccccagggcaugagccaguuucaguucuccgcccaacucggcgcuaugcagcaccugaaagaucagcuggagcagcggaccagaaugauugaagccaacauccaucgccaacaggaggaacuccggaagauucaggagcagcugcaaauggugcacgggcagggacuucagauguuucugcaacagucuaacccuggccucaauuucgggagcguccagcuguccucuggaaacagcuccaauauccagcaacuggcccccaucaacaugcagggccagguggucccgacaaaucagauucaaagcgggaugaacacgggacauaucggcaccacacagcacaugauucagcagcaaacccuucagucuacauccacccagagccaacagaaugugcucucuggccacucccagcagacgagccugccuucucaaacccaguccacacugaccgcuccccucuacaacacaaugguuaucagccagccugcggccggguccauggugcagauucccagcucuaugccucaaaauagcacccaguccgcugccgucacgacauuuacccaggacagacagauccgcuucucucaaggacagcagcuggugacaaaacuuguuaccgcccccguggcuugcggcgccgucauggugccgagcaccaugcugaugggacaggugguuacagcguacccuacguucgcuacccaacagcagcaaucccagacacucucugucacccagcagcaacagcagcagagcucccaagagcagcagcugacaucugugcagcaacccagccaggcccagcugacccaacccccucagcaguuucuucagacgucccggcuccugcaugggaacccgagcacacaacugauucucucugccgcuuucccccugcagcaguccaccuuuccucagagccaccaucaacagcaccagucucagcaacagcagcagcuuuccagacaucggaccgauagccugcccgacccuuccaaggugcaaccccaguga

SEQ ID NO: 67582 - RNA, 1086 nt, Artificial Sequence
  derived and/or modified sequence opt5 from CLP1__Homo_sapiens__NP_001136069
augggcgaggaagccaacgacgauaagaaacccaccacaaaguucgagcuggaaagagagacggaacuccgguuugagguggaggcuagccaguccguccaacuggaacuucugaccgggauggccgagaucuucggaacagaacucacccgcaauaaaaaguuuacauucgacgcgggcgcuaaaguugccguguuuaccuggcacgggugcucugugcagcugagcggaagaacagaggucgccuacguguccaaggauaccccuaugcuucuguaucucaacacgcauaccgcucuggagcagaugcggcgccaggccgaaaaggaggaagagagaggcccgcggguuaugguggucgggcccacagacgugggaaaaucuaccguuugucgccugcuccugaauuacgcuauuacaagcagacuugccgauguguucaaccaacggugcgaagucaaucgcagagcguccgugucuggcugugugaucaauaccugcggcugggucaaggggagcggauaucaggcccugguucacgcugccuccgcuuuugagguggacguggucgugguucucgaucaggagcggcuguacaacgaacuuaaacgcgaccugccucauuucgugagaacgguccuccugcccaagagcggcggggugguugagcggucuaaagauuuucgcagagaaugucgggacgagcgcauuagagaauauuucuacggauuucggggcugcuucuauccucacgccuuuaacgugaaguucuccgaugucaagaucuacaaagugggggcgcccacaauuccugacagcugucugccgcucggaaugucucaggaggauaaucaacugaagcugguccccgugaccccuggcagagacaugguucaucaccuucucuccgugagcacagccgagggcaccgaagagaaccugucugaaaccuccgucgcuggguucaucgugguuacaagcguggaccuugagcaccaggucuuuacggugcugucccccgccccucgcccccucccgaaaaauuuccugcugaucauggauauucgguuuauggaccucaaguga

SEQ ID NO: 67583 - RNA, 834 nt, Artificial Sequence
  derived and/or modified sequence opt5 from CLPP__Homo_sapiens__NP_006003
auguggcccggcauccuggugggaggagccagagucgcuagcugccgguacccugcccucggcccgcgccuggcggcucacuuccccgcccagagaccuccccaacggacccuucagaacgggcuggcccuccagcgcugucugcaugcuacagccacgagagcccuuccucugauucccaucguuguggagcagaccggacggggcgaacgcgcuuaugacauuuacuccagacuccugcgggagcgcaucgugugcgucauggggccuauugaugacucuguggcgagccugguuaucgcccaacuccuguuucuucaguccgaaucuaauaagaaaccgauccacauguauauuaacagccccggaggcguggucacagcuggccuggccaucuacgauaccaugcaguauauucucaauccuaucuguacauggugcguggggcaggcugccuccaugggaucucugcuucuggcggccggcacccccgggaugagacauagccucccuaacucccggauuaugauccaccaacccagcggaggcgcucgcgggcaggccacagacauugcuauccaggccgaggaaaucaugaagcugaaaaagcagcuguacaauauuuaugccaaacauaccaagcaaucucuccagguuaucgaguccgcuauggagagagaucgguacaugagcccgauggaagcgcaggaguucgggauucuggacaaggugcuuguccacccuccccaagauggcgaagacgagccuacgcuggugcagaaagagcccguggaagccgcucccgccgccgagccugucccggcuucuaccuga

SEQ ID NO: 67584 - RNA, 216 nt, Artificial Sequence
  derived and/or modified sequence opt5 from CLPS__Homo_sapiens__NP_001239527
auggagaagauccugauucuccugcuuguggcccugagcgucgcuuacgccgcgcccggcccuagagggaucauuaucaaccucacccuguauggaauuuacuauaaaugcccgugugaacggggccuuacaugcgagggggacaagacgaucguuggauccaucaccaauacaaacuucggcauuugucacgaugcugggcgcucuaaacaguga

SEQ ID NO: 67585 - RNA, 1968 nt, Artificial Sequence
  derived and/or modified sequence opt5 from CLPTM1__Homo_sapiens__NP_001269104
augagcagaaaggcccacaucaccgagaaagugacauccaacggcucuauugggcgggaucccccugcugaaacgcagccgcaaaaucccccugcccagcccgcgccuaacgcuuggcaggucaucaagggaguucuguuccgcauuuuuaucauuugggccaucagcuccugguucagacggggccccgccccucaggaccaagcugggccgggaggcgcuccccgcguggccucuagaaaucucuuuccuaaagacacccugaugaaccuucauguguacaucagcgagcacgaacauuucacagauuuuaaugccaccuccgcgcuguucugggagcagcacgaccucgucuauggggauuggacaucuggagaaaacagcgacggcugcuacgagcauuuugccgagcuggauauuccccaguccgugcagcaaaauggcagcaucuauauucacguuuacuucaccaagucuggguuucacccugacccccggcagaaagcucuuuaucgcagacuggccacagugcauaugucccggaugaucaacaaguacaagcgcagacgguuccagaaaaccaagaaucuccugacgggagaaaccgaggcugauccggaaaugauuaaacgcgccgaggacuauggcccugucgaggugaucagccacuggcaucccaacauuacaaucaauaucguugaugaccacaccccuugggugaaggggucugucccuccgccccuggaucaguacgugaaauuugacgcgguguccggagacuacuaucccauuaucuacuucaacgauuauuggaaucuccaaaaggacuacuaucccauuaacgaaagccuggccucucuuccucugagagucuccuuuuguccccucagccuguggcgguggcagcuuuacgcugcccaguccacaaagucuccuuggaauuuccugggcgaugagcucuaugaacaaagcgacgaggaacaggauuccguuaaaguggcucugcuggagaccaaccccuaccuccuggcccuuacgaucauugugagcaucguccacucuguguucgaguuucuggccuucaagaacgacauccaguuuuggaacucccgccagagccucgaagggcugucuguuagaagcguguucuuuggagucuuccaauccuuugugguucuucuguacauucucgauaaugagacaaauuucgugguccaggugucugucuuuaucggcgugcugauugaccuguggaaaaucaccaagguuauggaugugcggcucgacagagaacaucgcgucgcuggcauuuucccgcggcugagcuuuaaagauaaguccacauauaucgagagcucuaccaaaguguacgacgacauggcguucagauaucuuuccuggauccuguuuccucuccuggggugcuacgccguuuauagccuucuguaccucgaacacaagggaugguauucuugggugcuguccaugcuguacggcuuccuccugaccuucggguuuauuacaaugacgccccagcuuuucaucaacuacaagcugaaaagcgucgcucaucucccuuggcgcaugcugaccuauaaggcccugaauacauuuauugaugaccuuuucgccuuugugaucaaaaugcccgugauguaccggauuggaugucucagagaugacguugucuucuuuaucuaucuguaccagcgcuggauuuaucggguggauccuaccagagugaacgaguucggcauguccggggaggaccccacagcugccgcgccggucgcugaagugccuaccgccgccggagcucugacgcccacacccgccccuaccaccacaaccgcuacacgcgaggaagccucuacgagccucccgaccaagcccacacaaggcgcguccucugccagcgagccucaggaagcucccccuaaacccgccgaggauaagaagaaagacuga

SEQ ID NO: 67586 - RNA, 1617 nt, Artificial Sequence
  derived and/or modified sequence opt5 from CLPTM1L__Homo_sapiens__NP_110409
auguggagcggcagauccucuuucaccagccugguggucgggguuuuugugguguacgucgugcacacaugcuggguuauguauggaaucguguacacgcggcccuguuccggcgacgccaacugcauucagccuuaucucgcucgcagaccgaagcugcaacuuucugucuacaccacaacccggagccaucugggggccgagaauaacaucgaucucgugcugaauguugaagacuucgauguggaguccaaauuugaacgcacagucaacgugucugugcccaagaaaaccagaaauaacggaacacuuuaugcguacauuuuccugcaccaugcuggcguccucccuuggcacgacgggaagcagguucaucuggugagcccccugaccacguauauggugccuaaacccgaggaaaucaaucuccugaccggagaguccgauacacagcagauugaggccgaaaagaagccuaccagcgcccuugacgagccggucucucacuggcggccccgccuggcucucaacgugauggccgauaauuuuguuuucgacggcuccagccugccugcugaugugcacagauacaugaaaaugauccaacuuggcaagacaguccauuaccugcccauccucuuuauugaccagcugucuaaccgggugaaagaucugaugguuaucaaucgcuccaccacggaacucccucugacagugagcuaugacaaggucucucuugggagacugcgguucuggauucacaugcaggaugccguguacucccuccagcaauuuggauucagcgagaaagacgcggacgaggucaagggcaucuuuguggauaccaaccuguauuuccuugcccugacauuuuucguugcugccuuccaucuccuguuugacuuccuggcuuuuaagaaugauauuuccuucuggaaaaagaaaaagucuaugaucgggaugagcaccaaagccgugcucuggcgcuguuuuuccaccgucgugauuuuccuguuucuucuggacgaacagacaagccuccugguucuugugcccgcgggagucggcgccgcuaucgagcuguggaaggugaaaaaggcccucaagaugacgaucuucuggagagggcugaugccggaauuucaguucggaaccuacucugaguccgaacggaaaacagaggaguaugauacccaggcuaugaaguaccugagcuaucuccuguacccucuuugcgugggcggcgccguuuacucucugcucaacauuaaauauaagagcugguacuccuggcugaucaauucuuuugucaacgggguguaugccuucggauuucuguucaugcuuccccaacucuucgugaacuacaaacucaagagcgucgcucaucugccuuggaaggcguuuacauauaaagccuucaauaccuuuauugacgauguguucgcuuuuaucauuacgaugcccacaucccaccgccuggccuguuucagagacgauguuguguuucuggucuaccuuuaucagcgguggcuguaccccguggacaagagacgcguuaacgaguucggcgaaagcuacgaagagaaagccacccgggcuccucacaccgauuga

SEQ ID NO: 67587 - RNA, 738 nt, Artificial Sequence
  derived and/or modified sequence opt5 from CLRN1__Homo_sapiens__NP_001182723
augcccagccagcaaaagaaaaucauuuucugcauggccggcguguuuuccuucgcuugugcccugggggucguuaccgcgcucggaacaccucuguggaucaaggcuacggugcuuugcaaaaccggcgcccugcucgugaacgccucugggcaggagcuggacaaguuuaugggagaaaugcaguacggccuuuuccacggggagggagucagacaguguggccugggcgcucggccguuucgcuucagcuuuuuccccgaucuccugaaagccauuccuguguccauccauguuaaugugauucuguuuucugcuauccucaucguccugacaaugguggggaccgccuucuuuauguauaacgcguucggaaagcccuuugaaacacuucacggcccucuggggcucuaccugcuuagcuucauuuccguugcccuguggcuccccgcuaccagacaucaagcccagggaucuugcggcugucuggugaugauccuguucgcuagcgaggucaagauucaccaucucuccgagaaaaucgccaauuauaaggaagggacauacguguauaaaacccagagcgagaaguacacgaccucuuuuugggugauuuucuuuugcuucuuuguccacuuccugaacggacuucugauccggcucgcgggcuuucaguucccuuuugccaaauccaaggacgcugaaacaaccaauguugccgcugaucugauguauuga

SEQ ID NO: 67588 - RNA, 3999 nt, Artificial Sequence
  derived and/or modified sequence opt5 from CLSPN__Homo_sapiens__XP_011540241
augaccggcgagguggggagcgaaguccaccuggagaucaacgaccccaauguuauuucccaggaagaggccgauucuccuagcgacuccggacaaggcucuuacgaaacaaucgggccgcucagcgagggagauuccgacgaggaaauuuucgugucuaagaaacugaagaacagaaaagugcuucaggauagcgacuccgagacggaagauaccaaugcuagccccgagaagacaaccuaugacucugccgaggaagagaacaaagaaaaucuguacgcgggcaagaacacaaagaucaaacggauuuauaagaccgucgcugauuccgacgagagcuacauggaaaaaucucucuaucaggagaaucuggaggcccaggugaagccuugccuugaacugucccuccaaagcgggaacucuacagauuuuaccacggaccgcaaauccagcaagaagcauauccacgauaaagagggaaccgccggcaaggcuaaaguuaaguccaaaagacggcuggaaaaggaggaacgcaaaauggagaagaucagacagcugaagaaaaaggagacaaagaaucaggaagacgacguggagcagcccuucaacgauucuggcugucuccuggucgacaaggaucuuuuugaaaccgggcuggaggacgaaaauaacagcccucucgaggaugaggaaucccuggagagcauucgggccgcugugaaaaauaagguuaagaaacauaagaaaaaggaacccucucuugaguccggagugcacagcuucgaggaaggcucugagcugagcaaagggacaacccgcaaggaaagaaaggccgcgcggcucuccaaagaggcccugaagcaacugcauucugaaacgcagcgccucaucagagagagcgcucugaaccuuccuuaccacaugccggagaauaaaacaauucacgacuuuuucaagcggaaaccccgcccuaccugccauggaaacgccauggcucugcucaaguccagcaaguaucagucuucccaccauaaagaaaucauugauacagccaacaccaccgagaugaauagcgaccaccacucuaagggcuccgaacagacaacgggggcggagaacgaagucgagaccaaugcccugcccguggugagcaaagagacacaaaucauuaccggauccgaugaaucuuguagaaaggaccuugucaaaaacgaggaacuggagauccaggaaaagcagaaacaaagcgauauccggccuucccccggcgacucuagcguucuccagcaggaguccaauuuucugggcaacaaucauagcgaggaaugccaggucgggggacugguggcuuucgagccgcacgcccucgaaggcgaggggccucaaaaccccgaggaaacagacgagaagguggaagaaccugaacagcagaauaagucuuccgcugugggaccucccgagaaaguucgcagauuuacccuggaucggcuuaagcagcugggcguggacgucagcauuaaacccagacucggggccgaugaggacucuuucgugauccuggaaccggagacgaaccgcgaacuugaggcccugaagcaacgguuuuggaaacaugcuaaucccgcggccaagccuagagcuggacagacaguuaacgugaaugucauugugaaggauaugggcaccgacggcaaagaagaacucaaggccgaugucgugcccguuacccuggccccuaaaaagcuggacggggcuucccacacaaaacccggagagaagcuccaggugcugaaggccaaacuucaggaagcgaugaagcugcgccgguucgaggaaagacaaaaacgccaggcucucuuuaagcuggauaacgaggacggcuucgaagaggaggaagaggaagaggaggaaaugaccgaugagagcgaagaggacggggaagagaaagucgagaaggaagagaaggaagaggaacuggaggaggaagaggaaaaagaggaagaggaggaagaggaaggaaaucaggagacagccgaguuccuucucucuagcgaagagaucgaaacgaaggaugagaaagaaauggacaaggagaacaacgacggcuccagcgagauugggaaagccgugggcuuucugucuguuccgaagucccugagcuccgauucuacccuccugcuuuucaaagacagcuccucuaagaugggauacuuuccuacagaagagaaaagcgaaaccgaugaaaauuccggcaaacagcccucuaagcuggacgaagaugacagcuguucccuccugacaaaagagagcucucauaacuccagcuucgagcugaucgggucuaccaucccuuccuaccaacccugcaaucggcagacgggaagaggcaccagcuuuuucccuacagcugggggauuucgcucucccuccccgggccuuuuccgggccagccucguguccagcgcuucuaagagcuccgggaaacugucugaaccuagccugcccauugaggauucccaggaccucuauaacgccucucccgaaccuaagacccuguuucuuggcgcgggagauuuccaauuuugucuggaggacgauacacagagccagcuccuggacgccgauggcuuccugaaugucagaaaccaccgcaaucaguaccaagcucuuaagccgcggcucccccuggccuccauggacgaaaacgcuauggacgccaauauggaugagcugcucgaccugugcaccgggaaauuuacgucucaggcggagaagcaccuuccuagaaaaagcgauaagaaagaaaacauggaggaacugcucaaucuguguuccggaaaguucacaagccaggacgccucuacccccgcuuccagcgagcugaacaagcaggagaaagaaucuuccaugggcgauccuauggaggaagcccuugcucucugcagcggguccuuccccacagacaaggaggaagaggaugaggaagaggaauuuggagacuuccggcuggugucuaaugauaacgaguuugacagcgaugaagacgagcauuccgacagcggcaaugaucuggcccucgaggaccacgaagaugacgaugaggaggagcugcuuaaacgcucugaaaagcugaaaagacaaaugcggcucagaaaguaucuggaggacgaggccgaaguguccgggagcgauguuggcucugaggacgaauacgauggagaggagaucgacgaauaugaggaagaugucauugacgaggugcugccuagcgaugaggagcuucagucccagaucaagaaaauucauaugaagaccaugcuggacgacgauaaacgccagcuccggcuguaccaagagagauaucucgcugacggcgaucugcacucugacgggcccggacgcaugagaaaguuccgguggaaaaacaucgaugacgcgagccagauggaucuuuuucaccgcgacuccgaugacgaucagaccgaggagcaacuggacgaaucugaggccagauggcggaaggaacgcaucgagagagagcaguggcuccgggauauggcucagcagggcaagauuacagccgaagaggaagaggaaaucggggaggacagccaauucaugauucuggccaaaaaggugacggcuaaagcccugcagaagaacgcgucccgcccgauggucauccaggagagcaaaucucuucugagaaauccuuuugaagcuauucggcccggauccgcccagcaagugaagaccggcagccuccugaaccagccuaaagccguucuccagaagcuggcugcccuuuccgaccauaaucccucugcgccgcgcaacagcagaaauuucguguuucacacacuguccccugucaaggcugaggccgccaaagaaucuagcaagucccagaaaauccccgagaaggauagcgacuggcucaccuggucuggggcuccuauucccggcuucuuucggcuguccuucgauccccauggauga

SEQ ID NO: 67589 - RNA, 2889 nt, Artificial Sequence
  derived and/or modified sequence opt5 from CLSTN1__Homo_sapiens__NP_001289812
augcugagacggcccgccccugcucucgccccggcggcucgccugcuucuggccggccuccugugcgggggaggcgugugggccgcuagagucaacaagcacaaacccuggcuugagccuaccuaccaugggaucguuacagaaaaugacaacacggugcugcucgaucccccucugauugcccuggacaaggaugcuccccuccgguucgccgagagcuuugaagugaccgucacaaaagagggagaaaucuguggcuucaagauucacgggcagaaugugccuuuugacgcgguuguggucgauaaauccaccggagagggcgugauccgcucuaaggagaagcuggacugcgaacuucaaaaagauuauagcuucacaauucaggccuacgacuguggcaaggggccggauggaaccaacguuaaaaagucccauaaagcuacagugcacauccaggucaaugacgugaacgaguaugcccccguguuuaaggaaaagucuuacaaagcuaccgucaucgagggcaagcaguaugauagcauucugagaguugaggccguggacgcggauugcuccccucaauucucucagaucuguagcuacgaaauuaucacgcccgacgugccuuuuaccgucgacaaagauggguauauuaagaauacagagaaacucaacuacggaaaggaacaucaguacaaacugaccgugacagccuaugacugcggcaagaagcgggcuaccgaggauguucuugugaaaaucuccauuaagcccacguguacaccgggguggcagggauggaauaaccgcaucgaauacgagccuggcaccggcgcccuggcugucuuccccaauauccaccucgagacaugcgacgaaccuguggccagcguucaagccaccguggagcuggaaaccucucacauugggaaaggaugugauagagacacauauuccgaaaagagccugcaucggcucugcggcgcugcggccgggacggcugaacugcuucccucucccuccggaagccugaacuggaccaugggccucccuacagauaaugggcacgacucugaucaggucuuugaguucaacggaacccaggccgugcgcaucccggacggcgucguguccguuagccccaaagagccuuuuacaauuuccguguggaugagacauggccccuucgggcggaagaaggaaaccauccuguguucuagcgauaaaacggacaugaaucgccaccacuacucccuuuauguccauggaugcagacugauuuuucucuuccggcaggacccuagcgaggaaaagaaauaccgccccgccgaguuccacuggaagcugaaccaagugugcgaugaagaguggcaucacuauguucugaacguggaguuuccgucugucacacucuacguggacggcaccucccaugaaccuuucagcgugaccgaggauuacccccugcacccuucuaaaaucgaaacacagcuuguugucggggcuuguuggcagggaggcgaccugcacaugacccaauuuuucagagggaaucucgccggccugacacuucggagcggaaagcuggcggauaagaaagugaucgacugccucuauacguguaaggagggccuggaucuccaggugcuggaggacuccgggagaggaguccagauucaggcucaucccucucaacuggugcuuacccuggaaggcgaggaucucggggaacuggacaaagccaugcagcacaucagcuaccugaacucccgccaguuuccuacacccggcauucggagacuuaagaucaccagcacaauuaaaugcuucaaugaggccaccuguaucucuguuccgccuguggauggauaugucauggugcuccagcccgaggagcccaagaucucccugagcgggguucaucacuuugcucgcgccgcuucugaguucgaauccagcgagggcguguuucuguucccugaacuccggauuaucuccacgauuaccagagaggucgaaccggagggagacggcgccgaggaucccacagugcaagaaucucugguuagcgaggaaaucgugcacgaccuugauaccugcgaggucacaguggaaggggaggagcugaaccaugaacaggagucccucgaaguggacauggcgcgccugcagcagaagggaauugaggucucuagcuccgagcugggcaugaccuuuacggggguugacacaauggccagcuacgaagaggugcuucaccuccugcgguauagaaauuggcaugcucgcucucugcucgaucggaaauucaagcugaucuguuccgaacuuaacggaagauacauuagcaaugaguuuaaaguggaagucaacgugauccacaccgccaauccuauggagcaugcuaaccacauggccgcgcaaccccaguucguucacccugagcaucgcucuuucguggaccuguccggccacaaucucgccaacccccauccuuuugcugucgugcccagcacagccaccguugugaucgucgugugcguuucuuuccugguguuuaugauuauccugggggucuuccggauuagagcugcccaccggcgcaccaugagagaucaggacacaggcaaggaaaaugagauggauugggacgauagcgcccuuacgaucaccgugaacccgauggaaacauaugaggaccagcauuccagcgaagaggaggaagaggaagaggaagaggaggaaucugaggauggagaagaggaggacgauauuaccuccgcugaaagcgaguccucugaagaggaagagggcgagcaaggggacccucagaaugcgacacggcagcaacagcucgaaugggacgauagcacccuguccuacuga

SEQ ID NO: 67590 - RNA, 2868 nt, Artificial Sequence
  derived and/or modified sequence opt5 from CLSTN2__Homo_sapiens__NP_071414
augcugcccggcagacucugcugggugccucugcuucuggcccucggggucggaagcggcuccgggggaggcggggacucucggcagcgcagacugcuugcugccaagguuaacaaacacaagccguggaucgagaccagcuaccauggagugauuacagaaaauaacgauacggugauccuggaucccccucucgucgcgcuggacaaagacgcucccgugccuuucgccggcgagauuugugccuuuaagauccacggccaagaacugcccuucgaggcuguugugcucaauaaaaccuccggggaaggacggcugcgcgccaagucuccuauugauugcgagcuucagaaggaguauacauuuaucauccaggcuuacgacuguggcgccgggccgcaugaaaccgcguggaaaaagagccacaaagccgucgugcauauucagguuaaggaugugaacgaguucgcucccacauuuaaagaaccugccuauaaggcugucgugaccgagggaaagaucuacgacuccauucugcaaguggaggccaucgaugaagacugcucuccccaguauagccagauuuguaauuacgagaucgucacaaccgauguuccuuucgcgauugacagaaacggcaauauccggaacacggaaaaacucuccuaugauaagcagcaccaauacgagauccuggugaccgccuacgacugcgggcagaaacccgcugcccaggacacacuugugcaggucgaugugaagccgguuuguaaaccuggauggcaagacuggaccaagcgcauugaauaucagcccggcagcggcucuaugccucuguuucccuccauccaccucgagacaugcgauggggcugugagcucucugcagauugucaccgagcugcaaacgaauuacaucggaaaaggcugugacagagaaacauauuccgaaaagagccuccagaagcugugcggggccucuuccggaauuaucgaucuucugcccagcccuuccgccgcuaccaacuggacagcgggccuccugguggacucuagcgagaugaucuucaaauuugaugggcggcagggagccaagguuccggacggcauugugcccaaaaaucuuaccgaucaguucaccaucacaauguggaugaagcauggcccuucccccgggguccgcgcugagaaagaaacgauucuguguaacagcgacaagaccgagaugaauagacaccauuacgcccucuaugugcacaacugccggcuggucuuucugcuccgcaaggauuucgaccaagccgacacauuuagaccugcugaguuccacuggaaacuggaucagaucugcgacaaggaauggcauuacuaugugauuaauguugaguuccccguggucacccuuuacauggauggagccacauacgaaccguaucuggugaccaacgacuggccuauccaccccucucauaucgcgaugcagcucacgguuggcgcuuguuggcaagggggagaggugacaaaaccucaguuugcccaguucuuucacggcucccuggccagccuuaccauucggcccgggaagauggaaucucagaaagucaucagcugccugcaggcuuguaaggagggccucgauauuaacucccuggagucucugggacaaggcaucaaguaccauuucaauccuagccaguccauucucgugauggaaggggacgauaucggaaacauuaaucgcgcccugcagaaagugagcuauaucaacucuagacaguuucccaccgcuggcguucggagacuuaaggucuccagcaaagugcaaugcuucggggaggacguguguaucucuauuccggaagucgaugccuacgugaugguucugcaggcgaucgagccucgcauuacacuccggggaaccgaccacuuuuggagacccgccgcucaguucgaguccgcccgcggcgugacacuguuucccgauaucaagauugucagcacguucgcuaaaaccgaagccccuggggacgugaagacaaccgauccgaaguccgagguucuggaagagaugcuucacaaucucgacuuuugcgacauccuggugaucggcggagaucuggacccccggcaagaaugucucgagcugaaccauucugagcuucaccagagacaucuggaugcgacaaauagcaccgccggcuauuccauuuacggggucggaucuaugagccgcuaugaacaggugcuccaccacauccgguacagaaacuggcgcccugcuucccuggaggcccggagauuccgcauuaaaugcagcgaacugaauggccgguacacgucuaacgaguuuaaucuugaaguuuccauccuccaugaggaccaggugagcgauaaggagcacgucaaccaucugauugugcaacccccuuuccugcagucugugcaccaucccgaauccagaagcucuauccagcacagcuccgucguuccuagcaucgcuaccguggugauuaucauuucugucuguaugcucguguucguuguggccaugggggucuaucgggugcgcaucgcccaccagcauuuuauucaagagacagaagcugcgaaagaguccgaaauggacugggaugacagcgcccugaccaucacaguuaaucccauggagaagcacgagggaccgggccauggggaagaugagaccgaaggcgaggaggaagaggaagcugaggaagagauguccucuagcuccggaucugacgauagcgaggaagaggaagaggaagagggcauggggagaggacggcacggccagaacggggccagacaggcccagcuugagugggacgauuccacgcugccuuacuga

SEQ ID NO: 67591 - RNA, 711 nt, Artificial Sequence
  derived and/or modified sequence opt5 from CLTA__Homo_sapiens__NP_001070145
auggccgagcuggaccccuucggcgcuccugccggggcgccgggaggccccgcucucgggaacggaguggccggcgccggggaagaggauccugcugccgcuuuucuggcccagcaagaaagcgagaucgcgggaauugaaaaugacgaggccuucgcuauccuugauggcggcgcccccgggccucagccccacggagagccuccgggcgggcccgacgcugucgauggaguuaugaacggcgaauacuaucaggaguccaaugggccuaccgacucuuacgccgcgauuagccagguggauagacugcaauccgaacccgagucuauccggaaguggcgcgaggaacagauggagagacucgaagcccuggacgcuaacagccggaaacaggaggccgaauggaaggagaaagcuauuaaggagcuugaagagugguaugcccgccaggaugaacaacugcagaaaacaaaggccaauaacagaguggcugacgaggcguuuuacaagcagccuuucgccgaugucaucggauauguggcugccgaagaggccuuuguuaaugacaucgaugaguccucucccggcacggaaugggagcggguggcucgccucugcgacuucaacccgaaaagcuccaagcaggccaaagacgucagcagaaugcggucugugcugauuucccugaagcaagcgccucucguucauuga

SEQ ID NO: 67592 - RNA, 5028 nt, Artificial Sequence
  derived and/or modified sequence opt5 from CLTC__Homo_sapiens__NP_004850
auggcccaaauccugcccauuagauuccaagagcaccuccagcugcagaaccuuggcaucaauccugcuaacauuggguucagcacccugacaauggaauccgacaaguucaucugcauucgggagaaggugggagaacaggcccaagucguuaucaucgauaugaaugacccgucuaaccccauucgcagaccuaucagcgcggauuccgcuauuaugaaucccgccucuaaggugaucgcccucaaggcuggcaagacgcugcagauuuuuaacaucgagaugaaaagcaagaugaaggcccauaccaugacagacgaugugaccuucuggaaauggauuucccuuaauacagucgcucuggugaccgacaacgccguuuaccacuggucuauggaaggggagagccagccugugaagauguuugaucggcauuccagccucgcgggaugucagaucaucaauuaucgcacagacgccaaacaaaaguggcugcugcucaccggcauuucugcucagcagaacagagucgugggggccaugcagcuguacuccguugaucggaaagugagccaacccaucgagggacacgcugccucuuucgcgcaguuuaagauggaaggcaaugccgaggaauccacgcuuuucugcuuugcuguccgcggccaggccgggggaaagcugcauauuaucgaggugggcaccccuccgacagggaaccaacccuucccuaaaaaggcuguggacgucuucuuucccccugaggcccagaaugauuuucccguugccaugcagauuagcgaaaaacacgacgugguguuucucaucaccaaguauggauacauccaccuguaugaucuugagacaggcaccuguauuuacaugaacagaaucucuggggaaacgauuuucgucacagcuccgcaugaggcgaccgccggaaucauuggcgugaaucggaaaggccagguucuguccgugugcgucgaagaggagaacaucaucccuuauauuacaaacgugcuccaaaaucccgaccuggcucugcgcauggccguuagaaacaaucucgccggggcugaggaacuguuugcccggaaguucaacgcgcuuuuugcucagggaaauuacagcgaagccgccaaaguggcugccaacgcuccuaagggcauccugcgcacccccgacaccauuagacgguuccaguccguccccgcccagccugggcaaacaucuccgcuccugcaguacuuuggaauccuucuggaucagggccagcucaauaaguaugagagccuggaacugugucgccccgugcuccaacaggggagaaaacagcugcuugagaaguggcugaaagaggacaagcucgaaugcuccgaggaacugggagaucuugucaaaagcguggacccuacgcuggcgcucucuguuuaccugcgggccaacgugcccaauaaggucauucaguguuucgcugagaccggccaagugcagaagaucguucuguaugccaaaaaggugggcuacacaccugauuggauuuuucuccugagaaacgucaugcgcaucucccccgaccaggggcaacaguucgcucagaugcuugugcaggaugaggaaccgcuggccgacaucacccaaauuguggauguuuuuauggaguauaaucucauccagcagugcacagcguuccugcuggacgcccuuaaaaacaaucggccuagcgaaggaccccuccagaccagacugcuggagaugaaccucaugcacgcuccucaagucgccgaugcuauucugggcaaucagauguuuacgcauuacgaccgcgcccacaucgcccagcuuugugaaaaggcugggcugcuccagcgggcgcuggagcacuucacagaccuguaugauauuaaaagagccguggugcauacccaccuucucaaccccgaguggcuggucaacuacuuuggaucucugagcguggaagacucccucgagugccugcgcgcuaugcuuucugccaauauccggcaaaaccugcagaucuguguucagguggccagcaaguaccaugaacaacucuccacccagagccugauugagcuguucgaaucuuucaaguccuuugagggccuuuucuauuuucucgggagcaucgucaauuucucucaggauccugacgugcacuuuaaauacauucaggcugccugcaagacaggccaaaucaaagagguugaaagaauuugccgcgaguccaacuguuaugaucccgaacgggugaagaauuuccugaaagaggcgaagcugaccgaccagcucccgcugaucaucgucugcgauagauuugacuucgugcaugaucuuguucuguaccucuaucgcaacaaucugcagaaguacauugaaaucuaugugcagaaagucaacccuagccggcugcccguggugauuggaggccuucucgacgucgauuguuccgaggacguuaucaagaaucugauucugguggugagagggcaauuuucuacagaugagcucgucgcugaaguggagaaacggaaccgccugaaacuucugcuccccuggcuggaagccagaauccacgagggaugcgaggaaccugccacgcacaaugcucuggccaaaaucuacauugacagcaacaauaacccggagcgguuccuuagagaaaaucccuacuaugacucccgcguugugggcaaguacugugagaaacgggauccucaucuggcgugcgucgcuuaugaaagagggcagugugaccucgagcugaucaacgugugcaacgaaaauucucucuuuaagagccugucccgcuaccuuguuagacggaaggaucccgaacuguggggaagcgugcuccuggagucuaacccuuaucgcagaccccugauugaccaggucgugcagaccgcccuuuccgaaacacaagauccugaggaaguuagcgugaccgucaaagccuucaugacagcugaccugcccaaugagcucaucgagcugcucgaaaagauugugcuggauaacucuguguuuuccgagcaccggaaucuucagaaccugcucauccugaccgccauuaaagcugaccgcacgagagucauggaauacaucaaucggcuggauaacuaugacgccccggauaucgcgaauauugccaucagcaacgagcuuuucgaagaggcuuucgccauuuuucgcaaguucgacguuaauaccucugcuguccaggugcugaucgagcauauuggcaaccucgauagagccuacgaauuugccgagcgguguaaugaaccugcuguguggagccagcuggcgaaagcccaacuccagaaggggauggugaaggaggcuaucgacuccuacaucaaagccgacgaucccagcucuuauauggaaguugugcaggccgcuaacacauccggcaauugggaggagcuggucaaguaccuucaaauggcccgcaaaaaggcgagagaaagcuauguggagaccgaacugauuuucgcucuggccaaaacaaaccggcucgccgagcuggaggaauuuaucaacggaccuaauaacgcucacauucagcagguuggcgacagaugcuacgaugagaagauguaugacgccgcgaaacuucuguacaauaacguguccaauuucgggcgccucgcuucuacccugguccaccucggagaauaucaggccgccguggauggcgcucggaaagccaacagcacgagaacauggaaggaggucuguuuugcuugcguggacgggaaagaguuccgccuggcccaaaugugcggacuucauaucguugugcacgcggaugagcuggaggaacugauuaauuacuaccaggaccggggcuauuuugaggaacucaucaccaugcuggaggccgcucuugggcuggaaagagcccauaugggcauguucacagagcucgcuauccuguacuccaaguuuaaaccccagaagaugcgcgagcaccucgaacuguucuggucucgggucaacauuccgaaggugcuuagagccgccgagcaggcucaucugugggcggaacugguuuuccucuaugauaaauacgaggaauaugacaaugccaucauuaccaugaugaaccacccuaccgaugcuuggaaggagggacaauuuaaagacaucauuacaaagguggccaaugucgagcuguacuaucgcgccauccaguucuaccuugaauuuaaaccccugcuccugaacgaccuccugauggugcuuagcccucggcuggaucacacgagagcugugaauuacuucuccaagguuaaacagcugccccucgucaagcccuaucugcggucugugcagaaccauaauaacaagagcgugaaugagucccuuaacaaccuguuuauuaccgaagaggacuaccaagcccuccgcacaagcaucgaugcguaugacaauuucgauaacaucucucuggcucagagacuggagaaacacgaacucauugaguuucggcgcaucgccgccuaccuuuucaagggcaauaacagauggaaacaguccgucgaacuguguaagaaagacagccuguauaaggaugcuaugcaauacgccucugaguccaaggacaccgaacucgcggaggagcugcuucagugguuucugcaggaagagaaacgggaaugcuucggggccugucucuuuacaugcuaugaucugcugagaccugacgugguucucgagaccgcuuggcgccauaauauuauggauuucgccaugccguacuuuauccaggugaugaaggaauaccuuacgaaagucgacaagcuggaugcuagcgagucucugcggaaagaggaggaacaggccacagaaacccagcccauuguguauggacagccucagcucaugcugaccgcuggccccuccguugccgugccuccccaagcgccuuucggguacggauauacagccccgcccuacggccagccucagcccggguucggcuauagcauguga

SEQ ID NO: 67593 - RNA, 4752 nt, Artificial Sequence
  derived and/or modified sequence opt5 from CLTCL1__Homo_sapiens__NP_001826
auggcccagauccugcccgugagauuccaagagcacuuucagcuccagaaccugggcauuaauccugcuaacaucggguucagcacccuuacaauggaauccgacaaguuuauuugcauccgggagaaagucggagaacaggcccaaguuacgauuaucgauaugucugacccgauggcgcccauccgcagaccuauuagcgcugaguccgccaucaugaaucccgccucuaaggugauugcucugaaagccggcaagacccuccagaucuucaacauugaaaugaaaagcaagaugaaggcucauacaauggccgaggaggugaucuuuuggaaaugggucuccgugaauaccguugcgcuggugacagaaaccgccgucuaccacuggucuauggagggggauagccagccuaugaagauguucgaccggcauacaucccuugugggaugucagguuauucacuaucgcaccgaugaauaccaaaaauggcugcuccuggugggcaucagcgcucagcagaacagagucgugggggccaugcagcuguauucuguggaccggaaggucucccaacccaucgagggacaugcugccgcguuugccgaguucaaaauggaaggcaaugcuaagccugccacgcucuuuugcuucgcuguucgcaacccgaccggcgggaagcugcacauuaucgaggugggacagcccgccgccggcaaucagccuuuugugaaaaaggcugucgauguguucuuucccccugaagcgcaaaacgacuuccccguugccaugcagauuggggcuaaacacggagugaucuaccuuauuacaaaguauggcuaccugcaucucuaugaucuggagagcggggucuguaucugcaugaauagaaucucugccgacaccauuuucgugacagccccgcacaaaccuaccuccggaaucauuggcguuaacaagaaaggccaggugcuuagcgucuguguggaagaggauaauaucgucaacuacgcuacgaaugugcugcagaaccccgaccucgggcugcggcuggccguucgcucuaaccucgcgggagcugagaagcuguuugugagaaaguucaauacacuuuuugcccaaggcuccuacgccgaagcugccaaagucgcugccagcgcgccuaaggggauucugcggacccgcgagacagugcagaaauuccaguccauccccgcccagucuggacaagcuagcccccuccugcaguauuuuggcauccuucuggaucaggggcagcucaacaagcuggaaucccuggagcucugccaucugguucuucaacagggaagaaaacagcugcucgaaaaguggcugaaggaggacaaacuugaguguagcgaagaacugggcgaccucgugaagaccaccgauccuaugcuggcccugucugucuaccuccgggcuaaugugccguccaaagugauucagugcuucgccgaaacaggccaauuucagaagaucguucuguaugcgaaaaaggucggguacacgcccgacuggauuuuccuucugcgcggagugaugaagaucagcccugagcagggccuccaauuuucuagaaugcuggugcaggaugaagaaccccuggccaacauuagccagaucgucgacauuuucauggaaaauucccuuauccagcaauguaccucuuuucuccuggaugcucugaaaaacaaucggccugccgaagggcuccugcagacauggcuucuggagaugaaccucgugcacgcuccccagguugccgacgccauccugggaaauaagauguucacccacuaugauagagcucauauugcgcagcugugcgaaaaagccggccuucuccaacaggcucuggagcacuacacagaccuguaugauaucaagcgcgccgugguccauacccaccuccugaacccggaguggcuugugaacuuuuucgggagccuguccguugaagacagcguggagugucuccaugccaugcugucugcuaauauucggcagaaucugcagcuuugcguccaaguggccuccaaauaccacgaacagcucggcacgcaggcgcugguugagcuguucgagagcuuuaagucuuacaagggacucuucuauuuucugggcuccaucgugaacuucagccaagauccugacguccaccuuaaauacauucaggcugccugcaagacagggcagaucaaagagguggagagaaucugucgcgaauccucuugcuauaaucccgagcgggugaagaacuuucugaaagaagccaagcucaccgaccagcugccucugauuaucgucugugauagauucggauuuguucaugaccuugugcucuaccuguaucgcaacaaucugcaacgguacauugagaucuaugugcagaaagucaaccccagcagaaccccugcugugauuggcgggcuccuggauguugacugcuccgaagaggugaucaagcaccuuaucauggccguccgcggacaguucucuacagaugagcugguggcggaaguugagaagcggaauagacucaaacugcugcuucccuggcuggaaagccagauucaagagggcugugaggagccggcuacccauaacgcccucgccaagaucuacauugacuccaauaacagcccugagugcuuucugcgcgaaaaugcuuacuaugauucuuccguggucgggcgguacugugagaaaagagacccccaccucgccugcguggcuuaugaacggggccagugugaucuggagcuuaucaagguuugcaacgagaauagccuguucaaaucugaagcccgcuaccucguguguagaaaggaccccgagcugugggcgcacguccuggaagagacaaacccuucccggagacagcuuauugaucagguggugcaaacggcccugagcgaaacccgcgacccggaggagaucucugucacaguuaaggcuuuuaugaccgccgaucuccccaaugaacugaucgagcuccuggagaaaauugugcuugacaacagcguguucuccgagcaucggaaucugcagaaccuccugauccugacagcuauuaaggccgacagaacccgcgucauggaauauaucagcagacuugauaauuacgacgcccuggauauugcuucuaucgcgguguccagcgcccucuaugaggaggcuuuuacgguuuuccacaaauucgacaugaacgccuccgccauucaggugcugaucgaacauaucggaaaccucgaucgggcuuacgaguuugccgaacgcugcaaugagccugcggucuggucucagcuggcucaagcccagcuucagaaggaccuggugaaagaagccauuaacagcuacaucagaggcgaugaccccuccucuuaucuggagguugugcaaagcgcuucccggucuaauaacugggaggaucucgucaaguuccugcagauggcccgcaagaaagggagagaaagcuacauugagaccgaacuuaucuuugcgcuggcuaagacaucccgggugagcgagcucgaggacuucauuaauggaccuaacaaugcccacauccagcaggucggcgaucgcugcuaugaagaggggauguacgaagccgcuaaacugcucuauucuaacguguccaauuuugccagacuggcuagcacccuuguucaucugggagaguaccaagccgcgguggacaacucucggaaggccuccagcacacgcaccuggaaagaagucuguuucgcuugcauggauggccaggaguuuagauucgcccagcugugugggcuccacaucgugauucacgcugacgagcuggaggaacuuaugugcuauuaccaggaccggggcuacuuugaggaacugauccuccugcucgaagccgcccugggacuugagagagcucauaugggcauguucacggagcuggcgauucuguauucuaaguuuaagccccagaaaaugcucgaacaccuggagcuuuucuggucccgcguuaauaucccuaaggugcugcgggccgcugaacaagcccaucucugggccgagcuggucuuccucuacgauaaauaugaagaguacgacaacgcugugcugacaaugaugagccaccccaccgaggccuggaaggaagggcaguuuaaagauauuaucacaaagguggcgaauguugagcuuuguuauagagcucugcaguucuaccuggacuauaaaccgcuccugaucaacgaucuucugcucguccuguccccucgccuggaccauaccuggaccgugagcuuuuucucuaaggccggacaacucccccuugugaagccuuaccugcggagcguccagucccacaauaacaaaucugugaacgaagcccugaaucaccuccugacagaggaggaagauuaccaggacgcuaugcaacaugccgcggagagcagagaugccgaacuugcucagaagcugcuccagugguuucuggaggaaggcaaacgcgagugcuucgccgcuugucuguuuacgugcuaugaccuccuucggcccgauaugguucuggagcuggccuggagacacaaccucguggaccuggcuaugccguacuucauucaggucaugcgcgaauaucuuuccaagguggacaaacuggaugcccucgagucucugcggaagcaagaggaacauguuaccgaaccugcgccccugguguuugacuucgaugggcacgaguga

SEQ ID NO: 67594 - RNA, 1242 nt, Artificial Sequence
  derived and/or modified sequence opt5 from CLUAP1__Homo_sapiens__NP_055856
augagcuucagagaccugcggaacuuuaccgagaugaugcgcgcccucggcuaccccagacacaucuccauggaaaauuuccggacaccuaacuuugggcuggugucugagguccuucuguggcucguuaagcgcuaugaaccgcagacggauauucccccugacguggauaccgagcaagacagaguguucuuuaucaaagcuauugcccaguucauggcgacaaaggcucauaucaaacugaauaccaagaaacuuuaccaggccgauggauaugccgucaaggaacugcucaagauuacaagcgugcuguacaacgcuaugaaaaccaagggcauggagggguccgagaucguugaagaggacgugaauaaauuuaaguucgaucugggaucuaaaaucgccgaccucaaggcugcccggcagcuggcgagcgaaauuacauccaagggcgccucucuuuaugaucugcucgggauggaggucgagcugcgcgaaaugagaaccgaggcuaucgcccggccccuugaaauuaacgagacggaaaaagugaugcgcaucgcuauuaaggagauccugacccaaguucagaaaacaaaggaccuccugaauaacguggccagcgaugaggcgaaucuggaagccaaaauugagaagagaaaacucgaacuggagcggaaccgcaagagacuugaaacccugcaguccguccggccuugcuuuauggacgaguacgagaagacagaagaggaacuccagaaacaauaugauaccuaccuggagaaguuccagaaucuuacguaccuggaacagcagcucgaggaccaccaucgcauggagcaagaaagauuugaggaagcuaaaaacacacugugucugauccagaauaagcucaaagaggaggaaaagcggcugcuuaagagcggaucuaacgacgauuccgacaucgauauucaggaggacgaugaaagcgacucugagcuggaagagagacgccuccccaaaccucaaaccgccauggagaugcugaugcagggccggccgggcaagagaaucguggggacaaugcagggaggcgauuccgacgauaaugaagacagcgaggaaucugagauugauauggaagacgacgaugacgaggaugacgaucuugaggacgaauccaucagccugucccccaccaaaccuaaccgccgggugagaaagucugagccccucgaugaaagcgacaacgauuucuga

SEQ ID NO: 67595 - RNA, 1350 nt, Artificial Sequence
  derived and/or modified sequence opt5 from CLU__Homo_sapiens__NP_001822
augaugaagacccugcuccuguucgugggccuucugcucacaugggagagcgggcagguccugggagaccaaacgguuuccgauaacgaacuucaggagaugucuaaucagggcagcaaauacgugaacaaggaaauccagaaugccgugaacggggucaaacaaauuaagacccugaucgagaaaacaaaugaagagagaaagacccuccuguccaaccuggaggaagcuaagaaaaagaaagaggacgcccucaaugaaacacgggagucugagaccaagcugaaagaacuucccggagugugcaacgagacaaugauggcgcugugggaagaguguaagccuugccucaagcagaccuguaugaaauuuuaugcucgcguuugcagaagcggcuccgggcuggugggacggcagcuugaagaguuccugaaucagucuagcccguuuuacuucuggaugaacggcgaucgcauugacucccuccuggagaaugauagacaacagacgcacaugcuggacgucaugcaggaucauuuuagccgggccucuuccaucauugacgaacucuuccaggaucgcuuuuucaccagagagccccaagacacauaucacuaccugccuuuuagccuuccccaucggcgcccucacuucuuuuuccccaagucuagaaucgugcggucccugaugccuuuuagcccguaugaaccccucaacuuccaugccauguuccagccuuuucuggagaugauccacgaagcucagcaagccauggauauucacuuccauucucccgcuuuucagcacccucccaccgaguucauccgcgagggcgacgaugacagaacaguuugucgggaaauucgccauaauuccaccgggugccuuagaaugaaagaccagugugauaagugccgggagauccugagcguggacuguuccacgaacaauccgucucaggccaaacucagacgcgaacuggaugagagccugcaagucgcggaacggcucacaagaaaguacaacgagcugcuuaaauccuaucaguggaagaugcugaacaccagcucucuccuggagcagcuuaaugaacaguuuaacugggugucccgccuggccaaucucacacaaggagaggaccaguacuaccugcgggugaccaccgucgcuagccacacaucugauagcgacguuccuuccggcgugacggaaguggucgugaagcuguucgauucugaccccauuaccguuacagugccugucgaggugagccgcaaaaaccccaaguuuauggagaccguugccgaaaaagcucuccaggaguauagaaagaaacaccgggaagaguga

SEQ ID NO: 67596 - RNA, 1557 nt, Artificial Sequence
  derived and/or modified sequence opt5 from CLUL1__Homo_sapiens__NP_001275965
augagaaccugggacuaccgguggagccuggcccucguggcucagacaggcguccacugcuguaaccuguccucucuucaaccccugccuccgcgcuucaagagauuuagcugccucucccugucuagcgggugggauuauuccaauucuggaaacaugaaacccccucuucugguuuucaucgugugucuccuguggcugaaggacagccauugcgcccccacguggaaagauaagaccgcgauuuccgagaaucucaagagcuuuucugaagugggcgagaucgacgcugaugaagaggucaagaaggcccugacagggauuaaacagaugaagaucaugauggaacggaaagagaaggagcacaccaaccuuauguccacacugaaaaagugucgcgaagagaagcaggaagcccucaaacugcuuaaugaggugcaggagcaucuggaagaggaagagagacucugccgggaaagccuggcugacucuuggggagagugucgcuccugccuggagaacaauuguaugagaauuuacaccacaugccaaccuagcuggucuuccguuaagaacaaaaucgaacgguucuuucgcaagaucuaucaguuccucuuucccuuccacgaggauaaugaaaaagaccugccuauuagcgagaaacuuaucgaagaggaugcccagcugacccagauggaggacguguuuucccaacucacggucgaugugaacucucuguucaaucggagcuuuaacguuuucagacagaugcagcaggaauuugaccaaaccuuccagucccauuucauuagcgauacagaccuuaccgagccguacuuuuuccccgcuuuuucuaaagaaccuaugacaaaggccgaccuggagcaguguugggauauccccaauuucuuucaacucuucugcaacuuuuccgugagcauuuaugaaucugucagcgagaccaucacgaagaugcugaaagcgauugaggaccugccuaagcaggauaaagcccccgaccacggcgggcucaucuccaagaugcugccgggacaggaucgcggccuuugcggcgaacuggaccagaaucucucuagauguuucaaauuucacgagaagugccaaaagugucaggcucaucugagcgaagauugcccugacgugcccgcccuucacacagagcuggaugaggcuauccggcucgugaacgucuccaaccagcaguacgggcaaauucugcagaugacccgcaaacaucuggaagacacagccuaucucguugagaagaugagaggacaguucggcugggugagcgaacuggcgaaucaggccccugagaccgaaaucauuuuuaacucuauccaaguggucccccggauucacgaggggaauaucuccaaacaggaugagaccaugaugacagaccuuagcauccugcccucuuccaacuucacgcucaagauuccucuggaagagagcgcugaauccucuaauuuuaucggauacgugguugccaaagcucugcagcacuucaaggagcauuucaagaccugguga

SEQ ID NO: 67597 - RNA, 1065 nt, Artificial Sequence
  derived and/or modified sequence opt5 from CLVS1__Homo_sapiens__NP_775790
augggccccgugagccugcucccuaaguaccagaaacugaacaccuggaauggggaccuugccaagaugacacaucugcaagcuggacucuccccggagacgaucgaaaaagccagacuggagcuuaacgaaaaucccgauguccugcaccaggacauucagcagguucgggauaugaucauuacccgcccugacaucggcuuccucagaacagaugacgcguuuauucugcgguuccugcgcgcuagaaaguuucaccaagccgaugccuuccggcuccuggcucaguauuuucaguaccgccagcuuaaccuggacauguucaaaaauuuuaaggccgaugaccccgggaucaagagagcucucaucgauggauucccuggcgugcuggagaaccgggaccauuaugggcgcaaaauucuucugcucuuugccgcgaauugggaucaaucuagaaacagcuucaccgacauccugcgggccauucugcucucccuggaagugcuuaucgaggaccccgagcugcagauuaauggauuuauccucauuaucgauuggucuaacuucagcuuuaagcaggcuuccaaacugacaccuucuauccuuaagcuggccauugaaggccuccaggacagcuucccggcucgcuucggcgggguccacuuugugaaucaacccugguacauccaugcccuguauacccugauuaaaccuuuccucaaggauaagacaagaaaacggaucuuucugcacggaaacaaucuuaacucccugcaccagcucauucaucccgaguuccugccuagcgaauuuggcgggacccuucccccguacgacaugggaacgugggcgcgcacccugcucggcccugauuauucugacgagaaugauuacacacacaccuccuacaacgccaugcauguuaagcacacaagcucuaaccuggagagagaaugcucccccaaacugaugaagcggagccagucuguggucgaggcugggacccucaaacacgaagagaagggagaaaaugagaacacgcaaccucugcuugcccuggacuga

SEQ ID NO: 67598 - RNA, 1023 nt, Artificial Sequence
  derived and/or modified sequence opt5 from CLYBL__Homo_sapiens__NP_996531
auggcccugagacuccugcggcgcgcugccagaggcgcggcugccgccgcccuucugcggcucaaggcuagccuggcugccgacaucccccgccuuggguacuccucuagcucccaccauaaauauauuccuagacgggcggugcuguacgucccgggaaacgaugagaagaaaaucaagaaaauucccucucucaauguugacugcgccgugcuggauugugaagacggcguggcugccaacaagaagaaugaggcucgccugagaaucgucaaaacccucgaagauauugaccuggggccuacagagaagugcgugcggguuaacagcguguccucuggacuugccgaagaggaucuggagacgcuccugcagagccgcguccuucccuccagccugaugcucccuaaaguggaaucucccgaggaaauccaaugguucgcggacaaguuuuccuuccaccugaaaggcagaaagcuggagcagccuaugaaucucaucccguuuguugagaccgccauggggcugcuuaacuucaaggcugugugugaagagacacugaaagucggaccccaggugggccucuuucuggaugccguggucuucggcggggaagacuuucgggcuagcauuggagccaccucuuccaaggagacacuugauauccuguaugcccgccagaaaauuguugugaucgcuaaggcguucggccuccaagccauugaccugguguacaucgauuuuagagacggggcuggacugcuccggcagagccgcgaaggcgccgccaugggguucaccggaaaacaggucauucauccuaaucagaucgcugugguucaagagcaguuuucucccuccccugagaagaucaaaugggccgaggaacugauugcggcuuucaaggaacaccagcagcuuggcaagggcgccuuuacauuccaagggagcaugaucgacaugccccugcucaaacaggcccagaacaccgugacgcuggcuaccuccauuaaggagaaauga

SEQ ID NO: 67599 - RNA, 744 nt, Artificial Sequence
  derived and/or modified sequence opt5 from CMA1__Homo_sapiens__NP_001827
augcugcuccugccccuuccucugcuccuguuccuucugugcagcagagccgaggcuggcgaaaucauugggggaaccgaguguaagccgcacucccggcccuacauggccuaucucgaaaucgugacaucuaacggcccuagcaaauuuugcgggggauuccugauucgcagaaauuuuguccugacggcggcucauugugccggccgguccaucaccguuacacucggggcccacaacauuaccgaggaagaggacacauggcagaagcuggaggugaucaaacaauuccgccaucccaaguacaauaccucuacacuucaccaugauaucaugcugcucaaacugaaggaaaaggcuagccuuacccuggccgugggaacgcucccuuuucccucccaguucaacuuugucccuccgggcagaaugugccggguggcuggcugggggcgcaccggaguucugaaacccggcucugacacacugcaggaggugaagcucagacugauggauccucaggccuguagccacuuccgggacuuugaucacaaucuucaacugugcgucgggaacccccgcaaaaccaaguccgcguucaaaggagacagcggcgggccucuccugugugccggaguggcucagggcauuguuucuuauggcagauccgaugccaagcccccggcuguguuuacacggaucagccauuaccgcccuuggauuaaucagauccuucaggccaacuga

SEQ ID NO: 67600 - RNA, 1305 nt, Artificial Sequence
  derived and/or modified sequence opt5 from CMAS__Homo_sapiens__NP_061156
auggacagcguggagaagggcgccgcuaccuccgucucuaaccccagagggcggccuagccgcggaagaccgcccaaacugcagcgcaauucccggggcgggcaaggaagaggcguugaaaagccuccccaccucgccgcgcugauccuugcucgcgggggaucuaaaggcauuccucugaagaacaucaaacaucucgccggcgugccccugauugggugggugcuucgggccgcucuggauagcggagccuuccaguccgucugggugucuacagaccacgaugagaucgaaaauguugcuaagcaguuuggcgcccaggugcauagacggagcuccgaggucagcaaggacucuuccacgagccucgaugcgauuaucgaguuccugaacuaccacaaugaaguggacaucguugggaacauucaagccaccucuccuugccugcauccgacagaucuccagaaaguggcugagaugauccgcgaagagggauaugacuccgucuuuagcguggugagacggcaccaguuccgcuggucugaaauucagaagggcgucagagagguuaccgagccccugaaucuuaacccugccaaacggccccgcagacaagauugggacggggaacuguacgagaauggauccuuuuauuucgcuaagcggcaccucaucgaaaugggcuaccugcagggcgggaaaauggccuauuacgagaugagagcggaacauagcguggauauugacguggauaucgacuggccuauugccgagcagcgcguccuucgguauggauacuuuggcaaggagaagcugaaagaaaucaagcuccugguguguaacaucgacgggugccugacaaauggacacauuuacguuuccggcgaucagaaagagaucauuucuuaugacgugaaggaugcuaucgggauuagccuccugaaaaaguccggaaucgaagucagacuuaucagcgagcgcgccuguucuaaacaaacccuguccagccucaagcuggacugcaagauggaagugucuguuagcgauaaacuugcuguggucgacgaguggcggaaggagaugggccuguguuggaaagaaguggccuaccucggcaacgaggucuccgaugaagagugccugaagagaguggggcugucuggagcccccgcugacgcguguagcacagcccagaaagcuguuggcuauauuugcaaguguaaugggggacgcggcgccauccgggaguucgccgaacauauuugccuccugauggagaaggugaacaauuccugucagaaauga

SEQ ID NO: 67601 - RNA, 321 nt, Artificial Sequence
  derived and/or modified sequence opt5 from CMC1__Homo_sapiens__NP_872329
auggcccuggaccccgcugaucagcaccucagacauguggagaaggacguccugaucccuaaaauuaugcgggaaaaggccaaagagcgcugcagcgaacaaguucaggauuucaccaaguguugcaaaaacuccggcgugcuuaugguggucaaguguagaaaggaaaauucugcgcugaaagagugccucacagcuuacuauaacgacccggccuuuuacgaggaguguaagauggaauaucugaaagagcgggaagaguuccgcaagacggggauccccaccaaaaagagacuucagaagcugccuacaagcauguga

SEQ ID NO: 67602 - RNA, 240 nt, Artificial Sequence
  derived and/or modified sequence opt5 from CMC2__Homo_sapiens__NP_064573
augcaccccgaccugagcccucaucuccacaccgaggaaugcaacgugcugaucaaucuucugaaggagugucauaaaaaccacaauauucucaaguucuuuggcuacugcaacgaugucgacagagaacugcggaaaugucuuaagaaugaguauguugaaaaccgcacaaaauccagagagcaugggaucgccaugcggaagaagcuguucaauccgcccgaggaaucugagaaauga

SEQ ID NO: 67603 - RNA, 207 nt, Artificial Sequence
  derived and/or modified sequence opt5 from CMC4__Homo_sapiens__NP_001018024
augccccagaaggacccuugccaaaaacaggccugugagauccagaagugccugcaggcuaacagcuacauggaauccaaaugucaagccgugauucaggagcucagaaagugcugugcgcaguauccgaaaggccggucugucguuugcagcggguucgaaaaggaggaagaggagaaucugacccgcaaguccgcuucuaaauga

SEQ ID NO: 67604 - RNA, 2040 nt, Artificial Sequence
  derived and/or modified sequence opt5 from CMIP__Homo_sapiens__NP_085132
augggccaggccgcugagcccaccggguacauggaaaacagcguguccuauucugccaucgaggacguccaacugcucagcugggaaaaugcgccuaaguacugccugcagcuuacaauuccgggaggcacgguucugcuccaggcugccaacuccuaucugagagaucagugguuccacucucuucaauggaaaaagaaaaucuacaaguauaaaaaggugcugagcaaucccucccggugggaggugguccucaaggaaauucgcacccugguggacauggcccugacaucuccucuccaggaugacagcaucaaccaggcuccccuggagauuguuuccaaacuucugagcgagaauaccaaccucacaacccaggaacaugagaauaucaucguggccauugcuccucugcuugaaaacaaucaucccccuccggaucugugugaguuuuucugcaagcacuguagagagcggccccgcucuauggucgugaucgaaguuuuuacaccugugguccaacggauucucaaacacaacauggacuucgggaagugccccagacugcgccuguuuacccaggaguacauccucgcccugaaugaacuuaacgcgggaauggagguggugaaaaaguucauucaguccaugcauggcccuacggggcacuguccccacccgagaguccugccuaaucucguugccgugugccuggcugccaucuauagcuguuacgaagaguuuauuaacucucgggauaauucccccagccuuaaggagauccgcaacggaugccagcaaccuugugacagaaaacccacccugccccuccggcugcugcauccuucuccggaucucgugucccaggaagcuacacugagcgaggcccgccuuaaguccgucgugguugcgucuagcgaaauccacguggaggucgaaagaaccuccacagccaaacccgcucugaccgccagcgcuggcaacgacucugagccuaaucucauugauugccugauggugucccccgccuguagcacgaugucuaucgagcuuggcccucaggccgaccggacacuggggugcuacguugaaauucucaagcugcugagcgauuaugacgacuggcgccccucccucgcuucucugcuucaaccgaucccuuuccccaaagaggcgcuggcccaugaaaaguuuaccaaagagcucaaguacgugauucagagauucgcugaagauccucggcaggagguccacagcugccugcuguccgugagagccggaaaggacggcugguuucagcuuuauagccccgggggagucgccugugaugacgauggcgagcuuuucgcuucuauggugcacauccugaugggguccugcuacaaaacaaagaaauuucugcucagccuggccgaaaacaagcucggaccuuguaugcugcucgcgcugcgcggcaaucaaaccaugguugagauccugugccuuaugcucgaauauaacauuaucgacaauaacgauacccagcugcagauuaucucuacacuggaguccacggacgugggcaaacggauguacgagcagcucugugauagacaacgcgaacugaaggagcuucagcggaaagggggacccaccagacugacacucccgagcaaguccaccgacgcugaucuggcccgccugcuuucuagcggcuccuucgggaaucucgaaaaccugucucuggccuucacaaaugucaccagcgcuugcgccgagcaucucauuaagcugccuucccuuaaacagcugaaccucuggagcacgcaguuuggagacgcuggccugcggcugcuuucugaacaccucacaaugcugcaagugcugaaucucugugagacccccguuaccgacgccgggcugcuugcgcuguccagcaugaagucucucugcucccugaacaugaauagcacaaaacugucugccgauaccuaugaggaccuuaaggcuaagcugcccaaccucaaagaaguggaugucagauacacagaggccugguga

SEQ ID NO: 67605 - RNA, 1122 nt, Artificial Sequence
  derived and/or modified sequence opt5 from CMKLR1__Homo_sapiens__NP_001135815
augagaauggaggacgaagauuacaacaccagcaucuccuauggcgacgaguaccccgauuaucuggacucuauugugguccucgaagaucugagcccucuugaggcccggguuacacgcaucuuccuggugguggucuacuccauugugugcuuucucgggauccugggaaauggccuuguuauuaucaucgcuacguucaagaugaaaaagaccgugaacauggucugguuucugaaucucgccguggcggacuuccuguuuaacguuuuccugccgauucacaucacauaugcugccauggauuaccauuggguguuugggaccgccauguguaaaauuucuaauuuccuccugauccacaacauguuuacaagcgucuuccuucugaccauuaucuccucugacagaugcauuagcgugcuccugcccguguggucccagaaucaucggagcguccgccuugcuuauauggccuguaugguuaucugggugcuggccuuuuuccucucuuccccuagccugguguuuagagauacagcuaaccugcacggaaagaucucuugcuucaauaacuucucccucagcacccccgggucuuccagcuggccuacgcauucccaaauggaccccgucggcuacucucggcacauggugguuaccgugacacgcuuucuguguggauuccuugucccugugcugauuaucaccgcgugcuaccucacaauuguuuguaaacugcagagaaaucggcuugccaagaccaagaaaccguuuaagaucauugugacgaucaucauuacauucuuucugugcuggugucccuaucacacccucaaccugcuggaacuccaucacacagcuaugccuggcagcgucuucucccugggccuuccccuggccaccgcucucgccaucgcgaauagcugcaugaacccuauucuguacguguuuauggggcaggauuucaaaaaguuuaaagucgcccuuuucucucgccuggugaaugcucucuccgaggacaccggacauagcucuuaucccagccacagauccuuuacaaagaugucuagcaugaacgagcggacguccaugaacgaacgcgagaccggcaugcuguga

SEQ ID NO: 67606 - RNA, 1230 nt, Artificial Sequence
  derived and/or modified sequence opt5 from CMPK2__Homo_sapiens__NP_001243406
auggccuucgcuagacggcugcuccgcggcccccugagcgggccucuucugggaagacggggcgugugcgccggggcgauggcuccgccccgcagauuuguccucgagcugccugacuguacccuugcccacuucgcccugggagcugaugcccccggcgacgcugaugccccugacccccggcucgcggcccugcuggggccuccggaacgcuccuacucucucugcguucccgugacaccugaugcuggauguggcgccagagugcgggcugcccgccugcaucagagacuucugcaccaacuccggcgcggccccuuucagagaugccagcugcuucggcugcucuguuauugcccugggggacaggcgggcggggcccaacagggauuccugcugcgcgacccccucgaugacccggauacgagacaggcucugcuugagcugcucggcgccugucaggaagcuccucggccccaucugggggaguuugaagccgacccuagaggacaacuuuggcagcgccugugggagguccaggauggccggagacuccaggugggcugcgcccaaguugugcccguccccgagccuccgcugcaccccgugguuccugaccugcccagcuccguggucuucccugaucgcgaagcugcgcgggccgugcucgaggaauguaccucuuuuauccccgaggcuagagccgugcuggaccuugucgaccagugcccgaagcagauucaaaaagggaaguuccagguuguggccaucgagggacuggaugcuacaggcaaaaccacagugacccagagcgucgccgacucccucaaggcggugcugcuuaaaucuccucccagcuguauugggcaguggcgcaagaucuuugaugacgaaccuacaauuauccggagagcuuucuacucccugggaaacuauaucguugccagcgagauugccaaggaaucugcuaaaucccccgugaucgucgaucgcuacuggcauagcaccgccacguaugcuauugccaccgaggugucuggcgggcuccaacaucugccucccgcgcaccacccgguuuaccaguggccugaagaccugcucaagcccgaucugauccuucugcucacagugucccccgaggagcggcugcagagacugcagggacgcggcauggagaaaacccgggaagaagccgagcuugaagcuaauagcgucuuuagacaaaaguga

SEQ ID NO: 67607 - RNA, 786 nt, Artificial Sequence
  derived and/or modified sequence opt5 from CMSS1__Homo_sapiens__NP_001161396
augcacggcgaggccagcgacggggaaggagagggcgauaccgaagugaugcagcaagagacaguccccguuccugugccguccgaaaagacgaaacagcccaaggagugcuuccugauccagccuaaagagagaaaggaaaacaccacaaaaacccggaagcgcagaaagaaaaagauuacagacgugcucgcuaaaucugagcccaagccugggcugcccgaagaucuucagaaacugaugaaggacuacuauagcucccggcgccucgucaucgagcuggaggaacuuaaucugccugauucuuguuuucucaaggccaacgaccugacccauagccuguccucuuaccucaaagagauuugcccgaagugggugaaacugagaaagaaucacagcgaaaagaaguccguucuuaugcugaucauuuguagcucugcggugcgggcucucgagcugauccgcuccaugacagccuucagaggagauggcaaagucaucaaacuuuuugccaagcauauuaaagugcaagcucagguuaagcugcucgaaaaacgggugguccaccugggggugggaacccccggccgcaucaaggagcuggugaaacagggcgggcucaaccugagcccucuuaaguuccuggucuuugacuggaauuggagagaucagaagcuccggcgcaugauggacauucccgagaucagaaaagaaguuuucgagcugcuugaaaugggagugcugucucucugcaaguccgagagccugaaacugggccucuuuuga

SEQ ID NO: 67608 - RNA, 549 nt, Artificial Sequence
  derived and/or modified sequence opt5 from CMTM3__Homo_sapiens__NP_853531
auguggcccccugacccggaucccgacccugaucccgagccugccggcgggagcagacccggaccugcugugccgggccugcgggcccuccugcccgcgcgcgcuuuccuuugcucccugaaggggagacuccugcuugccgaaucuggacugagcuuuaucaccuucauuuguuacgucgccuccucugcuagcgccuuucucacagcuccucugcuggaguuccuccuggcccuuuauuuucuguucgcggacgccaugcagcucaacgauaaauggcaaggccugugcuggcccaugauggacuuucuucgguguguuacggcugcccugaucuacuucgcuauuuccaucaccgccauugcgaaguauucugauggggccagcaaagcugccggaguguuuggcuucuuugcuacaaucguguucgccaccgacuuuuaccucaucuucaaugaugucgccaaguuccugaaacagggcgacuccgcugaugaaacaaccgcgcacaagacagaggaagagaacagcgacucugauuccgacuga

SEQ ID NO: 67609 - RNA, 378 nt, Artificial Sequence
  derived and/or modified sequence opt5 from CMTM5__Homo_sapiens__NP_001032365
augcugagcgccagagaccggcgcgauagacaccccgaggaaggcguggucgcugagcuccagggguucgccguugacaaggcguuucugaccucccauaaaggaauccuucuggaaacagagcucgcucugacgcuuauuaucuucauuugcuuuaccgccucuaucagcgccuacauggcugccgcucugcucgaguucuuuauuacacuggccuuccuguuucucuaugcgacccaauacuaucagcgguucgaucgcaucaacuggccuugucugguguuuggcaucauucuuguguccaucuucgccuacgacgcuuuuaagauuuauagaacagaaauggccccgggggcuucucagggagaucagcaauga

SEQ ID NO: 67610 - RNA, 528 nt, Artificial Sequence
  derived and/or modified sequence opt5 from CMTM7__Homo_sapiens__NP_612419
augagccacggcgccgggcuggugagaaccacaugcuccucuggaagcgcucucggccccggggccggagcggcucagccuuccgccucuccgcuggagggccuucuggaccucagcuacccccggacgcaugccgcucugcuuaaggucgcccaaaugguuacccugcucaucgcuuucauuugugugcgcuccucucuguggacaaacuauagcgccuacuccuauuuugaaguggucaccaucugcgaucugauuaugauccucgcguucuaccuggugcaccuuuuuagauucuaucggguucugacauguauuagcuggccucucucugagcugcuucauuaccugaucgggacccuccugcugcucaucgccuccauuguggcugccagcaaaucuuauaaucaguccggacuggucgcuggcgccaucuuuggcuucauggcgacauuucuuugcauggccagcauuuggcugucuuacaagaucuccugugugacccagagcacggacgcugccguuuga

SEQ ID NO: 67611 - RNA, 522 nt, Artificial Sequence
  derived and/or modified sequence opt5 from CMTM8__Homo_sapiens__NP_849199
auggaggaaccccagagagcccggagccacaccgugacaacgaccgcuuccucuuucgccgagaacuuuagcacauccucuagcuccuucgcguacgaccgcgaauuucugagaacccucccuggcuuccugaucgucgcugagauuguucuugggcugcucguguggacacugaucgccggaaccgaauauuuucgggugccggccuucggcugggucauguuuguggcuguuuucuacugggugcuuacagucuuuuuccugauuaucuauauuaccaugacguacacccgcaucccccaagugccuuggacaaccguugggcucugcuuuaauggaucugccuucgugcuguaucugagcgcugccgucguggaugcguccagcgugucucccgagagagacucccauaacuuuaauagcugggccgcuucuuccuucuucgccuuucucgucacaaucuguuacgcuggcaacaccuauuucagcuuuauugccuggcggucucgcacgauccaguga

SEQ ID NO: 67612 - RNA, 2508 nt, Artificial Sequence
  derived and/or modified sequence opt5 from CMTR1__Homo_sapiens__NP_055865
augaagagacggaccgaccccgagugcacagccccuaucaaaaagcagaaaaagcgcguggcugaacuggcccucagccuguccucuacgagcgaugacgagccgcccuccucugucagccacggcgcgaaggcuuccaccacaucucuuagcggguccgauagcgaaaccgagggaaaacaacauucuuccgacagcuucgaugacgccuuuaaggccgauucucugguugaaggcacauccagcagauacucuauguauaacuccgugagccagaaacucauggcuaagaugggguuccgggagggagagggccuggggaaauacucccagggacgcaaggacauuguggaagccucuagccagaaaggcagacggggccuugggcugacccuccgcggauuugaucaagagcugaaugucgacuggagagaugaaccugagcccuccgcuugugaacaggugagcugguucccugagugcacaaccgagauccccgacacgcaggaaaugucugauuggaugguugugggcaagcggaagaugauuaucgaggacgaaaccgaguuuuguggggaggaacugcuccacuccguccugcagugcaaaagcguguucgacguucuugauggagaggaaaugcgcagagcccggacacgcgcgaacccuuaugagaugauuagaggcguguuuuuccugaaucgggccgcuaugaagauggccaacauggacuuugucuucgaucgcauguuuaccaauccgagagacucuuacgggaaaccccucgugaaggaucgggaagcugagcugcuuuauuucgccgacgugugugcgggaccuggcggcuuuagcgaguacguccuguggcgcaaaaaguggcaugccaaaggguucggaaugacacucaagggccccaacgauuucaagcuggaagacuuuuauuccgcuucuagcgagcuguucgaaccuuacuacggggagggaggcaucgauggggacggagauaucaccagacccgaaaauauuuccgccuuucggaacuucguucucgacaauacggacagaaaaggcgugcacuuucugauggcugauggcggguucagcguggagggacaagagaaccuucaggaaauccugucuaagcagcuccugcuuugccaguuucugauggcccucuccauuguccgcacaggcgggcauuucaucuguaaaaccuuugaccuguucacaccguuuagcgugggacugguuuaucuccuguacugcuguuucgagcgggugugccuuuuuaagccuauuaccucuagacccgccaauuccgaacgcuaugucguguguaaaggccugaagguugggaucgaugacgugcgggauuaccucuucgcugucaacauuaagcugaaucaacuuagaaacaccgacagcgaugugaaucuggucgugccucucgagguuaucaaaggcgaccacgaguucacagauuauaugauccgcuccaacgaaucucacugcagccugcagauuaaggcgcuggccaaaauccaugcuuuugugcaggacacgacccucuccgagccccggcaagccgaaauuagaaaggagugccugcgccuuuggggaauccccgaucaggcccgggucgcuccuucuagcuccgacccgaaaagcaaguucuuugaacugauucagggcacagagaucgauaucuucucuuacaagcccacccuccugacauccaaaacccuggagaagauuagaccuguguuugacuaucgguguaugguuagcgggucugaacagaaauuccuuaucggacucggcaagucccaaauuuacacgugggacgggcgccagagcgauagauggaucaaacuggaccugaagacagagcucccccgggauacccugcuuucuguggaaauuguccacgagcugaagggagaaggcaaagcccagagaaagaucagcgcgauccauauucucgacgugcuggugcugaacgggaccgauguucgcgagcagcacuuuaaucaacggauccagcuugcugagaaauucgucaaggccguguccaaaccuagcagacccgacaugaacccgauucgcgugaaggaagucuacagacucgaggaaauggagaaaaucuuugugcggcuggaaaugaagauuaucaaggggucuuccggaacaccuaaacugagcuauaccggccgcgaugacagacacuucguucccauggggcucuacauugugcggacagucaaugagccuuggacgaugggauuuuccaagucuuucaaaaagaaauuuuucuauaacaagaagaccaaagauagcacauucgaccugcccgccgauuccaucgcuccuuuucauaucugcuacuauggccgccuuuucugggaguggggcgacggaauuagagugcacgauucucagaagccccaggaccaagacaaacugagcaaggaagauguucucuccuuuauccagaugcaucgggccuga

SEQ ID NO: 67613 - RNA, 2313 nt, Artificial Sequence
  derived and/or modified sequence opt5 from CMTR2__Homo_sapiens__NP_060818
augagcaagugcagaaaaacccccgugcagcaacuggccuccccugcuucuuucagcccggacauccucgccgauauuuuugagcuguucgcgaagaacuuuuccuacggcaaaccccuuaauaacgaauggcagcugccugaccccucugagaucuucacaugugaucacacggaacucaaugcuuuucuggaccuuaagaacagccugaaugaggucaaaaaccuccuguccgauaagaagcuggacgaauggcaugagcacaccgccuucacaaauaaagccgggaagauuaucucucauguucggaaaagcgugaacgcugagcucugcacccaggccugguguaaguuucacgaaauucugugcuccuucccucuuaucccccaggaggcuuuucaaaauggaaaacugaacagccuccaucugugugaagccccuggcgcguucaucgccucucuuaaucacuaucugaagucccaccgcuuuccgugccauuggagcuggguggcuaacacacucaaucccuaccacgaggccaacgaugaccugaugaugauuauggaugacagacugaucgcuaauacccuccauuggugguauuucgggccugauaacacaggagacauuaugacccugaaguuucuuacgggccugcagaacuucaucucuuccauggccaccguccaccucgugacagcggaugggagcuucgacugucagggaaaucccggcgagcaggaagcccugguuucuucccuucacuacugcgagguggucaccgcucugacaacccucggcaacgggggcagcuuugugcugaaaauguucacgauguuugaacauuguuccauuaaucugauguaucuccugaacugcuguuucgaccaaguucacguguuuaagccugccacaucuaaagcuggaaauagcgaggucuacguggugugccuucauuauaaggggcgggaagccauccacccccugcucuccaaaaugacccugaacuucggaacagagaugaagcgcaaagcccuuuuuccgcaucacgucauuccugauagcuuccugaagagacacgaggaaugcuguguguuuuuccauaaguaccagcucgagaccaucucugaaaauauccggcuguuugagugcaugggcaaagcugaacaggagaagcugaacaaucuccgcgacugugcgauucaguacuucaugcaaaaauuucagcugaagcaccuuuccagaaacaauuggcugguuaaaaagagcucuaucgggugcagcaccaacacaaagugguucggacagcggaauaaauauuucaagacguacaacgagcgcaaaaugcucgaagcccuguccuggaaggauaaaguggcuaagggcuauuuuaauucuugggccgaggaacauggcgucuaccaccccgggcaaagcuccauucuggagggaaccgccagcaaccuugaaugucaccucuggcauauccuggagggcaagaaacugccuaaggugaaaugcucucccuucuguaacggggagauucucaagacacugaaugaagcuaucgagaaaucccuuggaggcgccuuuaaccuggacagcaaguucagacccaagcagcaguauucuugcuccugucacguuuuuagcgaggaacucaucuucuccgagcugugcucucugaccgaaugucuucaggaugagcaaguggucgugccuagcaaucagauuaaaugccuccugguuggguuuuccacacugcggaacaucaagaugcauauuccgcucgaagugcgccugcuugagucugcggaacugaccacguucagcugcucccuccugcacgacggagaucccacauaccagagacuguuucuugacugucuccugcauagccugcgggagcuccacaccggcgaugucaugauccugccugugcuuucuugcuucacccgcuuuauggcuggccugauuuucguccuccacuccuguuuuagauucaucacauucgugugccccaccagcucugacccucugcggacaugugccguucugcuuugcgugggguaucaggaucuccccaauccggucuuuagauaccugcaauccgugaacgagcugcucagcacgcugcuuaauucugacagcccucagcagguucugcaguucgugcccauggaaguccuccugaaaggagcccugcuugacuuucugugggaucucaacgcugccaucgcuaagcgccaucugcacuucauuauccaacgggagagagaagagauuaucaauucccuccagcugcagaacuga

SEQ ID NO: 67614 - RNA, 12210 nt, Artificial Sequence
  derived and/or modified sequence opt5 from CMYA5__Homo_sapiens__NP_705838
auggccagccgggacuccaaccacgcuggcgagucuuuccuggggagcgauggagacgaagaggccacacgggaacucgagacagaagaggaguccgaaggcgaggaagaugagacggccgcugagucugaagaggaacccgacagccgccuguccgaucaagacgaggaagggaagaucaaacaagaguacaucaucucugauccuagcuuuuccauggugaccguccagagagaggacagcggaauuacaugggaaaccaauucuucccggagcucuacacccugggccuccgaggaaagccagaccucuggcguuugcucccgcgaggggagcacagugaacagcccgccuggaaaugugucuuucaucgucgaugaagugaagaaaguuagaaagcggacccauaaaagcaagcacggcucccccagccuucgcagaaagggcaaccggaaacgcaauucuuuugagucccaggacgugccuacgaacaagaaagggagcccccugaccucugccagccaaguccucacaaccgagaaggaaaaauccuauacaggaauuuacgauaaggcuagaaagaaaaagaccacgucuaauacaccucccaucaccggcgccaucuauaaagagcauaagccccuggugcuucggccuguuuacauugggacagugcaguauaaaaucaagauguucaacagcgucaaagaagaacugauuccccuccaguuuuacggaacccugccuaagggcuaugugaucaaggaaauucacuaccgcaaagggaaggacgcuuccaucagccuggagcccgaucucgacaauucuggauccaacaccgugagcaaaacaagaaagcuggucgcccagucuauugaggacaaaguuaaggaaguguucccgccuuggcggggcgcgcuuuccaagggcagcgagucccugacgcucauguuuucucaugaagaucagaagaagaucuacgccgacagcccccugaaugcuaccuccgcccuugagcacacagugccuucuuauagcuccagcgggcgcgcugagcagggaauccagcugagacacucucaguccgucccccaacagcccgaagaugaggccaaaccucaugaaguggagccgcccagcguuaccccugacacacccgcgaccauguuccuccggacgacaaaggaagagugugagcuggccucuccuggcaccgcugccuccgaaaacgauagcucugugagccccuccuuugcuaaugaggucaaaaaggaagacguguacagcgcccaccauucuauuucccuggaggccgcuagcccggggcucgcggccuccacccaggauggacuggacccugaucaagaacagcccgaccuuacaucuaucgagagagcugagccuguuagcgccaagcugacccccacacacccuuccgugaaaggcgaaaaggaggaaaacaugcucgagcccucuauuagccuguccgaaccgcuuaugcuggaggagccugaaaaagaggaaaucgagacgucucuccccauugccaucacccccgagccugaagauagcaaucuggucgaggaagagaucguggaacuggacuauccggagagcccccuggucagcgagaagccuuuucccccucacaugucucccgaaguggagcauaaagaagaggaacugauucuuccucugcucgcugccuccagccccgagcacguugcgcugucugaggaagaacgcgaagagaucgcuuccgugagcacagggucugccuuugucuccgaauacagcgugccgcaggaccuuaaccaugagcugcaggagcaagaaggagagccuguucccccuuccaacguggaagccauugcugagcacgccguccucagcgaggaagagaaugaagaguucgaggcuuauucucccgccgcggccccgaccagcgaguccucucugagcccuuccacaaccgagaagacgucugaaaaccagagcccccuguuuuccaccgugacaccugaguacauggugcucucuggcgaugaagcuagcgaguccggcugcuauacccccgacagcacaucugccuccgaauacagcguucccucucuggcuaccaaggagucccuuaaaaagacgaucgaucggaaaagcccucugauucucaagggggucuccgaguacaugaucccgucugaagagaaagaagacacaggauccuucacccccgccguggcgccugccuccgagcccagccugucuccuuccacaaccgaaaagaccagcgagugucagucuccccugccuagcacagcuacguccgagcauguggucccgucugaaggcgaggaucuugggagcgaaagauucacccccgacuccaaacucaucucuaaguaugccgcuccucugaaugccacacaggagagccaaaagaaaauuaucaacgaggccucccaguuuaagcccaaaggaauuagcgaacacaccgugcugucuguugauggcaaggaggugaucgggccuuccagccccgaccucgucguggcuuccgaacacucuuucccgccucauacaaccgagaugacgagcgaaugccaggcgccgccccuguccgccacaccuucugaguacguugugcuuagcgaugaggaagcugucgagcuggaacgcuauacccccuccagcaccucugccuccgaguuuagcgugccuccguacgccacacccgaagcucaggaggaggaaauuguucaccggucucucaaucugaaaggcgccuccagcccuaugaaccugucugaggaagaccaagaggauaucggacccuucagcccugacuccgcguuugugucugaguucagcuuucccccguaugcuacccaggaggccgagaagagagaguucgaaugugauuccccuauuugccuuacaagccccuccgaacauacgauccucucugacgaggacaccgaggaagccgagcuguuuagcccugauuccgcuucucaggucagcauucccccuuuccgcauuuccgaaacagagaagaaugaacuggagcccgacucucuccugaccgccgugagcgcguccggcuacagcuguuuuucugaggcugaugaagaggacaucggguccacagccgccaccccggugagcgaacaguucucuuccagccaaaaacagaaggcugagacguuuccucuuaugucuccccuggaagaucucucccugcccccuagcaccgacaaauccgagaaggccgagauuaaaccggaaauccccacaaccagcacaucugucagcgaguaucugauucuugcucagaagcaaaagacccaggccuaccucgaaccugaguccgaagaucugauccccucucaccugacaagcgagguugagaaaggagaacgggaggcguccucuagcguggccgcuaucccugccgcucuccccgcccaguccucuauugugaaggaagagaccaaaccugccagcccgcacuccguccugcccgacagcgugccugcuaucaagaaagagcaggaacccacggcggcccuuacacugaaggcugccgaugagcaaauggcccucucuaagguuagaaaagaagagauugugccugacucccaggaagcuaccgcccaugucagccaggaucagaagauggagccccaaccgccuaacgugcccgagucugaaaugaaauacuccguucugcccgacaugguggaugagccuaagaaaggcgucaagcccaaacuggugcuuaauguuaccagcgaacucgagcagcgcaagcuguccaagaacgaaccugaggugaucaaaccguauucuccccugaaggagacaagccucuccgggccugaagcgcugagcgcugucaaaauggagaugaagcacgacucuaaaauuaccacgacacccaucgugcuucauuccgccagcucuggaguggaaaagcaggucgagcacggcccucccgcccuggcuuucagcgcccucuccgaagagaucaagaaagagauugaaccgucuagcuccaccacaaccgcgucuguuacaaagcuggacagcaaucugacccgggcugugaaagaggaaaucccuacggauuccagccuuauuacccccguggacagaccuguccugacaaagguggggaaaggcgagcucggaucuggccugcccccucucguuaccuccgccgaugagcauagcgugcuggccgaagaggacaaggucgcuaucaagggggccucccccauugaaacaucuagcaaacaccuugcuugguccgaggccgaaaaggagaucaaauucgauucucugccgagcguguccagcaucgcggagcacucuguucucuccgaaguggaggccaaggaagucaaagcuggacugccugugauuaagaccuccucuagccagcauagcgacaagucugaggaagcccgcgucgaggauaaacaagaccugcuuuucuccacggugugcgauagcgagcggcugguuucuagccagaagaaaucccucaugagcacauccgaagugcuggagcccgaacacgagcucccccugucucuuuggggcgaaaucaagaaaaaggagaccgagcugccuagcucccagaacgucucuccggcuagcaagcauauuauccccaaagggaaggacgaagagacagccuccucuagcccugaacucgagaaucuggccuccggacuggcucccacccuucugcuccugagcgaugacaaaaacaagccugcgguggagguuucuuccaccgcccaaggcgacuuccccagcgaaaaacaggauguggcucucgccgagcugucucuugaaccugagaagaaagacaagccccaccagccgcuggaacugccuaaugccggguccgaguuuagcucugaucucggcagacaguccggaagcauuggcacaaagcaagcuaaaucucccaucacggagaccgaagacuccguccuggagaaggggccugccgaacuucggagccgcgagggaaaagaagagaacagagagcugugugcgagcuccacaaugcccgcuauuucugaacucagcucccugcuccgggaggaaucucagaacgaggaaaucaagccguucagcccuaaaaucauuucccuggagucuaaggagccgcccgccagcguggccgaaggcgggaauccugaggaauuucagcccuucaccuuuucccuuaagggacugagcgaggaggugucucauccugcugauuucaaaaagggcgggaaccaggaaaucggcccgcugcccccuacaggaaaucucaaagcccaaguuaugggcgacauucuggauaaacuuuccgaggaaaccgggcaccccaacagcucucagguccugcaguccaucacggagccuagcaaaauugcgcccuccgaccuccugguggaacagaagaagacagagaaagcccuccacucugaucaaaccgugaagcugccugacgucagcaccuccucugaggauaaacaggaccuuggaaucaagcaguuuagccugaugagagaaaaucugccgcucgagcaguccaagagcuucaugacaaccaagcccgcugaugugaaggaaacaaaaauggaggaauuuuucaucucuccuaaggacgagaacuggaugcugggcaaacccgagaauguugccucccaacaugaacagcgcauugcugggagcgugcagcuugacucuagcuccucuaacgagcugcggccuggacaacucaaggccgcugucagcuccaaagaucacacgugcgaagugagaaagcagguucugccccauagcgccgaggaaucucaccucuccagccaggaggcgguguccgcccuggacaccucuagcggcaauacagagacccuuuccucuaaaagcuacuccucugaagaggucaagcuggcugaagaacccaagagccuggugcucgccggcaacguugagcgcaauaucgcugaagggaaagagauucacucccugauggaaagcgagucucuucugcucgaaaaggccaacacagagcuguccuggccuagcaaagaggauucucaggaaaagaucaaacugccgcccgagagauuuuuccaaaagccuguguccggacucagcgucgaacaggugaagucugagaccauuagcuccagcgugaaaacggcccauuuccccgcugaaggcgucgagccugcgcuugggaaugagaaggaagcccaccgguccaccccgcccuuuccugaggaaaaaccccuggaggaaucuaagaugguucagagcaaagugaucgacgaugcugacgagggaaagaagccuucccccgaggugaaaaucccgacacagcgcaagccuauuucuagcauccaugccagagaaccccaauccccugagucucccgaagucacccagaacccgccuacacagcccaaaguggccaagcccgaucugccugaggagaaaggcaagaaggggauuagcuccuucaaaagcuggaugucuucccucuuuuucggaagcucuacccccgacaauaagguugcugaacaggaggaucuggaaacacaaccuuccccgagcguggagaaagccgucacggugaucgaccccgaaggcaccauuccuacaaacuuuaacguugcggagaagcccgccgaucacucucuuuccgaggugaaacugaagaccgcugacgaaccucggggcacccucgucaaaagcggggauggacagaaugugaaggagaagucuaugauccuguccaacgucgaagaccugcagcaacccaaauucauuagcgaggugucccgcgaagacuauggcaagaaagagaucagcggggauucugaggaaaugaauaucaacagcguugugacauccgccgacggagagaaucucgaaauucagucuuacagccuuaucggcgagaagcuggugauggaagaggcuaaaacgauugucccuccgcauguuaccgauuccaagagagugcagaagcccgccaucgcgccucccucuaaauggaacauuagcaucuuuaaggaggaaccucgguccgaccagaaacaaaagagccugcucucuuucgauguggucgacaaagugccccagcagccgaaguccgccagcucuaauuuugcuuccaagaacaucacaaaagagagcgaaaagccugagucuauuauccugcccguugaggaauccaaagggagccuuauugauuucuccgaggaccgccugaagaaagaaaugcagaaucccaccucucucaagaucagcgaggaagagacaaagcugagauccgugagcccuaccgagaaaaaggauaaccuggaaaaucggucuuauacgcucgccgagaaaaagguccuugcugaaaaacaaaacuccguggcgccccuggagcugcgcgacagcaaugaaauuggaaagacacagaucacccucggcucuagaagcaccgagcugaaggaguccaaagcugaugccaugccucagcacuuuuaccagaacgaagacuauaaugagcggccgaagaucauugucggcucugaaaaagagaagggggaagagaaagagaaccaaguguacguucuuagcgaaggaaagaaacagcaggagcaccagcccuacuccgugaacgucgcggaaagcaugucuagagaguccgacaucagccugggccauucucucggggagacacaauccuucagccuggugaaggccaccuccguuacagaaaagucugaggcuaugcuggccgaagcucacccugagauucgcgaagccaaagccgugggaacccagccccauccucucgaggagagcaagguccuuguggagaagacgaagacauuccugcccguggcgcuguccugucgggaugagaucgaaaaucacucucucagccaggagggcaaccugguucuugaaaaauccagcagagacaugccggaucacucugaggagaaggaacaauuucgcgaguccgaacugagcaaagggggaucugucgacauuaccaaagagacagugaagcagggcuuccaggaaaaagcugugggcacccagccucggccccucgaggaguccaagguccugguugagaaaacgaagaccuuucugccuguggugcucagcugccaugaugagaucgaaaaucacucucuuucccaagaggggaaccugguccuggaaaagagcagcagagacaugcccgaucauuccgaagagaaagaacaguucaaggagucugaacucuggaaaggaggcagcguggacauuacaaaggaguccaugaaagagggguuuccuucuaaggaaagcgagcgcacccuggcccggcccuucgaugaaacaaaguccucugagaccccgcccuaucuucugagcccuguuaaaccccagacacucgcuuccggagccucuccugaaaucaaugccgugaagaaaaaggagaugccgagaagcgagcugacccccgaacgccacacgguccauacaauccagaccuccaaagacgauaccagcgacgugccuaagcaaucuguucugguguccaaacaccaccucgaggcugccgaagauacacgggucaaggagccccuuagcucugcgaaguccaacuacgcccaguuuauuagcaauaccucugcuuccaacgccgacaaaauggugagcaauaaggaaaugccuaaagagcccgaggacacauaugcuaagggcgaagauuucacggugaccuccaaaccugccgggcugagcgaggaccagaagacagcguuuucuaucauuagcgaaggaugcgagauccugaacauucaugcccccgcuuucaucuccucuaucgaucaggaggaaagcgagcaaaugcaggacaagcucgaauaccuggaggaaaaagccuccuuuaagaccauuccgcuuccugaugacucugagacagucgcuugucacaaaacccucaagagcagacucgaggaugaaaaaguuacgccccugaaggagaauaagcagaaagaaacccauaagacaaaagaggaaaucuccaccgacucugagacagaucugagcuucauucaaccuaccauccccuccgaggaagacuauuuugagaaguacacgcucauugauuauaacaucagcccggacccugaaaaacagaaggcuccccagaaacuuaauguggaggaaaaacugucuaaggaggugacagaggaaaccaucuccuuccccgucagcucuguggaguccgcccuggaacacgaguacgaccucguuaaacuggaugagagcuucuacggcccugaaaagggccacaacauucuuucccaucccgagacacagucucaaaauagcgccgaccggaacguguccaaagauaccaagcgcgacgucgauagcaaaucuccugggaugccgcuguuugaagcggaggaaggagugcucuccagaacccagaucuuccccacaacgauuaagguuaucgacccugaguuucuggaggaacccccugcccuggcuuuccucuauaaggaucuuuacgaggaagccgugggcgagaaaaagaaagaagaggagaccgcuagcgaaggggacucugucaauuccgaggccagcuuucccucucggaacagcgauacagacgauggaaccggcauuuauuucgaaaaguacauccugaaagacgauauucugcacgacacaucccucacccagaaggaccaggggcaaggacuggaggaaaagcgcgugggcaaagaugacucuuaucagccgaucgccgcggagggcgagaucugggggaaguuuggaacgauuugcagagagaaaagccuugaggaacagaagggcguuuacggggagggagaguccguggaucaugucgaaacagugggcaacgucgcuaugcagaaaaaggccccuaucaccgaggacgugcggguugccacccaaaagauuagcuaugcugugcccuucgaagauacacaccauguccuggagagagccgacgaagcugggucucacggaaaugaggugggcaacgccuccccugaggugaaucucaacguucccgugcaggucagcuuuccugaagaggaguucgcguccggcgccacccacgugcaggagacaucucuggaagaacccaaaauccugguuccgcccgagccuagcgaagaacgccucagaaauucccccgugcaagaugaauacgaguuuacggaaucucuucauaacgaggucgugccucaggacauucugagcgaggaacuguccagcgagucuacccccgaagauguccucucccaggggaaggagagcuucgagcacaucucugaaaaugaguuugcuuccgaagccgagcagagcaccccugcugaacaaaaagagcugggaucugagagaaaggaagaggaccagcuuuccagcgaagugguuaccgagaaagcccagaaggaacugaagaaaucucagaucgauacauacuguuauaccugcaaguguccgauuagcgcgacggacaaaguguucggcacccauaaggaucacgaggucuccacacucgacaccgccaucagcgcugugaaaguucaacuggccgaguuccuggaaaaccuccaggagaagucccugcgcauugaggcuuuugugucugagaucgagagcuucuuuaauacaauugaagagaacugcuccaagaaugaaaaacggcuugaggaacagaacgaggagaugaugaagaaaguccuggcccaguacgacgaaaaggcucaaucuuucgaggaagugaaaaagaaaaagauggaguuucuccaugaacagauggugcacuuccugcagagcauggauaccgccaaggacacacuugagaccaucguuagagaggcggaagaacuggaugaagccgucuuucucacguccuucgaggaaaucaaugagcgccugcugucugcuauggagagcacagccucccucgagaaaaugcccgccgcuuuuagccuguucgagcacuaugacgauucuuccgcccggagcgaccagaugcuuaagcaaguggcggugccucagcccccuagacuggaaccccaggagccgaacucugcuaccuccaccacaauugccgucuacuggagcaugaauaaagaggaugugaucgacucuuuucaaguuuauuguauggaagaaccucaggaugaccaggaagugaacgagcucgucgaagaguaccgccugacggugaaggaguccuauugcauuuucgaagaucuugagcccgacagauguuaccagguuugggugauggccgucaacuuuaccgggugcagccugccuuccgaacgggcuaucuuccgcacagcccccagcaccccggugauuagagcugaggacuguacaguuugcuggaauaccgccacaauccgguggcgcccuaccacgcccgaagcgaccgagacauacacccucgaguauugcagacaacauucucccgaaggagagggccugcgguccuucagcgggauuaaaggccugcagcucaaggugaaccugcagccuaaugauaacuacuuuuucuaugucagagccaucaaugcuuuuggaacaucugaacagagcgaggccgcucuuaucuccacccgcggcacgcgguuccugcuccugagagaaacagcccaccccgcgcuucauauuucuagcuccgggaccgugaucucuuuuggagagcgccggagacugacagagauuccuagcgugcucggcgaggaacugccguccugugggcaacacuacugggaaaccacggucaccgacugccccgccuaucggcugggaaucuguuccucuuccgcuguucaggccggcgcucucgggcagggcgagacaagcugguacaugcacugcucugagccucagcgcuauaccuucuuuuacuccggaauugugagcgaugugcaugucacagaaagacccgcccgggugggcauccugcuugacuacaacaaucaacgccugaucuucauuaacgccgaguccgaacagcuccuguuuaucauuagacaccgguucaaugaggggguucauccugcuuuugcgcuugaaaagcccggaaaauguacccugcaccucggcaucgagccuccggauucugugcgccauaaguga

SEQ ID NO: 67615 - RNA, 1311 nt, Artificial Sequence
  derived and/or modified sequence opt5 from CNBD1__Homo_sapiens__NP_775809
augcccaugagcucccugccugccgcuauccucucucacaugaccgccauuaacaaugugccgcccccuccccugcauagcaucccuaaccuuaagaaauccaagcacauuaauuacggccagcugaacgcgcucugccauaucagagggcaacacucucggagcauguccaauauucugucugcucaugacacauucaugaaacaguaucccaaggucuuucuucaccagaaaccucgccugccgaaacucuucaagcaggaggaacaaagagagcugaacgaaggaaaggaggaaagccagcaccagcagcccgaugacuccaauaacaucgccguucaugugcaacgggcccacggcgggcauauccuguaccgcccuaagagagcuacggagaaauuugaggaguuccucgccauucugaagaaacuucccauccaccggaccccuuaugaacacaagacaguguggaaguuucugaaaaccauucccgaucucacauuccagcugaaugacaagcaucuuaaaacccugagcaagacagucuuuucugaaaccuggcucaaaggauccacggugguugcuaacgauggcuucuacgugauccugaaggggcuggcccgcccgcagaccaaugucuauaaaaaccucauugagggaagcgacucuccugauuccuuuaucagccagucuuuccacuccuuuauuuggagcgaggaguucaaaaauuccacacuggcggaaauguaccuucccucuuaugacagcaugcuguccaaguggagcaccuuuggcacacucgaagugaugccucaaaacgagucugaaacccagauguucuccguugugacggaggaugacugugagauccugaagauccccgccaagggcuacgcuaaaauuaaggaagagaaaaucaaacuugaaaauaugcagaagcugaagcucauuagaaugugccccuacuaugaggaauggccuacacugagcaucuacgagcugauugcccuccugaaguggaaaaaguucccgcccgggcaugucaucguggagucuggaaacaucauuagcuuugugggcuauaucaacuccggguguugcaauauuuaccggucuaucauuggauucgucaaacuucgcagcaacaagguuaagagaucccaaaaacugguguauaugggcaagcucaaagaaaaggagagcuuuggggaaaucucugugcugcuucaggucccuuucaccuguacaaucauuaccaaaaaggagguggaaauggcuaucauugaggauaaggaccuguuuguugccuga

SEQ ID NO: 67616 - RNA, 540 nt, Artificial Sequence
  derived and/or modified sequence opt5 from CNBP__Homo_sapiens__NP_001120664
augagcuccaacgagugcuucaaguguggcagaucugggcacugggcccgggaaugccccaccggaggcgggcgcggaagaggcaugcggagccgcgggagaggaggcuuuacauccgaccggggcuuccaguuugugucuagcucccugccugauaucuguuaccgcugcggggagucuggacaucucgcuaaagacugugaucugcaagaagacgucgaggccugcuauaauuguggcagagggggacacauugcgaaggauugcaaagaaccgaagcgggagcgcgagcaguguugcuacaacuguggcaaacccgggcaucuugcuagagacugcgaucacgccgacgaacagaagugcuauagcuguggagaguucggccauauccagaaggauugcacgaaaguuaaguguuaccggugcggcgaaaccgggcacguggccauuaauuguuccaaaacaagcgaggugaacugcuaucgcuguggagagucuggccaccuggcuagagaaugcaccaucgaggccacagcuuga

SEQ ID NO: 67617 - RNA, 1524 nt, Artificial Sequence
  derived and/or modified sequence opt5 from CNDP1__Homo_sapiens__NP_116038
auggaccccaagcugggcagaauggccgcuagccuccuggccgugcuucugcuccugcuugagcgggggauguucuccucuccuagcccgcccccugcgcugcucgaaaaagucuuucaguacaucgaucugcaccaagacgaguucguucagacccugaaggaauggguggcuauugaguccgauucugugcagcccgucccucgcuuuagacaggaacucuuccggaugauggccguggccgcugacacacugcaacgccuuggagccagaguugcuagcguggauaugggcccccagcagcugccugacgggcagucccucccgauucccccugucauccuggccgagcuuggaucugaucccacgaaaggcaccgugugcuuuuaugggcaucuggacguucaaccugcggaucggggagacggcuggcucacagaucccuacgugcugaccgaggucgacggcaagcuguaugggcgcggagccacagauaacaaaggcccggugcucgcuuggaucaaugccgugagcgcuuucagagcccuggaacaggaccuuccugucaacauuaaguuuaucaucgaggggauggaagaggcgggauccguugcccuggaggaacucguggagaaggaaaaagaccgguucuuuagcggcguggauuacauugucaucucugacaaucuguggauuucccagcgcaagcccgcuaucaccuaugggacaagaggaaacagcuacuucaugguggagguuaaaugucgggaucaggacuuucacucuggcaccuucggcgggauucuucaugaaccuauggccgaucugguggcucuccugggaucccuggucgacagcucuggccacauccucgugcccgggauuuaugaugagguugugccccugacggaggaagagaucaauaccuacaaggccauccaucuugaccuggaagaguaccgcaacuccagcagagucgaaaaauuucucuucgauacaaaggaggagauucugaugcaccuuuggcgguauccuucccugucuauccacggaauugaaggcgccuucgacgagccggggaccaagacagugauccccggacgcgucauuggcaaauuuagcaucagacucgugccucauaugaauguuuccgcuguggaaaagcaagucacccggcaccuggaggauguguucagcaaaagaaacucuuccaauaagaugguugugagcaugacgcugggccuccaucccuggaucgcgaacauugacgacacacaguaccuggccgcuaaacgcgccauccggaccgucuuugggacagaaccugauaugauuagagacggaucuaccauccccauugccaagauguuccaggagaucgugcacaaaagcgugguucuuaucccgcugggcgcugucgaugacggggagcacucccaaaaugaaaagauuaaccgcuggaauuauaucgagggaaccaagcucuuugccgcguucuuucuggaaauggcucagcugcauuga

SEQ ID NO: 67618 - RNA, 1176 nt, Artificial Sequence
  derived and/or modified sequence opt5 from CNDP2__Homo_sapiens__NP_001161971
auggccgcucugaccacacucuucaaguacaucgacgagaaccaggauagauauauuaaaaagcuggccaaauggguggcgauccaaagcgucuccgcuuggcccgaaaagcggggcgagauucgcagaaugauggaaguugccgccgcugacgugaaacagcuugggggaucuguggagcuggucgauaucggcaagcagaaggaaauuccugugaauguucgguuuugccucgaggggauggaggaaagcggauccgagggccuggacgaacuuaucuucgcccgcaaagauacguuuuucaaggacguggauuacgucuguaucucugacaacuauuggcuggggaaaaagaaaccgugcauuaccuacggacucagaggcaucuguuauuucuucauugagguggagugcagcaauaaggaucugcacuccggcguuuacgggggaucugugcaugaagcuaugacagaccugauccuccugaugggcagccuugucgauaagcgggggaacauucugauccccggaauuaaugaggccguggcggccgugaccgaagaggaacacaaacucuaugacgauaucgacuuugacaucgaggaguucgcuaaggaugucggcgcccagauucugcuucauucccacaaaaaggacauccugaugcaucgcuggagauacccuagccucucucugcacgggauugaaggagcuuuuuccggcagcggcgccaaaacaguuaucccccggaaggugguggggaaauucucuauucgccuggucccuaacaugacccccgaggugguuggagaacaagugacauccuaccucaccaagaaguuugcggagcugagaagcccuaaugaauuuaaagucuauaugggccacgggggaaagccgugggugucugauuuuucccauccccacuaccuugccggccggcgcgcuaugaaaacgguuuucgggguggagccugaccugaccagagagggaggcagcauccccgucacacucaccuuccaggaagccacaggcaagaacgugaugcugcuuccugucggguccgcugaugacggagcccauucucagaaugagaaacugaaccgguauaauuacaucgaaggcaccaagaugcucgccgcuuaucuguacgaggugagccagcugaaggauuga

SEQ ID NO: 67619 - RNA, 2280 nt, Artificial Sequence
  derived and/or modified sequence opt5 from CNGA1__Homo_sapiens__NP_001136036
auggagagcagauccucuccccggcuggaaugcagcggcgccaucuccgcucacuguucucuccaucugccugacagcuccgauuuccagcuuauuuuuguguuccuggucgagaugggguuucaccauguuggacaagccggccucgaacugcuuaucucuagcgaccugccgaccuccgcgagccagucugcugggauuacagauaugaagcucuccaugaaaaacaauaucauuaacacgcagcagagcuucgugaccaugcccaaugugaucgucccugacaucgagaaggaaauucgcagaauggagaacggagccuguucuuccuuuagcgaggaugacgauucugccuccacaagcgaagaguccgaaaaugagaacccccacgcucggggcucuuucagcuacaaaucccugcgcaaagggggaccuagccaaagagagcaguaucugcccggcgccaucgcucucuuuaaugugaacaauucuuccaacaaggaccaggaaccugaggaaaagaagaaaaagaaaaaggagaaaaagagcaagucugaugacaaaaaugaaaacaagaaugauccggagaaaaagaaaaagaaaaaggacaaggagaaaaagaaaaaggaagagaaaagcaaggauaagaaagaagaggaaaagaaagagguuguggucauugaccccuccggcaacaccuacuauaauuggcuguucugcaucacacuuccugugauguacaacuggaccaugguuauugcccgggcgugcuuugacgagcugcagucugauuaucucgaauacuggcugauccuugacuaugugagcgauauugucuaccugaucgacauguucgugcgcacaagaaccggguaccucgagcaaggacugcuggugaaggaggaacucaaacugaucaacaaguauaaguccaaucuucaguuuaaacuggauguccucagccugauucccacggaccuucuguacuucaagcucggcuggaacuauccugaaauccggcugaaucgccugcucagauuuucucggauguucgaguucuuucagcgcaccgagacaagaaccaacuaccccaauauuuuccggaucuccaaccugguuauguauauugugaucaucauucauuggaaugccuguguguuuuacagcaucucuaaagcuauuggguucggaaacgauacaugggucuauccggacaucaaugauccugaauuuggccgccuugccagaaaguacguguacucccuguauuggagcacccucacgcugacaaccauuggggagacacccccucccguucgggacuccgaauacguguucgucgugguugauuuucuuaucggagugcugaucuucgcuaccauugucggcaacaucggcucuaugauuagcaauaugaacgccgcgagagccgaguuucaggcucgcaucgacgccauuaaacaauauaugcacuuccggaauguguccaaggacauggagaagagagucaucaaaugguuugauuaccucuggaccaacaagaaaacaguggacgaaaaggagguucugaaauaucugcccgauaagcuccgcgcugaaauugccaucaaugugcaccuggacacgcuuaaaaagguccggaucuucgccgauugcgaggcugggcugcucguggaacugguucugaaacuucagccucagguguacucuccgggagacuauauuuguaagaagggcgauaucgggagagagauguacauuaucaaagagggaaagcucgcggucguggccgacgauggcgugacccaauuuguuguccugagcgacggguccuacuucggagaaauuagcauccugaacaucaaaggcucuaaggcuggcaaccgccggacagccaauauuaaguccaucggguauagcgaucucuucugccugucuaaagacgaucuuauggaggcccugaccgaauaccccgacgcuaagacaaugcucgaggaaaaaggaaagcagauucugaugaaagacggccugcuugaucucaacaucgccaaugcgggguccgacccuaaggaucuggaggagaaggugaccagaauggaaggaagcguggaccugcuccagacgcgcuuugcucggauucuggccgaguaugaaucuaugcagcaaaaacuuaagcagagacugacaaaagucgagaaguuccucaaaccccugaucgauaccgaauuuagcuccaucgagggcccuggggccgagagcggccccauugacucuaccuga

SEQ ID NO: 67620 - RNA, 2031 nt, Artificial Sequence
  derived and/or modified sequence opt5 from CNGA3__Homo_sapiens__NP_001073347
auggccaagaucaacacccaguacagccaccccuccagaacacaucugaaagugaagacgucugaccgggaucucaaucgcgcugagaacggccugagcagagcccacuccucuagcgaagagaccuccucuguccuucaaccugggauugcgauggaaacacggggacuggcugacagcggccagggguccuucaccggacagggcaucgcccgccucagcagacugauuuuucuucugcggcgcugggccgcuagacauguucaccaucaggaucaagggccggacucuuuccccgaucgguuucgcggagccgagcucaaagaaguguccagccaggagucuaaugcucaggccaacgugggcucccaggagccugcggacagaggccggcgcaagaaaacaaagaagaaagaugccaucgucguggaccccagcucuaaucuguauuacagauggcugaccgcuauugcccucccuguuuucuauaacugguaccugcuuaucugccgggcuuguuuugaugaacugcaauccgaguaucucaugcuguggcuugugcuggacuacagcgccgauguccucuaugugcuggacguucuggugcgcgcgagaacaggguuccucgaacagggacugauggucuccgauaccaaucggcuuuggcagcacuacaagacgaccacacaguuuaaacuggacgugcucucucuggugcccaccgaccuugccuaccugaaggucggcacaaacuauccugagguuagauucaaucgccuccugaaauuuagccggcuguucgaguuuuucgauagaaccgaaacgcgcacaaacuacccgaauauguuucggaucgggaaccucgugcuguauauucuuaucauuauccacuggaaugcuugcauuuacuucgccaucuccaaguucauuggauuuggcaccgacagcuggguguaucccaacaucucuaucccugagcaugggagacugucccgcaaguacauuuauagccucuacuggucuacacugacccuuaccacaaucggagaaacgcccccucccgucaaagaugaggaauaccuguucgugguuguggacuuucucgucggcgugcugauuuucgcuaccaucguuggcaauguggggagcaugauuuccaacaugaacgccucucgggccgaguuucaagcuaagaucgauagcaucaaacaguauaugcaguucagaaaggucacaaaagaccuggagacccgcgugauucggugguuugauuaccucugggcgaauaagaaaacagucgacgaaaaggaggugcugaagucccuuccggauaaacugaaggccgaaaucgcuauuaacguucaccucgacacccugaaaaaggugagaaucuuccaagauugugaggccggacugcuugucgaacucgugcugaaacugcgcccuacgguuuuuagccccggcgacuauauuugcaagaagggggacaucggaaaagagauguacaucauuaaugagggcaagcucgccguggucgcugaugacggggugacacaguucgugguucugucugauggauccuauuuuggcgaaaucagcauucuuaacaucaaaggcucuaaguccgggaaucggagaaccgccaacauucggagcaucggauacuccgaccuguucugucucucuaaagaugaccugauggaggcgcugaccgaauauccugaggcuaagaaggcccuugaagagaaaggccgccagauucucaugaaggauaaucugaucgacgaggaacuggccagagcuggggccgaucccaaagaccucgaggaaaaggucgagcagcugggaagcucccuugauacacugcaaacccgguuugcuagacuccuggccgaguacaacgcgacacagaugaaaaugaagcagcgccugucucagcuugaaagccaagugaagggcgggggcgacaaaccccucgccgauggagaggugccuggcgacgcuacgaagaccgaagacaaacagcaguga

SEQ ID NO: 67621 - RNA, 900 nt, Artificial Sequence
  derived and/or modified sequence opt5 from CNGB1__Homo_sapiens__NP_001129111
augcugggcugggugcagagaguccucccccaaccuccggggacaccccggaagaccaaaaugcaggaggaagaggaaguugagccugaacccgagauggaggccgaaguggagccugaacccaacccugaggaggcugaaacggagagcgaauccaugccgcccgaggaaucuuucaaggaggaggaaguggccgucgcggacccuagcccccaggagaccaaagaagcugcccugacauccaccaucucucuucgcgcccagggagcugagauuagcgaaaugaacuccccuucuagacgggugcugacauggcucaugaagggcguugagaaagugaucccccaaccgguccacagcauuaccgaggauccugcccagauccuggggcauggauccacaggcgacaccgggugcacggaugaacccaaugaggcucuugaagcccaggacacccgcccuggacugagacuccugcuguggcucgagcagaaucuggaacgggugcuuccccaacccccuaagagcucugagguuuggcgcgaugagccggcgguggccacaggcgcugccuccgaccccgcuccucccggcagaccucaggaaauggggcccaagcugcaggcccgggagaccccgagccucccuacacccauuccucugcagcccaaagaggaaccuaaggaggcgcccgccccggaaccucaacccggaucucaggcucagaccuccagccuucccccuacgcgcgauccggccagacuggucgcuugggugcuccaccggcuggagauggcccugccccaaccugugcuccauggcaaaaucggggaacaggagcccgacucuccuggaaucugugauguccagacacgcguuaugggcgccgggggacuguga

SEQ ID NO: 67622 - RNA, 2430 nt, Artificial Sequence
  derived and/or modified sequence opt5 from CNGB3__Homo_sapiens__NP_061971
auguucaagagccugaccaaagugaacaaggucaaacccaucggcgagaauaacgaaaaugagcaguccucuagacggaacgaagaggggagccacccuuccaaucaaucucagcagacaacggcccaggaagagaacaagggagaggagaaaagccucaagaccaaguccacaccgguuaccucugaggaaccccauacaaauauucaagacaaacugagcaagaaaaacuccagcggcgaucuuaccacaaauccugacccccagaacgcugccgagccuaccgggacggugcccgagcagaaggaaauggauccuggaaaagagggccccaauucuccccagaacaagccucccgcggcuccugugaucaaugaauacgccgacgcccaacugcacaaccucgucaagcgcaugagacagcggaccgcucuguauaaaaagaaacuuguggagggggaucuguccagccccgaagccucuccgcagacagcuaagccuaccgccguucccccugugaaagaguccgacgauaagcccacagagcauuacuaucgccuccugugguuuaaagucaagaagaugccccugaccgaauaccucaaaagaauuaagcugccuaauagcaucgacucuuauacggaucggcuuuaccugcucuggcugcuucuggugacacucgcguauaacuggaacugcuguuucauuccgcugcgccugguuuuucccuaccagaccgccgacaauauccacuacuggcucaucgcugauauuaucugcgacauuaucuaucuguacgauaugcuuuucauucaaccuagacugcaguuugugcggggaggcgacaucauugucgacuccaacgagcuccgcaaacauuauagaacaagcaccaaguuccagcuggauguggccuccaucauccccuuugacauuuguuaccuuuucuuuggcuucaauccuauguuucgggcuaaccgcaugcugaaauauaccucuuucuuugaguucaaucaccaccucgaaagcaucauggauaaggccuacauuuauagagugauccggacaacgggguaccugcuguucauucuccauaucaacgcgugcgucuacuauugggccuccaauuacgaaggaaucggcaccacacgcuggguuuaugacggggagggaaacgaguaccugagauguuauuacugggcugugcggacccuuauuacaaucggcgggcugcccgaaccgcaaacccucuuugagauuguguuccagcugcuuaacuuuuucagcggagucuuuguguucucuucccugaucggccagaugagagauguuauuggcgccgcuacggccaaucagaauuauuuucgcgccugcauggacgauacaaucgcuuacaugaacaauuacagcaucccuaagcucgugcaaaaacgggucagaaccugguaugaauacaccugggacucucagcgcaugcuggaugagagcgaccugcucaagacacugcccaccacagugcagcuugcgcuggccauugauguuaacuucuccaucauuucuaaaguggaccucuuuaaggggugugacacgcagaugaucuaugauaugcugcugcggcuuaaaagcguccucuaccugccuggagacuucgugugcaagaagggcgaaauugggaaagagauguauaucauuaagcacggagagguccaagugcugggcgggcccgauggaaccaaaguucucgugacacugaaggcuggcuccgucuuuggcgaaaucagccuucuggccgccgggggaggcaauagacgcaccgcuaacgugguugcccauggguucgcgaaccuccugacacuggacaaaaagacccuucaggagauccucgugcacuacccugauucugaacggauucugaugaagaaagcuagaguccugcucaagcagaaagccaagacggccgaggcuaccccgccgcgcaaagaccuggcccuucuguuuccucccaaggaggaaacacccaaacucuucaagacccugcugggaggcacagggaaggcuucccuugcccggcuccugaaacugaagagagagcaggcggcccagaaaaaggaaaauagcgagggcggagaagaggagggcaaagaaaacgaggauaagcaaaaggaaaaugaggacaaacagaaggaaaacgaggauaaagggaaggagaaugaagacaaagauaagggacgcgagccugaagagaagccgcucgaccggcccgaauguaccgcuucuccuaucgccguggaggaggaaccccacuccgugagacggacgguucugccucgcggcacaagcagacagucccuuauuaucucuauggcucccagcgccgaagggggagaagagguccugaccauugaggugaaagaaaaggcgaaacaauga

SEQ ID NO: 67623 - RNA, 483 nt, Artificial Sequence
  derived and/or modified sequence opt5 from CNIH3__Homo_sapiens__NP_689708
auggccuucaccuuugcugccuucugcuacaugcugagccucgugcugugugcggcucuuaucuuuuucgccauuuggcacaucauugccuuugacgagcugagaacagauuucaagucccccaucgaccagugcaacccuguccaugcucgggaacgccucagaaauauugagcggaucuguuuucugcuucgcaaacugguucucccggaauauucuauccacagccuguucugcauuauguuucugugugcccaagaguggcucacgcugggccuuaacgugccccuccuguucuaccauuuuuggagauauuuccacugcccugcugauuccucugaacuggccuacgaucccccuguggucaugaaugcggacacccuuagcuauugucagaaggaggccuggugcaaacuggcuuuuuaccuccuguccuucuucuauuaccuguacuguaugaucuauacacucgugucuagcuga

SEQ ID NO: 67624 - RNA, 2163 nt, Artificial Sequence
  derived and/or modified sequence opt5 from CNKSR1__Homo_sapiens__NP_001284576
auggagcccguggaaaccuggacaccuggcaaggucgccacguggcugagagggcucgacgauagccugcaggacuacccguucgaggauuggcaacuucccgggaaaaaccugcuccagcugugcccucagucccuugaagcucuggccguucggucucucggccaccaggagcugauccugggaggaguggaacaacuccaggcgcugagcucccgccuucagaccgagaaucugcagucucucacagagggccugcuuggggcuacccaugacuuucaaagcauugugcagggaugucugggcgauugcgccaagacacccaucgacguccucugugccgcuguggaacugcugcacgaggccgaugcucuccuguucuggcuuuccagauaucuguuuucucaucucaacgacuucagcgccugccaggaaauucgggaucugcuugaggagcugucccagguucuccacgaagacggcccugcggccgagaaagaagggaccgugcugcgcaucuguagccaugucgcuggaauuugccacaauauccugguguguugccccaaggagcuccuggaacaaaaagccguucuugaacaggugcagcuggauucuccucucggccuggagauccacacaaccuccaacugucaacauuuugucagccagguggacacccaggugccgaccgauucuagacuucagauucaacccggggacgaagucguucagaucaaugaacagguggugguccgggaggagcgcgacauggugggauggccuagaaagaacaugguucgggagcugcuccgcgagcccgcuggccugucccuggugcucaagaaaauuccuauccccgagacaccgccucagacgcccccucaaguccuggauagcccccaccagagaucucccucccuuagccuggccccucucuccccgcgggcgcccucugaagacguguucgccuuugaucugagcuccaauccuagccccgggccuucucccgcuuggacagacuccgccagccugggaccggagccucuucccauuccucccgaaccucccgcuauccucccggccggcguugccggcaccccugggcugcccgagucucccgauaagagcccugugggacgcaaaaaguccaaaggccuggcuacgagacucucucggcgcagagucagcugccgggaacuggggagaccggacugugauggauggcuucugcuccgcaaggcgcccggcggguucaugggaccucgguggagacgccggugguuugugcugaagggccauacacuguacugguauagacagccccaggacgagaaagccgagggccuuauuaacgucuccaauuacagccucgaaucugggcacgaucaaaagaaaaaguauguguuccagcugacccacgacguuuacaaaccuuuuaucuucgcugccgauacacugaccgaccucuccaugugggugcgccaucugauuaccugcaucagcaaguaucagucucccggacgggccccucccccgagagaggaagacugcuacuccgagacagaggcugaagauccugacgaugaggccggcagccacuccgcgucucccagcccugcucaggccgggucuccccuucauggagacacguccccggccgcuaccccuacacaacgcagcccccggaccuccuuuggcagccugacagauucuuccgaagaggcccucgaagggauggucagaggccugcgccagggaggcgugagccugcuugggcagccucaaccccucacccaggagcaguggcggucuuccuucaugagacggaaccgcgacccccagcugaaugagagaguucaccgggugagagcucugcaaagcacgcucaaagccaagcugcaggaacuucagguccuggaggaagugcucggagauccugagcugacaggcgaaaaguuccgccaguggaaagagcaaaaccgggagcuguacucugaagggcuuggagcguggggcguggcccaggcugaggggagcucccauauccucaccagcgacucuaccgaacaguccccgcacagccugcccuccgauccugaggaacacucucaucuguguccccucacaagcgaguccucucugagaccucccgaccuuuga

SEQ ID NO: 67625 - RNA, 3015 nt, Artificial Sequence
  derived and/or modified sequence opt5 from CNKSR2__Homo_sapiens__NP_001162118
auggcccugaucauggagcccgugagcaagugguccccuucucaggucguugacuggaugaaaggccucgaugacugccugcaacaguacauuaagaacuucgaaagagagaaaaucagcggggaucagcuucugcggauuacccaccaggaacucgaggaccugggagugucccgcaucggccaucaagaacuuauucuggaggcuguggaucuccugugugcccugaauuaugggcucgagacagaaaaccugaagacgcuuucucacaaacugaaugcgagcgcuaagaaccuccagaauuuuaucaccggaagacggcgcuccggccauuacgacgggagaacaucucggaagcugccgaacgauuuccuuaccagcgucguggaccugaucggagccgccaaaucccuccuggcuuggcuggaucgcagccccuuugccgcuguuacagacuauucugugaccagaaauaacgucauucagcucugccuggagcuuacaaccaucgugcagcaagauuguacgguuuacgaaaccgagaauaagauucugcacgugugcaaaacacucuccggcgucugugaccauaucauuagccugucuuccgauccucuugugagccagucugcccaccuggaggugauccagcucgcgaacauuaagcccuccgaaggccuggggauguauaucaaaagcaccuacgacggacugcacgucaucacaggcaccacggaaaauuccccugccgaccggugcaagaagauucaugcuggggaugaaguuauccaggugaaccaccaaacaguggucggauggcagcucaaaaaucuggugaacgcccuucgcgaggaccccucuggcguuauucugacccucaagaaaagaccucagagcaugcugacauccgcuccggcccuucugaagaauaugcgguggaaaccccucgcgcugcaaccucugaucccccgcagcccuaccucuuccguggccacccccagcucuacaauuagcacgccgaccaagagagauuccucugcucuccaggaccuguauaucccucccccucccgccgaacccuacaucccucgggaugagaaagggaaccuuccgugugaggaccugcgcggacauauggucggcaagcccgugcacaagggcagcgaauccccuaacagcuuccucgaucaggaguacagaaaacgguuuaauauuguugaagaggacacagugcuguauugcuacgaauaugagaaggggagaucuuccagccagggacgccgggagucuacccccacauacgaaaacucccugcuuagauauaugagcaaugagaaaaucgcucaagaagaguacauguuccagcgcaacuccaagaaagauaccggcaagaagucuaaaaagaaaggggacaagagcaauuccccuacgcacuauucucuccugcccagccugcagauggaugcccuccggcaggacauuaugggaacaccggucccugaaaccacccuguaccauacauuucaacaguccagccuucagcacaaaucuaagaagaaaaacaagggccccaucgccgggaaauccaagagacgcauuagcuguaaagaccugggacggggcgauugcgagggcuggcucuggaagaagaaagacgcuaagucuuacuucucccagaaauggaagaaauauugguuugugcugaaggaugcgagccuguacugguauaucaaugaggaagacgagaaagccgaaggguucaucucucuuccugaguuuaagauugauagagcuagcgagugucgcaagaaauacgccuucaaggccugccaucccaaaaucaaguccuuuuauuucgcugccgaacaccucgacgauaugaaccgguggcugaauagaauuaacaugcugaccgcgggauacgcugagcgcgaacggaucaaacaagagcaggacuauuggagcgaaucugauaaggaggaggccgacacaccuuccacgcccaagcaggauagcccgccuccucccuacgacaccuaccccagaccgcccuccaugucuugcgccagcccuuaugucgaagcuaaacauucccggcucucuagcacagagaccucccagucucaaagcucccacgaagaguuccgccaggaagugacaggcagcucugccguuucccccauuagaaagaccgcuagccagcggagaucuuggcaagaucugaucgagacgccucuuaccuccagcgggcugcacuaccuccagacacugccccuggaggacucuguguuuuccgacagcgccgcgauuuccccugaacaucgccggcagagcacccuucccacacagaaaugucaccuccaagaucauuauggaccguacccucuggccgagucugaaagaaugcagguccugaauggcaacgggggcaagccccgcagcuucacccucccuagagacuccggauuuaaucacugcugucugaacgcucccgugucugccugcgauccgcaggacgauguucagccucccgagguggaagaggaggaagaggaagaggaggaagagggcgaagcugccggggagaauaucggagagaaaagcgagucccgggaggaaaaacuuggcgacucucugcaagaucucuaucgcgcgcuggagcaggccagccuguccccucuuggggaacacagaaucucuacgaagauggaguacaagcucagcuucauuaagcgguguaacgaccccgucaugaacgaaaaacugcaucgccugagaauccucaaguccacacugaaagcucgggagggagagguggccauuaucgauaaggugcuugacaaucccgaucugaccagcaaggaauuucagcaguggaaacaaauguaucucgaccuguuccuggauauuugccagaacacaaccucuaaugacccucuuuccaucagcucugagguugacgucaucaccuccagccuggcucacacacauuccuacauugaaacgcacguguga

SEQ ID NO: 67626 - RNA, 1668 nt, Artificial Sequence
  derived and/or modified sequence opt5 from CNKSR3__Homo_sapiens__NP_775786
auggagcccgugaccaaguggagcccuaaacaggucguugacuggacaagaggccuggaugacugccuccaacaguacgugcacaaguucgaacgggagaaaaucaacggggaacagcugcuucagauuucccaucaagaucuggaggaacucggagugacgcgcaucggccaccaggagcugguccuugaggccguggaccugcucugugcucugaauuaugggcuggaaaccgauaacaugaagaaucucguucugaaacuuagagccucuagccauaaccugcagaauuacauuuccucucggcgcaagagcccggcguaugacggaaacacauccagaaaggcucccaaugaguuucucaccucuguggucgaacugaucggcgccgccaaagcccuucuggccuggcucgaucgggcuccuuucacagggauuaccgacuuuagcgugacaaagaacaaaaucauccagcugugccuggaucucaccacgaccguucaaaaggacuguuucguggccgagauggaggauaaaguccugacaguggugaagguccuuaauggaauuugcgacaagaccauccgcuccacaaccgaucccguuaugagccagugugcgugccuggaagaggugcaccucccuaacauuaaacccggcgaaggccuggggauguacaucaagucuacguaugacggacuucaugugauuacaggcaccacagaaaauuccccugccgacagaagccagaaaauccacgcuggggaugaggucauucaggugaaccaacagaccguugugggauggcagcugaagaaucucgucaaaaagcugcgggagaacccgaccggcgugguucugcuccugaaaaagcgccccacagggucuuuuaauuucacgccugcuccccuuaagaaccugagauggaaaccuccccucgugcaaaccuccccgccucccgcuacaacccagagcccugagucuacaauggacaccucccugaagaaagaaaagagcgccauccuugaucuguacaucccgcccccuccggcgguccccuauuccccucgggacgagaacggaucuuuuguguacggcggcagcuccaaauguaagcagccccucccugggcccaagggaagcgaaucucccaauuccuuccuggaucaggagagccgcagacggcgcuuuacgauugccgacucugaucaacugccuggcuacagcgucgaaacaaacauccuccccaccaaaaugagagagaagaccccuuccuaugggaaaccccggccucugucuaugcccgcugacggaaauuggaugggcauuguggauccguucgccagaccucgcgggcacggacggaagggcgaggacgcucuuugcagauacuuuagcaacgaacgcaucccucccauuaucgaggaauccagcucucccccguaucgguucuccagacccacaaccgagcgccaucugguucggggcgccgauuacaucagagggagccgcuguuauauuaauucugaccuccacuccagcgccacaaucccuuuucaggaagagggaacgaaaaagaaguccggcucuagcgcuaccaaauccucuagcacagagcccucccugcuggugagcugguucacccggcuuaagcuccugacacauuga

SEQ ID NO: 67627 - RNA, 894 nt, Artificial Sequence
  derived and/or modified sequence opt5 from CNN1__Homo_sapiens__NP_001290
augagcuccgcccacuucaacagaggccccgcuuacgggcugucugccgaggugaagaauaaacucgcgcagaaguaugaccaucaacgggaacaggagcugcgcgaauggaucgagggagucaccggcagacggauugggaacaauuuuauggauggacuuaaagacggcaucauucugugcgaguucaucaacaagcuccagccugggagcguuaaaaagauuaaugaauccacacagaacuggcaccaacuggagaauaucggaaacuuuaucaaggcuauuacgaaauacggcgugaagccgcaugauaucuucgaagccaaugaccuuuuugagaacaccaaucacacacaggugcagucuacccugcucgcccuggcuagcauggccaaaacaaagggcaacaaagucaauguggggguuaaguaugcugaaaagcaggagcgcaaauucgagcccggaaagcugagagaaggccggaacauuaucgggcuccaaaugggaaccaauaaauuugccucccagcagggcaugacagcguacgggacccgcagacaucuguaugauccuaaacuuggaacggaccagccccuggaucaagccaccauuucucuccagaugggcacaaacaagggcgcuagccaggccgggaugaccgcuccuggaacaaagcggcaaaucuucgagcccggccuggggauggaacacugugacacccuuaacgugucccugcagaugggaagcaauaaaggcgccucucagcgcgggaugacggucuacggacucccuagacagguguaugauccgaaguacugccugacacccgaguacccugaacugggcgagcccgcgcacaaccaucacgcccauaauuauuacaacuccgcuuga

SEQ ID NO: 67628 - RNA, 930 nt, Artificial Sequence
  derived and/or modified sequence opt5 from CNN2__Homo_sapiens__NP_004359
augagcuccacccaguucaacaagggccccucuuacgggcugagcgccgaggugaaaaauagacuccuguccaaguaugacccucaaaaagaagcugagcuucggacauggaucgaaggacugacgggccucucuauugggccggauuuucagaagggacugaaagacggcaccauccuuugcacacugaugaacaagcuccagcccgggagcgucccuaagauuaaucgcuccaugcagaacuggcaccaacuggagaaucugucuaacuucaucaaagccaugguuagcuacggaaugaaucccguggaucucuuugaagcgaacgaccuguucgaguccggcaauaugacccaggugcaggucagccuucuggcucucgccggcaaggccaaaacaaaggggcugcagucuggaguggauauuggcguuaaauauuccgagaagcaagaaagaaacuuugacgaugcuaccaugaaggccgggcagugugugaucggacuucagaugggcacaaauaaaugcgcuagccagucugggaugaccgccuacggaacgcggcgccaucuguaugacccuaagaaccacauccugcccccuauggaucauuccaccauuagccuccaaaugggcacaaauaaaugugcgucucaggucggcaugaccgccccggggacaagacggcacaucuacgacaccaagcugggaacggauaaaugcgacaacuccagcaugucccuccagaugggcuauacacaaggggcuaaucagucuggacagguguucggccuggggcgccagauuuacgaucccaaguacuguccucaaggaaccguugccgacggcgcucccagcggcacaggggacugcccugaucccggagaggugccggaauauccucccuacuaucaggaggaggccggcuacuga

SEQ ID NO: 67629 - RNA, 2856 nt, Artificial Sequence
  derived and/or modified sequence opt5 from CNNM1__Homo_sapiens__NP_065081
auggccgcugccgcggcugccgccgcugccgugggcgucagacugcgggacugcuguagccgcggggcuguucuccugcuuuucuuuucccugucucccagaccuccggccgcggccgcuuggcuccugggacuucggcccgaggauaccgccggcgggcgcgugagccuggaaggaggcacacucagagcugccgaggggacguccuuccugcugcggguguacuuucagccuggacccccugcgaccgccgcucccgucccuucuccgacacucaacagcggcgaaaauggcaccggggacugggcccccagacugguguucaucgaggaaccucccggaggcgggggaguugcuccuuccgccgugcccacaagaccgccuggcccccaacggugccgcgagcagucugauugggccagcgacgucgaggugcuugggccucugagacccggaggcguugcuggcuccgcgcucgugcagguccgggugcgcgaacugagaaagggggaggccgaacggggaggcgcugggggaggcgggaaacuuuuuagccugugugccugggauggacgcgccuggcaccaucacggcgcugccggcggguuccuccugagagugcggcccagacuguauggaccuggcggggaccuccugccgcccgcguggcuucgcgcucugggagcccuccugcuucuggcccucucugcucuguuuuccggccugcggcucagccugcuuucucuggauccugucgagcucagaguucugcgcaacuccgggagcgccgcugagcaggaacaagcccggagagugcaggcggugcgcggccggggaacccaucuucugugcacacuccugcugggccaggccggggcuaaugccgcucucgccggauggcuguacaccucucuucccccuggcuucgggggaacgggcgaggacuauuccgaagaggggauucacuuucccuggcugccggcgcucgucuguaccggcgccguguuccugggagcugaaaucugcccuuacagcguuuguuccagacauggccuggccauugcuucucacagcgugugccuuacacgccuccugauggccgccgcuuuucccgucuguuauccucuggggcggcuccuggauugggcgcuuagacaggagaucuccaccuucuacacacgcgagaagcugcucgaaacccugcgggccgcugaccccuauagcgaucuggugaaagaggaacuuaacauuauccaaggagcccucgagcugagaacgaagguuguggaagagguccugacaccucucggcgacugcuuuaugcugcggucugaugccgugcuugacuucgcuaccgucuccgagauccugcgcagcggguacacacgcauucccguguacgaaggagaccagcggcacaauaucguugauauucucuucgugaaagaccuggccuuugucgauccggacgauuguaccccucugcuuaccgugacaagauucuauaaccgcccccuccauugcguuuuuaaugacacgcggcuggauaccgugcuggaggaguucaagaagggcaaaucucaccucgcgaucguccagagagugaacaaugaaggggaaggcgaccccuuuuacgaggugaugggaauuguuacacuggaggauaucauugaagagaucaucaagagcgaaauucuugacgagaccgaucuguauacagacaaccgcaaaaagcagagagucccucaacgggagcgcaaaagacaugacuucucccucuuuaagcugucugauaccgaaaugcgggugaagaucagcccgcagcugcuucucgcuacgcaccgcuucauggccacagagguggaacccuuuaaaucccuguaccugagcgagaagauucuccugagacuucugaaacacccuaaugucauccaggaacucaaguucgacgagaaaaacaagaaagcccccgagcauuaucuguaccaacggaaucgcccuguggauuauuuuguucugcuucugcagggcaagguggaagucgagguggggaaggaaggacucagauucgagaacggcgcuuuuaccuacuacgggguucccgccauuaugaccacagcgugcucugacaaugaugugcggaaagucggaucccuggcuggcagcucuguguuccucaaccgcuccccuagcagauguuccgggcugaaccggucugaaagccccaauagagagcgcuccgacuucggcggaucuaacacccagcuuuauagcuccagcaauaaccuguacaugccggauuauucuguucacauccucuccgacgugcaguuugucaagaucacacggcaacaguaccagaaugcccugacggccugccauauggauagcucuccucagucccccgacauggaggcuuucaccgauggcgacagcacaaaagccccuaccacaagagggacgccccaaaccccgaaggaugacccugcuauuacccugcuuaacaaucgcaacucucugcccuguagccgguccgacggacucagaagcccuucugaagugguguaucugcgcauggaggaacucgccuuuacacaggaggaaaugaccgauuucgaggagcacuccacacagcagcugacccuuagccccgcggccguccccacgcgggcugccuccgacucugaaugcuguaauaucaaccuggauacagagaccagcccuugcuccucugacuuugaagagaauguuggcaaaaagcuccugagaacacugagcgggcaaaagcgcaaacgguccccggagggagaaagaaccucugaggauaacagcaaucuuacaccccugauuaccuga

SEQ ID NO: 67630 - RNA, 2628 nt, Artificial Sequence
  derived and/or modified sequence opt5 from CNNM2__Homo_sapiens__NP_060119
augaucggcugcggggccugugagcccaaggugaaaauggcuggaggccaggccgcggcugcccugccuaccuggaagauggccgcuagacggagccucuccgcccgcgggagaggcauucugcaagcugccgcgggacggcuucugccgcuccugcuucugucuugcuguugcggggccggaggcugugcugccgucggcgaaaacgaggaaacaguuaucauugggcuccgccuggaggacacgaaugaugugagcuucauggaaggaggcgcucugagaguguccgagcggacccgcgucaaacucagaguguacgggcagaacaucaauaacgagacauggucucggauugccuuuaccgaacacgagcgcagacggcauagccccggagaacgcggccucgggggaccugcgcccccugagcccgacuccggcccucagagaugcggcauccggacaucugauaucauuauccuuccgcacauuauccugaaucgcagaaccagcgggauuaucgagauugaaaucaagccccuccggaaaauggagaaguccaagagcuauuaccuguguacaucucuuuccaccccugcccugggagcuggcgggagcggaucuacgggcggggccguuggaggcaaaggcggguccggaguggcuggccugcccccucccccgugggccgaaaccacauggaucuaucaugacggggaggauaccaagaugauugucggagaagagaaaaaguuccugcugccuuuuuggcuccaggugaucuucauuagccugcuucugugccucucuggcauguuuuccgggcugaaccuuggccugauggcccucgaccccauggagcugagaaucguucaaaauuguggaacagaaaaagagaagaacuacgcuaagcgcauugaaccugugcggagacagggcaauuaucugcucugcagccugcuucuggggaacguccucgugaauaccacgcugacaauccuucuggaugacaucgcgggauccggccucguggccgucguugugucuaccauugggaucgugauuuucggagagaucgucccccaggcuauuuguagccgccacggccuggccgugggggccaacacaaucuuucugaccaaauucuuuaugaugaugaccuuccccgcuuccuacccuguuagcaagcuccuggauugcgugcuuggccaggaaaucggaacagucuauaaucgggagaaacugcucgagaugcugagagugacggacccguacaacgaucugguuaaggaagaacuuaauauuauccaaggcgcccucgaacugcgcaccaaaacaguggaggacgucaugacaccccugcgggauugcuuuaugauuaccggggaagcgauccucgacuucaacaccaugucugagauuauggaguccggauacacgagaaucccuguguuugaaggcgagcgcagcaacauugucgaccugcuuuucgugaaggaucuggcuuucguugaccccgaugacuguacaccucucaaaaccaucaccaaguuuuauaaucauccccugcacuucguguuuaacgauacaaagcuggacgccaugcuugaagaguucaaaaaggggaaaucucaccucgccaucguccagcgggugaauaacgagggagaaggcgauccguuuuacgagguucuggggauugugacccuggaagacgucaucgaggaaauuaucaagagcgagauucucgaugagacagaccuguauacggauaauagaaccaaaaagaagguggcucaucgcgaacggaaacaggacuucuccgccuuuaagcagacagacucugagaugaaagugaagaucagcccucaacuucugcucgcuaugcacagauuccuggccaccgaaguugaggcguuuucccccagccagaugucugagaaaauccugcuucggcuccugaagcauccuaacgucauucaggagcugaaguacgaugagaaaaauaagaaagcccccgaauauuaccucuaucaacgcaacaagccuguggacuacuucgugcugauccuucagggcaaagucgagguggaagcuggaaaggagggcaugaaguuugaagccuccgcuuucagcuacuaugggguuauggcccugacagcgucucccgugccgcucucccugagcagaaccuuugucgugucccggacggagcugcuugccgcuggaucuccuggcgagaauaaaagcccucccagacccugcgggcucaaccacuccgauucucugagccgcuccgaccggauugaugccguuaccccgacacugggaagcucuaauaaccagcucaauuccagccugcuucagguguacauccccgacuauucugucagagcucuguccgaucuccaauucgugaagauuagccgccagcaguaccagaacgcccugauggccucuagaauggacaaaaccccucaaagcuccgauagcgaaaauacaaagaucgagcugacccuuacggaacugcacgacggccuccccgaugagacagcuaaccugcucaacgagcagaauuguguuacccauucuaaagcgaaccacucccugcauaaugaaggggccaucuga

SEQ ID NO: 67631 - RNA, 2328 nt, Artificial Sequence
  derived and/or modified sequence opt5 from CNNM4__Homo_sapiens__NP_064569
auggcccccgugggcgggggaggcagaccugucgggggaccggcucggggccgccugcuccuggccgcgcccguucuucuggugcuccugugggcucuuggggccagaggacagggcagcccucaacagggcaccaucguggggaugcggcuggccuccugcaacaagucuuguggaacaaaucccgacggcauuaucuucgucagcgagggguccacggugaaccuccgccuguacggauauucucugggcaauauuagcuccaaccucaucucuuuuaccgaaguugaugacgcugagacacugcacaaaagcaccuccugccuugaacugacaaaggaucucgugguccagcagcuggugaauguuagcagagggaacaccucuggagugcuugucgugcugacaaaauuccuccggcgcuccgagagcaugaagcuguacgcccuguguaccagagcucaaccugacggccccuggcucaaauggacggauaaggacucucugcuuuuuaugguggaggaaccuggccgguuccugccgcucuggcugcauauucuucugaucaccguccuccugguucuguccgggaucuuuagcggacucaaucugggccuuauggcccuggaucccauggagcuccgcauugugcagaacugcgggacagaaaaggagagacgguaugcgcgcaaaaucgaaccuauuagacggaagggaaauuaccugcuuuguucucugcuccugggcaacgugcuggucaauaccucccucacaauccugcuugacaaccugauugggagcggacucauggccguggcuuccucuaccaucggcauuguuaucuucggcgagauccugccccaggcccugugcagccgccacgggcuugcugugggagccaauacgauucuccugacaaaauuuuucaugcugcucaccuuuccucuguccuuccccaucagcaaacuucuggacuuuuuccucggccaggagauuagaacagucuauaaccgggaaaagcugauggagaugcugaaggugaccgaaccguacaaugaucuuguuaaggaggaacucaacaugauccaaggggcgcuggagcugagaaccaaaacaguggaggauauuaugacgcagcuccaggacuguuuuaugauccgcucugaugccauccuggacuucaacaccauguccgaaauuauggagagcggauauacacggaucccugucuucgaagacgagcagucuaauauuguggauauccuuuacgucaaggaccuggcuuuuguggaucccgacgauugcaccccucucaaaacaauuaccagauucuacaaccaucccguucacuuuguguuccaugacacgaagcuggaugccaugcuggaagaguuuaaaaagggcaaaagccaccuugcuaucguccaaaaggugaauaacgagggggaaggcgaccccuucuaugagguucucggacuggugacacuggaagaugucaucgaggaaauuaucaaguccgagauucucgacgagucugauauguacaccgacaaucgcagccggaaaagaguguccgaaaagaacaaacgcgacuuuagcgccuucaaggaugccgacaaugagcugaaagugaagaucucuccucagcuucugcucgcugcgcaccgguuucuggccaccgaaguuucccaguucagcccgucucugauuuccgagaagauccuucucagacugcugaaauaucccgaugucauucaagagcucaaguuugacgaacauaacaaauacuaugcucgccacuaccuguauacacggaauaagccugccgauuacuucauccuuauccugcagggcaaaguggagguggaagccgggaaggagaacaugaaguuugaaaccggagcuuucagcuacuauggcacaauggcccucacguccguccccucugacagaagcccugcgcaucccaccccgcugucccgcucugcuagccuguccuacccugaucggacagacgugagcaccgccgccacacuugcugggucuuccaaucaguucggaagcucuguucugggccaguauauuuccgauuuuagcgugagagcccucgucgaccugcaauacaucaaaauuacccggcagcaguaucagaacgggcuccuggcuucucgcauggagaauagcccccaauucccuaucgauggcuguacgacccacauggagaaccuugccgaaaaguccgagcugcccgugguugacgaaacaaccacacuccugaaugagagaaacagccugcuucacaaagcgucucaugaaaacgccauuuga

SEQ ID NO: 67632 - RNA, 7116 nt, Artificial Sequence
  derived and/or modified sequence opt5 from CNOT1__Homo_sapiens__NP_001252541
augaaccuggacagccugucccuggcccuuucucagaucagcuaccugguggauaaucucaccaagaagaacuaucgcgcuucccagcaggaaauucagcacaucgugaaucggcacggccccgaagccgaccgccaccuccuuagaugccuguucucucauguugauuuuagcggggacggaaaguccucuggcaaagauuuccaccagacacaauuucucauucaggagugugcgcugcugaucacgaagccuaacuucauuagcacccucuccuacgcuaucgacaauccccugcauuaucagaaaagccuuaagcccgccccucaccuguuugcccagcucucuaaggugcugaaacuuuccaaggugcaagaagucaucuucgggcuggcucuccugaacucuagcuccagcgaucugcggggauuugccgcucaguucauuaaacagaagcuccccgaccugcuucgcucuuacaucgaugccgacguguccggcaaucaggaagggggauuucaagauauugccaucgaaguucugcaccuccugcuuagccaucuccuguucggccagaaaggcgccuuuggggugggacaggagcaaauugacgcuuuccugaagacacugagacgggauuuuccucaggagcgcugccccgucgugcucgccccucugcuuuaucccgaaaagagagacauccugauggaccggauucuccccgauuccggcgggguugcuaaaaccaugauggagucuagccuggccgacuucaugcaggaagugggauacggcuucugugcguccaucgaggagugccgcaacaucauuguccaguuuggggugagagaagugacagccgcucaagucgcccggguucuuggaaugauggcucgcacccacagcggccugacagauggcaucccucuccagucuauuuccgcccccgggagcggaaucuggucugacggcaaggauaaaagcgacggggcccaggcucauaccuggaauguggaggugcugauugauguccugaaggaacucaacccuucccugaauuucaaagaggugacguaugaacuugaccaccccggauuucagaucagagauucuaagggccugcacaacguuguguacgggauccaacggggacucggcauggaggucuucccgguggaccugauuuaccgcccuuggaaacaugcggagggccagcugagcuuuauccagcacucccuuauuaaucccgaaaucuucuguuuugccgauuauccuugccauaccguugcuacagacauucucaaggcgccgcccgaggacgauaacagagaaaucgccaccuggaaaagccuggaccugaucgagucucuccugcggcuugcugaaguggggcaguacgagcaagucaaacagcuguucuccuuuccuauuaagcacuguccggauaugcucgugcuggcccugcuucagaucaauacaagcuggcauacccucagacacgagcugauuucuacgcugaugcccaucuuccucggaaaccacccuaacuccgcgauuauccugcauuaugcuuggcacggccaggggcaaagccccuccauucgccagcuuaucaugcaugccauggccgaaugguacaugcggggagagcaguaugaccaagcuaaacugucuagaauccucgaugucgcccaggaccugaaggcucugagcaugcuucucaauggcacaccuuuugccuucgugauugaucuggcggcccuggcuucccgccgggaauaccucaaacuggacaaguggcuuaccgauaagaucagagagcacggggaacccuuuauucaggccugcaugacauuccugaaacgccgguguccgucuauccucggcggacuggcuccugagaaggaccagcccaaaagcgcccaacugccucccgagacccuugcgaccaugcucgccugccugcaggcuugugccggcuccguuagccaggaacugucugagacaauucucacgaugguggcuaacugcuccaaugucaugaacaaggccagacagccucccccgggggugaugccuaaaggaagaccgcccagcgccucuucccuggaugcuaucagcccuguucaaaucgacccgcuugcgggcaugaccucucugagcauugggggauccgccgcuccccacacacagagcaugcagggcuucccucccaaucucgggucugccuuuuccaccccucagagccccgccaaggcuuucccuccccuguccacaccgaaccaaaccacggccuuuucuggcaucggaggccugagcucccagcuuccugucgggggacugggcacagggucucucaccggaauuggcaccggggcgcugggccuccccgcugucaauaacgauccuuucgugcagcggaagcugggaacaagcggccuuaaucaacccaccuuucagcagacagaccugucccagguguggccggaagccaaccaacauuucucuaaagagaucgacgaugaggccaauagcuauuuucagagaauuuacaaccacccuccccauccuacgauguccguugacgaaguccucgagaugcugcagcgcuucaaggauagcaccaucaaacgggaaagagagguguuuaauugcaugcugcggaaccuuuucgaagaguaccgcuuuuucccccaguaucccgacaaggagcugcacaucacagcuugucucuuugggggaauuaucgaaaaaggccuggugaccuacauggcccucgggcuggcgcuuagauauguccuggaggcucuccggaagccuuucggaucuaagauguacuauuucggcauugccgcccuggauagauuuaaaaaucgccugaaggacuacccgcaauauugccagcaucuugcuuccaucagccacuucaugcaguuuccccaccaucugcaggaauacauugaguacgggcaacagucucgggauccucccgugaaaaugcagggcuccaucacaaccccuggaagcaucgcccucgcucaggcccaagcgcaggcccagguucccgcuaaggccccucuggcuggccaagugucuacgauggucaccacauccaccacaaccacgguggccaaaacaguuaccgugacaagaccgaccggggucagcuucaagaaagacgugcccccuuccauuaacaccacaaacaucgauacgcuccugguugccaccgaccagacagaacgcauuguggagcccccugagaauauccaggaaaagauugcuuuuaucuucaacaaucuuagccagucuaacaugacccaaaaggucgaggaacugaaagagacagugaaggaagaguuuaugcccugggugagccaguaucuggucaugaaaagaguuuccauugagccgaauuuccacucucucuacagcaacuuucuggauacccuuaagaauccugaguucaacaaaauggugcugaaugagacguaucggaacaucaaggugcuccugacauccgacaaggcggccgcuaauuuuucugaucgcagccuccugaaaaaccuuggacauuggcugggcaugaucacccuggccaagaauaaacccauucuccacaccgaccuggacgucaagucccuucugcucgaagccuacgugaaagggcagcaggagcugcucuauguugugcccuucgucgcuaaggugcuggagucuagcaucagauccguuguguuccggccucccaacccuuggacaauggccauuaugaauguccuugcggaacugcaucaagagcacgaucugaagcucaaccugaaauuugaaaucgaggugcuuuguaagaaccuggcucucgacauuaaugaacugaaaccgggaaaccuccugaaggauaaagaccgccuuaagaaucuggaugagcagcugagcgcccccaagaaagacguuaagcagccugaggaacugcccccuaucaccacaacgaccacaucuaccacacccgccaccaacacgaccugcacagcuaccgugccgccucagccccaauacuccuaucacgauaucaaugucuacagccuggccggccuugcgccucauauuacacugaaccccaccaucccucucuuccaggcucacccccagcugaaacaaugugugagacaggccauugagcgggccgugcaggaacugguccauccgguuguggaccgcucuaucaagauugcuaugacaaccugcgagcagaucgugagaaaagauuuugcccucgacuccgaagagagccggaugcgcaucgcugcccaccacaugaugagaaaucuuacggcgggcauggccaugauuacaugucgggagccucugcugauguccaucucuaccaaccucaagaauagcuucgcuuccgcccugagaaccgcuagcccccaacagcgcgaaaugauggaucaggccgccgcucagcuugcgcaagacaacugcgagcuggccuguugcuuuauucagaaaacagcugucgaaaaggccgggcccgagauggacaagcggcucgccaccgaguucgagcugagaaaacaugcucgccaggagggacggagauacugugauccugugguucugacguaucaggccgaacgcaugccggagcaaauccggcucaaggugggcggggucgaccccaaacagcuugcgguguacgaagaguuugcuagaaauguuccuggauuccugcccacaaacgaucugucucagccuaccggcuuucucgcccagcccaugaagcaagccugggcuacagacgauguggcccagauuuaugacaaaugcaucaccgagcuggaacagcaccuucaugcgauuccuccgacacuggccaugaauccccaagcucaggcccuccgcucccugcuggaggucgugguccucagccggaacucuagagaugcuaucgccgcucuugggcugcugcagaaggccguggaaggacuccuggacgcgaccagcggcgccgaugcugaccuucugcuccgguaccgcgagugccaucugcugguucucaaggcccuucaggauggcagagcuuauggguccccuugguguaauaaacaaaucacgcggugccugauugaaugucgcgacgaguacaaguauaacguggaggccgucgaacugcucaucagaaaccaucuggugaauaugcagcaguacgaucuucaccuggcccagucuauggagaacggacucaauuacauggcuguugcguucgccaugcaacuggugaaaauucugcucgucgacgaacggagcguggcucacgugaccgaggccgaccuuuuucauacaaucgaaacccugaugagaauuaacgcccacucccgcggcaaugcucccgaggggcugccucagcucauggagguuguccggucuaacuaugaagccaugaucgauagagcgcauggaggccccaauuucaugaugcacagcgggaucucccaggccagcgaguacgacgauccgccuggacugcgcgaaaaggcugaguaucuucugcgggaaugggugaaccucuaccacucugccgcugccggcagagacuccacaaaagcguuuagcgccuucgugggccagaugcaucaacaggggauucugaagaccgaugaccugaucacgcgcuucuuucggcucugcacagagaugugugucgagauuuccuauagagcucaggccgaacaacagcacaaucccgcugccaaccccaccaugauccgcgcuaagugcuaccauaaucuugaugccuucgugagacugauugcgcugcucguuaaacacucuggagaggccacaaacaccgugaccaagaucaaucugcuuaacaaaguccugggcaucgugguuggggugcuccugcaggaccaugauguccggcagagcgaauuucaacagcugccuuaucaccgcauuuucaucaugcuccuucuggagcugaaugcucccgagcacgugcucgaaacaauuaacuuucagacgcugaccgccuucuguaauacauuucauauccuuagaccuaccaaggcuccgggauucguuuacgccuggcuggagcucauuucccaccggaucuuuauugcccgcaugcuggcgcauacaccccagcaaaaaggcuggccuauguacgcucagcugcucaucgaccuuuucaaguaucuggcccccuuucugagaaacguggaacucaccaagccuaugcagauccuguacaaagggacgcuucggguccugcucgugcugcugcacgauuuccccgaguuucucugcgacuaucacuacggauucugugaugugauuccgccuaacugcauccagcuuagaaaucugauucugucugcuuucccccgcaacaugcggcucccugaccccuuuacaccuaaucugaaggucgacaugcuuagcgaaaucaacauugcccccagaauccugaccaauuucaccggcguuaugccgccucaauuuaaaaaggaucucgacuccuaucugaaaacacgcagccccgugaccuuccugucugaucuccgguccaaccuccaggugagcaaugagcccggcaacagauacaaucuucagcugaucaacgcccucguccuguauguggggacacaagcuauugcccauauccacaauaagggaucuacgccuuccaugagcaccauuacacauucugcgcacauggacaucuuucagaaccuugccguugaucuggacaccgagggccgguaccucuuccugaaugcuauugccaaccagcugcgcuacccgaauagccauacacacuauuuuuccuguaccaugcucuaccuguucgcugaagccaacacggaggcgauccaggaacaaaucaccagagugcuucuggagcggcucauugucaaccgcccccacccuugggggcugcuuaucacauuuauugaacugaucaagaaucccgccuucaaauuuuggaaccaugaguucgugcacugcgcuccugagauugaaaagcucuuucagucuguugcccagugcuguaugggacagaaacaagcucaacaggugauggagggcaccggggccagcuga

SEQ ID NO: 67633 - RNA, 1623 nt, Artificial Sequence
  derived and/or modified sequence opt5 from CNOT2__Homo_sapiens__NP_055330
auggugagaaccgacggccacacacugagcgagaagcggaacuaccaggucaccaauuccauguucggggccucucgcaaaaaguuuguugaaggaguggauagcgacuaucacgaugagaacauguacuauucccaaucuagcauguucccccacagauccgaaaaagacaugcucgcuucuccuagcaccuccggccagcugagccaguuuggggccucucuuuacggacagcaauccgcgcugggccucccgaugcgggggaugagcaauaacacaccccagcugaaucgcucucuuucccagggaacccagcugccuagccaugugacacccaccacaggcgucccuaccaugucucuccacacgcccccuuccccgagcagaggcauccugcccaugaacccucggaauaugaugaaccauucccaaguggggcagggaauuggcauccccucucgcaccaauagcauguccagcucugggcugggauccccuaacagaagcucucccagcauuaucugcaugccgaagcagcagccuucccggcaacccuucacaguuaauucuaugagcggcuuugggaugaaccgcaaucaggcuuucggaaugaacaauucccucagcucuaacauuuuuaacggcaccgauggcuccgagaaugugacagggcuggaccuuagcgauuucccugcccuggccgacagaaaccggcgcgaaggaucuggcaaucccacgccccucaucaacccucuggcugggagagccccguaugucggaauggugacgaaacccgcuaaugagcagucccaagauuuuagcauccacaacgaggacuucccugcccuucccggcuccucuuacaaggauccuacaagcuccaaugacgauucuaagagcaaccugaauaccuccgggaaaacaaccagcucuaccgacggacccaaguuuccgggcgacaaauccagcacaacgcagaacaauaaccagcagaagaaaggcauucaaguucucccugaugggcgggugaccaauaucccccagggaauggucacagaccaguucggcaugauugggcugcugaccuuuauccgcgcggccgaaacagauccuggaauggugcaccucgcucugggcucugaccuuaccacgcuggggcucaaccuuaauucccccgagaaccuguauccuaaguucgccagccccugggcuucuagcccguguagaccucaggauauugacuuccaugugcccuccgaauaccugacaaacauccacauucgggauaagcucgccgcgaucaaacugggcagauacggagaggaccugcucuuuuaucuguacuauaugaauggcggggauguccuucaacugcucgccgcuguugagcuguucaaccgcgacuggcgguaccauaaggaagagagaguguggaucacccgcgcccccggaauggaaccuaccaugaaaacaaauaccuaugagcggggcacauacuacuuuuucgauugccuuaacuggagaaagguggcuaaagaauuucaccuggaguaugacaagcucgaggaacgcccgcaucugcccagcacguucaauuacaacccugcccagcaggccuuuuga

SEQ ID NO: 67634 - RNA, 2262 nt, Artificial Sequence
  derived and/or modified sequence opt5 from CNOT3__Homo_sapiens__NP_055331
auggccgacaagagaaaacugcagggcgagaucgaucggugccucaagaaagugagcgaaggggucgagcaauucgaagacauuuggcagaagcugcacaacgcugccaaugcgaaccagaaagagaaguacgaagcugaucuuaagaaagagaucaagaaacugcagcgccucagagaccaaauuaagaccuggguugccuccaaugagaucaaagauaagcggcagcugauugacaaccgcaaacuuaucgaaacacagauggagagauuuaaggugguggaacgggagacgaagaccaaagccuauucuaaggagggacugggccucgcucagaaagucgaucccgcccaaaaggaaaaagaggaaguggggcaguggcugacaaauaccaucgacacacugaacaugcagguugaucaguucgagagcgaaguggagucccucucuguccaaacccgcaagaagaaaggagacaaggauaaacaggacagaauugagggccugaagcggcauaucgaaaaacaccgcuaccaugugagaaugcuugagacaauucugcggaugcucgauaaugacagcauccugguugacgcuauucgcaagaucaaggaugacguggaauauuacgucgauuccucucaggacccugauuuugaggaaaacgaguuccuuuaugacgaucuggaccucgaggauauuccgcaagcccugguggcgaccagcccucccucccacagccauauggaagacgagaucuuuaaucagucuuccagcacgcccaccucuacaaccuccagcucucccauucccccuuccccggccaacuguacaaccgaaaauagcgaggaugacaaaaagagagggcgguccacggacucugaagugagccagucccccgcuaaaaacggaagcaagccuguccacucuaaucagcacccccaauccccugccguucccccgacauacccuagcgggcccccucccgcugccucugcgcugagcaccacacccggcaacaauggcgugccugccccggcugcucccccuuccgcccucggacccaaagccucuccugcccccagccauaacuccggcaccccggcuccuuaugcgcaggccguggcucccccugcccccagcgggccuucuaccacacagccccgcccgccuuccguccagcccagcggaggcgggggaggcggcucugggggaggcggguccagcuccucuagcaacuccucugccggaggcggggcuggaaagcaaaauggcgccacgagcuacuccagcgugguugcggauucucccgcugagguggcccuguccagcucuggcgggaacaaugccuccagccaggcucuuggaccuccgucuggcccccacaacccucccccuagcaccuccaaggagcccagcgccgcugccccuacaggggcgggaggcgucgcccccgggucuggcaauaacuccggaggcccgagccugcucgugccucugcccguuaauccucccuccucuccgaccccuagcuucuccgacgcuaaagccgcuggggcccuucugaacggacccccucaguuuucuacagcgcccgaaauuaaggcccccgagccucucagcucccugaaaucuauggcugaaagagccgcuaucagcuccggcauugaggauccggugcccacccugcaucucacggagcgggacaucauucugagcucuacauccgccccucccgccagcgcucagccuccccuucaacugucugaagucaauaucccucucucccugggggugugcccgcuuggacccgucccucugaccaaggagcagcucuaccagcaggcgauggaagaggccgcuuggcaccacaugccccauccuagcgauucugaaagaauccgccaauaucugccccggaacccguguccuaccccucccuaccaccaucagaugccucccccucacuccgacacaguggaguucuaucagagacugagcaccgagacacucuuuuucaucuuuuacuaucuggaaggcacgaaagcccaauaccuugccgcuaaggcccugaagaaacaguccuggcgcuuccauaccaaguauaugaugugguuucagcggcacgaggaaccgaaaacaaucaccgaugaguucgaacaggggacauacauuuacuucgacuaugagaaguggggccaacgcaaaaaggagggauuuaccuucgaauacagauaucucgaggaucgggaccugcaguga

SEQ ID NO: 67635 - RNA, 1719 nt, Artificial Sequence
  derived and/or modified sequence opt5 from CNOT4__Homo_sapiens__NP_001008226
augagcagaucccccgacgccaaggaggauccuguggaaugcccgcuguguauggagccccucgaaaucgacgauauuaacuucuuuccuugcaccuguggcuaccagaucugccgguucuguuggcaccgcauuagaacagacgagaaugggcugugccccgcuugucggaaaccuuaucccgaagauccugccgucuacaagccgcuuucucaagaggagcugcagcgcaucaaaaacgaaaagaaacagaagcagaaugagagaaagcagaaaauuagcgaaaaccggaagcaucucgcguccguucgcguggugcagaaaaaucuggucuuugugguuggacuuucucagagacuggcugaccccgaggugcucaagcggccugaguauuucggcaaauuugggaagauccacaaggucgugaucaacaauagcacguccuacgccggaucucagggccccagcgccuccgcuuauguuaccuacauucgcagcgaagaugcccugagagcuauccaaugcgugaacaaugucgugguggacgggcggacacugaaagccucucucggaaccacaaaguauuguuccuacuuccugaaaaacaugcagugcccuaagcccgauuguauguaccuucaugagcugggcgacgaagcggccagcuuuaccaaagaggaaaugcaggcuggcaagcaccaggaguaugagcaaaaacuccugcaggaacuuuacaagcugaauccgaacuuccuccagcugucuacaggguccgucgauaagaauaaaaacaagguuaccccucugcaaagccccauugacaaaccuucugauucccucagcaucggaaauggcgacaacucccagcagauuucuaacagcgacacgcccuccccucccccggggcugagcaagucuaaucccgugaucccuauuuccagcucuaaccauagcgcccgcucccccuuugagggagcugugaccgaaucucagagccuuuucuccgauaauuuuagacacccuaaccccaucccgagcggccugccucccuucccuucuagcccccaaacauccucugacuggccuaccgcccccgagccgcagucccucuuuacaagcgaaaccaucccugucuccucuagcacggauuggcaggcggccuucggguucggauccucuaaacagcccgaggacgaucugggcuuugaccccuucgaugugacacggaaggcucuugccgaccugauugagaaggaacucagcguucaagaucagccuucccugagcccgaccucucugcaaaauuccagcucucacacaaccaccgcuaaaggccccggguccggauuucuccauccugccgccgcuacaaacgcgaauagccugaacucuacguucagcgugcuuccccagcgcuuuccucaauuccagcagcacagagccgucuauaauuccuuuagcuuccccggccaggcugcccgguacccuuggauggccuuucccagaaacucuaucaugcaucugaaucacaccgcuaacccgacauccaauagcaacuuccucgaccugaaucuuccuccccaacacaacaccgggcugggaggcauuccuguggccggggaggaagagguuaagguguccacaaugccccucucuaccagcucccauucucugcagcagggacaacagccgacgagccugcacacaaccgucgcguga

SEQ ID NO: 67636 - RNA, 1674 nt, Artificial Sequence
  derived and/or modified sequence opt5 from CNOT6__Homo_sapiens__NP_001290170
augcccaaggagaaauacgaaccuccggaccccagacggauguauaccaucaugagcuccgaggaagccgcuaacggcaagaaaucucacugggccgagcuggaaauuagcgggaaggugcgcucccucucugcgagccuguggucccuuacacaucugacggcucuccaccugucugauaauagccuuuccagaaucccuagcgacauugccaaacugcauaaccucgucuaccuggaucugucuuccaauaagauccggagccuccccgccgagcugggaaacaugguuucucuucgcgagcugcaccucaauaacaaucugcuuagagugcugccuuucgaacucggcaagcuguuucagcugcaaacccucgggcugaaaggaaacccccuuacacaggacauucugaaucucuaucaggagccugauggcacccggcgccugcuuaacuaccugcucgacaaucuguccgggacagcuaagagaaucaccacagaacagccgcccccucggagcuggaucaugcugcaagagcccgaucgcaccagaccuacggcccucuucucugugaugugcuauaacguccugugugacaaauacgcuacccggcagcuuuauggauacugccccuccugggcccugaauugggauuaccgcaagaaagcgauuauccaggagauucucagcuguaacgccgacaucgugucccugcaggaaguugagacagaacaauauuacagcuuuuuccuuguggagcugaaggaaagaggcuauaauggcuuuuucucuccgaagucccgggcucgcaccaugagcgagcaggagagaaaacaugucgaugggugcgccaucuuuuucaagacagaaaaauuuacccucgugcagaagcacacgguugaguucaaccagcuggcuauggccaacucugaaggauccgaggcgaugcugaaucgggugaugacaaaagacaacauuggcgucgccgugcuccuggaacuuagaaaggagagcauugagaugccuucugggaaaccccaccugggaaccgaaaagcaacucauccugguggcuaaugcccauaugcacugggauccugaguacagcgacgucaagcugguucagacaaugauguuucuuuccgaagugaaaaacaucauugacaaggcuucucgcaaucucaaaagcuccgugcugggcgaguucgggaccaucccccugguccucugugccgaucugaacagccuucccgacucuggagugguugaauaucuguccaccggcggcguggagacaaaucauaaggauuuuaaagagcuccgguacaacgaaagccugacgaauuucucuugccacgggaagaacggaaccacaaauggcagaauuacccacggguucaagcugcaguccgccuaugagagcggacuuaugccuuacacaaacuacaccuuugacuucaaaggcaucauugauuauaucuuuuacuccaagccgcaacucaauacgcuggggauccugggaccccucgaccaucacuggcuggucgaaaacaauauuucuggcuguccucauccccuuaucccuagcgaucacuucucccuguuugcucagcucgagcugcugcuucccuuccucccucaggugaacggcauucaucugccggggcgccgguga

SEQ ID NO: 67637 - RNA, 1668 nt, Artificial Sequence
  derived and/or modified sequence opt5 from CNOT6L__Homo_sapiens__NP_653172
augagacugaucggcaugcccaaggagaaauacgacccuccggauccccggcgcauuuauaccaucaugagcgccgaagagguggcuaacgggaagaaaucccacugggccgaacucgagauuucuggaagaguccggagccuguccacaucucuuuggagccugacgcaucucaccgcgcugcaccuuaaugacaacuaccugucccgcaucccucccgauauugcuaagcuccauaaucugguuuaucuggaccucucuagcaacaaacugagaucccuuccugccgaacugggcaauauggugagccuccgggagcugcuucugaacaauaaccuccugcgcgugcugcccuacgagcucgggagacuguuccagcuucaaacacugggacucaagggcaauccucugucucaggauauccuuaaccuguaucaggacccggaugggacccggaagcuccugaauuuuaugcuggacaaccucgccguccaccccgaacagcugccuccccgcccuuggaucacacuuaaagagagagaucaaauucugcccuccgcuagcuucaccgugaugugcuacaauguucucugugacaaguaugccacacggcagcuguacggauacugcccgucuugggcucuuaacugggaauaucgcaaaaagggcaucauggaggagauugugaauugugaugccgacaucauuucccugcaggaagucgagaccgaacaguacuuuacgcuguuccugccugcgcugaaagagagaggcuaugauggguuuuucagccccaagucucgggccaagaucauguccgaacaagagcgcaaacauguggacggaugcgcuauuuucuucaagaccgagaaauuuacacucguucagaagcacaccguggaauuuaaccaggucgccauggcuaacagcgacggcuccgaggccaugcugaauagagugaugacaaaagauaacaucgggguggcggucguucuugaagugcacaaggagcuguuuggagccggcaugaaaccuauccaugcugccgacaagcagcuccugauuguggcuaaugcccacaugcauugggaucccgaauacucugacgucaagcugauccaaaccaugauguucgugagcgagguuaaaaacauucuugagaaggccuccagccggcccgggucuccuacggcugaucccaauuccaucccgcucgugcugugugcggaccugaacagccucccugauucuggagucguggaauaucugagcaauggcggcguugccgacaaccacaaagauuuuaaggagcuuagauacaaugaaugccugaugaacuucuccuguaaugggaaaaacggaucuagcgagggccgcauuacacacggguuccagcucaaguccgcuuaugaaaauaaccugaugcccuacaccaauuacacauuugacuucaagggagugaucgauuauaucuuuuacagcaaaacccauaugaacguccugggcgugcuugggccucucgacccccaguggcuggucgagaacaauauuaccggaugcccgcacccucauauccccucugaccacuucucccugcucacacaacuggagcuucauccuccccugcucccucuggugaacggcguucaccuccccaaucggagauga

SEQ ID NO: 67638 - RNA, 858 nt, Artificial Sequence
  derived and/or modified sequence opt5 from CNOT7__Homo_sapiens__NP_037486
augcccgccgcuaccguggaccacagccagagaaucugcgaggucugggccuguaaccuggaugaagagaugaagaaaauucggcaaguuauccgcaaguacaauuauguggcgauggacacagaguucccuggcguggucgcuagaccgauuggggaauuucgguccaacgccgauuaccaguaucagcuccugcgcugcaauguggaccuucugaaaaucauucagcucggacugacguucaugaacgaacaaggcgaguaucccccugggaccucuacauggcaguuuaauuucaaguuuaaccuuaccgaggauauguacgcccaggacagcaucgaacugcucacaaccuccggaauccaguucaaaaagcaugaggaagagggcauugagacacaauacuuugcugaacugcugaugaccucugggguugugcucugugagggagucaaguggcugagcuuccacuccggcuaugauuuuggcuaccuuaucaaaauucugaccaauucuaaccuccccgaagaggaacuggacuucuuugagauccuuagacuguucuuuccugugauuuacgauguuaaguaucucaugaaaagcugcaagaaucugaaagggggacugcaggagguggccgaacagcucgagcuggaacggaucggcccccagcaucaagcuggguccgacagccuucugacgggaauggccuucuucaagaugcgcgagauguuuuucgaagaucacauugacgaugcgaaguacuguggccaucucuaugggcugggaucuggcuccagcuacguccagaacggcacagggaaugccuaugaggaggaagcuaacaaacagucuuga

SEQ ID NO: 67639 - RNA, 717 nt, Artificial Sequence
  derived and/or modified sequence opt5 from CNOT8__Homo_sapiens__NP_001288003
augcccgccgcucugguggagaacagccaggucaucugcgaaguuugggccuccaaucucgaggaagagaugagaaagauucgggaaaucgugcugucuuacagcuauauugcgauggacaccgaguucccuggcguggucgugcgcccgaucggggaguuuagauccucuauugauuaccaauaucagcuucugcgguguaacguugaccuccugaaaaucauccagcuuggacugacauucacgaaugaaaagggcgaguaccccagcgggauuaacaccuggcaguuuaauuucaaauuuaaccucacaggauaugauuucggcuacauggugaagcugcugaccgacucccgccucccugaagaggagcacgaauuuuuccauauccugaaucuguuuuuccccucuauuuaugaugucaaauaccuuaugaaguccugcaagaaccucaaagggggacugcaagagguggcugaccagcuugaucugcagagaaucggccggcagcaccaagccggcagcgacagccuccugacagggauggccuuuuuccgcaugaaggaacuguuuuucgaggauucuauugacgaugcuaaauacuguggaagacucuauggccuggggaccggaguugcccagaagcagaaugaagacguggauuccgcucaggagaaaaugagcauccuugccauuaucaacaauaugcaacaguga

SEQ ID NO: 67640 - RNA, 1266 nt, Artificial Sequence
  derived and/or modified sequence opt5 from CNP__Homo_sapiens__NP_149124
augaacagaggcuucagccggaagucccacaccuuucugcccaaaaucuucuuucgcaagaugucuagcuccggggccaaagacaagccugagcuccaguucccguuucugcaagaugaagacacaguggcuacgcuucuggagugcaaaacccucuucauucugagaggacuucccggcucuggaaagagcacacuggcccgggucaucguugauaaguaccgcgacgggaccaaaaugguguccgcggaugcuuauaagauuacaccuggcgccagaggggccuuuucugaagaguacaaacggcucgacgaagaucuggcugccuauugucgcagacgggacauccgcauucuggugcucgaugacaccaaucaugagagagagcggcuggaacagcuuuucgagauggcugaucaguaccaguaucaagucgugcugguugaacccaagacagccuggcgccucgacugcgcgcagcugaaagagaagaaccaguggcagcuuagcgccgaugaccugaagaaacucaagccuggacuggagaaagacuuucugccccucuacuucggcugguuucugaccaagaaauccagcgaaacgcuuagaaaggcuggccaaguguuccuggaggaacucgggaaucacaaagccuuuaagaaggagcugcggcaguucgucccuggagaugaaccgcgcgagaaaauggaccuugugaccuauuucggcaagagacccccugggguucugcauuguacaaccaaauuuugcgauuacggaaaggcucccggcgccgaggaauacgcgcagcaggacgugcucaaaaagucuuauuccaaggccuucacacugaccaucagcgcucuguuugucacgccuaaaacaaccggggcccggguggagcucucugaacaacagcugcagcuuuggcccuccgauguggacaagcugagcccgacagauaaccucccuagaggaucucgcgcucacaucacccugggcugugccgccgacgucgaggcuguucaaaccggccuugaucugcucgaaauucugcggcaggagaaagggggauccagaggcgaggaagugggggagcugagccgcggaaagcucuacucccugggcaaugggcgguggaugcuuacacuggcgaaaaacauggaagugagagccaucuucacgggauauuacggcaagggcaagcccgucccuacccaggggucucgcaaaggaggcgcucuccagagcugcacaauuaucuga

SEQ ID NO: 67641 - RNA, 549 nt, Artificial Sequence
  derived and/or modified sequence opt5 from CNPY2__Homo_sapiens__NP_055070
augaagggcuggggguggcuggcccuccugcuuggagcucugcucggcaccgccugggcgagacggagccaggaccugcacugcggggcuugucgcgcccuuguggaugagcuggaaugggagaucgcccaagucgaccccaaaaagacaauucagaugggauccuucagaaucaacccugauggcucucagagcguuguggaagugccguacgcucgguccgaggcccaucucacggaacugcuggaggagauuugcgaccgcaugaaagaauauggggagcagaucgaucccucuacccacagaaagaauuacguccgggugguuggacgcaacggcgaaagcuccgagcucgaccugcaaggcauuagaaucgauucugacaucagcgggacacuuaaauuugcuugugaguccauuguggaagaguaugaagaugagcugaucgaguucuuuagccgggaagccgacaaugucaaggauaagcucugcucuaaacgcaccgaccugugugaucaugcgcuucacauuucccaugacgagcuguga

SEQ ID NO: 67642 - RNA, 837 nt, Artificial Sequence
  derived and/or modified sequence opt5 from CNPY3__Homo_sapiens__NP_006577
auggacagcaugcccgagccugccuccagaugccugcuccugcuuccgcugcuccugcuucugcuccugcugcuccccgcuccugaacugggccccucucaggccggggcggaggaaaacgauugggugcggcuuccuagcaagugugaggucugcaaauacguugcuguggaacugaaguccgccuucgaggagaccggaaaaacaaaggaagugaucggcacgggguaugggauucucgaccaaaaagccucuggcgucaaguacaccaagagcgaucugcgccuuaucgaggugacagaaaccauuuguaaaagacugcucgacuauucccugcacaaggagcggacagggucuaaucgcuuugcuaaaggaaugagcgagaccuucgaaacacugcauaaccucguucacaagggcgugaaagucgugauggauauccccuacgagcuguggaaugaaaccuccgccgagguugcugaccuuaagaagcagugcgaugugcuggucgaagaguuugaggaagugauugaggacugguauagaaaccaucaggaagaggaucucacggaguuccugugugccaaucacgugcuuaaaggcaaggacaccagcugccuggcggaacaguggucugggaaaaagggagauacagccgcucucggcgggaaaaaguccaaaaagaaaagcucucgggccaaggcugccggaggccgcuccuccucuuccaagcaaagaaaagagcugggaggacuggaaggcgacccuagcccggaggaagaugagggcauccagaaggcgagcccccucacccauucuccucccgacgaacuguga

SEQ ID NO: 67643 - RNA, 1419 nt, Artificial Sequence
  derived and/or modified sequence opt5 from CNR1__Homo_sapiens__NP_001153731
augaaaagcauccuggacggccucgccgauaccacauucagaacgauuaccacagaccugcuuuacgugggguccaacgauauccaguaugaggacauuaagggagauauggcuucuaagcugggcuacuuuccccaaaaauucccucucaccagcuuucggggguccccguuccaggaaaagaugacagccggagacaauccccagcuggucccugcggaucagguuaacaucaccgaguuuuauaauaaaucucuuagcuccuucaaggaaaacgaggaaaauauucaaugcggcgagaacuuuauggacaucgaguguuucauggugcugaaucccucucagcagcucgcuaucgccgugcugagccugacacucgggaccuuuacgguccuggaaaaccuucuggugcucugcguuauucugcacucccgcagccuuagaugucggccuucuuaccauuucaucggaucccuggccguggcugaucuccugggcagcgucauuuuuguguauucuuucaucgacuuucacguuuuccaucgcaaggauuccagaaauguguuccuguuuaaacucggcggggucaccgccagcuucacagcuucugugggaucccuguuucuuaccgccauugaccgguacaucagcauucaccgcccccuggcguauaagagaaucgugacacggccuaaagccgucguugcuuucugccucauguggaccaucgccauugugaucgcugugcugccgcuucugggcuggaacugugagaagcuccaguccgucugcucugauauuuuuccccauaucgacgaaacguaccugauguucuggauuggggugacaagcguucugcuccuguuuaucguguacgccuauauguacauccuuuggaaagcgcacucccacgccguccgcaugauucaaagaggaacccaaaagagcaucauuauccauacaucugaggacggcaaggugcagguuacccggccugaucaggcucgcauggacauuagacuggccaaaacccucgugcugauccuugucgugcugaucauuuguugggggccccuccuggcuaucauggucuaugauguguucggaaagaugaauaaacugauuaagacaguuuuugccuucugcuccaugcucugucugcuuaacagcacggugaauccuaucauuuacgcccugcggucuaaagaccuccgccacgcuuuuagaagcauguuccccuccugcgagggcaccgcgcagccgcuggauaacucuaugggcgacagcgauugucugcauaagcacgccaauaacgcugccuccguccaccgggccgcugaaagcugcaucaaaucuacagugaagauugccaagguuaccauguccgugagcacagacaccucugcggaggcucuuuga

SEQ ID NO: 67644 - RNA, 1083 nt, Artificial Sequence
  derived and/or modified sequence opt5 from CNR2__Homo_sapiens__XP_011538931
auggaggaaugcugggugaccgagaucgccaacggcagcaaggacgggcuggauuccaaucccaugaaagacuacaugauucucucuggaccucagaagacagcugucgccguucuguguacgcuucugggccuccugagcgcgcuugaaaacguggcugugcuguaucucauccuguccucucaccaacugagacggaaaccgagcuaccucuucauugggucccuggccggagccgauuuucuugcuucugucguguucgccugcagcuuuguuaauuuccauguguuucacggcgucgacuccaaggcuguguuccugcucaaaaucgggagcguuaccaugacauuuaccgccucugugggaucccugcuucugacagcgauugaucgcuaucucugucugagauaucccccuagcuacaaggcccugcucacccggggccgcgcucuggucacacuuggcaucaugugggugcugucugcccucguguccuaccugccccuuaugggguggaccugcuguccuagacccugcagcgagcuguucccucucaucccgaacgacuaucugcugucuuggcuccuguuuauugcuuuccuguuuuccggaaucauuuacacguacggccauguccuuuggaaggcccaccagcauguugcgagccucuccgggcaccaggaucgccaggugcccggaauggcccggaugagacuggacgugcggcuugcuaaaacccugggccucguccuggccgugcugcucaucuguugguucccuguucuggcucuuauggcccacucucuggccacaacccucagcgaucaagugaagaaagcguuugcuuucugcuccaugcugugucugauuaauagcauggucaaccccgugaucuaugcccuucgcucuggggaaauuagauccagcgcucaucacugccucgcccauuggaagaaauguguucggggacugggcucugaggccaaggaggaagcuccucgcagcuccgugacagagaccgaagccgacggcaagaucacgcccuggccggauucuagagaccuggaucucagcgacugcuga

SEQ ID NO: 67645 - RNA, 387 nt, Artificial Sequence
  derived and/or modified sequence opt5 from CNRIP1__Homo_sapiens__NP_001104571
augggcgaccugcccgggcucgugagacugagcaucgcccuucggauucagccuaacgauggaccggucuucuacaagguugacggccaacgcuuugggcagaauagaaccaucaaacugcucacaggauccucuuauaagguggaggugaaaauuaagcccagcacgcugcaggucgaaaacaucuccauuggcggggugcuuguuccucuggagcucaaaucuaaggaacccgauggagaccggguggucuacaccggcacauaugauaccgagggcgugacaccuaccaagagcggggaacgccagcccauccaaaucacaaugccugagugccuggagcagagaccgcaggaaauuucccugaccuacgagugugaagaguga

SEQ ID NO: 67646 - RNA, 1851 nt, Artificial Sequence
  derived and/or modified sequence opt5 from CNST__Homo_sapiens__NP_001132931
auggacgauagcgacacccccacauacuaucugcagaucgagccucaagauggcugccacccgggggacuccguggaaagaucugucacgugucuccccagcgccuccgaugagaacgaaaaucagcuggacggagauggccaugagcaccuuaccucuagcgacuccgcuauggggaagccucagguuucugaacaggauagccugaacaauaacgaguccugcacacucagcugugagguggccgcgggagaaaaucugcaaaacacccuuugcgaggcuucucgggacgaacaggccuuccugggcaaagauaagaaaauucccgggaagcgcuccccuagaagcaaaaagggaacagccaagaaaauucccccuggccucuuuucuggcgacaucgcuccgcugaugcaggagaaggugcuguccgccgucaccuacgcuguggaugacgaggaagccgcggagguuaaugccaacgaacagcccgaggcuccuaaacucgugcugcaaagccuuuucucucugauccgcggggaagucgagcagcucgacucccgggcccugccccuuugucugcaucagauugcugagagcuauuuucaggaagaggauuacgaaaaggccaugaaauucauccaacucgagagacuguaucacgaacagcugcucgcgaaucuguccgccauccaggagcaaugggagacaaaguggaagaccgugcagccucauacgguuaccgcccuucggaacucugaaaaaggauuuaauggcgaggacuucgaacgccugacaaagauuugcgcuacccaccaggauccccuccugagcaaacacaagaucgcugccguggagaaaucccaggaaagaaaguguagcacacaacuucuggucucugaggacccgaaagaagggggagccaccacgaaggaauccgagagcaagacaugccucggcaccgaaucuagcaaagagucccagcauacaguggagccucuggggucuagccccuguugccaccagauggaugugcagaccgacuccccuagccugucugucaccgcuggaaaggaucauauggaggagcuccuguguuccgcggaagccacacuugcucugcacacgcaaagcucugagaccgccggcucccccagcggccccgacuccucugaagaugccugcgaggacgauagccggcuccagcuggcucagacagaggccugccaggacguugcgcgcauugaagggaucgcugaggacccuaaaguguuucuuuccucuaagagcaaaaccgaaccgcugauuucccccggaugugauagaaucccucccgcccucauuagcgagggcaaguacucucaagcccagcggaaggaacugcgccugccucucagagacgcuuccgaggcccugcccacagaucagcuugagaacaaugaacugaacgagcuccagcaaccggaccugaccgauagcgacgggaaaucuccucaggcucaggccgauuccgacggaagcgaaaaugugcugugcggcaacaaccaaaucucugaucuugggauccuccugcccgaggucuguauggcgccugaagagaagggagacaaagaugaccagcugaauaaggagacggaagauuaucucaacagccugcuugagggcugccugaaagacacagaagacucccucagcuacgaggauaaucaggacgaugacucugaucugcugcaggaccuuucccccgaggaagccagcuacucccuccaagagaaccugccuucugaugaaagcugucugucccucgacgaucuggcuaagcggauugagaucgccgaagugaaucagcgcuga

SEQ ID NO: 67647 - RNA, 603 nt, Artificial Sequence
  derived and/or modified sequence opt5 from CNTF__Homo_sapiens__NP_000605
auggccuucaccgagcacagcccccugacaccucauagacgggaccucugcucccgcucuaucuggcuggcuagaaagauucggagcgaucuuacggcccugaccgaauccuacgugaaacaccagggccucaacaagaauaucaaccuggacucugcggaugggaugccggucgcuagcacagaccaaugguccgagcuuaccgaagccgagcgccugcaggaaaaucuccaggccuauagaacauuucauguucugcuggcucggcuccuggaggaucagcaagugcacuucacccccacagagggagacuuucaucaggccauucacacccuucugcuccagguggcugccuucgcguaccagaucgaggaacugaugauucuucuggaauauaaaaucccucgcaacgaggccgauggcaugcccaucaaugucggggacggaggccucuuugagaagaaacugugggggcugaaggugcuccaagaacugucucaguggacgguuagaagcauucacgaucuucgguucaucuccagccaucagaccggcauuccugcucgcggaucucacuacaucgccaacaauaagaaaauguga

SEQ ID NO: 67648 - RNA, 1119 nt, Artificial Sequence
  derived and/or modified sequence opt5 from CNTFR__Homo_sapiens__NP_001193940
auggccgcucccgugccuugggccugcugugcgguccuggcugccgccgcugccguuguguacgcucagagacacagcccgcaagaggcgccccaugugcaguaugaacggcucggcuccgacgucacccugccuugcgggacagccaacugggaugccgcugugacguggcgcguuaauggaaccgaccuugcccccgaucugcucaacggcucucagcuggugcuucacgggcuggagcucggacauagcggccuguacgcuuguuuccacagagacuccuggcaucugcggcaccagguccuccugcacguggggcuuccuccccgcgaaccuguucugucuugcagaagcaauacauauccgaagggauuuuacuguuccuggcaucuccccaccccuacauauauccccaacaccuucaaugugacaguccugcacggcucuaaaauuauggugugcgagaaggauccugcccuuaaaaaccggugucauauccgcuacaugcaccuguuuagcaccauuaaguauaaaguguccaucagcgucucuaaugcgcucggccacaacgccacggcuauuaccuucgacgaauuuacaaucguuaagcccgauccgccugagaaugugguggccagacccgucccuuccaacccccggcgccuggaggugaccuggcaaacacccagcaccuggccugacccggaaucuuucccccugaaguuuuuccucagauaccggccucugauccuugaucaguggcagcauguugagcuguccgacgggacggcucacacaauuaccgaugccuacgccggaaaagaauauaucauucagguggcugcgaaggacaaugagaucggcacauggagcgauuggucugucgccgcucaugccacccccuggaccgaggaaccucgccaccucacaacggaggcccaagcugccgaaaccacaaccuccacaaccagcucccuggcgcccccgccuacgacaaaaauuugcgaccccggggagcuuggaucuggcgggggaccuagcgcucccuuucugguguccguuccuaucacccucgcccuggccgcugccgcugccaccgcgagcucucugcucauuuga

SEQ ID NO: 67649 - RNA, 1176 nt, Artificial Sequence
  derived and/or modified sequence opt5 from CNTLN__Homo_sapiens__NP_001107867
auggccgcuagaagcccucccuccccgcaccccucuccucccgcccggcagcugggcccucgcagccccagaguggggcggggagcggagguccaugcuaugcgcuccgaagccucuggcuucgccggggcugccagagagguuguggcugacgaaagcgauaagaucugggugggagaggaaggcuccgggggacggcgcggcccuggcggggccgcgccggcccacgcuccccuccugucugccccuaugggaagcagacggcuugagggcauuuccgucgaggaagcuauggugacccgcacacaacugcucgaggaagaacugagcucucuuaaagaggaacuggcccucugccaggcggacaaggaguuuguuuggucccuguggaaaagacuccaggugacgaaccccgaucugacccaggucgugagccugguuguggaacgggagaagcaaaaaucugaagccaaggaccgcaagguccuugagauccuccaggugaaagaugcuaagauucaggaguucgaacagagagaguccgugcugaaacaagaaaucaaugaccuggucaagcggaaaauugccguugaugaggaaaacgcuuuucuucgcaaggaguucagcgaccuggagaagaaauuuaaggauaaaucucaggaaaucaaggacacaaaagagugugugcagaauaaggaggagcagaacagacucgugaucaaaaaucuggaagaggagaacaagaagcuguccacccggugcacagaucuccugaaugaccuugaaaaacugagaaagcaagaggcccaucuccgcaaagaaaaguacagcaccgaugccaaaauuaagacauucgaggacaaccugaucgaggcucggaaggaagucgaggugucccagucuaaauauaaugcgcuuagccugcagcucuccaacaagcaaaccgaacugauucagaaagacauggauaucacgcugguuagaaaggagcuccaggaacugcagaaucuuuacaaacaaaacagcacccacacagcccagcaggcugagcugauucagcaacuccaggugcugaauauggacacccagaagguccuucgcaaccaggaggaugugcauacagccgaaucuaucuccuaucaaaagguuuguuuuuacagcgugauuaaaauguga

SEQ ID NO: 67650 - RNA, 1884 nt, Artificial Sequence
  derived and/or modified sequence opt5 from CNTN1__Homo_sapiens__NP_001242993
augaagauguggcugcucgugagccaccuggucaucauuuccaucaccacaugccuugccgaguucacgugguacagacgguacggccaugggguuucugaagaggacaaaggauuuggccccauuuucgaggaacagcccaucaacaccauuuacccggaagagagccuggaggggaaggugucccucaauugucgcgcuagagccucucccuuuccuguguauaaauggcggaugaacaauggagaugucgaccugacaagcgaucgcuacuccauggugggcgggaaccuuguuaucaauaaccccgacaagcaaaaagaugcgggaaucuauuacugccuggcuucuaauaacuauggcauggugagaagcaccgaagccacacucuccuucggcuaccuggacccuuuucccccugaggaacggccggagguccgcgugaaggaggggaagggaaugguucugcucugugaucccccuuaccacuuccccgacgaucugagcuauagauggcuucugaaugaauuuccuguguucauuaccauggacaaacggcgcuuugucucucagacaaacggcaaucucuacaucgccaacguggaggcuuccgauaaggggaauuauagcugcuucgugucuucccccagcauuaccaaaucugucuuuuccaaguucaucccgcugauuccuauccccgaaagaacgaccaaaccuuaccccgccgacauuguugugcaguuuaaggauguguaugcucuuaugggacagaacgucacacuggaguguuucgcccucggcaaucccgugccugacauccgguggcgcaagguucuggaaccgaugcccagcaccgcggagaucuccacaucuggggccgugcugaaaauuuucaacauccaacucgaggacgaaggaauuuacgagugcgaagcugagaacaucagaggcaaggauaaacaucaggcccggauuuauguccaggcuuuuccugaauggguggagcacaucaaugacaccgagguugauaucggcagcgaccuguacuggcccuguguggccacggggaagccuauucccacaauccgcuggcuuaaaaacggauacgcguaucauaagggcgaacugagacucuacgaugucaccuucgagaaugccgggauguaucagugcauugcugaaaacacauacggagccaucuaugcuaaugccgagcugaaaauucuugcccuggcuccgaccuuugaaaugaacccuaugaagaagaaaauccucgcggccaagggcgggcgggugaucauugaguguaaacccaaggcugccccuaaacccaaguucuccuggagcaagggaaccgaguggcuggucaauucuuccagaauccugauuugggaagacggcagccucgagaucaacaauauuacacgcaacgauggcgggaucuacacgugcuuugccgaaaauaaccggggaaaagcuaauucuaccggcacacuggugauuaccgacccuacaagaaucauccuugcccccauuaacgcggauaucaccguuggggagaaugcuacgaugcaaugugccgccagcuucgacccggcucuggaucucacauuugugugguccuucaacggauaugucauugacuuuaacaaggagaauauccacuaccagcgcaacuucaugcuggacucuaauggcgaacuucugauucggaacgcccagcucaaacacgcugggagauauaccugcaccgcccagacaaucguggauaauagcuccgcgagcgccgaccugguugugcgcggcaagaaccggaaaggaggcgagaagaauauggucgauucuuuucugccugugugcgcuucccucccucccaccugguga

SEQ ID NO: 67651 - RNA, 3123 nt, Artificial Sequence
  derived and/or modified sequence opt5 from CNTN2__Homo_sapiens__NP_005067
augggcaccgccacaagacggaagccccaucugcuccugguggcugccgucgcgcuuguuagcuccucugcuuggagcuccgcccuggggucucagacgaccuucggaccuguguuugaggaccaaccgcucagcgugcuguuccccgaagaguccacagaagaacagguccuucuggccugccgcgcuagagccucuccucccgcuaccuaccgguggaaaaugaacggcacagaaaugaagcucgagccugggagccgccaccagcuggugggaggcaaucugguuaucaugaaccccaccaaagcccaggaugcggggguguaucaaugucucgccuccaauccugucggaacagugguuagcagagaggcuauucugcgguuuggcuuccuucaggaauuuucuaaggaggaacgcgacccggugaaagcccacgagggcuggggagucaugcugcccugcaacccucccgcucauuacccuggacucuccuauagauggcugcuuaaugaguuccccaacuuuaucccgaccgauggccggcacuucgugagccagacgaccgggaaucuguacauugcccgcacaaacgcgucugaccucggaaauuauuccugucuggccaccagccauauggauuuuucuacaaaguccguguucagcaaguuugcucagcugaaccucgccgcugaagacaccagacuguucgccccuuccaucaaagcccgguuucccgcugagacguacgcgcuugucggccaacagguuacacuggaaugcuucgccuucgggaauccugugccccgcauuaaguggagaaaaguggauggaucucucagcccccaguggaccacagcugagccuacccugcagaucccguccgucagcuuugaagacgagggcaccuaugagugugaagccgagaacucuaagggccgggauacagugcaagggcgcaucauuguucaggcccagcccgaauggcuuaaagugaucuccgacacggaggcugauauuggaagcaaucugagauggggcugcgccgcggcugggaagccucggcccaccgucagauggcuccgcaacggagaaccucuggccucucaaaaucggguggagguucuggccggcgaccucagauucagcaagcugucccuugaggauucugggauguaccaguguguggcugaaaacaaacacggaacaaucuacgccagcgcugagcuggccguccaggcgcucgcccccgacuuucgccugaacccggugcggagacuuauuccugcugcccgcggcggcgaaauccugauucccugccagccucgggcugcccccaaggcggucgugcucugguccaaagggaccgagauccugguuaauagcucuagagugacagucaccccugacggaacgcugaucauucgcaacaucucccggagcgaugaaggcaaguauacauguuucgccgagaauuuuauggggaaagcuaacucuaccgggauucucuccgugagagacgccaccaagaucacacuggcucccagcuccgccgauauuaaucuuggcgacaaccugacccuccaaugccacgccucucaugauccgacaauggaccugacguucaccuggacacuggaugacuuuccuaucgauuucgacaaacccgggggccacuaccgccggaccaauguuaaggagacaaucggagaucuuaccauucucaacgcucagcugagacauggcgggaaguauacguguauggcgcagaccguggucgacagcgccuccaaagaagcuacagugcuggugcggggacccccuggcccgcccgggggaguugucgugcgcgacaucggcgauaccacaauucagcucucuuggagcagaggguuugacaaucacuccccuaucgccaaguacacccugcaagcccggacgcccccugcuggcaaauggaaacaggugagaacaaaccccgccaauauugagggaaacgcggaaaccgcucagguccuuggccugacaccuuggauggauuaugaguuccgcgugaucgccagcaauauccucgggaccggagagcccucuggcccguccagcaagauucggaccagagaagccgcuccuucuguugcccccuccgggcugagcggaggcgggggcgcgccuggagagcugaucgugaacuggacacccaugucucgcgaauaccagaauggcgacggguuuggauaucuucucagcuucagacggcaaggcuccacgcacuggcagaccgcucgcgucccgggggccgaugcccaguacuuuguguacagcaacgagucuguuagaccuuauacacccuucgaagugaagauucgguccuacaaccgcagaggagacggcccugagagccugaccgcucuggucuauuccgccgaggaggagccccggguggcucccacaaagguuugggccaaaggggugucuagcuccgaaaugaaugucaccugggagccugugcagcaagauaugaacggcauccuccugggauacgaaauucgcuauuggaaggcgggcgacaaagaggccgcugccgauagagugcggacggcugggcuugacacaucugcccgcgucagcggacugcauccgaauaccaaguaccacguuaccgugagagccuauaaccgggcuggcacagggcccgcguccccuucugccaaugcuaccacaaugaaacccccucccagacgcccuccgggaaacaucagcuggacguucuccucuagcucccucagcauuaagugggaucccguggucccuuuucggaaugagucugccgugaccggcuacaagaugcuguaccagaacgaccugcaucuuacacccacccuccaccugacaggcaaaaauuggaucgaaaucccuguucccgaggauauugggcaugcccuggugcagaucagaaccacgggaccgggcggggacggcauuccugcugaaguccacaucgugcgcaacggagggaccuccaugaugguugagaauauggccgugcggcccgcgccccacccuggaacagucauuagccauucuguggcuaugcucauccugaucggcucccuugaacuguga

SEQ ID NO: 67652 - RNA, 3087 nt, Artificial Sequence
  derived and/or modified sequence opt5 from CNTN3__Homo_sapiens__NP_065923
augauguuccccuggaagcagcugauccuccugagcuuuauuggcugccuugggggagagcugcuccugcaaggcccuguguucaucaaagaaccguccaacucuauuuuucccgucgggagcgaggacaagaaaaucacccuucacugugaagccagaggaaauccuagcccccauuaccgguggcagcugaacggcucugauauugacaugagcauggagcaccgcuauaagcucaaugggggaaaccugguugugaucaauccuaacagaaauugggauacaggcacguaccagugcuucgcuaccaacucccugggcacaaucgugucucgggaagccaaacuccaguuugcguaucuggagaauuucaagaccaagaugcgcagcacagucuccgugagagaggggcaaggaguugugcuucuguguggacccccuccgcauagcggggaacucucuuacgcuuggauuuuuaacgaguaucccuccuucgucgaagaggacagccggcgcuuugugucucaggagaccggacaccuguacaucuccaaaguugaaccuagcgaugugggcaauuauacaugcgucgugaccucuauggugacgaacgccagaguccuugggucccccaccccucugguucuccggagcgacggagugaugggcgaguacgaacccaagauugaggugcaguucccggaaacacugccugccgcuaaaggcuccaccgucaagcuggaguguuuugcccucgggaaucccaucccucagauuaacuggcgcagaucugauggacugcccuucagcuccaaaaucaaacuucggaaguuuagcggcgugcuggagauucccaauuuccaacaggaagacgcugggucuuacgagugcaucgccgaaaacucccgcggcaagaacguugcgagaggccggcucacauauuacgccaagccucauugggugcagcugaucaaagaugucgagauugcuguggaagacagccuuuauugggagugucgcgccucugggaagccgaaacccagcuacagauggcugaagaauggagcugcccucguucuggaggaacggacccagaucgagaacggcgcgcugacgauuuccaaucucucugugacagauagcggcauguuccaaugcaucgccgaaaacaaacacgggcuggucuauuccagcgcugagcuuaagguggucgccucugcuccugacuuuuccaagaaucccaugaaaaagcuggugcagguucaggugggaagccucgucucucuggauuguaaaccuagagccagcccccgcgcccuuagcuccuggaagaaaggcgacgugucuguucaagaacacgagcggauuagccugcucaacgacgggggacugaagaucgcuaaugugaccaaggcggaugccggcacauauaccugcauggcugagaaccaguucgggaaagccaauggcaccacacaucuggucgugacggaaccgaccagaaucacacucgccccuuccaacauggacgugucuguuggagagagcgucauucugcccugucaggugcagcacgauccucuucuggacaucauuuuuaccugguacuucaauggcgcucucgccgauuuuaagaaagacgggucccauuucgaaaaggugggaggcuccucuuccggggaucugaugauccgcaacauucaacugaaacacagcggaaaguacgucugcauggugcagacaggcguugacucuguguccagcgcggcugaucuuaucguccgggggucucccggcccucccgagaaugugaagguugacgagaucaccgauacgacagcccagcucagcuggaaagaaggaaaggacaaccacuccccggugauuagcuacucuauccaggccagaaccccuuuuuccgucggcuggcaaaccgugacaaccguucccgaggugauugacgggaaaacacauacggcuaccgucguggaacugaaucccuggguggaguaugaguuccgcgucguugccagcaacaagaucggaggcggggaaccuucccugccgucugagaaagugcggacagaagaggcugugcccgaagucccucccagcgaggugaacggaggcgggggcuccagaucugaacucguuauuaccugggauccugugcccgaggagcugcagaauggagaaggcuuuggguacgucguggccuuccgcccucuuggaguuacaaccuggauccagacgguggucaccagccccgacacaccgcgguauguguuuagaaacgaguccauuguuccuuacucucccuaugaagugaaggucggcguguacaauaacaagggggagggaccuuucagccccgugaccacagucuuuuccgcggaagaggagccgaccguugccccuagccaggugucugcuaauucccuguccucuuccgaaaucgaggugagcuggaacacgauccccuggaaacucucuaauggccaucugcugggguaugaaguccgcuacuggaacggcggaggcaaggaggaguccagcuccaaaaugaagguggccgggaaugaaacaagcgcucggcuuagaggacucaaaucuaaccuggccuacuauaccgcgguucgggccuacaauagcgcuggcgccgggccuuucuccgcuacagugaacgucaccaccaagaaaacaccucccucucaacccccgggaaaugugguuuggaacgccacggauaccaaggugcugcucaauugggagcaggucaaggccauggaaaacgagagcgaagugacaggcuauaaagucuucuaccgcaccuccucucagaacaaugugcagguucugaacacaaauaagaccagcgcugagcuugugcugcccauuaaagaggacuauaucauugaagucaaggcgacgacagauggcggggacggaaccuccucugagcaaauccggauuccuagaaucaccagcauggaugccagaggcuccacaagcgcuaucucuaacgugcaccccauguccagcuacaugccuauuguucucuuucugaucguguauguccugugguga

SEQ ID NO: 67653 - RNA, 3081 nt, Artificial Sequence
  derived and/or modified sequence opt5 from CNTN4__Homo_sapiens__NP_001193884
augagacugcccugggagcuccuggugcuucagagcuucauccugugccucgccgacgauuccacccugcacggcccuauuuuuauccaagaaccgucucccgucauguucccucuugacagcgaggaaaagaaaguuaagcugaacugugaggugaaagggaaucccaagccucauauucgguggaaacucaacggaacagauguggacacgggcauggauuuucgcuacuccgucguggaagggucucugcugaucaauaaccccaauaagacccaggacgcuggaacauaucagugcaccgccacaaacagcuucggcaccauuguuuccagagaggcgaagcuccaguuugcuuaccuggauaauuucaaaacacggacccgcucuacggugagcgucagacgggggcaaggaauggugcuucuguguggcccuccgccccacuccggcgagcucagcuaugccuggaucuuuaacgaauacccuucuuaucaggacaaucgcagauucguuucccaggagaccgggaaccuguacaucgccaagguggaaaaaucugaugucggaaauuauacaugcguggugaccaacacagucaccaaucauaagguucuugggcccccuacgccccugauucuccggaacgacggcgugaugggagaguacgagccgaaaaucgaagugcaguuuccugagacaguccccaccgcuaagggcgccacagugaagcuggaauguuucgcucuggggaauccuguucccaccauuaucuggcgcagagccgauggaaaacccauugcgcggaaggcccgcagacacaaaucuaacggcauccucgagauuccuaacuuucaacaggaagacgcuggccuguacgagugcguggccgaaaauucccgggggaagaacgucgcucgcggacagcuuaccuucuaugcccagccgaauuggauccagaaaaucaacgauauucauguggcgauggaagagaauguguuuugggaauguaaggccaacggcagacccaaaccuacauacaaguggcugaagaauggggagccccuccugacgcgggacagaauccaaauugaacagggaacccuuaacaucacaauuguuaaucugagcgacgcuggcauguaucaaugccucgccgagaacaaacacggggucaucuucucuaaugcugagcuguccgugaucgccgucggaccugauuucagccgcacccugcucaagcgggugacacugguuaaagugggcggcgaagucgugauugaguguaagcccaaagccuccccgaagccuguuuacaccuggaagaaagggagagacauccuuaaggaaaacgagcgcauuacgaucucugaagauggaaaucugcggauuaucaacgugacaaaaagcgacgcuggcuccuauaccugcaucgcgaccaaucacuuugggacagccagcucuaccggaaaccucgucgugaaggaucccacaagagugaugguuccucccuccagcauggacgucacggugggcgagucuauugugcugccuugucaggucacccaugaucacagccuugacaucguguucacaugguccuuuaacgggcaucugauugauuucgaccgcgauggcgaccacuuugagcggguuggaggccaggacucugcuggggaucucaugaucagaaauauucagcugaaacacgccggaaaguacgugugcaugguccaaaccagcguggaccgccuguccgccgcugccgaucucaucguucgggggcccccgggcccucccgaagcggugacaauugacgagaucaccgauacgaccgcucagcugagcuggagacccggaccugacaaccauucuccgaucacaauguaugucauucaggcccgcacccccuucuccgugggcuggcaggccguuagcacagugccugaacuuaucgaugggaagaccuuuacggcuacagucgugggccugaaucccuggguggaguacgaguuccggaccgucgccgcuaacguuauuggaaucggcgaaccuucuagacccuccgagaaacggcgcacagaagaggcccucccugaagugacccccgcgaaugugagcgggggaggcggguccaagucugagcuggucauuaccugggagacagugccggaggagcugcaaaacggaagaggcuuuggguacguuguggccuuccggccuuauggcaaaaugaucuggaugcuuacgguccucgcuagcgccgacgcuuccagauacguguuucgcaaugaaucuguucaccccuucagcccuuuugaggugaaggucggaguguucaacaauaaaggcgaagggcccuucuccccgaccacaguuguguauagcgccgaggaggaaccuaccaagcccccugcgucuaucuuugcccggucccugagcgcuacagauauugaggucuucugggccucuccccuggaaaagaacagaggacgcauccagggcuacgaggugaaauauuggagacaugaagacaaggaggagaaugcucggaaaauucgcaccguggggaaccagacguccacaaagaucaccaaucucaaaggaagcguccuguaccaccuugccguuaaggccuauaacucugcuggcaccgggcccagcuccgcgacagugaaugugaccacaagaaaaccuccgcccagccagccucccggcaacauuaucuggaacucuuccgauagcaagaucauucugaauugggaccaagucaaggcccucgauaacgaauccgaggugaaaggauacaagguucuguaccgguggaaucgccagucuagcacguccgugaucgaaaccaacaaaacaucugucgagcugagccuuccuuuugacgaggacuauauuaucgaaauuaagcccuucuccgauggcggggacggaucuagcuccgagcagaucagaaucccuaaaauuagcaaugcuuacgcccggggcucuggggccuccaccagcaacgcuugcacacucucugccaucuccaccauuaugaucagccugacggcgcgcagcucccuguga

SEQ ID NO: 67654 - RNA, 3303 nt, Artificial Sequence
  derived and/or modified sequence opt5 from CNTN5__Homo_sapiens__NP_001230199
auggccagcuccuggaagcugaugcuguuccucucugugaccaugugccuuagcgaguacuccaaaucucugcccggccucagcacauccuaugcugcccugcuuagaaucaagaaaucuagcuccagcucucuguuuggguccaagacgcggccucgcuacagcucuccgucccucggaacccugagcgcgucuucccccagcuggcugggcgcugcccagaacuauuacuccccuauuaaucucuaucacucuagcgacgccuucaaacaagaugaauccgucgacuacgggcccguuuuugugcaggagccugaugacaucauuuuccccacagauagcgacgaaaagaagguggcucugaacugugaggucagaggaaauccugugccgucuuaucgguggcuucgcaacggcaccgaaaucgaucuggaguccgacuacagauacagccucauugaugggacauuuaucaucucuaaucccagcgaggccaaagacuccggacauuaucagugccuggcuaccaacacaguuggcucuauucuuagccgggaagccacccugcaguucgcguaccucggcaauuuuuccgggcgcacgagaagcgccgugucuguccgggagggacaaggcgugguucugauguguuccccucccccucacagccccgaaaucauuuauucuuggguguucaacgaguuuccguccuucgucgcugaggauagccgcagauuuaucucccaggaaaccgggaaucuguacauuucuaaggugcagacaagcgacgugggauccuauaucugccucgucaaaaacaccguuacaaaugcccgggugcugucuccucccaccccucuuacgcugcgcaacgauggcgugaugggggaguacgaacccaagauugagguccauuuccccuuuacagugaccgcugccaaaggaacaaccguuaagauggaauguuucgcgcucggcaauccugugccgaccaucacauggaugaaggucaacggcuauauccccagcaaagccagacugcggaagucccaggcugugcuugagauuccuaauguucaacuggacgacgccgggaucuacgagugccgcgcugaaaacagcagaggcaaaaacucuuuccggggccagcuccagguguacacguauccccacugggucgagaagcugaaugauacccagcuggacuccgggagcccucucagaugggaauguaaagccacaggaaagccccgcccgaccuaccgguggcugaaaaacggcgugccucuuucuccccaauccagagucgagauggugaaugggguucugaugauucauaacgugaaucagagcgaugccggaauguaucagugccucgcugaaaacaaguacggcgcgaucuaugccucugcugagcugaagauucuugccagcgccccuacauuugcucugaaucaacucaaaaagaccaucaucgucacgaaagaccaggaggugguuauugaauguaagccccagggcuccccuaaacccacaaucagcuggaagaagggggaucgcgccgugcgggagaacaaaagaauugcgauccugccggacggaucucugcgcauucucaaugcuuccaagagcgaugaaggcaaauacgucugcagaggggagaacguguucggauccgccgaaaucaucgccucucugagcgugaaggagccuacccggauugagcuuacccccaaacgcacagaacugaccguuggcgaguccaucguccucaauuguaaggcuauucacgacgccucucuggaugugacauuuuauuggacgcugaaggggcagcccaucgacuucgaagaggagggcggacacuuugaaagcauucgggcucaagccuccucugcggaucuuaugaucagaaacauucuccugaugcaugccggccgcuacgggugccgggugcagaccacagcugacagcgucuccgacgaggccgaacugcucgugagaggaccuccgggacccccugggaucguuaucguggaggaaauuaccgagagcacagcuacccugucuuggucccccgccgcggauaaucacagcccuaucucuuccuacaaccuucaggcccggagccccuucucucugggauggcagacggucaaaaccgugccugagauuaucacaggcgacauggaauccgcuauggccguugaucucaaucccuggguggaguaugaauuucgcgucguggcuaccaacccgauugggacaggcgacccuagcacccccuccagaaugauccggacgaacgaggccguuccuaagacagcccccaccaaugugagcggaagaucuggccgccggcaugaacuggucaucgcuugggagccggugagcgaggaguuccaaaacggggagggauuuggcuacauuguggcguucagaccuaaugggacacgcggauggaaagaaaagauggucaccuccucugaggccagcaaauuuaucuauagagaugaauccguucccccucugacccccuucgaggugaaggugggcgucuacaacaauaagggggacggccccuuuucucagauugugguuaucugcagcgcugagggagaaccuuccgccgccccgacagaugugaaagcuacgucugucagcguguccgagauucuuguugccuggaagcacaucaaagaaagccucggccggccccagggguucgaggugggauauuggaaggacauggagcaggaagauaccgcggagacagucaaaacccgcggcaacgaaucuuucgugauccugacagggcuggagggaaauacccucuaccacuuuacgguuagagcuuauaacggcgccggguacggcccucccuccagcgaagugucugccacaaccaagaaauccccucccagccaagcuccuuccaaucugcggugggagcagcagggaucucaggucagccuuggcugggagccggugauuccccuggccaacgaauccgagguggucggguacaagguuuucuaucgccaagaaggacauagcaauucucaggugaucgagacccagaagcuccaagcgguggucccucugcccgacgcuggcguguacauuaucgaaguuagagccuauuccgaagggggagauggcacagccagcucucagauucgggugccuagcuacuccggcgggaaaaucaccucugcucagagcacacugcacucccuuucuacgagcuccagcucugucacccuccugcuggcccucaugauccccuccacaagcugguga

SEQ ID NO: 67655 - RNA, 2871 nt, Artificial Sequence
  derived and/or modified sequence opt5 from CNTN6__Homo_sapiens__NP_001276010
augagcuaccacuauagacuggacggcgggucccucgccaucaacucuccccauaccgaucaggacauuggaauguaccaaugccuggcuacaaaucuucugggcacgauccucagccggaaggccaaacugcaguucgcguauauugaggauuuugaaaccaagacacgcuccaccgugucugucagagaggggcagggaguugugcuucuguguggcccuccgccccacuucggggaccucagcuacgcuuggacauuuaacgauaauccucuguaugugcaggaagacaaccggcgcuucgucucccaagagaccggaaaucuguacaucgccaaaguggaacccucugauguuggcaacuauacaugcuuuauuaccaauaaggaggcccagagaagcgugcagggcccucccacgccucucguccagcggaccgacggggugaugggagaguacgaaccgaaaaucgagguucgcuuccccgaaacaauccaagcugccaaggauuccagcgugaagcuggaguguuuugcucuuggcaacccuguccccgacauuucuuggagacggcuggauggguccccucuccccggaaaagugaaguacagcaaaucucaggccauccuggagauuccgaauuuccagcaggaagacgagggcuuuuaugaaugcaucgcguccaaccuucgcgggagaaaucuggccaagggacaacucauuuucuacgcuccucccgagugggaacagaaaauccagaacacccaucugagcauuuaugauaaucugcucugggaguguaaggccucuggcaagccuaaccccugguacacauggcugaaaaauggcgagcggcuuaaccccgaagaacgcauccaaaucgaaaacgggacccugauuaucacgaugcucaauguguccgacagcggagucuaucagugcgcugccgagaacaaguaccagauuaucuaugcgaaugccgaacugagaguucuugcuuccgccccugacuuuucuaaaagcccggugaagaaaaaguccuucgugcaggucggcggggauauugugaucggauguaaacccaacgcuuuuccucgggccgccaucagcuggaagcgcggcacagagacccugagacaaucuaagcggauuuuccuccuggaggacgggucccugaaaaucuacaauauuacaagaagcgaugcuggaucuuacacaugcaucgcgaccaaccaguucggcacagccaagaauacgggcagccucauuguuaaagaacgcaccgugaucacagugcccccuuccaagauggacgucaccguuggggagucuaucgugcugcccugucaggucagccacgauccguccauugaaguggucuuugugugguucuuuaacggagacguuaucgaucuuaaaaagggcguggcucauuucgagcggauugggggagaaagcgucggcgaccugaugaucagaaauauucagcuccaccacucugggaaguaucugugcacagugcaaaccacgcuugagucccugagcgccguugccgauaucauugugcgcggcccucccggaccucccgaggacguccagguggaagauaucucuuccacaaccagccagcucuccuggcgggcuggcccugacaacaauucucccauccagauuuuuaccauccaaacaagaaccccguucagcgugggguggcaggccguugcgacagucccugagauucugaacggaaaaacguacaaugcuaccguggugggccugucccccugggucgaauaugaguuucgcgugguugccgggaacucuaucggaauuggcgagcccagcgaaccuuccgagcuccugcggacaaaggccagcgugccggucguggcucccguuaauauccaugggggcggaggcucuagauccgaacuugugaucaccugggagagcauuccugaggagcugcagaacggggagggauucggcuacaucauuauguuucgccccgucgggucuacaaccugguccaaagaaaaggugagcucuguugagagcucccgguucguguauagaaacgaaagcaucauuccucucucucccuuugaggucaaagugggaguguacaauaacgaaggcgaggggucccugagcacggucaccaucguuuauuccggcgaggacgaaccucagcuggcuccccgcggaacaucucuucagagcuucuccgccucugagauggaagugagcuggaaugccaucgcguggaaccggaauaccggcagagugcucggguacgagguccuguacuggacagaugacuccaaggaaucuaugauuggaaagauccgggugagcggcaacguuaccacgaaaaauauuacagggcugaaggccaacaccaucuauuuugcuuccgugcgcgccuacaauacagcuggaaccggcccgagcucuccucccgucaacgugaccaccaaaaaguccccucccagccaaccgccugccaauauugcguggaaacucacgaacucuaagcugugucuuaauugggagcacguuaagaccauggagaacgaauccgaggugcugggguauaaaauccucuacagacagaaucggcaaagcaagacacauauccuggaaaccaacaacacaucugccgagcugcuuguccccuucgaggaagauuaucucauugagaucagaaccguguccgacggcggagauggcagcuccagcgaagagauucgcaucccuaaaaugucuagccuguccucucgggggauucaguuccuggaacccagcacgcacuuucucuccaucguuauugugaucuuccacugcuuugcuauccagccccugauuuga

SEQ ID NO: 67656 - RNA, 4155 nt, Artificial Sequence
  derived and/or modified sequence opt5 from CNTNAP1__Homo_sapiens__NP_003623
augaugcaccugagacucuucugcauccugcuugccgcugugagcggcgccgagggguggggauacuauggcugugacgaagaacuggucgggccccucuacgcgcggucccugggagcuucuagcuauuacucccuucugaccgccccucgcuuugccagacuccauggcauuucuggguggagcccgcggaucggagaucccaacccuuggcugcagauugaccugaugaagaaacaccgcaucagagcuguugccacacaaggcuccuucaauucuugggauugggugacgcgguauaugcuccuguacggcgaccgcguggauagcuggacccccuuuuaucagagagggcauaacuccacauucuuuggaaaugucaacgaaagcgcugugguucggcacgaccuucauuuccacuuuaccgcccgcuacauuagaaucgugccucuggcguggaauccccggggcaagaucgggcuccgccugggacuuuacggcugcccuuauaaagccgauauucuguacuucgacggggaugacgcuaucucuuauagauuuccgcggggagucucccgcagccucugggauguguucgccuuuucuuucaagacagaggaaaaagacggccugcugcuccacgcugagggcgcccagggggauuacguuacccuggagcuugaaggagcgcaucugcuccugcacaugucccuuggcagcucucccauucagccuagacccgggcauacaaccguguccgccggaggcguccugaacgaccaacacuggcacuaugugcggguggacagauuugggcgcgaugucaauuucacgcucgacggauacguucagcgguucauccugaacggcgauuuugagagacugaaucucgacaccgaaauguucauuggcgggcuggugggagcugcccgcaagaaccuugcuuaucggcauaauuuuagaggcuguaucgagaacgugauuuucaaucgcgucaacaucgccgaucuggccgugcggagacacagccgcaucacauuugaggggaagguugcuuuccggugccucgacccugugccccauccgauuaauuuuggaggcccucacaacuucguccaggugcccggguuuccuagacgcggccggcuggcgguuuccuucagauuucggaccugggaucuuacaggacugcuccuguucucucgccugggcgacgggcucggacauguggaacugacccuuagcgagggccaggucaacguguccaucgcccaaagcgggcggaaaaagcugcaguuugcugccggauacagacucaaugauggcuucuggcacgaagucaacuucguggcccaggagaaucacgcuguuauuucuaucgacgauguggaaggggccgaggucagaguguccuacccccugcugauucgcacgggcacaagcuauuucuucggaggcugucccaaaccugcgucucggugggacugccauagcaaccagaccgcuuuucacggguguauggagcuucucaagguugacggacaacuggugaaucugacacucgucgaaggcagacgccugggguucuacgccgaggugcuuuuugauaccugcggaaucaccgacagauguuccccgaacaugugcgaacaugauggccgguguuaucagucuugggacgauuucaucugcuacugcgagcugacaggguauaaaggcgaaacgugucacacaccccucuacaaggagagcugcgaggccuaucgccuguccggaaagaccagcggcaauuuuaccauugacccugaugggucuggaccccugaaaccuuucgugguuuacugugacaucagagaaaaccgggcuuggacagucgugcgccacgauagacuuuggaccacgcgggugacaggcuccagcauggagcgccccuuucucggggccauucaguacuggaaugcuucuugggaagaggucuccgcccuggcgaacgccagccaacauugcgaacaguggaucgaguucuccuguuauaauucuagacugcucaacaccgcuggaggcuacccguauagcuuuuggauugggcggaaugaggaacagcacuucuacuggggcggaucccagccuggcauccaacgcugcgccugugggcuggacagaucuugcguggaucccgcucuuuauuguaacugcgacgccgaucagccucaguggcggaccgacaagggacugcucacauuuguugaccaucugcccgugacccaggucgugaucggcgauacaaauagaagcacguccgaggcgcaauucuuccugcgcccucuucgguguuacggggacagaaacagcuggaacaccauuucuuuucacacaggagccgcucuccgcuuucccccgauccgggccaaucauucccuggauguuagcuuuuauuucagaaccucugcuccuuccggcguguuucuggaaaacaugggcgggcccuacugccaguggcgccggcccuacgucagaguggagcucaauacaagccgcgacguuguguucgccuuugaugucggaaacggcgacgagaaucugaccgugcacucugaugacuucgaauuuaacgaugacgaguggcaccuugugcgggccgaaauuaaugucaaacaggcuagacugcggguugaucaucgcccuugggugcucagaccgaugccccugcagacguauaucuggauggaguacgaccaaccucuguauguggggagcgcggaacuuaagcggcgccccuucgucggaugccucagagccaugcggcugaacggcgugacccugaaucucgaggggagagcuaacgccuccgagggaacaagcccuaauuguaccggccacugcgcccauccccgccugccuuguuuucacggcgggcggugcguugaaagauacucuuauuacacaugugauugcgaccuuaccgcuuucgacggacccuauuguaaccaugauauuggcggguucuuugagccgggaacguggaugcgcuacaaucugcaguccgcccuccggagcgcggcuagagaguucucccacaugcugucucgcccugugcccggcuacgagccuggguauauccccggauacgacacaccgggcuaugucccuggcuaccacgggcccggauaucggcugccugauuaccccagacccggccgcccugugccgggguauagaggacccguuuacaacgugaccggcgaagaggucagcuuuuccuucucuacaagcuccgccccugccgugcuucuguacguuucuagcuuugugcgggacuauauggcuguccucauuaaagaugacgggacccugcagcuccgcuaccagcugggaaccucccccuauguguaccaacuuacaacgagaccugugaccgauggccagccccauagcaucaauaucacacgggucuaucgcaaccuguucauucagguugacuacuuuccucucaccgagcaaaaguucucucugcugguggauucccagcuugacagcccgaaagcccuguaucucggcagagugauggaaacaggggucaucgaucccgagauucagcgguacaacaccccuggauuuucuggcugccuguccggggugagauucaauaacguugcgccccucaagacgcacuuucgcacaccucggcccaugaccgcugaacuggccgaggcccuuagagugcagggagaacugagcgagucuaauuguggcgcuaugccgcgccucgucuccgaggugccucccgaacuggaccccugguaccugccucccgacuucccuuauuaccaugaugagggguggguugccauccuucugggauuucucguggcuuuccugcuccugggccuugucggcaugcuggugcuguucuaucuccaaaaccaccgguacaaggggagcuaucacaccaaugaaccgaaagccgcgcaugaguaccaccccggauccaagccuccccugccuacaagcggccccgcccaggucccgaccccuacagcugcccccaaccaggcuccugccucugcccccgcuccugcgcccacgccggccccugcucccgggcccagagaccagaaucuuccucaaauucuggaggaaagccgguccgaguga

SEQ ID NO: 67657 - RNA, 3996 nt, Artificial Sequence
  derived and/or modified sequence opt5 from CNTNAP2__Homo_sapiens__NP_054860
augcaggccgcucccagagccggcugcggggcggcucugcuccuguggaucgugagcuccugucuuugccgggccuggaccgccccuucuacaagccaaaagugugacgagccgcuggucuccggacucccccacguugcuuucucuagcuccucuagcauuuccggcagcuacucuccuggguaugccaaaaucaacaagcgcggaggcgcugggggauggucccccagcgauucugaccauuaccaguggcuucagguggauuuuggcaauagaaaacagauuuccgccaucgcgacgcaaggccgguauuccucuuccgacugggugacccaguaccgcaugcuguauagcgauacagggagaaacuggaagccuuaccaccaggacggaaauauuugggccuuccccggcaacaucaauuccgauggggucgugcggcaugaacugcagcacccuaucauugcucgcuauguuagaaucgugccgcucgacuggaacggagagggccggauugggcugcgcaucgaagucuacggaugcucuuacugggccgaugugauuaauuuugacggccauguugugcugcccuauagauuccggaacaaaaagaugaagacccucaaagaugucaucgcucugaauuuuaagacaagcgaguccgaaggcgugauucuucacggggagggacaacagggcgacuacaucacccuggagcucaaaaaggccaaacuggugcuuagccugaaccucgggucuaaucagcugggaccuaucuauggccacacauccgucaugaccgggagccugcucgaugaccaucacuggcauucuguugugauugaacgccagggaagaagcaucaaccugacgcuugaccgguccaugcaacacuuccgcaccaauggcgaguuugauuaccuggaccucgauuaugaaauuacauucggcgggauccccuuuucuggaaagccuagcuccagcucuagaaagaacuucaaaggcuguauggaguccauuaauuacaacggggugaacaucaccgaccuggcgcggagaaagaaacuugagcccagcaaugucggaaaccugucuuuuuccugcguggaaccguauacaguuccuguguucuuuaaugccaccagcuaccucgagguccccggccgccugaaccaggaucuguucuccgugucuuuccaguuucggacguggaauccuaacgggcuccugguuuucagccacuuugcugacaaucuuggcaacguggaaaucgaucugacagaguccaaggucggagugcauauuaauaucacccaaacaaaaaugucucagauugacaucagcuccggcagcgggcucaacgauggacaguggcacgaagucagauuccuggccaaggagaauuuugcuauucuuaccaucgacggcgaugaggccucugccgugcgcaccaacagcccccugcagguuaaaacaggggaaaaguacuucuuuggaggcuuccucaaucaaaugaacaauagcucucauuccgugcugcagcccagcuuucagggguguaugcagcugauccaagucgacgaccagcucgugaaccuguaugagguugcucagcggaagccuggcucuuucgcgaacgugagcauugauaugugcgccaucauugacagaugugucccgaaucacugcgaacauggaggcaaauguucccagacgugggauagcuuuaaguguaccugcgacgagacaggguacucuggagcuaccugccacaacuccaucuaugaacccagcugcgaggccuacaaacaccuuggccaaacauccaauuauuacuggauugauccugacgggucuggaccccugggcccucucaagguguauuguaacaugaccgaggauaaaguguggacgaucguuagccaugaccugcagaugcagacacccgucgugggguacaauccggaaaaguacuccgugacccagcuggucuauucugccagcauggaucaaauuuccgcuaucaccgacucugccgaguacugcgaacaguaugugagcuacuucuguaagaugucccgccuucucaacacaccugauggcagccccuauaccugguggguuggaaaagcgaaugagaagcacuacuauuggggcgggucuggaccuggcauccagaaaugcgcuugugggauugaacggaacugcacagaccccaaguacuacuguaauugcgaugccgacuauaaacaauggagaaaggacgccggauuucuguccuacaaggaucaucugccugugagccaggucgugguuggcgacacggaucgccaggggucugaggcuaaacucuccgugggcccccugcggugucagggagacagaaacuauuggaaugccgcuagcuucccgaacccuucuuccuaccuucacuucagcaccuuucaaggcgagacauccgccgauaucagcuucuauuuuaagacccugacacccuggggagucuuccucgaaaauauggggaaagaggacuuuauuaagcuggaacugaaaucugcgaccgaggugagcuucuccuuugauguuggcaacgggcccguggagaucgucgugcgcucuccuacgccgcuuaaugacgaucaguggcaccgggugaccgccgaaagaaacgucaagcaggcuagccuccagguugaccggcugccccaacagauucgcaaggccccuacagagggacauaccagacuggaacucuacucccagcuguucgugggcggcgcugggggacagcaaggcuuucuugggugcauccggucucugagaaugaacggagugacacucgaucuggaggaacgcgccaaagucaccagcggcuucaucuccgggugcucuggacacuguacgagcuauggcacaaauugcgagaacggcgggaagugucuggagcgguaccauggauacuccugcgacuguagcaauaccgcguaugauggcacauuuugcaacaaagacgugggggccuucuuugaagagggaauguggcuuagauacaauuuccaggcucccgccaccaacgcucgcgacucuuccagcagaguugauaaugccccugaccagcaaaacucucaccccgaucucgcccaggaagagauucgguucuccuuuagcaccacaaaggcuccuuguauccugcuguauauuuccucuuucacgaccgacuuucucgcggugcuggucaaacccacaggcagccuucagauccgcuacaaucucgggggaaccagagaaccguauaacauugauguggaccaucggaauauggccaacggccagccucacuccguuaauaucacacgccacgagaagaccaucuuccugaaacuggaucauuaccccagcgugucuuaucaucugccuuccagcucugacacgcuuuuuaacagccccaagucccucuuccugggcaaggucauugagacagggaaaaucgaucaagaaauucacaaguacaauaccccgggauuuaccggcugccugucuagagugcaguucaaccagaucgcuccucucaaagccgcccugcggcagacaaacgcuagcgcccacguucauauucaaggggagcuuguggaauccaauuguggagcgucuccccugacccucagcccuauguccagcgcuacagaccccuggcaccuggaucaccuggacucugccuccgccgacuuucccuacaacccuggccaggggcaggcuauccgcaauggagucaacagaaauagcgccaucauuggcggcgugaucgcgguggucauuuucacgauccuuugcacccugguuuuucucauucgguauauguuccgccauaaggggacauaccacaccaacgaggcuaaaggagccgaauccgccgagucugcugaugccgcuaucaugaauaacgacccgaauuucacagagaccauugaugaaagcaagaaggaguggcugaucuga

SEQ ID NO: 67658 - RNA, 3867 nt, Artificial Sequence
  derived and/or modified sequence opt5 from CNTNAP3__Homo_sapiens__NP_387504
auggccagcguggcuugggccguccugaagguucuccugcuucugcccacccagacaugguccccugugggcgcggggaacccgcccgacugcgaugcuccucucgccucugcccugcccagaagcuccuucucuagcuccucugagcuuagcuccagccacggaccuggcuuuucucggcugaaucgcagagacggggcuggaggcuggacgccccucguguccaacaaauaccaauggcugcagaucgaucugggggaacggauggaggucaccgccguggcuacacagggaggcuauggcagcucugacuggguuaccuccuaccuccugauguucagcgaugggggacgcaauuggaagcaguauagacgggaagagucuauuuggggcuuuccugggaacacaaaugccgacuccgugguccauuaccgccuucaaccgcccuucgaagcgagauuucugcgguuccucccucuggccuggaacccccgcggaagaaucggcaugcggauugagguguaugggugugcuuacaaaagcgagguuguguauuuugauggacaguccgcccuucuguaccgccucgacaagaaaccucugaagcccaucagagaugucauuucucugaaguucaaagcuaugcagagcaauggcauccuccugcaccgggaaggccagcaugggaaccacaucacccuugagcugauuaagggaaaacucguguuuuuccuuaauuccggcaacgccaagcugccgagcacaaucgcgccugugacccugacgcucgggucucugcuggacgaucaacauuggcacuccguccucauugaacugcuugacacccagguuaauuuuacaguggauaaacacacccaucacuuccaggccaagggagacagcucuuaccuggaccucaacuuugagaucagcuucggcgggauucccacaccuggacgcuccagagcuuuccggagaaagucuuuucauggcugccuggagaaucuuuauuacaacggcguggaugucaccgaacuggccaaaaagcacaaaccccagauccucaugauggggaaugugagcuucuccuguccccaaccucagacgguuccggugacauuucugagcucucgcuccuaucuggcucuccccggaaacagcggcgaggacaaggucucugugaccuuccaguuucggacauggaacagagccgggcaucugcuuuucggagaacugcgccggggcuccgggagcuuuguucucuuccugaaagauggcaagcugaaacuuucccucuuucaaccuggacagucucccagaaaugugaccgccggcgcugggcugaacgacggacaguggcacagcgucuccuucucugcgaaguggagccacaugaauguggucguggaugacgauaccgccguucagccucugguggcuguccucauugacuccggcgauacauacuauuuugggggaugccuggacaacagcucuggcuccggguguaagagcccccuuggcggauuccaaggcugccugcgccucaucacgaucggggauaaagccguggacccgauucugguucagcagggagcccugggcucuuuucgggaccuucagaucgauuccugugggauuaccgacagaugccucccuagcuacugugagcauggaggcgaaugcucucaaagcugggauacauucuccugugacugccuggggaccggcuauacaggagagaccugccacagcucucuguacgagcaguccugugaagcucauaagcaccgcggcaaucccagcgggcucuacuauaucgaugccgacggauccggcccucuggggcccuuccuuguguacugcaacaugacggcggaugcugccuggacagucgugcagcacggaggcccugacgccgugacccugagaggggcucccucuggccauccgcggagcgccguuuccuuugcuuaugccgcgggagccggccagcuccgcucugcugucaaucuggccgagcggugugaacaaagacuggcucugcggugcgggaccgcccgcagaccugauagccgggacggaacaccccucuccuggugggugggcagaaccaacgagacacacacgucuuggggagggagccugcccgaugcgcagaaauguaccugcggccuggaaggcaauuguauugacucccaguacuauugcaacugugaugccgggcgcaaugaguggacaagcgacaccaucgugcucucucagaaggagcaucugccugucacacaaaucgugaugaccgacgcuggacggccgcacuccgaagccgcuuacacgcuuggcccccugcucugcagaggggaucagagcuucuggaacucugccuccuuuaauaccgagacaagcuaucugcacuucccugccuuucauggagaacugaccgcugacguuuguuucuuuuucaaaacaaccgugucuuccggcgucuuuauggagaaccuugggauuacggauuucauccgcauugaacucagagcgcccacagaggugaccuuuagcuucgacguuggaaauggcccuugcgaggugacaguccagucccccaccccuuuuaacgauaaccaauggcaccaugugcgggccgaacgcaauguuaagggcgcuagccuucagguggaccagcugccccagaagaugcaaccggccccugccgaugggcacgucagacuccagcugaacucucagcuuuucaucggaggcaccgcuacacggcagcgcggguuccugggaugcauuagaagccuccaacugaauggcguggcccuggaccuugaggaacgggcgacggugacccccggggucgagccuggaugugcuggccauugcuccacauacggccaccugugucgcaacgggggaagaugccgggagaaacgcagaggcguuaccugugauugcgccuuuucugccuacgacgggcccuucuguagcaaugaaaucuccgcuuauuuugccacaggaucuagcaugaccuaccacuuccaggagcauuauacgcucuccgaaaacucuagcucccuggugagcucucuccaccgggaugugacacugaccagagagaugaucacccuuuccuuucgcacaacccggacaccgagccugcuccuguacgucucuuccuucuaugaagaguaccugagcgugauucuugcgaauaacggcucccugcagaucagauauaagcucgaccgccaucagaauccugaugcuuuuacguucgacuuuaaaaacauggccgacgggcaacugcaccagguuaagauuaaucgggaggaagccguggucaugguggagguuaaccagucuaccaaaaagcaagugauccucagcuccggaacagaguucaaugcugucaagagccugauucuuggcaaagugcuggaagccgcuggcgccgaucccgacaccagacgcgcggccacaucuggguuuaccggaugccucuccgcuguucgguucggcagagccgcuccucugaaggccgcccugcgccccagcgggcccucucgggugacggucagaggacauguggcuccuauggcgcggugugccgcuggcgccgccagcggguccccggcucgcgaacuugcccccagacuggcgggaggcgcuggccggucugggccugccgaugagggagagccccucgugaacgccgaccgcagagauagcgcugucaucggcgggguuauugccguggugaucuucauccugcucugcauuaccgcgaucgcuauucggaucuaccagcagagaaaacugcgcaaggaaaaugaguccaaagucucuaagaaggaagaguguuga

SEQ ID NO: 67659 - RNA, 3927 nt, Artificial Sequence
  derived and/or modified sequence opt5 from CNTNAP4__Homo_sapiens__NP_207837
augggcagcgugaccggggccguccugaagacacuccugcuucuguccacgcagaacuggaauagaguugaggcuggaaacucuuacgacugcgaugacccccucgugagcgcccugccucaagcguccuucucuagcuccucugaacuuagcuccagccacggcccgggguuugcucggcugaaucgcagagauggagccggcggguggucuccccucguguccaacaaauaucaguggcugcagaucgaccugggagagcggauggaagucaccgccguggcuacacagggcggcuacgggagcucuaauuggguuaccuccuaucuccugauguucagcgauucuggauggaacuggaagcaauaccgccaggaggacuccauuuggggcuuuagcgggaaugccaacgcugauuccguggucuauuacagacuucagccuucuaucaaagcccgguuccugcgcuuuauuccccucgaauggaauccuaagggaagaaucggcaugcggauugagguguucgggugugcguaucgcagcgagguuguggaccuggauggaaaauccagccuucuguacagauuugaccagaagucucucucccccaucaaggauaucauuagccugaaauucaagacaaugcaaucugacggcauccugcuccaucgggaaggcccuaacggggaucacauuacccugcagcuucgcagagcccggcuguuucuccugaucaauagcggagaggcuaaacuuccguccacaucuacccuggucaaccucacgcugggcagccugcucgacgaccagcauuggcacuccgugcugauucagcgccuugggaagcaagugaauuucaccgucgaugaacauagacaccacuuucaugcccggggagaguucaaccugaugaaucucgacuacgagaucagcuuuggcgggauucccgcuccuggaaaaucuguuuccuucccccacagaaacuuccauggcugccuggaaaaccuuuauuacaauggcguggauaucaucgaccuggccaagcagcagaagccucaaauuaucgcgauggggaacgugagcuuuucuuguucccagccccagagcaugccggucacauuccucuccucucgcagcuaucuggcccugccugauuuuuccggagaggaagaggugucugcuaccuuccaguuucggacauggaauaaagccggccuccugcuuuucagcgaacugcaacucauuuccgggggaauccugcuguuucuuagcgacggcaagcucaaaucuaaccuguaccagcccgggaagcugccuuccgauauuaccgcuggcguugagcucaaugacggacaguggcacagcgugucucuguccgccaaaaagaaccaccuuagcgucgccguggauggccagauggcuucugcggccccucugcucgggcccgagcaaaucuauagcggaggcacguacuauuucgggggaugccccgacaaauccuuuggcagcaaguguaagucuccgcuugggggcuuccagggaugcaugagacugaucuccauuagcggcaaaguuguggaucuuaucuccguccagcaggggucucucggaaauuuuagcgaccugcaaauugacuccuguggcaucucugaucgcugccugcccaacuacugugaacaugggggagagugcagccaguccuggucuacauuccacuguaauugcaccaacacaggcuacagaggggcuaccugccauaauagcauuuaugaacaguccugugaggccuacaagcaccggggcaacaccagcggauuuuauuacaucgacucugauggcuccgggccucucgaacccuuccugcuuuauugcaauaugacagagacggccuggaccaucauucagcauaacggaagcgaccugacacgcgugcggaauaccaacccugagaaccccuacgcuggcuucuuugaauaugucgccucuauggagcaacuccaggcgacaaucaauagagcugaacacugugagcaggaguucaccuacuacugcaaaaagucccgccuggugaacaaacaagaugggacgccgcugagcugguggguuggacggacaaaugaaacccagaccuauuggggcgggucuuccccugaccuucagaaguguacaugcggccucgagggaaacuguauugauagccaguacuauugcaauugugacgccgauagaaacgaauggaccaaugacacaggccugcuggccuacaaggagcaccuccccgugacgaaaaucgucauuaccgauacagggcgccugcauuccgaagcugccuauaagcugggaccucugcucugccaaggcgaccggagcuuuuggaacucugcuagcuucgauaccgaggccuccuaccugcacuuucccacauuccauggggagcugucugcggacgugagcuuuuucuuuaaaaccacggccuccucuggaguuuuccuugaaaaucucggcaucgcugacuuuauuagaaucgagcugcggagcccuaccguggucacauucuccuuugaugugggcaacgggcccuucgaaaucucugugcagagcccgacccacuucaaugacaaccaguggcaccauguucgcgucgagagaaauaugaaggaagccucccuucagguggaucaacucacaccuaaaacccagcccgcucccgccgacggacacgugcugcuucagcugaacagccagcucuuugucggcgggacggcgacacggcaaagaggauuccugggcuguauucgcucucugcagcuuaaugggaugacccuggaucucgaggagcgggcccaggugacaccugaaguucaaccgggaugcagaggccauugcuccagcuauggcaagcugugucgcaacgggggaaagugcagagagcggcccaucggcuuuuucugugacugcaccuuuucugcuuacaccgggccuuucuguuccaacgaaauuagcgccuacuuuggauccggcucuagcgugaucuauaauuuccaggagaacuaccuccuguccaaaaauucuagcucccacgcugccagcuuucauggggauaugaagcugucucgcgaaaugauuaaauucagcuuuagaacaacgcggacccccucccugcuccuguucgucucuagcuucuauaaggaguaccuguccgugaucaucgccaaaaacggaucucuucagauucgcuauaagcugaauaaguaccaggagccugacguugugaacuuugauuucaaaaauauggcugacggccaacuccaccacaucaugauuaacagagaagagggcgucguguuuaucgaaauugaugacaaucggcgcagacagguucaucugagcuccgggacagaguucagcgcggugaagucucucguccugggacggauccuugaacacuccgauguggaccaggacaccgcccuggcuggcgcccagggguuuacaggaugccucagcgccgugcaacugucccaugucgcuccccugaaagccgcgcuucacccuucucaucccgauccgguuaccgugacgggccacgugacagagagcuccuguauggcucagccugggaccgacgccaccucucgcgagagaacacacagcuucgccgaucauuccggaaccaucgacgaucgggaaccccuggcuaacgccauuaagagcgacucugcggucaucggcggccucauugcugugguuaucuuuauucugcucugcaucacagccaucgccgugagaauuuaucagcagaaacgccuguacaagcgguccgaggcuaaaagaagcgaaaaugucgauucugccgaggcugugcuuaaguccgagcugaacauccaaaaugccguuaacgaaaaucagaaggaguacuucuuuuga

SEQ ID NO: 67660 - RNA, 3921 nt, Artificial Sequence
  derived and/or modified sequence opt5 from CNTNAP5__Homo_sapiens__NP_570129
auggacagccugcccagacucaccuccgugcugacacuucuguucucuggccucuggcaccuggggcuuacggccaccaacuacaauugcgaugacccucuggcuagccuccuguccccgauggccuuuucuagcuccucugaucugacaggaacccauagccccgcgcagcucaacuggcgggucggcacagggggaugguccccugcugacagcaaugcccaacaguggcugcagauggaucuuggcaaccgcguugagaucaccgccguggcuacacaggggagauauggaucuuccgacugggugaccagcuacucucugauguucuccgauacgggccggaauuggaagcaauauaaacaggaagacagcauuuggaccuuugccggcaacaugaaugcugauucugucgugcaccauaagcuccugcacuccguucgcgccagauucgugcgguuugucccccuugaguggaacccuagcgggaaaaucggaaugcgcguggaaguuuacggcuguuccuauaagucugacguggcggauuucgacgggagaagcucccugcucuaccgguuuaaucagaaacugaugagcacacugaaggaugucauuucucucaaguucaaauccaugcagggagacggcgugcuguuucauggggagggacaacgcggcgaccacaucacccuugaacugcagaagggcagacucgcccugcaccuuaaccugggggauagcaaagcucggcucucuagcucccugcccucugccacacugggaagccuccuggacgaucagcauuggcacuccgugcuuauugagcgcgucggcaagcagguuaauuucaccguggacaaacauacgcaacacuuuagaacaaagggggagaccgaugcucuggacaucgauuaugaacucagcuucggaggcaucccugugccggggaagcccggaacauuucugaaaaagaacuuccacggcugcauugagaaucuuuacuacaacggcgucaauaucauugaccuggccaaacggcgcaagcaucagaucuauaccgggaacgugaccuucucuuguuccgaaccucagauuguucccaucacauuugugaacagcucuggauccuaccuccugcugccuggcacgccccaaauugaugggcucagcgucuccuuccaguuuagaaccuggaauaaagacggacugcuucugucuacagagcucagcgagggcuccgggacccugcugcuuucucucgaaggcggaauccugcggcuggugauccagaagaugacagagagaguugcggaaauucucaccggcagcaaccugaaugaugggcuuuggcacuccgugagcaucaacgcccgccggaauagaauuacgcugacacucgacgacgaggcugccccgccugcucccgauucuaccuggguccagaucuauuccggaaacagcuacuauuucggcgggugcccugacaaucugaccgauucucaaugucugaaccccauuaaagccuuucagggaugcaugcgccuuaucuucaucgacaaucagcccaaggaucucauuuccgugcagcaaggcagccuggggaacuuuucugaccugcauaucgaucucuguagcauuaaggaccggugccugccuaauuacugugaacacggcggauccugcagccagucuuggacaaccuucuauuguaacugcuccgauacaagcuacacgggcgccacgugccauaauuccaucuacgagcagucuugugaggucuauagacaccaggggaacacagcuggauuuuucuacauugacagcgauggcuccgggccgcuuggaccccugcaaguguauugcaauaucaccgaagacaaaaucuggacaucuguucagcacaacaacaccgagcucacgcgcgugcggggcgcgaauccugaaaagcccuacgccauggcucuggauuaugggggcagcauggagcagcuggaagccgucauugacggauccgagcauugugagcaggaaguggccuaccacugcagacgcucucggcuucucaacaccccugacggcacacccuuuaccugguggaucgggagaagcaaugagcgccauccguauuggggaggcuccccucccgggguucaacagugugaaugcggacuggaugagagcugucuggacauucagcacuucugcaacugugaugcugacaaagaugaauggacaaaugacaccggcuuucucucuuucaaggaucaucugccugugacgcaaaucgucauuacagacaccgaucgguccaacagcgaggccgcguggagaaucgggccccuucggugcuacggcgaccgcagauucuggaaugcugugucuuuuuacacagaggccuccuaucugcacuucccuaccuuucacgccgaauuuagcgcugauauuucuuucuucuuuaaaaccacagcccucuccggaguguuccuggagaaccugggcaucaaggacuuuauccggcuugaaauuagcucccccagcgagaucacguucgcuauugauguugggaauggaccggucgagcucguggugcagucuccuagccugcugaacgacaaucaguggcauuacgucagagccgaacgcaaccucaaggagaccucccuucagguggacaaucugccccggucuacaagagaaaccagcgaggaaggccacuuucgccugcaacucaacucccagcuguucguugggggaacaucuagcagacagaaaggcuuucugggcuguauccggucccuucaucugaaugggcagaagauggaucucgaggagcgcgcgaaagugaccucuggagucagacccggcugcccugggcacugcagcuccuauggaagcauuugucacaacggcgggaagugcguggaaaaacauaacggauaccugugugacugcaccaauucuccguaugagggccccuucuguaagaaggaaguuuccgccguguucgaggcuggcacaagcgucaccuacauguuucaagaaccuuaucccgugaccaaaaacaucucucucuccagcuccgccaucuacacagauucugcuccuagcaaggagaauauugcccuguccuucguuaccacacaggcgcccagccuucugcucuuuaucaacucuuccagccaggacuucguggucgugcugcugugcaaaaaugggucucuucaggugcgguaccaccugaacaaggaggaaacgcaugucuuuaccauugaugccgacaauuucgcuaaccgcagaaugcaccaucucaaaaucaaucgggagggacgcgaacugacaauucaaauggaucagcagcucagacugagcuauaacuuuuccccugagguugaguuccgggugauccgcucucuuacccugggcaaggugacagaaaaucucgggcuggacagcgaggucgccaaggcuaacgccaugggauuugccggcuguauguccucugugcaauacaaucacaucgcuccccugaaagcggcccuuagacacgcuaccguugccccggugacgguccaugggacccugacagaaagcuccugcggauucaugguggauagcgacguuaacgccgugaccacaguccacucuuccagcgauccuuuuggcaagaccgacgagcgggaaccccucacaaaugcugugagauccgacucugccguuauuggcggggugaucgcggucgugauuuucaucauuuucuguaucaucggaauuaugacccgcuuucuguaucagcauaaacagagccaccggacgucccagaugaaggagaaagaguacccugaaaaccucgauucuagcuucagaaacgagaucgaccugcaaaauacaguguccgaaugcaagcgcgaguauuuuauuuga

SEQ ID NO: 67661 - RNA, 6978 nt, Artificial Sequence
  derived and/or modified sequence opt5 from CNTRL__Homo_sapiens__XP_005251736
augaagaagggcagccagcaaaagaucuucuccaaagccaagauucccucuagcucccacucuccuaucccgagcuccaugucuaacaugagaagccggucccugagcccccugauugggucugagacccugccuuuucauuccggcggccaguggugcgaacagguggagaucgcugacgaaaauaacaugcuucuggauuaccaggaccacaaaggggccgauagccaugcgggaguccgcuauauuacagaggcucucaucaagaagcugacgaaacaagacaaucuugcccugaucaagucucucaaccugucccugagcaaagauggcgggaagaaauucaaguacauugaaaaucucgagaaguguguuaaacuggaggugcuuaaccugucuuauaaucucaucggaaagauugaaaaacuggacaaacuucugaaacucagagagcugaaccuguccuacaauaagaucagcaaaauugaaggcaucgagaacaugugcaaucuccagaagcugaaccuugccggcaaugagauugaacacauccccguguggcuggggaagaaacucaagucccugcggguccuuaaccugaaaggaaauaagaucucuagccuccaggauauuuccaaacugaagccucugcaggaccucaucagccugauucuuguggagaaccccguugugacccugccucauuaucuccaauuuacaaucuuccaccugagaucucuugaaucccuggagggccagccggucaccacacaggauagacaggaggcuuuugagcgguucagccucgaggaaguggagcgccuggaaagagaccuggagaagaaaaugauugaaaccgaggagcucaagucuaaacaaacacgguuucuggaagagaucaagaaccaggauaaacuuaauaagagccugaaggaagaggccaugcuccagaaacaauccugugaagaacugaagucugaccugaacaccaaaaaugagcuucucaagcagaaaacgaucgaacugacccgcgcuugccagaagcaguacgagcuggaacaagagcucgccuucuauaagauugaugcgaaauuugagccccugaacuacuacccuagcgaauaugccgagaucgacaaggcucccgacgaauccccuuacauugggaaaagcagauauaagcggaauauguucgccacagagucuuacaucauugauuccgcucaggccguucagaucaaaaagauggaacccgacgagcagcuucgcaacgaucacaugaaucugagaggacauaccccgcucgacacacaacuggaggauaaagaaaagaagaucagcgcggcccagacccggcugucugagcuucacgacgaaauugagaaagcugaacagcagauccuccgcgccacggaggaguuuaagcaacuggaagaggcuauucagcugaaaaagaucuccgaagccggcaaagaucuccuguauaagcagcuuagcgggagacugcagcucgugaacaagcugcggcaagaggcccuggaccuugaacuccagauggagaaacagaagcaagagauugcuggaaaacagaaggaaaucaaagaucugcagauugcgaucgacucccuggauucuaaggacccuaagcauagccacaugaaagcccagaaguccggcaaagagcaacagcucgacaucaugaauaagcaguaccagcaacuggaaucuagacuugaugagauucugagccgcaucgcuaaagagacagaagagauuaaggaccucgaagaacagcugaccgaaggccagaucgccgccaacgaggcucugaagaaagaucuugagggggucauuuccggacuccaggaauaucugggcacaaucaaggggcaagccacccaggcgcagaaugagugucggaaacugagagacgaaaaggagacccuccugcaacgccuuacagaaguggagcaggagcgggaucagcuggaaaucguggcuauggacgccgagaacaugagaaaagaacucgccgagcuggaaagcgcucugcaggagcaacacgaggucaaugccucucuucagcagacgcagggagaucuguccgcuuacgaagccgagcucgaagcgcgccugaaccuccgggacgccgaggcuaaucaacugaaggaggaacuugagaaaguuaccagacugacacagcucgaacagagcgcccugcaggcugagcuggaaaaggagcgccaagcccuuaagaacgcgcugggcaaagcccaguucucugaggaaaaggagcaggaaaacuccgagcuccaugcuaaacugaagcaccuccaggaugacaauaaccugcuuaaacaacagcugaaggauuuucagaaucaucucaaccacgugguggacgggcugguccggcccgaagagguggccgcuagaguugaugagcugcgccggaaacuuaaacugggaaccggcgaaaugaauauucauagcccuucugacgugcucggcaagagccuggccgaccuccaaaaacaguucuccgagauccuggccagaagcaagugggaacgggaugaggcucagguccgcgaaagaaaacuucaggaggagauggcgcugcaacaggaaaagcuggccacagggcaggaggaguuccggcaggcuugcgagagagcccucgaggcccgcaugaacuuugacaagcggcaacacgaagcucgcauucagcagauggagaaugaaauccacuaccugcaggagaaccuuaaaucuauggaagagauucaaggacugaccgaucuccagcugcaggaggccgacgaagagaaggaacgcauccucgcgcaacugagagagcuugagaagaagaaaaagcuggaggaugcuaagucccaggaacagguguucggccuggacaaagagcucaagaaacugaagaaagccguugccacgagcgauaaacuugcuacagccgagcugaccaucgcgaaggaccagcucaaaucccugcaugggaccgugaugaagauuaaucaagaacgggcugaggaacuccaggaggccgagcgcuuuucuagaaaagccgcucaggccgcucgggaucugacacgcgccgaagcggagaucgaacuucugcagaaccugcucagacaaaagggagagcaguuccggcuggagauggagaagaccggcgucgggacaggcgccaauagccaggugcuugagauugaaaagcugaacgagacgauggaacgccagagaaccgagaucgcucggcuccaaaauguccuggaccucacaggauccgauaacaaaggcggguuugagaaugugcuggaagagauugccgaacuucgcagagagguuucuuaucagaacgacuacaucagcuccauggcugaucccuucaagcggagaggauauugguacuuuaugcccccuccgcccucuagcaagguguccagccacucuucccaggccaccaaagacagcggcgucgggcugaaguauucugccuccacaccugugcgcaaaccccggccuggacagcaagacggcaaggaagggagccagcccccgccugcuucuggcuacuggguuuauucccccaucagaagcggacugcauaaacucuucccuucccgcgaugcggacagcggcggggauucucaggaggagagcgaacuggacgaucaagaggaacccccuuuugugcccccgccuggauacaugauguacaccguccuucccgacggcucccccgugccucaggggauggcccuguaugcuccgcccccuccccucccuaacaauucucggccccugacgccuggaaccgugguuuacggacccccgccugccggggcccccauggucuauggcccucccccgccuaacuucagcauucccuuuaucccuaugggagugcugcacuguaaugugcccgagcaccauaaccucgaaaaugaggucuccagacuugaggauauuaugcagcaccugaagucuaagaaacgcgaagaacgguggaugagagcuagcaagcgccaguccgaaaaagagauggaggaacugcaucacaacaucgacgaucuccugcaagagaagaaaucucuugaaugcgagguggaagaacugcaucggacaguucagaagagacagcagcaaaaggacuucauugauggcaauguggagagccucaugaccgaacuggagaucgaaaaaucccugaagcaccacgaggacauugucgacgaaaucgaguguaucgagaaaacacuccuuaagcggcgcagcgaacugagagaggccgaucggcugcucgcggaagcugagucugaacuguccugcaccaaagagaagacgaagaacgccguggagaaauuuacagacgccaagcgcagccuucugcagaccgaaucugaugcugaggaacucgagagacgggcccaggagacagcgguuaaucuggugaaagcugaccagcaacugagaucccuccaggccgaugccaaggaccuugaacagcauaaaauuaagcaagaggaaauccugaaagagauuaacaagaucgucgcugccaaggauagcgacuuccagugucuguccaaaaagaaagaaaagcucaccgaggagcugcagaaacuucagaaggauauugaaauggcugagcgcaaugaagaccaccaucugcaagugcucaaggagucugaaguucugcugcaggccaaacgggcggagcucgagaaacuuaaaagccaggugaccucccagcaacaggaaauggccguccuggauagacagcuggggcacaagaaagaggaacuccaucugcuucagggaagcauggugcaagcuaaggccgaccugcaggaggcucuccgccugggcgaaacagaggugacggagaagugcaaccacauccgggaagucaaaucucugcucgaggaacuuuccuuccagaagggggagcugaauguucaaaucagcgagagaaaaacccagcugacacucauuaagcaggaaaucgagaaagaagaggaaaaccuccagguggugcuucgccaaaugucuaagcacaagaccgagcugaaaaauauucucgauaugcugcagcuggagaaccaugaacuccagggacuuaagcugcagcacgaccaacgggucagcgagcuggagaagacacagguggccguucucgaggaaaagcuggagcuugagaaccugcagcagaucucccaacagcagaaaggcgaaauugaguggcagaagcaacuccuggaaagagacaaacgcgagaucgaaagaaugaccgccgagucucgggcucugcagagcugcguggagugucucuccaaggaaaaggaggaucuucaggaaaaaugcgacaucugggagaagaaacuggcgcaaacgaagcgcguccuggccgcugccgaggaaaauucuaaaauggagcagagcaaccucgaaaagcuggagcuuaaugugagaaagcugcagcaggaacucgaucaacugaaccgggacaaacugucccuccauaaugauauuagcgccaugcagcagcagcuucaagagaagcgcgaggcuguuaacucucugcaggaagaacuggccaaugugcaggaccaccucaaccuggcgaaacaggaucuucugcacacaaccaagcaucaagacguccuccuguccgaacagaccagacugcagaaagauaucagcgagugggcuaaucgguuugaagacugucaaaaggaggaggaaacaaagcagcagcagcuccaagugcuucagaacgagauugaagagaauaaacugaagcugguucagcaggaaaugauguuccaaagacuccagaaagagcgcgaguccgaagagucuaagcuggaaaccagcaaagugacacuuaaggagcagcagcaccaacuggagaaggaacucacggaucagaaauccaagcuggaccagguccugucuaaagugcucgccgccgaggaacgggugagaacccugcaggaggaagagagauggugcgagagccuugaaaagacacugucccaaaccaaacggcagcucagcgagagagaacagcaacuggucgagaagucuggggaacuucuggcucuccagaaggaggccgauuccaugcgggcggacuuuagccugcugcgcaaccaguuccucacagagcgcaagaaggccgaaaaacagguugcuucucugaaggaggcccuuaaaauccaacggucccagcuggaaaagaaucuccuggagcagaaacaggaaaacagcuguauucaaaaggagauggcuaccaucgagcuuguggcccaggacaaucaugaacgcgcuagacggcugaugaaggagcucaaccagaugcaguacgaauauacggagcugaaaaagcaaauggccaaucagaaagaucuggagcgcagacagauggaaauuucugacgcgaugcggacccucaagagcgaggugaaagaugaaauccgcacaucccugaagaaccuuaaccaauuucugcccgagcucccugccgaccuggaagcuauccuugagagaaaugagaaccuggaaggcgagcucgaaucucugaaggagaaucugccguucaccaugaacgaaggacccuuugaggagaaacucaauuucagccagguccacauuauggaugaacauuggcggggcgaggcccugagagaaaaacuucgccaccgggaggacagacugaaagcucagcuccgccacugcauguccaagcaggccgaagugcugaucaaagggaagcggcaaacagagggaacccuucauagccugagacgccagguugaugcccucggcgagcuggugacauccaccucugcugacagcgcguccucuccuagccugucccagcucgaaucuagccugacggaggauucccagcuugggcaaaaccaggaaaagaaugccagcgcucgguga

SEQ ID NO: 67662 - RNA, 2778 nt, Artificial Sequence
  derived and/or modified sequence opt5 from CNTROB__Homo_sapiens__NP_001032221
auggccaccagcgcugacucccccucuagcccucugggcgccgaggaucuccuguccgacucuagcgaaccgcccgggcuuaaccagguguccucugaggucacaagccaacuguacgcgucccucagacugagccggcaggcugaagccacggcccgcgcucagcuuuaucugccuucuaccuccccuccccacgagggacucgauggcuucgcccaggaacugagcagaucucuguccguugggcucgagaagaaucugaaaaagaaagacggaagcaagcauaucuuugagauggaaucugugcggggccaacuucagacaaugcugcagaccucccgcgauacagcuuacagagacccccucauuccuggggccggaagcgagcggcgcgaagaggauuccuucgacucugauagcaccgcgacacugcuuaacaccagaccgcugcaggaccucucccccagcucuagcgcccaagcucuggaggaacuguuuccucgguauacgagccuccgccccggcccuccccugaauccgccugauuuccagggccuuagagacgcccuggauucugagcacacccggcgcaaacauugcgaaagacacauccagagccuccagacacgggugcuggagcuucaacagcagcuggcugucgccguggcggccgaccgcaagaaggacaccaugauugaacaacucgauaaaacacuggcuagaguuguggagggguggaaccggcaugaggccgaaagaaccgagguccugcgcggacuccaggaagaacaccaggcugccgaacugacgcgguccaagcagcaagagacagugaccagacuugagcagucucugagcgaagccauggaggcucucaaucgcgaacaggaguccgcgcggcugcagcaaagagaacgcgagacacuugaggaggagcggcaggcccugacccucagacuggaagcugagcagcagcgcuguugcguucugcaagaggaacgggacgccgccagagcuggccagcucagcgagcaccgcgaacuggagacccuucgggccgcgcuggaagaggagagacagacaugggcucagcaagaacaucagcucaaagagcacuaccaggcccugcaagaagagucucaggcccagcuggaacgggagaaggagaaaucccagcgcgaagcucaagccgcuugggagacgcagcaucagcuugcccucgugcagagcgaagucagacggcuggagggggaacuggauaccgcgagacgcgagcgggacgcccuccaacuggagaugucucuugugcaggcuagauaugaaucccagcgcauccagcuggagagcgaacucgccgugcaacuggagcagagagucacagagcggcuggcucaggcccaagaauccucucuucgccaggcggccagccucagagagcaccaccggaagcagcugcaggaucuguccggacaacaucagcaggaacucgcuucucagcuggcccaauuuaagguugagauggcugaacgcgaggagagacagcaacagguggccgaagacuacgagcuucggcuggcccgcgaacaggcuagagugugugagcuccagagcggcaaccagcagcuggaggaacaacgggucgagcugguggaacgccuucaggcgaugcuccaggcccacugggaugaggcuaaucaacugcuguccaccacacugcccccucccaaucccccugccccgcccgccgggccuagcucucccggaccucaggaacccgagaaagaagagagacggguuuggaccaugccgccuauggcuguggcccucaagcccguccuucagcaguccagagaggcgcgcgacgaacugccuggcgcucccccugugcucugcuccucuuccagcgaucugucucugcuucucggccccagcuuccaaucccagcauagcuuucagccgcuggagccuaaacccgaccugacgucuuccacagccggggccuucagcgcucucggagccuuucaccccgaucaucgggcggaaagaccuuucccggaggaggaccccggcccugacggggaaggacugcuuaagcagggccugcccccugcucaacucgaggggcugaaaaacuuucugcaccagcuucuggaaaccguuccccagaacaaugagaacccuuccguggaucuccugcccccgaagucuggaccucucaccguccccagcugggaagaggccccucaggugccccgcauuccgccucccguccacaaaacaaaggugccucuggccauggcuuccucucuuuuccggguucccgagcccccuagcucccauucucaaggcagcggcccguccagcgggucucccgaaagaggaggcgacgggcugaccuuuccucgccagcucauggaggugucccagcugcugcggcuuuaucaagccagaggauggggcgcucugcccgccgaagaucuccugcucuaccugaagcgccuugagcacagcggguacaaaccuggccggaaggaagagggauucucuggcuggaaacuggacuauggggagugguccggaacagauggcagaggggacaaugucccccggcgcaacacggauagcagacucggagaaaucccucggaaggagaucccgucucaggcggugccccgcagacuggccaccgcuccuaaaacagaaaagcccccugcccggaagaaauccggccaucccgcuccgagcuccaugagaagccgcgggggcguuuggcgguga

SEQ ID NO: 67663 - RNA, 441 nt, Artificial Sequence
  derived and/or modified sequence opt5 from COA1__Homo_sapiens__NP_060694
augauguggcagaaguacgccggcagcagacgguccaugccccugggggcucgcauccucuuccacggaguguuuuaugccggcggguucgcgauugucuacuaucugauccaaaaauuucauucuagagcucuuuacuauaagcuggccguugagcagcuccagagccacccugaagcccaggaggcucugggaccgccccuuaacauucauuaccugaaacucaucgaccgggaaaauuucguggauauuguggacgccaagcugaaaaucccugucuccggcucuaagagcgaggggcugcucuaugugcacuccucucgcggaggccccuuucaaagauggcaucuggaugaaguuuuccuugagcugaaggacggccagcagaucccuguguuuaaacucagcggggagaacggagaugaagucaagaaagaguga

SEQ ID NO: 67664 - RNA, 225 nt, Artificial Sequence
  derived and/or modified sequence opt5 from COA5__Homo_sapiens__NP_001008216
augcccaaguacuaugaggacaaaccucagggcggggccugcgcuggacugaaggaagaucucggcgccugucugcuucaaagcgacugcgugguccaggaggggaaauccccgagacagugucugaaggaaggauacugcaacucucucaaauaugcguucuuugaguguaagcggagcguucuggauaaucgcgcuagauuccggggccgcaagggguacuga

SEQ ID NO: 67665 - RNA, 1782 nt, Artificial Sequence
  derived and/or modified sequence opt5 from COASY__Homo_sapiens__NP_001035997
augagaacaccccggcugcgcgcccagccuagaggcgcuguguaccaagccccgagcccuccucccgcgcccgucgggcucggauccauggcuguuuuccggucuggccugcuugugcugaccacgccccucgccagccuggccccucgccuugcuuccauccugaccucugccgcuagacucgugaaccacacacuguauguccaucugcagccggggaugagccucgagggacccgcccagccucaguccucucccgugcaagcgaccuuugaaguucuggacuucauuacacaccuuuacgccggcgcugaugugcaucggcaccuggacguccgcauccuccugaccaauauuagaacaaagagcaccuuucuuccuccccugccgacguccgugcagaaccucgcccauccucccgagguugugcugaccgauuuccagacacuggacgggagccaguauaauccugucaaacaacagcucgugcgguacgcuaccucuugcuauuccuguugcccccgccuggccagcgugcuucuguacucugauuauggaaucggcgaaguccccguugagccucucgacgugccgcugcccuccacaauuagaccugcgagccccguggccggcucuccuaagcagcccguccggggguacuaccgcggagcugugggcgggaccuuugauagacuucacaacgcccacaaaguucugcucuccguggcuuguauccuggcccaggaacaacuggucgugggaguugccgacaaggaucuccugaaaagcaaacuucugccggagcuccugcagccuuauacggagcggguggaacaucuuuccgaguuccuggucgacaucaagcccucucucacauuugaugugauuccucugcuggaccccuacggcccugcugggagcgaucccucccucgaguuccuggucgugagcgaagagaccuaucgcggaggcauggcgaucaauagauuucggcuugaaaacgaccuggaggaacucgcccuguaccagauucaacugcuuaaggaccucagacacacagagaaugaagaggauaagguuucuuccagcucuuuccgccagcggaugcugggcaaccugcucagaccgccuuaugagcgccccgaacugccuaccugccuuuacgugaucgggcugaccggaauuagcggcuccgggaaaucuagcaucgcucagcggcucaagggacugggcgccuuugucauugacuccgaucaucuggggcacagagccuaugcucccggaggcccggccuaccagcccgugguugaggcguucggcacagacauccuucacaaagaugggaucauuaaucgcaaggugcucggaagccgggucuuuggcaacaagaaacaacugaagauccugacggacauuauguggccuaucauugcuaaacucgccagagaagagauggaucgcgccguggcugaagggaagcggguguguguuaucgacgccgcuguccugcuugaggccggauggcagaaucuggugcaugagguguggaccgcggucauccccgaaacagaggccgugagacgcauuguugaacgggauggccucucugaggcugccgcucaguccagacugcagagccaaaugucugggcagcagcugguggaacagucccacgucgugcuuagcacccucugggagccucauaucacacaacggcagguugagaaagccugggcgcugcugcagaagcgcauucccaaaacccaccaggcccucgacuga

SEQ ID NO: 67666 - RNA, 1140 nt, Artificial Sequence
  derived and/or modified sequence opt5 from COBL__Homo_sapiens__NP_001274367
auggacgcccccagagcuagcgccgcgaagccuccgaccggccggaaaaugaaggcucgcgcucccccucccccugggaaagccgcuacacugcacgugcauuccgaucagaagcccccucacgacggagcccucggcucucaacagaaccuggucagaaugaaagaggcccuucgggccagcacgauggauguuaccguggugcugccguccgggcucgaaaagcgcucuguccugaauggaagccaugcgaugauggaccuucugguggagcucugccugcagaaccaccugaaucccucccaucacgcccucgaaaucagaucuagcgagacacagcaaccucuguccuucaagcccaacacccuuauuggcacacugaauguucacaccguguuucucaaagaaaaggucccugaggagaaagugaagcccgggccgccuaaaguucccgaaaagagcgugcggcuggucgugaacuaccuucgcacacagaaggcuguggucagaguuucuccugaggugccccugcagaauauccuccccgugauuugugccaaaugcgaagucuccccugagcaugugguucugcugcgggauaacaucgcuggagaggaacucgagcugagcaagucucuuaaugaacugggcauuaaagagcucuaugccugggacaaccgcagagaaaccuuccggaaguccagccugggcaaugaugagacggacaaagagaagaaaaaguuucuuggguucuuuaaggugaacaaacgcucuaauuccaagggaugucugaccacaccgaacagccccuccaugcacucuagaagccucacccugggcccuucccugagccucgggucuaucuccggagucagcgugaaaucugaaaugaagaaacggcgcgcgcccccucccccgggcagcgggccucccguucaggauaaggccuccgagaaggugucucugggaagccaaaucgaccuucagaaaaagaaaagacgggcuccugcucccccucccccgcagccucccccucccuccccgcugauucccaauagaacagaagauaaggaggaaaaccgcaaaagcaccauggucuacugcugugccucuuucccuacgcaggccaagcgguuuuga

SEQ ID NO: 67667 - RNA, 3702 nt, Artificial Sequence
  derived and/or modified sequence opt5 from COBLL1__Homo_sapiens__NP_001265387
augcccccuagcugguccccgcugaugugcggcagagccgcugaggccgcggcuucuagccggacccccgggcgcgaaaugggacaggccgugacaagacggcucggcgccggggcucgcgccgcuccuagacgggccauggacggacgcacgcccagaccucaagaugcgcccgcccggcgcgagaucgcuggcuccuggagaaagccuaaagccaaggcuccgcugcccccugccgaaaccaaauacacagacgucucuagcgcggccgauuccguugagucuaccgcuuucauuauggaacagaaggagaacaugaucgacaaagauguggagcuuagcgugguccugcccggggacauuaucaaguccacaaccgugcacggaagcaagccuaugauggaucuccugauuuuucuuugugcccaguaucaucugaaucccucuuccuacacaaucgaccuccugagcgcugaacagaaccacaucaaauucaagccgaauaccccuauuggcaugcuggagguugaaaaagugauccucaagcccaaaaugcuggauaagaagaaaccuacgcccauuauccccgagaagaccguccgggugguuauuaacuuuaaaaagacacagaaaaccaucgugcgcgucucuccucaugccucccuucaagagcuggccccgauuaucugcagcaagugugaguucgacccccuccacacacugcuucugaaagauuaucagucucaggagccucucgaccugaccaagucccugaaugaucucggccugagagaacuuuacgcuauggacgugaaccgggcgacgagcgugacagucuuuuccaagucuagccugcaagaguccugccagaucagccagaaucucgacauuaugaaagaaaaggagaacaaaggguucuuuucuuucuuucagcgcuccaagaaaaagagagaucaaaccgccagcgcucccgccacaccucugguuaauaagcaucggcccaccuucaccagaucuaacacaaucagcaaaccguauauuuccaauacgcuuccuucugacgcccccaagaaacgccgggcuccucugcccccuaugcccgccagccaguccgugccgcaggaucucgcgcacauccaagagagaccugcuagcuguauugugaagucuauguccgucgacgaaaccgauaaaagccccugcgaggccggacgcgugcgggccggcucucugcagcuguccagcauguccgcugggaacucuagccucagacgcacaaagcggaaggcccccuccccuccgucuaaaauucccccucaccagagcgacgaaaauuccagaguuaccgcucugcagcccguggauggagucccucccgacagcgccucugaggcgaacuccccugaagaacuuagcucucccgagacauuucauccgggccuguccagccaagaacaguguaccgccccuaagcucauggaggaaacgucuguguucgagugccccgggacaccugaagcugccaucaccagccugaccuccggaaucagcucugauuacucccuugaggagaucgacgaaaaagaggaacugagcgagguucccaagguggaggcugaaaauauuuccccgaaaucucaggauaucccuuuugucagcacagacauuaucaacacccucaagaacgaccccgauuccgcccugggcaauggcucuggggaguucagccagaacuccauggaagagaagcaagaaacaaaaucuacggacggacaggagccucacagcguggucuaugauaccuccaauggcaagaaagugguugacagcauccgcaaccugaagucucucgggcccaaucaggagaacgugguccagaaugaaauuaucguguaccccgagaacacagaagauaauaugaaaaacggaguuaagaaaaccgagauuaauguggaaggcgucgcgaagaacaauaacaucgacauggagguggagcggccuuccaauagcgaagcccaugagacagauaccgcuauuucuuacaaggaaaaccaccuggccgcuuccagcgugccggaccaaaaacuuaaccagcccucugccgagaagacgaaagaugccgcuauccagaccacaccuuccuguaauagcuucgacgggaagcaccaggaucauaaccuguccgacagcaaaguugaagagugcguccaaaccucuaauaacaauauuagcacacagcacuccugucucucuagccaggauuccgugaacaccucuagagaguuucgcagccaaggaacgcugaucauccauuccgaagacccccugacagugaaggacccuauuugcgcgcacggcaaugaugaccuucugcccccugucgaucggaucgacaagaacucuaccgccagcuaucucaaaaauuacccgcuguauagacaggauuacaaccccaagccuaaacccuccaaugagauuacacgggaauauaucccuaagauuggcaugaccaccuacaaaaucgugcccccuaagagccucgagaucucuaaggacuggcaguccgagacaauugaauauaaagaugaccaggauaugcaugcucuggggaagaaacacacgcacgagaacguuaaggaaaccgccauccaaacagaggacagcgccauuucugaauccccggaggagccccuucccaaucugaaaccuaagcccaaccuccgcaccgaacaucaggugccuagcuccgucucuagcccggaugacgcuauggugagcccccugaagccugcccccaaaaugacaagagauaccggaacggcgccuuucgcucccaaucuggaggaaaucaacaacauucuugaguccaaguuuaaaucucgggccuccaaugcccaggcuaagccgagcucuuucuuucuccagaugcaaaaacggguuagcggccacuacgugacauccgccgcggcuaagucuguccaugccgccccuaaccccgcuccuaaagaacugaccaauaaggaggccgagcgcgacaugcugcccagcccugaacagacccucucuccccuguccaagaugccgcacagcgugccucagccccuuguugagaaaacagacgaugacgugaucgggcaggcucccgccgaagcguccccuccgcccaucgccccuaagcccgucaccauuccugcuagccaagugucuacacagaaccugaaaacgcucaagaccuucggagcccccagaccuuacuccagcuccggcccgucucccuuugcucuggccguggucaaaagaagccaguccuucucuaaggagcgcacagaaagcccuuccgccagcgcucugguucaacccccugcgaauaccgaggaggggaagacacacucugugaacaaauuuguggauaucccccagcuuggcgucuccgacaaggaaaauaacagcgcccauaaugagcagaacucucagauuccgaccccuacggauggacccuccuucaccgugaugagacaaagcucucucacauuucagagcuccgaccccgaacagaugcggcagucucugcugaccgcuauccgcagcggcgaggccgccgcuaaacucaagagaguuacaauuccuuccaauaccaucagcgugaacgggcggucccgccugucucacagcaugucccccgaugcccaagacggacauuga

SEQ ID NO: 67668 - RNA, 1653 nt, Artificial Sequence
  derived and/or modified sequence opt5 from COCH__Homo_sapiens__XP_011534841
augagcgccgcuuggauccccgcccugggccucggggugugccugcuucugcucccuggaccggcgggcuccgagggggcugcccccauugccaucaccuguuucacaagaggacuggacauucggaaggaaaaagcugauguccuuugcccuggcggguguccccuggaggaauuuucuguuuacggaaacaucguguaugccagcguguccucuauuugcggcgcugccguccaccgcggcgugaucagcaauuccgggggaccuguuagaguguacucucuccccggccgggagaacuauagcuccgucgacgcgaaugggauccagagccaaaugcugucucgcugguccgccagcuucacggugaccaagggaaaaucuuccacacaggaagcuaccggccaggccguuagcacagcucauccuccgaccgggaagagacugaaaaagacacccgagaagaaaaccggaaacaaggauuguaaagccgacauugcguuucucaucgauggcucuuucaauauuggccagcggcgcuuuaaccugcaaaagaauuucguggggaaagucgcccuuaugcugggaaucggcacggaggggccucacgugggacucgugcaggcuuccgaacaucccaagauugaguuuuaccugaagaacuucaccagcgccaaagacguccuuuuugcuaucaaggaaguuggcuucagagggggaaauuccaacacaggcaaagcccugaagcacaccgcccagaaauuuuucacaguggaugcuggcgugcggaaggggauuccuaaagucgugguuguguuuaucgacggauggcccucugaugacaucgaggaggcgggcauugucgcccgcgaguucggggugaauguuuucaucgugagcgucgcuaagccgauuccugaagaacucggaauggugcaggaugucaccuuuguggacaaggccguuugcagaaacaauggcuucuuuuccuaucauaugcccaacugguucgggacgacaaaauacgugaagccucugguccaaaaacuguguacccacgagcagaugaugugcagcaagacauguuauaauucugugaacaucgccuuucucauugauggcuccagcucuguuggagacagcaacuuccggcugaugcuugaauuuguguccaauaucgcuaaaaccuucgagaucucugacauuggcgccaagaucgcggcuguccaguuuaccuacgaucagcgcacagaguucagcuuuacggacuacuccaccaaggaaaacgugcuggccgugauuagaaauauccgguauaugagcgggggaacagccaccggcgaugcuauuucuuucacaguucgcaacgucuuugggcccaucagagagucccccaauaaaaacuuccucgugaucgugaccgacggacaaagcuacgaugacguccagggcccugccgcugccgcgcacgaugccgggauuacgaucuucucugugggcguugcuugggccccgcuggacgaucuuaaggacauggcuuccaaacccaaggaaagccaugccuuuuucacacgggaguuuaccggacuggaaccuauuguguccgaugucaucagaggcauuugccgcgacuuccucgagucucagcaauga

SEQ ID NO: 67669 - RNA, 2943 nt, Artificial Sequence
  derived and/or modified sequence opt5 from COG1__Homo_sapiens__NP_061184
auggccaccgcugccacaagccccgcgcugaagagacucgaccugcgggauccugcugcccuuuucgagacgcacggcgccgaagagauccgcgggcuggaaagacaggugcgggcugagauugaacauaaaaaggaggagcuccgccaaauggucggagaaagauaccgggaccugaucgaggccgcugauaccauuggccagaugcgcagaugcgccguugggcuuguggacgcggugaaagccacagaucaguauugugcucggcugcgccaggccggauccgcugccccgagacccccucgggcgcaacagccccagcagccuucucaagaaaaguuuuacagcauggccgcucagaucaaacuccugcuggagauucccgagaagaucugguccucuauggaagccagccagugccuccacgcuacccagcuguaucuucuguguugccaucuccacucccugcuucaacuggacucuagcuccagccgcuacucuccuguccucuccagauucccgauccugauucgccagguggccgccgcuagccauuuucggucuacaauccugcacgaguccaagaugcuccugaaaugucagggcguuagcgaucaagcgguggccgaagcucuuugcucuauuaugcugcucgaggaauccagccccagacaggcccugaccgacuuccuucuggcccggaaggcuacaauccagaaacuccugaaccagccucaccauggggccggaauuaaggcgcaaaucuguucccuggucgagcuccuggcuaccacgcuuaaacaggcccacgcccuguuuuauacccuccccgagggccugcuuccugaucccgcucugccgugcggccuccuguucucuacacuggaaaccauuacagggcagcauccugccggaaagggcaccggggugcuccaggaggaaaugaagcuguguagcugguuuaaacaccuucccgcuuccaucguugaguuccaaccuacgcugagaacacucgcccaccccaucagccaggaauaccugaaggacacccugcagaaauggauucauaugugcaaugaggauaucaagaacggaauuacaaaucuucucauguaugugaaaucuaugaagggccuggcggggauccgcgacgccaugugggagcugcucaccaacgaauccaccaaucacagcugggauguccugugucggagacuucuggagaaaccccuccuguuuugggaagacaugaugcagcaacuguuccuugaccgccuccagacacugacgaaggagggauuugauucuauuagcuccucuagcaaggaacugcucguguccgcucugcaggagcuugagagcucuaccuccaacagcccuucuaauaaacauauccacuucgaauacaacaugucccuguuucucuggagcgaguccccgaaugaccugcccucugaugccgcuugggugagcgucgccaaccggggccaguucgcguccucuggccugagcaugaaggcccaagcuaucuccccuugcguucagaauuucugcagcgcccuugacucuaaacucaaggugaaacuggaugaccugcucgcuuaccugcccuccgaugacagcucucuuccuaaggaugugucccccacacaggccaagagcucugccuuugacagauaugcugaugcggggaccguccaagaaaugcugcgcacacagagcguggccuguauuaaacauaucguugacugcauucgggcugagcuccaguccaucgaggaaggagugcagggccaacaggacgcccugaacagcgccaagcugcacucuguccuuuucauggcuagacucugucagucccugggggagcugugcccgcaccucaaacaguguauucugggaaagagcgaauccucugagaaaccugcccgcgaauuucgggcgcuuagaaagcaaggcaaggugaaaacccaggagaucauccccacgcaggcuaaguggcaggagguuaaagaagugcugcuccaacagagcgucaugggguaccaggugugguccucugccgucgugaagguucugauucauggauucacacaaagccugcuucuggaugacgccggcuccgugcucgcuaccgccaccucuugggaugagcuggaaauccaggaggaagcggagagcggcuccagcgucacaucuaaaauucgccucccugcucagcccuccugguaugugcagagcuuucuguucucucuuugccaagagaucaaucggguugggggacacgcccugccuaaggugacccuccaggaaaugcugaaguccuguaugguccaggugguggccgcuuacgagaaacugagcgaagagaagcagauuaaaaaggaaggcgccuuucccguuacacaaaacagagcccuucagcugcucuaugaccugcgguaccucaauaucguccugacggccaaaggggaugaggugaagucuggacgcuccaaaccggacagcagaauugagaaggugaccgaucaucuugaagcgcugaucgacccuuucgaucucgacgucuuuacaccccaccugaacuccaaccugcaccggcuugugcagagaaccagcguucuguucggccucgugacagggaccgagaaucagcuggcuccccgcucuagcacguuuaacucccaagaaccucauaauauccucccgcuggcuucuagccagauucgguucggccuucugccccuguccaugaccucuacaagaaaggccaaaagcacccgcaacaucgagacaaaggcucaggucgugccucccgccagauccaccgccggagauccuacgguucccggcucucucuuucggcagcuggugagcgaggaagacaauacauccgcuccuagccuuuucaaacugggguggcucucuuccaugaccaaguga

SEQ ID NO: 67670 - RNA, 2214 nt, Artificial Sequence
  derived and/or modified sequence opt5 from COG2__Homo_sapiens__NP_001138508
auggagaaguccagaaugaaccugcccaaaggcccugacacccucugcuucgauaaggacgaauuuaugaaagaggauuucgacguggaucacuuugucuccgacugucggaagcgcguucagcuggaagaacuuagagaugaccuggaacucuacuauaaacugcuuaagacagccaugguggagcugaucaauaaggauuacgcugacuucgugaaccucucuacgaaucuggucgggauggauaaagcccugaaccaacucagcgugccgcugggacagcuucgggaggaaguucugucccuccgcucuagcguguccgagggcauuagagcggucgacgaacggaugucuaagcaggaggauauccgcaaaaagaaaaugugcgugcugagacuuauucagguuauccggagcguggagaagauugaaaagauccugaauagccaaagcucuaaagagaccuccgcucucgaagccagcucuccccugcugacagggcagauccucgagcgcauugccaccgaauuuaaccagcugcaguuccaugcuguccaauccaagggaaugccucuucuggacaaagugagaccccggaucgccggcauuacagcuaugcuccagcagagccuggaggggcuucugcucgagggacugcagaccucugacguggauaucauucgccacugucugagaacauaugccaccaucgacaagacgcgggaugcggaagcccucgucggccaaguucuggugaaaccuuacauugacgaggugaucaucgaacaguuugucgagucccaucccaauggccuucaggugauguauaacaagcugcucgaguucguuccucaccauugccgccugcuuagagaggugaccgggggagcuauuagcuccgagaaaggcaauacagucccgggguacgauuuucuggugaacucuguuuggccccaaaucgugcagggacucgaagagaagcugccuagccuguucaaucccggcaacccugacgccuuucacgaaaaguauaccauuuccauggauuucguccggagacucgagcgccagugugggagccaggcuucugugaaacggcugagagcccaccccgcguaccauuccuuuaauaagaaauggaaccuuccggucuacuuccaaauccgcuuccgggaaauugccggaagccuggaggcugcccucacagacgugcuggaggaugcuccugccgaaucucccuauugccugcuugccagccacagaaccugguccucucuccgccgguguuggagcgacgagauguuucugccucugcucguucauagacuguggcgccuuacgcugcagauccucgcucgguacuccguguucgucaaugaacugagccugagacccaucucuaacgagucccccaaggagauuaaaaagccucuugugacaggcagcaaggaaccgucuaucacccagggcaacacagaggaucagggguccggacccagcgaaaccaaaccuguuguguccauuucucgcacccaacucgucuaugugguggcggaccuggacaagcugcaggagcagcuccccgaacugcuugagaucauuaaaccuaagcuggagaugaucggcuuuaaaaauuucagcuccaucucugcccucgaagauagccaguccagcuuuucugcuugcguucccucccugagcucuaagauuauccaagaccuguccgauagcuguuucggguuucuuaagucugcccucgaggucccgcggcuguacagacggacaaacaaagaagugccuacgaccgccagcuccuauguggacagcgcucugaagccccucuuccagcugcagucuggacacaaagauaagcugaaacaggccauuauccaacaguggcuggagggcacacucuccgaaagcacccacaaguacuaugagacagucuccgacgugcuuaauucuguuaagaaaauggaggaaagccugaagcgccuuaaacaggcgagaaagaccacgccugcuaaccccguggggccuuccggaggcaugucugaugacgauaaaauucggcuccaacuggcccuggacgucgaguaccucggcgaacagauccagaagcuggggcuucaggccagcgauauuaaauccuuuucugcucuggccgagcucguggcugccgcgaaggaccaagccacagcugaacagcccuga

SEQ ID NO: 67671 - RNA, 2487 nt, Artificial Sequence
  derived and/or modified sequence opt5 from COG3__Homo_sapiens__NP_113619
auggccgaggcugcccugcuccugcuucccgaagcggcugccgagagagacgcccgggaaaagcuggcucucugggaucgcagaccugacaccacagccccgcugacggaucggcagaccgacagcgugcuugagcugaaagcugccgcggaaaaccuccccgucccugccgagcugcccaucgaggaucugugcucccucacaucucaaagccugccuauugaacuuaccuccguugugcccgagucuacagaagacauccugcucaagggcuucaccagccuggggauggaggaggaacgcauugagacagcucagcaguuuuucuccugguuugccaaacuucagacccaaauggaucaggacgaaggaacgaaguacagacagaugcgggauuaucugucuggcuuccaggagcaaugugacgcuauccucaaugaugugaacagcgcccugcagcaccuggaaucccuccagaaacaguaccuguuugucagcaauaagaccgggacacuucaugaggcgugcgagcaacugcucaaggaacagucugagcugguggaccuugccgaaaacauucagcaaaaacuguccuauuucaaugagcucgaaaccaucaacacaaagcugaauagcccuacccugucuguuaacuccgauggauuuaucccgaugcucgcuaaacuggacgacuguauuacguacaucagcucucaccccaauuucaaggauuauccuauuuaccuucugaaauuuaagcagugccucuccaaggcccugcaucuuaugaaaacauauaccgugaacacacugcagacccucaccagccagcugcugaagcgcgaccccuccucugucccuaaugcugauaacgccuucacacucuuuuacgugaaauucagagccgcugcgcccaagguucggacgcugaucgagcaaauugagcuucgcagcgagaaaaucccggaauaccagcagcugcucaaugacauucaccaguguuaucuggaucaaagagaacugcuucucggcccuuccaucgccugcaccguggcugagcugacaagccagaacaaucgggaccauugugcccugguccgcucugggugcgccuuuauggugcacgugugucaggaugaacaccagcucuacaacgaguucuucaccaagcccacauccaaacuggacgagcuucuggaaaagcucugcgucagccuguaugauguuuuuagaccucugaucauucaugugauccaccuugagacccucucugaacuguguggcauucugaagaacgaggugcucgaggaccauguccaaaauaacgcugaacagcugggagccuucgcggcuggcgugaaacagaugcuugaggauguucaggaacggcugguguaccgcacgcacaucuauauucaaacagacaucaccggguacaagcccgcccccggagaccucgccuauccugauaaacuggucaugauggagcagaucgcucagagccugaaggacgaacagaaaaaggugccguccgaggccucuuuuagcgauguucaccuugaggaaggcgaguccaauagccucaccaagucuggguccacagaaagccugaaccccagaccucagaccacaauuucucccgcugaccugcauggaaugugguacccuacggugcggagaacccucgucugccuguccaaacuuuaccgcugcaucgaucgggccguguuccagggccugagccaggaggcgcucuccgccuguauucaaucucugcugggggcuagcgaauccaucucuaagaauaaaacacagauugacggacagcuuuuucucaucaagcaucugcugauccucagagagcagauugcccccuuccacaccgaguuuacaaucaaagaaauuagccuggaucuuaagaagacccgcgacgcugccuucaaaauccugaacccgaugacggucccucgguuuuucagacucaauuccaacaaugcgcugauugaguuucugcuugaaggcacccccgagauccgcgaacacuaucuggauagcaagaaagacguggaucggcaucucaagucugccugcgagcaauucauucagcagcagacaaaacuguuuguugagcaacucgaagaguucaugaccaagguguccgcucugaagacaauggccagccagggcgggccuaaauacacccuuucucagcaacccugggcucagccugccaaggucaacgaccuggccgcuacggcguauaaaacaaucaagaccaaacuccccgugacacugagauccaugagccuguaccuuucuaauaaggauaccgaguucauccuguuuaaaccgguucgcaacaauauucaacagguguuccaaaaguuucacgcccuccugaaggaagaguucagcccugaagacauccagauuaucgcuugucccuccauggagcagcucagccugcuucugucugucuccaaauga

SEQ ID NO: 67672 - RNA, 2307 nt, Artificial Sequence
  derived and/or modified sequence opt5 from COG4__Homo_sapiens__NP_001182068
augggcaccaagauggccgaccuggauagcccgccuaaacucuccggggugcagcaaccgucugagggagucggcgggggaagaugcagcgaaaucuccgcugagcugauucggucucuuacagaacugcaggagcucgaagccguuuacgagcgccuguguggcgaggaaaaggugguggagagagaacuugacgcgcugcucgagcagcagaacacgaucgagagcaaaauggucacccugcaccggauggggcccaaucugcaacucauugaaggagaugcuaagcagcuggccggcaugaucacauuuaccugcaaccuugccgagaauguguccucuaaaguucgccagcuggaccucgcuaagaacagacuguaucaggccauucaacgggcugaugacauccuugaucugaaguucuguauggacggcgugcagacagcccuccgcagcgaagauuacgagcaggcggccgcucauacccacagauaucugugccuggacaaauccgucaucgaacucagccggcaggggaaggagggaucuaugauugaugccaaucugaaacuucugcaagaggcugaacagcgccucaaggccaucguggcggagaaauucgccauugcuacaaaggaaggcgaccugccucagguugagagauuuuucaagaucuuuccccuucuggggcuccaugaagagggacugcggaaauucuccgaguaccuguguaagcaaguggccagcaaagcugaagagaaccuccugaugguccuuggcaccgauaugucugaccgcagagccgccgugauuuuugcugacacgcugacccuccuguucgaagggaucgcgcggauuguggagacacaccagccuaucgucgaaaccuauuacggacccggccgccuuuauacacugaucaaguaccuccagguugagugcgauagacagguggagaaaguggucgacaaguuuauuaaacaacgggauuaccaucagcaguucagacacgugcagaauaaccugaugcgcaauuccaccacggaaaagaucgagccucgggaacuggacccgauucucacagagguuacccugaugaacgccagaagcgagcuuuaucugcgcuuucucaagaaacggaucucuuccgauuucgaagugggcgacagcauggcuuccgaggaagucaagcaagagcaccagaaaugucuggauaagcugcuuaauaacugccuccugucuuguacaaugcaggaacugauugggcucuacgugaccauggaggaguauuuuaugagagaaaccguuaauaaagccguggcccuggacacauacgagaagggacagcuuacgagcuccauggucgaugacguguucuauaucgucaagaaaugcaucggccgcgcucuguccucuuccagcauugauugucucugcgccaugaucaaccuggcgaccacagaacuggagucugacuuccgggacgugcuuugcaauaagcucagaaugggguuucccgcuaccacauuccaagauauucagcgcggaguuaccagcgccgugaacaucaugcauuccucucugcagcagggcaaauuugacacgaaggggauugaaagcacagaugaggccaaaauguccuuccugagcgacuguaccaagcucuuuucucaaggaaucggcggcgagcaggcucaggccaaguucgauuccugccugagcgaccuugcugccgucucuaacaaauuucgggaucugcuccaagaagggcugaccgagcugaauagcacagcgaucaagccucaggugcagcccuggauuaacagcuucuuuuccguuucucacaauaucgaagaggaagaguucaacgacuacgaggccaaugauccuugggugcagcaauuuauucuuaaccucgaacagcagauggcugaguucaaagccagccugucccccgucaucuaugacucucugaccggacucaugacaagccugguggcuguggaacuugagaagguuguccugaaauccacguuuaauagacucggcgggcugcaguucgauaaggagcugcgcagccuuauugccuaccucaccacagugaccacauggaccauccgggacaaguucgcgagacugucucaaauggccacgauucugaaccucgaacgggugaccgagauccuggauuacuggggacccaauuccggcccucuuacauggcgccugacccccgcugaagucagacaggugcucgcccugcggaucgacuuuagaagcgaggacauuaaacgccugcggcuuuga

SEQ ID NO: 67673 - RNA, 2583 nt, Artificial Sequence
  derived and/or modified sequence opt5 from COG5__Homo_sapiens__NP_006339
augggcugggucgggggaagacggcgcgacagcgccagcccucccggcagaucucggagcgcugccgaugacaucaacccggcgcccgcuaauauggaagggggaggcggguccguggccguugccggacugggcgcucgcggcucuggggccgcugccgcgaccgugagagaacuccugcaggauggaugcuacagcgacuuccuuaacgaggauuuugacgugaagacauauacgucccaaucuauucaccaggccgucaucgcugaacagcuggccaaacucgcucagggcauuagccaacuggaucgggagcuucaucuccaggugguugcccgccacgaagaccuccuggcgcaggccaccgggaucgagucccuggagggagugcuccagaugaugcaaacaagaauuggcgcucugcagggggccgucgaucggaucaaggcuaaaaucguggaaccuuacaauaagauuguugcccgcaccgcccagcuugcuagacuccagguggcgugugaccugcugcggcgcaucauuagaauccuuaaccugagcaaacggcuccaaggacagcugcagggcggcucucgcgagauuacaaaggccgcucaaucccugaaugaacucgauuaucugagccaggggaucgaccuuucuggaauugaggucaucgagaacgaucugcuguucaucgccagagcccggcuggaaguggagaaucaggcuaagagacuucuggaacagggccucgagacccaaaaccccacacagguggggaccgcccugcaggucuuuuacaaucugggaacgcucaaagacaccauuacauccguuguggacggcuauugcgcgacccuggaagagaacaucaauagcgcucuugauauuaaggugcugacacagccuucucaauccgccguccgcgggggacccggccggagcaccaugccuacgccgggcaacacagccgcucucagagccuccuucuggaccaauauggagaaacugauggaccauaucuacgcugugugugggcagguucagcaccuucagaaggugcuggccaaaaagcgcgaucccgucucucauauuugcuuuaucgaagagaucgugaaggacggacaaccugaaauuuucuauacauuuuggaacagcguuacccaggcgcucuccagccaguuccacauggccaccaauucuuccauguuucugaaacaggcuuucgagggcgaauaccccaagcugcuccggcuguacaacgaucuuuggaaaagacugcaacaguauagccagcacauccaagggaacuuuaaugccucuggaacaacggaccucuacguggaucugcagcauauggaggacgaugcucaggacauuuucaucccuaagaaacccgauuaugacccggagaaggcccugaaagacagccuucagccuuacgaagcggccuaucucuccaagucucugagccgccuguuugaucccauuaaccucgucuucccucccggcgggcggaaucccccuuccagcgacgagcuggauggcaucaucaagaccauugcuucugaacuuaacguggccgcugucgacacaaaucugacccucgccguguccaaaaacguugccaagacaauccaacuguacagcgugaaaucugagcagcugcuuuccacccagggagaugcuagccaggucauuggcccgcucacggaagggcaaagacgcaauguggcgguugugaacucccuguauaagcugcaccagucugucacaaaaguggugagcucccagucuagcuucccccucgccgcugagcagaccaucauuuccgcccugaaggccauccaugcucuuauggagaaugccguucaaccucugcucaccagcgucggagacgcgauugaagcuaucaucauuacaaugcaccaggaggauuuuucuggcucccuguccucuuccgggaagcccgacgugccuuguagccuguacaugaaagaacuucagggauucaucgcccgggugaugucugauuacuuuaagcacuucgagugccucgacuuugucuucgauaacaccgaggccauugcucaaagagccguggaacuguuuauccgccaugcgagccugauucggccccucggcgaagggggcaaaaugagacuggcugccgacuucgcccagauggaacuugcuguuggaccguuuugucggcgcguguccgaucugggcaagagcuauagaaugcuccggucuuucagaccucugcuguuucaggccuccgagcacgucgcuagcucccccgcccuuggggacgugaucccuuucucuaucauuauccaguuucucuucacacgcgcgcccgccgaacugaaaagcccuuuccaacgggcugaguggucccauacgagauuuucucaguggcuggacgaucaccccagcgagaaggaccgccuccugcuuauuagaggagcccuggaggcuuacguucaguccgugcggucucgcgagggcaaggaguucgccccggucuauccuaucauggugcagcuccugcaaaaagccaugagcgcucugcaguga

SEQ ID NO: 67674 - RNA, 1848 nt, Artificial Sequence
  derived and/or modified sequence opt5 from COG6__Homo_sapiens__NP_001138551
auggccgagggcagcggggaaguggucgcuguuuccgccaccggagcggcuaacggccugaauaacggggccggaggcacaucugccacgaccugcaauccccucagcagaaagcugcacaaaauccuugagacacggcuggacaacgauaaggaaaugcucgaggcucugaaagcccuuuccaccuucuuuguggaaaauucucugcgcacaagacggaaccuccgcggggacauugagagaaagagccuggcuaucaaugaggaguucguguccauuuuuaaagaggucaaggaagaacuggagucuaucagcgaagaugugcaggccauguccaacuguugccaagacaugaccagccggcuccaggcggccaaggagcagacacaggaucugauuguuaaaaccacgaaacuucaaucugaaucccagaagcuggagauccgcgcucagguggccgacgcuuuccucagcaaguuucagcugaccucugaugaaaugucccuucugagaggaacacgggagggcccuaucaccgaggacuucuuuaaagcccucggccgcgucaagcaaauucauaaugaugugaagguucugcugagaacaaaccagcagaccgcggggcucgaaaucauggagcagauggcccugcuucaagaaacggcuuacgagcggcuguaucgcugggcccagagcgaauguagaacacucacccaggagucuugcgacguguccccgguccugacacaagcuauggaggcccuucaggaucggcccgugcuguacaaauauacccucgacgaguucggaaccgcccgcagaagcacagugguccggggcuuuauugaugcucugacgagagggggaccuggcgggacaccccgcccuaucgaaaugcacucccaugacccccugcgguacguuggagacaugcucgcguggcugcaccaggccaccgcuucugaaaaggagcaucuugaagcccugcucaaacacgugaccacacagggcguggaggagaauauucaagaagucgugggccacaucaccgaggggguuuguagaccucugaaggugcgcauugaacaggucaucguggccgagccgggagcuguucuucuguauaaaaucagcaaccuccugaaguucuaccaucacacgauuuccggcaucguggggaauagcgccacagcgcugcucaccaccauugaggaaaugcaucugcuuucuaaaaagaucuuuuucaacucccugagccuccacgcuucuaagcugauggauaaagucgagcugcccccucccgaccuuggaccuagcuccgcccucaaucagacacugaugcugcuccgggaagugcuggccucucacgauagcuccgucgugccccuugacgcuagacaggccgauuuuguucaagugcugagcugcguccucgacccgcugcugcagauguguaccgugucugcuuccaaccuuggcacagccgauauggcgacguucaugguuaacagccucuauaugaugaagaccacacuggcccuguucgaguuuaccgaccgccggcucgaaaugcugcaguuccagauugaggcucaucuugauacacugaucaaugagcaagccucuuacgugcucaccagagucgggcuguccuacaucuauaacacggugcagcagcacaaaccugaacagggaagccuggcuaauaugcccaaccuugacuccgugacccucaaggccgcgaugguucaauuugaucgcuaccugucugccccugacaaucugcucauuccccagcugaacuuccuucugagcgcuacagucaaacggcccccuaauggcccguga

SEQ ID NO: 67675 - RNA, 2313 nt, Artificial Sequence
  derived and/or modified sequence opt5 from COG7__Homo_sapiens__NP_705831
auggacuucagcaaguuucuggccgaugacuucgaugugaaagaguggaucaacgcugccuuuagagcgggcuccaaggaagcugccucugggaaagccgacggacacgcugccacccucgucaugaagcugcagcuuuucauucaagagguuaaucaugcuguggaagagacaagccaccaggcccugcagaacaugcccaaagugcuccgggaugucgaagcgcugaagcaggaggccuccuuucuuaaggagcaaaugauccuggugaaagaagacauuaagaaauucgagcaggauacgucucagagcaugcagguucucguggaaaucgaccaagucaagucccgcaugcagcuggcugccgagucucugcaggaggcugauaaauggagcacccucuccgccgacauugaagagacauuuaagacccaggauaucgcggugaucagcgccaagcugacaggcaugcaaaauucucuuaugaugcugguugacaccccugauuacuccgaaaaaugcgugcaucucgaggcucugaagaacagacuugaagcccuggcuagcccgcagauugucgccgccuucacaucucaggcuguggaccaauccaaaguguuugucaagguuuucaccgagaucgaccggaugccccagcuccuggcguauuacuauaaaugucacaaggugcagcugcucgccgcuuggcaggagcugugccaaagcgaucuuucucuggaccgccagcucacggggcuguacgaugcccuucugggagccuggcauacccagauucagugggcuacacaaguguuucagaaaccucacgaagucgugaugguucuccugauccagacccugggcgcccucaugcccucccugccuagcugucuuuccaaugggguggagagagcgggacccgaacaggagcugacacggcuccuggaguucuaugacgcuaccgcccacuuugccaagggccuugaaauggcucugcucccucaucugcacgagcauaaccuggucaaggugacggaacucguugaugccguguacgacccguauaaacccuaccaacugaaguacggcgauauggaggaaucuaaucuucugauucagaugagcgcugucccucucgagcacggggaagugaucgacugcguccaggagcugucccacagcgugaacaaacuguucggacuugccucugcggccguugaucgcugugugagauucacaaauggccucgggaccugcggacugcuguccgcucucaagagccuguuugccaaauaugucucugacuucacaagcacccuucaguccauucggaagaaguguaaacuggaucauauucccccuaacucucucuuucaagaggacuggaccgcuuuccagaauagcauccgcaucaucgccacaugcggcgaacugcugagacacuguggggacuuugagcagcaacuugcgaaccggauucucuccacggccggaaaguaccugagcgauucuugcagcccccgcucccuggcuggcuuccaggaaucuauccucaccgacaaaaagaacuccgccaaaaauccguggcaggaguauaauuaccugcagaaggauaacccugcugaguaugccagccuuauggaaauucuguacacacucaaggagaaaggcuccucuaaccauaaucugcuggccgcucccagagcggcccuuacccggcucaaccaacaggcucaccagcuggccuuugacagcguguuccugcgcaucaagcagcaacuccugcuuaucuccaaaauggauucuuggaauacagccgggauuggagaaacccugacggacgagcucccugcuuuuagccugacaccccuggaauauaucuccaacauuggccaguacaucaugagccuuccccucaaucuggagccuuucguuacccaggaggauucugcccuggaacucgcgcugcaugcugggaaacuuccguuucccccugagcagggagacgaacugcccgagcucgauaacauggccgacaauuggcugggcuccauugccagagcuaccaugcaaacauacugugaugccauccugcagaucccugaacuuagcccccacucugcgaagcagcuggcuaccgacauugauuaucucaucaacgugauggacgcccuggggcuccaaccgucccggacacugcagcacauugucacgcuucugaagaccagaccugaggacuaccgccaggugagcaagggacucccccggagacuggccacaaccguggcuacaaugcgcucuguuaauuauuga

SEQ ID NO: 67676 - RNA, 1839 nt, Artificial Sequence
  derived and/or modified sequence opt5 from COG8__Homo_sapiens__NP_115758
auggccaccgcugccacaauccccagcguggcgacggcuaccgccgccgcucugggcgaggucgaagacgaggggcuccuggccucccuuuucagagaucgguuuccugaagcucaguggcgcgagagaccggacguuggacgguaccugcgcgaacucucuggcagcgggcuggagagacuucggcgcgagcccgaaagacuggccgaggaacgggcgcaacuccugcagcagacacgcgaucuggccuucgcuaacuauaagaccuuuauuagaggagccgagugcacagagcggauccaccgccucuucggcgacguggaggcuucccuggggagacuucuggaucggcucccuucuuuucagcaaagcugucgcaauuucgugaaagaggccgaagagauuuccucuaacagacggaugaauagccugacccuuaacagacauacagaaauccuggagauucucgagaucccccagcugauggauaccugcguccgcaauuccuacuaugaagaggcgcuggaacucgccgcuuacgugcggagacuggagcgcaaguauagcucuaucccuguuauucagggaaucgugaacgaaguccggcaguccaugcaacuuaugcugagccagcucauucagcagcugagaacgaauauccaacuucccgccugucugcgcgugauuggcuaccuccggagaauggacguuuuuaccgaggcugagcugcgcgugaaauuccugcaggcccgggacgccuggcucagaucuauccugacagcuauuccuaacgaugacccguauuuucacaucaccaagacaaucgaagcgucccgcguccaucuuuucgauauuaucacccaguaccgggccauuuuuagcgacgaggauccccugcucccucccgcuaugggcgaacacacggugaaugagucugccaucuuccaugggugggugcugcaaaaagucucccaguuucuucagguucuggaaacagaccucuacagaggaauuggcgggcaccuggacagccugcucggacagugcauguauuucggccuguccuucucucgggugggggccgauuuucgcggacaacuugcuccuguguuccagagagucgccaucagcaccuuucagaaggcgauccaggagacaguggagaaguuccaagaagagaugaacuccuacaugcugauuagcgcucccgccauccucggcaccucuaauaugccggccgcuguuccugccacccagcccggcacacugcagccucccauggugcugcuugacuuucccccucucgcuuguuuccugaacaauauucuggucgccuuuaacgaucuccggcugugcuguccgguggcgcuugcccaggacguuacgggggcucuggaagaugcccucgcuaaagugaccaagaucauucuggccuuccacagagcggaggaggccgcuuuuuccagcggagaacaagagcuguucguccaguuuugcacaguguuccuugaagaccucguccccuaucugaaucgcugucuccaggugcuguuuccucccgcccagaucgcucaaacccugggcaucccucccacacagcuuucuaaauacgggaaccugggacauguuaacauuggcgccauccaggagccgcucgccuucauucugccuaagcgggaaacccuguucacgcuugaugaccaagcucucgggcccgagcugacagcgccugcccccgagccucccgcugaagaaccgagacuggaaccugccggacccgccugccccgagggcggccgcgcugaaacccaggccgagccuccgagcguggggcccuga

SEQ ID NO: 67677 - RNA, 1731 nt, Artificial Sequence
  derived and/or modified sequence opt5 from COIL__Homo_sapiens__NP_004636
auggccgcuagcgagaccgugagacugcggcuccaguucgacuaucccccuccggccacaccccacugcacggcguuuuggcugcuugucgaucugaaccgcuguagaguugugaccgaccucaucucccugauucggcaacgcuucggcuuuucuagcggggcuuuccuuggacuguaccucgaaggcgggcugcugccucccgccgaguccgccagacucgugcgggauaaugacugccugcgcgucaaacuugaagagagaggaguggcugaaaacucuguugugaucagcaauggcgauauuaaccugucccuccggaaggccaagaaacgcgcuuuucagcuggaggagggggaagagacagaaccugacuguaaguacucuaaaaagcauuggaaaagcagagagaauaacaauaacaaugagaagguccuugaucuggaacccaaggccgugaccgaccagacaguuuccaaaaagaacaaacggaagaauaaggcgaccugcggaacagugggcgaugacaacgaggaagccaaacgcaagagcccuaaaaagaaagagaagugugaauauaaaaagaaggcuaaaaauccgaagucucccaaaguccaggccgugaaggauugggcuaaccaaagaugcuccagcccuaaaggcucugcccggaauagccucgugaaggcgaagcgcaaagggagcgucucuguuuguuccaaggagagccccuccucuagcuccgagagcgaaucuugcgacgaguccaucagcgauggaccuucuaaagugacccuggaagccagaaacagcuccgagaagcugcccacggaacucucuaaagaggagccgagcaccaagaacacaaccgcugacaagcuggccauuaaacuuggcuucucccugacaccuagcaaggggaaaaccucuggaacgacauccuccucuuccgacagcuccgcugaaucugaugaccagugucucaugagcuccucuacccccgagugcgccgccggcuuucugaagacaguggggcuuuucgcuggacggggcagaccuggccccgggcugagcucccagaccgcgggagccgcuggcuggcgccggagcgggucuaauggaggcgggcaggcccccggagccuccccuagcgucucucucccggcuucccugggcagaggcugggggcgcgaagagaaccuguuuagcuggaaaggagccaagggccgggggaugagaggacgcggccgggggagaggccaccccgugucuuguguugugaaucgcagcaccgauaaccaacggcagcagcagcucaaugacgucgugaagaacuccagcacaaucauccaaaauccuguugaaacgcccaaaaaggauuacucucugcuuccucugcucgcggcugcuccccaggugggagagaaaauugccuucaagcugcuugagcugaccuccagcuauuccccggacgucucugauuacaaagaaggcagaauccucagccauaacccugagacacagcaaguggacauugaaauccuguccucucugcccgcccuccgcgagccugggaaguuugaucuggucuaucacaaugagaacggagccgaagugguugaguacgcugugacccaggaaagcaaaauuacagucuucuggaaggagcuuaucgacccccggcugauuaucgaauccccuucuaauaccagcuccacggagcccgccuga

SEQ ID NO: 67678 - RNA, 2043 nt, Artificial Sequence
  derived and/or modified sequence opt5 from COL10A1__Homo_sapiens__XP_011533735
augcugccccagaucccuuuccuccugcuugugagccugaaccucguccacggcguguuuuacgccgagagauaucaaaugccgaccgggauuaagggaccccugccuaauacaaaaacgcaguucuuuauccccuacaccauuaaguccaaaggcaucgcuguucggggcgaacagggaacaccugggcccccugggccggccggaccccgcggccauccuggccccucugggccucccggaaagccgggcuaugggagcccuggacuucagggcgagcccgggcugccuggaccucccggccccuccgcggugggcaaaccggggguccccggacucccuggcaagcccggggaaagaggaccuuacggccccaagggggacgugggaccggcuggccugccuggcccccgggggccucccggaccucccggcauuccggggccugccggaaucucuguucccggcaaacccgggcaacagggcccuaccggagccccgggcccccgcggguucccuggagagaagggcgcucccggggugccuggaaugaacggccagaaaggggaaaugggcuauggagcccccggcagaccuggggagcggggacugcccggcccgcaggggccuacaggacccagcggcccucccggggucggcaagcgcggagagaauggcgugccggggcaaccuggaaucaaaggcgauagaggguuucccggagaaaugggcccuauugggccucccggcccccagggaccgcccggcgagcgggggccugaaggaaucggcaagcccggggcugccggagcgccuggccagcccggcauuccugggaccaagggacucccgggcgcccccgggaucgcuggaccucccggcccucccggguucggaaaaccgggccugccuggccuuaagggggagcgcggacccgccggccugcccgggggaccuggcgcuaaaggggagcagggacccgccggccucccuggcaagccggggcugacaggacccccuggcaacauggggccccaaggaccuaaaggcauucccgggucccacggacuuccgggcccuaagggcgaaaccgggcccgcgggaccugccggcuaccccggggcuaaaggagagagaggcucuccugggagcgacggaaagcccggcuauccgggcaagccugggcuggauggacccaaaggcaaucccgggcucccuggaccgaagggcgaccccgggguuggaggcccucccggccugccugggcccgugggaccugccggcgcuaaagggaugccgggacauaacggcgaagccgggccccggggagccccuggcauccccggcacgcgcgggccuauuggacccccgggcaucccuggguuucccggauccaagggcgaucccgggagcccuggacccccuggcccggcuggcaucgcgaccaaagggcugaauggacccacaggcccucccgggccucccggaccgagaggccacucuggggagccuggccuccccggaccucccggcccucccgggccgccuggacaggccgucaugcccgaaggcuucauuaaggcugggcagcggcccucccugagcggaaccccucuugugucugccaaccaaggcgugacagggaugccggucuccgccuuuaccguuauccugagcaaggcuuaccccgccauuggcacgccuauccccuucgacaaaauucucuacaaucgccagcagcauuaugauccuagaacaggaaucuuuaccugccagauccccggcauuuacuauuucucuuaccacgugcacgugaaggggacacaugucugggugggacuguauaaaaacggcaccccuguuauguacaccuaugacgaguacacaaagggguaccuugaucaagcguccggaagcgcuaucauugaccugacggagaaugaucagguguggcuccagcugcccaacgccgaauccaauggccuguauucuagcgaguacguccacuccagcuuuucuggcuuccucguggccccgauguga

SEQ ID NO: 67679 - RNA, 4395 nt, Artificial Sequence
  derived and/or modified sequence opt5 from COL11A1__Homo_sapiens__XP_011539021
auggagcccuggagcuccagauggaagaccaaacgguggcugugggacuucacagugacgacccucgcccugacauuucuuuuccaggcucgcgaagucagaggcgccgcgccuguugaugugcugaaggcucucgacuuucacaacucuccggaggggaucagcaaaaccacaggauucugcaccaaucggaagaacuccaaaggcucugauacagccuaccgcgugagcaagcaagcccagcuguccgcucccaccaagcagcuuuuuccugggggaacguuccccgaagacuuuucuauucuguucaccgucaaaccuaagaaaggcauccagagcuuucuccuguccauuuauaaugagcacgggauccaacagauuggaguggaaguuggcagaagccccguguuccuguuugaggaucacacaggcaagccugccccggaggacuacccccucuuccggaccgucaacaucgcugaugggaaauggcaucgcguggccaucucuguugaaaagaagacagugaccaugauugucgacuguaaaaagaaaacgacaaagccucuggauagauccgagcgggcgaucguggacaccaauggaauuacaguguuuggcacccgcauccuugaugaagaggucuucgagggggacauucagcaguuccugaucaccggagaucccaaagccgcuuaugacuacugcgaacacuauagcccugacugugauucuuccgcccccaaggcugcccaagcgcaggagccgcagauugacgaauacgccccugaggauaucaucgaauaugacuacgaguacggcgaggcugaauauaaagaggccgaaagcguuacagaggggcccacggugaccgaagagacaauugcucagaccgaggccaacaucguggaugacuuucaagaauacaauuauggaacaauggagucuuaccagaccgaagccccuagacaugucuccggcacgaacgagcccaaucccguggaagagauuuucacagaggaauaucucaccggcgaggauuacgacagccagcggaagaacuccgaagauacccuguaugagaauaaggagaucgacgggcgcgauucugaccuucugguugacggagaucucggcgaauacgacuuuuacgaguauaaagaauacgaggauaagccuacaagcccgcccaacgaagaguucgggccuggagugcccgcugagaccgacauuacagaaacguccaucaauggccacggggcguauggagagaaaggccaaaagggcgaaccugccgucguggagcccgggaugcugguugaaggaccgccuggccccgcugggccugccggaaucaugggcccucccgggcugcagggccccaccggaccgccuggcgaucccggggacagaggacccccuggccggccggggcuccccggagccgauggccugccugggcccccuggcacaaugcuuaugcugcccuuucgcuacggaggcgacgggagcaaaggaccuaccauuucugcucaggaggcccaggcgcaagcuauccuccagcaggccagaauugcccugcggggcccgcccgggccuaugggacuuacaggcagacccgggccugugggcggacccggcuccagcggggcuaagggagagucuggcgauccggggccucagggaccccgcggcguccaagggccucccggccccaccggaaagccuggcaaacgggggagaccgggagccgacggcgggcgcggaaugcccggcgaaccuggcgcuaagggggaucggggauucgacggccugcccgggcucccuggagauaaaggccacagaggggagcgcggaccccagggcccuccgggcccucccggggacgacggaaugcggggcgaagauggggagaucggacccagaggccugccuggggaagccggaccccgcggccugcucggcccgcgggggacgccuggagcgcccggccagcccgggauggccggaguggacggcccucccgggccuaagggaaacaugggcccgcagggcgagcccgggccucccggacaacagggcaauccugggccccagggacugccgggcccucaggggcccauuggaccucccggcgagaaaggcccucaagggaagcccggacuugcuggccugccgggggccgauggaccucccggccaucccgggaaggaaggacagagcggcgagaaaggcgcucucgggccuccgggaccccagggcccuaucggguaucccggaccuagaggcgucaagggggccgacggagugcgcggccugaaaggcuccaagggggaaaaaggagaggauggcuuucccggguucaagggagacaugggccuuaagggggaucggggcgagguuggacaaaucggcccuagaggggaagacggaccggagggccccaaagggcgggcgggaccuaccggcgaucccgggccuucuggccaggccggagaaaagggcaaacugggggugcccggacucccgggcuacccugggcgccagggacccaagggcagcacaggguuucccggcuucccuggagcuaacggcgagaaaggggccagaggagucgcuggcaagcccgggccucggggacagagaggcccgaccggcccccgcgggucccggggagccagaggcccuacagggaaacccggaccuaagggcaccagcgggggagacggcccgcccggcccucccggggaacgcggaccucaaggcccccaggggccugugggauuucccggcccgaaggggccucccggacccccuggcaaagauggccugccggggcaccccggacagagaggcgagacgggguuccagggaaagacaggcccucccgggccuggaggcguugugggcccccaagggccuaccggagagacaggccccauuggggaacggggacauccgggcccucccgggccucccggagagcagggccugccgggcgccgcugggaaagaaggagcgaagggcgacccugggccccagggaaucucuggcaaagaugggcccgccggacuccgcggcuuuccuggcgagagagggcugcccggagcucagggcgccccugggcuuaagggaggcgaagggccgcaaggacccccuggccccgucggcuccccuggggagcggggaagcgccggcaccgcugggcccauuggacugccuggccgcccggggccccagggcccucccggaccugccggcgagaagggggcgcccggagaaaaaggcccgcaggggccugcuggaagagacggcgugcaagggcccgugggccuccccggaccugccggccccgccgggucuccuggagaggacggcgauaagggggaaaucggagagccgggccagaaaggguccaagggcgacaaaggagaaaacggcccucccgggcccccuggacugcagggccccguuggggcuccgggaauugccggcggggauggcgagccuggaccccggggccagcaagggauguucggacagaagggcgacgagggggcgcgcggauucccuggcccgcccggcccuaucgggcugcagggacuucccggcccucccggggaaaagggagagaauggcgaugucgggcccaugggaccuccgggcccucccggccccagagggccucagggacccaacggcgcugacgggccucaaggaccgcccggcagcgugggguccgugggaggcgucggcgaaaaaggggagccuggagaggccggcaaucccgggccucccggagaagccggcguugggggaccgaagggcgagcggggcgaaaaaggggaggcuggaccucccggcgccgcugggcccccuggagccaagggcccucccggggaugacggaccgaaaggcaaccccggcccugugggguuucccggagauccuggcccgcccggggaaccuggacccgcgggccaggacggggugggaggcgauaagggcgaggacggggacccuggacagcccggcccucccgggccgucuggagaggccggacccccugggcccccuggaaagcgcggcccgcccggcgcugccggggcugaaggaagacagggcgagaaaggggccaagggagaagccggcgcugaggggccucccggcaaaaccggaccugucggcccccaagggccugcgggaaagcccggcccggaagggcuccggggcauuccuggccccgugggggagcagggccugccuggagccgcuggccaggaugggcccccgggaccuaugaaacugcccguuacaacguauugcaucgugagcaccggcgagaucaagcuccccagacacuccccuuucccccaucugcuuaauacaaccuga

SEQ ID NO: 67680 - RNA, 873 nt, Artificial Sequence
  derived and/or modified sequence opt5 from COL11A2__Homo_sapiens__NP_001157243
auggagagaugcagccggugucaccgccugcuccugcuucugccccucgugcugggccuuuccgccgcuccugggugggccggagcgccgcccgucgacguucugagagcucuccgguucccuucucugcccgauggcgugcgcagagccaaggggaucugcccugccgacguggcuuaccgggucgcccgccccgcucagcugagcgccccuaccagacaacucuuuccgggaggcuuccccaaagauuuuucccugcuuacagugguucggacgcgcccugggcugcaggcgccccuccugacccuuuauucugcccagggagugagacagcugggccucgaacugggccggccuguccgcuuccuguacgaggaccaaacagggagaccccagccgccuagccagcccguguuucggggacucucccuggcugauggcaaguggcaucgcguugccguggcugucaaagggcagucugugacccuuauuguggacuguaagaaaagagucacacggccucugcccagaagcgcccgccccguucucgauacccacggagugaucauuuucggcgcgcggauccuggacgaagagguguuugaaggggauguccaagagcuugccauugugccuggaguucaggcugccuaugaguccugcgaacagaaggagcuggaaugugagggcggccagagagagcgcccgcaaaaccagcagccccaucgggcucaaagaagcccucagcagcagcccucucgccuccaccggccucaaaaucaggaaccccagucccaggugagagagcugggggaaccgccuagcgccgcccauccccgcgagggacggcacccuggcaucucucccccuuga

SEQ ID NO: 67681 - RNA, 9192 nt, Artificial Sequence
  derived and/or modified sequence opt5 from COL12A1__Homo_sapiens__NP_004361
augagaucccggcugcccccugcccucgcugcccugggcgcggcgcuucuccucuccucuaucgaagccgaaguggacccgcccagcgaucugaacuucaagauuaucgacgagaauaccguccacauguccugggccaaaccuguugaucccauugugggguaccgcaucaccguggacccuacgaccgauggccccacaaaggaauuuacccuuucugcuagcacaaccgaaacacugcucuccgaacugguuccugagaccgaguaugugguuacgauuaccucuuacgacgaaguggaggaaagcguuccggugaucggccagcugacaauccagaccggguccagcacaaaacccguugagaagaaaccuggaaagaccgagauucagaagugcucuguguccgccuggacggaucucgucuuccugguggacggcagcuggucuguggggagaaacaauuuuaaauauauccuugauuucauugcugcccuggucuccgcguuugacaucggagaagagaagacacggguuggcguggugcaguacagcucugauacccgcacagaguucaaccucaaucaguauuaccaaagagacgagcugcuugccgcuauuaaaaagauccccuauaaaggcgggaacaccaugaccggagaugccauugacuaccuggucaagaauacauuuacggaauccgcuggcgcccgggugggguucccuaagguugcgaucaucauuaccgacggaaaaagccaggaugagguggagauccccgcccgcgaacucagaaacgucggcguggaggucuuuucccuggggauuaaggcugccgacgcuaaagaacugaagcagaucgccucuacaccgagccucaaucauguguucaacgucgccaauuuugaugcuauuguggacauccagaacgagaucauuucccaagucuguagcggaguggaugaacagcugggcgagcuuguuucuggcgaggaaguggucgagccucccuccaaucugaucgcgauggaagugagcucuaaauacguuaagcucaacuggaauccuagccccucccccgugaccggguauaaagucauucugacaccuaugaccgccggaucucggcagcacgcucuuagcgugggcccgcagacgacaacccuguccgugcgcgaccucagcgccgauaccgaguaccaaaucucuguuuccgccaugaaggggaugacaagcucugaacccauuuccaucauggagaagacccagccuaugaaaguccagguggagugcagcagaggaguggacaucaaggcugauauugucuuccugguggacggcuccuauucuaucgggauugccaacuuuguuaaagugcgggcguuccuggaaguccucgugaagucuuucgagaucucccccaaccgcguucaaauuucucuggugcaguacagcagagauccucauacagaauuuacgcuuaaaaaguucaccaaggucgaggacaucauugaggcuaucaauacauuucccuaucggggaggcuccaccaacacaggcaaagccaugaccuacgugcgcgaaaagaucuucguuccgagcaaagggucuagauccaaugugccuaaggucaugauucugaucacggacggaaaaagcucugaugccuuucgggaccccgcuauuaagcucagaaacuccgauguggagaucuucgccgugggcgucaaggacgcuguucgcagcgaacuggaggccauugcgucuccucccgccgaaacccacguguuuacaguggaggauuucgacgcuuuucagcggaucagcuucgagcuuacccaguccaucugucugagaauugaacaagagcucgccgcuaucaaaaagaaagccuaugucccucccaaggaucugagcuuuucugaagugacauccuacggguucaaaaccaauuggagcccggcgggagagaacgucuuuuccuaccauauuacguauaaggaagccgcuggcgacgaugaggugacagucguggagccugccucuagcaccuccguugugcugucuagccucaagcccgaaacacuguaccuugucaaugugaccgcugaguaugaagacggguucuccaucccccuggccggcgaggaaaccacagaggagguuaaaggagccccucgcaaccucaaggugacggaugaaaccacagacucuuucaaaauuaccuggacacaggcuccgggccggguccugagauaccgcaucaucuaucggcccguggcugggggcgagagcagagaagugaccacgccucccaaucagcgccggagaacacuggagaaccuuauuccugauaccaaguacgaggucuccguuauccccgaauauuuuagcggcccugggacaccccucacaggaaaugccgcuaccgaggaagugcgcggcaacccgcgggaccugagagugucugacccuacaacguccaccaugaaacugagcuggucuggggcccccggcaaggucaaacaguaccucgugacauacaccccuguugccggaggcgagacacaagaagugaccgucagaggggauacgaccaauacagugcugcagggacuuaaggagggcacccaguaugcucuguccguuacagcccucuacgcgagcggggcuggagacgcccuguucggcgaggggaccacacuggaagaacgcggcucuccccaggaucuugugaccaaggacauuacggauacauccaucggagccuauuggaccagcgcuccgggcauggucagaggguaccggguguccuggaaaagccucuaugacgaugucgacaccggagaaaagaaccugccugaggaugccauucacacaaugaucgaaaaucugcaacccgagaccaaauacagaaucucuguguuugcgacguauagcuccggcgagggggaaccucucacaggagacgcuaccacagagcugucucaggauagcaagacccuuaaaguugacgaagagacagaaaacaccaugcgcgugacguggaagcccgcccccggcaaggucgugaacuaccggguuguguacagaccucacgggcgcggcaaacagauggucgccaaggugccgcccaccgugacauccaccguucugaaaagacuccagccucaaacaaccuaugauauuacgguccugcccaucuacaagaugggagagggcaaacugcggcaggggucuggaacaaccgcuagccgcuucaaguccccuagaaaucuuaagacaucugaccccaccaugagcuccuuucgggugaccugggagccugccccgggcgaagugaaaggguauaaggucacauuccaucccacgggagacgaucgcagacucggcgagcuggugguuggcccuuacgacaacaccgugguccuggaagaacuccgggcugggacaaccuauaaagugaauguuuuuggaauguucgauggcggggagagcucuccccuggugggacaggaaaugacaacccuuuccgacacgacagucaugccuauucugagcucuggcauggagugccucacccgcgccgaagcggauaucgugcugcugguugacggguccuggagcauuggccgggccaacuuucggaccgugcgcuccuucaucucuagaauugucgagguguuugauaucggccccaagcgggugcaaaucgcucuugcccaguacagcggcgacccgagaacagaauggcagcucaaugcucaccgcgauaaaaagucccugcugcaggccgucgccaaccucccuuauaaagggggcaauacccugacaggcauggcucuuaacuucauucggcaacagaauuuuagaacgcaggcggggaugcgcccccgggccagaaagaucggaguucugauuaccgacggcaagagccaggaugacguggaggcucccucuaaaaagcucaaagacgaggggguggaacuguucgccaucggaauuaagaacgccgaugaggucgaacugaaaaugaucgcuacagacccugaugacacccaugccuacaauguggcggauuucgagucccuuagccgcaucguugacgaucugacaauuaaccucuguaauucugugaagggccccggcgaccuggaagcuccuagcaaccucgucaucuccgagcggacccacagaucuuuucgcgugagcuggacgccgcccuccgauucuguugaccgguacaagguggaguauuacccugucagcgggggaaaaagacaagaguucuaugugucccggauggagaccagcacaguccugaaggaucuuaaacccgaaaccgaguacgugguuaauguguauucuguggucgaagacgaguacuccgagccucugaagggcacagagaaaacccuccccguuccgguggugagccugaacauuuaugaugucgggccuacaacgaugcacgugcaguggcagcccguuggaggcgccaccggguacauccuguccuacaagccugugaaggacacagagcccacccgcccuaaagaagucagacuuggacccaccgugaacgacaugcagcugacagaucucgucccgaauacggaguaugccgugaccguucaagcugugcugcaugaccucacaucugagccugucaccgugcgggaaguuacacugccccuuccccgcccucaggaucugaagcucagagacgugacccacagcacgaugaacgucuuuugggagccggugcccggcaaagugcggaaguacauuguuagauauaaaacaccugaagaggaugucaaggaaguggagguggaccgcuccgagaccucuaccagccugaaggaucuguucucccagacacuuuacaccgucagcguuucugccgugcaugacgaaggcgagucucccccugugacagcgcaagaaaccacgcggcccgucccugcuccgacaaaucugaaaaucaccgaggugacaagcgaaggguuuagaggaaccugggaucacggcgccagcgacguuucccucuaucgcaucacgugggcccccuucgggagcucugauaagauggagaccauucugaacggagacgagaauacacucguguuugaaaaccugaauccuaacaccaucuacgaggucagcauuacagcuaucuaucccgaugaauccgagucugacgaccuuauuggcagcgaacggacccugccuauccugacaacccaggcccccaaauccgggccgagaaaucuccagguguacaacgcuacgagcaauucccugacaguuaagugggauccugccucuggacgcgugcagaaauaccggauuaccuaucaacccagcaccggcgagggcaacgagcagacaaccacaaucgggggaagacaaaauuccgucgugcuucagaagcugaagcccgacacgccuuacaccaucacagugucuagccucuaucccgauggcgaagggggacgcaugaccggcagagggaaaacaaagccucugaacaccguccggaaucuccgcguuuacgacccguccacgucuacccugaacgugagaugggaucaugcggagggaaacccccggcaauauaaacuuuucuacgccccugcugccggcggccccgaagaacuggugccuauucccgggaauacaaacuaugcuauccugcgcaaucuccagccggacaccagcuacacagucaccgugguuccuguguacacggagggagauggcgggagaacauccgacaccggacggacacugaugagaggccuugcccgcaacguccagguguauaaucccaccccuaacagccuggauguucggugggaccccgccccugggcccgugcuccaguacagagucguguauucuccgguugauggaacccgcccuuccgaaagcauugugguccccggcaauacacggauggugcaccuggagagacucauccccgacacgcuguacucugucaaccuuguggcucuguauuccgacggcgaagggaauccuagcccggcgcaaggacggacccugccccgcucuggcccuagaaaccuccggguuuuuggggagacaaccaauucccugagcguggccugggaucacgcugacggacccguccagcaguaccgcauuaucuauuccccuacagugggcgaucccaucgacgaauacaccacggugccugggagacggaacaauguuauucuucagccccugcaaccggauacaccuuacaagaucaccgugauugccgucuaugaggacggcgauggaggccaucucaccgggaacggacgcacagugggccugcugcccccucagaauauccacauuagcgacgagugguacaccagauuccggguuucuugggaucccagcccguccccugugcugggguauaaaaucgucuacaagcccgugggaucuaacgaacccauggaggccuuugucggcgaaaugacaagcuauacgcuucauaaucugaacccuuccaccacauacgacgugaacguuuaugcucaguacgauucugggcugagcgugccccucaccgaccaaggcacaacccuguaccuuaaugucacggaucugaagaccuaucagaucggaugggacacauucugcgugaaaugguccccucaccgcgccgcgaccucuuacagacucaagcugagcccggcugacggcacacgggggcaggagauuaccguuagaggauccgaaacaagccacuguuucaccggccugucucccgauacggacuauggggugacagucuuugugcagaccccuaaccucgagggacccggcguguccguuaaagagcauaccacagucaagccuacggaagcccccaccgagccuccgacacccccucccccucccaccaucccgccugcccgcgaugugugcaaaggggcuaaggccgacauuguguuccuuacagaugcgagcuggucuaucggcgacgauaauuuuaacaaagucgugaaguucauuuuuaauaccguuggaggcuucgacgaaaucucccccgccgggauucaagugagcuuuguccaguacuccgaugaggugaagucugaguucaaacugaacacauauaaugacaaggcucuggcccucggagcucugcagaacauccgguacagaggcgggaauacccgcacgggaaaagcccuuaccuuuaucaaggagaaaguucugacaugggagagcggcaugcggaagaacgugcccaagguccucgugguugugaccgauggcagaucccaggacgaagucaaaaaggcugcccuggugauucaacagagcggguucucuguguuugucguuggaguggcggacguggauuauaaugagcuggccaacaucgcuuccaaaccuagcgaacgccacgucuucauuguggacgauuuugagucuuucgagaagaucgaagacaaucucauuacauucguuugugagaccgccacgagcuccugcccccuuaucuaccuggauggcuacacaucuccuggguuuaaaaugcuggaggcuuauaaccucaccgagaagaauuucgccagcgugcagggagucucccuggaaucuggcagcuuuccguccuacagcgccuaucggauccagaagaacgcuuucgugaaccaacccacagcggaccuucauccuaaugggcugcccccuucuuacaccauuauccuccuguuuagacugcuccccgagacgccguccgauccuuucgccauuuggcagaucaccgaccgcgauuauaaaccccagguuggagugauugcugacccuagcuccaagacacuuagcuuuuucaacaaagauacccggggcgagguccaaacagugaccuuugacacagaagaggucaagacccuguucuacggcagcuuucacaaagugcauaucguugugacguccaagucugucaagaucuauauugauuguuacgaaaucauugagaaagacaucaaggaagccgggaauauuacaaccgacggauacgagauccugggcaaacuccugaagggggagagaaaaagcgccgcuuuccagauucaguccuuugauaucgugugcagccccguuuggaccucucgcgaccggugcugugauaucccguccagacgcgacgaaggaaagugcccugccuuccccaacagcuguacaugcacccaggauucugugggacccccugggcccccuggaccggcgggcggccccggggccaaaggaccuagaggcgagcgggggauuuccggagcuaucggacccccugggccccgcggagacauuggcccuccgggcccccaagggccucccggaccucagggccccaaugggcuuagcaucccgggagaacagggcagacaggggaugaagggagaugccggcgagccuggccugcccgggcggacaggaacgcccggccucccugggcccccuggaccgaugggacccccuggggacagaggauucaccggcaaggauggcgcuauggggccccggggaccucccggcccgccugggucucccggauccccuggcgucacagggcccagcggaaaaccuggcaagcccggcgaccacgggcgcccgggacccucuggccugaaaggggaaaagggagauagaggcgacauugccagccaaaacaugaugcgggcgguggcccgccaggugugugagcagcugaucuccgggcagaugaauagauuuaaccaaaugcucaaucagaucccuaacgauuaucagagcucccggaaucagcccggcccuccgggacccccuggacccccugggucugcuggagcccgcggcgagcccgggccuggaggcagacccggguucccgggcaccccuggaaugcaaggacccccuggggaacggggacuucccggcgagaaaggggaacgcggaacaggcagcuccgggccgagaggccugccuggaccgcccggcccucagggggagucucggaccggacccccuggcagcacggggucccgcggaccgcccggcccucccgggagaccuggcaacucuggcauucggggcccucccgggccucccggauacugcgacagcucccagugugcuagcauccccuauaauggccaaggguaccccggaucuggcuga

SEQ ID NO: 67682 - RNA, 2154 nt, Artificial Sequence
  derived and/or modified sequence opt5 from COL13A1__Homo_sapiens__NP_001123575
augguggccgagagaacccacaaggcugccgcgacaggcgcucgggggcccggagaacugggcgccccugggacggucgcccucguugcugcccgcgcugagagaggagcccggcugccgagccccggcuccugcgggcuucugacccucgcgcuguguucucuugcccugagccuccuggcucauuuccgcacagccgaacugcaggcuagagugcuccggcuggaggccgaacgcggagagcaacagauggagaccgcgauccuuggcagagugaaccagcugcucgacgaaaaauggaagcugcacucccggcgcagacgggaggccccuaaaacaucucccggcugcaauuguccucccgggccuccgggacccaccggccgcccugggcuucccggagauaagggcgcuauugggaugccuggaagagucggcagccccggcgacgccgggcuguccaucauuggaccgcggggcccucccgggcagccuggaacacgcggcuuucccggguuccccggaccuaucggccucgauggcaaaccggggcaucccggaccuaagggcgacauggggcugaccggacccccuggccaacccgggccgcagggccagaagggagaaaaaggccagugcggggaguacccucacagagagugucugucuagcaugcccgcugcccuccgguccagccaaauuaucgcccugaaacuucugccucuccugaacucugugagacuugcucccccucccguuaucaagcgccggacguuucagggagaacagucccaggcgagcauucaaggcccgccugggccucccggacccccgggccccucugggccucugggccaucccggacucccuggccccauggggccucccggacugccgggcccucccgggccuaagggagaucccggcauccagggguaucacggcagaaaaggagagcgcggcaugccggggaugccuggaaagcacggcgccaagggggcucccggaauugccguggccggcaugaaaggggaaccuggcauccccggaaccaagggcgagaaaggggcugaaggaucccccggccugccugggcuccugggacagaagggcgagaaaggcgacgccgggaauagcauuggaggcgggcggggagagccggggcccccuggccuucccggaccucccggcccuaagggcgaagcgggggucgauggacaagugggcccgcccgggcagccuggagacaaaggcgagagaggggcugccggagaacagggccccgauggcccuaaggggucuaagggagagcccggcaaaggggaaaugguugacuacaacggaaauaucaacgaggcccugcaggagauucgcacacucgcucugaugggcccgccugggcuucccggacaaaucgggcccccuggcgcccccggcaucccuggacagaagggcgaaauugggcugccgggacccccuggccaugauggggagaaaggaccccggggcaagccuggcgacauggggcccccgggaccucaggggcccccuggcaaagauggacccccuggcgugaagggggaaaauggacaccccggcuccccgggcgagaagggggaaaaaggagagaccggccaggcugggagcccuggagagaagggcgaagccggggagaaaggaaaccccggcgcggaaguccccggccucccugggccggagggacccccugggcccccuggccugcaaggagugcccggcccuaagggggaggccggccuggacggagcuaaaggcgaaaagggguuccagggagagaagggcgacagagggccgcucggacugcccggcgccuccgggcuugauggccgcccuggacccccuggcacacccgggccgaucggagugccuggccccgcugggcccaaaggagaacggggcucuaagggggacccuggcaugaccggacccacgggcgccgcggggcugccuggacuccauggcccgcccggggauaaaggaaauagaggcgagcgcggcaagaaagggagccggggaccuaagggcgacaagggggaucagggagcccccggccuggacgcuccuugcccccugggggaagauggacuuccgguccagggcuguuggaacaaauga

SEQ ID NO: 67683 - RNA, 5343 nt, Artificial Sequence
  derived and/or modified sequence opt5 from COL14A1__Homo_sapiens__XP_005251116
augaagaucuuccagagaaagaugcgguacuggcuccugcccccuuuccuggccaucguguauuucugcaccaucguccagggccagguugcuccgcccacacgccuuagauacaacgugauuagccacgacuccauccagauuucuuggaaggccccucgggggaaauuuggcggcuauaagcugcucgugacgcccaccagcgggggcaaaaccaaucagcugaaccuucaaaauaccgcgacaaaggcuaucauccagggccugaugccugaucagaacuacaccguccagauuaucgccuauaauaaggacaaagaguccaagcccgcccaagggcaguuccgcauuaaagaucucgagaagagaaaagacccuaagccccgggugaagguuguggaucgcggaaacggcucuagacccagcuccccugaggaagucaaauuugugugucagacacccgcuaucgccgacauuguuauccugguggauggcucuuggagcauugggcgguucaauuuucgccuggucagacauuuccucgagaaccuggugaccgcuuuugacgugggauccgaaaagacgcggaucggccuugcccaguacagcggggauccucgcaucgaguggcaccugaaugcguucucuaccaaagacgaggucauugaagccguuagaaaccuccccuauaagggaggcaauacacugaccgggcuugcucugaacuacaucuuugaaaauagcuucaaaccggaagccggaagccggacaggcgugucuaagauuggcauccucauuaccgaugggaaaucccaagacgauaucaucccucccagccgcaaccugagagagucuggaguggagcuguuugcuauuggcgucaagaaugccgacgugaacgaacuccaggagaucgcguccgaaccugacagcacgcauguuuacaacguggccgaguucgaucugaugcacacagucguggaaucccuuacccggacacugugcucuagaguugaggagcaggaccgcgaaauuaaggcuagcgcccaugcuaucaccgggccgcccaccgagcucauuacauccgaagugacggcccggagcuucauggucaauuggacccacgccccuggaaacguggagaaauauagagucguguacuauccgacacgcggcgggaagcccgaugaaguuguggucgacggaaccgugucuuccacaguucugaaaaaucuuaugagccugaccgaguaccaaaucgcuguguuugcgaucuaugcccacacggcuucugagggccuccggggcacagaaaccacccuggcccugccuauggccagcgaucuccugcuuuacgacgucacagagaacuccaugagagugaagugggaugcugugcccggggccucuggauaucugauucucuacgcgccucugaccgaaggccuugcuggggacgagaaagaaaugaagaucggagagacacauacggauauugagcugagcggccuccugcccaauaccgaauacacaguuaccgucuaugccauguucggggaggaagccuccgacccggugacaggccaggagaccacgcuggcucucagcccuccccgcaaccugcggaucucuaaugugggauccaacagcgccagacuuaccugggauccuacaucucgccagauuaauggcuaccggaucgucuauaacaaugcugacgggaccgagauuaacgaaguggagguugaccccaucacaaccuuuccucugaagggacucacgccccugacagaauacaccaucgccauuuucuccaucuaugaugagggccagagcgaaccgcugacagggguguuuaccaccgaggaggucccugcgcaacaguaccuugaaauugacgaggugacaacggauuccuucagaguuaccuggcacccccucucugccgacgaaggacugcauaaacugauguggauccccguguauggcgggaagacagaggaagucgugcucaaagaggagcaggauagccacguuauugaaggccuggagccuggaaccgaauacgaggugucccuucuggcuguccucgacgauggcucugaaagcgagguggugacagccgucgggaccacgcuggacuccuuuuggacagagccggcuaccaccaucguucccacaaccagcgugacaucuguguuccagacgggaauccgcaaucuggucgugggcgaugaaaccacauccagccuucggguuaagugggacauuucugauuccgacgugcaacaguuuagagucaccuacaugacagcccagggggauccugaggaagaggugaucggaaccguuauggugcccggcagccagaacaaucuccugcugaaaccucuccugcccgacacggaguauaaggucaccgugacaccuauuuacaccgacggggaaggcguuucugugagcgcgcccggaaagacacuuccguccagcggcccucaaaaccugcgggucucugaggaaugguauaaccgccucagaaucaccugggaucccccuuccagccccgugaaaggguaccggauuguguauaagccggucuccguuccuggacccacacuggagaccuucgugggcgccgacaucaauacgauccugauuacaaaccuucucucugggauggauuacaaugugaaaaucuuugcuagccaggccuccggauucucugacgcucugaccggcauggucaagacccuguuucucggggugacaaaccugcaggccaaacacguugaaaugaccagccuuugugcccauuggcaagugcacagacaugcuacggcguaucgcgucgugauugagucccugcaagaucggcagaagcaggagucuacaguuggcggaggcaccacaagacacugcuucuacgggcuccaaccugacagcgaauacaagaucuccguguauaccaaacugcaggagauugaaggacccagcgucucuaucauggagaagacacagucccugcccacccgcccuccgacguuucccccuaccauucccccugccaaagaaguguguaaggcugccaaagccgaucuugucuuuaugguggacggcagcuggucuauuggggaugagaauuucaacaagaucauuuccuuucucuacagcacaguuggagcucugaauaaaaucggcaccgacggcacacagguggccaugguccaauucaccgaugaccccagaacggaguuuaagcugaacgcguauaagacaaaagaaacccuccuggaugcuauuaagcauaucucuuacaaagggggaaauacaaagaccggcaaagccauuaaguaugugcgggacacccuuuucacagccgaguccgggacgcgcagaggaaucccuaagguuaucguggucauuaccgacggccggagccaggaugacgugaacaaaaucucccgcgaaaugcagcuggauggguacagcauuuuugcuaucggaguggccgacgcggauuauucugagcucguuagcauuggcuccaagccgucugcuagacacgucuucuuuguggacgauuucgacgccuuuaaaaagaucgaagaugagcugaucacauucgugugcgagaccgccagcgcuacaugucccgucgugcacaaagacggcauugaucuggccggguuuaagaugauggaaauguucggacuuguugagaaggacuucuccucuguggaaggcgucagcauggagccugggaccuuuaauguguuccccugcuaccagcugcauaaagacgcucucguuucccaaccuacgcgguaccugcaccccgagggacucccgucugauuauacaaucagcuuucuguuccgcauucuuccugacacaccccaggaacccuuugcccugugggagauccucaacaaaaauuccgauccucuggugggcgucauucuggacaacgggggaaaaacccuuacauacuucaauuaugaucagagcggcgacuuucagaccgugacauucgaaggccccgagaucagaaagaucuuuuacgggucuuuccauaaacugcacauuguuguguccgaaacgcucgucaagguggugaucgauuguaagcaagucggagagaaagcgaugaacgccagcgcuaacauuaccucugacggcguugaggugcuggggaagauggugcggucccgcggaccuggcgggaauagcgccccguuucagcuccagauguucgauaucgucugcuccacaucuugggcuaacaccgacaaauguugcgaacugcccggacuuagagaugacgagagcugcccugaucugccccacuccuguagcugcucugaaacaaaugagguggcccucggcccugccggcccucccgggggccccggccugcgggggcccaagggacaacagggcgaaccugggcccaaaggaccugacggccccagaggcgagauugggcugccgggaccucagggaccgcccgggccucagggaccguccggccuuagcauccaagggaugcccggaaugccuggcgagaagggcgaaaaaggggacaccggacugcccggcccucaggggauucccggaggcguugggucuccuggacgcgauggcagcccgggccagcgggggcuccccggaaaggacggcuccucugggccucccggaccucccggcccgaucgggaucccuggcacgcccggagugcccggcauuaccgggagcaugggaccucagggcgcucuggggcccccuggagucccgggcgcgaagggggagagaggcgaacgcggagaucuccaaucccaggccauggugcggucuguugcuagacaggugugugagcagcugauccaaagccauauggcccgcuauacagccauucuuaaccagauccccucccacuccucuuccauucggaccguccagggcccucccggggaaccuggaagacccggcagcccgggggcuccuggagagcagggacccccugggacacccggcuucccuggaaaugccggcgugcccgggaccccgggagagcgcggccugacagggaucaaaggagaaaagggcaacccuggcgucgggacgcaaggaccccggggacccccugggccggcgggacccuccggcgagucuagaccugggagccccggaccucccggcuccccuggcccccgggggccgccuggacaucugggcgugcccgggccucagggacccucuggccagccgggguacugcgacccuagcuccuguagcgcuuauggaguucgcgaucucauccccuacaaugacuaccaacacuga

SEQ ID NO: 67684 - RNA, 4167 nt, Artificial Sequence
  derived and/or modified sequence opt5 from COL15A1__Homo_sapiens__XP_011516516
auggcccccagacggaacaauggccagugcuggugucugcucaugcugcuuagcguguccaccccucugccggcugucacacaaacgcgcggggccaccgagacagcgucucagggacaccucgaccugacccagcuuaucggcguuccccugccuagcuccgugucuuucgugacaggguacggaggcuuucccgcuuauagcuucgggccuggagccaacgucggcagacccgcccggacccucauuccuuccacauuuuuccgcgauuuugcuaucucugugguugugaagccgagcuccaccagaggcgggguccuguucgccauuacggacgcuuuucagaaagugaucuaccugggacuccggcugagcggcguugaagaugggcaucaacgcauuauccuuuauuacaccgagcccggaucucacgugucccaggaagccgcggccuucagcgucccugugaugacacauagauggaaucgguuugcuaugaucgugcagggcgaggaagucacccugcucguuaacugcgaggagcacucucgcauucccuuccagagauccagccaagcccuggcuuuugaaucuuccgccgggaucuucaugggaaaugcgggcgccacaggccuugagcgguuuaccgggagccugcagcagcucacggugcauccugacccccgcacaccggaggagcugugugauccugaggaauccucugcuagcggagagaccuccggccugcaggaagccgacgggguggcugagauucucgaagccgucacauauacccaagccagccccaaggaggcuaaaguggagccuaucaacaccccucccacacccucuuccccguucgaagauauggagcugagcggagaacccguuccugagggcacgcuugaaaccacaaauaugucuauuauccagcacagcucccccaagcaggggucuggagagauucugaacgacacccucgagggcgugcacagcgucgauggcgacccuaucacagauuccgggagcggagcgggcgccuuccuggacaucgcugaagagaaaaaucuugccgccaccgcugccgggcuggcggaagugcccauuucuacggcuggagaggccgaagccuccagcguuccgacaggcgggccuacccucucuauguccaccgagaaccccgaggaaggcgugacaccuggacccgauaaugaggaaagacuggcugccaccgcugccggcgaggcggaggcccuggcuagcaugccuggggaagucgaggccuccggaguggcucccggcgaacucgaccugucuaugagcgcccaaucccuuggggaggaagcgacagucggaccgucuagcgaggacucccugacgaccgccgcugccgcuacagaggugagccucucuaccuuugaagaugaggaagccuccggcguuccuacagacgggcuggcuccccuuaccgccacgauggcgcccgagcgggccgugaccagcggcccuggagaugaagaggaccuggcugccgccacaaccgaggaaccgcucaucacagcuggcggggaggaaucuggaagcccuccucccgauggcccuccccugccccugcccaccgucgccccggagcgcuggauuacgccugcgcagagagaacauguggggaugaagggacaggcuggccccaagggggagaaaggcgacgccggagaggaacucccuggcccgcccgagccuuccgggcccguuggaccuacagccggcgcugaagccgaggggucuggacugggcugggggagcgaugugggcuccggaagcggcgaccuugucgggucugagcagcugcuccggggaccucccggcccgcccgggcccccuggacugcccggcaucccuggcaagcccgggaccgauguguucaugggaccuccgggcucccccggggaagacggaccugcgggcgagcccgggccucccggaccggaaggccaaccuggcguggauggggcuacaggacugcccggcaugaaaggggagaagggagccagaggccccaacgggagcguuggagaaaaaggcgacccuggcaaucgcgggcuucccggaccuccgggcaagaaggggcaggccggacccccuggcgucauggggcccccuggacccccgggcccucccggcccucccgggccuggaugcaccaugggccucggguuugaggacaccgagggauccggcucuacacagcugcugaacgaacccaaacucagccggccgacggcugccauugggcugaagggagagaaaggcgauagaggcccuaagggggaacgcggaauggacggcgcuuccaucguggggccucccggaccccggggcccgcccgggcacaucaaagugcuuucuaauagccugauuaacaucacccauggauucaugaacuuuuccgauauuccugagcucgucggcccucccggccccgacgggcugccuggacugccgggcuuccccgggccuagaggacccaagggcgauacagggcuuccuggauuucccggccucaaaggcgaacagggggagaagggagagccgggcgccauccugaccgaagacauuccucuggagcgccucauggggaagaaaggagaacccggcaugcacggggcgcccggcccuaugggacccaagggcccuccggggcacaaaggagaguucggccugcccgggcggccuggaagacccggccuuaaugggcugaagggcacaaaaggagauccuggcgugaucaugcaagggcccccgggacucccuggcccucccgggcccccuggacccccgggcgccguuaucaacauuaagggggcuaucuuuccuauucccgugcgcccccauuguaagaugccugucgacaccgcccacccgggcucucccgaacugaucacguuccauggagugaaaggcgagaaggggagcuggggacugccuggcuccaaaggggagaagggagaucagggcgcucagggcccucccgggcccccucuugaccucgccuaccugcggcacuuucugaauaaccucaaaggagaaaauggcgauaagggguucaagggagagaaaggcgaaaagggggacauuaacggcagcuuucugaugucuggcccgcccggccuuccugggaaucccggaccugccggccagaaaggggagacaguugugggaccccaaggcccgccuggggcucccggacugcccggcccucccggcuucgggagaccuggagauccgggacccccugggcccccuggacccccuggcccgcccgcgauccucggggccgcugucgcccugccuggacccccugggcccccgggccagccuggccugcccggaucccgcaaccuugugaccgccuucagcaauauggacgacaugcuccagaaggcucaucugguuauugagggcaccuuuaucuaucugcgggauucuacagaguucuuuaucagagugcgggacggguggaaaaagcuccagcugggagaacuuauucccaucccugccgauagcccucccccgcccgcgcuguccucuaacccucaccaacuccugcccccucccaauccgauuuccagcgcuaacuacgaaaagccugcccugcaccuugccgcucugaauaugcccuucuccggcgacauccgcgccgauuuucagugcuucaaacaggcgagagcugccgggcuccugagcaccuaccgggccuuucucucuagccaucugcaagaccuuuccacaauugucagaaaggcugagcgcuauucucugccuaucgugaaccucaaaggacaggugcuguucaauaacugggauagcaucuuuuccggccacggcgggcaguucaacaugcauauucccaucuacucuuuugacggacgggauauuaugacggacccgagcuggccucagaaggucaucuggcacggcuccucuccccacgggguuagacugguggauaauuauugugaagccuggcgcaccgcugacacagccgugaccggacuugcgagcccccuguccacaggcaaaauucucgaucaaaaggccuacagcugcgcuaacagacugaucguccucuguaucgaaaauucuuucaugaccgacgcccggaaauga

SEQ ID NO: 67685 - RNA, 4692 nt, Artificial Sequence
  derived and/or modified sequence opt5 from COL16A1__Homo_sapiens__XP_011539026
augugggugagcugggcccccggccuguggcuccuggggcuuugggcuaccuucggacacggcgccaacacaggggcgcagugcccuccgucccaacaggagggacugaagcucgaacauucuagcucccugcccgcuaaugucacgggcuuuaaccuuauccacagacugucucucaugaaaaccagcgccauuaagaaaauccggaauccuaaggggccccugauucugcgccucggagccgcuccuguuacacagcccaccagacggguguucccucgcggccugccggaggaauuugcccuugugcugacacuccugcuuaaaaagcauacccaccagaagacaugguaccuguuccaagucaccgacgcuaacggcuauccccagaucucccucgagguuaauucucaggaaagaagccuggagcugcgggcccaggggcaagauggagacuuuguguccuguauuuucccugugccccagcucuuugaucugcgcuggcauaaacuuaugcugagcgucgcgggcagaguggccucuguucacguggacugcuccagcgcuucuucccagccucucgggccccggcgcccgaugagaccugucggacacguguuccugggccuugaugccgagcaggggaagcccgugagcuuugaccugcaacagguccauaucuacugugauccugaacucguucuggaggaaggaugcugugagauccugcccgcuggcugucccccugagacgucuaaagcccggcgcgacacccaguccaacgaacucauugagaucaauccgcaaagcgaaggcaagguguauacaagaugcuucugccuggaggaaccccagaacuccgagguggaugcgcagcuuaccgggcggauuucucagaaagccgagcgcggagcuaagguccaccaagaaacagccgcugacgaguguccucccugcgugcauggcgccagagauagcaauguuacccuggccccuuccgggcccaagggaggcaaaggggaacggggacucccgggcccucccggcagcaagggggagaaaggagcuagaggcaacgacugugugcgcaucucuccugaugcgccccugcagugcgccgaagggccuaagggagagaaaggcgaguccggggcucuuggccccagcggacugccgggcucuacgggggaaaagggacagaaaggcgagaagggggacggaggcauuaagggggucccuggcaaacccggacgggacggcagacccggggaaaucugcgugauuggaccuaagggccagaaaggggauccgggauuuguuggccccgaggggcucgccggcgaaccuggacccccuggccugcccgggccucccggaaucggccugccggggacaccuggagaccccggcgggccucccggcccgaagggagauaaaggcagcuccgggaucccuggaaaggagggccccgggggaaagccuggcaaacccggcgugaagggggagaaaggagaccccugugaagucugcccuacccucccggagggcuuccaaaauuuuguggggcugcccggaaagccuggccccaaaggggaaccuggagaucccgucccugcccgcggcgacccgggcauucaggggaucaagggagagaagggcgagcccugucuuucuugcagcuccgugguuggggcucagcaccuggugagcucuacaggagccuccggcgaugucgggagcccuggauucggccuccccggccugccugggcgggcgggagugcccggccugaaaggggaaaagggaaacuucggcgaggcugggccggccggaucuccuggcccucccggccccguugggcccgccggaauuaaaggcgcuaagggggaaccuugugagccgugccccgcccuuuccaaucuccaggacggagaugugagagucguggcucugccuggccccagcggggaaaaaggagagccuggacccccgggcuuugggcugccuggaaagcaaggcaaggccggggagcgcggacucaaaggccagaagggggacgcgggaaaccccggcgauccuggcacccccgggaccacaggacggccuggccuguccggggaacccggagugcagggcccggccgggccuaaaggagagaagggccagcccggccuucccgggguucaaggaccuccgggccugaaagggguccagggagaacccggcccucccgggagaggcgugcagggaccucaaggcgagcccggggcuccuggacucccgggcauccaggggcugcccggaccucgcgggcccccuggccccacgggcgaaaagggagcccagggcucuccgggggugaaaggagcuaccggcccugucgggccucccggagccagcguguccggcccucccgggcgggacggccagcaaggacagacaggccugagagggacccccggagagaagggcccgcgcggggagaagggagaacccggcgaguguucuugcccuagccagggcgaccuuauuuucuccgggaugcccggagcgccuggccucuggauggggagcucuuggcagcccggaccgcaaggcccucccgggaucccuggacccccugggcccccgggcguuccuggccugcagggagugcccggcaauaacgggcugcccggacagccuggccucacagccgaacuggggucccuuccgaucgagcagcaucugcucaaaagcauuuguggagauugcguccaaggccagcgggcucaccccggcuaccugguggaaaagggggagaaaggagaccagggcaucccugggguucccggacuggauaacugugcccaaugcuuucuuucucucgagagaccucgggcugaagaggcccgcggcgacaauuccgaaggggaucccggaugcgugggcagcccuggccugcccgggccgccuggacugcccggccagagaggggaggagggaccucccggcaugcgggggucuccgggaccucccggccccauuggcccucccggguucccuggagccgucggcagcccggggcuccccggacugcagggcgaaagagggcuuaccggacugacgggcgacaagggcgagccugggcccccuggacagcccggcuauccuggggcuacaggaccgcccggccucccugggaucaaaggagaacgcggcuacaccggcuccgcgggggagaagggagaacccggcccucccgggagcgagggacugccgggcccucccgggcccgccggcccucggggagagagaggcccccaagggaacucuggagaaaagggcgaucagggguuucagggacagccuggcuucccggggcccccuggacccccuggcuuucccggcaaagugggguccccgggaccucccggcccucaagcugagaaggggagcgaaggcauucgcggccccuccgggcugccgggcucuccuggaccucccggcccucccgggauccagggacccgccggccuugacgggcucgauggaaaagacggcaagccggggcugagaggcgaucccggaccugccgggcccccuggccugaugggacccccuggcuucaaagggaagaccggacacccgggccuccccggcccuaagggggacuguggaaaacccggcccucccgggagcacaggacggccgggcgcugagggggaaccuggagccaugggcccccagggccgccccgggccucccggacauguuggcccuccggggcccccuggacagcccggcccugcggggaucuccgcugugggacugaagggcgauagaggcgccaccggggagcggggacuugccggccugcccgggcaaccgggaccucccggccacccugggcccccuggagagcccggcacagacggcgcugccgggaaagaaggaccgcccggcaagcagggguuuuauggaccucccggcccuaaaggggacccgggagcggcuggccagaagggccaggccggggagaagggacgcgccggcaugcccgggggaccuggcaaaucugggagcaugggacccgucggcccucccggcccugcuggggaaagaggacaucccggcgccccggggccuuccggaucucccggccucccuggggugcccggaagcaugggcgauauggugaauuacgacgagauuaagcgguucauccgccaagaaauuaucaaaauguuugaugagagaauggcuuacuauacgucccggaugcaguucccgauggagauggccgcggccccuggccgccccgggcccccuggaaaggacggcgcucccgggagaccuggagccccgggcagccccgggcugccuggccagauuggacgggaaggcagacaagggcugcccggaguccgcggccuuccugggaccaaaggagagaagggcgauaucgggauuggcaucgcuggagaaaacggccugcccgggccgccuggaccccagggcccucccggguacggaaaaaugggcgccacagggccuaugggccagcagggaauccccggcauuccggggcccccuggacccaugggccaaccugggaaggccggacacugcaaucccucugacuguuuuggcgcuaugccuauggagcagcaguauccgcccaugaagaccaugaaagggccuuucggcuga

SEQ ID NO: 67686 - RNA, 4494 nt, Artificial Sequence
  derived and/or modified sequence opt5 from COL17A1__Homo_sapiens__NP_000485
auggacgugaccaagaaaaacaagagagauggcacagaggucacggaacggaucguuaccgagacagugaccacacgccugaccagccugcccccuaaagggggaacauccaauggcuacgccaagaccgcuucucucgggggaggcagcagacuugaaaaacagucccugacgcacgggucuagcggauauauuaacuccaccggcucuacacggggccaugccagcaccuccagcuaccgcagagcgcacucuccggcuuccacacuccccaauagcccugggucuaccuucgagcggaagacgcaugugacacgccacgccuaugaaggauccagcucuggcaacuccagccccgaguacccuagaaaggaguuugccuccucuagcacccgggggcgcucccaaacaagagaaagcgagauccggguccgccugcagucugcuucccccagcaccagauggaccgaacuugacgaugugaaacggcugcucaagggaucucgcagcgccuccguuucuccuacaagaaauagcuccaacacgcugccgauucccaaaaagggcaccguggagacaaaaaucgucaccgcuagcucucaguccgugagcgggacauaugacgccaccauucuggaugcgaaucucccuucucauguuugguccagcacgcugcccgccggauccucuaugggcacauaccacaacaauaugaccacccagagcuccucucuucugaacacaaaugcuuauagcgccggcuccguguucggggucccuaacaauauggcuagcugcucucccacccuccacccgggacuguccacaucuagcuccguguuuggcaugcaaaacaaucuugccccuagccugacgacccucucucaugggacaaccacaaccagcacggcguacggagugaagaagaacaugccccaguccccugccgcugucaacaccggcguuagcacaucugccgcuuguaccacauccgugcagagcgacgaucugcugcacaaagacugcaaguuccucauccuggagaaagauaauacccccgccaagaaagaaauggagcuucugaucaugacgaaggacuccgggaaaguguuuacagccucucccgcuagcauugcggccaccuccuucucugaagauacacucaagaaggagaaacaggcugccuacaacgccgacagcggacugaaggcugaagccaauggcgaucuuaaaaccgucuccaccaagggcaaaacaacgaccgcggacauccauucuuaugggagcuccggaggcgggggaagcggcgggggcggaggcguugggggagcuggcgggggaccuuggggcccggcccccgccugguguccuugcgggucuuguugcuccugguggaaguggcugcucggccugcugcucacauggcugcuucugcucggacugcuuuuuggccugauugcucucgccgaggaggugcggaagcugaaagcuagaguggacgaacuggagcgcauccggagaagcauucuccccuacggggauucuauggaccgcaucgaaaaggaucggcugcaaggaauggccccugcggccggcgcugaccuugauaaaauugggcugcacuccgacagccaggaggaacucuggauguucgucagaaagaaacugaugauggagcaggagaacggaaaucugcgcggcucucccgggccgaagggcgauaugggauccccuggccccaagggggaccggggauuuccuggcacccccgggaucccuggaccccuuggccacccggggccucagggccccaaaggacaaaagggcagcgugggggaucccggaauggaaggcccuauggggcagagaggacgcgagggcccgaugggccccagaggggaagccggaccucccggcuccggggagaaaggagaaagaggcgcugccggggagccuggaccccauggcccucccggcguuccggggagcgugggaccuaagggcucuagcgggucccccggaccucaggggcccccgggcccugucggacuccaaggccugcgcggcgagguggggcugcccggagucaaaggcgacaaggggccuaugggaccucccggccccaagggggaucagggagaaaaaggcccgcggggccucacaggggagcccggaaugagaggccugccuggggcggugggagaacccggcgccaagggggcuaugggaccugccggccccgacggccaccaggggccucggggagagcagggccuuaccgggaugccgggaauccgcgggcccccuggccccucuggagacccuggcaaacccggccugacggggccgcaaggaccucagggccuccccgggacacccggaagaccuggcauuaagggggagcccggagcuccuggcaaaaucguuaccagcgaaggcuccucuaugcugaccgugccggggcccccuggacccccuggcgccauggggcccccgggaccucccggcgccccugggcccgcuggcccugcgggacugcccggccaucaggagguccuuaaccuccaggggccgccuggaccucccggcccccgggggccgcccggaccuagcauucccggcccucccgggccuagaggcccgcccggagaaggccugccugggcccccuggacccccgggcuccuuccugucuaauagcgagacauuucucuccgggccucccggacccccugggcccccuggcccgaagggcgaucaaggacccccuggcccccgcgggcaccagggagaacagggccugccuggguucagcaccucuggauccagcucuuuuggccuuaaccugcaggggcccccgggcccucccggaccucaaggccccaaaggggacaagggagauccuggcgugcccggggcccucggaaucccguccggcccuagcgagggcggguccucuagcacaauguauguuuccggaccucccggcccgcccgggcccccuggacccccuggcagcauuucuuccagcgggcaggagauccagcaguacaucucugaauauaugcaaagcgacuccauucggucuuaccugagcggagugcaggggcccccuggacccccgggcccucccggcccugucacgaccaucacaggcgagaccuucgauuauuccgaacuggcuucucauguggugagcuaccuuagaacauccggguacggaguuagccucuucucuuccagcauuuccucugaggacauccuggccguccugcagcgcgaugacgugagacaauaucuccggcaguaccugaugggcccccgcgggccgccuggaccucccggcgccagcggcgaugggucccuucugucucucgacuaugcugaacugagcucccggauucugagcuacaugucuuccagcggaaucucuaucggccuucccgggcccccuggaccgcccggccucccugggaccuccuaugaggagcugcugagccuccugcggggaucugaauuucgcggcauugugggcccucccgggcccccuggaccgcccggcaucccugggaaugucuggagcuccauuucuguggaggaucuuagcuccuaccugcacacggccggacucagcuucauccccggcccucccgggccgccuggaccucccggccccagagggcccccuggcguuuccggagcgcuggcuaccuaugccgccgaaaacucugacagcuuucgguccgagcugauuucuuaccuuacaagcccggaugugcgcuccuucaucgucggcccucccgggcccccuggaccccagggcccgccuggggacucuagacugcucagcaccgacgcuucccacagccggggaucuuccucuagcucccauucuagcuccgugcgcagaggcagcuccuacagcucuagcauguccacaggcgggggaggcgccgggucucugggagcgggcggggcuuuuggcgaagccgccggagaucggggccccuaugggaccgacauuggaccuggcgggggauacggcgcugccgcugaagggggcauguaugccggaaauggcgggcuccugggagcggauuucgccggcgaccuugauuacaacgagcuggcuguuagagugagcgaguccaugcagcgccaagggcuccugcagggaauggccuauacaguccaggggcccccgggccagccuggcccccaaggacccccuggcaucucuaagguguuuagcgcuuacuccaauguuaccgccgaccugauggauuucuuucagacguauggggccauccagggacccccuggccagaaaggggagaugggaacaccgggccccaagggggaccggggcccugcuggacccccuggccaccccgggccuccgggacccagaggccauaaaggggaaaagggagauaaaggcgaccaaguguacgcgggccgccggagacgccggucuauugccgucaagccuuga

SEQ ID NO: 67687 - RNA, 4551 nt, Artificial Sequence
  derived and/or modified sequence opt5 from COL18A1__Homo_sapiens__NP_085059
auggcccccuacccuugcggcugucacauccugcuccugcuuuucugcugucuggcugccgcgagagcuaaccuccugaaucuuaacuggcugugguuuaauaacgaggacaccagccaugccgccacaacgauuccggaaccccaggggccucuccccgugcagccuaccgcugauacaaccacacacgucacaccccggaauggauccaccgagccugccaccgcuccgggcucucccgaaccucccagcgagcugcuggaagacgggcaggauacgccuaccuccgccgagucucccgacgcgccggaggaaaacaucgccggaguuggcgcugagauucucaauguggccaaggggauccgcagcuucgugcagcuguggaacgauacagucccuaccgaaucccuugcuagagccgagacacuggugcucgagacccccguuggaccucuggcgcuugccggccccucuagcacgccccaggaaaauggcacaacccuguggccuucccgggggauuccgagcucucccggagcucauacaaccgaggccggcacccucccugcucccacaccuuccccgcccagccuggggcgcccuugggcgccccugacgggaccuucugugcccccucccuccagcgaaagaaucucugaggaagucggccuccugcaacuucugggggacccgccuccccaacaggugacccagacagaugaccccgauguuggacucgccuauguguuuggcccugacgcuaacuccggccaagucgcgcgguaccacuucccgagccuguuuuuccgcgauuuuucccuucuguuccauaucagacccgccaccgaggggccuggagugcucuuugcuauuacagacucugcccaggccauggugcugcugggcgucaaacucagcgggguucaggauggacaccaggacaucucccugcuuuauaccgagcccggcgcugggcaaacgcacacagccgcgagcuuccggcugccugcuuuugugggacaguggacccaucucgcccugucuguggccggcggcuucgucgcucuuuacguggacugcgaagaguuucagcgcaugccccuggccagauccagccgggggcucgaacuggagccuggagcuggccuguucguugcccaagccgggggagccgaucccgacaaguuccagggcgugauugcugaacucaaaguccgcagagauccccaggugucuccuaugcacugucuggacgaggagggggaugacagcgauggcgccuccggagacucuggcagcgggcuuggagaugcucgggaacugcuccgcgaggaaaccggcgccgcgcugaagcccagacugccugcucccccgccuguuacaacacccccucuugccgggggauccagcaccgaggacucucgguccgaagagguggaggaacagacgaccgucgccagccucggcgcucaaacacugcccgggucugauuccgugagcaccugggacggcuccgucagaacacccggaggccgcgugaaagaagggggacugaagggccagaagggggaaccuggaguuccggggcccccuggccgggccggacccccuggcucucccugccucccuggcccgcccgggcugccuugucccgugagcccucuuggacccgccggcccggcucugcagaccgucccugggccccagggacccccugggcccccuggcagagacggcacgccgggacgcgauggcgagcccggggacccuggagaggauggcaaacccggggacaccggaccucaaggcuuucccggcacaccgggggaugugggaccuaagggcgacaaaggggaucccggaguuggcgaacgggggccucccggaccucaggggcccccgggcccucccggccccuccuucagacaugacaagcucaccuuuaucgauauggagggaucuggcuucgggggagaccuggaagcgcugcgcggcccucggggguuuccgggacccccugggcccccuggcgugcccggccuuccuggagagccgggcagauucggggucaauagcuccgaugugcccggaccugccggccuccccggggugccuggacgcgaagggcccccgggcuuuccuggccugcccggacccccugggcccccuggccgggagggaccgcccggcagaacagggcagaaaggaagccugggcgaggcuggcgccccugggcacaagggaucuaagggcgcccccgggccugcuggagcccgcggcgaauccgggcucgcgggagcucccggcccggccggcccucccgggccucccggaccucccggcccgccugggcccggacugcccgccggcuucgacgauauggaggggagcggaggcccuuuuuggucuaccgcucgguccgccgacggcccgcaggggcccccuggacuucccggccugaaaggggacccuggaguucccggccucccuggggcgaagggcgaagucggagcugauggcgugcccggguucccgggacugccuggcagagaggggauugccggaccccaaggcccuaaaggggaccggggcagccgcggagaaaagggcgaucccgggaaagacggagugggccagccggggcugccuggaccgcccggcccucccgggccugucguguauguuucugagcaggauggcagcgugcuuuccgucccgggacccgagggcagaccuggguuugccggauuccccggcccugcugggcccaagggaaaccucggcagcaaaggcgaacgggggucuccuggaccgaagggcgagaagggggaacccggauccaucuuuagcccugacggcggggcccugggacccgcucagaaaggcgccaagggcgagccuggguucagaggacccccgggcccuuacgggcgccccggauauaaaggcgaaauuggguuccccggacggccuggcagacccggcaugaaugggcugaagggagagaaaggcgagccuggggaugcgucccucggauuuggcaugcgcgggaugccgggacccccugggcccccuggacccccgggcccucccggcacgccuguguacgacucuaacguuuucgccgaaagcuccagacccggcccgccugggcugcccggaaaucaagggcccccuggccccaagggagcuaagggcgaggugggcccuccggggcccccuggacaguuucccuucgauuuucuucagcuggaagccgagaugaaaggcgagaagggggaccggggagaugcuggccaaaaaggggaacgcggagagccuggcggcgggggauucuuuggcucuagccuccccgggccuccgggacccccuggccccagaggguacccuggaauccccggcccgaagggcgaauccauccgggggcagccuggaccucccggcccccaggggcccccuggaauuggcuaugaggggcgccagggcccgcccggaccucccggcccucccgggccgccuucuuuccccggaccucacagacaaacaaucagcguccccggcccucccgggccgcccggaccucccggcccuccggggaccaugggcgccuccagcggagugcggcugugggccacacgccaggcuaugcugggccagguucaugaagugcccgagggguggcuuauuuuugucgcggagcaggaggagcucuacgugagagugcaaaacggauuccggaaaguccagcuggaagcccgcaccccucugcccagaggcaccgacaacgagguugcugcccuccagccucccguggugcagcugcacgauucuaauccuuauccccggagagaacauccgcacccuacagcccgccccuggcgggcugacgacauccuugccuccccucccagacugccggagccucaacccuaccccggggcgccucaucacagcucuuauguccaccuccgccccgcucggccuacguccccgcccgcccauagccacagagauuuucagccugugcugcaucugguugcccuuaacucuccccuguccggaggcaugcgcgggauucggggcgcugacuuccagugcuuucaacaggccagagcggugggacucgcuggcaccuuccgcgccuuccugagcucccggcuccaggaucuguacagcaucgucagacgggccgaccgcgcugccgugccuaucguuaaucuuaaggaugagcugcucuuucccucuugggaagcucuguucagcggguccgagggaccgcugaagccuggcgccagaaucuuuucuuucgacgggaaagaugugcuucggcaccccacauggccucaaaagagcgucuggcacggauccgaccccaacggccgcagacugaccgaaucuuauugugagacauggcggaccgaagcgccuagcgccacggggcaggcuuccucucuccugggcggaagacuccugggccagagcgccgcuuccugccaucacgccuacauugugcuuuguauugagaauagcuuuaugacagccucuaaauga

SEQ ID NO: 67688 - RNA, 4395 nt, Artificial Sequence
  derived and/or modified sequence opt5 from COL1A1__Homo_sapiens__NP_000079
auguucagcuuuguggaccugagacuccugcuucugcucgccgccaccgcccugcuuacacacggccaggaggaagggcaagucgagggacaggaugaagacauucccccuaucacgugcguucagaacggccugcgguaccaugaucgcgacguguggaagccggagcccuguagaaucugcgugugugauaaugggaaaguccucugcgacgaugugauuugugacgaaaccaagaacugcccuggagcggagguucccgagggcgaauguugcccugugugucccgauggguccgagucuccuacagaccaggaaaccacaggagucgagggcccgaaaggcgauaccgggccccggggaccucgcggccccgcugggccucccggaagagacggcaucccggggcaaccuggacugcccggcccucccggacccccugggccgcccggaccucccggccucgggggaaauuucgccccucagcugagcuauggcuacgaugagaaguccacagggggaauuucugugcccggcccgaugggcccuagcgggccccggggacugccugggcccccuggggcccccggaccgcagggcuuucaggggccucccggcgaacccggagagccuggcgcuuccgggccgaugggaccccgcggcccucccgggccucccggcaaaaacggcgacgacggggaagccggcaagccuggaagacccggcgagcgggggccgccuggaccccaaggcgcucgcgggcuuccuggaaccgccggccugcccgggaugaagggccacagaggauucucuggccucgauggggcgaaaggagacgccggcccggcugggccuaagggagaacccggcagcccuggggagaauggcgcccccggacagaugggcccccgggggcugccuggagagcgcggcagaccgggggcucccggaccugccggcgcgcggggcaacgauggggccacgggagcugccgggcccccugggcccaccggaccugcuggcccgcccggguuuccuggagccguuggcgccaaaggcgaagcugggccccagggaccucgcggcuccgaggggccccagggagugagaggcgaaccggggccucccggacccgcgggcgccgcuggcccugccgggaaucccggagccgacggccaaccuggggcuaagggagccaacggcgcgccggggaucgcuggagcccccggcuucccuggcgcccgggggcccagcggaccucagggccccgggggaccgccuggccccaaaggcaauucuggagagccuggcgcucccggcuccaagggggauacaggagccaagggcgaaccugggcccgucggagugcagggcccgccugggcccgcuggagaggagggcaaaagaggcgcccgcggggaacccggaccuaccggccuuccggggcccccuggagagcggggcgggcccggaagcagaggcuuuccuggcgcggacgggguggccggacccaagggcccugcuggggaacgcggaucuccgggccccgccgggccuaaaggcucccccggagaggcuggccggccuggggaagccggacugcccggcgcgaaggggcucacaggaagcccgggcucuccugggcccgauggcaaaaccggacccccuggccccgccgggcaagacggaagaccuggcccgcccgggccucccggagcucgcggccaggccggggucaugggcuucccuggacccaagggcgcugccggggagccgggaaaagccggcgagagagggguuccuggacccccuggcgcugugggccccgcggggaaggauggagaagccggcgcucaggggccucccggaccggccggcccugccggggagcggggagaacagggccccgcuggcucccccggguuucaaggacugccuggcccggccgggcccccuggagaggcgggcaagcccggggagcagggagugccuggcgaccugggcgcucccgggccuagcggagcccgcggcgaacggggguuccccggagagagaggcguccaggggccgccuggacccgccggcccucgcggcgcuaacggggcccccggaaaugauggcgcgaaaggggacgcuggagccccgggcgccccugggucccagggagcucccggccuccaaggcaugcccggggaacggggagccgcuggccugccugggcccaagggagacagaggcgaugccgggccuaaaggagcggacggcucuccgggcaaggauggggugcggggacuuacgggccccaucgggccucccggaccugccggcgcucccggggacaaaggagagagcggcccuuccggcccggccgggcccacaggagcucgcggcgccccuggggauagaggagaacccggcccucccgggccggccggcuuugcuggaccucccggcgcggacgggcagcccggagccaagggcgagccuggggaugcuggagccaagggcgacgccgggcccccuggcccggcuggacccgccggcccucccgggccuauuggaaacguuggcgcgcccggggcuaaaggagcccggggcagcgccgggccgccuggcgcuaccggauuccccggcgccgcggggagagugggaccucccggcccgucugggaaugcuggaccucccgggcccccuggccccgccggcaaggagggaggcaaagggccucgcggagaaacaggcccggccgggcggcccggagaggucggcccucccggcccucccgggccugcuggagaaaagggcuccccgggggccgauggacccgcuggcgccccugggacccccggaccucagggcaucgcgggccagagaggggugguuggacugcccggccaacgcggggagagaggauuuccgggccucccugggcccagcggagaacccggcaaacagggcccuucuggggccagcggagagcgggggcccccuggcccgaugggacccccuggccuggcugggcccccuggagaguccggccgcgaaggcgcccccggggcugagggaucuccgggcagagacgggagcccuggagccaagggcgaucggggcgaaaccggacccgccggcccucccggcgcuccuggggcgcccggagccccgggccccguggggccugcuggaaaguccggcgaccgcggggagacaggacccgccggcccugccggcccggucgggcccgugggagcuagaggcccugccgggccccagggaccucggggcgauaaaggggaaacgggagagcagggcgaccgcggcauuaaggggcauagaggauucagcggccuucaagggcccccuggacccccgggcucuccuggggagcagggccccuccggagcgagcggcccugcugggccccggggaccgccuggcucugccggggcccccggaaaagacggccugaacgggcuccccggcccuaucggacccccuggcccgcgcgggagaaccggagaugcuggccccgucgggccucccggaccucccggcccgccugggcccccuggacccccuuccgccggcuucgacuuuagcuuccugccccagccgccccaagaaaaggcgcacgauggcgggcgguauuacagagccgacgaugcuaaugugguucgcgaccgggaucuggagguggacacaacccucaaaucccugucucagcagauugaaaacaucagaagcccugagggaucccgcaagaaccccgcccggacaugcagagaucuuaagaugugucauucugacuggaaaagcggcgaguauuggauugauccuaaucaggggugcaaccuggacgcuaucaaggucuuuugcaauauggaaaccggagagacguguguguaccccacacaaccuuccguugcccagaaaaacugguauaucagcaagaauccgaaagauaagcgccacgugugguucggcgaaucuaugaccgacggguuucaguucgaguacggcggacagggcuccgaccccgcugaugucgccauucaacucaccuuucugcggcuuaugagcacagaagcgucucagaacaucaccuaccacugcaaaaauuccguggccuauauggaccagcagacagggaaccugaagaaggcucuccugcugcaaggaagcaaugagauugagaucagagccgaaggcaacucucgcuucacguacagcgugaccguugauggguguacaucccauaccggagcuuggggcaaaacagucauugaguauaagaccacgaaaaccagccggcucccuaucaucgacguggcuccccuggaugugggcgccccugaccaggaauuuggguucgaugucggacccgugugcuuucuuuga

SEQ ID NO: 67689 - RNA, 4101 nt, Artificial Sequence
  derived and/or modified sequence opt5 from COL1A2__Homo_sapiens__NP_000080
augcugagcuucguggacaccagaacacuccugcuucuggccgucacgcucugccuggcuaccugucagucccuucaagaagaaacaguucggaagggccccgccggggaucgcggaccuagaggcgagcgggggccgcccggaccucccggccgcgacggggaagauggaccuaccggacccccuggcccgcccgggccucccggaccucccggccugggaggaaacuuugcggcucaguacgacggcaaaggggugggacucggcccgggcccuauggggcugaugggacccagaggcccucccggggccgccggagcucccggcccucagggguuccagggaccggccggcgagcccggcgaaccugggcaaacaggacccgcuggcgcccgggggccugcgggacccccgggcaaggccggggaggauggccacccuggaaaacccggccgcccuggggagagaggaguggucggcccccagggggcucggggauuuccuggcacccccgggcugccgggcuucaagggaauccgcggccauaaugggcucgacggacugaaaggccagccuggggcccccggagugaagggcgaacccggggcuccuggcgagaacggaacaccgggccagaccggggccagaggacuucccggcgaacgggggcgcguuggagcgccuggccccgccggggcuagaggcucugauggaagcgugggcccugucgggcccgccggaccuauuggcuccgcugggcccccgggauuuccuggcgcccccggcccuaagggggagaucggagccgugggcaaugcugggcccgcgggaccggccggcccucggggcgagguuggacugcccggccucucuggcccuguggggccucccggaaaccccggcgcuaaugggcugacgggagccaaaggcgccgcugggcuuccgggagucgccggcgcgcccggccugccugggccccgcggcauuccuggccccgugggggcugccggagccaccggcgcuagagggcucgugggagaaccuggcccggccggcagcaagggggaguccggaaacaaaggcgaacccgggucugcuggaccucaagggcccccugggcccagcggagaggaaggcaagcggggcccgaauggggaggccggauccgcgggcccucccgggcccccuggacugagaggcagccccgggucucgcggacugccuggcgccgacggccgggcuggggucaugggaccgcccggcuccagaggggccagcggaccugcuggcguucgcgggcccaacggagaugccggccggccuggcgagcccgggcucaugggaccgagaggccugccugggucucccggaaauaucggcccugcggggaaagaaggccccgugggacuuccuggcauugacgggcgccccggaccgaucggcccugccggggcucggggagagcccggcaacaucggguuccccggcccuaagggaccgacaggcgaucccgggaagaauggagacaaaggccacgccgggcuggcuggagccagaggcgccccugggcccgauggcaacaauggagcucagggcccucccgggccucagggagugcagggcgggaagggagaacaaggcccgcccggcccucccggguuucagggacucccuggccccuccgggccggcgggagaggucggcaaaccuggggaacgcggacugcauggcgaguucggccuucccgggcccgccggaccucggggcgagagagggcccccuggagaaagcggcgcugccgggccgaccggacccauuggcucucgcggcccuuccgggcccccuggacccgacggcaacaagggggagccgggagugguuggcgccguggggacagcuggaccuagcggccccuccggccugccuggggaacggggagccgcgggcauccccgggggaaaaggcgagaagggggaaccuggacucagaggcgagauuggcaaucccgggcgggacggagcucgcggcgccccgggggccgucggagcuccuggccccgccggggcgaccggagauagaggcgaggcuggcgccgccgggcccgcuggaccugccggcccgcgggggucucccggagaaagaggcgagguggggccugcuggacccaacggcuuugccggcccugcgggggccgcuggacagcccggcgccaaaggggaacgcggagcuaagggcccuaagggggagaacggcguugugggacccacgggcccggucggggccgccggaccugcuggccccaaugggccucccggaccggcgggcagccggggcgacggcggaccucccggcaugacaggguuccccggagccgcuggcagaaccgggccucccggaccuuccggcaucagcgggccgcccggcccucccggaccugccggcaaagaggggcugcgcggacccagaggcgaucaagggccugugggacggacaggcgaagucggggccgugggcccgcccggauuugcuggcgagaaggggccuucuggagaagccggcaccgcggggcccccuggaacccccggcccgcagggccugcucggggcuccugggauucugggccuucccgggucccgcggagagagaggccugcccgggguugccggagccgugggcgaaccuggcccccucgggaucgcuggaccuccgggcgcccgggggcccccuggagcggucggcagccccggggugaacggagcuccuggcgaggccggccgcgacgggaaucccggaaacgauggcccgccugggagagacggacagcccggccacaaaggggagcggggauauccuggcaauauuggccccguuggggccgcuggagccccgggcccucaugggcccgugggacccgcuggcaagcacgggaaccgcggagaaacaggcccuucuggccccgucgggccugccggagcggugggcccgagagggcccagcggaccucagggcauccgcggggauaaaggagagcccggcgaaaagggcccucgggggcugcccggacuuaagggccacaaugggcugcaaggacucccuggcaucgccgggcaucacggagaccagggcgcuccgggcuccguggggcccgccggaccuagaggccccgcugggccuucuggacccgccggcaaagaugggcggacgggccauccgggaaccguuggcccugccgggauuagaggaccccagggccaccaggggcccgcuggaccucccggcccuccggggcccccugggcccccuggagucagcggcgggggauacgacuucggcuaugauggggacuuuuaccgcgcggaccaaccccgguccgccccgagccugagaccuaaggauuaugagguggacgcuacacugaaaucucucaacaaucagaucgaaacccugcuuacacccgagggaucccgcaagaacccugcccggaccugcagagaucugcgccucagccaccccgaguggucuuccggcuacuauuggauugacccuaaucagggguguacgauggaugccaucaaaguguacugcgacuucagcacaggcgaaaccuguauucgggcucagcccgagaacaucccggccaagaauugguacagauccucuaaggauaaaaagcaugucuggcugggagaaaccaucaacgcgggcagccaauucgaguauaauguggaagggguuacauccaaagagauggcuacccagcuggccuuuaugcgccuucucgccaacuacgcuucucagaacauuacauaucacugcaagaauagcaucgccuacauggacgaggaaacgggaaaccugaaaaaggcggugauucugcagggcuccaaugaugucgagcucguggccgaagggaacagccgguucaccuauacaguucugguggacggauguucuaagaaaaccaaugaguggggcaagacaaucauugaguacaaaaccaacaagcccuccagacuuccuuuucuggauaucgcuccccucgacaucgggggcgccgaucaagaguucuuugucgacauuggaccugugugcuucaaauga

SEQ ID NO: 67690 - RNA, 3855 nt, Artificial Sequence
  derived and/or modified sequence opt5 from COL20A1__Homo_sapiens__NP_065933
augagcuccggcgaccccgcccaccuggggcucugccuguggcuuuggcugggagcuacccucggcagagaacaggugcaagccucugggcugcuucggcuggcgguccucccugaggaucgccugcagaugaaguggagagagagcgaaggauccggccugggguaccucguucaggugaaaccgauggcuggagacucugagcaggaagugauccugacaacgaagacccccaaagccacagucggcggccuuagcccuuccaagggguauacccugcaaauuuucgagcucacaggaucuggccgguuucugcuugcccgcagagaguucgugaucgaagaucugaaaagcuccagccucgaccggucuucccagcgcccccuggggagcggagcuccugagcccaccccuucucauacaggcuccccggaucccgaacaggccagcgagccucagguugcuuuuacccccucucaagacccuagaacgcccgccgggccgcaguuccggugucugccucccgugccugcggauauggucuuucucguggacggauccuggagcauuggccacucccauuuccagcagguuaaggauuuucuggccucugugaucgcucccuucgagauuggccccgacaagguccaaguggggcuuacccaguacagcggagaugcccagacagaaugggaccugaacucccucagcaccaaagagcaagugcuggcugccguccgcagacuucgguauaagggcgggaauacauuuaccggacuggcgcucacgcacguucugggccagaaccugcagccugccgcugggcuccgcccggaagccgcuaaaguggugauccuggucacagauggaaagucucaggacgacgugcauaccgccgccagaguucuuaaagaucugggcgugaaugucuucgcugugggcguuaagaacgcggacgaggccgaacuccggcugcuugcuuccccuccccgcgauaucacagugcacagcguccuggacuuucuccaacugggggcccuggccggacuccugucuagacuuauuugccagcggcugcagggcgggagccccagacagggaccugcugccgcgcccgcucucgauacccugccggccccuaccucccuggugcuuucucaagucacaagcuccagcauccgccucucuuggacgcccgccccucggcacccccugaaguaccugauuguguggagagcuucccgcggcgggaccccucgggagguuguggucgagggccccgccgcuagcacagaacuccauaaucuggccucuagaaccgaguaucuuguguccguuuucccgaucuacgaaggaggcgugggggagggacugcgcggccucgucacaaccgcgccucugcccccuccccgggcccugacgcuugcugccgugacaccgagaaccgugcaccucaccuggcagcccagcgcuggggccacacauuaucugguucgcuguuccccugcgucucccaaaggagaagaggaggaacgggagguccaggugggcagaccugaagugcugcucgacgggcuggagcccggccgcgauuacgaagucagcgugcagucccuucggggaccugagggcucugaggccagagggauucgggcucgcacccccacacuggccccgccuagacaccucggauuuagcgacguuucccacgaugcugcccggguguucugggaaggcgcccccagaccuguccgccuggugcggguuacguacgugagcucugaagggggacauuccggccaaaccgaggcucccgggaacgcgacaagcgccacccugggcccgcuuucuuccagcacaaccuauacggucagagugaccugccucuacccuggaggcgggucuagcacacugaccggacgcguuacaaccaagaaagcucccuccccuagccagcugucuaugacggagcuccccggcgacgccgugcagcuggccugggucgcugccgcgcccuccggggugcuuguguaucagaucacauggaccccucugggagagggcaaggcucacgaaauuagcgucccggggaaucucggcacagccguucugcccggacugggcagacauaccgaguacgaugugaccauccuugccuauuaccgggacggggcucgcuccgacccugugucucucagauauacacccagcacggucucccggucuccucccagcaaccuggcccuggcguccgaaaccccugauucucuccaagugagcuggacaccgccccugggacgcguucuucacuacuggcugaccuacgcuccugccuccggccucgggcccgagaaaagcgugucugucccuggagccagaucccaugugacacugcccgaccugcaggcugccaccaaguaucggguucuugugagcgcuaucuacgccgcgggccgcucugaagccgucuccgcuacgggccagacagccuguccggcucugagaccugaugggagccuccccggauucgaccugaugguggccuuuucucucguugagaaagccuaugcuuccauucggggcguggcgauggagcccagcgccuucgggggaaccccuaccuuuacacuguucaaggaugcucaacuuacccgcagagucuccgacguguaccccgccccucugccgcccgaacacacaaucguguuucucguccggcugcugccugagacgcccagagaagccuucgcucuuuggcagaugaccgccgaggauuuucagccucugcucggcguucugcucgacgcggggaagaaaagccugacauauuuccaccgcgauccccgggcugcccuucaggaagccaccuuugacccgcaagaggugagaaagauuuucuuuggaucuuuccauaaagugcacgucgcugugggccgcagcaagguucggcuguacguggauugcagaaaagucgccgagcgcccucucggcgaaauggggucucccccugcggcuggauuugugacacugggccggcuggccaaggccagagggccccgcuccagcuccgcugccuuccagcuucagaugcugcagaucguuuguucugacaccugggcugaugaggaccggugcugugaacucccugccagcagagacggagagacgugccccgcguucguguccgccuguucuugcagcuccgaaaccccgggcccucccgggccccaaggaccuccgggccugcccggccggaaugggacaccuggagagcagggcuuucccgggccucgcggacccccuggcgucaagggggagaaaggagaucauggccucccgggccugcaggggcaccccggacaccagggcauuccugggagagugggacuucaaggccccaaggggaugcggggacuggaaggcaccgcuggccugccugggcccccgggaccucgcggcuuccaggggauggccggagcuagaggcacaagcggggagcggggaccucccggcaccgucggccccacagggcuccccggaccuaaaggcgaaagaggggagaagggagagccgcagucucuggccacccuuuaucaacuggugucccaggccagccauguuucuaaauuugacuccuuccacgaaaacacgcggcccccuaugcccauccucgagcagaagcuggaaccuggcacagagccccucgggagcccgggaacccgguccaaggcucuggugccuggcgaauggggcagagggggacgccaucuugagggccgcggggagcccggagcggucggccagauggggucuccuggccaacagggagccagcacccagggccugugggaauga

SEQ ID NO: 67691 - RNA, 2874 nt, Artificial Sequence
  derived and/or modified sequence opt5 from COL21A1__Homo_sapiens__NP_110447
auggcccacuacaucaccuuccugugcauggugcucguccugcuucugcagaacagcguucucgcugaggacggcgaagugagauccucuugucggacagcccccacggaucugguguuuauucuugacgggagcuauuccgucggaccugagaauuucgaaaucgugaagaaauggcugguuaacauuaccaagaauuuugauaucggcccgaaauucauucaagugggggucgugcaguacucugacuaucccguucucgagaucccucugggaagcuacgauuccggcgaacaucugacagcggcuguggagucuauccucuaucucgggggaaacaccaagacaggcaaagccauucaguuugcccuugacuaccuguucgcuaagagcucccgcuuucucaccaagaucgccgucgugcugacagauggcaaaagccaggacgaugugaaggacgcugcccaagcggccagagauucuaaaauuacccuuuucgcuaucggggucggauccgagacggaagacgccgagcugcgggcuauugccaauaagcccagcucuaccuauguguuuuacguugaagauuacaucgcgauuuccaaaauccgcgaggugaugaagcagaagcucugcgaggaaagcgucuguccuacaagaauccccguggccgcucgggacgagcgcggcuucgacauucugcuggggcucgauguuaacaaaaaggugaaaaagagaauccagcugucuccuaaaaagauuaaaggauaugaagucaccuccaagguggaccuuagcgagcugacauccaauguuuuuccggaaggccugcccccuucuuacguguucgucagcacccagcgguuuaaggugaaaaagaucugggaucuguggcgcauucuuacgaucgacgggagaccccaaaucgccgucacacugaacggaguggauaaaauucuccuguucaccacaaccuccguuaucaauggcagccagguggucaccuucgcuaacccucaggugaagacacuguuugacgagggcuggcaccagauucggcuccugguuacggagcaagaugugacccuuuauaucgacgaucagcagauugaaaauaaaccccugcauccgguccucgggauccugaucaacggacaaacacagauuggcaaguacucugggaaggaggaaaccgugcaguucgacgugcagaaacuucgcaucuauugcgauccugagcaaaauaacagagaaacagccugugagauucccggauuuaauggcgagugccugaacgggccuuccgacguuggaagcacccccgcccccuguaucugcccuccgggcaagcccggccuccaggggccuaaaggagaccccggccugccugggaaccccggauacccgggccagccugggcaggauggcaagcccggauaucaaggcauugcugggacgccuggaguccccggcucuccugggauccagggagcgcggggccugcccggguacaaaggcgaaccgggacgcgacggcgauaagggggacagaggacucccuggcuuccccgggcugcacggaaugcccggcagcaagggggagaugggcgccaaaggagauaagggcuccccuggguuuuacggcaaaaagggcgcuaaaggggaaaagggaaaugccggcuucccggggcuucccggcccugccggagagcccggccggcaugggaaggacggacugaugggcucuccuggguuuaaaggagaagcuggcagccccggcgccccugggcaggauggaacaagaggcgagcccgggauuccgggauucccuggcaaccgcgggcucaugggacagaagggcgagaucggacccccugggcaacagggcaaaaagggcgcgcccgggaugccgggacugaugggcuccaaugggagcccuggacagcccggcaccccuggcucuaaaggguccaagggagaacccggcauccaggggaugcccggagcuagcggccugaaaggggagccuggagccaccggcucuccgggcgaacccggguauaugggacuuccuggcauucaagggaagaagggagacaaaggcaaccagggggagaagggaauccagggccaaaaaggcgagaaugggcggcagggcauucccggccagcaggggauccaaggacaccacggcgccaagggggaaagaggagagaaaggcgaaccuggcgugcgcggggcuauuggauccaagggcgagagcgggguggauggacucaugggccccgccgggccuaagggacagccgggcgaccccggcccucaggggcccccuggacuggauggcaaacccgggcgggaauuuuccgagcaguucaucagacaagucuguacagacgugauccgcgcucagcugccgguucuccugcagucuggacggauuagaaacugcgaucauugucuuagccagcacggcuccccugggauccccggacccccuggacccauuggcccugaggggccgcgcggacugcccggccucccugggcgggacggagugcccggccuggucggggugccuggcagacccggaguucgcggccugaaggggcuuccgggacggaauggcgaaaaagggucucaaggauuuggcuacccuggggagcagggacccccuggacccccuggccccgaagggccgccuggaaucagcaaggagggcccucccggggaccccggacucccgggcaaagauggcgaccaugggaagcccggcauucagggacaaccugggcccccuggaaucugcgaucccucccugugcuucagcgugaucgccagacgggacccuuuucgcaagggcccgaacuauuga

SEQ ID NO: 67692 - RNA, 4881 nt, Artificial Sequence
  derived and/or modified sequence opt5 from COL22A1__Homo_sapiens__NP_690848
auggccggccugagagggaacgcuguggccggacuccuguggaugcuucugcucuggagcggcgggggaggcugccaggcgcaacgggcuggguguaaguccguccacuacgaccugguuuuccuucuggauaccucuagcuccgugggaaaagaggacuuugaaaaggugcgccagugggucgccaaucucguggauacauucgagguuggccccgacagaacgcgggugggcgucgugcgcuauucugauagaccuaccacagccuuugaacuggggcuguucggaagccaggaggaaguuaaagcugccgcucggcgccucgccuaccauggcgggaacaccaauacaggagacgcgcugagauauaucaccgcccgguccuuuucuccgcacgcuggcgggcgccccagagaucgggccuacaaacagguggcuauucuucugacagacggacgcagccaagaucucguccuggacgccgcggccgcugcccauagagcuggcauccggauuuucgccgugggcgugggggaggcccuuaaggaggaacuggaggaaaucgcuuccgagccuaagagcgcgcacgucuuucauguuucugauuucaacgccauugacaagauccgcggaaaacucagacggagacugugcgagaaugugcugugucccuccgugcgcgucgaaggcgaucgguuuaagcacaccaacgggggaacgaaagagaucaccggcuucgaccucauggaccuguuuagcgugaaggaaauucuugggaaaagagagaauggagcucagucuuccuauguucgcaugggcagcuucccugugguccagucuacagaagauguguuuccccagggccugccugacgaguacgccuucguuaccacauuccgguuuagaaagaccucccgcaaggaggauugguauaucuggcaagugauugaccaguacagcaucccgcaggucuccauucggcucgauggggaaaacaaagccguggaguacaaugcugucggagccaugaaggacgcggugagaguuguguuccgcggcucucgggucaacgaucuguuugacagagauuggcacaaaauggcucuuagcauccaggcccaaaaugugucccugcauauugacugcgcccucguucagacgcugcccaucgaggaacgcgaaaacaucgauauucaggggaagacagugaucggaaaacggcuguaugacagcgucccuauugacuucgaucuccaaagaaucgugauuuacugugacucucggcacgcugagcuggagaccugcugugauauccccuccggcccuugccaggugacaguugucaccgaacccccgccucccccuccgccccagcgcccuccgacccccgggagcgagcagaucggcuuucuuaagacaauuaauuguucuugcccugccggagaaaaaggcgagauggggguggcuggacccaugggccugccugggcccaagggagacaucggcgccauugggccggugggcgcgccuggacccaagggcgaaaaaggggaugucggaaucggcccuuucgggcaaggagagaagggcgagaaagggagccucggccugcccggaccucccggcagagacggguccaagggaaugcggggcgaaccgggggagcuuggagaaccuggccugcccggggaggugggcaugagaggaccccagggcccuccggggcuccccggaccucccggccgcguuggggccccuggacugcagggcgagcggggcgaaaaagggacgagaggagagaagggcgaacgcgggcuggauggauuucccggcaagccuggggacaccggacagcaaggcagacccggcccgucugggguggcuggaccucagggcgagaaaggggaugucggacccgccggcccucccggggugccgggaagcguugugcagcaggaaggccucaagggcgagcaaggggcuccuggaccccggggccaucagggggccccuggaccucccggcgcgcgcgggcccauuggaccggagggcagagacggcccucccgggcugcagggacuucggggcaaaaagggggauaugggacccccuggcauccccgggcugcucggacugcagggcccuccgggcccucccgggguccccggaccucccggccccgggggauccccuggccugcccggggaaaucggauuccccggcaaaccuggcccucccgggccgacaggacccccuggcaaggacgggcccaacggaccucccggcccgccugggaccaagggagagcccggcgaacgcggcgaggaugggcuuccuggaaaacccggccucagaggggaaauuggagagcaaggccuggccgggcggccuggcgagaagggagaagcuggccugcccggggccccgggauuuccuggcgugcgcggggagaaaggagaccagggcgaaaagggggagcucggccugcccggacuuaaaggcgacagaggggaaaagggagaggcuggccccgccgggccuccgggacugcccggcacaaccagccucuucacgccucacccccggaugccuggggagcagggccccaagggagaaaaaggcgauccugggcugccgggagagcccggccugcaagggcgcccuggagaacuuggcccccagggcccuacagggcccccgggagccaagggccaggagggggcucacggagcgccuggcgccgcugggaaucccggagcccccggccauguuggcgccccugggcccucuggaccuccgggcuccgugggggcucccggacucagaggcaccccugggaaagacggagagcggggcgaaaagggcgccgcgggggaggaaggaagccccggcccugucgggcccagaggagauccgggcgcuccugggcugcccggaccucccggcaaaggcaaggacggggagccuggacugcgcggcucucccgggcucccgggaccucugggcaccaaagccgccugugggaaggugcggggauccgaaaacugcgcucuuggcggccagugcgugaagggggauagaggagcccccggcauccccgggagcccuggaucccgcggcgacccggggauuggagucgcgggcccucccggccccucugggccucccggagauaaaggcagcccugggucccggggacugcccggcuuuccggggccucaaggacccgcuggcagagacggcgccccugggaaccccggagagcgcggcccgccugggaagcccggacucucuagccugcugucccccggcgauaucaaucuucucgccaaagacguuuguaacgauugcccucccgggccuccgggccugcccggacugccuggcuucaagggggacaaaggagugcccggcaagccugggcgggagggaacagaaggcaagaaaggggaggcuggcccucccggacucccgggcccucccgggauugccggaccccagggcagccagggggaaagaggagcugauggcgagguggggcagaagggcgaccaaggacacccuggcguccccggguuuaugggaccgccuggcaaucccgggcccccuggagccgacggcaucgcgggggccgcuggcccucccggcauucagggcucuccggggaaagaaggacccccuggcccccaggggccuuccggacugcccggcaucccgggcgaggaggggaaggaaggacgcgauggcaaaccugggcccccuggagagcccggcaaggccggggaaccgggacuuccuggccccgagggcgcucgggggcccccuggauucaagggccauaccggggacagcggagcccccggcccuagaggggaaucuggagccaugggccugccgggccaggaggggcuccccggaaaagauggcgacacagggccuacgggaccccaaggcccucaggggccccggggaccuccgggcaagaacggcucccccgggagcccuggagagcccggcccuucugggacccccggacagaaaggcagcaagggggaaaauggauccccgggccugccuggcuuccuggggccccgcggacccccuggcgagcccggggaaaaaggagugccuggcaaggaggggguuccgggaaagcccggcgagccuggcuuuaaaggggaaagaggagaucccggcaucaagggggacaaaggaccucccggcgggaagggacaaccgggcgauccuggcauucccgggcacaaaggacauacaggccuuauggggccucagggacuccccggcgagaacgggccugugggacccccgggacccccuggccagcccggguucccuggacugcggggcgaaagcccgucuauggagacccugcgcagacucauccaggaggaacuggggaagcaacuugagacacggcuggcuuaucuccuggcgcagaugcccccugccuacaugaaauccagccagggaagacccggcccucccgggccucccggcaaggacggacugccgggccgcgcugggccuaugggagaacccggccggccugggcagggaggccuugaggggcccuccggcccgauuggaccuaagggcgaaagaggggccaaaggagaucccggcgcccccggggucggacugcgcggcgagauggggccucccggcaucccuggacaaccgggcgaacccggguaugcuaaggacggacucccuggcauucccgggccucagggagagaccggccccgccggccacccggggcugccuggacccccugggcccccuggccagugugaucccucucagugcgcguacuuugcuagccucgccgcccggccgggaaaugugaaaggccccuga

SEQ ID NO: 67693 - RNA, 1623 nt, Artificial Sequence
  derived and/or modified sequence opt5 from COL23A1__Homo_sapiens__NP_775736
augggccccggggagagagccggaggcgggggagacgcuggcaaggggaacgccgcgggaggcggcgggggaggccggagcgcuaccacagccgggucccgcgccgugucugcucugugccuccugcuuagcgucggauccgccgcugccugucugcuccugggcguucaggcggccgcccuucaagggagaguggcugcucuggaagaggaacgggagcuccugcgcagagccggaccuccgggcgcgcuggaugccugggcugaaccccaccucgagcggcugcuucgcgagaaacuggacggccucgccaagaucagaacggcucgggaagccccuucugagugcgugugucccccugggcccccuggacgcagaggcaaaccggggcggcgcggagaucccggcccucccgggcagagcggaagagacggcuacccuggcccccuggggcuugauggaaagccgggccugccugggcccaaaggagaaaagggcgccccuggggacuucggcccccggggagaucagggccaggacggggcugcgggacccccuggcccgcccgggccucccggagcccgcggcccucccggggauaccggcaaggacggaccgagaggcgcucaagggccugccggacccaaaggcgagccugggcaggauggagagaugggccccaaggggccucccggcccgaaaggagaaccuggcguccccgggaagaaaggagacgauggcacacccucccagccugggccgcccggaccuaagggcgagcccgggucuaugggcccucggggagaaaauggcguggacggggcccccggaccuaagggcgagcccgggcauagaggaaccgacggcgcugccggcccgcgcggggcgccuggacucaaaggcgaacagggggauacaguugugauugacuaugauggacggauccuggacgcucugaaggggcccccuggcccccaaggaccgccugggcccccuggcauucccggcgccaaaggagagcucggccugcccggggccccuggaaucgauggcgagaaggggccgaaaggacagaagggcgaccccggcgaaccugggcccgcuggacuuaaaggcgaggccggggaaaugggacugagcggccucccuggggcugauggacugaagggcgagaagggcgaauccgccagcgacucucuucaggagucccuggcgcagcucauugucgagcccgggccuccgggacccccugggcccccuggccccaugggacugcaaggcauccaggggccgaaaggacuggauggcgccaagggcgaaaaaggggcuagcggagagagaggcccuucugggcuccccggacccgugggcccucccgggcugaucggacuuccuggcaccaagggcgaaaaagggcgcccgggagagcccggccuggacggguuuccuggaccccggggcgaaaagggggauagauccgagcgcggagagaagggcgaacggggcguuccugggagaaaaggagugaagggccagaaaggggagcccggaccgccuggccucgaccaacccugcccugucgggcccgacggccugccugugcccggauguuggcacaaguga

SEQ ID NO: 67694 - RNA, 5091 nt, Artificial Sequence
  derived and/or modified sequence opt5 from COL24A1__Homo_sapiens__XP_011539493
augcaucugcgggcccaccggacccgccggggaaaggugagccccacagcuaaaacgaagucccuccugcacuucaucguccuuugcguugccgggguggugguccacgcgcaggagcaaggaauugacauccugcaccagcucggccuugggggcaaagaugugcggcauucuagcccugcuaccgccguuccguccgccucuacaccccugccucagggcgugcaccugaccgaaagcggggucauuuuuaagaacgacgcuuacaucgagacacccuucgugaaaauucucccuguuaaucugggacagcccuuuaccauccugacaggccuccaaucccaccgcgugaacaaugccuuccuguuuucuaucagaaacaagaaucggcuucagcugggcguccagcuccugccuaagaaacuuguggugcauauucgcgggaagcagccggcugucuucaacuauagcguucacgaugaacaauggcauuccuuugccaucaccauucggaaucagagcgugucuauguucguggaguguggcaaaaaguacuuuuccacggaaaccauccccgagguccagacauucgacagcaacucuguguuuacccugggcuccaugaauaacaauagcauucacuucgaggggaucguuugccagcucgauauuaucccuucugcggaagccuccgcugacuauugucgguacgugaaacaacagugccgccaggccgauaaguaucaacccgagacaagcaucccuuguaccacgcugauucccacaaagaucccggaacacuccccucccccuaaacuguuugcugagaagguccucucugaggacaccuucacagaaggaaaaagcauucccaacaucauuaagaaugauuccgagaccguguacaaaagacaggaacaucagaucagccggucucagcuguccagccuucaaucuggcaacguuagcgccguggaccugaccaaucacgggauccaggcgaaggagaugauuacagaagaggauacgcagaccaacuucucccucucugucacaacccaucgcaucagcgaggccaaaaugaacacaaaggaaaaguuuuccagccugcuuaauaugucugacaacauuacccagcacgaugacagagugacgggacugucccucuucaaaaagaugcccagcauccugccucaaauuaaacaggacacaaucaccaaucugaagaaagcuaucaccgccaaccuccauacaaaugagcugauggaaaugcagccgauucuuaacaccucucugcaccgggucacaaaugagcccuccguggauaaccaccucgaccugcgcaaggaaggcgaguuuuauccugaugcuacguaccccaucgagaauagcuacgaaaccgagcuuuaugacuacuauuacuaugaagaucugaacacaaugcucgagauggaauaccugagaggcccuaagggggacaccggacccccgggcccucccgggccugccggcauucccggcccuuccgggaaacggggacccagaggcaucccgggcccucaugggaaucccggacugcccggccucccugggccgaagggacccaaaggcgauccuggguucucucccggccagccuguucccggagagaagggcgaccaagggcugagcggacuuaugggcccucccgggaugcagggagauaaaggccugaaggggcacccgggccucccuggacugcccggcgagcaggggauuccuggauuugccggcaacaucgggucccccggauauccgggccgccaggggcuggcuggcccugaaggaaaucccggcccuaagggggcgcaaggauucauuggcucucccggggaggccggacagcuuggccccgaaggggagcggggcaucccuggaaucagaggcaaaaagggguuuaaaggacgccagggcuucccgggggacuuuggagaucggggccccgcuggccucgacgggagcccuggacuggugggcgggacaggacccccuggcuuccccgggcugagaggauccgucggcccugugggcccgauugggcccgccggaaucccuggccccauggggcucagcggaaacaagggccugccugggauuaaaggagacaagggcgagcaaggcaccgccggggaacuuggagagcccggcuacccgggggauaagggagcuguuggccugccugggccgcccggaaugcgcggcaaaucuggcccuuccgggcagacgggagaccccggccuccaggggccuagcggaccgcccggcccugaaggguuucccggagauaucggcauuccuggccagaaugggcccgagggaccgaagggccugcuggggaaccggggaccucccggcccucccgggcuuaaaggaacccaaggcgaagagggcccuaucggggccuucggagagcucggccccagagggaagccgggacagaaaggcuacgcgggggaaccuggacccgagggccugaagggcgaagugggggaccagggaaacaucggcaaaauuggggagacaggacccgucggccugccuggggaagugggcaugaccggaucuaucggcgagaagggggagcgcggauccccgggcccccucgggccucagggagaaaagggcgugaugggguaucccggcccucccggaguuccuggcccgauugggccccugggacuuccuggcagccgggggcccgauggacugcucggcgagcaagggauccagggcgcuaaaggagaaaagggcgaccaggggaaaagaggaccucauggccugauugggaagacaggaaaucccggcgagcgcggcuuucaggggaaaccgggacugcaaggccuuccugggucuaccggagaucggggccuccccggggaacccggacugagaggccugcagggcgacgucgggccucccggagagaugggcauggaggggccuccgggaacggaaggcgagagcgggcuccagggagaacccggcgccaagggcgauguggggacagccggauccgugggcgggaccggagagccuggccugagaggggagcccggagcuccuggcgaagagggccuucaagggaaggacggacugaaaggcguccccgggggacgcggccucccgggggaagauggagagaagggcgaaaugggccugccugggaucaucggaccccugggcagaagcgggcagacaggacuuccuggccccgaggggauugugggaaucccuggccagcggggcagacccgggaaaaagggagacaaaggccagauugggccgaccggagagguuggcucucgcgggccucccggaaagaucggcaaguccggccccaaaggggcccggggaaccagaggcgcuguggggcaccucggacugaugggcccugauggggaaccgggcauucccggauaccgcggccaccaagggcagccuggacccagcggccugccugggcccaagggagagaaaggcuauccuggggaagacuccacaguccucggaccucccggacccagaggcgagcccgggccugugggagaccagggcgaaagaggggagcccggagccgagggcuacaaggggcauguuggcgugccgggacugcgcggcgcgacggggcagcaaggaccucccggcgaacccggggaucagggagagcagggccuuaaaggggaaagaggcucugagggaaacaagggcaagaaaggggccccuggacccagcggcaagccugggaucccgggacugcagggccuccugggccccaaagggauccaaggauaucacggcgcugacgggauuuccggaaauccuggcaagaucgggcccccuggaaaacagggccugcccggcauuagagggggaccuggccgcaccgggcuugccggagcuccgggacccccuggggucaagggaucuagcggccugcccggcuccccugggauccagggacccaaaggcgaacaggggcucccgggacaaccuggcauucaggggaagagaggacaucggggcgcccagggcgaucaagggcccugcggagaccccggccugaaggggcagccuggagaguacggcgugcaggggcucacaggauuccagggcuuccccggcccuaaagggccggagggagaugcgggcaucguugggauuucuggacccaagggcccuaucgggcaccgcggaaacaccggcccccugggcagagaagggaucauuggaccuacaggccggaccgggccccgcggagagaaaggcuuuagaggggaaacgggaccgcaaggcccucggggccagcccgggccucccggaccgccuggcgcccccgggcccagaaagcagauggacaucaaugcugccauucaggcucuuaucgagagcaacacagcccugcaaauggaguccuaucagaauaccgaagugacccucauugaucauagcgaggaaaucuucaaaacacugaacuaccugucuaaucuucugcacuccaucaagaacccucucggaacccgcgacaaucccgcccggauuuguaaggaucugcucaacugcgagcagaaagucagcgacggcaaguacuggaucgauccuaaucugggguguccgucugacgcuauugaaguguuuugcaacuucuccgcgggcggacagacaugucuucccccugugagcgucacgaaacuggaguuuggcguugggaaggugcaaaugaauuuccuccaucugcugucuuccgaggccacccauaucauuacaauccacugccuuaacacccccagauggacaagcacccagacguccggaccuggccugcccaucggguuuaaaggauggaacggccagauuuucaaggugaauacccuccuggaaccuaagguccucagcgaugacugcaaaauccaagacgggucuuggcauaaggcuacauuucuguuccacacccaggagccgaaccagcuucccgugauugaaguucagaaacugccucaucugaagacagagcgcaaauauuacaucgauagcuccucuguguguuuucucuga

SEQ ID NO: 67695 - RNA, 1938 nt, Artificial Sequence
  derived and/or modified sequence opt5 from COL25A1__Homo_sapiens__NP_001243003
augcugcucaagaaacacgccggcaagggcggaggcagagagccccggagcgaagacccuaccccggcugagcagcauugcgcccgcacaaugcccccuugugcggugcuggcugcccuucuguccgucguugccguggugucuugccucuaccugggggucaaaacgaacgaucuucaagcuagaaucgccgcucuggaaagcgccaagggagcgcccuccauucaccuccugccugacacccuggaucaucucaaaacaauggugcaggagaagguugaacggcugcuugcccagaagucuuaugagcacauggcuaaaauccgcauugccagagaggcucccagcgaauguaauugcccugccggcccgcccgggaagcggggaaaacgcggcagacggggcgaguccgggccucccggacagccuggcccccaagggccgccuggacccaagggcgacaaaggggaacagggagaucagggcccucgcggccugcccggguuccccaccguggcggcccuccauucuaaccagauccugacagucaagggagaccaaggccaggcugggccuccgggacccccugggcccccugggcccagaggaccgccuggcgauaccggcaaggacgggccccggggaaugccuggcgugcccggggagccuggaaaacccggcgagcaggggcuuaugggcccgcugggaccucccggccagaaggggagcauuggagcccccggcaucccugggaugaauggacaaaaaggcgaaccggggcuccccggcgcuguuggacagaacggcaucccugggcccaagggagagccuggcgaacagggggagaaaggagaugccggcgaaaaugggcccaagggcgacacaggagagaaaggcgauccuggguccagcgccgcuggaauuaagggcgagcccggggaaucuggacgcccgggccaaaagggggagccuggccugcccggacugccuggccuccccgggaucaaaggagaaccgggcuuuauugggccucagggagagcccggccugccuggccuucccgggaccaagggagaaagaggcgaggcggggcccccuggacggggcgagcgcggggaaccgggagcccccggcccuaaaggcgacagaggggagaagggagauuccggcgcucaggggccccggggaccucccggccagaaaggggaccaaggagccacggaaaucauugacuacaacggcaaucugcacgaggcccuccagggcccuccggggcccccuggaccccagggccugcaggggccuaagggagaacaaggcagccccgggaucccgggaauggauggcgagcagggccuuaaggggucuaaaggagacaugggcgauccugggaugaccggagagaagggcgggauuggacugcccggccuccccggcgcuaacgggaugaaaggagaaaagggcgacuccgggaugccuggaccccagggcccuagcaucaucgggccgcccggaccucccggcccucacgggcccccggggccuaugggaccccauggccugccugggcccaaaggagagccuggccugaauggggugaagggacucaagggcgaacccggccagaaaggggauagaggaccgcugggccuuccuggggccucuggacuggacggcaagcccgggucccgcggcacagauggacccaugggcccucacgggccggcgggacccaaaggcgagcggggcgagaagggagcuaugggcgaaccugggcccagaggcccuuauggacuccccggcuucccugggccgcgcggagagaaaggcgaccugggggaaaagggagagaaggucaccagccccucccaacaugugccuugucuuauucugcuccugcugucugcccuccuguuuagccuuugcgauuccaucuga

SEQ ID NO: 67696 - RNA, 1326 nt, Artificial Sequence
  derived and/or modified sequence opt5 from COL26A1__Homo_sapiens__NP_001265492
augaagcuggcccuccugcuucccugggcuugcuguugccuguguggcagcgcccucgcgaccggguuccuguacccuuuuuccgcugccgcccuucagcaacacggauauccggagcccggcgcugggucuccuggaagcggcuacgccuccagacggcauuggugccaccauacagugacgcgcaccgucucuugucagguucagaacgggagcgaaacaguggugcagagagucuaucaauccugccgguggcccggaccuugugcuaaucuggugucuuaccgcacccucaucagacccacauaucggguuagcuaccgcaccgugacaguccuggaguggagaugcuguccuggcuucaccggcuccaacugcgacgaagaguguaugaauugcacgcggcugagcgauaugucugaacgccucaccacacuggaggccaaagugcuucugcucgaggcggccgaaagaccguccagccccgacaacgaucugccugcucccgagucuaccccucccacauggaaugaagacuuucuuccggaugccauuccucuggcucaccccguuccucggcagcgcagacccaccgggcccgccggaccuccgggccagacggggcccccuggacccgcgggcccucccggguccaagggagaccggggccagacaggcgagaaagggccggccggaccucccggccuccuggggccucccggaccucgcggccugcccggggagaugggaagaccgggcccucccgggcccccugggccggcuggaaaccccggcccuagccccaauucuccucaaggggcccucuauucccugcagcccccuaccgauaaggacaacggagauagccggcuugcuuccgccaucguggacacaguccuggccggcgugcccgggccgagaggcccucccggaccucccggcccgccugggccccgcggaccucccgggcccccuggcaccccgggaucucagggccucgcuggggaacggggcaccgugggacccagcggcgagccuggggucaaaggagaagagggcgaaaaggcggccacagcugagggggagggaguucagcaacugagagaagcccuuaagauucuggccgagcgcgugcucauccuggaacauaugauuggcauccacgauccccuggcuuccccugagggcggcagcggacaggacgccgcgcuccgggcuaaucugaaaaugaagagaggcggggcccagcccgauggagugcuugccgcucugcucggcccugacccggggcaaaaaucugucgaccaggccuccagccgcaaguga

SEQ ID NO: 67697 - RNA, 5583 nt, Artificial Sequence
  derived and/or modified sequence opt5 from COL27A1__Homo_sapiens__NP_116277
augggcgccgggagcgcuagaggagcccggggcaccgcggcugccgccgcugcccgcgggggaggcuuccucuuuuccuggauccucgugucuuucgcuugccaccuggccagcacacagggggcgcccgaggacgucgauauucuucaaagacugggacucuccuggacgaaggccggcucuccugcuccucccggcguuauccccuuucagagcggguucauuuuuacccagcgggcccgccugcaggcucccacaggaaccgugaucccugccgcgcuuggcacagaacuggcccucgugcugucccuguguucucauagagucaaccacgcuuuccucuuugccgugcggagccaaaagcgcaagcugcagcuugggcugcaguuccuccccggaaaaaccguugugcaucugggcuccagacggagcgucgcuuuugaccuugauaugcacgacgggcgcuggcaucaccuggcccucgagcugagaggacggacagugacccugguuacggccugcggccagcgcagagugccuguccuccugcccuuccaccgggaucccgcucuugacccuggcgggucuuuucuguucggaaagaugaauccccaugcggugcaauuugaaggcgcccucugucaguucuccauuuacccugugacccaggucgcucacaacuauugcacacaucugcgcaaacagugugggcaagccgauaccuaccagagcccccuuggaccgcuguucucucaggacuccggcagaccuuuuacauuccaaagcgaucucgcccugcuggggcucgagaaucugaccacggcuacacccgcccuuggaucucugccugcgggccggggccccagagggaccguugcucccgccacaccuaccaagccgcagcgcaccucccccacaaacccucaccagcacauggccgugggaggccccgcucagacgccucuccugcccgccaaacuuagcgcuuccaaugcccuggacccgaugcucccugcgucugucgggggcagcacccggacacccagaccugccgcugcccaacccucccagaaaaucaccgcuacaaagaucccuaaaagccugcccaccaagccgucugccccuuccacgagcauuguccccaucaaaucuccccauccuacacagaagaccgcgccgagcuccuuuaccaagucugcccugcccacacagaaacaagugccucccaccagccgcccuguucccgcucggguguccagaccugccgaaaagcccauucagcgcaacccgggcaugccucggcccccucccccgagcacaagaccucugcccccuacgaccucuuccagcaaaaagcccauccccacacuggcucgcaccgaggccaaaauuacaucucacgccuccaagccugcuagcgcgcggaccuccacgcauaaaccgcccccuuucaccgcccuuucuagcucccccgcuccuacacccgggucuaccagaagcacacgcccuccggccaccauggugcccccuacguccggcacaagcacaccccggacagccccugcugugcccaccccgggaucugccccuaccggcuccaagaagcccaucgggagcgaggcgucuaaaaaggcuggacccaaauccagcccuagaaagcccguuccucugcggccgggcaaagccgcccgcgaugugccccucucugaccugacaacgagaccuagcccccggcagccucagcccucccaacagaccacaccggcucugguccuugccccugcgcaguuucucuccucuagccccagaccuaccagcuccggguauucuauuuuccaccuggcuggaagcacacccuuuccucugcucaugggaccucccgggcccaagggcgauugcggacugcccggacccccugggcuuccgggacugcccggcaucccuggggcccgcggaccccggggcccucccgggccuuacggcaauccgggacuccccggcccucccggggccaagggacagaaaggcgacccugggcugucccccggaaaggcucaugacggcgccaaaggggauaugggccugccgggacuuucuggcaacccugggccgcccggaagaaagggccacaaaggguauccuggacccgcuggccacccuggcgaacaagggcagccgggacccgagggcagcccuggggccaagggauaccccggccgccaggggcucccuggacccgugggcgacccgggcccuaagggguccagaggauauaucggccugcccgggcuguucggacucccuggcucugauggggaacggggacugcccggcgucccuggcaaacgcgggaagaugggaaugcccggcuuuccggggguguucggagagagaggcccucccgggcuugacggaaaucccggcgagcugggccucccugggccgcccggaguuccuggccugauuggggaucugggagugcuuggccccaucggguacccuggacccaaaggcaugaagggccucauggggagcgucggagaaccuggccugaaaggggacaagggagagcaaggcgugcccgggguuuccggagauccgggcuuucagggcgacaaggggagccagggacugccuggcuuccccggggcgcggggaaaaccuggcccccucgggaaggugggagauaaaggcucuauuggcuuuccggggccucccggacccgaaggcuucccuggggacaucggacccccuggcgauaacgggccggagggcaugaagggaaaacccggcgcccgcgggcugccuggacccagaggccagcuugggccugaaggagacgagggccccauggggccuccgggcgcucccggacuggagggccaaccugggcggaagggauuccccggccgcccugggcucgacggagucaaaggcgaacccggggauccgggcagaccuggacccgugggcgagcagggguuuaugggauucauuggccuggugggggaacccggaaucguuggcgagaagggcgaccgggggaugaugggaccucccggcgucccugggccgaagggauccaugggccaucccgggaugccuggaggcaugggcacccccggggaaccuggaccccagggcccgccugggagccgcggacccccuggcaugagaggggccaaaggacggagaggcccccgcggcccggaugggccugcuggagagcagggcucucgggggcugaagggaccgcccggcccucaagggagacccggacgcccuggccagcagggcguggccggggagcggggacaccuuggcuccagaggguuuccgggaauccccggcccuagcgggcccccuggaacgaaaggccuccccggcgaaccugggccgcagggaccccaaggcccuauugggcccccuggagagaugggccccaaggggccgccuggagccgugggcgaacccggccugcccggggaggcuggaaugaaaggcgaccuggggccucucggaacacccggcgaacaggggcugaucggacagcgcggcgagccuggccuugagggggauucuggaccgaugggccccgacgggcugaagggagaucggggcgacccugggcccgauggcgaacauggagagaagggccaagaagggcucaugggagaggacggcccucccgggccgccuggagucaccggcgugagagggcccgagggcaaauccggaaagcagggcgaaaaagggcgcaccggagcgaagggcgccaaaggguaccagggacagcugggcgagauggggguuccuggcgaucccggaccucccggcacaccggggcccaagggaagccggggcucccuggggccuaccggagcucccggcagaaugggggcccaaggcgaaccuggacuugccggcuaugacgggcacaagggaauugugggcccgcuggggcccccuggacccaaaggcgagaagggcgaacagggggaggauggaaaagcugagggcccucccgggccucccggagaccggggcccggucggggaccgcggagauagaggcgaaccuggcgaccccggguacccuggacaggagggcgugcaggggcuccggggaaagcccggccaacaggggcagccgggacacccuggcccccgcggcuggcccgggccuaaaggaagcaagggcgccgaagggcccaagggaaaacagggcaaggcgggggcuccuggaagacggggcguucaaggccugcaggggcucccgggacccagaggcguggucgggcgccagggacuggagggcaucgccgggccugauggacuucccggccgggacggccaggccgggcaacagggagaacagggcgaugacggggauccuggacccaugggcccggcugggaaaagaggaaauccuggcguggccggccugcccggggcgcaaggaccucccggcuucaagggggagucuggacucccuggccagcuggggcccccgggaaaacgcggcacagagggccggacggggcugcccggaaaccagggcgaaccugggagcaagggacagcccggcgacuccggggagaugggcuuuccuggaauggcuggccuuuucgggcccaaaggaccuccgggcgauauuggguuuaagggaauccaaggccccagagggccucccggccugaugggaaaggaaggcaucguugggccucucggcauucucggccccucugggcucccgggaccuaaaggcgacaaggggagccgcggcgauuggggacugcagggcccccgggggccucccggaccgagaggccgcccugggccgcccggaccucccggcgggccuauccagcuucagcaagacgaucugggcgccgccuuccagaccuggauggacacauccggagcucucagaccggagucuuauagcuaccccgaccggcuggugcuggaucagggcggggaaauuuuuaaaacccuucauuaucuguccaaucucauccagucuauuaagacaccucugggaaccaaagagaaccccgcccgcgucuguagagaccucauggauugcgagcaaaagaugguggacggcacguacuggguggauccuaaucugggguguagcuccgacaccaucgaagucagcugcaacuucacacacggaggccagaccugucuuaagcccauuacagcuucuaaaguugaguuugccaucucccgggugcagaugaacuuccugcaucugcucagcucugaagugacccaacacaucacaauucauugccugaauaugaccgucuggcaggagggcacggggcagaccccugcgaagcaggccgugcgcuuuagagcuuggaacggacaaaucuucgaggccggcgggcaguuccggccggaaguuuccauggauggaugcaaagugcaggacggcagauggcaccagacccuuuuuaccuuccgcacacaagauccccagcagcugccuauuaucagcgucgacaaucugcccccugcuuccucugggaagcaguaucggcuggaggugggacccgccuguuuucucuga

SEQ ID NO: 67698 - RNA, 3378 nt, Artificial Sequence
  derived and/or modified sequence opt5 from COL28A1__Homo_sapiens__XP_011513662
auguggaacagauacuucguguuuuaucugcuccugcuuagcgccuucaccucccagacagucucuggccaacggaagaaggggcccaagagcaaucugcucgcucgcaaauccgacguucagggaucuaucugcuuuauugauaucguguucauuguggacagcuccgagucuagcaagaucgcccuguuugauaaacagaaggacuucgucgauucccuuagcgacaagauuuuucagcugacgccuggcagaucucucgaauacgauaucaaacuggcggcucugcaauucuccagcucugugcagaucgacccgcccuuuuccagcuggaaggaucuccagaccuucaaacagaagguuaaaucuaugaaccugauugggcaaggaacauuuuccuauuacgccaucagcaaugccacccggcuucugaagcgcgagggcagaaaggacggggugaaagucgugcuccugaugacagauggaauugaccacccuaagaaccccgauguucaguccaucucugaagacgcucggauuagcggcaucuccuucauuaccaucgcccuuagcacaguggucaaugaggcuaaacugcgccucaucucuggcgacuccagcucugaaccuacccugcugcucagcgaucccacgcugguggacaagauucaggauagacuugacauccuguuugagaaaaagugugagcggaaaauuugcgaaugugagaagggggauccuggagacccgggcccgccugggacccauggaaaccccggcaucaagggggaacgcggaccuaaaggcaaucccggcaacgcccagaagggggaggcgggagagagaggccccgggggcauuccuggcuauaaaggggauaagggagaacggggcgagugcggcaaacccgggaucaagggagacaagggcuccccugggcccuacggacccaaaggcccucgcgggauccaaggcauuacaggaccgcccggcgauccugggcccaagggauuccagggcaauaaaggggaaccuggacccccgggcccuuaugggucucccggcgccccuggaaucggccagcaagggauuaagggagagagaggccaggaagggcggcccggagcuccuggccccaucggggugggcgagccgggacagccuggcccccgcgggcccgagggagucccuggcgaaagagggcucccgggagagggcuuccccgggccuaaaggcgaaaagggaagcgagggccccaccgggccucagggacugcaaggccuuuccauuaagggggaaaaaggagacaucggccccguuggcccucaggggcccaugggaaucccgggcauugggagccagggagagcagggcauccaagggccuauuggacccccuggcccccagggcccggccgggcagggacugccuggcucuaagggggaggugggacagaugggccccacagggccucggggacccgugggcaucggcguccaagggcccaaaggagaaccuggcuccauugggcucccgggacagcccggcgugccuggggaggauggagcugccggcaagaaaggcgaagcggggcugcccggagccagaggcccugaggggcccccuggaaagggccagccggggcccaagggagacgaaggcaaaaagggcagcaaagggaaccagggacaacgcggccugccugggcccgagggaccuaagggcgagcccgggaucaugggaccguuuggcaugccuggcaccucuauucccgggcccccuggacccaaaggcgacagagggggaccuggcaucccgggguucaagggagaacccggccucuccauccggggcccuaaagggguucagggaccccgcggcccugugggggcucccggacugaagggcgauggguacccgggcgucccuggaccccggggccuuccugggcccccuggacccaugggccugagaggggugggagacacgggcgccaagggggagccgggcguucgcggaccucccggccccagcgggccucggggagugggcacacaggggccgaaaggagauaccggccaaaaggggcuccccggcccucccggaccucccggcuacgggucccagggaauuaaaggcgaacaggggccucagggauuuccgggccccaagggcacaauggggcacggacugccuggccaaaaaggggagcauggagagagaggcgacgucgggaagaagggagauaaaggcgaaaucggcgagcccgggucuccuggaaagcagggccuucaggggcccaaaggagaccugggccucaccaaggaagagauuaucaaacugauuaccgaaaucugugggugcggaccgaaguguaaggagacaccucuggagcucguguucgucaucgauagcuccgaaucugugggccccgagaauuuucagauuaucaaaaacuucguuaagacgauggcugaccgcguggcccuggaucuugccaccgcucggauuggcaucauuaauuauagccacaaagucgaaaagguggcgaaccugaaacaauuuuccagcaaggacgauuucaagcucgccguugacaauaugcaguaccugggggagggaacauauaccgcuacagcccugcaggccgcuaacgauauguuugaagacgccagacccggcgugaaaaaggucgcgcuugugaucaccgacgggcagacggauucucgcgacaaagagaagcucacagaggugguuaaaaacgcuuccgauaccaaugucgaaaucuucgugauuggaguggucaagaaaaacgacccuaauuuugagaucuuccauaaggaaaugaaccugauugccaccgaucccgagcacguguaccaauuugacgauuucuucacacugcaggacacccucaagcagaaacuguuucaaaagaucugcgaagauuucgacagcuaucuuguucagauuuuuggaucuuccagcccucagccgggguucggaaugucuggcgaggagcugagcgaauccacacccgagccucagaaagaaaucagcgagucucucuccgugacgcgggaucaagacgaggaugacaaggcccccgaaccuaccugggcugacgaucugcccgccacaaccagcuccgaggcuacaaccacgccgagaccucugcuuucuacccccgucgacggcgccgaagauccucggugucucgaggcgcugaaacccgggaauugcggagaauacgugguucgcugguauuacgacaaacaggugaacagcugugccagauuuugguucuccggcugcaaugggucuggaaaccgguuuaauagcgagaaggagugccaggaaacauguauccagggcuga

SEQ ID NO: 67699 - RNA, 4464 nt, Artificial Sequence
  derived and/or modified sequence opt5 from COL2A1__Homo_sapiens__NP_001835
augaucagacugggcgcgccccagacccucgugcugcuuacacugcucgucgcugccguucugcggugccaagggcaggacgugcaggaggcgggaagcugugugcaggauggccaacgcuacaacgacaaggaugucuggaaaccugaaccgugcagaauuugugugugcgacacggggaccguucuuugugaugacaucauuugcgaggaugugaaggacugucugucccccgaaaucccuuucggagagugcugucccauuugcccuacagaucucgcuaccgccucuggccagcccgggccuaaaggacagaagggcgaaccgggcgacaucaaagauaucgucgggcccaagggaccucccggcccucaggggcccgccggagagcaaggcccgcggggcgaccgcggagauaagggcgagaaaggcgcuccugggcccagaggacgggacggcgaaccugggacacccggaaaucccggcccuccggggcccccuggacccccuggcccgcccggccucgggggaaacuuugccgcucagauggccggcggguucgacgagaaggcgggaggcgcccagcugggggugaugcagggcccuaugggacccaugggcccucgcgggcccccuggacccgcuggcgccccggggccucaaggauuucagggcaaucccggggaacccggcgagccuggaguuagcggcccgauggggcccagaggaccucccggcccucccgggaaaccuggagaugacggcgaggcugggaagcccggcaaagccggagaacggggcccgccugggccccagggagcgcgcggcuucccugggacccccggacugccgggcgugaaggggcacagaggcuauccuggacuggauggcgccaagggggaggcuggagcccccggcgucaaaggggaauccggaucuccuggcgagaacggcagccccgggcccaugggaccucggggccuuccgggggaacgcggaagaacaggccccgcuggggccgccggagcucggggcaaugacggccaaccugggcccgcgggaccucccggcccuguggggccggccggaggccccggguuuccuggagcucccggcgccaagggcgaggccgggccuaccggagcucgcggccccgagggggcccagggaccgagaggcgaaccugggacgcccggaucccccggcccugcgggcgcuucugggaaccccggaaccgauggcauuccuggggccaaaggaagcgccggcgcuccggggaucgccggagcucccggcuucccuggcccccgggggccucccggaccgcagggcgccacagggccucugggacccaagggccagaccggggagccuggaauugcgggcuuuaaaggcgaacaagggcccaagggagagccuggccccgccgggccgcagggagcuccuggccccgccggggaagagggaaaaagaggcgcucgcggcgagcccgggggagugggcccuaucgggccgcccggagaacggggcgccccugggaauagaggcuuccccggacaggacggccucgcggggccuaagggagcccccggcgagcgcgggccuuccggacuggcuggcccgaagggggccaacggcgaucccggacggccuggcgaacccgggcuuccuggagcuagaggccugacagggcgccccggagacgccggcccgcaggggaaagucggcccuagcggagcccccggcgaggaugggcggcccggaccucccggcccucaaggggcuagaggacagccgggcguuaugggcuuucccgggccuaagggagcgaauggcgaacccgggaaagccggagagaagggccucccuggggcucccggacugcgcggccugccgggcaaagacggggagaccggagccgccggcccucccgggccugcuggacccgccggcgaaagaggggagcagggagcgccuggccccucuggcuuccaggggcucccgggaccucccggcccucccggggaaggaggcaagccgggggaucaaggagugcccggcgaggcuggcgccccugggcuggugggaccccggggcgagcgcggguuuccuggagaacggggcucccccggggcccagggacuucagggcccuagaggccugcccgggacgccgggaacagacggcccuaagggggcuagcggacccgccggcccucccggggcgcagggaccgccuggccuccaaggcaugcccggggagcggggagcugccggcauugccgggcccaaaggagaccgcggcgaugucggggaaaagggaccugagggcgcucccggcaaagacgggggaagaggccugaccgggccuaucggaccgcccggcccugccggggcuaacggcgaaaagggagaggugggcccucccgggcccgccggaucugcgggcgccagaggggcuccuggagagcggggcgaaacagggccgcccggcccugccggauucgcuggcccucccggggccgauggacagcccggcgccaaaggggagcagggagaagcuggccaaaagggggacgcgggcgccccgggaccucagggccccuccggggcucccggaccucagggccccaccgggguuaccggaccuaagggcgcccgcggggcccagggcccgcccggagcuacaggcuuuccuggggccgcgggacgggugggcccucccgggagcaauggaaaccccggcccgccuggcccucccgggcccucuggaaaagauggcccgaagggggcuagaggagacuccggcccucccgggcgcgccggagagcccggccuucaaggcccugccgggcccccuggagaaaaaggcgagccgggggaugacggacccagcggcgcugaggggccucccggaccucagggccuggccggccagagagggauugucggacuccccggccagcgcggggaacggggauucccuggccugccggggcccuccggagagccuggcaagcaaggcgcgcccggggcuucuggagauagaggcccucccgggccggugggaccucccggccugacggggcccgccggagaaccuggccgggagggcagccccggggccgacggaccuccgggccgcgauggggcugccggaguuaaaggcgacagaggggaaaccggagcugugggcgcccccggcgcgccugggcccccuggaucccccggcccggccgggccuacaggaaagcagggcgaucgcggggaggcuggagcccagggccccaugggcccuagcgggcccgcuggagcccggggcauccaggggccucaaggacccagaggcgacaagggggaggccggcgaaccgggagagcggggccucaaagggcaucgcggauucaccggccugcaggggcuucccggaccucccggcccuucuggggaccagggcgcuuccggaccggcgggccccagcgggccuagaggacccccuggccccgucgggccuucuggaaaggauggcgccaaugggauccccggcccgauuggaccucccggcccucgggggagaagcggagaaacaggccccgcugggccgccuggaaaccccgggcccccugggcccccuggcccgcccggaccuggcaucgacauguccgccuuugccgggcugggaccccgcgagaaaggcccugauccccuccaauacaugcgggcugaccaggccgccgggggacugagacagcacgaugcugagguggacgccacccuuaagucucugaauaaccagauugaaagcauccgcuccccggagggcagccggaaaaacccugccagaacgugucgcgaucucaagcugugccaucccgaauggaaaucuggcgacuauuggauugauccuaaucaagggugcacacuggacgcuaugaaggucuucuguaacauggagaccggagaaaccugcguguaccccaauccugccaacguucccaagaaaaauuggugguccagcaagucuaaagagaagaaacacaucugguuuggcgagacaaucaacgggggauuccauuuuuccuauggcgaugacaaucucgcgccgaacaccgccaaugugcagaugacauuccugcggcuucugagcacggaagggucccagaacauuaccuaccacuguaaaaauucuaucgcuuaucucgaugaggccgcuggaaaccugaagaaggcccugcuuauucagggcagcaaugacgucgaaaucagagcugagggcaacucccgcuuuacauacaccgcccucaaggacgggugcacaaaacacaccggaaaguggggcaaaacggugauugaauaccggucucaaaagaccagcagacugcccaucaucgauauugcgccuauggacaucgggggacccgagcaggaguucggcguugauauugggccuguguguuuucuguga

SEQ ID NO: 67700 - RNA, 4401 nt, Artificial Sequence
  derived and/or modified sequence opt5 from COL3A1__Homo_sapiens__NP_000081
augaugagcuucgugcagaagggcuccuggcugcuccuggcccuucugcaccccaccaucauucucgcucaacaggaggccgucgaagggggaugcucucaucugggccagagcuacgcggacagagauguuuggaaaccugagccgugucagaucugcgugugugacuccgggucugugcuuugcgaugacauuaucugugaugaccaagaacuggauugccccaacccugagauucccuuuggagaauguugcgcugucuguccucagcccccuacagccccgacgcggcccccuaauggccaggggccccagggaccuaagggcgaccccggcccgccugggauccccggacgcaacggcgauccugggauccccggacaacccggcagcccuggguccccgggacccccuggcauuugcgagucuugucccaccggcccucagaauuauagcccccaguacgacuccuaugaugugaaaagcgggguugccgugggaggccucgcuggguacccgggaccugccggcccucccgggcccccuggacccccgggcacaucuggccacccugggucccccggaagccccggcuaucaggggccuccgggagagcccggccaagcugggccuucuggacccccuggacccccuggcgccaucgggcccuccggaccggcgggcaaggacggggaaagcggaagaccuggccggcccggggagcgcggccugccuggacccccgggcauuaaagggccugccggaauccccggcuucccugggaugaagggacauagaggcuuugaugggcggaacggcgaaaagggagagaccggcgcucccgggcugaaaggagagaauggccuccccggggaaaacggagccccuggcccgauggggccccgcggcgcuccuggagagagaggccggcccgggcugccuggagccgcgggcgcccgcgggaaugacggagcuagaggcucugacggccagcccgggccuccgggacccccuggcacagccggguuccccggauccccuggcgcuaagggggaagucggacccgccggcagcccgggcuccaacggggccccuggacagcggggcgagcccgggccccaaggacacgcuggcgcgcaggggccucccggaccuccgggcauuaauggcucucccgggggaaaaggcgaaauggggccugccggaauccccggcgcuccugggcuuaugggagcccgcgggcccccgggcccugccggcgcuaacggagcccccggccugagagggggagcgggcgagccugggaagaauggagcuaaaggcgagcccggcccuagaggggaacgcggagaggccggcauucccggggugccgggagccaagggcgaagaugggaaggacggaagcccuggcgagcccggcgcuaacgggcuccccggagccgcuggcgaaagaggggccccuggauuucggggcccggcggggcccaauggaaucccuggcgagaaaggccccgccggggagagaggagcuccuggccccgccgggccucgcggagcugccggcgaaccggggcgggauggcguucccggaggcccugggaugagaggaaugcccggcuccccugggggacccggcagcgacgggaagccgggcccucccggaucucagggcgaguccgggcgccccggaccucccggcccuagcgggccgcggggacagcccggcgugaugggguucccuggccccaaaggaaacgauggcgcgccugggaagaauggagaaagaggcgggcccggaggcccgggcccucaagggcccccuggcaaaaacggcgagaccgggccccagggaccucccggcccgacagggccuggaggcgacaagggcgauaccgggccucccggaccccagggccugcaggggcuuccgggaacgggcgggcccccuggagaaaacggcaaacccggcgagccugggcccaagggagacgccggcgcuccuggggcccccggaggcaagggggaugcuggagccccgggcgagcgcggcccucccgggcuggccggagcuccuggccucagagggggagcggggcccccgggcccugaaggaggcaaaggcgccgcugggccucccggaccucccggcgccgccgggacccccggacugcaaggcaugccgggggagcggggaggccugggcucucccgggccuaagggagacaaaggcgaacccgggggaccuggcgcugaugggguccccggaaaggacggcccucgcggcccgacagggcccaucggaccucccggcccugccgggcagcccggagacaaaggcgaagggggcgcgccgggacucccuggcauugcugggccccggggaagccccggcgagagaggggagaccggaccucccggcccugccggguuuccgggcgcccccggacagaauggcgagccugggggaaagggcgaacgcggggcucccggagagaagggcgaagggggcccucccggaguggccggcccgccugggggauccggccccgcggggccucccggaccgcagggcgugaaaggggagcggggcucuccuggaggccccggggcugccggauuccccggcgccagagggcugccuggacccccuggcagcaacggcaauccggggcccccuggacccuccggcagcccugggaaggauggacccccuggcccggcugggaacacaggagcccccggcucuccuggcgucuccgggcccaaaggagacgcuggccaaccuggggagaagggaagccccggcgcccaggggccgccuggagcgcccggcccccuuggcaucgccgggauuaccggagcucggggccuggccgggccucccggaaugccuggcccgcgcgggucucccggaccucagggcguuaaaggcgaauccgggaagcccggagcuaauggccucagcggggagagaggaccucccggcccgcaggggcugccuggacuugccggcacggccggcgaacccgggcgggauggaaacccuggcuccgacgggcugcccggaagagauggcucuccugggggaaagggcgaccgcggcgagaaugggagccccggagcuccgggcgcgcccgggcauccuggacccccuggcccgguggggcccgccggaaaauccggcgaucggggcgaaucugggccugcuggacccgccggcgccccugggcccgcuggaagcagaggcgccccugggccccaaggcccgcgcggagacaagggcgagacaggggagagaggagcggcuggcaucaaagggcaccggggauuuccuggcaaccccggggccccuggcucccccggaccggccggccagcagggggcuauuggaagcccuggccccgccgggccccgcggaccugugggccccucugggccuccgggcaaggauggaaccuccggccaccccgggccuaucggacccccuggccccagagggaaucggggagaacgcggcagcgaggggucuccgggccauccuggacaacccggcccucccgggccucccggagcgccgggccccugcugcgggggagucggcgcugccgccaucgcuggcauugggggagaaaaagccggcggguucgcuccuuacuauggagacgagcccauggauuuuaagaucaacacagacgaaauuaugaccucccucaagagcgugaauggccagaucgagucucugauuagcccugaugggucccggaaaaaccccgcccggaauugucgcgaccugaaguucugccacccugagcucaaaagcggagaauacuggguugacccgaaccagggcuguaagcuggaugcgaucaaaguguuuugcaauauggagaccggcgaaacauguaucucugccaacccccuuaacgucccuagaaagcauugguggacggacuccagcgcugagaaaaagcacgugugguucggggaguccauggauggaggcuuccaguuuucuuacgggaaucccgaacugccugaggacguucucgaugugcaacuggccuuccuucggcugcucagcucccgcgcuucucagaacauuaccuaucacugcaagaauagcaucgccuacauggaccaggccuccggaaacgucaaaaaggcucugaaacugaugggcucuaaugaaggggaguuuaaggcggaaggaaacagcaaauucacauauaccgugcucgaggauggcuguacaaagcauaccggcgagugguccaagacggucuuugaauacagaacacggaaagccgugagacugcccauuguugacaucgcuccguaugauauugggggaccugaccaggaguucggcguggaugucgggcccgugugcuuucuuuga

SEQ ID NO: 67701 - RNA, 1560 nt, Artificial Sequence
  derived and/or modified sequence opt5 from COL4A1__Homo_sapiens__NP_001290039
augggccccagacugagcguguggcuccugcuucugccugccgcucuccugcuucacgaggaacauucccgggccgcggcuaaagggggaugcgccggcucuggguguggaaagugcgacugucacggcgucaaggggcagaaaggagagcgcggccugccgggccuccaagggguuaucggauuccccggcaugcaggggccugaaggaccccagggcccucccgggcagaagggagauaccggcgagccuggccugccggggacaaaaggaacgagaggacccccuggggccagcggauaccccggcaacccugggcugcccggcauuccgggccaagacggcccucccgggccucccggaauccccggcugcaaugggaccaagggagaacggggcccucucgggccgcccggccugccuggauuugcuggcaaccccgggccucccggacuuccgggcaugaagggggauccuggagagauucugggccaugugcccgggaugcuccugaaaggcgagcgcggauucccuggcauccccgggacaccuggacccccgggccuuccugggcugcagggacccguggggcccccuggcuuuaccggcccgcccggaccucccggcccucccgggccucccggagaaaagggccagauggggcucuccuuccagggaccgaaaggcgacaagggggaucaaggcgucucuggaccucccggcgugccugggcaggcccagguucaggagaaaggagacuuugcuacaaagggcgaaaaggggcaaaaaggagagcccggcuuccagggcaugccgggggugggagagaagggcgaaccugggaaacccggaccuagaggcaagcccgggaaagauggagacaagggcgagaaaggcagccccggguuuccuggagaaccgggcuaucccgggcugauuggacggcagggcccucaaggggagaagggagaagccgggcccccuggacccccuggcaucgucaucggcaccggcccgcugggggagaagggagagcgcggcuaccccgggacaccuggacccagaggcgaaccuggccccaaaggguucccgggacucccuggccagcccgggcccccuggacugcccgugccuggccaggcgggggccccgggauuucccggcgagcggggcgaaaagggggaucgcggauucccuggcaccucccuucccgggccuucuggaagagacggccugcccgggccgccuggaagccccggcccucccggccagccuggguauacgaauggaauuguugagugucaacccggcccgccuggggaucagggaccucccggcauccccgggcagccgggauuuauuggcgaaaucggcgagaaagggcagaagggagaguccugccucauuugugacaucgauggcuaccgggggcccccuggaccccaaggcccucccggggaaauuggcuucccuggacagccgggcgcuaaaggggaccgcggacugcccggcagagacgggguggccggagucccucuucuguuucagauccacaaguga

SEQ ID NO: 67702 - RNA, 5139 nt, Artificial Sequence
  derived and/or modified sequence opt5 from COL4A2__Homo_sapiens__NP_001837
augggccgggaccagcgggccguggcugggcccgcccugcgcagauggcuccugcuuggcaccgucacaguuggcuuccuggcccaaagcgugcucgcuggggugaagaaguuugaugucccuugcggcggccgggacuguuccgggggcugccaguguuacccggagaagggcggccgcgggcagcccggcccugugggcccccagggguauaacggaccucccggccugcaaggguucccuggacuucagggcagaaaaggcgauaagggggaacggggagccccgggcguuacggggcccaaaggagacgugggcgcccgcggggucucuggauuuccuggcgcugauggcauccccgggcacccuggacagggcgggcccagaggacggccgggcuacgacgggugcaauggcacccagggagauagcggcccucaagggcccccuggauccgagggcuucaccgggccgcccggaccucagggcccgaaggggcagaagggcgaacccuaugcccugccuaaagaggaacgcgacagauaccggggagagcccggcgagccugggcucgugggauuucagggcccucccgggcgccccggacauguuggccaaauggggcccgugggcgcuccuggaagacccggcccucccgggccgccuggacccaagggccagcaggggaaccggggacugggcuucuauggggucaaaggcgaaaagggagaugugggccaacccgggccuaauggcauucccucugacacccugcaccccaucauugccccuacaggcgugaccuuucaucccgaucaguacaaaggggagaagggaagcgaaggcgagccuggcauccgcgggauuucccucaagggagaggaaggcaucaugggguuccccggacugagaggcuauccugggcuuucuggagagaaaggcagccccggccagaaggggucccggggacuggacggcuaccaggggccggauggaccuagaggccccaaaggggaagcgggagacccuggacccccgggccucccugccuacagcccccacccuucucuggcuaagggggcccgcggagaccccggcuuucccggggcucaaggagagccuggcucccagggggaaccgggagaucccggccuuccuggacccccugggcugagcaucggagacggcgaucagcggagagggcuccccggagagaugggcccuaaaggguucauuggagacccgggcauccccgcccuguauggcgggccucccggaccugauggcaagcgcgggcccccgggaccucccggccugcccgggccucccggaccugacggcuuucucuucggccugaaaggggcgaagggacgggccggcuuuccggggcuucccggaucuccuggcgcuagagggcccaagggauggaaaggcgaugccggcgagugucgcugcacagaaggggacgaggcuauuaagggacugccuggccuccccgggccgaaaggauucgccggcaucaacggggaaccuggccggaagggagauagaggcgaccccgggcagcauggacugccuggcuuccccgggcuuaaaggagucccuggcaauauuggggcccccggcccgaagggagcuaagggcgauucccgcaccaucacgaccaaaggggagcggggacaaccuggcguucccggggugcccggaaugaagggcgacgacgggagcccuggcagagauggacuggacggcuuuccggggcuccccggaccucccggcgaugggauuaaaggaccucccggcgacccuggcuacccggggauccccggaacaaagggcaccccuggggaaaugggacccccuggccuggggcugcccggacucaaaggccagcgcggcuucccgggggaugcgggacugccuggaccgcccggguuucuuggaccucccggcccugccgggacaccgggacagaucgacugugauaccgacgugaagcgggcugucggcggcgauagacaggaggccauucaacccgggugcaucggaggcccuaaggggcugcccggacucccuggacccccggggccuacgggagccaaaggccugcggggcauucccggguucgcuggagccgacggcgggccuggaccccgcggccuuccuggggaugcgggaagagagggcuuucccggcccgccuggguucaucggaccccggggcucuaagggggcugugggacugcccggcccugacggguccccgggacccauuggccucccuggccccgaugggccucccggagaaagaggccugccuggggagguucugggagcccagcccggcccgcgcggggacgccggagugccuggccagcccggccucaaagggcugccuggagaccggggacccccgggguuuagaggaagccagggcaugccugggaugcccggccuuaagggacaacccggccugccugggcccuccggacagccuggccucuaugggccgcccggacugcacggcuucccuggggcucccggccaggaaggaccucugggccuucccgggaucccuggacgcgagggccucccgggggauagaggagaccccggcgauacaggggccccuggccccgucggaaugaaaggccugucuggggaccggggagaugcuggcuuuaccggggaacaaggacacccuggcagccccggguucaagggcaucgacggaaugccgggcacaccugggcugaagggagaucgcggcucccccgggauggacggauuucagggcaugcccggccucaaagggagaccuggauuccccggcagcaagggggaggccggauuuuucggcauuccugggcugaaaggacuugcgggcgagccgggcuucaaggggucucggggagaucccggcccucccgggccucccccggugauccugccuggaaugaaagacauuaagggcgaaaaaggggaugagggacccaugggccucaagggcuaccugggggccaagggaauccagggcaugccugggauucccggacuguccggcaucccggggcuuccuggacgccccggccauaucaaaggcguuaagggggacauuggagugcccggcaucccugggcuccccggauuuccuggcgucgcugggccgcccggaauuaccggcuucccuggcuuuaucgggagcagaggagauaaaggcgcccccgggcgggcuggacuguauggcgaaauuggggccaccggagacuucggcgacaucggcgauacaauuaaccugccugggcgccccggacucaagggcgagagagggacgaccggaaucccuggccugaaaggguuuuucggagagaagggcacagaaggcgacaucggguuuccgggaauuaccggcgugacagggguccagggacccccuggccuuaaggggcaaaccggcuuccccggacugacgggcccucccgggucucagggagagcucggccggaucgggcugccgggaggcaaaggggaugacggcuggccuggagcgcccggccugcccggguuuccuggacuucgcggcauuagagggcuccacggacugcccggcacaaagggguucccuggcagcccgggauccgauauccauggcgaccccggguuuccuggacccccuggcgaaagaggggaucccggagaggccaauacccugccgggcccuguggggguucccggccagaaaggagaccagggcgcuccuggggaaagaggacccccuggcucucccgggcuccaaggauucccgggcauuacacccccuagcaacaucuccggcgcccccggggauaagggagcuccuggcaucuuugggcugaaaggauaccgcggcccgcccgggccucccggaagcgccgcccuuccuggcucuaagggcgacacagggaaucccggagcuccuggcacccccgggacaaagggaugggcgggcgauuccgggccgcagggacggccuggcguguucggccugcccggggagaaaggaccuagaggcgagcagggguucaugggaaacacgggccccaccggggccgucggagaccgcggcccgaagggcccuaaaggggaccccggauuucccggcgcuccugggacagugggagcccccggcauugccgggaucccucagaagauugcuguucaaccgggaaccgugggcccccagggccggagagggccucccggagccccuggcgaaauggggccccagggaccgccuggcgagcccggguuccgcggagcgccuggcaaagcuggcccccaagggcggggaggcgucagcgccgugccuggguuuagaggagaugaaggccccaucgggcaccagggaccgauuggccaggagggcgcccccgggcgcccuggaucucccggccucccugggaugcccggacgguccgugagcaucggcuaucugcugguuaagcacucccagacagaccaagaaccuauguguccggucgggaugaauaaacuuuggucuggcuacagccuccuguacuucgagggacaggagaaagcucauaaccaggaucugggccucgccggguccugccuggcgagauuuucuaccaugcccuuccuuuauuguaauccuggagacgugugcuacuaugcuagccggaacgauaaguccuacuggcugagcacgaccgcgccccucccuaugaugcccguggccgaagacgagaucaaaccguauauuucucgcugcuccgucugugaagcuccugccaucgcuauugccgugcacagccaggauguuucuaucccccauugcccugcgggcuggagaucccuguggauuggguacagcuuucugaugcacacagccgcuggagacgagggcgggggccaaucucuugugagccccggauccugucuggaagauuuccgggccaccccguuuaucgagugcaauggcgggcgcggaacaugucauuauuacgcuaacaaguacagcuucuggcucaccacgaucccugagcagucuuuucagggcucccccagcgccgacacacugaaagccgggcucauuagaacccacaucucccggugccaggucuguaugaagaaccuguga

SEQ ID NO: 67703 - RNA, 2259 nt, Artificial Sequence
  derived and/or modified sequence opt5 from COL4A3BP__Homo_sapiens__NP_001123577
augcagcacagcugcauccccaccccuccgucccccuucucugccccucccgcuuuucugccuguggucacaagagagagccggcgcggccucuccucugggggaagcgccggcagaaacgcggggguuacggcuaccgccgccgcugccgacggauggaagggccggcugcccuccccucuugugcugcucccgcgcucugcuagaugucaagcccggcgcagacgcgggggacggacaagcucccugcuucugcuucccccuacccccgaaagagcgcuguucgccagcccuucucccgauccguccccucggggccugggcgcuagcucuggggccgcugagggagccggcgcggggcuccugcuuggaugccgcgccuccaugagcgacaaucagucuuggaacuccagcggcuccgaagaggaucccgaaacagagucugggccucccguggagagauguggaguccugagcaaauggaccaauuacauucauggcuggcaggaccggugggugguucucaagaacaaugcucuguccuauuacaaaagcgaagaugagacagaauauggcugccgcgggucuaucugucuuuccaaggccgugauuacgccccacgacuuugaugagugcagauucgacaucagcgucaacgauucugugugguaccugcgggcucaggacccugaucauagacaacaguggauugacgccaucgagcagcacaaaaccgaaagcggauauggcuccgagucuagccuccgccggcauggguccaugguuagccuggugucuggagccuccggcuacagcgcuaccucuacauccagcuuuaagaaggggcacucccugagagaaaaacucgcggagauggaaaccuuccgcgauauccugugucggcaggucgacacacuucaaaaguauuuugacgccugcgcugaugccgugucuaaagacgagcugcagagagauaagguggucgaggacgaugaagacgauuucccgaccacgcgcagcgacggagauuuucuccacuccacaaauggcaacaaagagaagcuguucccccauguuaccccuaagggcauuaaugggaucgacuuuaaaggagaagccauuacauucaaggcuaccaccgccggcauccuugcgacacugucucacuguauugagcucauggugaaacgggaagauagcuggcagaagagacuggacaaagagacggagaagaaacgccggaccgaagaggcuuacaagaacgccaugacagaacugaagaaaaagucccauuuugggggacccgacuacgaggaaggcccuaauagccucaucaacgaggaggaguucuucgaugccguggaggcugcccuggacagacaggauaaaauugaagaacaaucucaguccgagaagguccgccuucacuggcccaccagccugccgucuggggacgcuuuuuccagcgugggcacacaccgguucguucagaaaccuuauucuagaagcuccagcaugucuuccaucgaucucgugagcgccuccgacgauguccaucgguuuucuagccaaguggaagagaugguucagaaucacaugaccuacucccugcaggacgugggaggcgaugcgaacuggcagcuugucguggaagagggggaaaugaaggucuaucgcagagagguggaggaaaauggaaucguucuggacccccucaaggccacgcaugcugugaaaggcgucacagggcacgaggugugcaacuacuucuggaacguugaugugcggaaugacugggaaaccaccauugagaacuuucaugucguggaaacacuggccgauaaugcuaucauuaucuaucaaacccacaagagaguguggccugccucucagcgcgacguucuguaccucagcgucauucggaaaauccccgcgcugacagagaacgacccugagacguggaucguguguaauuucuccguggaucacgacucugcuccccuuaacaauagaugcguccgcgccaagauuaacguggccaugaucugccagacccugguuagcccgccugaaggaaaucaggagauuuccagagauaacauccucuguaaaauuacauauguggcuaaugucaaccccggcgggugggcccccgccagcgugcugcgggcuguugcgaagcgcgaauacccuaaguuucugaaaagauucaccucuuacgugcaagagaagacagccggcaaaccgauccucuuuuga

SEQ ID NO: 67704 - RNA, 5013 nt, Artificial Sequence
  derived and/or modified sequence opt5 from COL4A3__Homo_sapiens__NP_000082
augagcgcccggaccgcuccccggccucaggugcugcuccugccgcuucugcucguccugcuugccgcggcucccgccgccuccaagggcugcguuuguaaagacaaggggcaaugcuucugugauggcgcuaaaggcgaaaagggggaaaaaggcuuuccuggacccccugggucucccggccagaagggcuucacaggcccugaggggcugccgggcccccagggcccuaagggguuucccggccucccuggccugacggggagcaaaggcgugcgcggcaucuccggccugcccggguucucuggcagcccgggccucccugggacccccggcaacacaggcccuuacgggcuggugggcguccccggcugcuccggcucuaagggggaacagggauuucccggccuuccugggacccugggauauccgggcauucccggggccgcuggccucaaaggacaaaagggcgccccugcgaaagaggaagacaucgagcuggaugccaagggggaccccggacuuccuggcgcucccgggccgcagggacugccuggacccccuggguuccccggcccugugggacccccgggcccucccggguuuuucggauuucccggcgccauggggccuagaggaccgaagggccacaugggggagcggguuauuggccauaaaggagaacgcggcgugaaggggcucacaggacccccuggacccccugggaccgucaucgugacacugaccggacccgauaauagaacggaccugaaaggcgagaagggggauaaaggcgcuaugggagaaccuggaccucccgggcccagcggacuccccggcgaguccuacgggagcgagaagggagccccuggcgaccccggccugcaggggaaaccgggaaaggauggcguuccuggguuccccggaucugaaggcgugaaggggaaccggggauuuccuggccuuaugggcgaggacgggauuaaaggacagaagggcgauaucgggccgcccggauuccgcggcccuaccgaauauuacgacacauaucaagagaaaggggaugaaggaaccccgggacccccuggccccagaggggcgcggggaccucagggccccuccgggccuccgggaguccccggcagcccugggucuucccgccccggacugagaggcgccccuggcuggcccgggcucaagggaagcaaaggcgagcgggggcgcccgggaaaggacgcuaugggcacaccugggucucccggaugugccggcucccccggccugccugggagccccggaccuccgggacccccuggggacaucguguuuagaaagggacccccuggcgaucacgggcuucccggauaccugggcuccccgggcauuccugggguggacggacccaaaggcgagccugggcuccugugcacccagugucccuauaucccuggacccccgggccugccugggcuccccggacugcauggcgucaagggcauucccgggcggcagggagcugccggccuuaaagggucuccuggaagcccgggcaauacggggcugcccggcuucccuggauuccccggcgcccaaggggauccuggacucaagggcgaaaaaggggagacacugcagcccgaaggacagguuggcgugccuggggacccgggccuucgcggacaacccggcagaaaggggcuggauggaaucccuggcacccccggggugaagggacucccuggccccaaaggggagcuggcucuguccggcgaaaagggagaccagggcccgccuggggaucccggaagccccggcucuccugggcccgcgggaccugccggcccgcccggcuacgggccucagggagagcccggccuccaggggacacaaggagucccuggcgcucccgggccgccuggagaggccggcccccggggcgaacuguccgugagcaccccuguucccgggccucccggaccgccuggaccgcccgggcacccuggaccgcagggacccccugggauucccggaucucuuggcaaaugcggcgacccugggcugcccggaccugauggcgagcccgggaucccgggaauuggcuuuccugggcccccuggacccaagggcgaccagggcuucccggggaccaaaggaagccucggcuguccugggaagaugggagaacccggccugcccgggaagccuggacugcccggcgccaaaggcgagccugcuguggccaugcccgggggccccggcacaccuggguuucccggagaaagaggcaacuccggggagcauggagagaucggccuuccuggccuccccgggcugccuggaacgccgggcaaugaagggcuggauggaccccgcggcgacccugggcagcccggaccucccggcgagcaaggcccgccugggcggugcaucgaaggacccagaggcgcgcaggggcuccccggacugaacggccuuaaggggcagcagggccgccggggaaaaaccggcccuaagggggaccccggcauuccuggccuggauagaucuggguucccgggagagacaggcagccccgggaucccuggccaccaaggagagaugggcccccucgggcagcgcggauacccuggcaaucccgggauucugggaccgccuggcgaagacggggucaucggcaugaugggauuucccggcgcuauugggccucccggaccgccuggcaaccccgggacccccggacagcggggcuccccugggauccccggcgugaaaggacagagaggcacaccuggggccaagggagagcaaggcgauaaagggaauccgggacccagcgaaaucucucacguuauuggcgacaagggcgagccugggcugaagggauucgccggcaaccccggggaaaaaggaaaucgcggcgugccugggaugcccggacuuaagggccucaaaggccugccugggccggcuggacccccuggccccagaggggaucugggauccaccggcaacccuggggagcccggacucagaggcaucccgggcagcauggggaauaugggaaugccuggcucuaaggggaaacgcggaacgcugggcuuucccgggcgggccggaagacccggccuuccuggcauucaugggcugcagggagacaagggcgagcccggguauuccgaaggaacacggccuggcccgcccgggccuaccggagaucccggccucccuggcgacauggggaagaaaggagagaugggccagcccgggccgccuggacaccugggccccgcugggccugaaggagcccccggcagcccuggcucccccgggcugccgggaaagcccggcccucauggggaucuuggauucaaaggcaucaaggggcuccugggacccccuggcauucgcggcccgcccgggcugccuggauuucccggcucuccugggcccaugggaaucagaggcgaccaagggcgggauggcaucccuggacccgcgggcgagaaaggggaaaccggacuccugagagccccgccuggcccccgcgggaacccuggagcucagggcgccaagggggaccggggcgcucccggauucccgggccuuccugggagaaagggagccaugggcgaugcggggccccgcggacccacaggcauugagggguuuccuggacccccuggacugccgggcgccaucauucccgggcagaccggaaauagaggcccucccgggagccggggauccccuggcgcucccgggccgccuggacccccuggaucucacgucaucggcauuaaaggggacaagggaagcaugggccaccccgggccuaaaggacccccgggcacagccggcgacauggggcccccuggacgccucggcgcucccgggacgccuggacugcccggcccuagaggggauccgggauuccagggcuuucccggcgugaagggggagaaaggaaacccuggcuuccugggguccaucggacccccuggccccauugggccgaagggaccucccggcguccggggcgacccugggacccuuaagaucaucagccuccccggaucuccgggcccucccgggacacccggagaaccuggcaugcaaggggagcccggaccuccgggacccccuggcaaccuggggcccuguggaccucgcggcaaacccgggaaggauggaaaaccuggcaccccggggcccgccggagaaaagggcaauaaaggcuccaagggggagccuggacccgccggcagcgacgggcugccuggacucaaaggcaagagaggggauucuggaucccccgcuacauggaccacgcggggcuucguguuuacccgccauagccagacaaccgcgauuccgucuugccccgaaggcacaguuccucuguacagcggguucuccuuucuuuucgugcagggaaaccagagagcccacggccaagaccuggggacccucggaagcugccugcagcgguuuacgacaaugcccuuccuguuuuguaaugucaacgaugugugcaauuucgcuucucgcaacgacuauuccuacuggcuuagcaccccugcccugaugcccaugaauauggccccuaucacaggcagagcucucgagccguauauuucccgguguaccguuugcgaggggcccgccaucgcgauugcugugcauucucagaccacagauaucccucccuguccucacggauggaucagccuguggaagggcuuuuccuucauuauguuuacgucugccggcagcgaagggaccggacaggcccucgcuucccccggcucuugccuggaggaguucagagccagcccguuucuugagugucaugggcgcggaacaugcaacuacuauuccaauagcuacucuuucuggcuggcgucccucaacccugagcggauguucagaaaacccaucccuagcaccgucaaggcuggcgaacuggagaaaauuaucucucgcugucaagugugcaugaagaaacggcacuga

SEQ ID NO: 67705 - RNA, 5073 nt, Artificial Sequence
  derived and/or modified sequence opt5 from COL4A4__Homo_sapiens__XP_005246338
auguggagccugcauaucgugcucaugcggugcuccuuccggcugaccaagucucuugccacaggccccuggagccugauucucauccuguuuuccguccaguacguuuaugggucuggcaaaaaguacauuggcccuugugggggccgcgacugcagcgugugucauugcgugccggagaaaggcucccgggggcccccuggacccccuggcccccaaggcccuaucgggccgcuuggcgcucccggcccuauugggcugucuggcgaaaagggcaugagaggggaucgcggacccccuggcgccgcgggcgacaaaggggauaagggacccacgggcgucccgggguucccuggacucgacggcauccccgggcacccuggaccgcccggcccucggggcaagccggggaugagcggacauaacggcuccagaggggaucccggauuuccuggcgggcgcggcgcucugggacccggcgggccucugggacaccccggcgagaaaggggaaaagggaaauagcguguucauccucggcgccguuaaagggauucagggcgacagaggagauccgggccugccugggcuucccggaucuuggggcgccgggggaccugcuggccccaccggguauccuggcgagcccggacuggugggcccgccugggcagcccggacggcccggccucaaggggaacccuggagucggcgugaaagggcagaugggcgacccgggagaaguuggccaacaggggucccccggaccuacccugcuuguggagcccccugauuuuugucuguacaagggcgagaaggggaucaaaggcauucccggcauggucggccucccugggcccccgggacgcaagggcgaaagcgggaucggagccaaaggcgagaaggggauuccuggauuccccggcccuagaggcgaccccgggucuuauggauccccgggcuuuccugggcugaaaggagaacugggccucgugggggaucccggacuguucggccuuaucggcccuaagggggaccccggaaaucggggccaucccgggccuccgggagugcuggucacacccccucucccccugaaaggcccucccggggauccuggauuuccgggccgcuacggcgagacaggggacguuggacccccuggacccccugggcuucugggaagacccggcgaggcuugcgccgggaugauuggaccgccuggcccccagggcuuccccgggcucccuggacugcccggcgaagcggggaucccuggacggccggacagcgcccccggcaagccugggaagcccggaucuccuggccugcccggcgcuccggggcuccagggacugccuggcuccagcgugaucuauuguuccguggggaaccccggaccucaaggcauuaaagggaaggucggacccccuggcggccgcgggcccaaaggagagaagggcaaugaagggcuuugcgccugugagccgggaccuaugggaccgcccgggccuccgggccugcccggaagacagggcucuaaaggggaucucggacugccuggcuggcuugggaccaagggagaccccggcccucccggggcugaaggcccuccgggacugcccggcaagcacggggccagcggaccucccggcaacaaaggggcgaagggagauauggugguuucccgggugaaaggccacaagggggagagaggcccugacggacccccgggcuuuccugggcagcccggaagccauggccgcgaugggcacgccggagagaaaggcgaccccggcccucccggggaucaugaagacgcuacaccuggaggcaagggguucccgggaccccucggcccucccgggaaggccggaccugucggcccucccggccugggguuucccggacccccuggcgagcgggggcaccccggagugccuggccaccccgggguuagaggaccggauggccugaaaggccagaagggggacaccaucucuugcaaugugacguacccuggacgccauggaccgcccggguucgauggaccuccgggccccaaaggguucccuggaccccaaggcgcuccuggccucuccgggagcgacggacacaagggccggcccgggaccccuggaacagccgaaauucccggcccgccuggguuuagaggagacaugggcgaucccggcuucgggggagagaaaggcucuagcccugucgggcccccgggaccucccggcucccccggggugaacggacagaagggcaucccuggcgaccccgccuuugggcaucugggaccuccgggcaagcgcgggcuuucuggaguccccggcauuaaagggccucggggagaucccggcuguccuggcgcugaagggcccgcgggaaucccuggcuuccuggggcucaagggaccgaaaggcagagaggggcacgccggcuuucccggagugccugggcccccuggccauagcugcgagcgcggagcucccggcaucccggggcagccuggacugcccggcuaccccggguccccuggcgcccccggaggcaaggggcaaccuggagacguuggcccgcccgggccugccggaaugaaaggccugcccgggcuuccuggccggcccggagcucacggcccgccugggcuccccggcauuccuggccccuucggggaugacggacugccgggcccucccgggcccaagggcccuagaggacugcccggcuuuccuggguucccgggagaacgcggcaaacccggggccgagggaugcccuggcgcgaagggcgaacccggggagaagggaaugagcggccucccuggggaucggggacugagaggcgcuaaaggggccaucggacccccuggcgacgaaggcgagauggccauuaucucucagaaggggaccccgggagagcccggcccucccggggaugacggauuuccuggcgaaagaggggauaaaggaacacccggcaugcagggccgcagaggggagccgggacgguauggcccucccggguuccacagaggagaacccggcgagaaggggcagccuggacccccuggcccgcccggcccucccggguccaccggacuucgcggcuuuauuggguucccuggacugcccggcgaccaaggggagccgggaagcccuggacccccuggcuuuucugggaucgauggagcucggggccccaaagggaauaagggagacccugccucccauuucgggcccccgggccccaagggagaaccuggcagccccggcuguccugggcacuucggagcuuccggcgagcaggggcucccgggaauccagggccccagagggucuccuggacgccccggcccucccggcagcuccgggccucccggaugcccgggcgaccaugggaugccuggacugagaggccagcccggggaaaugggcgauccuggaccccggggccugcaaggggacccgggcauuccuggcccucccgggaucaaaggacccucuggcagccccgggcuuaacggccuccacggacugaagggccagaaagggacgaagggagccuccggccugcacgauguggggccuccgggacccgucggcauuccugggcucaaaggcgagcgcggagaccccggcagcccugggaucucucccccgggaccuagaggcaagaaggggcccccuggacccccuggcuccagcgggcccccgggccccgcgggagccacaggccgggcuccuaaagauauucccgacccugggcccccuggagaucagggcccgcccgggccugacggaccccgcggcgccccuggcccucccgggcugcccggaucuguggaucuucugagaggcgaacccggggacuguggacucccuggcccucccgggccucccggaccucccggaccgcccggcuacaagggguuucccggaugcgauggcaaagacgggcagaagggacccguuggcuucccugggccccaaggaccucauggcuuucccggcccuccgggggagaaaggacugcccggcccucccgggcggaagggaccuaccggccugcccgggccgcgcggagagcccggcccucccgcugauguggacgacuguccuagaauccccggccuuccuggggccccgggaaugcggggccccgaaggggcgaugggacucccuggcaugcgcgggcccuccggaccuggcugcaagggcgagcccgggcuggauggaagacggggcgucgacggggugccgggaagcccuggacccccugggagaaaaggagauacaggcgaagacggcuaucccgggggaccuggacccccggggcccauuggagauccuggccccaagggguucggaccuggcuaccugggcggguuucuccuggugcuucacucucagaccgaccaggagcccaccuguccgcugggaaugccucgccucuggacaggcuauagccugcuguaccuugaagggcaggagaaagcccauaaucaagaucucggacuggcuggcuccugccugcccguuuucagcacgcucccuuuugccuauuguaacauccaccaggucugccauuacgcucagcggaaugacagaucuuacuggcuggccuccgccgcuccccuuccuaugaugccccugagcgaggaagcgauccgcccguaugugucccggugugccgugugcgaggcuccugcccaagccgucgcugugcacucucaggaucagagcauucccccuugcccccagaccuggagaucccucuggaucggguacucuuuccugaugcacacaggcgccggagaccaaggcgggggacaggcgcugaugagcccgggcuccugucuugaagauuuucgcgcugcccccuuccuggagugccaggggcggcagggaaccugucacuuuuucgccaacaaguauucuuuuuggcucacaaccguuaaagcugaccugcaauucagcuccgccccugcgcccgacacgcucaaggaaagccaggcucagagacagaaaauuucucgcugccaagugugugucaaguacuccuga

SEQ ID NO: 67706 - RNA, 5058 nt, Artificial Sequence
  derived and/or modified sequence opt5 from COL4A5__Homo_sapiens__NP_000486
augaagcugagaggcgugagccuggccgcugggcuguuccuucuggcccucucccuguggggccagcccgcggaggcugccgccugcuacggcuguucuccugggagcaaaugcgacuguuccggcaucaagggcgaaaaaggggagcggggcuuuccgggccuugaaggccaccccgggcugccuggcuuccccggcccugaggggcccccuggcccgcgcggccaaaagggggaugacggcauucccggcccucccggcccuaaagggaucagagggcccccgggccucccuggcuuucccggaaccccuggccugcccgggaugcccggacaugauggcgcuccuggcccgcaggggauucccggaugcaacggcacaaagggggaacggggauucccuggcucucccggguuuccuggccugcagggacccccgggcccucccgggaucccuggaaugaagggcgagcccgggagcauuaucauguccucucucccuggacccaaaggcaauccgggguauccuggaccgcccggaauccagggccugccugggccgacgggcauucccggcccuaucgggcccccuggacccccuggccuuauggggcccccgggcccucccggacugccuggccccaaggggaacaugggacucaauuuccaaggcccgaaaggggagaagggagaacagggccugcaggggccucccggcccucccggacagauuagcgagcaaaaacgccccaucgacgucgaauuucagaagggcgaucaggggcuuccuggagacagaggcccgcccgggccucccggcauucggggcccucccggcccucccgggggcgagaagggcgagaaaggggaacagggagagcccggcaagcgcgggaaaccuggaaaggauggcgaaaacggccaacccgggaucccuggacugcccggcgacccgggguacccuggagagcccggcagagauggggaaaaaggacagaagggcgacaccggacccccugggcccccuggacucguuauuccgcggcccggcacagggaucaccaucggagagaaaggcaauauugggcugccuggacugcccggcgagaagggcgaacgcggguucccuggaauccagggaccucccgggcuccccggacccccuggcgccgcugugauggggcccccuggacccccgggcuuuccuggcgagagagggcaaaagggagaugaaggaccgcccgggauuuccaucccuggaccgcccggccuggacgggcagccuggagcccccggccuuccuggacccccugggccggcgggaccccacauuccucccagcgaugagaucugugaaccuggacccccggggccucccggaucucccggcgacaaagggcugcagggagagcagggcgugaagggcgacaaaggggauacaugcuucaacuguaucggaaccggcauuuccgggccucccggacaaccuggccucccggggcugcccggcccucccggaagccuuggcuuuccugggcagaagggagagaaaggccaggccggggcuacaggacccaagggccugccggggaucccuggcgcccccggagcuccuggcuuccccgggucuaagggagaaccuggcgacauucucaccuuucccgggaugaaaggagauaagggcgagcugggguccccgggcgccccuggacugcccggccuccccgggacgccuggacaggacggccugccggggcuucccggaccuaaaggcgaacccggcgggaucaccuucaagggagagcggggcccucccgggaauccuggacugcccggccucccggggaacauuggaccuaugggacccccuggcuucgggcccccgggaccugucggcgaaaaagggauccaaggaguggcgggcaaucccgggcagcccggaaucccuggccccaagggcgauccugggcagacaauuacccagccgggaaagcccggccugccugggaaccccggacgcgacggcgauguugggcuuccuggagaccccggccugccuggccaaccggggcuccccggaaucccuggcagcaaaggggagcccggcauuccuggcaucgggcugcccggaccgccuggccccaagggcuuucccgggauuccuggacccccuggcgccccggggacacccggaagaaucggccuggaggggccucccggaccucccggcuucccgggcccuaaaggggaacccggauuugcucucccuggacccccggggccucccggacugcccggcuucaagggggcccuuggaccuaaaggcgaucggggcuuucccgggccuccgggacccccuggccgcaccgggcuggacggacuccccggcccuaagggggaugugggccccaauggacagccuggcccgauggggcccccuggacugcccggcauugggguccagggaccucccggcccgccugggauccccggccccaucggacagccuggccugcaugggauucccggagagaagggcgacccugggccgcccggacuugacgugccuggacccccuggggaaagaggcucucccggaaucccgggcgcuccugggcccauuggaccucccggcuccccugggcuccccggaaaagccggcgccagcggguucccgggcacgaagggagagaugggcaugauggggcccccuggacccccuggcccgcuggggauccccggacgguccggcguuccuggccugaaaggggaugacggacuccaaggccagcccgggcugccuggacccacaggcgagaaggggucuaaaggagaaccuggccuucccggcccgccugggcccauggauccuaaccugcucggaagcaagggcgagaaaggggaacccggacugccgggcauuccugggguguccggacccaagggcuaucagggccugcccggggacccuggacaacccggccuuagcgggcagccuggacucccggggcccccuggccccaagggaaauccuggccugcccggccagccggggcugaucggaccucccggccucaaagggaccaucggagauaugggcuuuccugggccccagggagucgagggcccucccggcccgucuggggugcccggacaaccuggcucccccgggcugccuggacagaagggcgacaaaggggaucccggaauuagcucuaucggccuuccuggccugccggggcccaagggagaaccuggccuccccggguacccuggaaaccccggcauuaaagggagcgugggagacccgggccugccuggccugcccgggacaccuggagcuaagggccagcccgggcuuccgggauucccuggcacccccgggcccccuggccccaagggaaucuccggcccuccggggaaucccggacucccuggcgagcccgggccugucggaggcgggggccaccccggacagccuggcccgcccggggagaaaggaaagccuggccaagaugggauucccggaccugcgggccagaaaggggaacccggccagccgggauuuggcaaccccgggccucccggacugccuggccugucugggcagaagggagacggcgggcuccccggcaucccuggaaacccgggccugcccgggccuaaaggagagcccggcuuccauggguuuccuggaguucaagggcccccgggcccucccggcagcccuggacccgcccuugaaggcccuaaggggaaucccggaccgcagggacccccugggagacccggacugccuggccccgagggcccgccugggcuccccggaaacggcgggaucaagggagaaaaaggcaauccugggcagcccggacugccuggccugcccggccuuaagggggaucaaggaccgccuggccuccaggggaaccccggacgcccuggccugaaugggaugaaaggagaccccggccugccgggcgugcccggguucccuggaaugaagggccccuccggggugccuggaagcgcuggccccgagggggagccuggacucauuggcccgcccggcccucccgggcugccuggacccucuggccaguccaucauuaucaaaggggaugccggaccgccuggcauucccgggcagccuggacuuaagggccugcccggcccucaagggccccagggacucccgggccccaccgggccucccggagacccuggccggaacgggcugcccggauuugacggcgccggcgggagaaagggagauccuggccugccggggcagcccggaacacgcggccuugacgggccucccggcccugauggacugcagggacccccggggccucccggaacgagcucugucgcucacggcuuccucaucacccggcacucccaaacaaccgacgccccucagugcccccaggggacacuccagguguaugaaggauucagccuccuguacguucaaggcaauaaaagagcgcaugggcaggaucuuggcaccgcuggauccugucugcgccgguuuucuacgaugccguucauguuuugcaacaucaauaacguguguaauuucgccagcagaaacgacuauuccuacuggcucucuacacccgagccuaugcccaugagcaugcagccucugaagggccaguccauucaacccuuuaucagccgcugcgccgucugcgaagcuccugccgugguuauugcugugcacucucagaccauccagauuccgcauuguccccaagggugggauucccuguggaucggauacagcuucaugaugcacaccucugccggcgcggagggguccggacaggcccuugcuagcccuggcucuugccuggaagaguuucggagcgcccccuucauugagugucacgggagaggcacaugcaauuauuacgcuaacuccuauagcuuuuggcucgccaccgucgacgugucugauauguucuccaaaccucagagcgaaacacugaaggcgggagaccuccgcacgcggaucuccagaugucaggucugcaugaaacggaccuga

SEQ ID NO: 67707 - RNA, 5001 nt, Artificial Sequence
  derived and/or modified sequence opt5 from COL4A6__Homo_sapiens__NP_001274688
augcaccccggccuguggcuccugcuugugacccugugccucacagaggaacuggccgcugccggggagaagagcuacggaaaaccuuguggcgggcaggacugcuccggaucuugucaaugcuucccggaaaagggcgcgagagggcggcccggaccuaucggcauucagggccccacggggccucagggauuuaccggcagcacagggcuuuccggacugaaaggcgagcgcggguuccccggacuccugggcccuuauggcccgaagggggauaaaggacccaugggcgucccuggguuucugggaaucaacggcauucccgggcauccuggacagcccggcccgagaggcccucccgggcucgacggauguaauggcacccaaggggcuguuggauucccuggccccgauggguaccccggccugcuuggaccuccgggccugcccgggcagaagggaucuaagggcgacccugugcucgcccccgggagcuuuaaaggaaugaagggcgauccugggcugcccggccuugacggaaucacaggcccgcagggggccccuggauuccccggcgcuguggggccugccggacccccuggccugcaggggcccccgggcccucccggaccccucggcccugaugggaacaugggacugggcuuucaaggggaaaaaggagucaagggcgacguggggcugccgggccccgcuggaccucccccuuccaccggcgagcucgaguucaugggguuucccaaaggaaagaagggcucuaaaggggaaccuggacccaagggcuucccgggcauuagcgggccucccggauuuccuggccuggggacaaccggagagaaaggcgaaaagggggagaaaggaauccccggccuuccgggcccucgggggcccaugggauccgagggcguucaggggccucccggacagcagggcaagaaagggacgcugggauuccccggccucaauggcuuucaagggaucgaaggacagaagggcgauauugggcugccuggaccggacguguucaucgauauugacggcgccgucaucagcgggaaccccggagauccuggcgugcccggccuuccugggcugaagggagacgagggcauucaggggcuccgcggacccucuggcguuccugggcugccggcgcuguccggagugcccggcgcccucggcccucaaggguuccccggacugaaaggcgaccaggggaauccuggaagaaccacaaucggcgcugccgggcuucccggacgggauggccugccgggcccucccgggcccccuggacccccuagcccggaauuugagaccgaaacacuccacaacaaggagucuggcuuccccgggcugcgcggagagcagggcccuaaagggaaucuuggacugaagggcauuaaaggcgacuccggguuuugcgcuugugauggaggcguccccaacaccgggccucccggagaaccgggcccucccgggccuuggggccucaucggacugcccggccugaagggggccagaggagaccggggcagcgggggagcgcagggcccugccggggcucccggccucgugggaccgcugggcccuucugggcccaagggaaaaaagggcgagcccauccuuuccacgauucaagggaugccuggagaucgcggcgacagcgggucccagggcuucagaggagugaucggcgaaccggggaaagauggaguccccggccugccugggcuccccggacugccuggcgacggcgggcagggauuucccggcgagaaggggcugccuggacuuccgggcgaaaaagggcaucccggaccucccggccucccuggcaaugggcugcccggacugccgggcccucgggggcuccccggagauaagggcaaggacgggcugcccggacagcaaggccuuccuggcucuaaagggauuacacugcccugcaucauuccuggaagcuauggcccguccggguuccccggaaccccuggcuuucccgggccuaagggaagccgcggccuccccggcacaccggggcagccuggaucuuccggcagcaaaggggagcccggaucuccuggccugguucaccugcccgagcuuccuggguuccccggaccgagaggcgaaaagggccucccuggguuucccggacugcccggcaaagaugggcugccuggaaugaucggcagcccggggcuccccggauccaagggcgccaccggcgacaucuucggggcugagaacggagccccuggcgaacaggggcugcagggacuuaccggccauaagggguuucugggagacucuggccuccccggccugaaaggggugcacggaaagccuggccugcuugggcccaaaggagagcggggcagcccugggacacccggccaagugggacagccgggcacgccuggguccagcggacccuacggcauuaaggggaaaucuggacucccuggcgcccccggguucccgggcaucuccggacacccuggcaagaaagggacccgcggaaagaagggcccccccgggagcauugucaaaaagggacugccuggccugaaagggcuccccggcaauccuggacuggugggccuuaaggggucuccgggaucccccggcguugcugggcugccugcgcucagcggacccaaaggcgaaaagggguccgugggcuuugucggauucccuggcauccccgggcugccuggaauuccgggcacaagagggcugaagggaauccccggcucuaccggcaaaauggggccuagcggacgggccggcacacccggggagaagggagauagaggcaacccugggcccgugggaaucccguccccucgccggcccaugucuaaucuuuggcucaaaggcgacaagggcagccagggguccgcuggaagcaacggcuuccccgggccuagaggagauaaaggcgaggccgggcgccccggaccuccgggccugcccggcgccccugggcugcccggaauuaucaagggcguuucugggaagccuggacccccgggcuuuauggggauucggggacucccuggccugaaaggcuccagcgggaucaccggauuccccggcaugccuggggaaucuggaucccagggcauuagagggagccccggacuuccgggcgcuucuggccugccugggcucaagggagacaauggccaaacgguggagaucagcgggucccccggacccaaaggccagccuggggaaagcggauuuaagggcacaaaaggccgcgaugggcugauuggaaacaucggcuuccccgggaacaagggagaggacggcaaggucggggugucuggagaugucggccugccuggcgccccgggguuucccggaguggcgggcaugcggggggagccuggacuucccggcuccagcgggcaucagggcgcuaucggaccucugggcucccccgggcucauuggaccuaaaggcccgucuaucaccgggguucccggaccugccggccugcccgggccuaagggcgaaaaaggauaucccggcauugggaucggagccccgggcaagccugggcucagaggacaaaaaggcgaccgcggguuccccggccugcagggacccgcuggccuuccuggggcccccggaauuagccugccuucccucaucgcuggccagccgggggaucccggacggccuggccuggacggggagagaggccgccccggaccugccggccccccggggccucccggaccuucuagcaaucagggcgauaccggggaccccggauuuccuggcauccccggcccgaaggggcccaaaggagaucaaggcauuccuggguucuccggacugcccggcgaacuugggcugaagggaaugcggggcgagccuggcuuuauggggacaccgggaaaggugggccccccuggggaccccggauucccuggcaugaaagggaaggcgggacccagaggcucuagcggccuccagggggacccuggacagacccccacagccgaagcuguccaggugccgccuggcccccuggggcucccuggaaucgauggcauucccgggcugacgggagacccgggcgcccaaggcccuguugggcuucagggauccaaaggccugcccgggauccccggaaaggauggcccuagcgggcuccccggaccuccgggcgcucugggcgaccccgggcugccuggacuucagggccccccuggguuugagggagcccccggccagcaagggccguucggaaugccuggcaugcccggccagucuaugcgggugggguacacccuggucaaacacucccagagcgagcaagugccucccuguccuauuggaaugucucagcucugggugggcuauucccugcucuuuguugaagggcaggagaaggcgcauaaccaggaucugggauucgccggcagcugccuuccccgcuucucuacaaugccguuuaucuacuguaauaucaacgaagucugccacuacgcuagacggaaugacaaguccuauuggcugagcaccacagcccccauuccuaugaugcccgugucccaaacccagaucccucaguacauuagcagaugcucugugugugaggcucccagccaggccaucgccguccacucccaagauauuacgaucccucagugcccgcugggguggcgcucucucuggaucggauauagcuuccugaugcauaccgcugcgggcgccgaaggcgggggacagucccuugugucucccggcagcugucuggaggacuuucgggcuacaccuuucauugagugcuccggggccagaggaaccugucacuacuuugccaacaaauauucuuucuggcucacaaccguugaagagcgccagcaauuuggcgaacugcccgugagcgagacgcucaaggcugggcagcugcauacaagagucucccggugccagguguguaugaaaagccuuuga

SEQ ID NO: 67708 - RNA, 5517 nt, Artificial Sequence
  derived and/or modified sequence opt5 from COL5A1__Homo_sapiens__NP_000084
auggacgugcacacccgguggaaggcccggagcgcucugcgccccggcgccccucuccugccgccccuucugcuccugcuucugugggcgccucccccuucccgcgcugcccagcccgccgaucuccugaaaguccuggacuuccauaaccucccugaugggaucacaaagacgaccggcuuuugcgcuacacggcgcucuagcaaaggcccggacguugccuacagagugaccaaggaugcucaacuguccgcccccacaaaacagcuuuauccugcgucugccuuccccgaggacuuuagcauucugaccacagugaaggcuaagaaagggucccaggccuuccucgucucuaucuacaaugaacagggcauucaacagaucggccuggagcuugggcggagcccuguguuucuguaugaagaucacaccggcaagcccggcccggaggacuacccucucuuccgcggcauuaaccuguccgaugggaaauggcauagaaucgcucugagcguucacaagaaaaaugugacgcucauccuggacuguaagaagaaaaccacaaaguuucuugaucggucugaccaucccaugauugauaucaacggcauuaucgucuucggcacccgcauucuggacgaagagguguuugagggggacauccagcagcuccuguucguuuccgaucacagagccgcguaugacuacugcgaacacuauagcccugauugugacacagccgugcccgauacaccccaaucucaggacccuaauccggaugaguacuacacggaaggcgacggcgagggggagacauauuacuaugaauaccccuauuacgaggauccugaagaccuuggcaaagagcccaccccuuccaagaaacccgucgaagcugccaaggagacaaccgaggugccggaggaacugaccccuacacccacggaagcugccccuaugcccgagaccagcgaaggcgccggcaaagaggaggauguggggauuggcgacuaugacuacgucccuucugaagauuacuauacacccuccccguacgacgaucucaccuauggcgagggggaagagaacccugaccagcccacagaucccggagcuggcgcggaaaucccuaccagcacggccgacacauccaauucuagcaacccggcucccccucccggggagggcgccgaugaccuggagggcgaauuuaccgaggaaaccauccggaaucuggaugagaacuacuaugacccuuacuaugaucccacauccagcccuucugagauuggccccgggaugccggccaaucaggacaccaucuacgaaggcauuggcgggccucgcggagagaagggccaaaagggggaacccgcuaucauugagccuggcaugcucaucgaaggacccccgggcccugaggggcccgccggacugccuggaccgcccgggacaaugggaccuacgggccagguuggggauccgggcgagagaggacccccuggccggcccgggcuuccuggagcggacggccugcccgggccuccgggaaccaugcucaugcugcccuuccgcuuuggcgggggcggagacgcuggcuccaaagggccuauggugagcgcccaggaaucucaagcccaggcuauccuucagcaggccagacuggcucuccggggacccgccggcccuauggggcugacaggaagacccggcccgguggggccucccggcagcggaggccugaagggggagcccggagaugucggcccucaagggccccgcggagugcagggcccuccgggccccgcggggaaaccuggacggagaggccgcgccggguccgacggagcucggggcaugcccgggcagaccggaccuaagggcgauagaggcuucgacgggcucgccggacugcccggcgaaaaagggcaucgcggagauccgggcccuucugggcccccuggacccccuggcgacgauggcgagagaggggacgauggagaaguuggccccagagggcuuccgggagagccuggcccccgcgggcugcucggacccaagggcccuccgggacccccugggcccccuggagugacaggcauggacgggcagcccggaccuaagggcaacgucgggccgcaaggagagcccggcccucccggccagcaggggaauccuggagcucagggccugcccgggccgcaaggagccauuggcccucccggggaaaaaggaccccugggcaagccuggccuucccgggaugccuggagcggauggcccgcccgggcacccuggaaaagagggacccccuggggaaaagggaggccagggcccucccgggccccagggacccaucggcuacccugggccccggggagugaaaggcgccgacgggauuagaggccucaagggaaccaagggcgagaaaggggaagauggauucccuggcuuuaagggggacaugggaaucaaaggcgaccgcggggagauuggaccucccggaccccggggcgaggaugggcccgaaggacccaagggcagagggggaccuaacggcgacccggggccccugggcccucccggagagaaaggcaagcuggggguuccuggacuccccggcuauccugggcggcagggacccaagggcagcaucggcuucccgggguuuccuggagcuaauggcgaaaaagggggacgcggcacgcccgggaagccuggacccagaggccaacggggcccgaccgggccuagaggagagcgcggcccccgggggaucacaggaaaacccggcccuaaggggaacuccggaggcgauggccccgccgggccuccgggagagagaggccccaacgggccucagggacccaccggcuucccugggcccaaaggaccuccgggacccccuggcaaggacgggcugcccggacauccuggccagcgcggggaaacaggauuucaaggcaaaaccgggcccccgggaccucccggcguggucggcccccaggggccuacgggagagacaggccccaugggggaaagaggacacccuggcccgcccgggccucccggagagcagggccuuccuggccuggcugggaaggaaggaaccaagggcgaucccgggccggccggacucccuggcaaagacgggcccccuggacugcggggcuuccccggcgaucgcgggcugccgggaccugugggcgcccuugggcucaagggaaaugagggaccgcccgggccucccggcccugcuggaagcccgggcgagagagggcccgcgggagccgcuggcccuauugggauccccggacggccuggcccccaggggccuccgggccccgccggagaaaaaggcgccccuggggagaagggaccccaaggcccugcugggcgcgacggacugcagggccccgucgggcugccgggcccugccggacccgugggacccccuggggaagauggagacaaaggcgagauuggggaacccggacagaagggcucuaagggggauaaaggcgagcagggaccuccgggccccacagggccucaaggacccaucggccagccugggcccuccggagcggacggcgagccgggcccuagagggcagcagggacucuuuggccaaaagggggacgaaggaccccggggcuucccugggcccccuggacccguuggccugcagggccuuccggggcccccuggagagaaaggcgaaaccggggaugugggacagaugggacccccugggccgcccggaccucgcggccccagcggcgcuccuggggccgacggaccccaaggcccucccgggggaauuggcaacccgggggccgucggagagaagggcgaaccuggcgaggcuggggagcccggacugccuggcgaagggggacccccgggcccuaaaggggagagaggagaaaagggcgagucuggccccuccggggccgcgggacccccuggccccaaggggccuccgggagaugacggccccaaagggagcccuggacccgugggcuuuccuggcgaucccgggccgccuggagagcccggcccugcugggcaggacggacccccuggcgauaagggggacgauggagaacccggccagaccggcuccccggggcccacaggagagccuggccccucugggccucccggaaaacggggcccuccggggcccgccggcccugaaggacgccagggcgagaagggggccaaaggagaagcuggccucgaggggcccccuggaaagacgggccccaucgggccgcaaggcgccccuggaaagcccggcccugacgggcugagaggcauucccggaccgguuggggagcagggacugccuggcagccccgggcccgauggcccucccggaccuaugggcccgcccgggcuuccuggacucaaaggcgacuccgggcccaagggagaaaaaggccacccugggcugaucggccugaucggacccccuggcgagcagggggaaaagggagaucggggccucccggggccccagggaucuagcggcccuaaaggcgagcaagggauuaccggacccuccggcccuaucgggcccccgggacccccuggccugcccgggccucccggaccuaagggcgcuaaaggcagcucugggccgacaggacccaagggcgaagccgggcauccuggacccccuggacccccggggccucccggagaggugauucagccucuucccauccaggcguccagaacccgccggaauauugacgccagccagcugcucgacgauggcaacggcgagaauuacgucgacuaugcugaugggauggaagagaucuucggaucucugaacucccugaaacuugaaaucgagcaaaugaaaagaccucucggcacacagcagaaucccgccagaaccugcaaggaccugcagcugugucacccggauuuucccgacggggaauacuggguggauccuaaccaaggaugcagccgggacucuuucaaaguguauuguaauuuuacggcuggcgggagcacaugcguuuuccccgauaagaaauccgagggagccagaauuaccagcuggccuaaggagaaccccggcucuugguucuccgaauuuaagcgcggcaaacuccugagcuacgucgacgccgaggggaauccggugggagugguccagaugaccuuccuucggcugcucuccgcuucugcgcaucagaacgugacauaucacuguuaccaaagcguugccuggcaggaugcugccaccggcuccuacgacaaggcccugagauuucuggggucuaaugaugaagagaugagcuaugacaacaauccuuacauccgcgcucuuguggacggaugcgccaccaagaagggcuaucagaaaacgguccuggagauugauacccccaagguggaacagguuccuaucguggacauuauguucaacgauuuuggggaggcgucccaaaaguucggauuugaagucggccccgcuuguuucaugggcuga

SEQ ID NO: 67709 - RNA, 4500 nt, Artificial Sequence
  derived and/or modified sequence opt5 from COL5A2__Homo_sapiens__NP_000384
augauggccaacugggcugaggccagaccccugcucauccugauugugcuucugggccaguucgucagcaucaaggcgcaagaagaggacgaagaugagggguacggagaagagauugcuugcacccagaauggccagauguaucucaaccgggacaucuggaaaccugccccgugucagauuugcguuugugauaauggggccauccugugcgacaagaucgagugucaagaugugcuugacugcgcugaucccgugacaccucccggagaauguugcccugucuguucccagacgcccggcgggggaaacaccaauuuuggccgcggcagaaaagggcagaagggagagccuggccuggugccgguugugacagggauucggggacgccccggcccugccgggcccccuggaucucagggccccagaggcgaacgggggccgaaaggacgcccuggccccagagggccucaaggaaucgacggcgagcccgggguccccggacagccuggcgcuccggggcccccugggcaccccagccauccuggacccgauggccucucccggccguucucugcccagauggcggggcuggacgaaaagagcggacugggcucccagguggggcucaugccuggcucuguuggacccgugggcccucgcgggccccaaggacugcagggccagcaagggggagccggcccuaccgggcccccgggcgagccuggagaucccggccccauggggccuauuggaagcagaggcccggaggggcccccuggaaagcccggcgaagacggggagccuggccggaacggaaaucccggcgaagucggguuugcuggauccccuggcgcccgcggguuccccggagcuccgggccuuccugggcugaaaggccacagaggacauaagggccucgaggggcccaaaggagaggugggcgccccugggagcaagggagaagcgggccccacaggcccgaugggggccaugggaccucugggcccccgggggaugccuggagagcgcggcagacuugggccccagggagcucccggccagcggggcgcccacgggaugccuggaaaaccgggccccauggggccucugggaauccccgggucuuccggcuuuccuggaaaccccggcaugaagggcgaagcugggccuaccggagccagaggcccggaggggccccagggacaacgcggcgaaacagggccucccggaccugugggcagccccggccucccgggggccauuggaaccgauggcacgccuggggcuaagggacccaccggcucucccgggacauccggaccucccggcagcgcgggcccuccggggucucccggaccucagggcuccaccgggccccagggaauccggggccagccuggggaccccggagucccgggcuucaaaggcgaggccgggccuaagggagagcccggcccucaugggauucaaggacccaucggcccucccggggaagagggaaaaagaggcccgcgcggcgacccugggacaguuggaccucccggccccgugggggaacggggagcuccgggcaauagaggguuucccggcagcgauggacugccuggccccaagggggcccagggagagcgcggcccugugggguccucuggacccaaaggcagccagggggacccuggccggccgggagaacccggccugccuggggccagaggacucaccggcaaccccgggguccagggaccugagggcaagcuggggccccuuggcgcuccgggagaggauggccgcccugggccucccggauccaucggcauucgggggcaacccggaagcaugggccugcccggcccuaaagggucuuccggagacccgggcaagcccggggaagccggaaaugcgggcgugccugggcagagaggagcucccggcaaggauggcgagguugggccuagcggacccgugggcccgccugggcucgccggagaacgcggcgagcaggggcccccuggacccacgggcuuccagggccugccugggcccccgggaccucccggcgagggcggaaaacccggcgaccaaggggucccuggagauccgggcgccgugggcccccuugggccucggggagaaagaggcaaccccggggagcggggagaaccuggcaucacagggcugcccggagagaagggcauggcuggcgggcacggaccugacggccccaaagggucuccgggaccuagcggcacccccggggauacaggaccucccggccuccagggcaugccgggggaacgcggaauugccggcaccccugggcccaagggagacagaggcgggaucggagagaaaggcgcugagggcaccgccgggaaugauggagcgcggggccugcccgggccucugggacccccuggcccggccgggcccacaggcgaaaagggagagccuggccccagagggcucguuggaccucccggcucccgcgggaacccuggaucucggggcgaaaaugggccgacgggcgcugugggauuugccggcccccaggggccugacggacaacccggcgucaagggggagccuggagaacccggccagaaaggggacgcuggcagcccgggaccucagggccuggccgggucccccggaccccacggcccuaacggggugcccggacuuaagggcgggagaggcacccagggaccuccgggcgcgacaggguuccccggaagcgccggccgcgucgggccucccggaccugcuggcgcccccggcccggcugggccucugggagagcccggcaaagaggggccucccggacucagaggcgauccggggucucauggacgggugggcgaccgcggcccugccgggccucccggaggccccggggauaagggagaccccggcgaagaugggcaaccuggaccggacgggcccccuggccccgccggcaccacaggacagagaggcauuguugggaugccuggacagcggggcgagcgcgggaugcccggacugccuggcccggcuggcacccccgggaaagugggaccuacgggcgcgacaggggauaagggacccccuggccccgucgggccgccuggauccaacggccccgugggcgaacccgggccugagggacccgccggcaaugacgggaccccuggaagagauggcgcuguuggggaacggggagaccgcggcgauccgggccccgccgggcuuccuggaagccagggcgcccccgggaccccuggacccgugggcgcuccgggggacgccggacaaagaggcgauccuggcucucgggggcccaucggaccucccggccgcgcggggaagagaggacugccuggcccccaggggccgcggggcgacaaaggagaccacggcgauagaggggaccgcggacagaagggccaucggggguuuacaggacuccagggccugcccgggccucccggcccuaacggagagcaaggcuccgcugggaucccgggacccuucggcccuagagggcccccuggacccgucggcccuagcgggaaagagggcaaucccggaccgcugggcccuauugggcccccuggagugcgcggcuccgugggggaagccggacccgagggcccgccuggggaacccggcccucccggacccccuggcccgcccgggcaccucaccgccgcucugggagauaucaugggccacuacgacgagucuaugccugauccccuuccugaguuuacagaagaccaggccgcgcccgaugacaagaacaaaacggauccggggguucaugcuacccucaagagccuguccucucagauugagacaaugcggagcccugacggauccaagaaacaccccgccagaaccugcgaugaccugaagcugugucauagcgccaaacaaucuggcgaauauuggaucgauccuaaucagggcuccgucgaggacgcuauuaagguguacugcaacauggaaacaggggagaccugcaucagcgccaaucccucuuccgugccucgcaaaacguggugggcuagcaagucucccgacaacaaaccggucugguauggacuugauaugaaucggggcagccaguucgccuacggggaccaccagucccccaacaccgcgaucacacaaaugaccuuccucagacugcugagcaaggaggccucucagaauauuacauauaucuguaagaacuccgugggauacauggaugaccaggcuaaaaaucucaagaaagccguugugcugaagggcgcuaacgaucuugacauuaaagccgaagggaauauccgcuuucgguacauuguccugcaggauaccugcagcaagagaaacggaaacgugggcaagacgguuuucgaguaucggacacaaaauguggcccgccucccuaucauugaccuggcucccgucgaugugggcgggaccgaccaggaauuuggaguugagaucggcccuguguguuucgucuga

SEQ ID NO: 67710 - RNA, 5238 nt, Artificial Sequence
  derived and/or modified sequence opt5 from COL5A3__Homo_sapiens__NP_056534
augggcaacagacgggaccucgggcagccccgcgccggccucugccugcuucuggcugcccuccaacugcuuccuggcacccaggcggauccgguggacguccugaaggcucucgggguucagggcggccaggccggggugcccgaaggcccuggcuucuguccccaaagaacaccugaaggcgaucgggccuuucgcaucgggcaggcuagcacgcugggcauucccaccugggagcuguucccugaaggccacuuuccggagaauuucucccuccugaucacacuuagagggcagcccgccaaccagucugugcugcucagcauuuacgacgaacggggcgcucgccaacugggccuugcccuggggccugcgcucggccugcugggcgaucccuuuagaccucucccccagcaggucaaucugaccgacggccgguggcaucgcguggccguuuccaucgauggggagauggugacacuugucgcugacugcgaggcccagccgccugugcugggccacggccccagauucauuucuaucgcugggcucaccguucugggaacacaagaucuuggcgagaaaaccuuugagggggacauccaggaacugcucauuagcccugauccccaggccgcguuccaagccugugagcgguaucugcccgacugcgauaaccuggcuccugccgcuacgguggccccgcagggagagcccgaaaccccucgccccagacggaagggcaaaggcaaggggcgcaaaaagggaagaggccggaaggggaaaggaagaaagaaaaauaaggagaucuggacauccucuccucccccggacagcgccgaaaaccagaccuccacagacauuccuaaaaccgagacgcccgcuccuaaucugcccccuacacccaccccgcuggucgugacaagcaccgugaccacaggccuuaacgcgacgauccuggaacgcucucucgauccugacuccgggaccgagcugggcacacuugagaccaaggccgcucgggaagaugaggaaggagacgauagcacaaugggccccgacuuuagagccgccgaguaccccucucgcacccaguuccaaauuuuuccuggggcuggagaaaagggcgccaaaggggagccggcggucaucgagaagggacagcaguucgaaggacccccuggggcucccggcccucagggaguugugggccccuccgggccucccggaccgccuggcuuucccggggauccuggacccccgggcccugccgggcugcccggcauuccuggaaucgacggcauccgggggccgcccggaacggugauuaugaugccuuuccaauucgccggcgggagcuuuaaaggaccgcccgucucuuuccagcaggcucaggcccaagcugugcuccagcagacacagcuguccaugaagggcccucccgggccuguuggccugaccggaagacccggcccuguggggcucccgggacaucccggccugaaaggggaggaaggagccgagggcccucaaggcccccgcgggcuucagggaccucacggcccucccgggcgggucggaaagaugggcagacccggggcggauggagcccgcggccugcccggcgacaccgggcccaaaggagaucggggcuuugacgggcucccuggacugcccggcgaaaaggggcagagaggagacuucggccaugugggccaaccugggccgcccggagaggauggcgagcgcggggcugaaggaccucccggcccuacagggcaggccggagagcccggcccgcggggccugcuugggccuagaggaagccccggcccuaccgggcggcccggaguuacaggcaucgacggggcuccuggagccaagggcaaugugggaccucccggggaacccggaccgcccggccagcaggggaaccacggaucccaaggccucccugggccgcagggacugauuggcacgcccggcgagaaagggccucccggaaauccuggcauccccgggcugccuggaucugauggcccgcucgggcaccccggacaugagggcccuaccggcgaaaagggggcgcagggacccccuggcagcgccgggcccccgggauauccuggcccccgcggggucaaaggcacauccggaaacagaggccugcagggggagaagggagaaaaaggcgaggacggguuucccggauucaagggcgauguggggcuuaagggcgaccaaggaaaaccuggcgcucccgggccucggggagaagauggcccggaggggcccaagggacaggccggccaggcuggggaggaaggcccucccggaagcgccggcgagaaagggaagcugggagucccuggccuccccggguacccgggaagaccuggccccaaaggcucuauuggguuuccuggaccccugggcccuaucggggaaaagggaaaguccggcaaaaccgggcagcccggacuggagggcgaacgcggcccgccugggagccggggagagagaggccaacccggggccacaggacagcccggcccuaagggggacgugggacaggauggcgcuccgggcauccccggggagaaaggacuuccuggccuccaagggcccccuggauuccccggcccuaaggggcccccgggacaccagggcaaagacggccgcccugggcaucccggacagagaggcgaacugggguuucagggacaaaccggcccucccgggccggcgggaguucugggcccucagggcaagacgggggaggugggaccccucggcgaacgggggcccccuggacccccuggcccgcccggggagcagggacugccuggccuugaaggccgcgagggggccaagggagagcugggacccccugggccccucggaaaagaaggcccugcugggcugagaggauucccgggccccaagggcgggccuggagaucccggcccuaccgggcugaaaggagacaagggaccucccgggcccgucggcgccaauggaucucccggcgagcgggggccccuuggaccugccggcgggauuggacuccccggccagagcggguccgaaggcccugugggaccggcuggcaaaaaggggucucgcggagagagaggacccccugggcccacaggaaaagauggcaucccugggccccugggcccgcugggaccucccggcgccgcggggccuagcggagaggaaggcgacaagggggacguuggagcucccggccacaagggguccaaaggcgauaagggagacgccggcccgccugggcaacccggcauucggggccccgccgggcacccuggacccccuggcgcugauggcgcccaggggcgcagaggaccgcccggccucuuugggcagaaaggagacgauggcgugcggggguucgucggagugaucggcccucccggccugcaggggcuuccuggacccccuggcgagaagggggaagugggagacguuggcagcauggggccgcauggagcgcccggcccucgcggcccccaagggccuaccggaucugagggcacacccgggcugccgggaggcgucgggcagccuggagcugugggcgaaaaaggcgagagaggggaugccggagaccccggacccccuggggcccccggcauuccuggcccgaagggggauaucggagagaagggcgacuccggccccagcggggcugccggaccucccggcaaaaaggggccucccggagaagauggcgcuaaagggucugugggaccgaccggccucccuggcgaccuggggcccccuggagaucccggcgucuccgggaucgacggaagcccuggcgagaagggggaccccggagaugugggcggcccggggcccccuggagccuccggcgaacccggggcgccuggaccgcccggcaaacgggggccuucuggccacaugggaagagagggccgcgaaggggagaagggagccaagggcgagcccgggccugacggacccccuggccggacggggcccaugggcgcuagaggaccgccuggccgcguugggcccgaaggacugcggggcauuccugggcccgugggagagccgggccuucucggggccccuggccagaugggaccgcccggcccucuggggcccagcggacugccuggccucaaaggggauacaggaccgaagggcgaaaaagggcauaucggccugauuggacuuaucggacccccuggggaggcuggagaaaagggcgaccaggggcugcccggaguccaaggcccucccggcccgaaaggggauccuggacccccuggccccauugggucccucggacacccuggacccccggggguggccggaccccugggccagaagggcucuaaggggagcccuggauccaugggccccagaggggacaccggaccugccggacccccugggccgcccggagcuccugcggagcugcauggccuucgccggagacgccgguuuguucccgugccucugcccgucguggagggcgggcucgaagagguucuggccagccucacaucucugucccuugaacuggagcagcucagacggccgccuggaaccgcugagcgccccggccuggugugucacgaacugcacagaaaccauccucaccuucccgauggggaguauuggaucgacccgaaucaaggaugcgcccgggauagcuuccgcgucuucuguaacuuuaccgccggcggggaaacaugccuguacccugacaaaaaguucgagauugugaaacucgcuucuugguccaaggaaaaacccggaggcugguauagcacguuuagacggggcaagaaauucucuuacguggaugccgacgggagccccgucaacguugugcagcugaauuuucucaagcugcuuuccgcgaccgcuagacagaacuucacauacagcugucagaaugccgccgcuuggcuggacgaggccaccggagauuauucucauuccgcgcgcuuucucggcacaaacggggaggaacugagcuucaaucaaaccacggcugccacaguguccgucccucaggacggaugccggcugagaaagggccagaccaaaacccuuuuugaguucucuagcucccgcgccggguuucugccccucugggauguggcugccacagacuucggacagaccaaccaaaaguuuggcuucgaacugggcccuguuuguuucucuagcuga

SEQ ID NO: 67711 - RNA, 3087 nt, Artificial Sequence
  derived and/or modified sequence opt5 from COL6A1__Homo_sapiens__NP_001839
augagagccgcucgggcccugcucccccugcuucugcaggcgugcuggaccgcugcccaagacgagccugaaacaccgcgcgccguggcuuuccaggauugucccgucgaccucuuuuucguucuggauacgagcgaguccguggcccuuagacugaagccuuacggcgcucucguggacaaagucaagucuuuuaccaaacgguucaucgauaaccugcgcgacagauauuaccggugcgaucgcaaucugguguggaacgccggggcgcuccacuauagcgacgaaguugagauuauccagggacugacaagaaugcccggcgggcgggaugcccuuaaguccucuguggacgcugucaaauacuuuggaaagggcaccuauacagauugugccauuaagaaagggcuggaacagcuccuggugggaggcagccaucuuaaggagaauaaauaccugaucguugugaccgacggccacccucucgagggguauaaggaacccugcggaggccuggaggaugcugucaacgaagccaaacaucugggggugaagguguucuccgucgcgauuacaccugaccaccucgagccgcgccugucuaucaucgccaccgaccauacguacagacggaauuuuaccgcugccgauuggggacaaagccgcgacgcugaggaagccauuucccagacaaucgauaccauuguugacaugaucaagaacaauguggaacagguguguugcagcuucgagugucagcccgccagaggcccucccgggcuucggggagauccuggcuuugagggcgaacgcgggaaacccggacugccgggcgagaagggggaggcuggagacccuggcagacccggggaucucggaccugucggcuaccaaggcaugaaaggggaaaagggaucucggggcgagaaaggguccagaggacccaagggcuauaaaggggaaaagggcaagcgcggaauugacggcguggaugggguuaaaggagagaugggcuaccccgggcugccuggaugcaagggcagcccgggguucgacggcauccagggacccccuggccccaaaggggauccuggagcguuuggccuuaagggggaaaaaggagagcccggcgccgacggggaggcuggccggccgggaucuuccggcccuagcggggacgaaggacagcccggcgagccugggcccccuggagaaaagggcgaggccggggaugaaggcaaccccggaccggacggcgccccuggggagagaggaggccccggggagcgcggaccccggggcacaccuggcaccagagggccgcgcggagaucccggcgaagcugggccucagggagaccaaggccgggaggggcccgugggagucccuggcgaucccggcgaagccgggccuauuggacccaagggcuauagaggggacgagggaccgccuggcucugagggggcgcgcggagcucccggcccugccggacccccgggggauccuggacugaugggcgaaagaggggaggacggacccgccggcaaugggacggaaggauucccuggcuuucccggcuaccccgggaaccggggagcuccuggcaucaaugggacaaaaggauauccgggccucaagggggaugagggagaagccggcgaccccggcgaugacaacaaugauaucgcuccucgcggggugaaaggagccaagggcuaccgggggcccgagggaccucaggggcccccugggcaccagggaccgcccggcccugacgagugugaaauucuggacaucauuaugaaaaugugcuccuguugcgagugcaaguguggccccaucgaucuccuguucguucuggacagcuccgaaucuauugggcuucaaaacuucgagaucgcgaaggauuuuguggucaaagugaucgacagacugagccgggaugaacucgucaaguucgagccuggacaguccuaugccggcgugguucaguacagccacucucagaugcaagagcaugugucccugcgcagccccucuauuagaaauguccaggaacuuaaagaggcuaucaagagccugcaguggauggccgggggaaccuuuacaggcgaagcucuccaguacacccgggaccaacugcugccgccuucccccaacaacagaauugcccucgugaucaccgaugggcgcucugacacacagcgggauacgacaccccugaauguucuuugcagcccuggcauucagguggucuccgugggcaucaaagacguguucgauuuuauccccggcagcgaccagcugaacguuauuucuugucaagggcucgcgccuucccagggaagaccgggccugagccuggucaaggagaauuaugccgaacuucucgaggaugcuuuccugaagaacgugaccgcccagaucugcauugacaaaaagugucccgacuauaccugcccuaucacauuuucuucccccgcugauauuaccauccugcucgacgggagcgccuccgugggaucucacaauuucgauacgacaaaacgcuuugccaagagacuggcugagcgguuccuuaccgcgggccgcaccgacccugcccaugaugucagaguggcuguugugcaguacagcgggacaggccaacagcggcccgaacgcgccucccugcaguuucuccaaaacuacaccgcccuggcuucugccgucgacgcgauggauuucauuaaugacgcuacagaugugaacgacgcccugggauauguuacgagauuuuaccgggaggccagcuccggcgcugccaaaaagcgccuucuccuguucagcgauggcaauucucagggagcgaccccggcugccaucgaaaaagccgugcaggaggcucagagagccggcaucgagauuuucgucgugguuguggggcggcaagucaacgaaccucacauccgcgugcuggugacaggaaagaccgcugaguaugacgucgccuacggcgaaucccaccucuuuagaguucccagcuaccaggcgcugcuuagagggguguuccaucagacagugucucggaaggucgcccugggcuga

SEQ ID NO: 67712 - RNA, 2757 nt, Artificial Sequence
  derived and/or modified sequence opt5 from COL6A2__Homo_sapiens__NP_478054
augcugcaggggaccugcagcgugcuccugcuuugggggauccugggagccauucaagcucagcagcaggaggucaucucccccgacacaacggaaagaaacaauaacuguccugagaagaccgauugcccgauucacguuuacuucgugcucgacacaucugaaagcgugaccaugcaaucccccacagauauccugcuuuuucauaugaaacaguucgucccucaguuuauuucucagcugcaaaaugaguucuaucucgaccagguggcccugagcuggcgguacggcgggcugcacuuuuccgaucagguugaaguguucucucccccuggaagcgaccgcgcguccuuuaucaagaaccuccagggcaucagcucuuucagacgggggaccuuuacagauugugcucuggccaauaugaccgagcaaauucgccaggacagauccaaaggaacgguccauuucgccgugguuaucaccgauggccacgugacaggcagccccugcgggggaauuaaacuucaggcugagcgggcccgcgaagagggcaucagacuguuugcugucgccccuaaccaaaaucucaaagaacaggggcugcgggacauugcgucuaccccgcaugagcuuuaucgcaacgauuacgccacaaugcugcccgacuccaccgagaucgaucaggacacgauuaauagaaucaucaaggugaugaagcacgaggcuuauggagaauguuacaaagugagcugccucgaaauuccuggccccucugggccuaagggauaucggggccagaaaggcgccaaggggaacaugggagagcccggcgaaccggggcaaaaaggacgccagggcgacccugggaucgagggacccauuggcuucccuggccccaaggggguccccggauuuaagggcgagaaaggggaguucggagcugauggcagaaagggggccccuggccuggcgggaaagaauggcacagacgggcagaagggaaaacugggccggaucgggccgcccggauguaagggcgauccugggaaccgcggccccgacggauacccuggcgaagccgggucccccggagaaagaggcgaucaagggggaaaaggcgacccggggcggccuggcagacgcggacccccuggcgagauuggggcuaagggaagcaagggcuaccagggcaauuccggagcccccggcucuccugggguuaaaggcgcuaagggaggccccgggccgcggggaccuaaaggcgaacccgggagacgcggagaucccggcaccaagggcagcccuggguccgacggaccgaaaggcgagaagggggaucccggaccugagggcccccgggggcucgccggagaagugggcaacaagggcgccaaaggggacagaggacugccuggcccccgcgggccucagggagcucuuggcgagcccgggaagcagggaagccggggcgauccgggcgacgcggggccuagaggagacucuggccagcccgggccuaaaggagaucccggccgcccgggguucuccuauccuggaccccggggcgccccuggcgaaaagggggagcccggacccagaggcccugaagggggacgcggcgacuuugggcugaaaggagagccgggccggaagggcgagaagggggaacccgcugauccuggacccccuggcgagcccgggccuagaggaccgcggggcgugcccgggccugaaggagagcccggcccucccggcgacccggggcucacagagugcgaugucaugaccuacgugcgcgaaaccuguggaugcugugacugcgagaaaagaugcggcgcccuggauguuguguucgucaucgacagcucugaaagcaucggguauacaaauuuuacgcuugagaagaacuucgugauuaacguugugaaucggcugggagccaucgcuaaagauccuaaguccgaaaccggcacaagagucggggugguccaauacucucacgagggaaccuuugaggccauucagcucgacgaugaacgcaucgacagccuguccagcuucaaagaggcggugaagaaccuggaauggauugcuggcggcacauggacccccucugcccucaaguuugccuaugaucggcugaucaaagaguccagacgccagaagacgagaguuuucgcuguggucaucacagacgggcggcaugacccccgcgaugacgaucuuaaucugagagcccucugugaccgggaugugaccguuaccgcuauuggaaucggcgacauguuucacgaaaaacaugagagcgagaaccuguacucuauugccugcgauaagccucagcaagugcgcaauaugacacuuuucuccgaccuggucgcggaaaaauuuaucgaugacauggaggaugugcucugucccgacccucagauugugugcccggaucugcccugucagaccgacgccccuuggcccgggggagaaccucccguuacauuccugagaacggaggaaggcccggacgcuaccuuuccucggacaaucccccucauucaacagcugcuuaacgccaccgagcugacacaggauccugcugccuauagccagcucgucgcggugcugguguacaccgccgagcgcgcuaaguucgccacgggggucgaaagacaagacuggauggagcuguucaucgauaccuuuaaacuugugcaccgggacaucguuggcgaucccgaaacagcucucgcccugugcuga

SEQ ID NO: 67713 - RNA, 9534 nt, Artificial Sequence
  derived and/or modified sequence opt5 from COL6A3__Homo_sapiens__NP_004360
augcggaagcaccggcaucugccccugguggccguguucugccuguuucuuagcggauucccuaccacgcacgcucagcaacagcaggccgacguuaagaacggggcggcugccgauaucauuuuucugguggacuccucuuggacgaucggagaagaacauuuccagcucgugcgcgaauuucuguacgaugucgucaagagccuugccguuggcgaaaaugacuuccacuuugcucuggugcaauucaacgggaauccgcauaccgaguuucuccugaacacauauagaaccaagcaggaaguccugucccacauuucuaauaugagcuacaucggaggcacaaaccagaccgggaagggacucgaguauauuaugcagucccaccugacaaaagccgcuggcucucgggccggcgauggggugccccaaguuaucgugguccuuaccgacggacauagcaaggauggccuggcgcucccuuccgccgagcucaagagcgcugacgugaauguguucgccaucggggucgaagaugcugacgagggagcccuuaaagaaauugcgucugagccccugaacaugcacauguuuaaucucgagaacuucacgucccugcaugauaucguuggcaaucuggugagcugugugcacucuuccgucagcccugaacgcgccggggacaccgagacacucaaggauauuaccgcucaggacucugccgacaucauuuuucugaucgauggauccaacaauacaggcagcgugaacuucgcuguuauucuugacuuccuggugaaucuccuggaaaaacuucccaucggcacccagcagaucagagucggggugguucaauuuuccgaugagccucggacgauguucucucuggacacauacagcaccaaggcccaggugcucggagccgucaaagcucugggcuuugccggcggggaacuggccaacauugggcucgcucuggauuucguggucgagaaccacuuuacacgcgccgggggauccagaguggaggaaggcguuccccaggugcuuguccugaucagcgccggccccucuuccgacgagauucgguauggggugguugcucucaagcaagccagcguguucucuuuuggacugggcgcgcaggcugccagccgcgccgaacuucagcauaucgcuaccgaugacaaucuggucuucaccgugccugaguuuagauccuucggggaucuccaggaaaagcugcugcccuacauugugggaguugcccaacggcacaucguccucaaaccucccacaaucgugacacaggugauugaggucaacaagcgcgacaucguguuucugguugauggcucuagcgcucuugggcuggccaauuucaacgcgauuagagacuuuaucgccaaagugauucagcggcucgagaucggccaggaccugauccaagucgcuguggcccaguaugcugauaccguucgcccggaguucuacuucaauacacauccuaccaagagagaagugauuacagccguccggaaaaugaagccccuggacggauccgcgcuuuacaccggcagcgcccucgauuuugugagaaacaaucuguucacgucuuccgcuggguaucgcgccgcugaaggaaucccuaaacugcucguucugauuacaggcggaaagagccuugacgagaucucucagcccgcccaggaacugaagcgguccagcauuauggccuuugcuaucggaaacaaaggcgcggaucaagccgagcucgaggaaauugcuuucgacuccucucugguguuuauccccgccgaguucagagccgcuccucugcaggggaugcuuccgggccuccuggcgccgcugcgcacccucagcggaaccccugaaguccacuccaauaagcgggauaucauuuuucugcuugacggcucugcgaacguggggaaaacaaauuuccccuacgugagagauuuugucaugaaccugguuaauagccucgacaucggaaacgauaauauucgcgugggccuggugcaguucuccgacaccccugucacagaguuuagccugaacacguaucagaccaagucugauauccuugggcaucuccggcaacugcagcugcagggaggcuccgggcucaacacaggcagcgcucugucuuacguguaugccaaucacuucaccgaggccggaggcucccggauucgcgaacacguuccccaacuucugcuccugcugacagcugggcagagcgaggacucuuaccuucaggccgcgaacgcucucacccgggccggaauccugacguuuugcgugggcgccagccaggcuaauaaagccgaacuggagcaaaucgcuuucaacccgucccucgucuaucugauggacgauuucagcucucuuccugcccugccccagcagcucauucagccucugaccacauacguguccgggggaguugaagaggugccccuggcgcaaccugagagcaagagagacauccuuuuucuguucgauggcuccgccaaucucgucgggcaguuucccgugguucgcgacuuccuguacaagauuaucgaugaacucaacgugaaaccggagggcacccggauugcugucgcccaguauucugacgaugugaagguggaaagcagauuugacgagcaucaguccaaaccugaaauccugaaucuugucaagcggaugaaaaucaagacaggaaaggcucugaaccucggcuacgcccuggauuaugcccaacgcuacauuuucguuaaaucugcugggagcagaaucgaggacggagugcugcaguuucuugugcugcucgucgcgggccgguccucugauagaguggacgggcccgccagcaaucugaagcaguccggaguugugcccuucauuuuucaagcuaaaaacgccgauccugccgagcucgaacagaucguccugagcccggcuuucauucuugccgcggagucucugcccaagaucggcgaccuccacccucagaucgugaaucugcugaaauccguucauaacggcgcucccgccccugugagcggggaaaaggacgucguguuucuucuggauggaucugagggcguccgcuccggguucccccuccugaaggaguucgugcagcggguuguggagagccucgacgucggacaagauagagugcgcguugccgugguccaguauucugacagaacccggccugaguuuuaccucaauuccuauaugaacaaacaggauguggugaaugcuguucgccagcuuacgcugcugggcgggcccacaccgaacaccggagccgcgcucgaguucguccugagaaacauucuugugagcuccgcuggcagccggaucacagagggcgugccucaacugcucauuguccugaccgccgaccgcucuggggaugacgugagaaaucccagcguuguggucaagcggggaggcgccgugccuaucgggauuggaaucggcaacgcugauauuaccgaaaugcagacaaucuccuuuauccccgacuucgccguugcuauuccgacguuucgccagcucgggaccgugcagcaagucaucucugagagagugacacagcugacccgggaggaacuuagccgccugcagccuguucugcagccccucccuucccccggagugggcggcaaaagagaugucguguuccugauugacgggucucaaagcgccggacccgaguuucaguacgugcggacacuuaucgaaagacuggucgacuaccucgauguuggcuucgacaccacgcgcguggcggugauucaguuuuccgaugacccuaaggucgaguuccugcucaaugcccacucuagcaaagaugaagugcaaaacgcuguucagcggcugagaccgaaagggggacgccagaucaaugugggcaacgcccuugaguaugucucccggaauaucuuuaagagaccccuggggagccgcauugaggaaggagugccucaguuccugguucucaucucuuccggcaagagcgacgaugagguggacgaucccgcugucgaacugaagcaauuuggcguggccccuuucacaauugcccggaacgcugaccaggaggaacuugucaaaaucucucugucccccgaguacguguucagcguuuccaccuuuagagagcucccuucucuggaacagaagcuccugaccccgauuacaacccuuacaagcgagcagauccaaaaacugcuggcguccacgcgcuaucccccucccgccguggaaagcgaugcugccgacaucguguuccucauugauucuuccgaggggguccggccugacggauuugcccacaucagagacuucguuagccggauugugcgcagacugaauaucggccccucuaaggugcgggucggggugguucaguuuagcaacgauguguucccggaauuuuaccuuaaaaccuaucgcucccaggcuccuguccuggacgccauuagacggcucagacugcgcggaggcucuccccugaauacagggaaggcgcucgaguucguggcucggaaccuuuuugucaagagcgccggauccagaaucgaggauggcgugccccagcaucugguucuggugcucggcgggaaaucucaagacgaugucagccgcuucgcccaggugauucgguccagcggaaucguuucucugggcgugggggacagaaauaucgaucgcaccgaacuucagacaauuaccaacgacccucggcuggucuuuacggugagagaguuccgcgaacuccccaauaucgaggagagaauuaugaacuccuuuggaccuagcgcugccaccccggcgcccccuggcguggauacacccccucccucccggccggaaaagaaaaaggccgacaucguuuuccugcuggaugggucuauuaacuuccgcagagacagcuuucaagagguccuccgguucguguccgaaaucguggauaccgucuacgaggacggagacucuauccagguuggccuugugcaguauaauagcgauccuacagacgaauuuuuccugaaagauuuuuccaccaagcgccagauuaucgacgcuauuaacaagguggucuacaaaggcgggagacacgccaauacaaaggugggacuggagcaucuccggguuaaccacuucgugcccgaggcuggcagcagacuggaucaacgcgucccucagaucgccuuugugauuaccgggggaaaaucuguugaagacgcucaggaugugucccuugcccugacgcagcggggcgucaagguguucgcggugggggucagaaauaucgacagcgaggaaguuggaaaaaucgccucuaacuccgcuacagccuuucgcgugggcaaugugcaagagcucagcgaacugucugagcagguccuggagacccuccaugaugcuaugcacgaaacccuuugucccggcgugacagacgccgccaaggcuugcaaccuggauguuauucugggguucgacggaagccgggaccagaauguguuugucgcgcagaagggcuucgaguccaaaguggaugccauccucaacagaauuucucaaaugcaccggguuagcuguuccgggggacgcagcccuaccgugagagucuccgugguugcuaauacgcccucuggcccgguggaagccuuugacuucgaugaguaccagccugaaaugcuggagaaguuccggaacaugcgcagccagcaucccuauguccuuacagaggacacccugaaaguguaccucaauaaguuuagacaguccucucccgauagcgucaaagugguuauccacuucacagacggggccgauggcgaccuggcugaucugcaucgggccuccgaaaaccuccgccaagagggagugagagcgcuuauucuggucggccuggaacggguggugaaucucgagcgccugaugcaccuugaguuugggagaggauucauguaugaccggccucugagacucaaccugcuggaucucgacuacgaacuugccgagcagcuggauaauaucgcugaaaaggccugcuguggcguuccgugcaaauguucugggcagcgcggagaccggggccccauugggagcaucggcccuaagggaauccccggcgaggacggguauagaggauacccuggcgaugaagggggacccggcgagcgcgggccuccgggcgugaacggaacccaaggcuuucaggggugccccggacagcggggcgucaagggguccagaggauucccuggcgagaaaggcgaagugggggagauuggacuggacggccucgauggggaagacggagauaagggccugcccgggagcucuggagagaaaggcaacccuggccgcagaggggacaagggacccagaggcgaaaaaggggagcgcggagauguuggcaucagaggggacccgggaaauccuggccaggauucccaagagagaggccccaagggggaaacaggagaccuuggccccaugggggugccuggacgcgauggcguccccgggggaccuggcgagaccggcaagaacgggggauuuggccggagagggccgcccggagcuaaaggcaauaaagggggaccuggccagcccggcuucgaaggggagcagggaacgcgcggcgcccaggggccugcgggacccgccggcccgccugggcugauuggagaacaaggcaucagcggccccagagggucuggaggcgcugccggggcuccuggagagcggggccgcaccgggccccucggaagaaagggcgagccuggcgaacccgggccgaagggaggcauugggaaccggggaccuagaggcgagacaggggacgacggccgggauggagugggcuccgaagggcgcagaggcaagaagggcgagcggggguuucccggauaucccggcccuaaggggaauccgggcgagcccggacugaacggcaccacagggccuaaaggaauccgcggcagacgggggaauagcggacccccuggcaucgucgggcagaagggcgaccccggauacccuggccccgccgggccgaaaggaaaccgcggcgauucuauugaccagugugcucugauccaguccauuaaggauaaaugcccuugcuguuacgggccccucgaaugcccuguguuccccaccgagcuugccuuugcgcuggacacgagcgaaggaguuaaucaagauacauucggcagaaugcgggacgugguccuguccaucgugaacgaucucaccauugccgagagcaauuguccgcgcggggcuagaguugccguggucacauauaacaaugaagugaccaccgagauccgguuugcugacucuaagcgcaagagcgugcugcuugauaaaaucaagaaccugcagguugcccucacauccaaacagcaaucucuggagacggccaugagcuucgucgcgagaaauaccuucaagcgggugcgcaacggcuuucugaugagaaaaguggcugucuucuuuuccaacacaccuacccgggccucuccccagcucagagaagcugugcuuaagcugagcgacgccggaauuacaccccuguuccucacccgccaggaggaucggcagcugaucaaugcccuucaaauuaacaauacggcuguuggccaugcccuggugcucccugcggggagagaccugacagacuuucuggaaaacguccugaccugccacgugugucuugauaucugcaauauugaccccuccuguggauucggcucuuggcgcccuagcuuucgggauagacgcgccgcuggguccgacguugauaucgacauggccuucauucuggauagcgcugagaccacaacccuguuucaguucaacgaaaugaagaaauacaucgccuaucucgugcggcagcuggacaugucuccggaucccaaggcgucccagcacuuugccagagucgcugugguucaacaugccccuagcgagucuguggacaaugcuuccaugcccccugucaaaguggaguucagccuuacagauuacggauccaaggaaaaacugguggacuuucucucucgcggcaugacgcagcugcagggcacccgggcccuggggagcgcuaucgaguauacaauugaaaacgucuucgaguccgcccccaauccuagagaucucaagaucguugugcuuaugcugaccggagaagugccggagcagcaacuggaggaagcgcagcgcgucauucuccaggccaaaugcaagggcuacuucuuugugguucuggggaucggacggaaggugaacauuaaagaggucuauacauucgcuagcgaacccaaugacguguuuuucaaacuuguugacaaaucuaccgagcugaacgaggaaccucucaugagauuuggccggcugcugcccuccuucgugagcucugagaaugccuuuuaccucagcccugauaucagaaagcaaugugacugguuccagggggaucagcccacgaaaaaccuggucaaguuuggacacaaacaggugaaugucccgaacaacgugaccuccucuccuacaagcaaucccguuaccacaaccaaacccgugacaacgaccaagccugucacaaccaccacaaaacccgugacgaccacaaccaagccuguuacaaucauuaaccaaccguccgugaaacccgcugccgccaagccugcgcccgcuaagccugucgccgccaaacccguggcuaccaagauggccacggugcgcccgccuguugcugucaaacccgccacagcggccaagccuguggcugccaaacccgcugccgugcggccgccugcggccgcugccgcuaagcccgucgccaccaagcccgaagugccuagaccccaggcugccaaaccugcggccaccaagccggcuacaaccaaacccaugguuaagaugucucgcgaggugcaggucuucgaaaucacagagaauagcgccaaacuucauugggagagagccgaaccucccggcccuuacuuuuaugaccugaccgugacguccgcucacgaucagagccucguucugaagcaaaaccuuacagugaccgaccgggucauuggcgggcugcucgccggacagacauaccacguggcggugguuugcuaucugcgcucucaggucagagcuaccuaccauggcuccuucagcacgaaaaagucccagcccccuccgccccaaccugcccggucugccagcuccucuaccaucaaucugauggugagcacagagccccucgcucugaccgaaacagauauuuguaaacuuccuaaagacgaggggaccugccgcgauuuuauccugaagugguauuacgaccccaacacaaaauccugcgccagauucugguauggaggcugugggggaaaugaaaacaaguucggcagccagaaagagugcgagaaggugugugcuccgguccucgccaagccuggcguuaucucugugauggggaccuga

SEQ ID NO: 67714 - RNA, 7845 nt, Artificial Sequence
  derived and/or modified sequence opt5 from COL6A5__Homo_sapiens__NP_001265227
augaagauccugcucauuaucuucgugcugauuaucuggaccgaaacacuugccgaccagagccccggcccugggccggucuacgcugauguuguguuucugguggacagcucugaucaccucggacccaagagcuucccuuuuguuaagacguucauuaacaagaugaucaauucccugcccaucgaagccaacaaguacagaguggcgcuugcucaauacucugacgaguuucacagcgaguuccaccuguccaccuuuaagggccggucuccuaugcucaaucaccugaagaagaacuuccaguuuauugggggaagccugcagaucggcaaagcccuccaggaggcccaccgcacauauuucuccgcucccauuaaugggagagaucggaagcaauuuccuccgauccugguugugcuugccagcgcugaaucugaggacgaggucgaagaggccuccaaagcgcugcagaaggauggagugaaaauuaucagcguuggcgugcagaaggccucugaagagaaccucaaggcuauggccaccucccacuuccacuuuaaucugcgcacaauuagagaccuuagcaccuucucucagaacaugacacaaaucaucaaagaugucaccaaguacaaagagggcgcuguggacgccgauaugcaagugcacuuccccauuuccugccagaaggacagccuggcggaucucgucuuucugguugacgaaucccuggggacgggaggcaaucuccggcaucugcagaccuuccuugagaacaucacaucuagcauggacgugaaagaaaauuguaugcgccuggggcucauguccuauagcaacucugccaagaccauuuccuuucugaaaagcucuacaacccaaagcgaguuccagcagcaaaucaagaaucuuuccauucaggugggaaagucuaacacgggcgcugccaucgaucagaugagacgggacggguuuagcgaauccuacggaagccgcagagcucagggcgucccucaaaucgccgugcugguuacacaccggcccucugaugacgaggugcaugaugccgcucucaaucugcgccuggaggacgucaacguguucgcgcucuccauucagggcgccaacaauacccagcuggaagagaucguuagcuauccucccgaacagacaauuucuacccuuaaauccuacgcugaucuggagaccuacagcacaaaguuucucaaaaagcugcaaaacgaaaucuggucccagauuucuacguaugccgagcagagaaaucuugacaaaaccgggugcguggauacaaaggaggccgacauccacuuccugaucgauggaagcuccucuauucaggaaaagcaauuugagcagaucaaacgguucaugcucgaagucaccgagauguuuagcauuggcccggacaaggugcgcgucggggugguucaguacuccgacgauacagaaguggaguucuauaucaccgacuacagcaacgauauugaccugagaaaagcuaucuuuaauauuaagcagcugacgggaggcacauauaccgggaaagcccucgauuacauccugcaaaucauuaagaacggaaugaaggaccggaugucuaaagucccuuguuaucuuaucgugcugaccgauggcauguccacagacagaguuguggagcccgcgaagcgccuccgggcugaacagauuaccguccacgccgugggcaucggggccgcuaauaaaauugagcugcaggaaaucgccggaaaggaggagagagugagcuucggccaaaacuucgaugcucugaaaucuaucaagaaugaaguuguccgcgagauuugcgccgaaaaggggugugaggacaugaaagcggauaucauguuucuuguggacuccagcuggucuauuggaaacgaaaauuuccggaagaugaaaaucuuuaugaagaaccuccugacaaaaauucagaucggcgccgauaagacgcagaucggggugguccaguucagcgacaaaaccaaggaggaguuucaacugaauagauacuucacacagcaggaaauuuccgacgcuaucgaucgcaugagccucauuaacgagggcacccugacaggaaaggcccuuaauuuugugggccaguacuucacccauucuaaaggggcucggcugggagccaagaaauuucucauccugauuacggacggcguugcgcaagaugacgugagagauccugcccgcauccugcgggggaaggacgucaccaucuucuccgugggaguuuauaacgcuaacagaagccagcuugaagagauuuccggcgauucuagccucguguuucacgucgaaaauuucgaccaucugaaagcccuggagcgcaagcucaucuuucgggugugcgcucugcacgauuguaagagaauuacacuucuggacguuguguucguccucgaucauuccgggucuaucaaaaagcaguaccaggaccacaugauuaaccugaccauccaccuggugaaaaaggccgaugugggccgggaccgcguccaauucggagcccuuaaauauagcgaccagcccaauauucucuuuuaccugaacacauauuccaauagaucugcuaucaucgagaaccugcggaagagacgcgauaccggcgggaauacguacacagcgaaggcccucaaacaugcuaacgcccuguucaccgaagaacacggaagccggauuaagcagaauguuaaacaaaugcuuaucgugauuacagacggcgaaucccaugaucacgaccagcugaacgauaccgcccucgagcugagaaauaaggggaucaccauuuuugcugugggagucggcaaagccaaccagaaggaacuggaggggauggcgggcaauaagaacaauacaaucuauguggacaacuucgauaaacuuaaggacguuuuuacgcucgugcaggagcgcaugugcaccgaagcucccgaggucugucaucugcaggaagccgaugugaucuuccugugcgacggaagcgauagaguuucuaacuccgacuuugugacaaugaccacauuccucagcgaccugauugauaauuuugacauccagucucagcggaugaaaauuggcauggcccaguucggguccaacuaccaaagcaucauugagcuuaaaaauucucugaccaaaacgcaguggaagacacagauccagaacgucuccaaaagcggaggcuuuccucgcaucgauuucgcucucaagaagguguccaauauguucaaccugcaugccgggggaagacggaaugcgggcguuccgcaaacccugguggucauuaccagcggggacccccgcuacgauguggcugacgccgugaaaacacuuaaggaucugggcaucuguguccucguucugggaauuggcgacguguauaaagagcaccuccugccuaucaccgggaacucugaaaagauuaucacauuucaggauuucgacaaacuuaagaauguggaugucaagaaaagaauuauccgggagaucugccagagcugcggaaagacgaacuguuuuauggacauugugguuggcuucgauaucuccacccaugugcaggggcaaccccuguuucagggacacccucagcucgaaucuuaccugcccggcauucuggaggacaucagcuccauuaaaggcgucucuugcggggccggaacagaagcucaagugagccuugccuucaagguuaauuccgaccagggcuuuccggcuaaauuccagaucuaucagaaggccguguuugauucucugcuccaagucaacgugagcgggccuacccaucugaaugcgcaguuccuccgcucccugugggacacauuuaaggauaaaagcgccucuagaggacagguccuucugaucuucuccgacggccuccagagcgagucuaacauuaugcuggagaaucaauccgaucggcugcgcgaagcugggcuugacgcccugcucgugguuagccugaacaccacggcucaccacgaguuuuccucuuucgaguucggaaagagauuugauuaccggacccaucucacaaucggcaugagagagcugggcaagaaacuuagccaguaucuggggaacauugccgaacgcaccuguugcuguacauucugcaaaugucccggaaucccuggcccccacgggacccggggacugcaggccaugaaaggcucccaggggcucaagggaagcagaggccaucgcggcgaggacgggaauccuggagugcggggcgauacagggccccaaggagacaaaggcauugcugggugcccgggagcguggggccagaagggccugaaaggguuuucuggaccuaagggcgggcacggagaugacggcaucgaugggcuugacggagaggaaggcugucauggcuuccccgggaucaaaggagagaagggcgaccccgggucccagggaagcccuggcucuagaggggccccgggacaauacggcgaaaagggcuuucccggggauccuggaaaccccggccagaauaacaauauuaaagggcagaagggaagcaaaggcgagcaggggcgccaaggacgguccggccagaagggcguccaggggucuccuagcuccagaggaucucgcggccgggaagggcagagaggacugcggggcgugagcggggagcccggcaacccuggacccaccggcacgcucggggcugagggacugcaaggcccgcaggggucccagggaaauccuggccgcaaaggggaaaagggcagccagggacaaaaaggcccccaggggucuccuggacucaugggcgccaagggguccacaggaagacccggccugcuugggaagaaaggcgagccgggacugccuggcgaccuggggcccguuggacagaccggccagcgggggcgccaaggagauagcggcaucccuggcuaugggcagaugggaagaaagggcgugaaagggccccggggauuccccggcgacgccgggcagaagggagauauuggcaacccuggcauccccgggggacccggcccuaaaggguuuagaggacucgcucugaccgucggccuuaagggggaagagggaucccgcggccugcccggcccucccgggcaacggggaauuaagggcauggccgggcagccuguguacucucagugcgaccucaucagauuccugcgcgagcacagcccguguuggaaagaaaagugccccgcguacccuacagagcucguguuugcucuggauaauuccuaugacguuaccgaagagucuuucaacaaaacgcgggauauuaucacaagcaucgucaaugaccuuaacauuagagaaaauaacugccccgugggagcccgcguggccauggucuccuacaauagcggcaccucuuaucugauccggugguccgauuacaacagaaagaaacagcugcuccaacagcugagccagauuaaguaucaggacacaaccgagccucgcgacguggggaaugcuaugagauuuguuacacggaacguguucaagcgcaccuacgccggagcgaacgucagacggguggcugucuuuuucucuaauggccaaacggccucccgcagcucuaucauuaccgccacaauggaguucagcgcucuugauaucucccccaccguguuugccuucgacgaaagagucuuucuggaggcuuucggcuuugauaacacagggaccuuccaggugaucccgguuccucccaauggagaaaaccagacgcucgagcggcugagacgcugugcccucugcuaugacaaauguuuucccaaugcgugcauucgggaagccuuccugccugaggauucuuacauggacguggucuuucuuaucgauaacagcagaaauauugcuaaggacgaguucaaagccgugaaggcucugguguccagcgucaucgauaacuuuaauauugccuccgacccccugaucucugauagcggcgaccgcaucgcccuccuguccuacucuccuugggaaagcucccggagaaaaauggggacaguuaagaccgaguucgauuuuauuacauaugacaaccagcuucugaugaagaaucacauccaaaccucuuuccagcagcucaacggagaagcuaccauuggccgggcgcugcuguggacaacggagaaucucuucccggaaacccccuaccuucgcaaacauaaggugaucuuuguggucagcgccggggagaacuaugagagaaaagaguucgugaagaugauggcucugcgggccaaaugucaaggauacguuauuuuugugaucucccugggcagcacacgcaaggacgauauggaggaacucgccucuuauccucuggaccagcaccuuauucagcugggcagaauccauaaacccgaucucaauuacaucgcuaaguuccugaagccuuuucuguauuccguccggcgcggguucaaccaguaucccccgccuaugcucgaggacgccugcagacuuauuaaccugggaggcgagaauauccaaaacgauggguuucaguucgugaccgaacugcaggaggacuuucucggaggcaauggguucauuggacaggaacugaacagcggccgggagucucccuuuguuaaaacagaagauaauggcuccgacuaccuuguguaucugccuagccaaauguucgagccccagaagcucaugaucaacuacgagaaagaucagaagucugcggaaauugcuucccugaccagcgggcacgagaauuauggacgcaaagaagaaccugaccacacguacgaacccggcgaugucucccugcaggaguauuacauggacguggccuuucucaucgacgccagccaaagagucgggucugaugaguucaaggaagugaaggcuuucaucacaagcguucuugacuauuuucauauugccccgaccccucugaccuccacacugggagaucggguggcggugcucucuuacuccccgcccggcuacaugccuaacaccgaggaauguccggucuaucuggaguucgaccuuguuacauacaauuccauccaccagaugaaacaucaucugcaggauucucaacagcucaacggggacguguuuauuggacaugcccugcaguggacgaucgauaauguguucgucggcacccccaaccugagaaagaauaaagugauuuuuguuaucagcgcuggcgaaacaaacucccucgacaaggaugugcuucgcaaugucucucugcgggccaaaugccagggguauagcaucuucguguuuuccuucggaccuaagcacaacgacaaggagcuggaggaacucgcuagccacccccuggaucaucaccuuguccaacugggcagaacccauaaaccugacuggaacuacauuaucaaguuugugaaacccuucguucaccucauucgccgggccaucaauaaguauccuacagaggauaugaaagcuaccugugugaacaugacgucuccgaaucccgaaaacgggggaaccgagaauacaguccugcugcucccuggcauuuacgagaucaagaccgaaaacggggaccuuuuugacgaguucgauucccaggcccagcaucugcuggugcucggcaauaaccauagcucuggauccgaaacagcgaccgaccugaugcagaaacuuuaucugcucuuuagcacagagaaacuggccaugaaggauaaagaaaaggcucaccuggaggagauuuccgcccucguuguggacaaacaacaggaaaaggaggauggcgaagacacgagaucuagcuga

SEQ ID NO: 67715 - RNA, 8835 nt, Artificial Sequence
  derived and/or modified sequence opt5 from COL7A1__Homo_sapiens__NP_000085
augacccugcggcuccugguggccgcucuuugcgccggcauccuggcggaggcuccccgggugcgcgcccagcaccgggaacggguuacauguacgcgccucuacgccgcugacauuguguuccugcuugauggguccuccucuaucggccggagcaacuuucgggaggugcgcuccuuccuggaaggccucguccugccuuuuucuggggccgcuagcgcccaaggcgugagauucgcgaccguucaguauuccgacgauccgcggaccgaguuuggccuggacgcccucgggucuggcggcgaugugauucgcgcuaucagagaacugagcuacaagggcgggaauacccggacaggcgccgcuauucuucaugucgccgaccacguguuccugccccagcucgcgcgcccuggcguucccaaagugugcauccugaucaccgaugggaagucccaggaccuugucgauacagccgcucaaagacugaaaggccagggcgugaagcucuuugccguggggauuaaaaacgcugacccugaggagcugaagcgggucgccagccagcccaccucugauuucuuuuucuuuguuaaugacuucuccauccugcgcacgcuccugccucuugugagcagacggguguguaccacagccggcggcgucccggugaccagacccccugaugacucuacauccgcuccccgcgaccugguucucagcgaaccuucuucccagagccugcgggugcaauggaccgcggccuccggccccgucacgggguauaaggugcaguacacaccgcuuaccggccugggccagccucuccccucugagagacaggaaguuaacgugccugcuggggagacaagcguccgccugcggggccugagaccccucaccgaguaucaagugaccgucauugcccuguacgccaauuccaucggcgaagcugugagcgggacagcccgcacgaccgcgcuugagggccccgaacugacaauucagaacaccacagcucauucucuccugguugccuggcgguccgugccuggcgccaccggcuauagagucacguggcgcgugcuuagcgggggcccgacacagcaacaggagcugggccccgggcagggaucuguucuccugcgggaucuggaaccuggcaccgacuacgaggugaccgucagcacacucuuugggagauccgugggccccgcuaccucucugauggcccgcacagaugcuagcguggagcagacgcuucggccuguuauccugggacccaccuccauucuccugagcuggaaucuggucccggaagccagaggcuaccggcuugaguggcgcagagaaacagggcucgagccuccccaaaaaguggugcugccuucugacgucacccgguaucagcuggauggacuccagcccggcacagaauacagacugacccuuuauacgcugcucgaggggcacgagguggcgaccccugccacaguugugcccaccggaccggaacugccugucucccccgugacagaccugcaggcuaccgagcuucccggccaacgcguucgggugagcuggucuccugucccgggggccacgcaguacagaaucaucgugcgcuccacacagggcguugaaagaacccucgugcugcccggaagccagacagcuuucgaucuggacgauguccaagccggccucuccuauaccgugcgggugucugcgcgcgucgggccuagagagggaagcgccuccguucugaccgugcggcgcgaacccgagacaccucuugcugugcccggccugagagucgugguuucugacgccacgcgggugcgcgucgcuugggggccugugcccggagccagcggcuucagaauuuccuggagcaccgggucuggcccggaguccagccagacacucccucccgauucuaccgccacagacaucaccggacugcagccuggcacgacauaccagguugcuguguccguccugcgggggcgcgaagagggacccgcggccgugauuguugcuagaaccgacccgcuuggcccugugcggaccguccaugugacacaagccagcucuagcuccgugaccaucacauggacgagaguccccggggccaccggauaucgcguuagcuggcacucugcucacggcccugaaaagucccagcucgugagcggggaggccacaguggcggagcuggauggccuggaacccgacaccgaguacacaguccaugugcgggcucacguugccggaguggauggacccccugccuccgucgugguuagaaccgcuccggaacccguggggcgcgucucucggcuccagauucugaacgccagcuccgacgugcuuagaaucacgugggucggagugaccggcgcgacagcuuaccgccuggccugggggcggucugagggaggcccuaugagacaucaaauccuccccggcaauaccgauagcgccgaaauucgcgggcuggagggaggcguuuccuauucugugcgggucacagcucuggugggggacagagagggaaccccuguuagcaucguggucacaacacccccugaagccccgcccgcucuuggcacgcuccacguggugcagagaggggagcacucccugcgccugagaugggaaccuguuccccgggcccagggauuucuccugcauuggcagccugagggcggccaagaacagagccgcguccuugggcccgagcugucuuccuaccaccucgauggacuggagccggcgacacaguauagagugcggcugagcgugcuuggcccugccggggaaggacccucugcugaggucaccgccagaaccgaaagcccccgcgugccuagcauugagcugcggguuguggacacaucuaucgauuccgucacccucgcuuggacgcccgugagcagagccuccagcuacauucugucuuggcgcccucuccggggcccggggcaggaaguucccggaagcccucaaacacugcccggcaucuccucuagccagagagugaccggccuugagccuggggucuccuauaucuucucucugacacccgugcucgacggaguucgcggcccggaggccagcgugacccagacaccugucugcccccgggggcuggcugaugugguguuucugccucaugcgacccaggacaacgcccacagagcugaagccacgcgcagaguccuugagcggcugguucucgcccugggaccccucggcccucaagcuguccagguggggcugcuuuccuacucucaucgccccagcccgcuguucccucucaauggaucccacgaucugggcauuauccugcagcggauucgggacaugcccuauauggaccccagcggcaacaaucuugggaccgccgucgugacagcgcaccgcuacaugcuggcuccugaugccccgggaagacggcaacauguucccggcgugaugguccuccugguggacgaaccucucagaggggauaucuuuucucccauucgcgaggcccaggcuuccggacugaacguugugaugcuuggcauggccggggcggacccugagcagcugcggagacuggcucccggaauggauagcguccagaccuucuuugccguggacgauggcccuucucucgaccaagccgucuccggccuggcuacagcccuuugucaggcuagcuucaccacgcagccgcgccccgaaccuugccccguguacuguccuaaagggcagaagggagagcccggcgaaauggggcugcggggacaaguuggcccgccuggggaucccggacuccccggcagaacaggcgccccugggccccagggaccuccgggcuccgcgaccgccaaaggggagcggggauuucccggcgcugacgggcgcccuggaucucccggcagagccggcaauccugggacacccggagcuccgggccugaaggggagcccuggacuccccggcccuagaggggaucccggcgaacgcggaccuagaggccccaagggggagccgggagccccuggccaggugaucgggggagagggccccgggcugcccggccggaaaggagacccuggcccguccgggcccccuggaccccgcggcccucuuggggaucccggaccuagaggacccccggggcugccuggcaccgccaugaagggagacaaaggcgacagaggggaacgcggacccccuggccccggggagggaggcauugcuccgggcgaaccugggcugcccggacuccccggcagcccugggccccagggaccugugggcccgcccgggaagaaaggagagaagggcgauucugaagacggcgcgccugggcugcccggacaaccuggcucccccggggagcagggaccuagaggcccgcccggggccaucggaccuaaaggcgaucggggcuuccccgggccucuuggagaggcuggcgaaaagggggagagaggacccccgggcccugccgggagccgcggacugcccggcgucgccggccggcccggggcuaagggaccugaaggacccccugggccgaccggaagacagggcgagaaaggggaacccggacgcccuggcgaccccgccguugugggcccugcgguggcugggcccaagggagagaaaggcgaugucgggccggccggaccucggggcgccacaggggugcagggagagagaggacccccuggccucguucugcccggggacccgggaccuaagggcgaucccggggaccgcggacccaucggccucacggggcgggcuggaccucccggcgauucuggcccuccgggggaaaaaggagaccccggcagaccugggcccccuggacccgugggcccucgcgggcgggauggcgaggucggagaaaagggcgacgaggggccgcccggagacccuggccugcccgggaaggccggagagagaggccuucgcggggcgccuggcgugcggggacccgucggcgaaaaaggggaucaaggagacccgggcgaggaugggagaaacggaagcccuggcuccucugggcccaagggcgaccgcggagaacccggcccucccgggccuccgggaagacugguggauaccggccccggggcccgggagaaaggagaaccuggcgaccgcgggcaggagggccccagaggaccuaagggcgaucccgggcugccgggagcuccuggcgagcgggggauugaaggauuuagaggacccccuggcccccagggggacccuggaguucggggccccgccggggagaaaggagaucgcggcccgcccgggcucgacggaagaagcggccuggauggcaagccuggggcugccggacccuccggcccuaacggggcugccggaaaggcgggcgacccggggcgggauggacuucccggccugcgcggcgaacaagggcucccuggacccucuggcccucccgggcugccuggaaaacccggcgaggacgggaagccgggacucaauggcaaaaacggcgaaccuggggaccccggagaggauggcagaaagggggagaaaggagacagcggcgccuccgggcgggaaggacgcgauggcccuaagggcgagagaggggcucccggaauccugggcccgcaggggccucccggacuucccggcccuguggggcccccuggacagggcuucccgggcguccccgggggaacaggcccuaagggggaccggggagaaaccggcagcaaaggggagcagggacugcccggcgaacgcggccugagaggggagccuggaucugugcccaauguugaucggcuccuggagacagccggcauuaaggcuuccgcccuucgcgaaaucguggagaccugggacgaaagcuccgggucuuuucugccggucccugagagacggcgcggacccaaaggcgauagcggggagcaaggcccucccggaaaggaaggcccuauuggguuccccggagagagaggccucaaaggggaccggggagauccgggcccccaggggccucccggccuggcccugggagaaagaggcccucccgggccuuccggacucgcuggcgagccggggaagcccggaaucccuggccuucccgggcgcgcgggcggagugggcgaagccgggcggccuggagagagaggcgagcgcggggaaaaaggagagcggggcgaacaggggagagacggacccccgggacugccuggcacgcccgggccucccggaccgccuggccccaaggugucuguugaugagcccgggccuggacugagcggcgaacagggacccccugggcucaagggagcuaaaggcgagccgggguccaacggagaccaaggccccaagggggaucgcggagucccuggcaucaaaggcgacagaggggagcccggaccuagaggccaggacgggaaucccggacugccuggcgaacgcgggauggccggaccggagggcaagcccggccuucaggggccucggggacccccuggccccgucgggggccacggcgauccggggcccccuggagcccccggccuggcuggcccugccgggccccagggaccuagcggccucaaaggggaaccgggagagacaggacccccugggagaggacugaccggccccaccggcgcgguggggcugccuggacccccgggcccuucugggcucgugggaccccaaggcuccccugggcuucccggacagguuggcgaaacaggcaagccuggggcccccggacgcgacggcgcuagcgggaaggauggagaccggggcucuccgggggugcccggauccccuggccugcccggcccuguggggcccaaaggagagccgggcccuaccggggcccccggacaggcugucgugggccugccuggggccaagggcgagaaaggagcgcccggcgggcucgccggagaucugguuggcgaaccuggggcuaagggagacagaggccuucccgggccgcggggcgagaaaggagaagccggcagagcuggggagccuggagaucccggcgaggacgggcaaaagggagccccuggccccaagggguucaaaggcgauccgggagugggcguccccgggagcccuggacccccuggacccccuggggugaagggagaccugggccucccgggccugcccggggcuccuggaguugugggcuuucccgggcagacaggaccucgcggcgaaauggggcagcccggaccgucuggcgagcggggccuggccgggccucccggaagagaaggcauuccugggccccucggaccucccggcccgcccgggagcgucggaccucccggcgcguccggccuuaaaggggauaagggagacccuggcguggggcugcccggaccucgcggcgagagaggggaaccgggaauccggggcgaggacggccgccccgggcaggagggaccuagaggccugacggggcccccuggaucucggggcgaacgcggggagaaaggagaugugggcagcgccggccucaagggggacaagggagauuccgcugucauucugggacccccggggccuagaggagccaaaggcgacaugggggaacggggaccccgcggccuugauggcgacaaggggccuagaggagauaacggcgaccccggggauaaaggaagcaagggcgagccgggggacaaaggauccgcuggccugcccggccuccgggggcugcugggaccucaaggccagcccggggccgccggaaucccuggcgaucccgggucuccuggcaaggacggaguuccgggcauucgcggggaaaaaggagaugugggcuucauggggcccagaggacucaagggcgagcgcggggugaagggcgcgugcggacuugacggcgagaaaggggacaagggagaagcuggcccucccgggcggccuggacuggccggccauaaaggggagaugggcgaacccggagucccuggccagagcggggcuccgggaaaggagggccugaucgggcccaaaggagauagaggcuuugacgggcagccuggccccaagggagaucaaggcgaaaagggggagcggggaaccccuggcaucgggggauuccccggcccguccggcaaugacgggucugccggacccccuggacccccugggagcgugggacccagaggcccugaggggcuccagggacagaaaggcgaacgcggcccgcccggggagcggguugugggagccccuggcguccccggggcuccuggagaaagaggcgagcaggggcgccccggaccggccggcccucggggcgagaagggggaagcggcccugacagaggaugacauuagaggauuugugcgccaagaaaugucccagcacugugcuugccagggccaguucaucgccucugggagccggccccuuccuuccuaugcugccgauaccgcgggaagccaacugcacgccguucccgugcucagagucucucaugcugaggaagaggagcgcgugccucccgaagacgaugaguacuccgaauauagcgaguacucuguugaagaguaucaggacccggaggcccccugggauuccgacgacccuuguagccugccccuggaugaaggcucuugcacagcuuacacccuccggugguaucacagagccgugacgggguccaccgaggcuugccauccuuuugucuacggaggcuguggcgggaacgccaaucgguucggaacacgcgaagcgugcgagagacggugucccccgcgcgugguccagagccaaggcaccgggacagcccaggacuga

SEQ ID NO: 67716 - RNA, 2235 nt, Artificial Sequence
  derived and/or modified sequence opt5 from COL8A1__Homo_sapiens__NP_065084
auggccgugcugcccggcccucuccagcugcuugggguccugcucaccaucagccuguccucuauuagacuuauccaagcuggagccuacuauggcauuaagccgcugcccccucagauucccccucagaugcccccucagaucccgcaauaccagccccucgggcagcagguuccucacaugccccuggcgaaagacggacuggcuaugggcaaggagaugccucaucuccaauaugggaaagaauacccccaucugccgcaguauaugaaggagauccagccugcuccccggaugggaaaagaagccgugccuaagaagggcaaagagaucccccuugccagccugcgcggcgaacaggggcccagaggagagccuggcccgcgggggcccccuggacccccuggccuccccgggcacggcauuccgggcaucaagggcaaaccugggccccaaggauacccuggcguggggaagcccggaaugccuggcaugcccgggaaaccgggagccaugggcaugccuggcgcuaagggggagauuggacagaagggcgaaaucgggcccaugggcauucccggcccucaggggccgcccggcccucacggacugcccggcaucgggaaaccuggaggccccgggcuuccuggacaacccggcccgaagggggaucgcggcccuaaaggacugcccggcccucaggggcucagaggacccaagggcgacaaaggguucggaaugccgggcgccccuggggucaagggacccccuggaaugcauggcccucccgggcccgugggacugccgggcguugggaaacccggagugacaggcuuuccugggccccagggcccucugggaaagcccggcgcgccuggggagccgggaccccagggcccuauugggguccccggagugcaaggcccucccggcaucccggggaucggaaagccuggccaggaugggauucccggacagcccggcuucccugggggaaaaggcgaacagggccuccccgggcugccuggaccgcccggccuuccugggaucggaaagcccggcuuuccugggcccaaaggagaccggggcaugggcgggguuccgggagcccugggcccucgcggggagaagggacccauuggcgcuccugggaucggaggacccccuggcgagcccgggcucccgggcauuccuggccccauggggcccccuggagccaucggcuucccggggcccaaaggagaaggcggcaucguggggccucaaggacccccuggccccaagggggagccuggacugcagggcuuuccggggaagcccggauuccuuggcgaagucggcccucccgggaugagaggacugccuggccccauugggccgaaaggagaggcuggccagaagggggugccuggacuccccggcgugcccggccugcuggggccuaaaggagaacccggcaucccuggggaucagggacuccaaggcccgcccgggauuccuggcaucggaggccccuccgggccuauuggacccccgggcaucccugggcccaagggagagccuggccugcccgggccucccggcuuuccgggaaucggcaaaccuggggucgccggacuucacggcccucccgggaagcccggagcgcugggcccgcaggggcagcccggccucccuggacccccuggacccccugggcccccgggaccucccgccguuaugccucccacgccgccuccccagggcgaguaucugcccgacauggggcuuggaauugauggcgugaagccuccccacgcuuacggcgccaaaaaggggaaaaacggaggcccugcuuacgaaaugccggccuucaccgccgagcugacagcucccuuuccucccgugggggcgccugucaaguucaauaaacuccuguauaacggacggcaaaauuacaacccccagaccggcaucuuuacaugcgaagugccugggguuuauuacuucgccuaucaugugcacuguaagggaggcaaugucuggguggcucuguuuaagaacaaugagccgguuauguacaccuaugacgaauacaaaaagggcuuccucgaucaggccucugggagcgccgugcugcuucugcgccccggagacagagucuuccuccaaaugccuuccgagcaggcugccggccuguacgcggggcaguaugugcauucuagcuuuuccggauaccugcuuuaucccauguga

SEQ ID NO: 67717 - RNA, 1917 nt, Artificial Sequence
  derived and/or modified sequence opt5 from COL8A2__Homo_sapiens__NP_001281276
augccccugccucuccugccgauggaccuuaagggcgagcccgggccucccggaaaaccuggccccagagggccuccgggacccccuggcuuccccgggaagccuggaaugggcaaacccggccugcacgggcagccgggaccugccggcccucccggguuuagccggaugggaaaggcuggcccucccgggcuccccggaaaagugggcccgcccggccaaccugggcugcgcggagaacccggcaucagaggggaucagggacuucggggcccucccgggccgccuggacugcccggcccuuccggcauuaccauccccgggaagccuggagcccagggcguccccgggccgccuggauuccagggcgagcccgggccccaaggcgaaccuggaccgcccggcgaccgcgggcucaagggagauaacggcguugggcagccuggacugcccggcgcgccugggcagggcggagcucccggcccucccgggcugccgggaccugccggccucgggaaacccggacuggacggccuuccuggggcccccggcgauaagggagagucuggcccgccuggggugcccggaccuagaggcgaacccggggcugugggacccaaaggcccuccgggggucgacggcgugggaguucccggcgccgcugggcugccuggaccccagggcccuagcggggccaagggagagcccggcacacggggcccuccggggcucauuggacccacgggcuacgggaugccuggacugcccggcccuaaaggggaucgcggacccgcgggcgugccgggccuucugggggacagaggagagccuggcgaagauggggagcccggagaacaaggcccccaggggcucggaggcccucccggccugccuggguccgccggacugccgggccggcgcgggcccccuggacccaagggcgaggcugggccuggaggcccgcccggcgucccugggaucagaggagaccagggccccucugggcucgccggaaagccuggcgugcccggggagcggggacugccuggcgcucauggcccgcccgggccuaccggacccaaaggcgaacccggguuuacaggacgcccuggcgggccgggaguugccggcgcgcuuggccagaagggggaucugggacuccccggccaaccugggcugagaggacccagcggcauuccugggcuucagggacccgccggcccuaucggcccgcaggggcugcccggacucaaaggcgagccugggcugcccggaccucccggcgaagggcgggcuggcgagccgggaaccgccggcccuacagggccucccggagugcccggcucccccgggaucaccggaccuccggggcccccugggcccccuggacccccgggcgcuccuggcgccuucgacgaaacagggauugccggacugcaccuccccaauggcggggucgagggagcugugcugggcaagggcggcaaaccucaauuuggacuuggcgagcugucugcgcaugccacccccgcuuucacggccgugcucaccagcccuuuucccgccuccgggaugccggucaaguucgaucgcacacuguauaacggacacagcggcuacaauccugcuaccgggaucuuuacaugccccguuggaggcguguauuacuucgccuaucaugugcacgucaaaggcaccaacguguggguugcgcuuuacaagaauaacgugcccgcuacguauacauacgacgaauacaagaaaggguaucuggaccaggccucuggaggcgccguccuccagcugagaccuaaugaucagguguggguucaaaugccguccgaccaggcuaacgggcuguacagcaccgaguauauucacucuuccuuuagcggauuccuccugugucccacauga

SEQ ID NO: 67718 - RNA, 2766 nt, Artificial Sequence
  derived and/or modified sequence opt5 from COL9A1__Homo_sapiens__NP_001842
augaagaccugcuggaaaauccccguguucuuuuucgucuguagcuuucuggagccuugggccuccgcugccguuaagagacggccgcgcuuccccgugaacucuaauagcaacggcgggaaugaacucugcccuaaaauuagaaucggacaggacgaucugcccggcuuugaccuuauuucccaauuccagguggauaaggcggcuucucggcgcgccauccagagagucguggggagcgccacacugcagguugcuuacaaacucggaaacaauguggacuuucggauuccuacgcgcaaccuguaucccuccggccuuccugaggaauacucuuuccugaccacauuuagaaugaccgggagcacacucaagaagaauuggaacaucuggcaaauccaggauuccagcggaaaagagcaggucggcauuaagaucaauggccagacccaaucugugguuuucuccuauaaagggcuggacggaagccugcagacagccgcuuuuucuaaccucuccagccuguucgauucucaguggcacaagauuaugaucggcguggaacgguccagcgccacccuuuuugucgacuguaaucgcauugagucccugccgaucaaacccagagggccuauugauaucgacggauucgcggugcucggcaagcuggccgauaacccccaggugucugucccuuucgagcuucaauggaugcugauccauugcgacccccuccggccgcgcagagaaacgugucacgagcugccugcucggauuacccccagccagacaaccgaugaacgcgggccucccggagagcagggacccccuggcccgcccgggccucccggaguuccuggcaucgacgggauugacggagauagaggccccaaggggccgccuggacccccuggccccgccggcgagccugggaaacccggagcuccgggcaagccugggacacccggagccgacggccugaccgggcccgauggcuccccuggaagcaucggcucuaaagggcaaaagggagaaccgggcgugcccgggucccggggauuuccuggcagagggauucccggcccucccggaccucccggcacggcggggcucccgggagagcugggccgcguggggccugucggagaccccggccggagagggccucccggcccgccuggacccccuggcccccgcgggacaaucggauuccaugauggcgacccccuuugcccuaaugccuguccgcccgggcggagcggauacccuggccugcccgggaugagaggccacaaaggagcuaagggcgaaaucggggagccuggacgccagggccauaaaggggaagagggagaucagggcgagcucggcgaagugggggcccagggacccccuggcgcucaagggcugcggggaauuaccggcaucguuggggacaagggagagaagggcgccagaggccuugauggggaaccgggaccccagggccugccuggggcccccggagaccagggccagcgcgggccucccggagaggcuggcccgaaaggcgaucggggcgcggaaggagccagaggcauuccugggcuccccggacccaagggcgacacagggcugccuggaguggacggccgcgauggcauccccgggaugccuggaaccaaaggcgagccggggaagcccggaccucccggcgacgcugggcugcaaggacucccuggcguccccggcauuccgggggccaaaggaguggccggcgagaaggggucuaccggagcuccuggcaagcccgggcagaugggaaacagcggcaaaccuggccagcaggggcccccuggagaaguuggcccccgggggccgcaaggacugccuggcuccagaggggagcuuggacccgugggcucucccggccugccugggaagcucggaagccugggcuccccggggcuucccggacugccugggcccccugggcuccccggcaugaaaggagaucggggcgucgugggggaaccuggaccgaagggcgagcagggggccagcggagaagagggcgaggcgggggaacgcggcgagcugggagacaucggccugcccgggccuaaaggaucugcuggcaaucccggggaaccuggacucagaggccccgaggggucccggggccugccgggagucgagggcccuagagggccucccggaccccgcggcgugcagggggaacagggagccacaggccuucccggcguucaagggccuccgggacgggcccccacggaucagcacaucaaacaggugugcaugagagucauucaagagcacuuugcugaaauggccgcuagccugaagcgcccugacucuggcgccaccgggcuccccggaagaccugggcccccgggcccucccggaccucccggcgagaacggcuucccugggcagaugggaauccggggccugcccgggauuaagggaccgccuggcgcgcuggggcuucgcggacccaagggcgaucucggcgaaaaaggggagagaggacccccuggccgggggccgaacggacugcccggcgccaucgggcugccuggagaccccggcccugcuuccuauggccgcaaugggagagauggagagcgggggcccccuggcguggccggcauucccggcguuccggggccucccggaccucccggccucccgggcuuuugugaaccugcuagcugcacaaugcaggccgggcagcgcgcguucaacaagggacccgaccccuga

SEQ ID NO: 67719 - RNA, 1215 nt, Artificial Sequence
  derived and/or modified sequence opt5 from COL9A2__Homo_sapiens__XP_011539020
auggccgcugccaccgcgagccccagaucccugcucgugcugcuucaggucguugugcuggcucucgcccaaauccggggcccuccgggggagcgcggacccccuggacccccugggcccccuggagugccgggcucugacgggauugauggagacaacggacccccuggcaaggccgggcccccuggacccaaaggcgaaccggggaaggcuggaccugauggccccgacgggaaaccuggaaucgauggccugacaggcgccaagggggagcccggacccaugggcauuccuggggucaaaggacagccgggccuucccgggccucccggacugccuggccccggcuucgcugggccgccuggacccccuggccccguggggcucccuggagaaaucggcauuagagggcccaagggcgacccgggaccugauggccccagcgggcccccuggaccgcccggcaagccugggcggcccggaacgauccagggccuggagggguccgccgacuuucugguucgcgaugaaugcccuaccaauugucccccuggcaugaaaggacccccgggccuccagggggugaagggacacgcgggcaaaagagggauccugggagacccuggccaucaagggaagcccggcccuaaaggagaugucggcgccucuggggagcagggcauucccggcccgccugggccccagggaauccggggcuacccugggauggcuggccccaagggagagacaggcccccacggguauaagggaauggugggcgccauuggggcuaccggaccuccgggcgaagagggcccccgcgggccucccggcagagccggcgaaaaaggggacgagggaagcccuggcauccgggggccccagggaauuacaggcccuaagggcgcgaccgggccgcccggaaucaacggcaaagaugggacaccuggaacccccggcaugaagggguccgccggacaagcuggccagccuggcucucccgggcaucagggacuugccacgccgggcccugggcgccaggcuauucugugcgcuccccuccugugucaccauugcggaaauguucaacuuagcuccagcuguagaggcuggaccuucugcuguucugcccccacagggggaggcaaccuggacuggggcugggaggccaaacaacaggugcacggggcgccuuccugccagggacggaauuga

SEQ ID NO: 67720 - RNA, 2055 nt, Artificial Sequence
  derived and/or modified sequence opt5 from COL9A3__Homo_sapiens__NP_001844
auggccggccccagagcuugcgccccucugcuccugcuucugcuccugggggagcuucuggcggcugccggagcccagcgggugggccucccggggcccccuggacccccugggcccccuggcaagccgggacaagacggcaucgauggcgaagcugggcccccuggacugcccggcccucccgggccgaaaggagccccuggcaagcccgggaaaccuggagaggcuggccugcccggccuccccggggucgacggacugaccggccgcgaugggccuccgggacccaagggcgccccuggggaaagaggaagccuugggcccccuggacccccgggccugggcggcaaagggcucccuggacccccuggcgaggcggggguuuccggacccccuggcggcauugggcugcggggacccccgggcccuucugggcuucccggacugcccggcccuccggggcccccuggacccccuggccaccccggcgugcucccugaaggggccacagaccugcagugucccagcaucugcccgccuggacccccugggcccccgggcaugccuggauucaagggccccacgggguacaagggcgagcagggagaggugggcaaagauggggaaaagggagacccuggcccucccgggcccgcuggacugccgggcuccgucgggcuccagggcccccgcggacugagaggccuuccugggccccugggaccucccggcgaucgggggccuauuggauuucgcggcccgcccggcaucccuggggcccccggaaaagcuggcgacagaggggagcggggaccugaaggcuuccgcgggcccaagggagaucucggcagaccgggcccuaaagggacccccggaguggccggccccucuggggagccuggaaugcccggcaaggacgggcaaaacggaguuccuggccuggauggccagaagggggaggcgggacggaauggcgccccgggggaaaaaggacccaacggccuuccugggcugcccggacgcgcuggcagcaagggcgagaaaggggaaagaggacgggccggcgagcucggggaagcuggaccuuccggcgagcccggggugccgggagacgccggcaugccuggcgagcgcggggaagccggacauagaggcucugcuggggcgcugggaccccagggcccucccggggccccuggaguccggggcuuucagggccaaaaggggagcaugggagaucccggccugccggggccucagggacucagaggcgacgugggggaccgcggacccggcggcgcugccgggcccaaaggagaucagggcauugccggguccgacggacugccuggcgauaagggggagcuuggcccgagcggacugguuggccccaaaggggaaucuggaucccggggcgagcucgggccuaagggaacacagggccccaaugggaccagcggcgugcaaggagucccugggcccccuggcccgcugggacuucagggcgugcccggggugccuggaaucacaggcaagcccggggucccuggcaaagaggcuucugaacagagaauccgcgagcuguguggaggcaugauuuccgaacaaaucgcccagcucgcggcucaucugcggaagccccuggccccggggagcauuggaagaccuggccccgccgggcccccuggacccccuggcccgcccggcucuaucgggcacccuggagcucgcgggcccccuggcuaucggggacccaccggcgagcucggggacccgggaccuagaggcaaccagggcgaucgcggggacaaaggagccgcuggcgccgggcuggauggacccgaaggcgaccaggggccucaaggaccccagggcguuccuggcacauccaaggaugggcaggacggagcgcccggcgagccggggccucccggagaucccggccuuccuggggccauuggagcucagggcaccccgggcaucugcgacacgagcgccugucaaggggcugugcugggaggcgugggggaaaaauccggaucucggagcuccuga

SEQ ID NO: 67721 - RNA, 375 nt, Artificial Sequence
  derived and/or modified sequence opt5 from COLCA1__Homo_sapiens__NP_001289574
auggagagcugcuccguggcccaggcuggcguccugaccucucccuucauguggagauggacagggauggccggagcgcucagcgcucuggacaacacgaucgaagaugacgccgaugaccaacuuccuuguggcgaggggcggccgggauggguucgcggcgaacugcucgggucccagggagugugcaaggauucuaaagaccuguuugugcccaccagcuccucucuuuacggcuguuucugcgucggccuggugagcgggauggccauuuccguucuccugcuggcuagcgauuuuagaaagcucgacuucucucggccugagcccuguuuugaaaaagaggccucccugugguucguggcucagcacuga

SEQ ID NO: 67722 - RNA, 465 nt, Artificial Sequence
  derived and/or modified sequence opt5 from COLCA2__Homo_sapiens__NP_001258386
augcaccccgagccucugcucaacagcacccaguccgccccgcaucacuuccccgacucuuuucaagcuacaccuuucugcuuuaaucagagccugauccccggcuccccuucuaacagcuccauucuuucugggagccuggauuacuccuauagccccgugcagcucccuucuuacgccccggaaaauuauaacucccccgcgagccuggacacgagaaccuguggauacccucccgaggaucauucuuaucagcaccuuuccagccaugcucaauacucuugcuucuccagcgccacaaccuccaucuguuauugcgccucuugugaagcugaggaccuggaugcccuccaggcugccgaauacuuuuacccuagcacagacugcgucgauuucgcgcccuccgccgcugccaccagcgacuuuuauaagcgggagacaaauugugauauuugcuacucuuga

SEQ ID NO: 67723 - RNA, 834 nt, Artificial Sequence
  derived and/or modified sequence opt5 from COLEC10__Homo_sapiens__NP_006429
augaacggcuucgccagccugcucagacggaaucaguuuauccugcuugugcuguuccuccugcaaauucagucccuugggcuggacaucgauucucgccccaccgcugaggucugcgccacacacacgauuagcccuggaccgaagggcgacgauggggaaaaaggagaccccggcgaggaagggaagcauggaaaaguuggcagaaugggcccuaaggggaucaaaggagagcucggcgauaugggggaccagggaaacauuggcaagaccgggcccaucggaaagaaaggcgauaagggcgaaaaagggcugcugggaaucccuggcgagaaggggaaagcgggaacagugugugacugcggccgguaccgcaaguuuguggggcagcucgauauuuccaucgcuagacugaagaccucuaugaaauucgucaagaaugugauugccggaauccgggagacagaagagaaauuuuauuacauuguucaagaagagaagaacuaucgcgagagccuuacccacuguagaauccggggcggcaugcuggccaugcccaaagacgaagcugccaauacacucauugcugauuacguggccaaguccggguucuuucgcgucuucaucggagugaacgaccuggagagagaaggccaguauauguuuaccgauaauacgccucuucagaacuacucuaauuggaacgagggggaaccgagcgaccccuauggacaugaggacugcguugagaugcuguccagcggccgguggaaugauaccgaaugucaccucacaauguacuucgugugcgaguuuaucaaaaagaagaaauga

SEQ ID NO: 67724 - RNA, 744 nt, Artificial Sequence
  derived and/or modified sequence opt5 from COLEC11__Homo_sapiens__NP_001242912
augagaggcaaccuggcccucguggggguccugaucagccuugcuuuccugucccuccugcccucuggacacccucagccggccggcgacgaugcgugcagcguucaaauucuugugcccgggcugaagggagacgcuggcgagaaaggggauaagggagccccuggccggcccggccgcguggggccuaccggagaaaaaggcgagaagggggacuccggagauaucgggcccccuggcccgaauggagaacccggccucccuugugagugcucucagcugagaaaagccauuggcgaaauggacaaccaggucagccagcugacauccgagcucaaguuuaucaagaaugcuguggccgggguucgggagacggaaucuaaaauuuaccugcuugugaaggaggaaaaacgcuaugcugaugcccaacugagcugucagggaagaggcgggacccucuccaugcccaaggacgaggcggccaacggacugauggcugccuaccuugcucaggccggccuggcgcgggucuucaucgggaucaaugaucucgagaaagaaggagccuuuguguauagcgaccauucuccuaugcgcacauucaacaaguggagauccggcgagcccaauaacgcuuacgaugaagaggacugcguugaaaugguggccagcggcggguggaaugaugucgcuugucacaccacaauguauuuuaugugcgaguucgacaaggagaacauguga

SEQ ID NO: 67725 - RNA, 2229 nt, Artificial Sequence
  derived and/or modified sequence opt5 from COLEC12__Homo_sapiens__NP_569057
augaaggacgauuucgccgaggaagaggaagugcagagcuuuggcuacaaaagauucgggauccaagagggaacccagugcacaaaguguaaaaacaauugggcucugaaguuuuccauuauccuccuguauauucuuugcgcccugcucacgaucaccgucgcgauucugggcuacaaaguuguggaaaagauggacaacgugacagggggaauggagaccucucggcagacauaugaugacaaacuuaccgcugucgagagcgaucugaaaaagcucggcgaccagacagggaaaaaggccaucuccaccaauucugaacugagcacguuccgcuccgauauccuggaccucagacaacagcugcgggagauuaccgaaaagacaucuaagaacaaggauacccuugagaaacugcaggccagcggagacgcucucguggaucgccagucccaacugaaggagacacuugaaaauaacagcuuucugaucaccacgguuaauaaaacacuccaggccuacaacggcuaugugaccaaucugcagcaggacacaucuguccugcaaggcaaccuccagaaucagauguacucccacaacgugguuauuaugaaucugaacaaucuuaaccugacccaagugcagcagagaaaccucaucaccaaucugcagcggagcgucgaugacacaucucaagcuauucagcgcaucaagaacgacuuccagaaucuucagcaaguguuucugcaggccaaaaaggauacggacuggcucaaagagaaggugcagucccugcagacccuggcggccaacaauagcgcucucgccaaggcuaacaaugauacacuggaagacaugaacucucaacuuaauuccuucaccgggcagauggagaacauuacaaccaucagccaggccaaugaacagaaccugaaagaucuccaagaccugcauaaggaugcggagaauagaacggccaucaaauuuaaccagcuugaggaacgguuccagcuguuugagacagacauugucaauaucauuuccaacaucucuuauaccgcucaccaucuccgcacccugacaagcaaccugaaugaaguuagaaccacauguacggauacccucacaaagcacaccgacgaucugacaucccuuaacaauacccuggccaacauucggcucgacagcgugucucugcgcaugcaacaggaccugaugagaucccggcuugauacggagguggcuaaucucagcgucaucauggaagagaugaaacugguggacucuaagcauggacagcugaucaagaacuucaccauucuccaggggcccccuggcccgcgcggacccagaggcgaucgggggagccaaggaccucccggcccuacaggcaauaaagggcagaagggagagaaaggcgaacccgggccuccgggacccgccggcgagagagggccuaucggacccgccggcccucccggcgaacgcgggggaaagggcuccaaagggucucagggaccgaagggcagccggggguccccuggcaagcccggaccucagggccccagcggggaccccggaccuccggggcccccuggcaaagagggacugcccggcccucaagggcccccgggcuuucagggacuucagggcaccguuggggaaccuggagugcccggcccuagagggcugcccggacucccuggcguccccgggaugccgggcccuaagggaccucccggcccuccggggcccucuggagcugugguuccucuggcgcugcagaacgagcccacacccgcccccgaggauaauggcugcccuccccacuggaaaaacuucaccgacaaguguuacuacuucuccguggaaaaagagauuuuugaagaugcuaaacuuuucugcgaggacaagagcucucaccucgucuuuaucaauacgcgcgaggaacaacaguggauuaagaagcagaugguggggcgggagucccauuggaucggacugacagauagcgaaagagagaacgaauggaaauggcuggacggcaccuccccggauuauaagaauuggaaagccgggcaaccugacaacuggggccacggacauggccccggggaggauugugccggacucaucuacgcuggccaguggaaugacuuccagugcgaggacgucaacaacuuuauuugugaaaaggaucgcgagacagugcugucuagcgcccuuuga

SEQ ID NO: 67726 - RNA, 1665 nt, Artificial Sequence
  derived and/or modified sequence opt5 from COLGALT2__Homo_sapiens__NP_001290349
auggccgcuagacccgccgcgacccuggcuuggagccuccugcuucuguccucugcccuccugcgggagggcugccgcgccagauucguggcugaacgggacagcgaggaugacggggaagaaccugucguuuuuccggaaucuccccuucaguccccuacagugcugguggccguccucgcucgcaacgccgcgcacacgcugccccauuuccugggaugucucgagagacuggauuacccuaagagccggauggccaucugggcugccaccgaccacaauguggauaacacaaccgagauuuuucgcgaauggcuuaaaaauguucaaagacuguaucauuacguggaguggcggcccauggacgaaccugaguccuauccggaugagaucggccccaagcacuggccuacaucucgcuucgcucaugucaugaaacucagacaggccgcgcugcggaccgcccgcgaaaaguggagcgacuacauucuuuuuaucgauguggacaacuuccugacaaauccccagacccucaaccugcugauugcugagaauaaaacgaucguugccccuaugcucgaauccagagggcuguauagcaacuuuuggugcggaaucacccccaagggcuucuacaagcggacaccggauuaugugcagauucgcgaguggaaaagaaccggguguuuuccuguccccauggugcacucuacauuccuuaucgaccugcggaaggaggcuuccgauaaacucaccuuuuacccuccccaccaagacuacacguggacauucgacgauauuaucguguuugccuucagcucuagacaggccggcauucagauguaucugugcaaucgcgagcauuacggauaucuucccaucccucugaagccgcaccagacccuccaagaggacauugaaaaccugauccauguccagaucgaggcuaugauugaucggcccccuauggaacccucccaguacguuagcguggugccuaaauaucccgacaagaugggcuucgaugagaucuuuaugauuaaucugaagagacgcaaagaccggagagaucgcaugcuccggacacuguacgaacaggagaucgaggucaagauuguggaagcgguugacgggaaagcccuuaacaccucucaacugaaggcucucaauaucgagaugcugccgggauauagagauccuuacuccagccgcccccuuacccggggcgaaaucggguguuuccugucccacuacucuguguggaaagaggucauugacagagaacucgagaagacacuggugaucgaggaugacguucgcuuugaacaccaguucaaaaagaagcugaugaaacucauggacaacauugaucaggcccaacuggacugggagcuuaucuauauuggacggaagagaaugcaagugaaagaaccugagaaggccguccccaauguggcuaaccuggucgaggccgauuacagcuauuggacgcucggcuacgugaucucccuggaaggggcgcagaaacugguuggagcuaacccuuuuggcaagaugcuucccguggacgaguuccucccggucauguauaauaagcauccugugcugcugagcucuccccacugccaucucuuucagacccuguccgaugacugucagcgguga

SEQ ID NO: 67727 - RNA, 1368 nt, Artificial Sequence
  derived and/or modified sequence opt5 from COLQ__Homo_sapiens__NP_005668
auggugguccugaaccccaugacccucggcaucuaccugcagcuuuucuuucugagcauuguuucccaaccuacauucaucaauucugugcucccgauuagcgccgcucugcccucccuugaccagaagaaaagagggggacacaaggccugcugucugcucacgccucccccucccccucuguuuccgcccccuuucuuucggggcgggcgcucuccccugcucagcccugauaugaaaaaccugaugcuugagcuggaaaccucccagucucccugcaugcagggaagccucggcuccccggggccucccggaccucaaggcccucccggccugcccgggaagacaggaccgaaaggcgagaagggggaacuuggaagacccggccggaaggggcgcccuggacccccuggcgugcccggcaugccggggccuaucggauggcccggcccugaggggcccagaggagaaaaaggcgaccuggggaugaugggacucccuggcagccggggccccauggggucuaagggauauccgggcucccgcggggagaaaggaagcagaggcgagaagggggaucugggcccuaaaggagaaaagggcuuccccggguuucccggaaugcugggccagaagggggagaugggaccuaaaggcgaaccggggauugcgggccaucggggacccaccggccgcccugggaagagaggaaaacagggccagaagggggacucuggagucauggggcccccuggcaaacccggcccuuccggacaacccggccggccggggccucccggaccucccccggcuggccagcucaucauggggccuaagggagagcgcggcuuccccgggccucccggcagaugucugugcggacccacaaugaaugugaacaauccuagcuacggcgagucuguuuaugggccguccagcccccgggugccugucaucuuugugguuaacaaucaggaggaacuugaacgccugaacacccagaaugccauugccuucagacgggaucaaagaucccucuacuuuaaagacucucugggauggcuucccauccagcugacaccuuucuaucccguggauuacaccgcugaccagcacggcacguguggggauggacuccugcaaccuggcgaggaaugcgacgauggcaacagcgacgucggggaugacuguauucgcugccaucgggccuauuguggagacggccacagacaugaggggguggaggauugcgacggauccgauuuuggcuaccugaccugugaaacauaccucccggggagcuauggagaccugcagugcacccaguacugcuauaucgauucuacacccugucgcuacuucaccuga

SEQ ID NO: 67728 - RNA, 609 nt, Artificial Sequence
  derived and/or modified sequence opt5 from COMMD10__Homo_sapiens__NP_057228
auggccgugcccgcugcccugauccucagagagagcccuuccaugaagaaagcggucucucugauuaacgcuaucgacaccggccgguucccgcgccuucugacacggauucuccagaagcugcaccuuaaagccgaaagcuccuuuucugaggaagaggaagagaagcugcaagccgcuuucagccucgagaaacaggaucugcaucugguucucgaaacgaucuccuuuauucuggagcaggccguguaccacaaugugaagcccgcugcccuucagcaacagcuggaaaacauccaucucagacaggacaaggcggaggccuucgucaauaccuggucuagcauggggcaggagacaguggaaaaauuucgccaaagaauccuggcuccuugcaagcuggagaccguuggauggcagcugaaccuccagauggcccacuccgcucaggccaaacuuaagagcccccaagcggugcugcagcucggcgucaauaacgaagauucuaaaucccuggagaaggugcuuguugaguucagccauaaggaacuguuugacuucuauaauaaacucgagacaauucaggcccaacuggauucucuuaccuga

SEQ ID NO: 67729 - RNA, 573 nt, Artificial Sequence
  derived and/or modified sequence opt5 from COMMD1__Homo_sapiens__NP_689729
auggccgcuggcgagcuggaagggggaaagccccucagcggccugcuuaacgcccuggcgcaggacaccuuccacggguacccuggaaucacagaggaacuccugagaucccaacuuuauccggaggugcccccugaagaguuucggcccuuccuggcuaaaaugcgcggcauucucaagucuaucgccagcgccgauauggacuuuaaucagcuggaggcuuuccugacggcccagaccaaaaagcaagggggaauuacauccgaucaggcugccgucaucucuaaauuuuggaaaagccauaagaccaagauuagagaaucccucaugaaccagucucgguggaauagcggccugcgcggccuuuccuggagaguugacggaaagagccagucucggcacuccgcgcagauccauacaccuguggccaucauugagcuggaacucgggaaauacggccaagagagcgaguuccugugccuugaauuugaugaggugaaggucaaccagauccugaaaacccucucugaaguggaggaauccauuagcacacugaucucucagcccaauuga

SEQ ID NO: 67730 - RNA, 1410 nt, Artificial Sequence
  derived and/or modified sequence opt5 from COMMD3-BMI1__Homo_sapiens__NP_001190991
auggagcugagcgaauccgugcagaagggcuuccaaaugcucgccgaccccagaucuuuugauagcaacgcuuucacccugcuucugcgggccgcguuucagucccuccuggacgcucaggccgaugaggccguccuugaccacccugaucugaaacauaucgacccgguugugcucaagcacugccaugcugccgcugccacauacauucuggaagcggggaaacaccgcgccgauaagucuacgcugagcaccuaucucgaggacuguaaauucgauagagaacggaucgagcuguuuugcacagaguaccagaauaacaagaauagccuugaaauucugcucggacgcacccugaucccccauccuauucaaagacuugugcuggucgcugccuggaacaauuaucggaucuucuaccaggcugagaugcaccgcacaaccagaaucaagauuacagaacucaacccccaccugaugugugugcugugcggcggguauuuuaucgacgccaccacgauuaucgagugucuccauucuuucugcaaaaccuguauuguucgguaccuggagacaagcaaguauugcccuaucugugaugugcagguccacaaaacccgcccccuucugaauauuagauccgacaagacacuccaggauaucguguacaaacugguuccuggacuuuuuaagaacgaaaugaagcggcgcagagacuucuacgcggcccauccgagcgcugacgccgcuaauggcucuaacgaggaucgcggggaaguggccgacgaggauaaacggaucauuaccgacgaugaaaucauuucccugagcaucgaguuuuucgaccaaaauagacucgaucggaaggucaacaaagacaaggagaaaucuaaggaagaggugaaugauaaaagauaucugcgcugccccgccgcuaugacggugaugcaucugcggaaguuucucagauccaagauggacauuccuaacacauuccagaucgaugucauguacgaagaggaaccccugaaagacuauuacacccuuauggacaucgcguauauuuacacauggcgccggaauggaccucugccccucaaguauagaguucgcccgaccuguaaacggaugaagaucagccaccagagagauggccugaccaacgccggcgagcuugagucugacuccgggagcgauaaagcuaacuccccugccggaggcauucccucuacaagcuccugccugccuagccccucuacgcccgugcaguccccucacccgcaauucccccacaucagcucuaccaugaaugggacaagcaacuccccuucuggaaaucaucagagcuccuuugccaaccgcccccggaaguccucugugaauggcuccagcgcuaccucuuccggguga

SEQ ID NO: 67731 - RNA, 675 nt, Artificial Sequence
  derived and/or modified sequence opt5 from COMMD5__Homo_sapiens__NP_054785
augagcgccgugggcgcugccacccccuaccugcaccauccuggggacucccacucuggaagagucagcuuccucggcgcgcagcugccgcccgagguugcugccauggcccggcuucugggggaucucgaccgcuccacauuuagaaagcugcuuaaauucguggugucuagccugcaaggagaagauugccgggaggcuguccagcgccucggcguguccgccaaccugccugaggaacagcugggggcucuccuggccggaaugcauacgcuucugcagcaagcgcucagacugcccccuaccucucuuaagcccgacacauuucgggaucagcugcaggaacucuguaucccucaggaccugguuggcgaucuggccagcguggucuucggcucccaacgcccgcuccuggacagcguggcucagcagcagggggccuggcuuccccacguugcugauuuuagauggcggguggacgucgccauuucuaccuccgcgcuggcccgcagccuccaaccuucugugcugaugcagcuuaaacuguccgauggaagcgcuuauagauucgaggugcccacagccaaguuucaggagcuccgguacucugucgcucugguucugaaagaaauggccgaccucgagaagcgcugcgaaagacggcugcaagauuga

SEQ ID NO: 67732 - RNA, 600 nt, Artificial Sequence
  derived and/or modified sequence opt5 from COMMD7__Homo_sapiens__NP_001092809
augggcagacugcacugcaccgaggaccccgugccugaagccgucgggggagauaugcagcaacucaaccagcugggcgcucaguucagcgcccuuacagagguucuguuucauuuccucacggaaccgaaggagguggaacgguuucuggcgcagcuuuccgaguucgcuaccacaaaucaaaucucucuggggagccuccgcuccauugugaaaucucugcugcucguccccaacggagcccugaagaaaagccuuaccgccaaacaggugcaggcugacuuuaucacacugggccucuccgaggaaaaggccaccuacuucucugagaaguggaagcagaaugcuccuacacuggccagaugggcgauugggcaaacccuuaugaucaaccagcugauugauauggaauggaaauuuggaguuacgagcggcuccagcgagcucgagaaggugggcucuaucuuccugcagcugaaacucgucgugaagaaagggaaucagaccgaaaacguuuauaucgagcugacacuuccccaauuuuacuccuuccugcacgaaauggagcgggugcgcaccagcauggaauguuuuugcuga

SEQ ID NO: 67733 - RNA, 2274 nt, Artificial Sequence
  derived and/or modified sequence opt5 from COMP__Homo_sapiens__NP_000086
augguucccgacaccgccugcguccugcuccugacacuugcugcccugggcgcgagcgggcagggacaauccccucucggcucugaucuggggccgcagaugcuuagagagcugcaggaaacgaacgcugcccuccaggacguucgggagcugcugcgccaacaggugagagaaaucaccuuccucaagaauacagugauggagugugaugccugcggaaugcagcagagcguccggaccggccugcccuccgugcgcccucuucugcacugugcucccggguuuugcuucccuggaguugccuguauucaaacagaaucuggcgcuagaugcggccccuguccugccggguuuaccggaaacggcagccauugcacagacgugaaugaguguaacgcgcacccgugcuucccccggguccgcuguaucaauaccuccccuggguuuagaugcgaggccugcccgccuggauacucuggccccacgcaucagggggugggacucgcuuucgccaaagcuaacaagcagguuuguaccgauauuaaugaaugcgagacaggccagcacaacugugugccgaauagcgucugcaucaacacccggggcuccuuucaaugugggccuugccagcccggauucgugggcgaccaggccagcgggugucaacgcagagcgcagcgguuuugcccugauggaucucccuccgaaugucaugagcacgccgacugcgugcuggagcgcgauggcagcagaucuugugucugcgcuguugggugggccggaaauggcauucuuugcggccgggacacagaucuggacggguuccccgaugaaaaacuccgcuguccugagagacagugccggaaggacaacugugugaccgugcccaauuccggacaggaagacgucgauagagacggcaucggggaugcuugcgaccccgaugccgacggagauggcgugccuaacgagaaagacaauuguccccugguucgcaacccugaucaacggaacacggacgaagauaaguggggcgacgccugcgacaauuguagaagccagaagaacgaugaccagaaagauacagaccaggaugggcgcggagacgcuugcgaugacgauaucgacggcgaucggauuagaaaucaagcggacaacuguccccgcgugccuaauucugaucagaaggacuccgacggggauggaaucggcgacgccugcgauaacuguccgcagaaaagcaaucccgaccaggcugaugucgaccacgauuuugugggggacgccugcgauuccgaccaagaucaggacggagauggccaucaggacucucgggacaacugcccuaccguucccaauagcgcccaggaggauuccgaccacgaugggcaaggcgacgcuugugaugacgaugacgauaacgacggagugccugauagcagagacaauugccgccugguccccaacccgggccaggaggacgccgaucgggacggggugggagaugucugucaggacgauuucgacgcggauaaggugguugacaaaauugaugugugcccugaaaaugcugaggucacacucaccgacuuuagagccuuccaaaccgugguucuggaucccgaaggcgacgcccagaucgaucccaacugggugguccuuaaucaggggcgcgagauugugcagacaaugaacucugacccuggacuggcugugggcuauacggccuucaacgggguugacuuugaaggcaccuuccaugucaauacagugaccgaugacgauuacgcuggauuuaucuucggcuaucaagacuccagcucuuuuuacguggucauguggaagcagauggagcagacauauuggcaggccaacccguuccgggcgguggccgagcccgggauucaacucaaggcuguuaaaagcuccaccggaccuggcgaacagcugagaaaugcccuuuggcacacgggggauacagagucucaggugcggcugcucuggaaggacccccgcaacgucggauggaaagauaagaaaagcuacagaugguuucugcagcaccggccucaagugggcuauaucagaguucgcuucuacgaagggcccgagcugguggcugacuccaaugucgugcucgauaccaccaugcggggcggaagacugggcguguuuuguuucagccaggaaaacaucauuugggccaaucuucgcuacagaugcaacgacacaaucccugaggauuaugagacccaucagcugcggcaagcguga

SEQ ID NO: 67734 - RNA, 816 nt, Artificial Sequence
  derived and/or modified sequence opt5 from COMT__Homo_sapiens__NP_001128634
augcccgaggccccuccgcugcuccuggcugccgugcuucugggccucguccugcuuguugugcugcuccugcugcucagacacuggggguggggacugugccuuaucggcuggaacgaguucauucugcagcccauccauaaucuccugaugggggacaccaaggaacaacggauucuuaaccacgugcugcagcaugcggaaccuggaaaugcucagagcguccucgaggccaucgauacauacugugaacagaaagagugggccaugaacgugggcgacaagaaagggaagauuguugaugcugugauccaagagcaccagcccuccguccugcuggaacucggagccuauugcggcuacucugcugugcgcauggccagacugcuuagcccuggcgcgcggcugaucacgauugagaucaaucccgacugugccgcuauuacccagcgcaugguugauuuugccggggugaaagacaaggucacacucguggugggagcuucccaggauaucauuccucaacugaagaaaaaguaugacgucgauacccuugacaugguuuuccuggaucauuggaaagacagauaccucccggauacacugcugcucgaagagugcggccugcuucggaaggggaccgugcugcucgccgacaacgugaucugucccggagcgccugacuuucuggcccacguccgcggcucuagcugcuucgaguguacacacuaucaguccuuucuugaauacagagaggugguugaugggcuggaaaaagcuauuuauaagggacccggcucugaggccggcccuuga

SEQ ID NO: 67735 - RNA, 3702 nt, Artificial Sequence
  derived and/or modified sequence opt5 from COPA__Homo_sapiens__NP_001091868
augcugaccaaguucgagacaaaauccgccagagugaagggccucuccuuucaccccaaacggccuuggauccugacgucucuucauaacggggucauucagcugugggacuaccgcaugugcacccucaucgauaaguucgacgaacacgauggaccgguuagaggcauugacuuucauaaacaacagccccuguucgugagcgggggagaugacuauaagaucaagguguggaauuacaaacuucggcgcugucuguuuacacuccugggccaccuggauuauauuagaaccacauucuuucaucacgaguacccuuggauccucuccgcuucugacgaucagaccauccgggucuggaacuggcagagccgcacaugcguguguguucugaccgggcacaaucauuaugugaugugcgcccaauuccaccccacggaagaccuugucguguccgcgucucuggaucagaccguuagagugugggacauuagcggacuccggaagaaaaaccuguccccuggcgcugucgagagcgaugugcgcggcaucacagggguggaccuuuuuggaaccacagacgccgucguuaagcaugugcuggaaggccacgauagaggggugaauugggccgcuuuccaccccaccaugccucucauugucucuggagccgacgaucgccaggugaaaaucuggcggaugaacgaguccaaggcuugggagguugacacguguagaggccauuacaauaacgugagcugcgccgucuuucacccgcggcaggaacugauucugucuaauuccgaggauaagagcauccgcgugugggacaugucuaaaagaacagggguucaaaccuuccggagagaucaugaccgcuuuugggugcucgcggcccaccccaaccugaaucuuuucgcugccggacaugauggcggcaugauugucuucaagcuggaacgggagagaccugcuuaugccgugcacgggaacaugcuccacuacgucaaagaccgcuuucugcggcagcuugauuucaauuccagcaaggacguggcgguuaugcagcugagauccggaucuaaauuucccguguucaacaugagcuacaauccugccgagaacgcuguccuccuguguacacgcgccuccaaccuggaaaauagcaccuaugaccucuacaccauccccaaggaugcugacucucagaacccggaugccccugagggcaaacgguccagcgggcugacagccguguggguugcuagaaaucgcuuugcggugcuugaccggaugcauucucugcucaucaagaaccugaagaaugaaauuacgaaaaagguccaagugcccaacugcgaugagaucuucuaugccggaaccggcaaucuucugcucagagacgcugauagcauuacacuguuugacgugcagcagaaacgcacccuggccuccguuaagaucucuaaagucaaguacgugauuuggagcgccgauaugucccacguggcucuccuggccaagcaugaacacagcuguccucuuccccugacagcgaucgucaucugcaaccggaaacucgacgcucuguguaauauucacgagaacaucagagugaagucuggggccugggaugaguccggaguuuucauuuauaccacgagcaaucauaucaaauacgccgugacaaccggcgaccacggcauuauccggacccuggaucuucccaucuaugucacacgcgugaaggggaacaauguuuacugccucgacagagaaugccggccuagagugcugaccauugacccgacagaguuuaaauucaagcuggcucucaucaaccgcaaguacgaugaaguccugcauauggugcggaaugccaaacuuguuggacaaucuauuaucgcuuaucugcagaagaaaggcuaccccgagguggcccuccacuuugucaaggacgaaaagacgagauucucccuggcgcuggagugugggaacauugagaucgcccuugaagcugccaaggcucucgaugacaagaacugcugggagaaacugggagaaguggcccugcuccagggcaaucaucagauuguggagauguguuaucaacgcaccaagaacuuugauaaacugagcuuccuuuaccugaucacagggaaucucgaaaagcugagaaaaaugaugaagaucgcggagauucggaaagacauguccggccacuaucagaacgcccuguaccuuggagaugucucugagcgcguuagaauccucaagaauugcggccagaaaagccuggcuuaucugaccgccgcuacacacgggcucgacgaagaggccgaaucccugaaagagaccuucgauccugagaaggaaacgauucccgacaucgauccuaacgccaaacuucugcagcccccggcuccuauuaugccccucgacaccaauuggccucugcugacagugucuaagggauuuuucgagggcaccaucgcgagcaaagggaagggaggcgcccuugcugccgauaucgacauugacacaguggggaccgaaggcuggggagaggaugccgaacuccaacuggacgaggauggcuuugucgaggcuacggaagggcugggagacgaugcccucggcaaggggcaggaggaaggaggcgggugggacguggaggaagaucuggagcuucccccugagcuggacaucucccccggcgcggcuggaggcgccgaagauggguucuuuguuccgccuacaaaaggaaccagccccacacagauuugguguaacaauucucagcuccccguggaccauauccuggccggcuccuucgagaccgcuaugcggcugcuucacgaucaagucggggugauucaguuuggaccuuacaagcagcuguuccuccagaccuacgcccgcggcagaacaacguaucaagcgcugccgugccuccccagcauguacggguauccuaaccggaauuggaaagacgcuggccugaagaacggaguucccgccgugggccuuaaacugaaugaccucauccagcgccugcagcuguguuaccaacuuaccacagucgggaaguuugaagaggccguggaaaaguucagaucuauccugcucuccguuccucugcucguggucgauaacaaacaggagauugcugaggcccagcagcugaucaccauuugccgggaauauaucgugggacuuagcguggagacagaacgcaagaaacugcccaaggagacccucgagcaacagaaaagaauuugugaaauggcugccuacuuuacgcauucuaaucugcagccuguccacaugauccugguucuucggacagcgcugaaccucuucuuuaagcugaagaacuucaaaaccgccgcuaccuucgccagacgccuccuggagcuuggccccaagccggaaguggcucagcaaacacggaaaauccugagcgccugcgagaagaauccuaccgacgccuaucagcugaacuacgauaugcauaaucccuuugacauuugugcugcguccuacagaccuaucuaucgcgggaaacccguggaaaagugcccgcucagcggagccugcuacucuccugaguucaaaggccagauuugucgggucacaacggugaccgagaucggcaaggauguuauugggcugagaaucagcccccuucaguuucgcuga

SEQ ID NO: 67736 - RNA, 2862 nt, Artificial Sequence
  derived and/or modified sequence opt5 from COPB1__Homo_sapiens__NP_057535
augaccgccgcugagaacgugugcuacacacugaucaauguccccauggacagcgaaccuccguccgagauuucucucaagaacgaucuggaaaaaggcgacguuaagagcaaaacggaggcccuuaagaaagugaucauuaugauccugaauggggaaaagcuccccggacugcuuaugaccauuaucagauucgugcugccucuccaggaucacacaaucaagaaacugcugcucgucuuuugggagauugugcccaagaccacaccugacggccggcugcuucaugagaugauccugguuugugaugcguaucgcaaagaccuccaacaccccaacgaguucauuagaggguccacccugcgguuucuuugcaagcugaaagaggcugaacuccuggagccucugaugccggccauccgcgccugucucgagcauagacacucuuacgugcggcgcaaugcuguccuggccauuuauacaaucuacagaaacuucgaacaucuuauucccgaugcuccugagcugauccacgacuuucucgugaaugaaaaggaugccagcugcaagcggaacgcguucaugaugcugauccacgccgaccaggaucgcgcucuugacuaucuguccaccuguauugaucagguucagacguuuggagacauccuccaacuggugauugucgagcugaucuacaaagugugccaugccaaucccucugaaagagcucgguucauucgcuguaucuauaaccuccugcagagcuccagcccugccgugaaguacgaggcggccggcacccuugucacacugucuuccgcucccaccgccaucaaagcugccgcccagugcuacauugaccucaucauuaaggagagcgauaauaacguuaaacugaucgugcuugacagacugauugaacucaaggagcacccggcucaugaacgggugcugcaggaucuggucauggacauccuccgcgugcugucuacaccugaucuugagguucgcaaaaagacccugcaacucgcgcuggaccugguguccagccggaaugucgaagaacuugugaucguucucaagaaagaggugauuaagacgaacaaugucucugaacacgaggauacagacaaauauagacagcugcuggugcgcacccuccacuccuguagcguccgguuucccgauauggccgcuaacgugaucccuguucugauggaguuccuuuccgacaacaaugaagccgccgcugccgaugugcuggaauuugucagagaggcgauucagcgcuucgacaaccuccggaugcugaucguggagaagaugcuggaaguuuuucaugcuauuaaaucugugaagaucuacagaggggcccuuuggauucucggagaguauugcagcacaaaggaagacauccaguccgucaugaccgagauccgccggagccugggcgagauucccaucguggaaucugagauuaaaaaggaagccggcgagcugaaacccgaagaggagaucaccguggggccuguucaaaagcucgucacagaaaugggaacguacgcuacccaguccgcccugagcucuagcagaccgaccaaaaaggaggaagauagacccccucuucggggcuuccugcucgacggggauuucuuuguggcugccucccuggcgacaacacugaccaagauugcccuuagauauguggcucucguccaggagaaaaagaaacaaaauucuuucguggccgaagcuaugcugcugauggccacgauccuccaccugggaaagagcucccuucccaaaaagccuaucacagacgaugacguugaucgcauuagccugugucucaaggugcugucugagugcagcccccugaugaacgacaucuuuaauaaagagugccggcagucccuuucucauaugcucuccgcgaagcuggaagaggaaaaacugagccagaagaaagaguccgaaaagagaaacgucaccgugcagccggaugacccuauuucuuucaugcaacucaccgccaaaaaugagaugaacuguaaggaggaucaguuucagcugagccuucuggcugccaugggcaauacacagcggaaggaagcugccgacccccucgccuccaaacugaacaagguuacccaacugacaggguucucugauccuguguacgcugaggcguauguccacgugaaucaguacgacaucguucuugacgugcuggucgugaaccagacgagcgauacccuccagaauugcacacuggaacucgccacccugggagaccuuaaacugguggagaagcccuccccucucacacuggcuccccaugauuuugccaacauuaaagccaaugucaagguugcuagcaccgagaacggcaucaucuucggcaacauuguguacgacgugucuggggccgcguccgaucgcaauugugucgugcugagcgacauccacauugauaucauggacuauauucaaccggcuacgugcaccgaugccgaauuuagacagaugugggccgaguucgaaugggagaacaagguuacagugaauaccaacauggucgaccuuaaugauuaccugcagcacauccucaaaucuacaaacaugaagugucugaccccugaaaaagcucucuccggauauugcggcuuuauggccgcgaaucuguacgcucggagcaucuucggggaggacgcccuugccaacgugucuauugagaagcccauccaucagggacccgaugcugccguuacgggccacauuagaauccgcgcuaaaagccaagggauggcccugucccucggagacaagauuaaucugagccagaagaaaacaucuaucuga

SEQ ID NO: 67737 - RNA, 2721 nt, Artificial Sequence
  derived and/or modified sequence opt5 from COPB2__Homo_sapiens__NP_004757
augccccugagacucgacaucaagcggaaacugaccgcccgcagcgauagagugaaguccgucgaccuucacccuacagagccguggaugcuggcuucucucuacaacggcagcguuugcguguggaaucaugaaacgcagacccuggugaaaacauucgaggucugugaucuucccgugcgggccgcgaaguuuguugcucgcaaaaacuggguggucaccggggccgacgauaugcaaauuagaguguucaauuauaacacacuggaacggguucacauguuugaggcccauuccgacuacauccgcugcauugcugugcacccuacccagcccuucauccucacaucuagcgaugacaugcugauuaagcugugggauugggacaagaaaugguccuguucucaggucuuugaaggacauacccacuaugugaugcagaucgugaucaauccuaaggauaacaaucaauucgccagcgcuucccucgacagaacgauuaaagucuggcagcugggcagcagcucccccaacuuuacccuugaggggcacgagaagggaguuaauugcaucgauuacuauagcggcggggacaaaccuuaccugauuucuggagccgacgaucggcucgugaagaucugggacuaucagaacaagacaugugugcagacccuggaaggccaugcgcaaaaugucuccugcgccagcuuccacccggagcuucccauuaucauuacaggcucugaagaugggaccgugcgcaucuggcauuccagcacguacagacuggaguccacacucaacuacggaauggagcggguuugguguguggcuucucugcgcggcagcaauaacgucgcccugggguaugacgaaggauccaucauugugaaacucggcagagaggaaccugcuaugagcauggaugccaaugggaagaucauuugggcgaaacacucugagguucagcaggccaaccugaaggcuaugggagacgccgaaaucaaagauggcgagcggcuuccccuggcugugaaggacaugggcuccugcgagauuuacccucagaccauccaacacaaccccaaugggcgcuuugucguggucuguggagauggcgaauauaucauuuacacagccauggcccucagaaacaaaucuuucgggucugcucaggaguuugcgugggcccaugacagcuccgaauaugcuauccgggagucuaauagcauugugaagaucuucaagaacuuuaaagaaaagaaauccuucaagccggauuucggagccgagagcauuuacggcggguuucugcuuggaguuagaucugugaauggccuggccuucuaugacugggacaacaccgagcucauccgccggaucgaaauucagccuaaacacaucuuuugguccgauagcggcgagcuggucugcauugcuaccgaagagucuuucuuuauccugaaguaccucuccgaaaaggugcuggccgcgcaagagacacaugaggggguuacggaagacggaauugaggaugcuuucgaagugcuuggcgagauccaggagauugucaaaaccgggcugugggugggagacuguuuuaucuacacaagcuccgugaauagacucaacuauuacguuggcggggaaaucgucaccauugcccaccuggaucgcacaauguaucuucugggcuacauccccaaggacaaucggcucuaucugggagauaaagagcugaacauuaucucuuacagccuccugguguccgugcuugaauaucagaccgccgucaugagacgcgacuucucuauggcugauaaggugcugccuacgauucccaaagagcagcggacaagaguugcccauuuucucgaaaagcaaggcuucaagcagcaggcucugaccgugagcaccgaccccgagcaccgcuuugagcuggcccuucagcucggggaacugaaaaucgcguaccaacuggccgucgaggcugaauccgagcagaaguggaaacagcucgccgaacuggcuaucagcaagugccaguucggacuugcccaagagugccugcaccaugcgcaggauuacggcgggcuccugcugcuugccacagcuucuggaaaugccaacauggugaauaaacucgcugagggcgccgaacgggacgggaagaacaauguugccuuuauguccuauuuccugcagggcaagguggaugcuugucuggagcuccugauuagaaccggacgccuuccugaagcggccuuccuggcucggacauaccucccgagccaggucucuagagugguuaaacuguggcgggagaaccuguccaaggugaaccaaaaagccgccgaaagccuugcugaccccacggaguaugagaaucucuuuccuggccugaaggaagccuucgucguggaggaaugggugaaagagacccacgcggaccuguggcccgcuaagcaguacccucucgucacacccaacgaggaacgcaauguuauggaggaagggaaagauuuucagccgucuagaagcaccgcccaacaggagcuggacggaaagccugccucccccacaccugugaucguggcuagccauaccgccaacaaggaagagaaaucucuucuggagcucgaagucgaucuggacaaucuggagcuugaagauauugacacgaccgauaucaaccucgacgaggauauucuggacgauuga

SEQ ID NO: 67738 - RNA, 927 nt, Artificial Sequence
  derived and/or modified sequence opt5 from COPE__Homo_sapiens__NP_009194
auggcucccccugccccgggccccgccagcgggggauccggcgagguggacgaacuguucgaugucaagaacgcguuuuacaucgggucuuaucagcaaugcauuaaugaggcucagagaguuaaacucagcuccccugaacgggacguggagcgcgauguguuccuguacagagccuaucuugcccagcggaaguuuggagucgugcuggacgaaaucaaacccucuagcgcuccugagcuccaggccguucgcauguucgcugauuaccuggcccacgaguccagacgggacucuauuguggcggaacuugaucgcgagaugagcagauccgucgacgugaccaacacaacguuucugcucauggccgcuagcaucuaucugcaugaucaaaaucccgacgccgcucugcgggcccuccaccagggcgauucucuggaauguaccgcgaugacaguucagauucuucugaagcucgaccgccuggaucuugccagaaaagagcugaagcggaugcaggaccucgacgaggaugcuacccugacacaacuggccaccgcuugggugucccucgccacagggggagaaaagcugcaggacgccuacuauaucuuccaggagauggcugauaaaugcagcccuacccuucugcuccugaacggccaggcggccugucauauggcucaaggccgcugggaagccgccgaggggcuucugcaggaagcucucgacaaggauucuggauacccggagacgcuggucaaucugaucgugcucucccagcaccugggcaaacccccugaggugaccaacagauaccuuagccaacugaaggacgcccaucggucucaccccuuuauuaaagaauaucaggcgaaggagaaugauuucgaccgccucguccugcaguacgcuccuuccgccuga

SEQ ID NO: 67739 - RNA, 2181 nt, Artificial Sequence
  derived and/or modified sequence opt5 from COPG2__Homo_sapiens__NP_001276962
augaucaagaaauucgacaagaaagaugaggaaagcggcuccgggucuaaccccuuucagcaccuggagaagucugccgugcuccaagaagcuagaauuuucaaugagaccccuaucaacccgcggcgcugccugcauauucuuacaaaaauccuguaccuccugaaucagggagaacacuuuggcacgaccgaggccacagaggcguucuuugcuaugaccagacuuuuccaguccaacgaccagacacugcggcgcauguguuaucucaccauuaaggaaauggccacaaucucugaggaugucaucauuguuaccagcucccugacgaaggacaugaccgggaaagaagauguguacagaggacccgccauccgggcucugugccgcauuacagacggcaccaugcuccaagccaucgagagauauaugaagcaggcuauuguggauaaagucucuagcguguccagcucugcccugguuuccagccuucauaugaugaagaucucuuacgacguggucaaacgguggauuaaugaggcgcaggaagccgcuuccagcgauaacaucauggugcaguaucacgcccuggggguucucuaccaucugcgcaagaaugacagacuugcugugucuaagaugcugaacaaauuuacaaaguccggacucaaaagccaauucgccuauuguaugcugauccggauugcgucccgccugcucaaggagaccgaagauggccacgagucuccucuguuugacuucaucgaaagcugccuuagaaauaaacacgagauggucauuuacgaggccgcuuccgccaucauucaucugcccaacuguacggcucgggaacucgccccugccgugagcgugcugcagcuuuucugcagcucccccaagccugcucugcgcuacgcggccgucagaacacucaauaaaguugcuaugaagcacccgagcgccgugaccgccuguaaccuggaucuggagaaucucaucacagacucuaaccggagcaucgcuacccuggccauuaccacacuucugaagacgggcuccgaaucuagcguggacagacucaugaaacagaucuccagcuuugucucugagauuuccgaugaauuuaaggugguugugguccaggcgaucagcgcucugugccaaaaauauccccgcaagcauucugugaugaugaccuuccuuuccaauaugcugcgggacgaugggggauucgaguacaaaagagccauuguugacuguaucaucagcauuguggaggaaaacccugaguccaaggaagccggccucgcucaccugugcgaguuuaucgaagauugugagcacacaguccuggccaccaagauucuccaucugcuugggaaagagggaccccgcacaccugugcccucuaaguauauccgguucauuuuuaacagagucgugcuggaaaaugaggcuguucgcgccgcggccgugagcgcucucgccaaauucggcgcucagaacgaaucccugcugccgucuauccuuguccuccugcagcggugcaugauggacaccgaugacgaggugagagaucgcgccacguuuuaccugaauguucuccaacagcggcagauggcgcugaacgccacauauauuuucaaugggcuuaccgugagcgucccuggaauggagaaggcucugcaccaguacacccucgaacccuccgagaaaccuuuugacaugaaaagcaucccccuggccauggcucccguguucgaacaaaaggccgagaucacacugguggccaccaagccugaaaaacuugcuccgucuagacaggauauuuuucaggagcagcucgcggccauccccgaguuccugaacauuggcccucuguuuaaguccagcgaacccguucaacucacagaggcugaaacggaguauuucguccgcugcaucaagcauauguuuaccaaucacauuguguuccaguucgacuguacaaacacccugaaugaccagcuucuggaaaaagugacaguccagauggagccuucugauuccuacgaggugcucagcugcauccccgccccgucucugccuuacaaccaacccggcaucuguuauacccugguucggcuuccugacgaugaccccacggccgggaccaauccucagaagggaggcgauacauga

SEQ ID NO: 67740 - RNA, 555 nt, Artificial Sequence
  derived and/or modified sequence opt5 from COPRS__Homo_sapiens__NP_060875
auggaccugcaggccgcuggcgcccaagcgcagggggcugccgagcccagcagaggaccuccgcuccccuccgcccggggcgcuccucccucuccugaagccggguucgcuaccgccgaucacagcucccaggagcgcgaaacagagaaggcgauggacagacuggcccggggaacgcagucuauccccaacgauagcccugcucgcggcgaagggacccauuccgaggaggaaggauuugccauggacgaggaagauucugacggcgagcuuaauacaugggagcugagcgaaggcaccaacugcccgcccaaagagcaaccuggggaucucuucaaugaagacugggauuccgagcugaaggcugaccagggaaaccccuacgaugccgacgauauucaggaaagcaucucucaggagcuuaaaccuuggguguguugcgcgccccaaggcgacaugauuuaugacccguccuggcaccauccucccccucugauccccuacuauagcaagauggucuuugagacagggcaguucgaugacgccgaagauuga

SEQ ID NO: 67741 - RNA, 1353 nt, Artificial Sequence
  derived and/or modified sequence opt5 from COPS2__Homo_sapiens__NP_001137359
augagcgacauggaggaugacuucaugugcgaugacgaagaggauuacgaccuggaauauuccgaggauucuaacagcgaacccaauguggaccucgagaaccaguacuauaauuccaaggcccugaaagaggaugacccuaaggcugcccuuucuagcuuucaaaaaguccuggaacucgagggcgaaaagggggaguggggauucaaagcgcugaagcagaugaucaagauuaacuuuaaacuuaccaauuucccggagaugaugaacagauacaagcagcugcucacauauauccgguccgcuguuacgcgcaauuacucugaaaagagcauuaacuccauccuggauuauauuagcaccucuaagcaaaauuccgacuuucugugucaaauggaucuccugcaggaguucuacgaaacaacccuugaggcccugaaagacgccaagaacgacagacucugguuuaagacaaauaccaaacugggcaaacuuuaccuggaacgggaggaguaugggaaacuccagaagauccugcgccagcugcaccaaagcugccagacagaugacggagaagaugaccucaaaaagggcacccagcugcuugagaucuacgcucuggaaauucagauguauacggcccagaaaaacaauaagaagcucaaagcucuguacgagcagucucuucauaucaaguccgccauuccccacccucugaucaugggggugauuagagaauguggaggcaaaaugcaucuccgggagggcgaguucgaaaaggcgcacaccgacuuuuucgaggccuuuaaaaacuaugaugaaagcgggucuccccgcagaacaaccugccugaaguaccuggugcucgcuaauaugcugaugaaguccggaaucaacccuuucgauagccaggaggccaaacccuauaagaacgacccugaaauucuugcuaugacaaaucuggucuccgccuaccaaaacaaugauaucaccgaguuugagaaaauccucaagacgaaccauucuaauauuauggacgauccguucauccgggaacacauugaggaacugcuucgcaacaucagaacacaggugcugauuaaacucaucaagcccuacacccggauccacauuccuuucaucagcaaggagcugaauauugacguugcggacguggagucccugcucguccaguguauccuggauaacacaauucauggccgcaucgaccaggugaaucaacuucuggaacucgaucaccagaaaagagggggagcccgguauaccgcucuggacaaguggaccaaccagcugaauagccuuaaccaggccguugugucuaaacucgcuuga

SEQ ID NO: 67742 - RNA, 1212 nt, Artificial Sequence
  derived and/or modified sequence opt5 from COPS3__Homo_sapiens__NP_001186054
augacccagcugugcgagcucaucaacaagagcggcgaacugcuugccaaaaaucugucccaccucgacacagugcugggggcucuugauguccaagagcauucucugggaguucucgccgugcuguucgugaaguuuagcaugcccuccgucccugacuucgaaacgcuguuuucucaggugcaacucuucauuagcaccuguaacggcgagcacaucagauacgcgacagauaccuuugcugggcugugccaucagcuuacaaaugcccugguugaacggaaacaaccgcuccgcggaauuggcauccugaagcaggccauugacaaaaugcagaugaacaccaaucagcuuacauccauccacgcugaucugugucaacucugccugcuggccaaguguuucaagcccgcucucccuuaucuggacguggauaugauggacaucugcaaagagaacggggccuacgaugcgaagcauuuucuuuguuauuacuauuacggaggcaugauuuauaccggccugaaaaauuucgagagagcccucuacuuuuacgaacaggcuaucacgacccccgccauggcugucucucacauuaugcuggagagcuauaagaaauacauccuugugucccugauucuccuggggaagguucagcagcugccuaaguauacaagccaaaucgugggacgguucauuaaaccccucucuaacgccuaccacgaacuggcgcaggucuauuccaccaauaacccuagcgagcuucgcaaucuggugaacaagcauucugagacauuuaccagagacaauaacaugggccucgugaaacagugccuguccagccuuuacaagaaaaauauccaacggcugacgaagacauuccucacccugucucugcaggauauggccucccgcguccagcucagcgggccgcaggaagcugagaaauauguucugcacaugaucgaagacggagagauuuuugccuccaucaaccaaaaggauggcauggugucuuuccaugacaaccccgaaaaguacaauaacccugcuaugcuucacaauauugaccaggagaugcugaaauguaucgagcucgaugaaagacugaaggccauggaccaggagauuacagugaacccccaguucguccagaaaagcauggggucccaggaagaugacagcggaaauaagccuucuuccuacagcuga

SEQ ID NO: 67743 - RNA, 1059 nt, Artificial Sequence
  derived and/or modified sequence opt5 from COPS4__Homo_sapiens__NP_001244935
auggccgcugccgugagacaggaccuggcgcaacucaugaacagcuccggcucucacaaggaucuggcugggaaauaccggcagauccuugagaaggccauucagcugagcggagccgaacagcucgaggcucugaaagccuucgucgaagcuaugguuaaugagaacgugucccuugugaucucucgccaacugcucaccgacuuuugcacacaucugcccaaucugccugauagcacggccaaggaaauuuaucacuucacccucgagaaaauccagccgagagucauuuccuuugaggaacagguggcgucuauccggcagcaucuggccagcaucuacgagaaggaagaggacuggcgcaacgcugcccaaguucuugugggcauuccccuggagacagggcagaagcaguauaaugucgauuacaaacucgaaaccuaucugaagaucgcuagacuuuaccuggaggacgaugacccugugcaggccgaagcguauauuaaccgggccucccuccugcaaaaugagagcacaaacgaacagcugcagauccacuacaaaguuuguuacgcucgcgugcucgauuauagacggaaguucauugaggccgcucaacgcuacaaugagcugucuuauaaaaccaucguccaugaauccgagagacuugaagcccugaagcacgcccuccacugcacaauucuggcuagcgcgggacagcagcggucucgcaugcuugccacccuguuuaaggacgagagaugucagcaacucgcugccuacggcauccuggagaaaauguaucuggaucggaucauucgcgggaaccagcuccaggaguucgccgcuaugcugaugccccaucagaaggccacgaccgcggacggauccagcauccuugauagagcugugauugagcacaaucugcucucugccuccaaacuguacaacaauaucacauuugaagaacuuggcgcccugcucgaaauuccugcugccaagcaugagaaacccugccaacggggcaucagcagauccaaccacuucgugucuaaguga

SEQ ID NO: 67744 - RNA, 1005 nt, Artificial Sequence
  derived and/or modified sequence opt5 from COPS5__Homo_sapiens__NP_006828
auggccgcuagcggcuccgggauggcccagaagaccugggagcuggcgaacaauaugcaagaagcucagucuaucgacgagauuuacaaauaugauaagaaacagcagcaagaaauccucgccgccaagcccuggacaaaagaccaccauuacuucaaguauugcaagauuagcgcucuggcccuucugaaaauggugaugcacgcuagauccggaggcaaccucgaggucauggggcugaugcuuggaaagguugauggcgaaacgaugaucauuauggacucuuuugcccugccuguggaggggaccgagacacgggugaaugcgcaggccgcugccuacgaauauauggcugccuacaucgagaacgcgaaacaggucggacgccucgaaaaugccaucggcugguaucauagccacccgggcuacggguguuggcuguccggaauugaugugucuacccagaugcugaaccaacaguuccaggagcccuuuguugcuguggucaucgacccuacaagaaccauuagcgccggcaaggugaaucucggggcuuuccggacauaccccaaaggauauaagccucccgaugagggcccuuccgaauaccagaccaucccgcugaacaagauugaggacuuugggguucauugcaaacaauauuacgcccuugaagugagcuauuucaagucuucccuggaucgcaaacuccuggagcuucuguggaauaaguacugggucaacacgcucucuagcuccagccugcugaccaaugccgacuauacaaccggacagguguuugaucucucugaaaaacuggagcaguccgaggcucaacuuggcagaggcagcuucaugcuggggcucgaaacacacgaccggaaguccgaggauaaacuggcgaaggccacccgcgacucuuguaagacgacaaucgaagcuauucacggacuuaugagccaggugaucaaagacaagcuguuuaaccagaucaauauuuccuga

SEQ ID NO: 67745 - RNA, 984 nt, Artificial Sequence
  derived and/or modified sequence opt5 from COPS6__Homo_sapiens__NP_006824
auggccgcugccgcggcugccgccgcugccaccaacggcacagggggaagcuccggcauggagguggacgcugccgucguucccucugugauggcgugcggggugacgggaagcgucuccguggcccugcacccucucguuauccugaauauuucugaucauuggaucagaaugcggagccaggaaggccgcccggugcaagucauuggggcucuuaucggaaagcaggagggcagaaacauugaagugaugaacuccuucgagcugcucucucacaccguugaagagaaaaucaucauugacaaggaguacuauuacacaaaagaggaacaguuuaaacagguguucaaggaacuggaguuucuuggcugguauaccacagggggacccccugaucccagcgacauccauguccacaagcaagugugugagauuaucgaauccccucuguuccucaagcugaaucccaugaccaaacauacagaucugccugugagcgucuuugagucuguuauugacaucauuaauggcgaagccaccaugcuguucgcugagcucacguacacccuugccacagaagaggcggagcggaucgggguggaucacguggcccgcaugaccgcuacaggauccggcgaaaacagcaccgucgccgagcaccugaucgcucagcauucugccauuaagaugcuccacuccagagugaaacugauccuugaauauguuaaggccagcgaggcuggggaagugccguuuaaucaugagauucugcgggaggcguacgcccucugccacugucugcccguccugucuacggacaaauucaagacagauuuuuaugaccagugcaacgaugugggacucauggcuuaccugggcaccaucacaaagaccuguaauaccaugaaccaguucguuaauaaauuuaacgugcuuuacgaccgccaaggcauugggagacggaugcgcggacuguucuuuuga

SEQ ID NO: 67746 - RNA, 828 nt, Artificial Sequence
  derived and/or modified sequence opt5 from COPS7A__Homo_sapiens__XP_005253752
augagcgccgaggugaaggucaccggccagaaccaagaacaguuccugcuccuggcuaaauccgccaagggggcggcucuugccacacugauccaccagguucucgaggcccccggaguguacguguuuggcgaacugcuugacaugccuaaugucagagagcuggcugaaucugauuucgccagcacguuucggcuccugaccguguucgcuuaugggacauacgccgacuaucuggcggaggcccgcaaccucccgccccugaccgaggcucagaaaaauaaacuuagacaucuguccguugugacacucgccgcuaaggucaagugcauuccuuacgccgugcugcuugaagcgcuggcccuccggaacguucgccaacuggaggaucuggugaucgaagcugucuaugccgacgugcucagaggaucucuggaucagcggaaucagcgccuugagguggacuacagcauuggcagagauauccagcggcaagaccuguccgcuauugcccgcacccuccaggaguggugugucgggugcgaaguugugcugucuggaaucgaggaacaggugagcagagccaaccagcacaaggagcaacagcuuggccugaaacagcaaaucgaauccgaggucgcuaaucucaagaaaacaauuaaggugaccacggcggccgcugccgccgcuaccagccaggaucccgagcagcaucugacagaacugcgggagccugcccccggcaccaaccagcgccaaccuucuaaaaaggcguccaaggggaaaggacucagaggcagcgcuaagaucuggucuaaauccaauuga

SEQ ID NO: 67747 - RNA, 630 nt, Artificial Sequence
  derived and/or modified sequence opt5 from COPS8__Homo_sapiens__NP_006701
augcccguggccgucauggcugagagcgccuucuccuuuaagaaacugcucgaccagugcgaaaaccaagagcuggaagcgccuggcgggaucgcuaccccgcccguuuacggacagcuucuggcccucuaucugcuucacaaugauaugaacaaugccagauaccuguggaagcggauuccucccgcuaucaaaucugccaacagcgagcucggcgggauuugguccgugggacagcgcaucuggcagagagacuucccuggcauuuauacaacgaucaaugcucaucaauggucugaaaccgugcagcccaucauggaggcccugcgggaugcgacacgcagacgggccuuugcucuggucagccaggccuacaccuccauuaucgcugacgauuucgccgcguuuguggggcucccuguugaggaagccgugaagggcauucuggagcagggauggcaagcugacucuacaacccgcaugguccuuccgagaaaacccguggccggcgcucuggauguuagcuucaacaaguuuaucccucucuccgaacccgccccugugcccccgauuccuaaugagcagcagcuggcccggcuuacagacuaugucgcuuuccuggagaacuga

SEQ ID NO: 67748 - RNA, 633 nt, Artificial Sequence
  derived and/or modified sequence opt5 from COPZ2__Homo_sapiens__NP_057513
augcagagacccgaggccuggccucggccgcaccccggcgaaggggcugccgcggcucaagccggaggcccugcucccccugcccgcgccggggagcccagcggacugagacuccaggaaccuucccuguacaccaucaaggcuguguucauucuugacaacgauggccggcgccugcucgccaaauauuacgacgauacauuuccgucuaugaaggagcagauggucuucgagaaaaauguuuuuaacaagacgagcagaaccgaauccgagaucgcguucuuugggggaaugacaauuguguauaaaaauucuaucgaccuguuccuuuacguggucggcagcuccuaugaaaacgagcugaugcucaugucugugcugaccugccuguuugaaagccucaaucauaugcugcggaagaacguugagaagcgcuggcuucuggagaauauggauggcgccuuccucgugcuggacgaaauugucgaugggggagugauccuugaguccgacccccagcaaguuauccagaaagugaacuuuagagcugaugacggcgggcugacagaacagagcgucgcccaggugcuccaaucugcuaaggagcagauuaaauggucccugcugaaguga

SEQ ID NO: 67749 - RNA, 1266 nt, Artificial Sequence
  derived and/or modified sequence opt5 from COQ2__Homo_sapiens__NP_056512
augacccccaucagccaggugagaaugcggaagggcuccgcccacacagcugcccaaccugggcgccugggacuccauccggcgggcgcuacggcccacgccugcagagggaugaccucuauucgggcucgccccggacugacaagcgccaugcuuggcuccagagcugccggguucgcgcggggacugcgcgccgucgcucucgccuggcugccuggcuggagaggccggucuuuugcucuugcccgcgcggccggggcuccccauggaggcgaccugcagccucccgccuguccugagccgagagggcggcagcucagccuguccgcugccgccguuguggauucugcuccccgcccucugcagcccuaccucagacugaugcggcuugacaaaccuaucggaaccuggcugcucuaucugcccugcacauggagcauuggccuugcggccgaaccgggguguuucccugauugguacaugcugucccucuuuggaaccggcgcuauccugaugcgcggcgccgggugcacaauuaacgacaugugggaucaagacuaugauaagaaagugaccagaacggccaaucggcccaucgcugccggagacaucagcaccuuccagucuuuugucuuccugggcgggcagcucacacuggcgcuuggagugcugcucugucugaacuacuauuccauugcucuuggcgccgggagccugcuccugguuaucaccuacccucugaugaagagaauuucuuauuggccccagcucgcccugggacuuacauuuaauuggggcgcucugcucggcugguccgccaucaaagggagcugcgaucccucugugugucugccucuuuacuucuccggagucauguggacccugauuuacgacacgaucuaugcucaccaagauaagcgcgacgaugugcucauuggccucaagagcacagcccugcgguuuggggagaacaccaaaccguggcuguccggauucucuguugcgaugcugggcgcccuuagccuggugggggucaauuccggccagacagcucccuacuaugccgcucucggagccgugggcgcgcaucugacccaccagaucuacacccuggacauccacagaccugaagacugcuggaacaaguuuauuagcaaucgcacacuugggcucaucguguuccugggaauuguccugggcaaccucuggaaagagaagaaaacggauaagaccaagaaagggaucgaaaauaagauugagaacuga

SEQ ID NO: 67750 - RNA, 1110 nt, Artificial Sequence
  derived and/or modified sequence opt5 from COQ3__Homo_sapiens__NP_059117
auguggagcggcagaaagcugggguccucuggaggcugguuccuccgggugcuggggcccggaggcugcaacaccaaagccgcucgcccucuuaucagcuccgccgucuacguuaagaaucagcugucugggacacuccaaauuaaaccgggaguguuuaacgaguauagaacgaucugguucaagagcuaccggaccaucuuuuccugucugaaucgcauuaaaucuuucagauaucccugggcgcggcuuuacagcacaucccagaccacaguggacagcggcgaagucaagaccuuucuggcucucgcccacaaguggugggaugagcagggcguguaugccccucugcauucuaugaacgaccugcgcguucccuucauuagagauaaucuccugaaaacaaucccuaaccaccagcccgggaagccucuucugggaaugaaaauccucgacgugggcugcgggggaggccugcuuaccgaaccgcuggggcggcucggagcuuccgucauuggcaucgaucccguggacgagaauauuaagacggcccaaugucauaagagcuuugauccuguucuggacaagcgcaucgaauacagagugugcucucuggaggagauugucgaagagaccgcugaaacauucgaugccgugguggcguccgaggucguugagcacgugaucgaccucgaaaccuuucugcaguguugcugucaggugcuuaagcccggcgggagccuguucauuacaaccaucaacaaaacgcagcucucuuaugcccugggaaucgucuuuuccgagcaaauugcuagcaucgugccuaagggcacacauaccugggaaaaauucguuucccccgagacacuugaaucuauucuggagagcaaugggcucuccgugcagaccgucgugggaaugcuguacaacccguuuagcggcuacuggcacuggucugagaauaccucccugaacuaugccgcuuacgccguuaagagccgggugcaggaacacccugcgucugccgaguucguccucaaaggggaaacagaggaacugcaggcuaaugccugcacgaaccccgcugugcaugagaaacuuaaaaaguga

SEQ ID NO: 67751 - RNA, 798 nt, Artificial Sequence
  derived and/or modified sequence opt5 from COQ4__Homo_sapiens__NP_057119
auggccacccugcucagacccgugcugcggcgccuuugcggccugccugggcuccagagaccggcugccgagaugccccugcgggcgcgcagcgacggagcuggcccucuuuacucccaccaucugcccacaucuccucuccaaaaggcccugcuggccgcugggagcgccgcuauggcccucuauaaccccuacagacacgauauggucgcgguucugggagaaacgaccggccaucggacacuuaaagugcugcgcgaccagaugagacgggauccugagggggcccagauccuccaggaacgcccgagaauuuccaccucuacacuggaccuuggaaagcugcaaagccuccccgagggcucccugggccgggaauaucugcgcuuccucgaugugaauagagucucuccugacacccgggcucccacacgcuuuguggaugacgaggagcuggccuacguuauccagagauaucgggaagugcacgauaugcuucauacccugcucgggaugccuacgaacauucugggagagaucgucgugaaaugguucgaagcuguucagaccggccuucccauguguauucugggggccuuuuucggaccgaucagacucggcgcgcagagccugcaagugcuggucuccgagcucaucccuugggccgugcagaaugggcgccgggcucccugcgugcugaaccuuuacuaugagagacgcugggaacagagccugcgggcccucagagaggaacugggaauuacagcuccucccaugcacguccagggccuugccuga

SEQ ID NO: 67752 - RNA, 984 nt, Artificial Sequence
  derived and/or modified sequence opt5 from COQ5__Homo_sapiens__NP_115690
auggccgcucccggcagcugcgcccugugguccuacugugggagaggauggucucgggcgaugcgcggcugccagcuccuggggcuuagaagcuccuggccuggagaccugcucucugcucggcugcuuagccaagagaagcgcgccgccgaaacccacuucggcuuugagacaguguccgaagaggaaaaagggggaaaggucuaucagguuuucgagucuguggcuaaaaaguacgaugugaugaacgacaugaugagccugggcauccauagagucuggaaagaucuccugcuguggaagaugcacccgcuccccggcacgcagcugcuugacguggccgggggaaccggcgauauugcuuuucgguuccugaauuauguucagucccaacaucagcgcaagcagaaaagacagcuccgggcccaacagaaccugagcugggaggaaaucgcgaaggaguaccagaaugaagaggacucucuugggggaucccgcguggucgugugugauauuaacaaagagaugcugaagguuggcaaacagaaggcccucgcucaaggguauagagccggacuggcuugggugcugggcgacgccgaagaacucccuuuugaugacgauaaguucgacaucuacacaauugcguuuggcauccggaaugucacccacaucgaucaggcccugcaggaagcucaucgcgugcuuaaacccgggggaagauuccugugccucgaguuuagccaagugaacaauccucugauuucucggcuuuaugaccuguacuccuuccaggucauccccguucucggcgaagugauugccggggacuggaaaagcuaccaguaucugguggagucuauccgcagauuuccuucccaggaggaguucaaggauaugauugaggacgcuggauuucacaaggucacauacgaaagccugaccuccggcaucguggccauucacucuggguucaaacucuga

SEQ ID NO: 67753 - RNA, 1407 nt, Artificial Sequence
  derived and/or modified sequence opt5 from COQ6__Homo_sapiens__NP_872282
auggccgcuagacuggugagccggugcggcgccguccgcgcggcuccccacuccgggccucucguuucuuggagacgguggagcggagccuccaccgacacaguguacgauguggucgugucuggcgggggacugguuggcgccgcuauggccugugcucuuggguaugacauccauuuccacgauaagaaaauucugcuccuggaggccggaccgaagaaagugcuugaaaagcugagcgagacguacuccaaccgcgucucuagcaucucccccggcagcgcgacccuccugucuuccuuuggcgccugggaccauauuugcaauaugagauaucgggcuuuccgcagaaugcaagugugggaugccuguagcgaagcucugaucauguuugacaaagauaaccucgacgauaugggguacauuguugagaaugacgugaucaugcacgcccugacaaagcagcuugaagcggucucugaucgggugaccgugcuguaucgcuccaaggccaucagauacacauggccuugccccuucccuauggcugacagcucucccuggguccauauuacccucggagauggcuccacauuucagaccaaacugcuuaucggggccgacggacacaacagcggcguucggcaggcuguggggauucagaauguguccuggaacuaugaccaaucugccgucguggccacgcugcaccucagcgaggcuaccgagaauaacguugcguggcagcgcuuccugccuuccggaccgaucgcccugcucccccugagcgauacacuuucuucccugguguggagcaccucucaugaacacgcugccgagcucgucagcauggacgaagagaaguuuguggaugccguuaauuccgcuuucuggucugacgccgaucauacagacuuuauugauaccgcgggcgcuaugcugcaguacgccgugagccuucugaaaccuacgaaggucuccgccagacagcucccucccagcguggcucgggucgacgccaaaucucgcgugcuguucccccugggccucgggcacgcugccgaguacguuagaccgcggguggcgcugaucggagaugccgcucacagaguccauccucuugccggccaaggggugaacaugggauuuggcgacauuuccagccuggcucaccaucucucuacagccgcguucaaugggaaggaucugggauccguuagccaccuuaccggcuaugaaacagagcgccagcggcauaacaccgcccugcucgcugccaccgaccugcugaagagacucuacuccacaucugcuagcccccuggugcuucugcgcacguggggccuccaggccaccaaugccgucuccccucugaaagaacagaucauggcuuuugcgucuaaguga

SEQ ID NO: 67754 - RNA, 540 nt, Artificial Sequence
  derived and/or modified sequence opt5 from COQ7__Homo_sapiens__NP_001177912
augacccuggacaacaucagcagagccgcuguggaucggauuauccgcgucgaccacgccggcgaguacggggcgaauagaauuuaugcuggacagauggccguucucggccggacauccguggggcccgugauccaaaagaugugggaucaggaaaaagaccaucugaagaaauucaacgagcuuauggucacguuucgcgugagaccuaccguucugaugccgcucuggaaugugcugggauucgcccuuggcgcugggacagcccugcucggaaaggaaggcgcuauggccugcaccgucgcgguggaggaaucuauugcccaccauuacaacaaucagauccggacacugauggaggaggaucccgaaaaauaugaggaacugcuccagcugaucaagaaguuucgcgacgaggagcuugaacaccaugauauuggccuggaccacgaugcugagcucgccccugcuuacgccguucugaaaagcaucauucaagcgggguguagaguggccaucuaucuuuccgaacggcuguga

SEQ ID NO: 67755 - RNA, 957 nt, Artificial Sequence
  derived and/or modified sequence opt5 from COQ9__Homo_sapiens__NP_064708
auggccgcugccgcggugagcggcgcucuggggagagccggauggcggcuccugcagcuucgcugccugcccgucgccagaugucggcaagcucucguuccucgcgccuuccacgcuuccgccgugggccugagaucuagcgacgagcagaagcagcagccgcccaacuccuuuucucaacagcauagcgaaacccagggggcggagaaaccugaucccgaauccucucacagcccuccccgguacacagaccagggaggcgaggaagaggaggauuaugaauccgaggaacaacuucagcaucgcauccugacggccgcucucgaguucgugccugcccacggguggaccgcugaggccauugcggaaggagcccagagccugggccugucuuccgcugccgcuagcauguuuggcaaggacgggucugagcucauccugcauuucgucacacagugcaauaccagacuuacacgggugcuggaagaggaacaaaaacucguucagcugggacaggccgagaagcgcaaaaccgaucaauuucuuagagacgccguggagacacggcugcgcaugcucauuccguacaucgaacacuggcccagagcucuguccauucugaugcucccucacaacauccccagcucucugucccuucugaccagcauggucgaugacauguggcauuaugcgggcgaucaguccacggacuucaauugguacacccggcgcgccaugcucgcugccaucuauaacacaaccgagcuggugaugaugcaggauucuagcccugacuuugaagauacauggagauuccuugagaaucggguuaacgacgccaugaauauggggcacaccgcuaaacaggugaaguccacgggagaagcccugguccaaggccucaugggggcggcugugacacugaagaaccugaccggacucaaucagagacgcuga

SEQ ID NO: 67756 - RNA, 3129 nt, Artificial Sequence
  derived and/or modified sequence opt5 from CORIN__Homo_sapiens__NP_006578
augaagcagagccccgcccuggcuccugaggaaagaugccggcgcgccggcuccccgaaacccgugcucagagcggacgauaacaauauggggaacggauguucucaaaagcuggcuaccgccaaucuucugcgguuccuccugcuuguccugaucccuugcauuugugcccucguucugcugcucgugauccugcuuagcuacgugggcacacugcagaaagucuauuuuaaguccaacgggucugagccccucgugacggacggagaaauucagggcagcgauguuauccugaccaauacaauuuacaaccaguccaccguggucucuacagcucacccugaccaacaugugcccgccuggaccacagaugcuagccuuccuggggaccagucccaccgcaauaccagcgccugcaugaacaucacgcauucucagugucagaugcugccguaucacgcgacccucacaccccugcuguccguugugagaaauauggagauggaaaaauuccucaaguuuuucaccuaccugcaucggcuuagcugcuaucaacacaucaugcuguuuggauguacacucgccuucccugagugcauuaucgauggcgacgauucucacggccugcuucccugucgcuccuuuugcgaggcugccaaggaagggugugagagcguccugggaauggugaacuacucuuggccugacuuccucagaugcucccaguuucggaaucagaccgaaagcuccaacgugucucgcauuugcuucagcccccagcaagagaauggcaaacagcugcugugugggagaggagagaacuuucucugcgcuuccggcaucuguauuccggggaagcugcagugcaauggauauaacgauugugacgauuggagcgacgaagcccauugcaacuguucugagaaucuuuuccacugccauacgggcaaaugucugaacuacucccucgucugcgacggcuacgaugacuguggggaucugagcgacgaacaaaauugcgauugcaacccuacaaccgagcaccgguguggagacggccgcugcaucgcgauggaauggguuugugauggggaccacgauugcguggacaagucugaugaggugaauuguagcugccauucccagggacuugucgaguguagaaacggccagugcauucccucuacauuucagugugacggggacgaagauugcaaagacggaagcgaugaggaaaauuguuccgugauccaaaccagcugccaggagggcgaccagcggugccuguauaacccuugucucgauucuugcggcggguccagccugugugaccccaauaacucucugaauaacugcucccagugugaacccaucacccucgagcugugcaugaaucuuccuuacaacagcacauccuauccgaauuacuucggacaccgcacgcaaaaggaggccucuauuagcugggaauccucucuguuccccgcucucguucagaccaacuguuauaaguaccugauguuuuucagcugcacaauccuggugccuaaaugugaugucaacaccggcgagcauauucccccuugcagagcccuuugugaacacuccaaggagcggugcgaaagcgugcucgggaucguuggacugcaguggcccgaggacacagauugcucucaguuuccggaggaaaauuccgacaaccaaaccugucugaugccugaugaguauguggaagagugcagccccucucauuucaaauguagauccggccagugcguccucgcuagccgccggugugacgggcaggccgauugcgacgacgauucugacgaggaaaauuguggcugcaaggagagagaucugugggaauguccuagcaacaaacagugccuuaagcacacggugauuugugacggauuucccgauugcccugacuacauggaugagaaaaauugcuccuucugucaagacgaugaacuggagugcgccaaccacgcuugugucagccgcgaccucuggugcgauggcgaggcggacuguucugauuccagcgacgaaugggacugcgugacacuguccaucaauguuaacucuagcuccuuucugauggugcaucgggccgcuaccgagcaccaugucugugccgauggguggcaggaaauccuuucucagcucgccugcaagcaaaugggacugggcgagcccagcgugaccaagcugauucaggaacaggagaaagagccgagauggcucacacugcacuccaauugggaaucucuuaacgggaccacacugcacgagcuccugguuaauggacagagcugugaaucccgcagcaagaucucucugcuuugcacgaaacaagacuguggccggagaccugcugcccgcaugaacaagcggauucucgggggcagaaccucccgccccggacgguggcccuggcagugcagccugcagucugagccuuccggccauaucugcgggugugugcugauugcgaaaaaguggguccucacaguggcucacugcuucgaaggaagagagaaugccgccguguggaagguuguccugggcaucaacaaucuugaucauccgagcguguuuaugcagacccgguucgugaaaacaaucauucugcacccccgcuacucuagagcugucguggacuaugauaucuccauuguugagcucagcgaagacaucuccgagaccggguacgugcggccugucugucugcccaacccugaacaauggcuggagcccgauacguauugcuacauuaccggauggggccauauggggaacaagaugccuuuuaaacuucaggagggcgaagugagaaucauuagccucgagcacugucagucuuauuucgacaugaagacaaucaccacacgcaugaucugcgccggauacgaaagcggcaccguugauuccuguaugggggacucuggaggcccccuggugugcgagaaaccugggggacgguggacgcuguuuggccucacaagcuggggguccgucuguuucucuaaggugcugggcccgggaguuuauagcaauguguccuacuucgucgaauggauuaagagacagaucuacauucaaaccuuucuucugaacuga

SEQ ID NO: 67757 - RNA, 1386 nt, Artificial Sequence
  derived and/or modified sequence opt5 from CORO1A__Homo_sapiens__XP_011544016
augagcagacaggugguccgguccucuaaguuccgccacguuuuuggccaacccgccaaagcugaccagugcuacgaggaugugagagugagccagaccacaugggacuccggguucugugccgucaacccuaaguuuguggcgcugaucugcgaggcuucuggaggcggggccuuccucguucugccgcuuggaaaaacgggccggguggauaagaaugcccccaccgucugugggcauacagcuccugugcuggacauugccuggugcccccacaacgauaauguuaucgcuagcggauccgaagacuguaccgugauggucugggaaauuccugauggcggccucaugcugccccuucgcgagccuguggugacacuggaagggcauaccaaaagagucggaaucguugccuggcacacaaccgcgcagaacgugcuccugucugccggcugcgacaaugugauuauggucugggauguggggacgggagcugccaugcugacccucggcccggagguucaucccgacacaaucuauagcguggauuggucccgggacgggggacugaucuguaccagcugccgcgauaagagaguccggauuaucgagccucgcaagggcacagugguugcugaaaaagacagaccccacgagggcacccggccugugcgcgccgucuuugugucugaagggaagauucuuacgacaggauucuccagaaugagcgagcggcaagucgcgcugugggacaccaaacaccucgaggaaccccugucucuucaggagcuggauacauccagcggcgugcuccugccguuuuucgacccugauaccaacaucguuuaccugugugggaagggagacucuuccauucgcuauuuugaaaucaccagcgaggcccccuuccuccauuaccuguccauguuuucuagcaaagaaucccagagaggcaugggguauaugccuaagcggggacuugaggugaauaagugcgagauugcuagauucuacaaacugcacgaacgccggugugagcccaucgccaugacaguccccagaaagagcgaucucuuucaggaagaccuguauccuccgacggcuggccccgauccugcccuuaccgccgaggaauggcugggcgggcgcgacgcuggaccccuccugaucucucugaaagauggcuacgugccucccaagucccgggagcucagaguuaaccgcgggcuggacacaggacggagacgcgcggccccggaggcuagcggcaccccuucuagcgaugccgugucccggcuugaagaggaaaugagaaaacugcaagccacaguccaggagcuccagaagcgccuggaccggcuugaagagaccgugcaggcuaaauga

SEQ ID NO: 67758 - RNA, 1470 nt, Artificial Sequence
  derived and/or modified sequence opt5 from CORO1B__Homo_sapiens__NP_001018080
augagcuucagaaaggugguccggcaguccaaauuucgccacguuuucggccaacccgugaagaacgaccagugcuacgaggauaucagagugucucgggucaccugggacagcacauuuugugccgugaauccuaaauuccuggcuguuauuguggaagccuccgggggaggcgcguuucucguccugccgcuuucuaagacggggcgcaucgauaaggcuuaucccaccgugugcggacauacaggcccuguucuggacauugauugguguccccacaacgacgaggugaucgccagcggguccgaagauugcaccgucaugguguggcagauuccugagaauggacucacaucuccccugaccgaaccuguggucguucuugagggccauacaaaaagagugggcaucaucgccuggcacccgaccgcucggaacgugcugcucagcgccgggugugacaaugucgugcugauuuggaacguuggaacggcugaggaacuguaccgccucgauucccugcaucccgaccuuaucuauaaugugagcuggaaccacaauggcucucuguucugcuccgccuguaaggauaaaagcgucagaauuaucgacccucggcgcgggacccucguggcggagagagaaaaggcccacgagggagcucggcccaugcgcgccauuuuucuggcugauggcaaaguuuucacaaccggguuuucuagaauguccgagcggcagcuugcccugugggacccugaaaaccucgaggaacccauggcgcugcaagagcuggacagcucuaauggagcccuccugccguucuacgauccugacacauccguggucuaugugugcggcaagggcgauagcuccauccgcuacuuugaaauuaccgaggagcccccuuauauccauuuccuuaacacguuuacaucuaaagaaccccagagagggaugggaagcaugcccaagcggggccuggaggucuccaagugugaaaucgcuagauucuacaaacuccacgagcgcaagugcgaaccuauugugaugaccguuccgcggaaaagcgaccuguuccaggaugaccuuuaccccgauacagccgggccugaggcugcccuggaggccgaagagugggugucuggaagagacgcugaucccauccucauuucccugcgcgaagcguaugucccuagcaagcagcgggaccugaaaaucucuagacgcaaugugcucagcgauucccggcccgccauggcuccgggcucuagccaucugggggccccugccuccaccaccacagcugccgacgcgacgcccagcggaucucuugcuagagccggcgaggccggcaagcuggaagagguuaugcaagagcuccgcgcucugcgggcccuugugaaagaacagggggacagaauuugucgccuggaggaacagcucggacggauggagaacggcgaugcuuga

SEQ ID NO: 67759 - RNA, 1584 nt, Artificial Sequence
  derived and/or modified sequence opt5 from CORO1C__Homo_sapiens__NP_001098707
auguacggccccgggagccagcugggaaaguccggcaacaauucuugggccaaagagagagggugcagcaucgcuugucaaggaucccucaccucugcccggcugcacgcgccuagcauuggcgaacgcccgcuuucccauaugagauggaaggacacaaugcggcgcguggucagacagucuaaauuccggcacguuuuugggcaggcugugaagaacgaucagugcuaugacgauauccgcgugagcagagucacgugggacuccagcuucugugccgugaauccccgguuuguugccauuaucauugaggcuucuggaggcggcgccuuccuggugcucccucugcauaaaaccgggcgcaucgauaaguccuaccccacagucugcggacacaccggcccugugcuugacaucgauugguguccccauaacgaccaaguuauugcuagcgggucugaagauugcacagugauggucuggcagaucccugagaauggacugacccucucccugacagaaccgguggugauucuggagggccacagcaagagagucgggaucguugccuggcaccccaccgcgcggaacgugcuccugucugccggaugugacaaugcuauuaucauuuggaacgugggcacgggcgaggcccuuaucaaucuggaugacaugcauuccgauaugaucuauaacgucagcuggaaucgcaacgggucccucauuugcaccgcuucuaaagacaagaaagugagaguuaucgacccucggaagcaggaaauuguggccgagaaagaaaaggcgcacgagggagcccgccccaugagagcuaucuuucuggccgauggcaaugucuucacaaccggguuuagccggauguccgagagacagcuugcucuguggaacccuaagaauaugcaagaacccauugcccuccaugagauggacacaagcaacggagugcugcugccguucuacgauccugacaccucuaucaucuaucucuguggcaaaggggauuccagcauucgcuacuuugaaaucacggacgagucucccuauguucacuaccugaacacauucagcuccaaggaaccucagcggggaaugggcuacaugcccaaaagaggccuugaugugaauaagugcgagauugcccgcuuuuucaaacugcacgagcggaagugugaacccaucauuaugaccgucccuagaaaaucugaccucuuucaggaugaccuguauccggauacagcugggcccgaggcggcccuugaagcugaggaaugguucgagggaaagaacgccgacccuauccugaucagccucaagcauggcuacauucccgggaaaaaucgcgaccugaagguggucaaaaagaacauccuggauuccaaaccuaccgccaauaagaagugcgaccucauuagcauccccaaaaagaccacagauacggcuucugugcagaacgaggccaaacuggacgaaauucuuaaggagaucaaauccauuaaggauaccaucugcaaucaagacgaacggaucagcaagcuggagcagcagauggcgaaaauugcugccuga

SEQ ID NO: 67760 - RNA, 1578 nt, Artificial Sequence
  derived and/or modified sequence opt5 from CORO2A__Homo_sapiens__XP_011517288
augagcuggcacccccaguacagauccucuaaguuccggcauguguuuggcaaaccugccagcaaggagaacugcuaugacuccgucccgaucacccgcucuguucacgauaaucauuucugugcugugaacccccacuuuauugccguggucacagaaugcgcugggggaggcgcguuccuggugaucccucuccaucaaacggggaaacuggacccccacuacccuaagguuuguggacacagaggcaaugugcuugaugucaaauggaaccccuuugacgauuucgagauugccagcugcuccgaagacgccaccaucaagauuuggucuaucccuaagcagcugcucacacggaaucugaccgcuuaucgcaaagagcuuguggggcaugccagacggguuggacugguggaauggcacccgacagcugccaacauccucuuuagcgcgggcuacgauuauaaggucaugauuuggaaucuggacaccaaagaguccgugaucacaagccccaugucuaccauuuccugucaucaggaugugauccugagcaugucuuucaacacgaauggcucccuccuggccaccacaugcaaggaccgcaaaauuagagucaucgauccucgggcugggaccguucuucaggaggccagcuacaagggacaccgcgcuucuaaggugcuguuucucggcaaccugaaaaagcucauguccacagggaccagcagauggaauaaccggcaaguggcccugugggaccaggauaaucucuccgucccccugauggaagaggaccuggacggaucuagcggcgugcuuuucccuuuuuaugaugcggacacguccaugcuguacguuguggggaaaggagauggcaacauucgcuacuaugaagucagcgccgacaagccccaccuuucuuaccugacagaguauagauccuacaauccgcagaaaggcaucggggugaugccuaagcggggacucgauguuagcucuugugagaucuuccgcuuuuauaaacugauuaccacaaagagccuuaucgaacccauuuccaugaucgugccuagacggucugagagcuaccaggaagacauuuauccucccaccgcuggcgcccaacccucccugaccgcucaggaguggcucagcgggaugaacagagauccgauccuggucucucugcgccccggauccgaacuccugcggccucauccccuuccugccgagagacccaucuucaacagcauggccccggcuucuccucgccugcucaaucagacagagaagcuggcggccgaagacggcuggcgguccagcucccuucuggaggagaaaaugcccagaugggcugccgaacaccgccucgaagagaagaaaacguggcugaccaacggguucgauguguuugagugcccucccccuaagacagaaaaugagcugcuccagauguucuaccggcaacaggaagagauuagacgccugcgggaacuucugacccagagagagguccaagccaaacagcucgagcuggaaaucaagaaccugcgcaugggaucugagcagcuuuga

SEQ ID NO: 67761 - RNA, 1428 nt, Artificial Sequence
  derived and/or modified sequence opt5 from CORO2B__Homo_sapiens__NP_001177385
augagcuggagaccccaguaccgguccucuaaguuccgcaacguguauggcaaagucgccaauagagagcacugcuuugacgggaucccuauuaccaagaacguucaugauaaucacuucugugcugugaacacacgguuucuggccaucgugacggaaagcgcgggaggcggguccuuccucgucauuccgcuggagcaaaccggacgcaucgaacccaauuacccuaaagugugcggccaucaggggaacguucuugacauuaaguggaaucccuuuaucgauaacaucauugcuucuuguagcgaggacacauccgugagaaucugggaaauuccugagggaggccugaaacggaauaugaccgaggcccuccuggaacuucacggccauucucgcagagucgggcugguggaguggcaccccacaaccaacaauauccucuucagcgccggauaugauuacaagguucugauuuggaaccuggacgugggcgaaccugucaagaugaucgauugccacacagacgugauucucuguauguccuuuaauaccgaugggagccugcuuacgaccacaugcaaagacaagaaacugcgggugaucgagccgcgcucuggaagaguccuccaggaggcuaacuguaagaaucaucggguuaaccgcgugguguuccugggcaacaugaaaagacuucugaccacaggggucucccgguggaauacccgccagaucgcccucugggaucaagaagaccugagcaugccccugauugaggaagagaucgauggacucucuggccugcuuuuuccuuucuaugacgcugacacgcacaugcuguaccucgccggcaagggggauggaaacauuagauauuacgaaaucuccacagagaagcccuaccugagcuaucuuauggaguuucggucuccugcgccccagaaaggccugggggugaugccgaagcauggacucgacguuuccgccugcgaaguguucagauuuuacaaacuggucacccugaagggccucauugagccuaucagcaugaucgugccccgccgguccgauucuuaucaggaagacauuuacccuaugacacccgggaccgagcccgcucugaccccugaugaauggcuuggaggcaucaauagagacccgguucugaugagccucaaagagggcuauaagaaauccagcaagaugguguucaaggcccccauuaaagagaagaaaucugucguggucaacgggaucgaucugcuugaaaaugugccuccccgcacagagaacgaacugcuccggauguucuuuagacagcaagacgagauucgccggcugaaggaggaacuggcucagaaagauaucagaauccgccagcuccagcuggagcuuaagaaucugcggaacuccccuaagaauuguuga

SEQ ID NO: 67762 - RNA, 1419 nt, Artificial Sequence
  derived and/or modified sequence opt5 from CORO6__Homo_sapiens__NP_116243
augagcagacgggugguccgccaguccaaguucagacacguuuuuggccaagccgcuaaagccgaccaggcguacgaggauauccgggugucuaaggugaccugggacagcuccuucugcgcugucaaccccaaauuucuggccauuaucguggaagccgggggaggcggggcuuucauuguucucccucuggccaagacaggacgcguggauaaaaauuauccgcuugucacgggccauaccgcucccgugcuggacaucgauugguguccucacaacgacaauguuauugccucugcgagcgaugacacaaccaucaugguguggcagauccccgauuacacaccuaugagaaacauuaccgagcccaucauuacacucgaagggcauuccaagcgggucggaauccugucuuggcacccuaccgcccgcaaugugcuucugagcgcuggcggcgacaacgugauuaucauuuggaaugucgggacgggagagguucuccugucccuggaugacaugcauccggaugugauccacagcgugugcuggaacucuaauggcucccuccuggccaccacauguaaggacaaaacccuuagaaucauugacccccggaaggggcaggucguggcugaacgcuuugccgcgcacgagggaaugagaccuaugcgggccguuuucacacgccaaggccauaucuuuaccacgggguucacaagaaugagccagcgggagcugggacucugggaucccaacaauuuugaggaaccuguggcucugcaggaaauggacaccucuaacggcguccuucugcccuucuaugauccggacuccagcauuguguaccucugcggcaaaggggauucuuccauccgcuauuuugagauuacagacgagccucccuucguucacuaccugaauaccuuuagcuccaaggaaccucagagaggaaugggcuucaugcccaaacgggggcuggaugugucuaagugugagaucgccagauucuauaagcuccaugaacgcaaaugcgagcccaucauuaugaccgucccuagaaagagcgaccuguuucaagaugaccuuuacccggauacacccggaccugaacccgcucuggaggccgacgaguggcucuccggccaggacgccgaaccugugcugaucagccuucgggauggguacgugcccccgaaacaccgcgagcugcgggucacgaagagaaacauucucgacguucgcccucccucuggaccucggagaucccagagcgcuucugaugcgccccugagccagcaacacacccuggaaacacuccuggaggaaaucaaagcccuucgcgagcgggugcaggcucaggagcaaagaauuaccgcccuggaaaauaugcucugugagcuggucgacggcacagauuga

SEQ ID NO: 67763 - RNA, 2523 nt, Artificial Sequence
  derived and/or modified sequence opt5 from CORO7__Homo_sapiens__NP_001188402
augaacagauuccgggugagcaaguuucgccacaccgaggccagacccccucggcgcgaauccuggaucucugacauuagagcuggcacagccccgagcugccggaaucauaucaaauccucuuguagccugauugcguucaacuccgaucgccccgggguccucggaaucguuccucugcagggccaaggggaggacaagagacggguggcucaccuuggaugccauucugaacuggccgcccacggcgaucucgugcagagcgcugucuggucccgcgacggggcccuggugggaacggcuuguaaagauaagcagcuuagaauuuuugacccccggaccaaaccucgcgccagccagucuacacaagcgcaugaaaauuccagagauagccggcuggccuggaugggcaccugggaacaccucguuucuacaggcuucaaccagaugcgcgagagagaggugaagcugugggacacccgguuuuucuccagcgcucuggccucucucacacuggauaccucccuugggugccuggucccccuccuggacccugauagcggacuucuggugcucgcuggcaagggggaaagacagcuguacuguuaugagguugugccgcagcaacccgcccuguccccugucacgcagugcgugcucgaaucugugcugcgcggagcggcccuugucccccggcaggcucuggccguuaugagcugugaggugcucagagugcugcagcuuuccgacaccgcuaucgucccuaucggcuaccacgugccccgcaaagccguugaguuucaugaagaucuguucccggacacagccgggugcgugccugcuaccgacccccacagcuggugggcgggagauaaucaacagguccagaaggugucucucaacccugccugucggccccaucccuccuuuacaagcugccugguuccuccggcugagccccugccugacaccgcccaacccgccgugauggaaacgccugucggcgaugcugacgccucugagggcuucagcucucccccguccagccucacauccccuagcacccccucuucccuggggccuagccuuucuuccacaagcggaauuggcaccucccccucucugagaagccuccagucccugcuugggccuucuagcaaauuucgccacgcgcagggaaccgugcugcaccgggauucccauaucacaaaucucaagggccugaaccugacgacccccggggaaagcgacggauucugugcuaauaaacucagagucgccgugccgcugcuuucuuccggcggccagguugccgugcuggagcuccgcaagccugggcggcugcccgauacagcucugcccacccuucaaaacggagccgcugucacagaccucgccugggauccuuuugacccgcacagacuggcgguggccggcgaggaugcucgcauucggcuguggagaguucccgccgaagggcucgaggaagugcugaccacgccugagacaguccuuaccggacauaccgaaaagaucugcagccugcgguuccacccccucgcugccaaugugcuggcgucuuccagcuaugaccugacagugcgcauuugggaccuucaggccggcgcugauagacucaaacugcaggggcaucaggaccaaaucuucucucuggccuggagcccugauggccagcagcucgcuaccguuugcaaggacggacgggucagaguguaccgcccccgguccggcccugagccccugcaggaggggccgggaccuaaaggcgggagaggagcccgcauugugugggucugugauggcagaugccuucuggugagcggguuugacucucaauccgaacggcagcuccugcuguaugaggccgaagcucuugcgggcggaccccucgccguucugggccuggauguggcuccuagcacacuccugcccuccuacgacccggauacggggcuuguccugcucaccggaaagggcgacacacgcguguuccuguaugagcugcuuccugaaucucccuuuuuccucgaguguaacagcuuuaccuccccugauccccacaaagggcugguucugcuccccaagacagagugcgacgugagagaagucgagcugaugcggugucuucgccugagacagucuagccucgaaccuguggccuuccggcugccgcgcguuagaaaagaguuuuuccaggaugacguguuucccgacaccgccgucaucugggagccugugcuguccgcugaagccuggcuucaaggagcgaauggccagcccuggcugcucucucugcagccucccgauaugagcccugugucccaagcuccgcgggaggcccccgcccgcagagcuccuagcucugcccaguaccucgaagagaaguccgaccagcagaagaaagaggagcugcuuaacgcgauggucgcuaagcuggggaaucgggaggauccccucccucaagacagcuucgaaggcguugaugaggacgaaugggauuga

SEQ ID NO: 67764 - RNA, 3147 nt, Artificial Sequence
  derived and/or modified sequence opt5 from CORO7-PAM16__Homo_sapiens__NP_001188408
augaacagauuccgggugagcaaguuucgccacaccgaggccagacccccucggcgcgaauccuggaucucugacauuagagcuggcacagccccgagcugccggaaucauaucaaauccucuuguagccugauugcguucaacuccgaucgccccgggguccucggaaucguuccucugcagggccaaggggaggacaagagacggguggcucaccuuggaugccauucugaucuggugacggaccucgauuuuagccccuucgacgauuuucugcuugccaccggcuccgccgaccgcacagucaaacuguggagacucccugggcccggacaggcucugccuagcgccccgggcgugguucugggccccgaagaucucccuguggagguccugcaguuccaccccaccucugacgggauucuuguguccgcugccggaacaaccguuaaggugugggaugcggccaaacagcaaccucugacagaacucgcugcccauggcgaccugguccagagcgcuguguggucucgggauggggcccuugugggaaccgcguguaaggacaagcagcugcgcaucuuugaccccagaacgaaaccgcgggccucccagagcacccaagcucacgaaaauucucgcgauuccagacucgccuggaugggcacaugggagcaccuggucagcaccggguucaaccagaugcgggaaagagagguuaagcugugggacacacgcuuuuucuccucugcucucgccagccugacccuugauacgucccugggaugccucgugccucugcuugaccccgauagcggccugcucgugcuggccggcaaaggggaacggcagcuguacuguuaugaggucgugccucagcaacccgcucucucucccguuacacagugcgugcuggaguccguccuuagaggagcggcccuggugccucgccaggcucucgccguuaugagcugugaagugcugcggguccuucaacugucugacaccgccaucgugccgauuggcuaccauguccccagaaaggcuguggaguuucacgaagaucucuucccugacacagccgggugcguucccgcgaccgauccucauagcuggugggcuggagacaaucaacaggugcagaaagucucccugaaccccgccugucgcccgcacccuucuuuuaccagcugccuggugcccccugccgagccccucccugauacagcucaacccgccguuauggaaacgccggugggcgacgcugacgccuccgagggguucagcucuccucccuccagccugaccucucccuccacaccuagcucccuuggaccgucucugagcuccaccucuggcaucggcacaagccccucccuccggagccugcagucucugcuugggccuuccagcaaguucagacacgcgcagggaaccguccuccaucgcgauucucacauuacgaaucugaagggccugaaccucacaacccccggggaguccgacggauuuugugccaauaaacugcggguggcugugccucuucugagcucuggcgggcagguugccguccucgaacugagaaagcccggccgccugccugauaccgcccuucccacacuccaaaacggagcugcggugaccgaccuggccugggauccguucgacccucaucggcuggcuguggccggcgaggaugcuagaauccggcucuggcgcguccccgccgaagggcuggaggaagugcuuacaacgccugagaccguucugacaggacacaccgagaaaauuugcagccucagauuucauccccuggccgcuaaugugcuggcguccagcucuuaugaccuuacaguccggaucugggaucuccaggccggcgcugacagacugaagcugcaggggcaccaggaucaaauuuucucccucgccuggagcccggacggacagcagcuggccaccgugugcaaagauggccgcguucggguguacagaccucgcuccgggcccgaaccucuucaggagggccccggacccaagggcgggagaggagcucggaucgucugggugugugacggccgcugccugcucguuucuggguuugacagccaauccgaaagacagcugcugcuuuaugaggccgaagcgcucgcuggaggcccucuggccgugcuggggcucgaugucgccccgucuacgcugcuucccagcuacgacccugauaccggccuggugcuccugacaggaaaaggcgacacccggguguuccuguaugagcuucugcccgagucccccuuuuuccucgaauguaacucuuuuacaagcccugauccucacaaggggcugguccuccugccgaagaccgagugcgacguucgcgaaguggagcuuaugagaugucugcggcuccgccaguccagccuggagcccguggcuuucagacugccucggguccgcaaagaauuuuuccaagaugacguguuucccgauacggccguuaucugggagccugugcuuucugcggaggcuuggcugcagggagccaauggccagcccuggcuccugucccuccagccgccugacaugagccccgucucucaagcccccagagaggcuccugcccggagagcucccuccagcgcccaguaccuggaagagaagucugaucagcagaaaaaggaggaacuucugaacgcgaugguggccaaacucgggaaucgcgaggacccucugccgcaagauuccuucgaaggaguugacgaggacgaaugggcuaaguaccuggcccagauuaucgugaugggcguccaggugguugggcgggcuuucgccagagcccuucgccaggaguuugcugcgagccgggccgcugccgaugccagaggccgcgcuggacaucgguccgccgcggcuagcaaccugucuggccucagccugcaagaggcccagcagauucucaacguguccaagcugucucccgaagagguccagaaaaauuaugaacaccuuuucaaggugaacgacaaaagcgucgggggauccuuuuaccugcagucuaaggugguuagagccaaagagcgccuggaugaggaacucaagauccaggcucaggaggaccgggaaaagggccaaaugccucauacauga

SEQ ID NO: 67765 - RNA, 429 nt, Artificial Sequence
  derived and/or modified sequence opt5 from COTL1__Homo_sapiens__NP_066972
auggccaccaagaucgacaaagaggcuugcagagccgcguacaaccuggugcgggaugacggcagcgcugucauuuggguuacauucaaguaugauggguccacgaucgugcccggagaacagggcgccgaguaccaacacuuuauucagcaguguaccgacgaugugcgccucuucgccuuugucagauucacaaccggggacgcuaugucuaaacggagcaaguuugcccugaucacauggauuggagaaaauguguccggccuucagcgcgcuaaaaccgggacagauaagacccugguuaaggaggugguccaaaacuucgccaaagaauuugugaucucugacagaaaggagcucgaggaagauuucaucaaaagcgagcugaagaaagcgggaggcgccaauuaugacgcucagacggaauga

SEQ ID NO: 67766 - RNA, 720 nt, Artificial Sequence
  derived and/or modified sequence opt5 from COX10__Homo_sapiens__XP_005256515
auggccgcuagcccccacacacuguccucuagacuccugacaggcugcgucgggggaagcgugugguaccuugagcggcgcacgauccaggacuccccucauaaguuccugcaccuccugagaaacguuaauaaacaauggauuaccuuucagcauuucucuuuucuuaagcggauguaugugacacagcugaaccgcagccacaaucagcaagugagaccgaaacccgaaccugucgccucccccuuccucgagaagaccucuagcggccaggcgaaagcugaaaucuacgagaugcggccucugucucccccuagccugucucucucccgcaagccgaacgaaaaggagcugauugagcuugaacccgauagcgugaucgaggacucuauugauguugggaaagaaacaaaggaggagaaaagauggaaggaaaugaaacuccagguguaugaccugccuggaauccuggcccggcuuuccaagaucaagcugaccgcccucgucgugagcacaaccgcugccggcuuugcucuggcccccgggccuuucgauuggcccuguuuucugcucacgucuguuggaaccggccuggcguccugcgccgcuaauagcauuaaccaguucuuugaggugccguucgacuccaauaugaaccgcaccaaaaauagaccucuuguccggggccaaauccgccaguccuuuuucagcuccuuuuga

SEQ ID NO: 67767 - RNA, 693 nt, Artificial Sequence
  derived and/or modified sequence opt5 from COX11__Homo_sapiens__NP_001156333
augggcgggcuguggagacccggauggcggugcgugccuuucuguggcuggcgcuggauccacccggggagccccaccagagccgcugagcgggucgaaccuuuucuccgccccgagugguccggaacaggcggggccgaaagaggacugcgguggcuuggcacguggaagcgcugcucucugagagcgcggcauccugcucuccagcccccucgcagaccgaaaagcuccaaccccuucacccgggcccaagaggaggaacgcagacggcagaauaagacaacccugacauacguugccgcuguggccgugggcaugcuuggggcuucuuaugccgcggucccucuguaccgccucuauugucagaccacaggacugggcgggagcgccguggcuggacacgccuccgacaaaauugagaacaugguucccgugaaggauagaaucauuaaaaucucuuuuaaugcugacguccaugccagccugcaguggaacuuccggccucaacagaccgaaauuuacgugguucccggcgagacggcgcucgccuuuuauagagcuaagaauccgaccgauaagccugugaucgggaucuccacauacaacauuguccccuucgaagccggacaguauuuuaauaaaauccaggugcugagcucucgccuucaauccugcaccgagagcacauucuga

SEQ ID NO: 67768 - RNA, 174 nt, Artificial Sequence
  derived and/or modified sequence opt5 from COX14__Homo_sapiens__NP_001244062
augcccaccggcaagcagcuggccgacaucggguacaaaacauucagcacguccaugaugcuccugaccguguauggaggcuaccuuugcucugucagaguuuaucacuacuuucaauggcggcgcgcucagagacaggccgcggaggaacagaagacaagcgggauuauguga

SEQ ID NO: 67769 - RNA, 1167 nt, Artificial Sequence
  derived and/or modified sequence opt5 from COX15__Homo_sapiens__NP_004367
augcagagacugcucuuucccccucugcgggcccuuaagggccgccaauaccugccgcuccuggcucccagagccgcgccucgggcucagugcgacuguauccgcagaccccuucggccugggcaguauagcaccauuuccgagguggcccugcagucuggacgcggcacagucagccuccccuccaaagccgcugaaagaguuguggggcgguggcugcuggugugcucuggaacggucgccggcgcugugauccucgggggaguuacccgccugacagagagcggccuuuccaugguggauuggcaccugauuaaggaaaugaaaccuccgaccucucaagaggaaugggaggccgaguuccagagauaccagcaguuccccgaauuuaagauccucaaccaugacaugacacugaccgaguucaaauuuauuugguauauggaauacagccaccggauguggggccgccuugucgggcugguguauauccucccugcggccuacuucuggagaaagggauggcugucccggggcaugaaggggcgcguucuggcucucuguggacuggugugcuuucaaggccuucuggggugguauauggucaaaagcggacucgaggagaagucugauucccaugacauccccagagugagccaguaccggcuggccgcucaccuuggcucugcccuggugcucuacugugcgucccuguggacaagccugucucuccugcuuccuccccauaaacugccggaaacccaccagcuccugcagcuuagacgcuucgcccacggcacggcugggcuggucuuucucaccgcccuguccggagcuuucguugccggccuggaugccgggcucguguauaauagcuuuccuaagaugggagaguccuggauucccgaagaccuguucacauuuucuccuauccuucggaacguguucgagaaucccaccaugguccaauucgaucaucgcauucugggcaucacaagcgugaccgcuauuacgguucucuacuuucuguccagacggaucccccugccuagacgcacaaaaauggcggccgugacccuucucgcucuggccuauacacaggggccgguccuguucaacuuuaccuucaagauuagcgaccucgaugaaggaauccggaauaucuga

SEQ ID NO: 67770 - RNA, 321 nt, Artificial Sequence
  derived and/or modified sequence opt5 from COX16__Homo_sapiens__NP_057552
auguucgcccccgcugugaugagagccuuucggaagaacaaaacccugggcuacggggucccuaugcuccugcuuaucguuggaggcagcuucgggcugcgcgaguuuucccagauuagauaugacgcggugaagucuaaaauggauccggaacucgagaagaaacugaaggaaaauaagaucagccuugaguccgaauacgagaaaauuaaggacucuaaauucgaugacuggaagaacauccggggaccccgcccuugggaggaucccgaccugcuccaaggcagaaauccugaaagccugaaaacaaagacgaccuga

SEQ ID NO: 67771 - RNA, 192 nt, Artificial Sequence
  derived and/or modified sequence opt5 from COX17__Homo_sapiens__NP_005685
augcccggccugguggacagcaacccugccccgcccgagucccaggaaaagaaaccucucaagcccugcugugcuugcccugagaccaaaaaggccagagaugcguguaucauugaaaaaggggaggaacacugcggacaucugaucgaggcucacaaggaguguaugcgggcccuuggcuucaagauuuga

SEQ ID NO: 67772 - RNA, 1005 nt, Artificial Sequence
  derived and/or modified sequence opt5 from COX18__Homo_sapiens__NP_001284661
augcugugcagacucggcgggcgguggcugcgcccccuuccugcccugcagcucugggcuagagaccugccgcuugcccccgugccuaccagcggagcgaagcggcccacacugccugucugggcuguugcccccguguccgccgugcacgcuaacggcugguacgaggcccucgcugccucuagcccuguccgcguggcggaagagguucugcugggggugcaugccgcuacgggacucccgugguggggcuccauccugcuuucuaccgucgcccugagaggggcugugacacucccccuggccgcguaucaacacuacauucuugccaaaguugaaaaucugcagccugagaucaagaccauugcucggcaucucaaccaggaaguggccguccgcgcuaaucagcugggauggagcaaaagagaugcccggcugacauaucucaagaacaugcgcagacugaucuccgagcuuuacgugcgggacaauugucaccccuucaaagccaccgugcuggucuggauucaacucccuauguggaucuuuaugucuuucgcucugcgcaaccuuagcacaggcgcggcccauuccgaggcuggcuuuagcguucaggaacagcuggccaccgggggaauccucugguuccccgaucugacggccccggacucuaccuggauucugccuaucuccgugggcgugauuaaucuccugaucgucgagauuugcgcccuucagaagaucgggaugagcagauuucaaacauauauuaccuacuucgugcgggcuaugucuguucugaugauccccaucgcggcuacagugccuuccagcauuguccucuauuggcuguguucuuccuuugugggacuuagccagaaccugcuccugcgcucccccggcuucagacagcugugccggauccccucuaccaagagcgauuccgaaacgccuuacaaagacauuuuugccgccuucaauacaaaguuuaucagcagaaaauga

SEQ ID NO: 67773 - RNA, 273 nt, Artificial Sequence
  derived and/or modified sequence opt5 from COX19__Homo_sapiens__NP_001026788
augagcaccgccaugaacuucggcacaaaguccuuucagcccagaccuccggacaaagggucuuucccccuggaucaccucggagagugcaagagcuuuaaagaaaaguucaugaaaugucugcauaauaacaauuuugagaacgcucuuugccggaaggaauccaaggaguaccuggaaugucgcauggagagaaaacucaugcugcaagagccucuugaaaagcugggcuucggggaccucacgucuggaaaaagcgaggccaagaaauga

SEQ ID NO: 67774 - RNA, 510 nt, Artificial Sequence
  derived and/or modified sequence opt5 from COX4I1__Homo_sapiens__NP_001852
augcuggccaccagaguguucagccucgucggcaagcgggcuaucuccacaucuguuugcgugcgcgcccacgagagcguggucaaauccgaagacuuuucucugcccgcguacauggauagacgggaccauccucuuccggagguggcucacguuaagcaucugagcgccucccagaaagcccucaaggaaaaagagaaggcuucuuggagcucccugagcauggaugaaaagguggagcuuuaucgcauuaaauucaaggagucuuuugccgaaaugaacagaggguccaaugaguggaaaacggucgugggaggcgcuauguucuuuaucggguucaccgcccugguuauuauguggcaaaagcacuacguguauggaccccucccucagagcuuugacaaagaaugggucgcgaagcagacaaagcggaugcuggauaugaaagugaaccccauccagggccuggccucuaagugggacuacgagaaaaaugaguggaagaaauga

SEQ ID NO: 67775 - RNA, 516 nt, Artificial Sequence
  derived and/or modified sequence opt5 from COX4I2__Homo_sapiens__NP_115998
augcugcccagagccgcuuggagccucgugcugcggaagggcgggggaggccgcagagggaugcacuccucugagggaaccacacggggcgggggaaaaaugagcccuuacacgaacugcuaugcccagcgcuacuauccgaugcccgaagaaccuuucuguaccgaacuuaaugcggaggaacaagcucugaaggagaaagagaagggcuccuggacacagcucacccaugccgaaaaagucgcccuguacagacuucaguuuaacgagacauucgcugaaaugaaucggcgcucuaacgaguggaagaccguuaugggcugcguguuuuucuuuaucggguucgccgcucuggugauuugguggcagagagucuauguguuucccccuaagcccaucacacucaccgacgagcggaaagcccaacagcugcagcgcaugcuggauaugaagguuaauccugugcagggacucgcgagcagaugggacuacgagaaaaagcaauggaaaaaguga

SEQ ID NO: 67776 - RNA, 453 nt, Artificial Sequence
  derived and/or modified sequence opt5 from COX5A__Homo_sapiens__NP_004246
augcugggcgccgcucucagacggugcgccguggcggcuaccacacgcgccgaccccagagggcugcuucacagcgcccggacgccuggaccggcugucgccauccaguccguucgcuguuacucucauggcagccaagagaccgaugaagaguucgacgcuagaugggugacauauuuuaacaagcccgauauugacgccugggaacugcggaaagggaucaauacccucgugacauacgauauggucccugagcccaagauuaucgacgcggcccugcgcgcuugcagacggcuuaacgauuucgccuccaccgugcgcauucuggaaguugugaaagacaaggcuggaccucacaaagagaucuaucccuacgucauccaggagcucagaccuacacugaaugaacugggcauuucuaccccggaggaacucgggcuggauaagguguga

SEQ ID NO: 67777 - RNA, 390 nt, Artificial Sequence
  derived and/or modified sequence opt5 from COX5B__Homo_sapiens__NP_001853
auggccagcagacugcuccggggcgcugggacccuggccgcgcaggcccuucgcgcuagaggacccuccggcgccgcugccaugcggucuauggcuagcgggggaggcgugccuacagacgaggaacaagccacggggcuggagcgcgaaaucaugcucgcggccaagaaaggacuggauccguacaacguccuugcucccaagggcgccuccggcaccagagaggacccuaaucugguucccucuauuagcaacaaacggaucguggggugcauuugugaagaggauaauacauccguggucugguucuggcuccacaagggagaggcucagcgcugcccuagauguggcgcccauuauaaacuggugccccagcagcuggcgcacuga

SEQ ID NO: 67778 - RNA, 330 nt, Artificial Sequence
  derived and/or modified sequence opt5 from COX6A1__Homo_sapiens__NP_004364
auggccguggucggcguuagcuccgugucuagacugcucgggcggagccgcccccagcugggaagaccuauguccucuggcgcucacggggaggaaggaagcgcccggauguggaagacccuuacauucuuuguggcgcugccgggcgucgcuguguccaugcucaacguuuaccugaaaucucaucacggggagcaugaacgccccgaguucaucgccuauccucaccuucggauuagaacgaagcccuuuccuuggggagacggcaaucauacccuguuccacaacccccacgugaauccucucccgacaggcuacgaagaugaguga

SEQ ID NO: 67779 - RNA, 294 nt, Artificial Sequence
  derived and/or modified sequence opt5 from COX6A2__Homo_sapiens__NP_005196
auggcccugccccucagaccucugacccggggccuugcuagcgccgcgaaagggggacacggcggggcuggagcccgcacauggagacugcucacguucgugcuggcccuuccguccgucgcucugugcaccuuuaacucuuaccuccauagcggccaccggccccgcccugaguucagacccuaucagcaucugcggauccgcacaaagccuuaccccuggggagacgggaaucacacccuguuucauaacucccacguuaauccucucccgacaggcuaugaacaccccuga

SEQ ID NO: 67780 - RNA, 261 nt, Artificial Sequence
  derived and/or modified sequence opt5 from COX6B1__Homo_sapiens__NP_001854
auggccgaggacauggaaaccaagaucaaaaacuacaagacagcucccuucgauagcagauuuccuaaucagaaccaaacgcggaauugcuggcagaacuaucuggacuuccaccgcugucagaaagccaugaccgcgaagggcggggauauuuccgugugcgagugguaccagagagucuaucaaucucucuguccgacaagcuggguuaccgacugggaugaacagcgggcugagggaacauuucccggcaaaaucuga

SEQ ID NO: 67781 - RNA, 228 nt, Artificial Sequence
  derived and/or modified sequence opt5 from COX6C__Homo_sapiens__NP_004365
auggcccccgaggugcugccuaagccgagaaugcggggccuccuggcucgcagacuucggaaccacauggccgucgcguucguucugagccucgggguggcugcccuguacaaauuucgcguggccgaccagagaaagaaggcuuaugccgauuucuaccggaauuaugacgucaugaaagauuuugaagagaugcgcaaagcuggaaucuuccaauccgugaaguga

SEQ ID NO: 67782 - RNA, 240 nt, Artificial Sequence
  derived and/or modified sequence opt5 from COX7A1__Homo_sapiens__NP_001855
augcaggcccugagagugagccaagcucucauccgguccuucucuagcaccgcccgcaacagauuucagaaucggguccgcgagaagcagaaacuguuccaggaagacaacgauauuccccuuuaccugaagggcgggaucguugacaauauucucuauagagugacaaugacgcugugccuuggaggcaccguguacucccuguauucucucgggugggcgagcuuuccucggaacuga

SEQ ID NO: 67783 - RNA, 348 nt, Artificial Sequence
  derived and/or modified sequence opt5 from COX7A2__Homo_sapiens__XP_011533748
augcacacccaggacagcgaggugguccccguuccugccuggccguucucccuggugguguuuucuugcggcggguguuggagcgucacagcuaagaugcucagaaaccugcuugcccugcggcaaaucggacagcgcacgauuuccaccgcgucuagacggcauuucaaaaauaaggugcccgaaaaacagaagcucuuucaggaggaugacgaaaucccucuguaccuuaaaggcgggguugcugaugcccugcucuaucgcgccacaaugauucugaccgugggaggcacagcuuacgccaucuaugagcuggcugucgccagcuuccccaagaagcaagaauga

SEQ ID NO: 67784 - RNA, 345 nt, Artificial Sequence
  derived and/or modified sequence opt5 from COX7A2L__Homo_sapiens__NP_001305965
auguacuauaaguucagcggcuuuacccagaaacuggccggggcuugggccuccgaggcguacucuccccaaggacucaagccuguggucagcacagaagcuccgcccaucauuuucgccacgccuaccaaacugacauccgacucuaccguuuaugauuacgccggcaagaacaaagugcccgagcuucagaaguuuuuccagaaggcugacggggugccugucuaucugaaaagaggacuccccgaucagaugcuguaccggacaaccauggcccuuacagugggcgggaccaucuauugccugauugcucucuacauggccagccaaccuaagaauaaauga

SEQ ID NO: 67785 - RNA, 246 nt, Artificial Sequence
  derived and/or modified sequence opt5 from COX7B2__Homo_sapiens__XP_005248113
augauguucccccuggccagaaacgcucucagcucccugaagauccagucuauucuucaaagcauggcccggcacucccaugugaaacacucuccugacuuucaugauaaguacggcaaugcgguccuggcuagcgggaccgccuucugcguugccacauggguguuuacggcuacccagaucggaauugaguggaaccucuccccggugggccgcgucacacccaaagaauggaagcaccaguga

SEQ ID NO: 67786 - RNA, 243 nt, Artificial Sequence
  derived and/or modified sequence opt5 from COX7B__Homo_sapiens__NP_001857
auguucccccuggugaaaagcgcccucaacagacugcagguccgguccauccaacagaccauggcucgccagucucaccagaagagaacaccugacuuucaugauaaguacggcaaugccguucuugcgagcggggcuacguucugcauugugaccuggacauauguggccacccaagucggaaucgaguggaaccuguccccggugggccggguuacacccaaagaauggcgcaaucaguga

SEQ ID NO: 67787 - RNA, 192 nt, Artificial Sequence
  derived and/or modified sequence opt5 from COX7C__Homo_sapiens__NP_001858
augcugggccagagcaucagacgguucaccacauccgugguccgcagaucucacuacgaggaagggcccggaaagaaccucccuuuuagcguugagaauaaauggucccugcuugccaagaugugccuguauuucggcucugcuuuugccacgccguuccucguggugcggcaucaacugcuuaaaaccuga

SEQ ID NO: 67788 - RNA, 210 nt, Artificial Sequence
  derived and/or modified sequence opt5 from COX8A__Homo_sapiens__NP_004065
augagcgugcugacaccccuccugcuuagaggccugaccggguccgcccggcgccucccugucccgagagcuaagauccacucucugcccccugagggaaaacuuggcauuauggaacuggccguugggcucacgagcugcuucgugaccuuucugcugcccgcgggauggauccucucccaucuggagacauaccggcgcccugaauga

SEQ ID NO: 67789 - RNA, 1260 nt, Artificial Sequence
  derived and/or modified sequence opt5 from CPA1__Homo_sapiens__NP_001859
augagaggccugcucgugcugagcguccuucugggggccguuuucggaaaggaggacuuugugggccaccaggugcuccggaucuccgucgcugaugaagcccaagugcagaaaguuaaggagcuggaagaccuugagcaucugcagcucgauuucuggcgcgggcccgcgcacccuggaucuccgauugacgugagaguccccuuuccuagcauccaggcugugaaaauuuuccuggaaucccauggcaucucuuacgagaccaugauugaggauguucaaagccugcucgacgaggaacaggaacagauguuugccuuccggucccgcgccagaucuacagauacguuuaacuaugcuaccuaccacacacuggaggagaucuaugacuuccuugaucugcucguggccgaaaauccccaucuggucagcaagauccagauugggaacaccuacgagggacggccuaucuaugugcuuaaauuuuccacaggcggcagcaagcgccccgcuauuuggaucgacaccgggauucacucuagagaaugggugacacaagccuccggagucugguucgcgaagaaaaucacccaggauuacggccaggacgccgcuuuuacggccauucuggauacccucgacaucuuccuggagaucguuacaaauccugacggguuugcuuucacccacagcacaaaccggauguggcgcaagaccagaucucauacggccggaucccugugcauuggcguggauccgaaucggaacugggacgcgggguucggacucagcggcgccucuuccaaucccuguagcgaaacauaucacggcaaauuugcuaacuccgagguggaggucaagucuaucguggauuucguuaaagaccaugggaauauuaaggccuuuaucagcauucacuccuacagccagcugcuuauguacccuuauggauacaagaccgaacccgugccugaucaagacgagcuggaucagcucucuaaagcugccgucacagcccuggcuucccuuuauggcaccaaguucaacuacgggagcaucaucaaagcgauuuaucaggccucuggaagcaccaucgacuggacauacucccaaggcauuaaguauucuuuuacguucgaacugcgcgauaccgggagauacggauuucuccugcccgcuagccagaucauuccgacagccaaagagaccuggcuggcccuccugacaaucauggaacacacccuuaaucauccuuacuga

SEQ ID NO: 67790 - RNA, 1260 nt, Artificial Sequence
  derived and/or modified sequence opt5 from CPA2__Homo_sapiens__NP_001860
auggccaugagacugauccucuucuuuggcgcucuguucgggcacauuuacugccuugagaccuuugugggagaccagguccuggaaaucguucccagcaacgaggaacaaauuaagaaucuccugcagcuugaggcccaggaacaucugcagcucgauuucuggaaauccccuacaacgccgggcgagaccgcgcacgugcgggugcccuuugucaacgugcaagcuguuaagguguuccuggagucucaggggaucgccuauagcauuaugaucgaagacguccaggugcugcucgauaaagagaaugaagagaugcuguuuaaccgcagacgggagcgcuccggaaauuucaacuuuggcgccuaccauacacuugaagagaucucucaggaaauggacaaucugguugcugagcacccugggcucgugagcaaggucaacauuggauccucuuucgaaaauagacccaugaacgugcugaaauuuagcaccggcggcgauaagccugccaucuggcuugacgcugggauucaugcccgggagugggugacacaagcgaccgcccuguggacagcuaauaagaucgucuccgauuauggaaaagaccccagcauuaccucuauccucgaugcccuggacauuuuccugcucccuguuacgaacccggauggcuacguguuuucccagaccaagaaucgcauguggagaaaaacacggagcaaggugucugggucccugugugucggaguggaccccaaccgcaauugggaugcuggcuucgggggaccuggcgccagcucuaaccccugcuccgacagcuaucacggcccuuccgcgaacucugagguugaagugaaaagcaucgucgacuucaucaagucccacgggaaggugaaagccuuuauuacccuucauagcuacucucagcugcucauguuccccuauggauacaaguguacaaaacuggaugacuuugaugagcuuuccgaaguugcucagaaggccgcucaaagccugagaucucuccacggcaccaaauacaagguggggccgaucugcagcgucauuuaucaggccuccggaggcucuaucgacuggagcuacgauuaugggauuaaauacuccuucgccuuugagcugcgggacacgggacgcuauggcuuccugcucccugcuagacagauccugcccacagcggaagagaccuggcuuggccugaaggccaucauggagcaugugcgggaucacccuuacuga

SEQ ID NO: 67791 - RNA, 1254 nt, Artificial Sequence
  derived and/or modified sequence opt5 from CPA3__Homo_sapiens__NP_001861
augagacugauccuccccgugggccugauugccaccacacuugcuaucgccccuguccgguucgaccgcgagaagguuuuuagagugaaaccgcaggaugaaaagcaagcggacauuaucaaagaucuggcuaagacgaacgagcucgacuucugguaccccggggccacccaccauguggccgcuaauaugauggucgauuuucgggugagcgaaaaagagucccaggccauucagucugcucuggaccagaacaagaugcacuaugaaauccuuauccaugaucugcaagaggagauugaaaagcaguucgacguuaaagaggauaucccuggacgccacagcuacgccaaguauaauaacugggaaaagauuguggcguggacagagaagaugauggacaaauaccccgagauggucuccagaaucaagauuggcucuaccguggaagauaauccucucuauguucugaagaucggggagaaaaacgaacggcgcaaggccauuuuuacagacugcggaauccaugcuagagagugggugagccccgccuucugucagugguuugucuaccaggcuaccaaaacauauggccggaauaagaucaugaccaaacugcucgaucgcaugaacuucuacauucugccuguguuuaauguggacggguacaucugguccuggacgaagaacagaauguggcggaaaaaucgcucuaagaaccaaaauagcaagugcauuggaaccgaccuuaacagaaauuucaacgccuccuggaacagcaucccgaauacaaacgaucccugugcggacaauuaucggggcucugccccugaauccgagaaagagaccaaggcugucacaaacuuuauucgcagccaccugaaugaaaucaaaguuuacaucaccuuccacucuuauucccagaugcuccuguuucccuacggcuauacgagcaaacuuccucccaaccaugaggaucuggccaaaguggcuaagauugggacagacgugcucucuaccagauacgaaacacgguauaucuacggaccgauugaguccaccaucuacccuauuagcggcuccucucuggauugggccuaugaccuggggaucaagcacaccuucgccuucgaacucagagauaaaggaaaguuuggcuuccugcuucccgagagccgcaucaaaccuacaugccgggagacgaugcuggcugucaaguuuauugcgaaauacauccucaagcauaccuccuga

SEQ ID NO: 67792 - RNA, 1167 nt, Artificial Sequence
  derived and/or modified sequence opt5 from CPA4__Homo_sapiens__NP_001156918
augagauggauccuguucauuggcgcccucaucgggagcuccauuugcggacaggagaaguuuuucggcgaccaagugcugcggaucaacguccgcaauggggaugaaauuucuaaacuuagccagcugguuaacuccaauaaccucaagcugaauuuuuggaaaucucccagcuccuucaacagaccuguggacgugcuugucccgucugugagccugcaggcuuuuaaguccuuccuccggagccagggacuggaguacgccguuaccaucgaagaucugcaaaucuaucacgagauggacaauauugcggcugauuuucccgaccucgcccgcagagugaaaaucggccauucuuucgaaaaccggccuauguacguccugaaguuuuccacagggaagggagugcgcagacccgccguuuggcuuaaugcuggcauucacagccgggaguggaucucucaggccacggcuauuuggaccgcccgcaaaaucguguccgauuaucagagagacccugcgauuacaagcauccuggagaagauggauaucuuccuccugcccgucgccaacccugacggcuacguguauacccagacacaaaaucggcuuuggcgcaaaaccagaucucggaacccgggguccagcuguauuggagcugaucccaaucgcaacuggaaugccuccuuugcuggcaagggggccucugacaacccuugcagcgaaguguaccauggaccccacgcgaacuccgaggucgaaguuaaaagcgugguggauuucauccagaagcauggcaauuuuaagggguucauugaccugcacucuuauucccagcuccugauguacccuuacggauauagcgucaaaaaggcccccgacgcugaggagcuggauaaaguggccagacucgcugccaaggcccuggcuucuguuagcggcacagaauaccaggugggcccgaccuguacgaccgucuauccugcguccgggucuagcaucgacugggccuacgauaacggaauuaaauucgcuuuuacauucgagcuucgggacaccggcacauauggguuucugcuccccgccaaucaaaucaucccuaccgccgaagagacguggcugggacuuaagacaauuauggaacacgugagagauaaccuguacuga

SEQ ID NO: 67793 - RNA, 1314 nt, Artificial Sequence
  derived and/or modified sequence opt5 from CPA6__Homo_sapiens__NP_065094
augaagugccugggcaaaagacgggggcaggccgcugccuuccucccccuguguuggcuuuuucugaagauccuccaaccuggacacagccaucuguacaacaaucgcuaugcgggcgacaaagugauuagauucaucccgaagaccgaggaagaggcuuacgcccuuaaaaagauuuccuaucagcugaaggucgaucucuggcagcccucuagcaucuccuacguuucugaagggacagugacggacgugcacauuccucagaacggaagccgggcccugcuggcuuuucuccaagaggccaauauccaguauaaaguccugaucgaagaucuucagaagacccuggagaaaggcuccucucuccauacacagcgcaacagacggagccuguccggguacaauuaugagguguaccacagccuugaagagauucaaaacuggaugcaucaccugaauaagacccacucuggacucauccauauguucuccauuggccgcagcuacgaaggcagaucucuguuuauccugaaacucgggcggcgcuccagacugaagcgggcuguuuggauugacugcggaauccacgcccgcgaguggauuggccccgcguucugucagugguuugugaaggaggcccuucugacauauaaaagcgauccugcuaugagaaagaugcucaaccaucuguacuucuauaucaugcccgucuuuaauguggacggguaccacuucucuuggaccaacgaucgguuuuggcgcaaaacaagaucccggaauagcagauuccgcugccggggaguugacgccaacagaaauuggaaggugaaauggugugaugaaggcgcuuccaugcacccuugcgacgauaccuauugugggccguuucccgagucugaaccugaggucaaggccguggcgaacuuccuucgcaaacaucggaagcacaucagagccuaccugagcuuccaugcuuaugcccagaugcuccuguaccccuacuccuauaaguacgcuacgauuccuaauuuucgcugcguggaaagcgccgccuauaaagcugucaacgcgcugcagucuguuuacggagugcgguauagauacggccccgccuccaccacacucuaugugagcucuggcagcuccauggacugggcuuacaagaacgggaucccguacgccuucgccuuugagcugcgcgauaccggauauuucggcuuucuucugccugagaugcucauuaaacccacauguaccgaaacgaugcuggcugucaagaauaucacaaugcaccuucugaaaaagugcccuuga

SEQ ID NO: 67794 - RNA, 5799 nt, Artificial Sequence
  derived and/or modified sequence opt5 from CPAMD8__Homo_sapiens__NP_056507
auggcccccggcgcucugagagggggaugcgagcagcgggccccuggcgggggagcccgcaccgcugcccugggcccguggcccuggccuagccccgggccugcccccuccccuggagcugccccgccccggucucggaagaugagcggcgcucugcuuuggccucugcucccccugcuucugcuccugcuguccgcccgcgacggcgugagagcggcccaaccucaggcucccggguaccucaucgccgcuccgucugucuuccgggccggaguugaagaggugauuagcgugacaaucuuuaacuccccucgcgaagucacggugcaggcgcagcugguugcccaaggcgagcccgugguccagucucagggggcuauucuugauaaaggaaccaucaagcugaaagugccuacaggccucagagggcaggcccugcuuaagguuuggggacggggcuggcaagcugaagagggcccccuguuccacaaccagaccagcgugacagucgacgggcgcggagccuccguguuuauucagaccgauaaacccguguauagaccucagcaucggguccucaucagcaucuucacaguuucuccgaaccugcgccccgugaaugagaagcuggaagccuacauucucgacccuagaggcucccggaugaucgaguggcgccaccugaagcccuuuuguugcgggauuaccaacaugagcuucccucuuucugaucaacccgugcugggagaaugguuuaucuucgucgagaugcagggccaugcuuauaauaaauccuuugaggugcagaaguacguucucccgaaauucgaacugcuuauugacccucccagauauauccaagaucuggacgcgugugagacggggaccgugcgggccagauacacauuuggaaagccugucgcuggcgcccucaugauuaacaugaccgugaauggcguuggguauuacagccacgaagugggacgccccguccugcggacaaccaaaauccugggcucuagagauuucgacaucugcgugcgcgauaugauuccugccgacguccccgagcauuuucgggggagaguguccaucugggcuaugguuacgagcguggauggaucccagcaggucgccuucgacgacucuacaccggugcagcgccaacucguugauauucgguacagcaaggacaccagaaagcaguucaaaccuggccuggcguauguggggaaggucgaacuuuccuaccccgauggcagccccgcugagggagugacagugcagaucaaagccgagcugaccccuaaggacaacauuuauaccucugaaguugucucccagcgcggccucgugggguuugagaucccgagcauccccacaucugcccaacacguguggcuggaaacgaaagucauggcucuuaauggaaagccugugggcgcccaguaccugcccagcuaucucucccuggggucuugguacagcccuucccaguguuaucugcagcuccaacccccuagccacccccugcagguuggagaggaggcuuacuucucugugaaauccacaugcccguguaacuuuacacuuuacuaugaggucgccgcgcggggcaauauugugcugagcgggcagcagccugcccauaccacacaacagagaucuaagcgcgcugcccccgcucucgagaagccuauccggcugacccaccuguccgaaacggagcccccgccugcccccgaagcggagguugaugugugcgucacaagccuucaucucgccgugaccccuuccaugguuccccugggcagacugcucguguucuacguccgggaaaacggagagggcguggcugacucucugcaguuugccguggagaccuucuuugaaaaucaagucagcguuacauauuccgcuaacgagacccagcccggggaagugguggaucuucgcauuagagccgcccggggaucuugugucugcguggcugcgguugacaaaagcguguaccugcucagauccggcuuccgccugacgccugcucaggucuuucaggagcuggaggauuaugacgugagcgauucuuucgggguuucccgggaagacggaccguuuuggugggcuggccuuacagcccaaagacgcagacggagcucuguguuccccuggccuugggggaucaccaaggacuccggcuuugccuucacagagaccggacucgucgugaugacagaucgcguuagccugaaucacagacaggacggcgggcuguacaccgaugaagcugugcccgccuuccagccucacacgggaucucucgucgcgguggcucccagccggcauccuccgcgcaccgagaaaagaaagcggacauuuuuccccgaaaccuggauuuggcacugucugaacaucuccgacccuagcggcgaggggacacuuucugugaaaguccccgauuccaucaccagcuggguuggagaggccguggcccuguccacgucucagggccucgggauugcugaaccuagccugcugaagacauuuaagcccuucuuuguggacuucaugcuuccggcccucaucauucgcggcgagcaagucaaaaucccucuguccguguauaacuacaugggaaccugcgcggaaguuuacaugaagcugucugugcccaaaggcauucaguuugucgggcaucccggaaagagacacgugaccaaaaagaugugcguugcuccuggcgaggccgaacccaucugggugguccucagcuucuccgaucuggggcuuaauaacauuaccgccaaggcucuggccuauggagacaccaauuguugccgggauggccgcucuagcaaacauccugaggagaaccacgcugacagacgggugccgaucggcgucgaucacgugagacgcuccguuaugguggaagccgagggggucccccgggcguacacauauagcgccuuuuucuguccuucugaaagagugcauaucuccacgcccaauaaguacgaguuucaguauguucagcgcccucuccggcugaccagauucgacguggcuguccgcgcccacaacgaugcucggguggcccugagcucuggaccccaagacacagccggcaugauugaaaucgugcuugggggacaucagaauaccagauccuggauuagcacaucuaaaaugggcgagccgguugcuuccgcgcacaccgccaagauccucagcugggacgaguuucgcacguucuggauuuccuggagagggggacugauccaggucggccacggcccugaacccagcaacgagucugugaucguggcuuggacacugccuagacccccugaaguccaauucauuggguuuagcaccggauggggcuccaugggggaguuccggaucuggcgcaaaauggagguggaugaaucuuacagcgaggccuuuacccucggaguuccccauggcgccauuccgggguccgaaagagcuacagccucuaucauuggagacgugaugggcccuacccugaaucaccuuaacaaucugcuccggcugcccuucggcugcggggagcagaacaugauccauuuugcgcccaaugucuucgugcugaaguaucuucagaagacacagcaacugagcccugaaguugagcgcgagacgaccgauuaccucgugcagggauaccagagacagcugacauauaaacggcaagacggcuccuacucugcuuuuggggaaagagaugccagcggauccauguggcucaccgccuucguccucaagagcuuugcucaggcccgcucuuucaucuuuguggacccgcgggagcuugcggcugccaaauccuggauuauccagcagcaacaggccgauggcagcuuccuggcuguugggagagugcucaacaaggacauucagggaggcauccacggcacagucccccugaccgccuaugugguggucgcucugcuugaaacggggaccgccucugaggaagaacgcggauccacagauaaagcgcggcauuuccuggagagcgccgcuccucucgccauggaccccuacuccugugcucugaccacauaugcccucacccugcuuagaucuccugccgcucccgaagcgcugcgcaagcuccggagccuggccauuaugagagauggcguuacacacuggucccugagcaauucuugggacguggauaaagggaccuuucuuuccuucagcgaccgcgugucucagagcgucguguccgcugagguugaaaugacggccuacgcccugcucacauauacccugcucggagacguggcugccgcgcugccugucgugaaguggcuuucucaacagagaaacgcucugggcggguuuagcuccacccaggauacaugcguugcccugcaagcccucgcugaguacgccauccugucuuacgcgggaggcaucaaccuuaccgugagccuggccuccacgaaucucgacuaucaggaaacauucgagcugcaccggaccaaccagaagguccuccagacagcugccauuccgagccugcccaccggccuuuuugugucugcuaaaggggauggauguugccugaugcaaaucgacgucacauacaaugugccugaucccguugccaagccugcuuuccagcugcucgugucccugcaggagcccgaagcccagggccgcccgccucccaugcccgcgagcgccgcugagggguccagaggagacuggccucccgccgaugacgaugacccugcugccgaucaacaucaccaggaauauaaagugaugcuugaggucuguacccgguggcugcaugccggcucuagcaacauggcuguucucgaggugccgcugcucuccggguuucgcgcggacauugaaucucuggagcagcuucugcuggacaagcacaugggaaugaaaagauacgaaguggccggccggagaguccucuucuauuuugaugagauccccagccgcugccugacgugugugcgguucagagcccuucgcgaaugcguugugggccggaccuccgcccugccugucagcguguacgacuauuacgagcccgccuuugaggcuacaagauucuacaaugucucuacccauuccccucucgcccgggaacugugcgcggggcccgccuguaacgagguggaacgcgcuccggccagaggaccuggcugguuucccggggagagcggaccugcuguugcccccgaagagggcgcggccauugcucggugcgggugugaucacgacugcggagcccagggcaauccuguguguggcucugauggggucguguaugcuuccgccugccgccucagagaggcugccugucggcaagcggcgccccuggaaccggcuccucccagcugcugugcccuugagcagcgccugcccgcuucuagcuccucuacauacggagacgaucuggccagcguugccccuggcccgcuccagcaagacgugaagcugaacggggcgggacuugaagucgaggauuccgaccccgaaccugagggcgaggcugaagauagagugaccgccgggccccggccucccgugagcuccggcaaucuggagucuagcacgcaguccgcuucuccuuuccaccgcuggggacagacacccgccccgcagagacauagcggccggguugucggggcccacagaccuggacuccugucccccguguucguguauucuccugcuuuucaaagcggcggggaagagggacuguggauguccaauaccugcacacuccgcuga

SEQ ID NO: 67795 - RNA, 1254 nt, Artificial Sequence
  derived and/or modified sequence opt5 from CPB1__Homo_sapiens__NP_001862
augcuggcccuccuggugcuugucaccguugcucuggccagcgcgcaccauggcggggagcacuucgaaggagagaagguguuuagagugaacgucgaagacgagaaucauaucaacauuauccgggaacucgcuuccacaacgcagauugauuucuggaaacccgacucugugacccaaaucaagccucacagcacaguugauuuucgcgugaaagccgaggacaccgucacaguggagaauguucugaagcagaacgaacuucaguacaaagugcugauuuccaaucucagaaacgucguggaggcccaguucgauucucgggugcgcgcuaccggccauagcuaugaaaaguacaauaagugggagacaaucgaggccuggacccaacaggucgcuacggaaaacccggcccugaucuccagaucuguuauugggaccacauuugagggacgggcgaucuaucugcucaaagugggcaaggccgggcagaauaaacccgcuauuuucauggacugcggauuucacgcccgcgaauggaucagcccugcuuucugucagugguuugugagagaggccguccggaccuacggccgcgaaauucaagugacagagcugcuugauaagcuggacuucuauguucuccccgugcugaacaucgauggcuacauuuauaccuggacgaaauccagauuuuggcggaagacacgcagcacccacacagggucuuccugcaucggaaccgacccuaauagaaacuucgaugcgggcuggugugagaucggggccagccggaaucccugcgacgaaaccuacuguggaccugcugccgagucugaaaaggagacaaaagcucuugccgauuuuauucgcaacaagcuguccagcaucaaagccuaccucacgauucauucuuauucccagaugaugaucuacccguauagcuacgcuuauaagcugggcgaaaauaacgcggagcugaacgcccucgcuaaagccaccgucaaggagcuggccucccuucacgggacaaaauacaccuauggacccggcgcuacaaccauuuacccugccgcgggcgggucugacgacugggcuuacgaucagggaaucagauauagcuucacguucgaacugcgggacacaggcagauacggguuucuccugcccgagucccagauccgcgcuaccugcgaagagaccuuccuugccauuaaguauguggccagcuacguucuggaacaucucuauuga

SEQ ID NO: 67796 - RNA, 1161 nt, Artificial Sequence
  derived and/or modified sequence opt5 from CPB2__Homo_sapiens__NP_001265470
augaagcugugcagccucgccgugcugguccccaucguucuuuucugugagcagcacguguuugcuuuccaauccggccaggugcuggccgcgcucccuagaaccucucggcagguccaggugcugcaaaaccuuacaacgaccuacgaaauuguucuguggcagccggugacagcugaccucaucgucaaaaagaaacaggugcacuuuuucguuaaugccagcgauguggacaacgucaaggcccaucugaauguguccgggauucccugcucugugcugcucgcugaugucgaggaccugauccagcaacagauuagcaacgauaccguuuccccucgcgccucugcuagcuauuacgaacaguaucauucccuuaaugagaucuacagcuggaucgaauuuauuacagagagacaccccgacaugcugaccaaaauccauauuggaucuuccuucgagaaguauccucucuacgugcugaaggugagcggcaaagaacaggccgcgaagaacgccaucuggauugauugugggauccacgcucgggaguggauuucucccgccuuuugccuuugguucaucggacacaaucgcauguggcggaaaaacagauccuuuuaugcuaauaaccauuguaucggcacagaccugaaucgcaacuucgccagcaagcacuggugcgaagagggggcgucuuccagcuccuguucugagaccuacugcggacucuacccugaaagcgagccggaagucaaagccguggcuuccuuucugagacggaauauuaaccaaaucaaggccuauauuagcaugcauucuuacucccagcacaucguuuuccccuauagcuacacgcgcucuaagagcaaagaucacgaggaacugucccucguggcuucugaggccgucagagccauugagaagaucagcaaaaauacccgguauacacauggccacggcuccgaaacccuguaccuugcuccugggggaggcgacgauuggaucuaugaccuggggauuaaguacagcuuuacaaucgagcuccgcgauaccggaacguacggcuuccugcuucccgaaagauauauuaaaccuacaugucgggaggcguucgccgcugugucuaagaucgccuggcauguuauucgcaacguguga

SEQ ID NO: 67797 - RNA, 3402 nt, Artificial Sequence
  derived and/or modified sequence opt5 from CPD__Homo_sapiens__NP_001186704
augagauucgugcugagcggcaaccuccacgggggauccgucguugccucuuaccccuuugacgauagcccugagcauaaggcuaccggcaucuauuccaaaacaucugacgaugaaguguucaaguaccuggccaaagcguaugcuagcaaucacccgauuaugaagacgggggagccccauugcccuggagacgaagaugagaccuuuaaagacggcaucacaaacggggcccacugguacgauguggaaggaggcaugcaggacuauaauuacgucugggccaacuguuucgagauuacccuugagcuguccugcuguaaguaucccccugcuucucaacuccggcaggaaugggagaauaaccgcgaaagccugaucacacuuauugagaaggugcauaucggcguuaaaggguuugugaaggauuccaucaccggaagcggccuggagaaugccacaauuucugucgcugggaucaaccacaauauuaccacgggaagauucggcgacuuuuaccggcuccuggugcccgggaccuacaaccugacaguugugcucaccggauauaugccucugacagucaccaaugugguggucaaagaaggcccggccacggagguugauuucucccuucgccccacagugaccagcgugaucccugacacaaccgaagcggucucuaccgccuccacaguggcuauucccaacauccugagcggcacgucuuccagcuaccagccuauucagcccaaggauuuucaccaucaccauuucccggacauggagaucuuucucagacgguucgccaaugaauauccuaacaucacccgccuguacucccuugggaaaucuguugagagcagagagcuguaugugauggaaauuuccgacaaucccggaguccacgagccuggcgaacccgaguuuaaguacaucgggaacaugcacggaaacgaagugguuggccgggagcuccugcugaaucucauugaguaucugugcaagaacuucgggacagaucccgaagugaccgaccuuguccauaauacacgcauccaccugaugccuagcaugaacccggauggauacgagaaaucucaagaaggcgacuccauuagcgugaucggcagaaauaacucuaauaacuucgaucucaaucggaacuuucccgaccaguucguccagaucaccgauccuacgcagcccgagacaauugcugugaugagcuggaugaaguccuacccuuuuguucugucugccaaucuucaugggggaagccugguggucaacuaucccuucgacgaugacgaacaaggccucgcgaccuacuccaaaagcccggaugacgccguguuucagcagaucgcucugucuuauuccaaggagaauagccagauguuccaagggcgcccuuguaaaaacauguaccccaaugaguauuuuccucacggaauuaccaacggcgccucuugguacaacguucccgggggcaugcaggacuggaauuaucugcagacaaacugcuucgaagugaccaucgagcucggaugugucaaguacccucuggaaaaagagcuucccaauuuuugggagcaaaacagacggucccugauucaguucaugaaacaggugcaucagggcgugcgcggguuuguucucgaugcuacagacggaagaggcauccugaaugccacgaucagcgucgccgaaauuaaccacccggugaccacauacaagaccggggauuauuggcggcuucuggugccuggaacauacaagaucaccgcuuccgcgagaggcuauaaucccgucacgaagaacgugaccguuaaaucugagggggccauucaagugaauuucacacucguccgcagcuccaccgacucuaacaaugaaagcaagaaaggcaagggagcuuccagcucuacaaacgaugccuccgaccccaccacgaaggaguuugaaacacugaucaaagaucugagcgccgagaauggccucgagucucugaugcuucgguccagcucuaaccuggcucucgcccuguacagauaucacagcuacaaggaccuguccgaguuccuucgcgggcucgugaugaauuauccucauauuaccaaccugacaaaccugggacagagcaccgaguaccggcacaucuggucucucgaaauuuccaauaaaccgaacguuagcgagcccgaagaaccuaagaucagauucguggcgggcauccaugggaaugcucccgucggaaccgagcugcuucuggcccucgccgaauuucugugccugaacuacaaaaagaauccugcugugacacagcuuguugaucgcacgcggauugugaucguccccucccucaacccugacggcagagagcgcgcccaggaaaaggauuguaccucuaaaauugggcaaacaaaugcucggggcaaggaccuggauaccgacuucacaaacaaugccagccagcccgagaccaaagcgaucauugaaaaccugauccagaagcaggacuuuucccucucuguggcccuggauggaggcagcaugcuugugacguauccguacgacaaaccuguccaaacaguugagaauaaggagacccugaagcaccucgcuucccuguaugccaacaaucaccccucuaugcauauggggcagccuagcugccccaacaaauccgaugaaaauaucccgggaggcgugaugagaggggcugaguggcacagccaucugggaucuaugaaggacuacuccgugaccuauggccacuguccugaaauuacagucuacaccagcugcugcuauuuccccucugccgcgcgccuuccuucccucugggccgauaacaaacggagccugcugucuaugcucguggagguucauaagggggugcacggcuuugucaaagacaagacaggaaaacccaucuccaaggcugugauuguucugaacgagggcaucaaggugcagacgaaagaagggggauacuuccacguccuucuggcccccggcgugcauaauauuaucgcuaucgccgauggguaccagcaacagcacagccagguuuuugugcaucacgacgccgcuuccagcgucgugauuguguucgauaccgacaacagaaucuuuggacucccucgggagcuggucguuacagugucuggcgcgaccaugagcgcccugauucuuacagcuuguaucauuuggugcaucuguuccaucaagucuaaucgccauaaagauggcuuccacagacuccggcaacaccaugacgaauaugaggaugaaauuagaaugaugagcaccggguccaagaaaucucugcugagccacgaguuucaggacgagacggacaccgaagaggaaacacucuacuccucuaagcauuga

SEQ ID NO: 67798 - RNA, 1476 nt, Artificial Sequence
  derived and/or modified sequence opt5 from CPEB1__Homo_sapiens__NP_001073001
augcuguuccccaccagcgcccaggaguccucuagaggccucccugacgcuaacgaucugugccuugggcugcaaagccucucccugacaggaugggaccggccguggucuacgcaggauagcgacuccucugcccagagcuccacccacagcgugcuuucuaugcugcauaauccccucggcaacguccuggggaagccuccccuguccuuucucccucuggauccccuuggaagcgaccugguugauaaauucccugcgccgucugugcgcggcuccagacucgacacacggcccauccuggauagccgcagcuccagcccuuccgacucugauaccagcggguuuuccagcggaucugaccaccuuuccgaucugauuagcucucucagaaucucucccccucugcccuuccugucccucucuggcggcgggccgcgggacccucugaagaugggagugggcagccgcauggaccaggaacaagcugcccuugccgcugucacacccuccccuaccagcgccucuaaaagauggcccggggcuuccguguggcccagcugggaucugcucgaggccccuaaggacccguuuucuauugaacgggaggcgcgccugcauagacaggccgcugccguuaaugaagcuacauguaccugguccggacagcuucccccucggaacuacaaaaaucccaucuauagcugcaagguguuccugggcggggucccuugggauauuacggaggccggacucgugaacaccuuucgcguuuucggcucccugucuguggaguggcccggcaaggacgggaaacacccgagauguccucccaagggaaauaugccuaaaggcuacgucuaucugguguuugaacucgagaaaagcgugcggucccugcuucaggcgugcucucaugauccccugagcccugacgggcucuccgaauacuauuucaaaaugagcucucgcagaaugcgguguaaggagguccaaguuauccccugggugcuggccgauuccaacuuugugagaagcccgucucagcgccuugacccuucccggacagucuucgugggagcucugcacggcaugcucaaugccgaggcucuggccgccauccugaacgaucucuuugggggaguuguguacgcuggcauugacaccgauaagcacaaauaucccaucggcagcgggagagucacauucaauaaccagcgcucuuaccugaaggcggugagcgccgcuuucguugaaauuaaaaccacgaaguuuacaaagaaggugcagaucgaccccuaccuugaggacucccugugccauauuuguagcucucaaccuggaccguucuuuugccgggaucaggucuguuucaaauauuuuugcagauccuguuggcacuggcgccauagcauggaaggccuccggcaccacucuccccugaugagaaaucagaagaaccgcgacuccagcuga

SEQ ID NO: 67799 - RNA, 2055 nt, Artificial Sequence
  derived and/or modified sequence opt5 from CPEB3__Homo_sapiens__NP_001171608
augcaggacgaucugcucauggacaagagcaaaacccaaccccagccucagcagcaacagagacagcagcaacagccgcagcccgaguccucugugagcgaagccccuuccacaccccugucuagcgagacgccuaagcccgaagagaacuccgcugucccugcccuuucuccggcggcugcucccccugcccccaauggcccugauaaaaugcagauggaaagcccccugcucccggggcuguccuuccaccaaccuccccagcagccucccccuccccaagagccggccgcccccggagcuagccuuucuccuuccuuuggcagcaccuggucuacagggaccacaaacgccguugaggacuccuucuuucagggaaucacccccgugaauggcacaaugcuguuccagaacuuuccucaucacgugaaucccgucuucgggggaaccuuuagcccgcagauuggccucgcgcaaacgcagcaucaccagcagccucccccucccgccccugcuccccaaccggcccagccugcucagccuccccaggcccaacccccgcagcagcggcgcucucccgcguccccuagccaggcccccuacgcucaaagauccgccgcugccgccuauggccaucagccuaucaugaccucuaagcccagcuccagcucugcuguggcggccgcugccgccgcugccgcggcuuccagcgccucuagcuccuggaacacacaccagucuguuaaugccgcuuggagcgccccuuccaaccccuggggagggcugcaagcuggccgggauccgcgcagagccgugggggucggagugggcguuggggugggagucccuagcccccugaauccuauuucuccccucaaaaagccguucuccagcaacgugaucgcgccucccaaguuuccucgggccgcuccccugaccucuaaauccuggauggaagacaaugccuuccgcacagauaacggcaauaaccuucugcccuuucaggacagaagccggccuuacgauaccuucaaucuccacucccuggagaacucucuuauggacaugauucgcacggaucaugaaccgcugaagggcagaauggggaucaacuuucaccaucccggaacagacaauaucauggcucucaacagccgguccucucuguucccuuucgaggaugccuuucuggacgacagccacggcgaucaggcgcucuccagcgggcugucuucccccacccgcugccagaauggagagagaguggaacgguauagccgcaaagucuucguuggcgggcuuccucccgacauugaugaggacgaaaucacagccucuuuuagacgguucggaccucuggugguggauuggccgcacaaggcugaguccaaaagcuacuuucccccuaagggcuaugccuuccuccuguuucaagaagagucuagcguccaggcucuuauugacgccugucuggaggaagauggcaagcucuaccugugcguguccagccccaccaucaaagacaagccuguucagauuagacccuggaaccugucugauuccgacuucgugauggaugggagccagccgcucgacccucgcaaaaccaucuuugucggaggcgugccccggccccugagagccguugagcuugcuaugauuauggaccgccuguaugggggaguguguuacgcgggcaucgauacagacccugaacucaaguaccccaaaggggccggccgggucgcuuucuccaaucaacagucuuauaucgccgccauuagcgcuagauuugugcagcugcagcauaacgauaucgacaagcgcgucgaggugaaaccuuacguucuugaugaccaaaugugcgaugaaugucagggaacgcggugcggcgggaaguucgccccguuuuucugugcgaaugugaccugccugcaguauuacugugaguauugcugggcuuccauucacucuagagccggacgcgaguuccauaagccccucgucaaagaaggcggggaccggccuagacacgugcccuuucgcuggagcuga

SEQ ID NO: 67800 - RNA, 2190 nt, Artificial Sequence
  derived and/or modified sequence opt5 from CPEB4__Homo_sapiens__NP_085130
augggcgacuacggguucggagugcugguccagagcaacaccggcaauaaguccgccuuucccguuagauuccacccucaucuccaaccgccccaccaucaccagaacgcuacaccuucucccgccgcguuuaucaauaacaauacggcugccaacgggagcuccgccggaucugcuuggcuguucccugcccccgcuacccauaauauucaggaugagauccuuggcagcgaaaaagccaagucccagcaacaggagcagcaggacccucuggaaaaacaacagcucucuccgagccccgggcaggaggcggggauucugccugaaacagagaaggccaaauccgaggaaaaccagggcgauaauagcucugagaacggcaaugggaaggaaaagauccggauugagucccccgugcuuaccggauuugacuaucaagaggcuacaggccuggggaccagcacacagccucucaccucuuccgccagcucucugacgggauucuccaacuggagcgcugccaucgcgcccuccucuagcaccaucauuaaugaagaugccuccuuuuuccaccagggcggggugccggcugccagcgcuaacaauggagcccugcucuuucaaaacuucccucaccaugucucucccggcuuuggcggguccuucagcccucagaucggaccccugucucagcaccauccccaccacccucauuuucagcaccaucacagccaacaucagcagcagcgcagauccccggccucuccccacccucccccuuucacacaccggaacgcugcguucaaucaacuuccccaucuggccaacaaucucaacaaaccgccuagccccugguccagcuaccagucuccuucccccaccccuucuagcuccuggagccccggcgggggaggcuaugggggauggggcggcucccaggggcgcgaccacagacggggacugaauggcgggauuacaccgcuuaacucuaucagcccucugaagaaaaauuuugcuuccaaccauauucagcuccaaaaguacgcccgccccucuagcgccuucgcucccaaauccuggauggaggauagccugaauagagccgacaacaucuuuccuuucccggaucggccccgcaccuuugacaugcacucucuggaauccagccucauugauaucaugagagcggagaaugacacgaucaagggacggcugaacuauucuuacccuggcuccgauagcucucuucugauuaaugcucgcacauaugggagacggcgcggccagagcucccucuuccccauggaagacggauuucuggacgauggcagaggggaccagccucuucacagcggacugggcucuccccauugcuucucccaccagaacggggagcggguggagagauacagccgcaagguuuuugugggaggccucccucccgauaucgacgaagaugagauuaccgccuccuuccggagauuugggccgcugaucgucgacuggccucauaaagccgaaucuaagagcuacuucccuccuaaaggcuaugcuuuucuucucuuccaagaugaguccucugugcaggcccugauugacgcuuguaucgaagaggauggaaagcuguaccugugcguuagcucccccacaaucaaagacaagccggugcagauucgcccuuggaaucucucugauagcgacuucgucauggacggcucccaaccccuggauccucggaaaaccaucuuugugggaggagugcccagaccccuucgcgccgucgagcuggcgaugauuauggaccggcucuauggcgggguuuguuacgccggaaucgauaccgacccugaacugaaguauccgaagggcgcugggagaguggccuucagcaaccagcagucuuacauugcugccaucuccgcgcgcuuugugcagcugcaacacggcgagaucgauaaacgggucgaagugaagcccuauguucucgacgaucagcugugcgacgagugucagggagccagaugcggcgggaaauucgcucccuuuuucugugccaacgugacaugccuucaguacuacugugaauauugcugggcugccauucauagccgcgccggacgggaguuucacaagccccuggucaaagagggcggggauagaccucggcacaucucuuuccgcuggaauuga

SEQ ID NO: 67801 - RNA, 2352 nt, Artificial Sequence
  derived and/or modified sequence opt5 from CPED1__Homo_sapiens__NP_001099003
auggugugcagacccgucuucccuugucggcgcagauuuugcccgcggcccuuccugguuggccucgugguggccaucugucuguuuuaccagacccuuacacugcgcgggagcagaaagcucacggcugccgcgccuggagcugucccccacaccuccacagagacccaagccucucggugcaaaaagggcuucagccaggacaaacaguguuuucugcuuuccgggaacgcccaggaaacacgcaaggugaaagagucuauggaaacccauuucggaagccacggcagacgggcuauucuguaucgcccucccuuuuacuccaagacagagcuccaacugcaucagcacauccugacccagcauggguauacgguugugauugccgaagagagacucaaugcuggacugggcccuggccuucuggagcagggggaucucggaucuugggaccugcuuaucugccugagcuccaagaaagccgaaggcaccccguguauuagcaaggaggucaugugccaacucgggcugcaccagaaagcgaaccggcugcccgaaauccagcagccucucugucgcaaggagggacugugccaaaucgugagacgguuccccgagcuucagcugccuguuucucccuccgugugucucgaucagggcaugcaacugaaaccgagcacaucuucccaccuucugaagaccgucaagccucgcguguggaaacccggggacuggagcagagaacagcucaaugagacaaccgugcuggccccucaugaaacgauuuuucgggcugaggaucugucugucauccucaaggccuacguucuggugacaucccuuacaccccugagagcuuucauucacagcaccggaaccguguggaaucccccuaaaaagaaacgcuuuaccgucaagcuccagacauucuuugaaacguuccugcgggccuccucuccgcagcaagcguucgacaucaugaaagaggccauuggcaaacuucugcucgcugccgagguguuuagcgaaaccuccacacugggccccaagaccuuccauagaugccgcuuuugcuuccagcugcucacauuugauaucggguauggaucuuucauguacccuguugugcugcagguccacgagcaccuuaacuuucaggacuaugauaacauggacuucgaagaucaaaauaccgaggaauuucugcucaacgacacguucaauuuucuguuccccaacgagucuucccugagcauuuuuagcgagaucuuccagcggcuuuacagaagcgauguguucaagggcgaaaauuaccagaaggagcucaaccagugucugucccuggaagagaucaauucuauuaugacauuuaucaaagaacucgggagccugggacaauuccagcuucuguuuccuuccaccacccccggcauucagagccucaugcaugaguucuaugacguugcuaacccgguggggaauccuggaucuguccugacacaguacuggucccugcuuaacguguuugagcaauuccaguuuaugaacaagaaaacccagccccacccucucgaauggaauagcuucacagaggacaagaacaucgaaaagccccaagucccuuuugaugccauugagaauaaaaaggccgcugugccccagaucaaaaacgagaauaaggaaauccauugcucugacgaugagaacacgccgugucacauuaaacagaucuucacccauccucaccuggaacugaaucccgacuuucaccccaagauuaaggauuauuacugcgagguuccuuucgacguggucacagugaccaucggcguugaaacaccgaaaugucucugcaaggugcaucuguaugagcaggcgggccccuccuuugccagcuacccucuugggcugggaaugaacaaaauuuccaucuucgucguggaugagucucccgcucacggcgaaacccucaucacguauaagcugaccauuuaccgcgaggaccggccuagccugccccuuuucgaagccuuuacagccuguggguucgugcaagauugcggacuccugauccauccugaggaaaccuguggccugcagcccauuuccucugacuacaucgaggcuauucuccagagcgagcugaaaagaugcccguccggggauaugaagggccaguggaucguuccuugucuuagcugcucugacaaucgcacaugcgacuggcgggaaauuaccuggcaaccccacaacugucaguauggaguccugacgaagccucagcuccagcaaugccugggcgggagaaaacugggaguggaugugcagcgcgucccccgguccagaaauuga

SEQ ID NO: 67802 - RNA, 1431 nt, Artificial Sequence
  derived and/or modified sequence opt5 from CPE__Homo_sapiens__NP_001864
auggccggcagagggggaagcgcucugcucgcccugugcggcgcgcuugcugccuguggguggcugcucggagccgaggcucaggaacccggcgccccugcugccgggaugcggcgcagacggcgccugcaacaggaggacggaaucuccuucgaauaccacagauauccggagcuucgggaagcgcuggugucugucuggcuccagugcaccgccauuagccgcaucuacacaguuggcagauccuuugagggccgggagcugcuggugauugaacucucugauaaccccggggugcaugagccuggagaacccgaguucaaguauaucggcaauaugcacgggaacgaggcugucggacgcgaacugcuuauuuuucuggcccaguaccucuguaaugaguaucaaaaaggcaacgaaacgaucgugaaucugauccauagcacccggauucacaucaugccuucccuuaaccccgacggguucgagaaggcugccucucagccuggagaacugaaagauugguuuguuggcagaagcaaugcgcagggcauugaccucaaccgcaauuucccggaucuggacagaaucguguacgucaacgagaaggaagggggacccaauaaccaucugcucaaaaauaugaagaagauuguggaucagaacacaaaacuggccccugagaccaaggcuguuauccacuggauuauggacauccccuuugugcuuuccgccaaucugcacggcggggaucucgucgcuaacuauccuuacgacgagacacggagcggaucugcccaugaauacuccagcucucccgaugacgccaucuuccaaucccuggcucgcgcguauagcucuuuuaacccggccauguccgauccuaauagacccccuugccggaaaaacgacgacgauagcuccuucguggacggcaccacaaaugggggagcuugguacucugugcccggcggcaugcaggauuuuaacuaucuuagcuccaauuguuucgagauuaccgucgaacugagcugcgagaaguuucccccugaggaaacgcucaaaaccuacugggaggacaacaaaaauucucugaucuccuaucuggaacagauucacagagggguuaagggauucgugcgcgaucuccagggcaacccgaucgccaaugccacaauuagcguggaggggaucgaccaugaugucaccucugcuaaggacggagauuacuggcggcugcuuauccccggcaacuauaagcugacagccagcgcgccuggguaccucgcuauuaccaaaaagguggccguucccuacuccccugccgcuggcguggacuucgaacuggagucuuuuagcgagagaaaagaagaggaaaaggaggagcuuauggaaugguggaaaaugauguccgagacgcugaauuucuga

SEQ ID NO: 67803 - RNA, 3198 nt, Artificial Sequence
  derived and/or modified sequence opt5 from CP__Homo_sapiens__NP_000087
augaagauccugauucucggcaucuuccuguuucuuugcagcacccccgccugggcuaaagagaagcacuacuauauugggaucauugaaacaacgugggacuacgccuccgaucauggagagaaaaagcugaucucuguggacaccgaacacagcaacaucuaucuccagaauggcccugauagaauugggcggcuguacaaaaaggcgcuuuaucugcaauacacagacgagaccuuccgcacaaccaucgaaaagccggucuggcucggauuucugggccccauuaucaaagcugagacaggggauaagguuuaugugcaucugaaaaaccucgccuccagaccuuacaccuuccacucucauggaauuacguacuauaaggagcacgaaggcgccaucuaccccgacaauaccacagauuuucagcgggcugacgauaaaguguauccuggcgagcaguacaccuauaugcugcuugccacagaagaacagagccccggggagggagacggcaacugugucacccgcauuuaccacucccauaucgaugcuccuaaggacaucgccucugggcugauuggaccgcucaucauuugcaagaaagauagccuggacaaggaaaaagagaagcacaucgacagagaguucgugguuauguuuuccguggucgaugagaauuucagcugguaucuugaagacaacauuaaaacguacuguucugagcccgagaagguggauaaagacaaugaagauuuucaagaguccaaccggauguacagcguuaauggcuauacauucgggucucugccuggacucuccaugugcgcggaagaccgcgugaagugguaccuguuuggcaugggcaacgaggucgaugugcaugccgcuuucuuucacgggcaggcccugaccaauaagaacuauagaaucgacacaaucaaucucuuccccgcuacccuguucgaugccuacaugguggcgcagaacccuggagaauggaugcuuagcugucagaaucugaaccaccucaaagccggccugcaagccuuuuuccagguccaggagugcaacaagucuuccagcaaagacaauauucgggggaagcauguucgccacuauuacaucgcugcugaggaaauuaucuggaacuaugcccccuccggaauugauaucuuuaccaaagagaaucuuacagccccgggcucugacagcgcuguguucuuugaacaggggacgaccagaaucggaggcuccuacaagaagcugguguaccgggaguauacagacgcgagcuucaccaaccgcaaagaaagaggcccugaggaggaacaucucgggauucugggacccgucaucugggccgaggugggcgauacaauucggguuaccuuucacaauaagggggcuuacccucugucuaucgaacccauuggagugcgcuucaacaaaaauaacgagggcacguauuacucccccaauuauaacccucaaagcagaucugucccgcccagcgccucccauguggccccuacagagaccuuuaccuacgaauggacaguucccaaggagguggggccuaccaaugcugaccccgucugucucgccaaaauguauuacucugcgguggauccgacaaaggacaucuucacgggccugauuggaccuaugaagaucugcaaaaagggcagccuucacgcuaacgggcggcagaaagaugucgacaaggaauuuuaccuguuccccaccguguuugaugagaaugaaucccuccugcuugaggacaacaucagaauguucacaaccgccccugaucagguugacaaagaggaugaagacuuccaagagagcaauaagaugcacucuaugaacggauuuauguauggcaaccagcccgggcugacaauguguaagggagauuccguggucugguaccucuucagcgccggcaaugaagcugacgugcaugggauuuauuuuucuggcaacaccuaccuguggcgcggagagcggagagacacggccaaucuguucccucagaccucccucacacugcacauguggcccgauaccgaaggcacauuuaacguugagugccuuaccacggaccauuauacagggggaaugaaacagaaguacaccgugaaucaaugucgccggcagagcgaggauuccacauucuaucugggcgaaagaaccuacuacaucgcugccgucgagguggaaugggacuauucuccgcagcgcgagugggaaaaagagcuccaccaucugcaggagcaaaacgugagcaaugcguuucuggauaagggggaguucuacauuggauccaaauauaagaaaguugucuaccggcaguauaccgacucuacauuuagagugccuguggaacgcaaggccgaagaggagcaccuuggcauccucgggccccagcugcacgcugaugucggcgacaaggugaaaauuaucuucaagaacauggccacgcggcccuacagcauccaugcucacggaguucagaccgaauccagcacagugaccccuacacugccgggcgagacccucacguaugucuggaaaauucccgaaagaucuggggccggaacagaggauuccgcgugcaucccuugggccuacuacagcaccguggaccaaguuaaggaucuguauucuggccuuauugggccccugaucgugugccgccggccuuaccucaaagucuuuaaucccagacggaagcuggaguucgcucugcuuuuucucguguucgacgaaaacgaguccugguaucuggaugacaauauuaagaccuacagcgaccauccugaaaaaguuaacaaggaugacgaggaguucaucgaaucuaauaaaaugcacgccaucaacggacgcauguuuggcaaucugcaggggcucacaaugcacgugggcgaugaagucaacugguaucugaugggaaugggcaacgagauugaccuucauaccgugcacuuccaugggcacagcuuucaguacaagcauagaggaguguauuccagcgaugucuucgacaucuuucccggcacauaccagacgcuggagauguucccgcggaccccugggauuuggcuccugcacugucacguuacagaucauauccacgcuggaauggaaaccacauacaccgugcugcaaaaugaggacacgaaaucuggcuga

SEQ ID NO: 67804 - RNA, 405 nt, Artificial Sequence
  derived and/or modified sequence opt5 from CPLX1__Homo_sapiens__NP_006642
auggaguucgugaugaagcaggcccugggcggggcuaccaaagacaugggaaagaugcucggcggggaugaagagaaagaccccgaugccgcgaagaaagaagaggaaagacaagaggcucugcggcaggccgaggaggaacgcaaggccaaguacgcuaaaauggaagccgagagagaggcuguccggcagggaauccgcgacaaguauggcauuaaaaagaaagaagagagagaagccgaggcgcaggccgcuauggaagccaacagcgaggggucccuuacacggccuaagaaggcuaucccgcccggaugcggcgaugagguugaagaggaagacgagucuauucuggauacggugaucaaauaccucccuggcccccugcaagacaugcuuaagaaauga

SEQ ID NO: 67805 - RNA, 405 nt, Artificial Sequence
  derived and/or modified sequence opt5 from CPLX2__Homo_sapiens__XP_011532721
auggacuucgugaugaagcaggcccugggcggggcuaccaaagauaugggaaagaugcucggcggggaggaagagaaagaccccgaugcccaaaagaaagaagaggaaagacaggaggcgcugcggcagcaggaggaggaacgcaaggcuaagcacgccagaauggaagccgagcgggagaaaguccgccaacagaucagagacaaguacggacuuaaaaagaaagaagagaaggaagcugaggaaaaggccgcucuggagcagccuugcgagggcagccucacacggccgaaaaaggccauucccgcgggguguggagaugaagaggaagaggaagaggaguccauccuggacacgguucuuaaauaucugccuggcccccuccaggauauguuuaagaaauga

SEQ ID NO: 67806 - RNA, 477 nt, Artificial Sequence
  derived and/or modified sequence opt5 from CPLX3__Homo_sapiens__NP_001025176
auggccuucauggugaagaccauggucggcgggcagcugaaaaaccucacaggaagccugggcgggggagaggacaagggcgauggggacaaauccgcugccgaagcgcaaggaaugucuagagaggaauacgaggaauaucagaagcagcuuguugaggagaaaauggaacgggaugcucaguuuacgcaacgcaaggccgagagagccacccugcggagccacuuccgcgacaaguacagacuccccaaaaaugaaacagaugagucccagauccagauggcuggcggcgacguggagcugccucgggaacuugccaagaugauugaggaagauaccgaggaagaggaggaaaaggcuucugugcuggggcagcucgccagccugccgggacugaaccucggcucccugaaagacaaagcgcaagccacacuuggggaucugaagcagucugcugagaagugccaugucauguga

SEQ ID NO: 67807 - RNA, 483 nt, Artificial Sequence
  derived and/or modified sequence opt5 from CPLX4__Homo_sapiens__NP_857637
auggccuuccugaugaaaagcaugaucuccaaccaggugaagaaucucggcuuugggggaggcucugaggaaaacaaggaggaagggggagcuagcgaccccgccgcggcucaaggcaugaccagagaggaauacgaggaguaucagaaacagaugauugaagagaagauggaacgggaugccgccuucacacagaaaaaggcugagcgcgccugccugagaguccaccuucgggagaaguaccgccugccuaaauccgaaauggacgagaaucaaauccagauggcuggggaugacguugaucucccggaagaccugagaaagaugguggaugaggaccaggaagaggaggaagauaaagacucuauucuuggacagauccaaaaccugcagaauauggaucucgacacgauuaaggagaaagcccaggcgaccuuuacagaaaucaagcagaccgccgagcaaaaguguagcgugauguga

SEQ ID NO: 67808 - RNA, 1332 nt, Artificial Sequence
  derived and/or modified sequence opt5 from CPM__Homo_sapiens__NP_001005502
auggacuuccccugccuguggcucggccugcuucugccucucguggccgcucuggauuuuaacuaccacagacaggaggggauggaagccuuccuuaagaccgucgcgcaaaauuauagcuccguuacacaucugcacucuaucggaaaaagcgugaagggccggaaccucugggugcuggucguggggcgcuuuccgaaagagcauagaauuggaauccccgaguucaaguacguugcuaauaugcacggcgacgaaacgguggggcgggaacugcuccugcaucuuauugauuaucuggucaccuccgacggaaaagauccugagaucacaaaccucauuaauucuacccgcauccacaucaugcccagcaugaacccugacggcuuugaggccgugaagaagcccgauuguuacuauuccauuggcagagaaaauuacaaccaguaugaccugaaucggaacuucccugaugccuuugaguacaauaacguuucucgccagccggaaacaguggcugucaugaaauggcuuaagaccgagacauucgugcugagcgccaaucuccacgggggagcucugguggccuccuaccccuuugacaacggcguccaggcgaccggggcccuguauagcagaucucucacgccugaugacgauguuuuccaauaccuggcucauaccuaugccucccggaaucccaacaugaaaaagggagacgagugcaaaaacaagaugaauuuuccuaacggcgugacaaauggguacagcugguauccccuucagggaggcaugcaggacuacaacuauaucugggcucaguguuucgaaauuacccuggagcucucuugcuguaaguacccgcgcgaagagaaacugccuuccuuuuggaauaacaauaaggccagccuuaucgaauacauuaaacaagugcaccugggcgucaagggacagguguucgaucagaacgggaauccccucccuaacguuaucguggagguccaggacagaaaacauauuugccccuaucggacaaauaaguacggcgaguauuaccugcugcuccugcccgggucuuauaucaucaacgugaccguuccuggacacgauccgcacauuacgaaagugaucauucccgaaaagucccaaaauuucagcgcgcuuaagaaagacauccugcucccuuuucagggccagcuggauuccauucccgucucuaacccuagcugucccaugaucccgcuuuaccgcaaucugccugaccauuccgccgcuacaaagcccagccucuuccuguuucuggugucucuccugcacaucuucuuuaaauga

SEQ ID NO: 67809 - RNA, 1419 nt, Artificial Sequence
  derived and/or modified sequence opt5 from CPN1__Homo_sapiens__XP_011537601
augagcgaccugcucuccguguuccugcaccuucugcuccuguuuaaacuugucgcccccguuaccuucagacaucaccgguacgaugaccuggugcgcacacucuauaaagugcagaacgagugcccuggcaucacgagagucuacucuauugggcggagcguggaaggacgccaucuguauguucuggaguuuuccgaucacccgggcauccaugaaccccucgagccugaagugaaguacgucgggaauaugcacggaaacgaggcucugggcagagagcuuaugcugcaacucucugaguuccugugugaagaauuucggaaucgcaaccagagaauugugcagcuuauccaggacacccggauucacauccugcccagcaugaauccugauggguaugagguugccgcggcucaaggacccaacaaaccuggcuaccucgugggccgcaauaacgccaauggggucgaccugaacagaaauuucccggaucugaacacauauaucuacuacaaugagaaguauggaggccccaaccaucaccucccucugcccgacaauuggaaaucccagccucagcuugcccugcaucggcagccccucgcuucuagccaaguggaaccggagacccgcgccgugauuagauggaugcacuccuuuaacuucguccugagcgcuaaccuucacgggggagccguuguggcgaauuacccuuaugauaagucuuuugaacaucgggugcgcggcgucagacggacagccuccacccccacaccugacgauaagcuguuccagaaacucgcuaagguguacagcuaugcccacggguggauguuucagggauggaacugcggcgacuacuuccccgauggcaucaccaauggggcuucuugguauucccugagcaaaggaaugcaggacuuuaacuaccugcauacgaauuguuucgagauuacccucgaacugucuugcgacaaguuucccccugaggaggaacuucaaagagaguggcugggcaaccgcgaagcccucauccaguuccuggagcagguucaccaagggauuaaaggaauggugcuugaugaaaauuacaacaaucuggcgaacgccgucaucuccgugagcggcauuaaucaugacguuacauccggggaucacggagacuauuuccggcuccugcugccgggcaucuacaccgugucugcuacagcccccggcuaugauccugagaccgucacggugacagucgggcccgcugagccuacccucgugaacuuucaccugaagagaagcaucccccagguuuccccggugcgccgggccccuagcagacgccauggaguccgggccaaggugcagccccaggcuagaaagaaggaaauggagaugcgccaacuucagcggggcccugcguga

SEQ ID NO: 67810 - RNA, 1638 nt, Artificial Sequence
  derived and/or modified sequence opt5 from CPN2__Homo_sapiens__NP_001278917
augcugcccggcgccuggcuccuguggaccagccuucugcuccuggcuagaccugcccagccgugccccauggggugugacugcuucgugcaagaggucuuuuguuccgaugaagaacuugcgacaguuccucuggacauucccccuuacacgaagaacauuaucuucguggaaaccucuuuuacaacccucgagacacgggcuuucggaagcaaucccaaccugaccaaaguggucuuucugaauacacagcucugccaguuccgcccugaugccuuuggcgggcugccgagacuugaagaccuggaggugaccggauccucuuuccucaaccugagcacgaauaucuuuuccaaccuuaccucucugggcaagcucacacugaauuucaacaugcuggaggcccuccccgaagggcuguuucagcaccuugcugcccuggagagccuccaucugcaaggaaaucagcuucaggcucugccucggcgccucuuccagccccugacccaccugaaaacacucaaccuggcccaaaaucuucuggcgcagcucccugaggagcuguuucauccccuuaccucccugcagacgcucaagcugagcaacaaugcccugucuggccucccgcagggcguuuucgggaaacugggaucccuucaagagcuguuccucgauagcaacaauaucucugaacugccuccccagguguuuucccagcuguucugucuugagagacucuggcugcaacggaacgcuauuacacaucugccucucagcaucuuugccucucugggcaaccuuaccuuccugucccuccaguggaauaugcugcgcguccugcccgcugggcuuuuugcccacacacccugccucgugggacugagccugacccacaaccagcucgaaaccguugcggagggcacauucgcccaccuguccaaucuuagaucucugaugcucagcuauaacgcuaucacgcaucugccugccgggauuuuucgggaccuggaggaacuugugaagcucuaccugggauccaauaaccugaccgcucuccacccggcccuguuccagaaucuuagcaagcuggagcuccugucucuguccaaaaaccaacuuacaacccuccccgaaggcaucuuugauacaaauuauaaccuguucaaucuggcccuccauggcaacccuuggcagugugacugccaccuggcuuaccuuuuuaauuggcugcagcaguauaccgaucgccuccugaacauucaaacguacugugcggggcccgccuaucugaagggacaggucgugccugcucuuaaugagaaacagcuggugugccccgucacaagagaccaccucggcuuccagguuaccuggccggaugaaagcaaggccgggggaucuugggaccuggccgugcaagagcgggcugcccgcagccaguguaccuacuccaacccugaaggcacagugguccucgcgugcgaucaggcucagugcagauggcugaacgugcaacuuucuccccagcaggggagccugggacuccaauacaaugccucccaggagugggaccugcggagcucuuguggcucccugcgccuuaccguuagcaucgaggccagagcugccggcccuuga

SEQ ID NO: 67811 - RNA, 1611 nt, Artificial Sequence
  derived and/or modified sequence opt5 from CPNE1__Homo_sapiens__NP_001185792
auggcccacugcgugacccugguccaacucagcaucuccugugaccaucugauugauaaggacaucggcucuaaaagcgauccccuuugcguucugcuccaagacgucgggggaggcuccugggcugagcuggggagaacagaacgggugcgcaacuguucuagcccugaguucuccaagacgcuucagcuggaauacagauuugagaccgugcagaaacuccgguucggaauuuaugauaucgacaauaagacaccggaacugcgcgaugacgauuuucugggcggggccgagugcucucucggacagauugugagcucccaaguucugacccuuccccugaugcucaaaccuggcaagcccgcgggcagagggacaaucaccgugagcgcucaggagcugaaggacaaccgggucgugacaauggaaguugaggcccgcaaucuugauaaaaaggacuuccugggaaaaucugauccuuuucucgaguucuuuagacagggcgacgggaaguggcaccugguguaccgguccgaagucaucaaaaacaaucugaaccccaccuggaagcgcuucagcgugccugugcagcauuuuuguggaggcaauccgucuacgcccauucaaguccagugcuccgacuaugauagcgacgggucucacgaucucaucggaaccuuccauacaucccuggcccagcuucaggcuguuccugccgaguuugaauguauucaccccgagaagcaacagaaaaagaaaagcuacaagaacuccggcaccaucagagugaaaauuugccggguggaaacagaguauucuuuccuggacuacgucaugggcgggugucagaucaauuuuaccgugggaguugauuucacgggcagcaacggggacccuuccagccccgauucucuccacuaucuguccccgacaggagugaaugaauaccuuauggcucuguggagcgucggcucugugguucaagacuacgauagcgacaaacucuucccugccuuuggguucggagcccaggugcccccugauuggcaggucucccaugaguuugcccugaacuucaaucccucuaaccccuauugcgcuggcauucagggcaucguggacgccuaccgccaagcucugccucaggucagacucuaugggccgaccaauuuugcccccaucauuaaccacguggcgcgguucgccgcucaggccgcucaucagggaacagccagcuacuuuaugcugcuucugcucaccgacggcgccguuaccgauguggaggcuacacgcgaagcggucgugagagccuccaaccugccuaugagcguuaucauugugggggucggaggcgcugacuucgaggccauggaacaacuugaugccgacgggggcccccugcacacgcggucuggacaggcugccgcgagagauaucgugcaguuugugccuuaucgccgguuccagaaugcucccagagaggcccucgcccaaaccguucuggcugaagucccgacacagcugguguccuacuuucgcgcccagggcugggcuccucucaagccccugccucccagcgccaaggacccugcgcaggcgccccaggcuuga

SEQ ID NO: 67812 - RNA, 1647 nt, Artificial Sequence
  derived and/or modified sequence opt5 from CPNE2__Homo_sapiens__NP_689940
auggcccacauccccagcggcggggcuccugccgcgggagcugccccgaugggcccccaguacugcguguguaaggucgagcucuccguuucugggcagaaccuccuggacagagaugugaccagcaaauccgacccuuucugcgugcuuuuuacagaaaauaacggacgguggauugaguaugaucgcacggaaaccgccaucaauaaccugaaucccgcuuucucuaagaaauuuguccucgacuaccauuucgaggaagugcagaagcugaaauuugcccuuuucgaucaggacaagagcuccaugagacuggaugagcacgacuuucucggccaguucucuuguagccuggggacaauuguuuccagcaagaaaaucacccggccucugcuccugcuuaacgauaagcccgcuggaaaaggccugauuacaaucgccgcgcaagagcucucugacaaucgcgugaucacccugucccuugccggcagacggcuggauaagaaagaccucuuuggaaagagcgauccuuuccuggaauuuuauaagccgggggacgacggcaaauggaugcugguccaucgcacagaggugauuaaguacacccucgaucccguuuggaaaccuuucacggugccccuggucucucuuugcgacggggauauggaaaagccuauccaggugauguguuaugacuacgauaacgacggaggccacgauuuuauuggggaguuccagaccuccgugagccagaugugcgaggcuagagacucugucccccuggaguucgaauguaucaauccgaaaaagcaacggaaaaagaagaacuauaaaaauuccggaauuaucauucuccgcagcugcaagaucaacagagauuacuccuuucuggacuacauccuuggcggcugucagcugauguucacaguugggauugauuuuaccgccucuaauggaaacccucucgaccccagcucccugcauuauaucaauccuaugggcacaaacgaauaccugagcgcuauuugggccguggggcagaucauucaggacuaugauucugacaaaauguuccccgcgcucggauuuggcgcccaacugcccccugauuggaaggugucccacgaguucgcuaucaacuuuaauccgaccaaccccuucugcagcggggucgacggaaucgcccaggcuuacucugccugucuuccucacauucgguuuuauggccccacgaauuucagcccuaucgugaaccauguugcccgcuuugcugcgcaggccacacaacagagaaccgcuacacaguacuucauucugcucaucauuaccgauggcgugaucuccgacauggaagagacccggcacgccgucgugcaggccucuaaacugcccaugagcaucauuaucguuggggugggaaaugcugauuuugccgcgauggaguuccuugacggcgauucccgcaugcugagaagccauacaggggaagaggcugcccgggacauuguccaauucgugccguuuagagaguuccgcaacgccgcuaaggaaacgcucgccaaggcuguccuggccgaacugccucaacaggugguucaguauuuuaaacacaagaaucugcccccuaccaacucugagcccgcguga

SEQ ID NO: 67813 - RNA, 1614 nt, Artificial Sequence
  derived and/or modified sequence opt5 from CPNE3__Homo_sapiens__NP_003900
auggccgcucagugcgugaccaaggucgcccugaacguuagcugugcgaaucuccuggacaaagauaucggcuccaagucugacccccuuugcgugcuguuccucaacacaagcgggcaacagugguacgagguggaaagaacggagcggauuaaaaauugucugaacccucaguuuuccaagaccuucaucauugauuauuacuuugaagucgugcagaaacuuaaguucggaguuuaugacaucgauaauaagacaauugagcugucugacgaugacuuucucggcgaaugcgaguguacccuggggcaaaucgugagcuccaaaaagcugacacgcccgcucgucaugaaaaccggaagacccgcuggcaaggggucuaucacaauuagcgccgaggaaaucaaagauaaccgggugguucuguucgagauggaagcccgcaaacuugacaauaaggaucuguuuggaaaguccgacccuuaccucgaguuccacaagcagaccagcgauggcaacuggcugauggugcauagaacggaggucgugaaaaauaaccuuaaucccguguggcggccuuuuaagauuucucugaacucccucugcuauggcgacauggacaaaaccaucaaggucgaauguuacgauuaugacaaugaugggagccacgaccugauuggaacauuccagaccacaaugaccaaacugaaggaggcuucucgcuccagccccguugaauuugagugcaucaacgaaaagaaaagacagaagaaaaagucuuacaaaaauuccggcgugauuagcgugaagcaaugugagaucacggucgagugcacauuccucgauuacaucaugggagggugucagcugaacuuuaccgugggcguugacuucacaggguccaacggagauccucggucuccggacagccuucauuauauuucccccaauggcgugaacgaauaccugaccgcccucuggagcgucggccuggugauccaggauuaugacgcugauaagauguucccugccuuuggguucggagcgcagauucccccucaauggcagguuucucacgaguuucccaugaauuucaacccguccaauccuuacugcaacggcauccaggggauuguggaagccuaucgcagcugccuuccccaaaucaaacuguacggaccuaccaauuuuucucccaucauuaaccaugucgcuagauucgccgcugccgcgacacagcagcagacggccagccaauauuuugugcuccugaucauuaccgacggcgucaucacagaccuggaugagacccggcaggcuauugugaaugccucccgccuccccaugucuaucaucauuguuggggugggaggcgcugacuucagcgccauggaauuucuggauggcgacgggggaucccuuagaagcccucugggcgaggucgccauccgggauauugugcaguucguuccguuucgccaguuccaaaacgcucccaaggaggcgcucgcccagugugugcuggcugaaaucccucagcaggucgugggguacuuuaauacauacaaacuucugcccccuaagaaccccgccaccaaacaacagaagcaguga

SEQ ID NO: 67814 - RNA, 1728 nt, Artificial Sequence
  derived and/or modified sequence opt5 from CPNE4__Homo_sapiens__NP_001276041
auggccguggagcccagcuccucugaaagcaucaagagacgggcuggccgcagaaugaaaaagauguccaacauuuacgagucugccgcgaauacccuggggaucuucaacagcccuugccucacaaaagucgaacugcggguugcuuguaagggaauuuccgaccgcgaugcccuuucuaaaccggaccccugcgugauccugaagaugcagagccacggccaaugguuugagguggauagaacggaagucauucggaccuguaucaauccuguguauuccaagcuguucacaguugacuuuuacuucgaggaggugcagcgccugagauuugaaguccaugauaucagcucuaaccacaaugggcuuaaagaggccgacuuccugggaggcauggaaugcacccucgggcagauugugucccagcggaagcugagcaaaucucugcucaagcauggaaacacagcuggcaaauccagcaucaccguuauugccgaggagcugucuggcaaugaugacuauguggaacuugcuuuuaacgcccgcaagcuggaugacaaggauuucuuuuccaaaagcgaccccuuccucgagaucuuuagaaugaaugaugacgcgacacaacagcugguccaccggaccgaaguggugaugaacaaucuuuccccugccuggaagucuuucaaagucagcguuaacucccuguguagcggggaccccgaucgcagacucaagugcauugugugggacugggauucuaauggaaaacaugacuuuaucggcgaguucacguccaccuucaaggaaaugcgcggggcuauggagggaaaacaggugcagugggaguguauuaacccuaaguacaaggccaaaaagaaaaauuauaagaacagcggcacagucauccugaaccugugcaaaauccacaagaugcacucuuuucucgauuacauuaugggagggugucaaauccaguucaccguggcuauugacuuuacagccagcaauggcgauccgcggaacuccugcucucugcauuauauccaccccuaccagccuaaugaauaccuuaaggcgcugguugccgugggcgagauuugucaggacuaugauagcgacaaaauguuccccgcuuuuggguucggagccagaaucccucccgaauacaccgucucccaugauuuugcuaucaacuucaaugaggacaacccggaaugcgccggcauucaaggggugguugaggccuaucagagcugccucccuaagcugcagcuuuacggacccacgaauaucgcuccuauuauccaaaaaguggcgaagucugccuccgaggaaacaaacaccaaagaggcuagccaguauuuuauucugcucauccugacagacggcgucaucaccgauauggccgacacccgggaagccauugugcacgcuucucaccuccccauguccgucaucauuguggggguuggaaaugccgauuucagcgacaugcagaugcucgauggcgacgauggcauccugagaucccccaagggggagccugugcuucgcgacauuguccaguuugugccguuccggaacuuuaagcaugcgucucccgcugcccuggccaaaagcguucucgcugaagugccuaaucaagucguggauuacuauaacggaaagggcaucaaacccaaguguuccucugagauguacgagagcuccagaacacuggccccuuga

SEQ ID NO: 67815 - RNA, 1902 nt, Artificial Sequence
  derived and/or modified sequence opt5 from CPNE7__Homo_sapiens__NP_055242
augagcgccggcuccgagagaggggcugccgcgacccccggaggccugccugcuccgugcgccucuaagguggaacuccggcugagcugucgccaccuucuggacagagauccccucacaaaauccgacccuucugucgcccugcuucagcaagcucaggggcaguggguucaggugggacggacggaggugguccgcagcucccugcaucccguguucucuaagguuuuuaccguggauuacuauuucgaagagguccaaagacuccgguuugaaguguacgacacacacggcccuagcggguucuccugccaggaggaugacuuucugggaggcauggaguguacccugggccagcccgcccagaaauggcuccugcaaguugugaugcgcgucagcguggaugugcuugggccugcuggacauugcgccaagcacuuccuguguugcacagaaucuucccaucucgcgagaaccggcccgagcuuucugcuucgguaugacgaucugugucuccccugggccacagcuggggccguccgcugguggaccugcagaggaggccacacgcagggguggcagaucguugcucagaaaaaggugacccggccucugcugcucaaguucggacgcaacgccggcaaaucuacaauuaccgugaucgcggaggacauuuccggcaauaacggguacgucgaacugagcuuuagagcccggaaacuugaugacaaggaucuguucucuaaguccgaccccuuucucgagcuguaucgcgugaaugacgaucaaggacuucagcugguuuacagaacagagguggucaaaaacaaucucaacccugugugggaggcuuucaagguuagccuguccucucuguguagcugcgaagaaacccggccccucaagugucuggugugggacuaugauuccagaggcaaacacgacuuuaucggggaguucagcacgacauucgaagagaugcagaaggccuuugaggaaggacaagcucagugggauugcgucaauccgaaauacaagcagaaacgccggucuuacaagaacuccggcguggucgugcuugccgaccugaaauuccauagaguuuauagcuuucucgauuacauuaugggagggugccagauccacuucaccguggccaucgacuuuacagcuucuaauggcgauccucgcaacagcuguucccugcauuauauuaaucccuaccaaccuaacgaguaucuuaaggcgcuggucucugugggcgaaaucugccaggacuacgauagcgacaagcgguucuccgcccucggguuuggagcucgcauuccucccaaauaugagguuagccacgacuucgccaucaauuuuaaccccgaagaugacgagugugagggcauucaggggguggucgaagccuaccagaauugccugccgagagugcaacuguacggacccaccaacguggcuccuaucauuucuaagguugcccgggucgcggcugccgaggaauccaccggcaaagccagccaguauuacauccuccugauccuuacagaugggguggugacggacauggcugauaccagagaggccauuguccgcgcuucucggcugcccauguccaucauuaucgugggcguuggaaacgccgacuucacagauaugcagguccucgacggcgaugacggggugcugagaagcccucgcggagaacccgcgcugcgggauauugugcaguuuguuccguucagagagcuuaagaaugccuccccugcugcccucgcuaaaugugugcuggccgagguccccaagcaagugguugaauauuacucucaccggggccugccuccccgcagccucggggugccugcgggagaggccucccccggcugcaccccguga

SEQ ID NO: 67816 - RNA, 1695 nt, Artificial Sequence
  derived and/or modified sequence opt5 from CPNE8__Homo_sapiens__NP_705898
auggacagcagauacaacuccaccgccggcaucggggaucugaaucagcucucugcugccauucccgcgacacggguggaggucagcguuuccugccgcaaccugcuugacagagauacguucucuaagagcgacccuaucugugugcuguaugugcaaggagucggcaauaaagaauggcgggaguuugggcgcaccgaagugauugauaacacacucaauccggacuucguuagaaaguuuauccuggauuacuucuuugaggaacgggagaaccuucgcuucgaccuguaugauguggacuccaaaucucccaaucucagcaagcacgauuuucugggacaggucuucugcacccugggcgagauuguggggucccagggaagcagacucgaaaaaccuaucguuggcauccccggcaagaagugugggacaauuauccugaccgcugaggaacuuaacugcugucgggacgccgugcugaugcaguuuugcgccaauaaacucgauaagaaagacuucuuuggaaagucugacccuuuccuggucuuuuaccgcuccaacgaggauggcagcuucacaauuugucauaaaaccgagguggugaagaauacgcuuaaccccgucuggcaagccuucaagaucucuguuagagcccugugcaauggggacuaugaucggaccauuaaaguggaaguguacgacugggaucgcgacggaucccacgauuuuaucggcgaguucacaaccagcuauagagaacucucucgggggcagucccaguuuaacgucuacgaggugguuaauccuaagaaaaagggcaaaaagaaaaaguacacaaacagcggaaccgugacgcugcuguccuuccucgucgaaacagaggugucuuuucuggacuauauuaagggcgggacccagaucaacuucacaguugcuaucgauuuuaccgccagcaauggaaacccggcgcaacccaccucccuucauuacaugaauccuuaucagcugaacgccuacggcauggcucucaaagccgugggggagauuguccaggacuaugauagcgacaagauguuccccgcucugggauuuggcgccaaacuuccucccgacgggcgcaucucucacgaguucgcgcugaauggaaacccgcagaauccuuacugugauggcauugaaggcgugauggaagccuauuacagaucccucaagagcguccaacuguacgggcccacaaacuuugcuccugugaucaaucauguugcccgguaugcuucuagcgugaaagacggaucccaguacuucguccugcucauugugacggauggcguuaucucugacauggcccagaccaaggagagcaucgugaacgccuccaagcugcccaugagcauuaucauugucggggugggacccgcugaauuugaugcgaugguggagcuugacggcgaugacguuagagucucuucccgcgggaaauaugccgagcgggauaucgugcaauucgugccuuucagagacuacauugaucgcagcggcaaucacauccugucuauggcucggcucgccaaggacguccuggccgaaaucccggagcaguuucuuuccuauaugagagcucgcggaauuaaacccagcccugcucccccucccuacacaccgccuacccacgugcugcagacacagaucuga

SEQ ID NO: 67817 - RNA, 1125 nt, Artificial Sequence
  derived and/or modified sequence opt5 from CPO__Homo_sapiens__XP_011508929
augaagccccugcucgagacccuguaccuucugggcaugcucgugccugggggacugggcuaugacagaagccuugcccagcaccggcaagaaaucgucgauaaauccguuucuccguggagccuggagacauacuccuauaacauuuaccaucccaugggggaaaucuaugaguggaugcgcgaaauuucugagaaguacaaagagguggugacgcagcacuuccucggagucaccuaugaaacacauccuauguacuaccugaagaucagccagcccuccggcaauccuaaaaagauuaucuggauggacugcgggauccacgcuagagaguggauugcccccgcguuuugucagugguucgugaaggaaauccugcaaaaccauaaagauaauucuagcauucggaagcuccugcgcaaccuugacuuuuauguucugccugugcucaauaucgauggauacauuuauaccuggacaaccgacagacuguggcggaaaucccgcagcccgcacaacaauggcacaugcuucggcaccgaucuuaacagaaauuuuaacgcuucuugguguuccaucggggccagccggaauugccaggaccagacguucuguggaaccggccccgucucugagccugagacaaaggccguggcuuccuuuauugaaagcaaaaaggaugacauccugugcuuccucaccaugcacucuuacgggcagcugauccugacacccuauggauacaccaagaacaaauccagcaaucauccugagaugauucaaguuggccagaaggccgcuaacgcccucaaagcgaaguaugggacgaauuaccgcgugggauccucugccgauauccuguacgcuagcuccggcagcucuagagacugggcccgggauauuggcauccccuuuuccuauacauucgaacuucgcgacagcgggaccuacggauuuguccugccggaggcucagauucagccuacaugugaagagaccauggaggccgugcucucugugcuggacgaugucuaugcgaaacacuggcauagcgacuccgccggcagaguuaccucugcuacaaugcuucuggggcuccuggugagcugcaugucccugcucuga

SEQ ID NO: 67818 - RNA, 1365 nt, Artificial Sequence
  derived and/or modified sequence opt5 from CPOX__Homo_sapiens__NP_000088
auggcccugcagcucggcagacugagcuccgggcccugcuggcuuguggcucggggaggcugugggggaccucgcgccuggucucaaugcggcgggggaggccugagagcguggagccagcgguccgcugccggccgcgucuguagaccgcccgggccugccggaaccgagcagucucggggccucgggcacggaagcacaucccgcggcgggcccuggguuggaacgggccuggcugccgcucuugccggccugguggggcucgcgaccgccgcuuucggacaugugcagagagccgaaaugcugccuaagacaucuggcacccgggcuacaagccuggggcgccccgaggaagaggaagacgagcucgcccacagaugcuccagcuuuauggcgccuccggucaccgaucugggagagcuucggcgcagacccggcgacaugaaaacaaagauggaacugcucauccuggagacccaagcccaggugugucaggcucuugcccagguugaugggggagcuaacuucucuguggaccggugggaacgcaaagagggcggcgggggaauuuccugcguccugcaagauggcuguguguuugagaaggccgggguuagcaucucugugguccauggaaaucucuccgaagaggccgcuaaacagaugagaagccggggcaaggugcugaagacgaaagacgggaagcugccuuucugcgcgaugggcgugucuuccgucauucaccccaaaaacccucaugcccccaccauccacuuuaauuacagauauuucgaaguugaggaagcugauggaaacaagcaguggugguuuggcgggggaugugaccucacaccgaccuaccugaaucaggaggaugccgugcacuuccaucgcacacuuaaagaggccugcgaccaacacggcccugaucuguaucccaaguuuaagaaauggugugacgauuacuucuuuauugcucauagaggggaacggcgcggaaucggcgggaucuucuuugacgaccucgauagcccuuccaaggaggaaguguuccgguucguccagucuugcgccagagcggugguucccagcuauauuccccuggugaaaaagcacugcgacgauuccuuuaccccucaggagaaacuuuggcaacagcugcgccggggcagauacgucgaguucaaccuccuguaugaccgcggaacgaaguuuggccuguucacaccggggagccggaucgaaucuauucucaugucccugccccuuaccgcuagaugggaguacaugcacagcccuucugaaaauagcaaagaggccgaaauccuggaggugcuccgccauccccgggauuggguuagauga

SEQ ID NO: 67819 - RNA, 519 nt, Artificial Sequence
  derived and/or modified sequence opt5 from CPPED1__Homo_sapiens__NP_001092925
augagcgccgcugaggccggcgggguguuccacagagcgcggggacgcacccuggcugccuuucccgccgaaaaggaguccgaauggaaaggcccuuucuacuuuauccucggggcugacccgcaguucggacugauuaaggccuggucuacaggcgauugcgacaacgggggagaugagugggaacaagagaucagacuuacggagcaggcuguccaggccauuaauaaacugaaccccaagccuaaauuuuucguucucuguggcgaccugauccaugcgaugcccggcgugaagguggucuuuagcgggcacuaucaucggaaugccggaggcaccuaccagaaccuugauauggugguuuccucugcuauugggugccaacugggacgcgacccucacggccucagaguggucgugguuacagccgaaaagaucgugcaucgguauuacagccuggaugagcuguccgaaaaagggaucgaggacgaucucauggaccugauuaagaaaaaguga

SEQ ID NO: 67820 - RNA, 1419 nt, Artificial Sequence
  derived and/or modified sequence opt5 from CPQ__Homo_sapiens__NP_057218
augaaguuccugaucuuugccuucuuuggcggggugcaccuccugagccuuugcuccggaaaagcuauuuguaagaacggcaucucuaaaagaaccuucgaggaaauuaaggaggaaaucgccagcugcggggacgucgcgaaagcuauuaucaaucuggccguuuacggaaaggcccagaaccgguccuaugagcgccucgcucugcuuguggauacagugggccccagacugucugggagcaagaaucucgaaaaagccauccaaauuauguaccagaaccugcagcaggacggacuggagaagguccaucucgagccugugcggaucccgcacugggaacgcggcgaggaauccgcuguuaugcuggagccccggauucauaaaaucgccauucuuggccuggggucuagcaucggaacgccucccgagggcauuaccgcggaagugcucgucgugacauccuuugaugagcugcaaagacgcgccagcgaagcuagagggaagaucguuguguauaaucagccuuacaucaacuauucucggaccguccaguaccgcacacagggagccguggaggcugccaaagugggcgcgcuugccucccugauuagaagcgucgcuucuuucuccaucuauagcccccacaccgggauucaagaauaccaggacggaguuccuaagaucccgacagccuguauuaccguggaggaugcugagaugaugucucggauggccucccauggcaucaagaucgugauucagcucaaaaugggcgccaagacguaccccgacaccgauagcuuuaauacagucgcugaaaucaccggguccaaauauccugaacaggugguucuggugucuggacaccuggacagcugggaugucggccaaggggcgauggacgauggaggcggggccuucauuuccugggaggcucucagccugaucaaggaccuuggacugcgccccaaaagaacacuccggcuggugcuuuggaccgccgaggaacagggcggcguuggggccuuucaguacuaucaacugcacaaggugaacauuucuaauuacucccucgucauggagagcgaugcuggaacguuccugccuacaggccugcaguuuaccgggucugagaaagcccgcgcgaucauggaagaggugaugagccuccugcagccccuuaacaucacacagguccugucccauggagaaggcaccgacauuaauuucuggauccaagcuggggugccgggcgccucucuccuggacgaucuuuauaaguacuuuuucuuccaccauagccacggagacaccaugacaguuauggauccuaagcagaugaacguggccgcugccgucugggcugugguuuccuauguggucgccgacauggaggaaaugcugcccagaagcuga

SEQ ID NO: 67821 - RNA, 4521 nt, Artificial Sequence
  derived and/or modified sequence opt5 from CPS1__Homo_sapiens__NP_001116105
augccccagaucauuaagaugaccagaauccugacagccuucaaagugguccggacgcucaagaccggcuuuggguucacaaacguuaccgcucaccaaaaauggaaguuuagccgcccuggaauuagacugcuuuccgugaaagcccagacagcgcauaucgugcuggaggacggcaccaagaugaagggguacucuuucggacacccgagcuccgucgcuggcgaagugguuuuuaauacagggcucggaggcuaucccgaggccauuaccgauccugccuacaaaggccagauccugacgauggcuaaccccaucauugggaauggaggcgccccugacaccacagcucuugaugaacuggggcucucuaaguaucuggagagcaacggaaucaaaguguccggccugcucguccuggacuacucuaaggauuauaaucauuggcuugccaccaaaagccuggggcaguggcuccaagaagagaaggugcccgcgauuuacggaguugacacacggaugcugaccaagaucauucgcgauaaaggcacgaugcuuggcaagaucgaguucgaagggcagccuguggacuuugucgauccgaacaaacagaaucugauugccgagguguccacaaaggacgugaaagucuauggaaagggcaaccccaccaaaguuguggcuguggauugcgggaucaagaauaacgucaucagacuccuggugaagcggggagccgaaguucaccuggugccuuggaaucaugacuucacaaaaauggaguacgauggcauucucaucgcugggggacccggcaacccugcccuggcggagccccuuauucagaauguccgcaagauccuggaaagcgacagaaaagagccgcucuuuggcauuucuaccgggaaccugaucaccggacuugccgcuggcgccaagacauacaaaauguccauggcuaaucgggggcaaaaccagccugugcugaacaucacgaauaagcaggccuucauuaccgcccagaaccacggauaugcucucgacaauacacugcccgcgggcuggaagccucuguuuguuaacgugaaugaucaaaccaacgaagggaucaugcacgagagcaaacccuucuuugccguccaguuccaucccgaagugacaccuggcccgauugacaccgaguaccucuucgauuccuuuuucucccugaucaagaaaggaaaggcuacgacaauuaccagcguccuucccaaaccugcccugguggccucucgcguugagguguccaagguccucauccugggcagcgggggacuuuccaucggccaggcuggggaauuugacuauucuggaagccaagccgugaaggcgaugaaagaggaaaauguuaagaccgugcugaugaaccccaauauugcuuccguccagacaaacgaggugggccucaaacaggccgauaccguguacuuccugccuaucacaccccaguuuguuacggaagucauuaaggccgagcaaccggacgggcugauccucggcaugggaggccagaccgcucugaauugugggguggagcuuuucaaaagaggagugcugaaggaauauggcgucaaggugcucgggacaagcguugagucuauuauggccaccgaagaucggcagcuguuuuccgacaaacugaacgagaucaaugaaaagauugcuccuagcuucgccguggagucuaucgaggaugcgcuuaaagccgcugacacaaucggauaccccgucaugauucgcagcgccuaugcucucggcgggcugggcuccggaaucugcccuaacagagaaacccugauggaucucucuacgaaggccuuugcgaugaccaaucagauucugguggagaaaagcguuacaggcuggaaggaaaucgaguacgaggugguccgggacgccgacgauaacugugugaccguuugcaacauggaaaauguggacgcuauggggguccacacaggagauuccgugguggucgcccccgcucaaacccuuagcaacgccgaguuccagaugcugcgcagaacgucuauuaauguugugcggcaucucggcaucgugggggaauguaacauccaguuugcccugcacccuacauccauggaguacugcauuaucgaagucaaugcuagacugagcagaucuuccgcgcuugccagcaaagcuaccggauauccccucgccuucauugccgcuaagaucgcccugggcauuccgcugccugagaucaagaacgugguuuccgggaaaacaucugcguguuuugagcccagccucgacuacauggugaccaagaucccccggugggaucuggacagauuccacggcaccuccucucgcauuggaagcuccaugaaaagcgucggcgaagugauggcuaucgggcggacauucgaggaaucuuuucagaaggcccuuagaaugugccauccuuccauugagggauucacgccgcgccugcccaugaauaaagaauggccuagcaaccucgaucugcggaaggagcugucugagcccuccagcaccagaaucuaugccauugcuaaggccaucgacgauaauaugucucuugacgaaaucgagaaacucacauacauugauaagugguuucuguauaaaaugcgcgacauccugaacauggaaaagacccucaaaggccugaauagcgaguccaugacagaagagacccuuaagcgggcgaaggagauuggguucagcgauaaacaaaucucuaagugucugggacucacggaagcucagacaagagagcugcgccugaaaaagaacauucacccuuggguuaaacagaucgacacccuugccgccgaauaccccuccgugaccaauuaucucuacgucacauacaacggccaggagcaugacgugaauuuugaugaccacggcaugaugguucuggggugcggaccuuaucauauuggcagcuccguggaguucgauuggugugcugucucuagcauccggacccugagacaacucgggaagaagacagugguggucaacugcaaccccgaaacgguuuccaccgacuuugaugagugcgacaaacuguacuucgaggaacuuucucuggaacggauccucgauauuuaucaccaggaggccuguggaggcugcaucauuagcgugggaggacagaucccgaauaaccuggcugugccucuguacaagaauggcgucaaaauuaugggcacaucuccccuucaaaucgaccgcgccgaggauagaucuaucuuuagcgcggugcuggacgaacucaagguugcccaggcuccuuggaaagccgugaacacccugaaugaggcucucgaguucgccaaguccgucgauuaucccugucugcuucggccgagcuacgugcugucuggguccgccaugaacguuguguuuagcgaagacgaaaugaaaaaguuccucgaggaggcuacaagagucucucaggaacacccugugguccugaccaaguuuguggagggagcgcgcgaaguugagauggaugccgugggcaaagacgggcgggucauuucccaugcuaucagcgaacacguggaggacgccggaguucauucuggcgaugccacgcugaugcuucccacccagacaauuucccaaggggcuaucgagaaggugaaagacgccaccagaaagauugcgaaggcuuucgccaucagcggaccuuucaauguccaguuucuggugaaaggcaacgaugugcucguuaucgaaugcaaucugcgcgccucccgcagcuuccccuuugucucuaagacacucggcguggacuucauugauguggcuaccaaagucaugaucggggagaacguggacgaaaagcaucugcccacacuugaucacccuauuaucccggccgacuauguugcgauuaaagcucccauguuuagcuggccucggcugcgcgaugccgaccccauccucagaugugagauggccuccaccggagagguggcuugcuucggcgaagggauucacacggccuuucugaaggcuaugcugucuacaggauucaaaaucccucagaagggcauccuuauugggauccagcagagcuuucggccccgcuuccugggagucgccgagcagcuccacaaugaaggcuuuaagcuguucgcgaccgaggccaccuccgauuggcucaacgcuaauaacgugccugccacaccgguugcuuggcccucucaggaaggccagaauccuagccuguccucuauuagaaaacuuauccgggacgggagcauugaccuggugaucaaccugcccaacaauaacaccaaguucguccaugauaauuacgugauccgcagaacggccguugacuccgggauuccucuccugacaaacuuucaagugaccaaacuuuucgccgaggcuguccaaaagagccggaaaguggauucuaagucccuguuucacuaccgccaguauagcgcgggcaaggccgcuuga

SEQ ID NO: 67822 - RNA, 4332 nt, Artificial Sequence
  derived and/or modified sequence opt5 from CPSF1__Homo_sapiens__NP_037423
auguacgccguguauaagcaggcucaucccccuaccggccuggaguucagcauguacugcaacuuuuucaauaacuccgaaagaaaucucgucguugccgggacaucucaacuguauguguaccggcuuaaccgcgacgcggaggcucugacgaaaaaugauagaagcaccgaaggaaaggcccaccgggagaaacucgaacuggccgcuuccuuuucuuucuuuggcaacgugaugagcauggccuccguccagcuugcuggggccaagcgcgacgcgcugcuccugucuuucaaagaugccaagcugagcgugguugaguaugacccgggaacacacgaucucaagacccugucccuucauuacuuugaggaacccgagcugagagacggcuucgugcagaauguccacacaccucgggugcgcguugaucccgacgggagaugugcugccaugcucguguauggaacccggcuggucgugcuuccuuuucgcagagaaagccuggcugaggagcaugaaggccucgugggcgaggggcagcggucuuccuuccugcccagcuacaucauugauguccgcgcccuggacgaaaaacuccugaacaucauugaucuucaauuucugcacggauacuaugagccuacacuccugauccuuuucgaaccgaaucagaccuggcccggcagaguugcggugcggcaggacacgugcucuauuguggccaucucccugaacaucacccagaagguccacccugugauuuggagccucacaucucugcccuuugauuguacccaagcucuggccguuccuaaacccaucgggggaguggucguguucgcuguuaauucccuccuguaccuuaaccagagcgugccgccuuauggcgucgcccugaauagccucacaaccgggacgacagccuucccccugcgcacccaggagggagugagaauuacacuugacugcgcucaggcgaccuuuaucucuuacgacaagauggucauuagccugaaaggcggcgagaucuaugugcucacccugauuacagaugggaugcgguccguuagagccuuccauuuugacaaggcugccgccagcgugcugacgaccucuauggucacaauggaaccuggauaccucuuccugggcucccgccuugggaacagccugcuccugaaguauaccgagaaacugcaagaaccucccgcuucugccgugcgggaggcggcugauaaggaggaacccccgagcaaaaagaaaagaguugacgccacagccggaugguccgcugccggcaagucugugccccaggaugaggucgacgaaaucgagguguacgggagcgaagcucaguccggaacccaacuugccacguacagcuuugaggugugugauucuauccucaauauuggcccuugcgcgaacgccgcuguuggcgaacccgccuuccuguccgaggaguuucagaacagcccugaacccgaccuggagaucgucguguguucugggcacgggaaaaauggcgcucucuccgugcugcaaaagagcauucgcccgcaggucgugacaaccuucgaacuuccugggugcuaugauauguggaccguuaucgcccccgugcggaaggaggaggaagacaacccuaaaggagagggcacagaacaggagcccuccaccacaccugaagcggaugacgacgggagacgccauggcuuucugauucucucucgggaggauagcacgaugauccugcagaccggacaggagaucauggaacuggacacauccggcuucgccacccaggggcccacagucuuugcuggaaauauuggcgauaacagauacaucgugcaaguuucuccgcuugggauucgccuccuggagggagugaaucagcugcacuucaucccugucgaccucggcgcccccauugugcagugugcuguugccgaucccuauguggucaucaugagcgccgaagggcacgugaccauguuucugcuuaaguccgacagcuacggcggacggcaucacagacuggcucuccauaaaccuccgcugcaccaucagucuaaggugaucacgcugugccuuuaucgcgaucucuccggcauguucaccacagagagccggcugggaggagcgagagacgaacugggcgggcggucuggacccgaggccgagggccucggguccgaaaccagcccuacagucgaugacgaggaagagaugcuguacggcgauucuggaagccuuuucucccccagcaaagaagaggcucgcagaucuucccaaccucccgccgaccgggauccugcccccuuuagagcugagccgacccacuggugucugcucguucgcgaaaacggcacgauggagauuuaucagcugccugacuggcggcugguguuccuugugaagaauuuucccgucgggcagagagugcucguugacagcuccuucggacagccuacaacccaaggcgaagcccgcagagaggaggcgacacggcagggggaacugccccuggugaaggagguccuccugguggcucuuggaucucgccagagcagaccguaccugcucguucacguggaucaagaacugcugaucuacgaggccuuuccucaugacucccagcuuggccaggggaaccugaaaguccgguucaagaaagugccccacaauauuaacuuucgcgaaaagaaaccuaagcccucuaagaaaaaggccgagggcggaggcgcugaggaaggggccggagcgagaggccggguugcucgcuucagauauuuugaggauaucuacggguauagcggaguguucauuugcggccccuccccucauuggcuccuggucaccggccgcggggcccuccggcugcacccgauggccaucgacggacccguggauucuuuugcuccuuuccacaaugugaacugccccagaggcuuucuuuacuucaaucggcagggggaacugagaauuagcguccucccugccuaucuguccuacgacgcucccuggccuguucgcaaaaucccgcugcgguguaccgcccauuauguggcguaccacguggagagcaaggucuacgccguggcuacaucuacgaacacccccugcgccagaaucccucgcaugacaggagaagagaaagaguucgaaaccauugagcgggaugaaagauauauccauccccaacaggaggcuuuuuccauucagcuuaucagcccuguuucuugggaagccauucccaaugcccgcaucgagcugcaggagugggaacacgugacauguaugaagaccgucucccuccggagcgaggaaacggugucuggccugaagggguacguugcugcgggaacaugccucaugcaaggcgaggaggugaccuguagaggccgcauccugauuauggacgucaucgaaguggucccggagccugggcagccccuuaccaaaaacaaguucaaagugcuguaugaaaaggagcagaaaggacccguuacagcccucugccauuguaacggccaccugguguccgcuauugggcagaagaucuuucuguggagccuucgggccuccgaacugaccggaauggccuucauugauacacaacucuacauccaccagaugaucagcgucaaaaauuuuauucuggcugccgacgugaugaagucuaucagccuccugagauaucaggaggaguccaagacgcuuucucugguuagccgggaugcgaaaccucuggaaguguacuccgucgacuucaugguggauaacgcucaacucggcuuucuggugucugaccgcgacagaaaucuuaugguuuauauguaccugcccgaggccaaggaauccuucgggggaaugcggcuccugcgcagagccgauuuucaugucggcgcucacgugaacaccuucuggcggacaccuugcagaggcgccaccgaggggcucuccaaaaagucuguggucugggaaaauaaacauauuacaugguuugcgacccuggacggaggcaucgggcuucugcugccgaugcaggagaagacguaccgccggcuccugaugcuucagaacgcucugaccacaaugcucccccaccaugccggacugaauccuagagccuuccgcaugcuccacguggaucggagaacccugcagaacgcuguucgcaaugugcuugacggcgagcugcugaaccgguaucucuaccugagcacaauggaaagauccgagcuugccaagaaaauugggaccacacccgauaucauccuggacgaucuccuggaaaccgaccgcgucacggcucacuucuga

SEQ ID NO: 67823 - RNA, 2349 nt, Artificial Sequence
  derived and/or modified sequence opt5 from CPSF2__Homo_sapiens__NP_059133
augaccagcaucauuaagcugacaacgcucuccggcgugcaggaggaaucugcccugugcuaccuucugcaagucgacgaguucagauuucuccuggauugugggugggacgaacacuucagcauggauaucauugacucccuucggaaacauguucaccagaucgaugcugugcugcucucucaucccgacccucugcaccugggagcccucccguaugcggugggcaagcuggggcuuaacugcgcuauuuacgccaccauccccgucuauaaaaugggacagauguuuauguacgaucuguaucagagccgccauaauacagaggacuucacccucuuuacacuggaugacguggaugccgcuuucgacaagauccaacagcuuaaauuuucccagauuguuaaccugaagggcaaggggcacggacucucuaucaccccucugcccgccggccacaugauuggcgggacaaucuggaaaauugugaaggauggagaagaggagaucgucuacgcuguggacuucaaucauaaaagagaaauucaccugaacggcuguagccucgagaugcugucccggccuagccuucugaucaccgacucuuuuaaugccacguauguucagccccgcagaaagcaacgggaugaacagcuccugaccaacgugcuugagacacugcgcggggacggaaauguccucaucgcgguggauaccgccggcagagugcuggagcuggcucagcuccuggaccagauuuggcggacaaaagaugccgggcuuggagucuacucccuggcucuccugaacaauguuagcuacaacgugguggaguucucuaagucccaagucgaauggaugagcgacaagcucaugcgcugcuuugaagauaaaagaaauaacccuuuccaguuucggcaucugucucucugucacggccuguccgaccuggcccgcgugccgagccccaagguugugcucgcgucccagccugaucuggagugcggcuucucuagagaccuuuucauccaauggugucaggaucccaaaaauagcauuauccugaccuaucggacgacaccugggacccucgcccgcuuucugauugacaaccccuccgaaaagaucacagagaucgagcugagaaaacgggucaaacuugaaggaaaagagcucgaagaguaccuggaaaaggagaagcugaaaaaggaggcugccaaaaagcucgaacagagcaaagaggcugacauugauucuuccgacgaaagcgauaucgaggaagacauugaucagccgucugcccacaagaccaagcaugaccugaugaugaaaggcgaggggagcagaaagggauccuucuuuaaacaagccaagaaaucuuauccuauguuccccgcuccugaggaacgcaucaagugggaugaguacggcgaaauuaucaagcccgaggacuuucuugugcccgagcugcaggcgaccgaagaggaaaagagcaagcucgaguccgggcugacaaauggagaugaaccuauggaccaggaucugagcgacguuccgacgaaaugcaucucuaccacagaguccauugagaucaaggcccgggugaccuauauugauuacgaaggcagaagcgacggcgacucuaucaaaaagauuaucaaccagaugaagccccgccaacuuauuaucguccacgggccucccgaggcuucccaggaucucgccgaauguugccgggccuucggaggcaaagacaucaagguguauaugccuaaacugcaugagacagucgaugcuaccagcgaaacgcacauuuaccaggugagacugaaggacucccucguuucuagccugcaguuuuguaaagccaaggaugcggagcuugcuuggaucgacggggugcuggauaugcgcgucuccaaaguggacacaggaguuauucucgaggaaggcgagcugaaggaugacggggaagauucugagaugcaaguggaagcccccagcgacuccagcgucaucgcccagcagaaggcuaugaaaucucuguucggcgaugacgagaaggagaccggagaagaguccgaaauuaucccgacccuugagccucuucccccucaugaggugcccggccaccagagcguguuuaugaacgaaccucggcugucugacuucaaacaaguucugcucagagaggggauccaggccgaauuugucggaggcgugcuggugugcaauaaccaggucgcugugcgccggacagagaccgggagaauuggacuugaaggcugccugugucaagauuucuaccgcauccgggaccuccuguaugagcaguacgccauuguuuga

SEQ ID NO: 67824 - RNA, 2055 nt, Artificial Sequence
  derived and/or modified sequence opt5 from CPSF3__Homo_sapiens__NP_057291
augagcgccauccccgcugaggaauccgaccagcugcucauuagaccucugggcgccgggcaagaggugggacggucuugcaucauucuugaguucaagggccgcaaaaucaugcuggauugugggauucacccgggacucgagggcauggacgcgcugcccuacaucgaucuuaucgacccugcugaaauugaucugcuccugaucagccauuuucaccuggaccauugcggggcccuccccugguuccugcagaagaccuccuuuaaaggaagaacauucaugacgcacgccaccaaggcuauuuaucgguggcuucugucugauuacgucaaaguuagcaacaucuccgccgacgauaugcucuauacagagaccgaccuggaggaaucuauggauaagauugagacaaucaauuuucaugaagugaaggagguggcuggcauuaaauucugguguuaccacgccggccacguccuuggggcggccauguuuaugaucgagaucgcuggagugaagcugcucuauaccggcgacuucagccgccaggaagauagacaucugauggccgcugagauuccuaacaucaaacccgacauucugaucauugaauccacauacgggacccacauccaugagaagcgggaagagagagaggccagauuuugcaauacgguucacgacaucgugaaccggggaggccgcgggcucauuccugucuucgcgcugggacgcgcccaggaacuucugcucauccuggaugaguauuggcaaaaucacccggaacuucaugacauucccaucuacuacgcuagcucucuggccaaaaaguguauggcuguguaucagaccuacguuaacgccaugaaugauaagauucggaaacagaucaacaucaauaacccuuuuguguucaagcacauuuccaaucucaaaagcauggaccauuuugaugacaucggccccucugucgugauggccuccccuggcaugaugcagagcgggcugucucgcgagcuguucgaauccuggugcacagauaagagaaacggagugauuaucgcuggcuauugugucgaggggacccucgcgaaacacauuaugagcgagcccgaagagaucacaaccauguccggacaaaagcugccgcuuaaaaugucuguugacuacauuagcuucuccgcccauacggauuaucagcagacaagcgaauuuauccgggcucugaagccuccccacgugauccucgugcacggcgagcagaaugaaauggcccgccugaaggccgcucuuauuagagaguacgaggacaacgaugaaguccauaucgaggugcacaauccucggaacaccgaagccguuacacugaacuucagaggggagaaacucgcgaaggugaugggauuucuggcugacaaaaagcccgagcaaggccagcgcgucucuggcauucuggugaaacggaauuucaacuaucauauccucucccccugcgaccugagcaauuacaccgaucuugccaugucuaccguuaagcagacacaagccauuccuuacacggggccguuuaaccugcucuguuaucagcugcagaagcugaccggagacguggaagaacuugaaauccaggagaaacccgcucucaaggucuucaaaaauaucacagugauucaagaaccuggcauggucgugcuggaguggcuggccaaccccagcaaugauauguacgcugacaccguuacaaccgugauccucgagguccaguccaacccuaagauuagaaaaggggccgugcagaagguuucuaagaaacuggaaaugcacguguauagcaagcgccuugagaucaugcugcaggauauuuuuggagaagacugcgucuccgugaaagaugacagcauccucucugugacgguugauggcaagacagcgaaucugaaccuggagacccggaccgucgaaugugaggagggguccgaagacgaugagagccuuagagaaaugguggagcucgccgcucaacgccuguacgaagcccugacacccgugcacuga

SEQ ID NO: 67825 - RNA, 1983 nt, Artificial Sequence
  derived and/or modified sequence opt5 from CPSF3L__Homo_sapiens__XP_011539949
augcccgagaucagagugaccccucugggcgccugcccgguccucagcuggaaccugguucuucccccugggcggggaucccgcgcucccucuagcacagacacgagaaccggcuuccacgugcugccucaugggccccucggauguggcccugugauucugaugugcggggccggauuuggccacuucgaauggcuugcgggcgggggagcuggccaggaugucgggcgguccuguauccuggugucuauugccggaaagaauguuaugcucgacugcggcaugcauaugggguuuaacgaugaccgcagauucccggauuuuagcuacaucacacaaaauggacggcugaccgacuuccuggauugugugauuaucucccacuuucaucucgaccacugcggcgcccugcccuauuucucugagauggucggcuacgaugggccuaucuauaugacacaccccacccaggcuauuuguccuauccuucuggaagacuaccgcaaaauugccguggauaagaaaggagaggcuaacuuuuucacaagccagaugaucaaggacugcaugaaaaagguuguggccguccaucuccaccagaccgugcaaguggaugacgaacuggagauuaaggcguauuacgccggccauguccuuggggcugccauguuucagaucaaaguuggauccgagagcgugguguauacgggcgacuacaauaugacccccgauagacaccugggggcugccuggauugacaagugucggccgaaccuccugaucacagaaucuaccuacgcgacaaccauccgcgauuccaaaagaugccgggagcgcgacuuccugaagaaaguccacgaaacgguggagagaggaggcaagguucucauuccuguguuugcccugggccgggcucaggagcuuuguauccugcucgaaacauucugggagcgcaugaaucugaagguccccauuuauuucagcaccgggcuuacagaaaaagccaaccauuacuauaagcuguuuaucccuuggaccaaucagaaaauuagaaagaccuucgugcaacggaacauguuugaguucaaacacaucaaggcuuuugauagagccuucgccgacaaucccggacccaugguuguguuugcuacaccuggcaugcuccaugcggggcagucucugcagaucuuccgcaaaugggccggaaacgaaaagaauauggucauuaugccgggcuacugcgugcaggggacggucggccacaagauccuguccggacaacggaaacucgagauggagggcagacaggugcuggaaguuaagaugcaaguggaguauaugagcuuuucugcucaugccgaugccaaagggauuaugcagcuugucggacaggcugaacccgaguccgugcugcucguucacggcgaagccaagaaaauggaguuccugaagcagaagaucgagcaggaacuucgcgugaacugcuacaugccugcgaauggggagaccgucacacugcccaccagcccuuccauucccgugggaaucucucucggccugcugaaacgggaaauggcucaagggcuccugccggaggccaagaaaccuagacuucugcacggcacacucaucaugaaggacagcaacuuucgccugguguccagcgaacaggcccugaaagagcuuggacucgcugagcaucagcugcgguucaccuguagaguucaucugcacgauacgcgcaaggaacaggagacagcccuccgggucuauucucaccugaaguccgugcuuaaagaccacugcgugcaacaucugcccgauggcagcgucaccguggaaucuguucuccugcaggcugccgcgccuagcgaggaccccgggaccaaggugcugcuugucuccuggacauaccaggacgaggaacucggaucuuuucugaccagccugcucaaaaagggccugccucaggcccccuccuga

SEQ ID NO: 67826 - RNA, 735 nt, Artificial Sequence
  derived and/or modified sequence opt5 from CPSF4__Homo_sapiens__NP_001075028
augcaggagaucauugccagcguggaccacaucaaguucgaucuggaaauugcugucgagcaacagcucggcgcccagccccugccuuuuccggggauggacaaauccggagcggcuguuugcgaguucuuucuuaaggccgccuguggcaaagggggaaugugccccuucagacauaucucuggcgaaaagaccgugguguguaaacacuggcugcgggggcucugcaagaagggagaucagugugaauuucugcaugaguacgacaugacaaaaaugccugagugcuauuucuacagcaaguuuggcgaauguuccaacaaagagugccccuuccuucacauugauccugaaucuaagaucaaagacugucccugguaugaucgcggcuuuugcaagcaugggccucuguguagacaccggcacacgcgcagagucaucugcgugaauuaccucguuggauucugcccggagggccccagcuguaaguuuaugcauccucgguucgagcugcccauggggaccacagaacaaccuccccugccgcagcagacccagccucccgcuaaacaacgcacaccucaggugauuggagucaugcagucccagaacucuagcgccggcaauagagggccccggccccucgagcaagugaccugcuauaaguguggagaaaaaggccacuacgcuaaccgcugcacaaagggccaucuggccuuucuuuccgggcaguga

SEQ ID NO: 67827 - RNA, 1767 nt, Artificial Sequence
  derived and/or modified sequence opt5 from CPSF6__Homo_sapiens__NP_001287876
auggccgacggcguggaucacaucgacauuuacgcugaugucggggaggaguucaaccaggaagccgaauauggaggccaugaccaaaucgaucuguacgacgauguuauuagccccuccgcgaauaacggggacgcuccugaggauagagacuauauggauacccucccgcccacagugggagacgaugugggcaagggggccgccccuaaugucguguacacguauaccggaaaacggaucgcucuguacauuggcaaccuuacaugguggaccacagacgaagaccugaccgaggccguucacucucucggcgugaaugauauccuggagaucaaguuuuucgaaaaccgcgcuaaugggcagagcaaaggauuugcccuugucggcgugggguccgaggcgucuagcaagaaacugauggaccuccugcccaagagagaacugcauggacagaacccuguugugacacccugcaauaagcaguuccucucccaauuugagaugcagucucggaaaaccacgcagagcggccagauguccggggagggaaaggccggcccuccgggcgggagcucucgcgcugccuucccccaaggaggcagagggcggggacgcuuuccuggcgcuguccccgggggagauagauucccuggccccgccggccccgggggaccucccccucccuuucccggcaaccugauuaaacaccuugugaaggggacccggccucuguuccucgaaacacgcaucccguggcauaugggacacuccauugaggaaauccccauuuuuggccugaaagcggggcagaccccucccagaccuccccuuggcccgccuggacccccuggcccgccugggcccccgccucccggacaggugcugcccccuccgcucgccgggcccccuaaucgcggcgaccggcccccucccccuguccuguuccccggacagccguuuggccaaccuccccuggggccucugcccccgggcccucccccucccguucccggauauggcccuccgcccgggccucccccuccccagcagggaccuccgcccccucccggcccuuuucccccgagaccucccgggccccucggaccuccccuuacacuggcuccuccgccccaccucccugggcccccucccggcgccccgccucccgcuccucaugugaaccccgccuucuucccucccccgaccaauagcggcaugccuacgucugauucccggggacccccucccacagacccguacggcagacccccucccuacgaucgcggggacuauggaccucccggccgggagauggauaccgccagaacaccucugagcgaagcugaguucgaggaaaucaugaaccgcaaucgggcgauuucuuccagcgccaucuccagagcugugucugacgccagcgccggggauuacggauccgcuaucgagacccuugucaccgccauuagccugaucaagcaaucuaagguguccgcggacgaccgcuguaaaguucucauuagcucucugcaggauugccugcacggcaucgaaagcaaguccuaugggucuggcagccggagagagcgcucccgggaaagagaccauagccgcucucgggagaaauccagacgccacaagagccggucuagagaucggcacgacgauuacuaucgcgagagaucccgggaaagagagcgccaucgggacagagaucgcgacagagaucgggaacgcgacagagagcgggaauaccgccacagauga

SEQ ID NO: 67828 - RNA, 1416 nt, Artificial Sequence
  derived and/or modified sequence opt5 from CPSF7__Homo_sapiens__NP_001129512
augagcgagggcguggaccugaucgauauuuacgccgacgaagaguucaaccaggaucccgaauuuaauaacaccgaccaaaucgaucucuaugacgauguccugacagcuacgucccagccuucugacgauagaagcuccucuaccgagccgcccccucccguucggcaggaaccuagccccaagccuaauaacaaaacaccggccauucuuuacaccuauuccgggcugcgcaauagacgggcggcuguguacgugggaucuuucagcugguggacaaccgaccagcaacucauccaggucauucgcuccaucggcguguaugauguuguggagcugaaguuugccgagaacagagccaaugggcagagcaaaggauacgcugaagucgugguugccucugagaacuccgugcacaagcuccuggaacuccugcccggcaaaguccugaauggggagaagguggacgugcggccugcuacacgccagaaccucagccaauucgaggcccaggcgagaaagcgggaaugcguccgcguucccagaggaggcaucccuccccgggcccauucucgcgauuccagcgacucugcugacggcagagccaccccguccgagaaucuggugccuagcuccgcucggguggauaaacccccuucuguccuucccuauuuuaacagacccccuagcgcccugccgcucauggggcugcccccucccccuauucccccgccucccccucuuuccagcucuuucggagugcccccucccccgccuggcauccacuaccagcaucugaugcccccucccccgcgccuucccccucaccuggcgguucccccucccggggccauuccucccgcucugcaucucaauccggccuuuuucccucccccuaacgcuacggugggacccccgccugacaccuacaugaaggccuccgcccccuauaaucaccacggcagccgggauucugggccuccucccagcacagucuccgaagcugaguuugaagacaucaugaaaagaaaccgcgcgauuucuagcuccgccaucagcaaggcugugucuggagccuccgccggcgauuacagcgacgcuauugagacccugcuuacagccaucgcgguuaucaaacagucucggguggcuaacgaugagagaugucgcguccugauuuccagccucaaggacugccugcauggcaucgaagccaaguccuauucugugggggccagcggauccucuagccggaaaagacaccgcucccgggagagaagccccucucgcucccgggaaagcucuagacgccaucgggaucuucugcacaaugaggacagacacgaugacuacuuccaagaacggaaccgcgagcaugagagacaccgggacagagaacgcgaucggcaucacuga

SEQ ID NO: 67829 - RNA, 2418 nt, Artificial Sequence
  derived and/or modified sequence opt5 from CPT1A__Homo_sapiens__XP_005273819
augcagcaccugagcuccgaggcccucucuaccgaacugagcccccagcuuggcacagcugggcuggaccucccuacggagagauacucccugaagauggccgaagcgcaucaggcuguggccuuccaguuuaccgucacaccggauggaaucgaccuucggcugucucacgaggcccuccgccagauuuaucugagcggccugcauuccuggaaaaagaaauucaucagauuuaagaacgggauuaucaccggaguuuaccccgcuucuccuagcuccuggcucauugugguggucggcgugaugacaaccauguaugccaaaaucgaucccagccuggggaucauugcuaagaucaaucggacacuugaaaccgccaacugcaugucuucccaaacgaagaauguugugagcggaguccuguucggcaccggccucuggguggcgcugauuguuacaaugcgcuacucucuuaaagugcugcucuccuaucacggguggauguuuaccgagcauggaaagaugagcagagccacaaaaaucuggaugggcauggucaagauuuucucugggcggaaaccuaugcuguacuccuuucagaccagccugccccgccucccugugccggcugugaaggacacggucaacagauaucugcaguccguucggccccuuaugaaggaggaagauuucaaacgcaugacagcccuggcucaggacuuugccgugggacucggcccuagacugcaaugguaccuuaagcugaaaucuuggugggcgaccaauuacgugagcgauuggugggaggaauauaucuaccuccgggggcgcggaccccugauggucaacuccaauuauuacgccauggaccugcucuauauucugccuacacacauccaggcugccagagcuggcaacgccauccacgccauucuucuguaccggcgcaagcucgauagagaggagaucaaacccauucggcugcuuggcagcaccaucccgcuguguucugcucagugggaaagaauguucaauaccucccgcauuccuggggaggaaacagacacgauccagcauaugcgggauagcaagcacaucgugguuuaucauagaggacgcuacuuuaaaguguggcucuaccacgacggccggcugcugaagcccagagagauggaacaacagaugcagcgcauucucgauaacaccucugagccucaacccggggaggcgcggcuggccgcucuuacagccggagacagaguccccugggcccgcugccggcaggcuuauuucggcagagggaagaauaaacagagccuggacgccguggaaaaggcggccuuuuucguuacccucgaugagacagaagagggauaccgcuccgaagacccugauaccucuauggacagcuaugcuaaaucccugcugcacggccgguguuacgauagaugguucgacaagagcuuuacguucguggucuuuaaaaacggcaagauggggcuuaaugccgagcauucuugggcugaugccccgaucguggcucaccucugggaguaugucauguccauugacagccugcagcugggauacgccgaagauggccauugcaagggggacaucaaccccaauauuccuuaucccacacggcuccaaugggauaucccuggagagugucaggaagugaucgagaccucucugaacaccgcgaaccuucuggccaaugacguugacuuccacuccuuucccuucguggcuuuuggcaaagggauuaucaagaaaugccgcacaagcccggaugccuucguccagcucgcucugcagcuggcccauuacaaggacaugggcaaauuuugucuuaccuacgaagcguccaugacaagacucuuccgggagggaagaacggagaccgugcgcucuugcacaaccgaaagcugugauuuuguucgggccaugguggacccugcucaaacagucgagcagagacugaagcuguucaagcucgccuccgaaaaacaccagcacauguaucgccuggcuaugaccggcucugggauugauagacaucucuuuugccuguacguggugagcaaguaucucgccguugagucccccuuccugaaagagguccugagcgaaccuuggcggcuuucuacgucccagacaccccaacaacagguggagcuuuucgaccuggaaaacaauccugaguacgugagcucuggaggcggguuuggacccgucgccgaugacggcuaugggguguccuacauccugguuggcgaaaaccucauuaauuuccacaucagcucuaaguuuagcuguccggagaccgauucccaucgcuucggaagacaccugaaagaggcuaugaccgacauuaucacacuuuuuggccugagcucuaacuccaagaaguga

SEQ ID NO: 67830 - RNA, 2217 nt, Artificial Sequence
  derived and/or modified sequence opt5 from CPT1B__Homo_sapiens__NP_001138606
auggccgaggcucaccaggccguggcguuccaauuuaccgucacacccgacggcguugauuucagacugagccgggaagcucucaagcauguguaccuguccgggaucaacucuuggaaaaagcgccuuauuagaaucaaaaauggcauucugcggggaguguauccugggagcccgacguccuggcucgucgugaucauggccaccguuggaucuagcuuuugcaacguggacauuucccugggccuugucucuuguauccagcgcugccugccccagggguguggaccuuaccagacaccccaaaccagagcccuccugagcauggcuaucuucuccacaggcguguggguuaccggcaucuuuuucuuucggcagacacugaagcuccugcuuugcuaucacggguggauguucgagaugcauggaaaaaccagcaaucugacgcgcauuugggccuaccucgaaucugugagaccucugcuugaugacgaggaauauuaccggauggagcugcucgcuaaggaguuucaggauaagaccgcgccccgccugcagaaauaucugguccucaaguccuggugggcgagcaacuacgugucugacuggugggaagaguacauuuaucugagaggccgguccccucuuauggugaauagcaacuacuaugucauggaucugguucucaucaaaaauacagacgugcaagccgcucgccuggggaacauuauccacgccaugauuauguacagacggaaacuugaucgcgaagagaucaaaccggugauggcucugggaaucguccccauguguucuuaucagauggagagaauguucaauaccacacggauuccuggcaaggacaccgaugugcuccagcaucuguccgacagcagacacguugccguguaccacaaggggcgcuuuuucaaacuguggcucuaugaaggagcgcggcugcuuaagccccaggaucuggagaugcaauuucagagaauccucgacgacccuucucccccgcagccuggcgaagagaaacuggccgcucuuacggccggcgggcgcgucgaaugggcucaagcccggcaggccuucuucucuagcggaaagaacaaagcugcgcuggaggccauugagagagcugccuuuuucguggcccucgaugaagaguccuacagcuacgaccccgaagaugaggcuucucugucccuguauggcaaggcccuccugcaugggaauugcuacaaccgcugguuugacaagagcuucacacuuaucucuuuuaagaauggacagcugggccucaacgcggaacacgcuugggccgaugccccuauuaucgggcaucugugggaguucguucugggaaccgacagcuuucaccuuggcuauacagagaccggccacugucucgggaagcccaaucccgcucuggccccuccgacccggcugcagugggauauccccaaacaaugccaggcugugauugaauccucuuaccaggucgccaaggcgcucgccgacgauguggagcuguauuguuuccaguuucuuccuuucggaaaaggccugaucaagaaaugcagaacaagccccgacgcuuuuguccaaauugcccuccagcuggcucauuuccgcgaucgggggaaguuuugucugacguacgaagccuccaugaccagaauguuccgcgagggacggacagaaaccgugagaagcugcacaucugaguccaccgcguucguucaggccaugauggagggcagccacacgaaggcugaccuucgggaccucuuucagaaagccgcuaagaaacaucaaaacauguaucgccuggccaugacaggggccggcaucgauagacaccuguucugccucuaccuggugucuaaguaccuuggagucuccagcccuuuucuggcugaagugcucuccgagcccuggcggcugucuaccagccagauuccgcagucccagaucagaauguucgacccugaacaacaucccaaccaccugggcgccgggggaggcuuugggccuguugccgaugacggauauggcgugucuuacaugaucgcuggggagaauaccauuuucuuucacaucagcuccaaauucagcuccuccgagacaaacgcccagcgcuuuggcaaucauauucggaaggcccuucucgauaucgcugaccuguuccagguccccaaggccuauagcuga

SEQ ID NO: 67831 - RNA, 2379 nt, Artificial Sequence
  derived and/or modified sequence opt5 from CPT1C__Homo_sapiens__NP_001129524
auggccgaggcucaccaggccgugggcuucagacccagccugaccuccgacggggcggaagucgagcucucugcuccuguucugcaagaaaucuaccuuagcggacugcgguccuggaagcgccaucucucuagauuuuggaacgauuuccugacaggcguguuuccggccagcccccuuuccuggcuguuccucuuuucugccauucagcuggcuugguuccugcagcucgacccuagccuggggcuuauggagaaaaucaaggaacugcuccccgauuggggaggccagcaccaugggcugcggggagugcuugccgcugcccuguuugcguccugccucuggggcgcccugauuuucacgcugcacgucgcucuccgccugcuucugagcuaucauggcuggcuccuggagccucacggggccaugucuucccccaccaaaacauggcuugcucuggugagaaucuuuagcggacggcacccuaugcuuuucucuuaccaacgcucccugccgagacagcccguuccuagcgugcaggacaccguccggaaguaucuggagucugugcgccccauucucuccgaugaagacuuugauuggacagccguucuggcgcaggaguuccuuagacugcaagccagccuccugcagugguaccuucggcugaaauccuggugggcuucuaauuaugugagcgacuggugggaagaguuugucuaccuccgcuccagaaacccucugauggugaauagcaacuauuacaugauggccgcucgggccggcaaugccgugcaugcucugcuccuguaccgccacagacuuaaccggcaggagauucccccgacccugcucauggggaugagaccucuguguucugcgcaguaugaaaagaucuucaauacaacccgcauccccggaguccaaaaggauuacauccggcaucugcacgacucccagcacguugccguguuccauagaggccgcuuuuuccggauggggacgcacagcagaaacucucuucucagcccucgcgcucuggagcagcaauuucagcggauucuggaugaccccucccccgccugcccucaugaagaacaccucgccgcucugaccgccgcgccgagaggaacaugggcucaggugcgcaccucucuuaaaacacaggccgccgaagcucuggaggccgucgagggcgcugccuucuuugugagccucgaugcggaacccgccggccugacccgggaggacccugcugccucccuggacgcuuaugcccaugcgcuucucgccgggagaggacacgaucgcugguucgacaagagcuuuacgcugaucguuuucucuaauggcaaacuggggcucuccguggaacacagcugggcugauugucccauuucuggacauaugugggaguuuacacuggccaccgaaugcuuccaacuuggcuacuccacagacgggcacuguaagggacauccugaucccacccugccgcagccucagcggcuccagugggaccugcccgaucaaauccacagcuccauuucucuggcucuuagaggcgccaaaauccucagcgagaacgucgacugccacgugguuccuuuuucccuguucggcaagucuuuuauccggcgcugucaucugagcuccgauagcuucauucagaucgcccuccagcuggcucacuucagagaccgggggcaguuuugccuuaccuaugagucugcgaugacaagacuguuccucgaaggacgcacggagaccgugcgguccuguacaagagaagccugcaauuuuguccgcgcuauggaggauaaggagaaaaccgacccccaaugucuggcccuguucagaguggccgucgacaagcaucaggcucuccucaaagccgcgaugagcggccaggggguggaucggcaccuguuugcucuguacauuguuucucgcuuccuccaucugcaguccccuuuucuuacacaagugcacagcgagcaguggcagcugucuaccagccaaauccccguccagcagaugcaccucuucgacgugcauaacuauccggauuacguuuccagcggaggcggguuuggcccugccgacgaucacggauacggcgugucuuauauuuucaugggggacggaaugaucacguuucauaucuccagcaagaaauccucuacaaagaccgauagccacagacugggccagcauauugaggacgcccugcuugaugucgcuucccuguuccaagccgggcagcacuuuaaacggcgcuucagaggaucuggcaaggaaaauagccggcaccgcugcggguuccucuccagacagaccggcgcgucuaaggcuagcaugacauccaccgacuuuuga

SEQ ID NO: 67832 - RNA, 1431 nt, Artificial Sequence
  derived and/or modified sequence opt5 from CPVL__Homo_sapiens__XP_011513739
auggugggcgccauguggaaggucaucguuagccuggugcuccugaugcccgggccuugcgacggacuuuucagaucccuguaccggucugugagcaugccgcccaaaggcgauuccgggcagccucucuuucugacccccuauauugaggcuggaaagauccaaaaaggccgcgaacuuucucuggucgggccuuuccccggacucaacaugaaaagcuacgccggcuuucugacagugaauaagacguauaacuccaaucuguucuuuugguucuuuccugcgcagauucagccggaggacgcucccguugugcucuggcugcagggcgggccuggaggcucuagcauguucgggcuuuuugucgaacacggacccuacgugguuaccuccaacaugacacugagagaucgggacuucccuuggaccacaacccucagcaugcuguauaucgauaaucccgugggcacaggguuuucuuucaccgacgauacgcauggauacgccgucaacgaggacgauguggcccgcgaccuuuauuccgcucugauucaauuuuuccagaucuucccggaauacaagaauaacgauuuuuacgugaccggcgagagcuaugccggcaaguacgucccugcuaucgcccaccucauucauucucugaaucccguuagagaggugaaaaucaaccugaaugggauugcgaucggagacggcuauuccgauccugaaagcauuaucgggggauacgccgaguuccucuaucagauuggccugcuugacgaaaagcagaaaaaguacuuucaaaaacagugucacgagugcaucgagcauauccggaagcagaacugguucgaggcuuuugaaauucuggacaagcuccuggauggggaccuuacaucugaucccuccuauuuccagaaugugaccggauguagcaacuacuacaauuuucugcgcugcacagaacccgaggaccaacucuauuacgucaaauuccugucccugccugaagugagacaggccauccacguuggcaaccagaccuuuaacgauggcacgauuguggagaaguaucuccgggaggacacaguccaaucugugaaaccguggcugaccgaaaucaugaauaacuacaagguucuuauuuauaaugggcagcuggauaucaucguggcugccgcgcucacagagcgcagccugaugggaauggacuggaaaggcucccaggaauacaagaaagccgagaagaaggucuggaaaauuuucaagagcgauucugaaguggcuggguauaucagacaggccggagacuuucaccaagucauuauccggggcgggggccauauucuucccuacgaucagccucugcgcgcuuucgacaugaucaacagauuuaucuacggaaaaggcugggaccccuaugugggguga

SEQ ID NO: 67833 - RNA, 906 nt, Artificial Sequence
  derived and/or modified sequence opt5 from CPXCR1__Homo_sapiens__NP_001171700
augagcucccccaccaaggagggcucugacacagccgggaacgcucacaaaaauagcgaaaacgagccuccgaaugauugcuccacggacaucgaaucucccagcgccgauccuaacaugauuuaccagguggagaccaaucccaucaacagagaaccuggaacagcgaccucccaagaggacgucguuccccaggcugccgaaaauucugaacuggagacagaaauucagaaggaucagcgggaggaggaccucaaagaggagcugcuucugcuccaaaccccuaucccgcgcaagcuggugagccauaaaccccuuaacgauagaucccggagccacucuggcaagguggaaaugaaggccaauaacuucccuauuaaucauaaaacacgcuuuagacuguccaccagcuggcggguccccuucaucaacucucacgagauccgcuccaugauucuccaucugcugugugacagauauuuuagccaggcugccgggugccagaauacgaugugggugaagcggaaauacaucgcuugucucuaucacccuaacucuuucacccaccaugaacgcgccauuacauuuagacggcccucccgcguucacuacuauagaccgcugaccgagcggaugacaagcggaaaguucugcaaauccaccgauacgaagggcaagugucgcuuuagagcgaucgugcggucuguccuuuucgugagccagauucaaaucgaguccauuuuuaauaucaaaggguucguugacauccugacauacauucauaccaugaacgugaugaucacaaacaccaauaacggauggaaguauuuuugcccuauuuguggcagacucuucaauaccuacagcgaacugcgccagcacucuugcuccagcucuggcaacuga

SEQ ID NO: 67834 - RNA, 1959 nt, Artificial Sequence
  derived and/or modified sequence opt5 from CPZ__Homo_sapiens__NP_001014447
augcccccuccgcccccucugcuccugcuuaccgugcuggucguugccgcugccagacccggcugcgaguucgaacggaacccugcgggggagugucacagacccccugcugccgacagcgccacaugcguggaucuccagcugagaacguguuccgacgcugccuacaaucauaccacauuuccgaaccuucugcaacaccggucuugggaaguggucgaggcuagcuccgaauauauccuccugucugugcugcaucagcuccuggagggacagugcaaucccgaucuucgccugcucggcugugccguucuggcgccuagaugcgaagggggaugggugcggcgccccuguagacacauuugcgagggccuucgggaggucugucagccugccuucgacgcuaucgauauggccuggcccuacuuucuggacugccaucgcuauuucaccagagaagaugagggguguuacgacccgcucgagaagcugcggggaggccuggaagcugaugaggcccucccuagcggccugcccccuacauuuauucgcuucucccaccacucuuaugcgcaaauggugagaguucuucggcgcaccgccagcagaugcgcucauguggcccggacauacuccaucgggcgcagcuuugacggacgcgaacugcucgucauugaguucucuucccggcccggccagcacgaacugauggagcccgaggugaaacuuaucgggaacauccauggaaaugaaguggcuggcagagagaugcugauuuaucucgcccaguaccugugcagcgaauaccugcucgggaacccucgcauccagcggcugcuuaauaccacgcgcauucaccuccucccgucuaugaaccccgauggauaugaggucgccgcugcggaaggcgccggcuacaauggguggaccuccggaagacaaaacgcucagaaucuggaccuuaaccggaauuuuccugaucugacaagcgaguauuacagacucgccgagacccgcggcgcccggucugaccacauccccauuccucagcauuauuggugggggaagguugcucccgaaacaaaagccaucaugaaguggaugcagaccauuccguucgugcuguccgcgagccugcacggaggcgaccucguggucuccuacccuuuugauuucucuaaacauccccaagaggaaaagauguuuagcccuacgcccgacgagaagauguucaaacugcuuuccagagcuuaugccgaugugcacccuaugaugauggaccgcagcgaaaaccggugugggggaaauuuccugaagagaggcucuaucaucaacggcgccgauugguacuccuuuacagggggaaugagcgacuucaacuaccuccauaccaauugcuuugagauuacaguugagcugggcugugugaaauuucccccggaagaggcucuguauacccuuuggcagcacaacaaggaaucucuccugaauuucgucgagaccgugcaccgggggaucaaaggaguugugacagauaaguucggcaagccugucaaaaacgcccgcauuagcgugaaggggaucagacaugacauuacgaccgcucccgauggcgacuacuggcggcugcugcccccuggaauccacaucgucauugcccaggcgccgggcuaugccaaagugaucaagaaaguuauuauccccgcuagaaugaagcgcgccgggcggguggauuuuauucugcaaccucuuggaaugggccccaaaaauuucauccaugggcugagacgcacaggaccucacgacccccucggcggggcuuccucucugggcgaggccaccgaaccugacccccugagagcgcggcgccagccgagcgccgauggauccaagccuuggugguggagcuacuuuacaucucuuuccacccacagaccccgguggcuccugaaguauuga

SEQ ID NO: 67835 - RNA, 6120 nt, Artificial Sequence
  derived and/or modified sequence opt5 from CR1__Homo_sapiens__NP_000564
augggcgccagcucccccagaucuccugagccgguggggcccccugcucccggacugccuuucugcuguggcgggagccuccuggccgucguugugcuucuggcgcuccccguggcuuggggacagugcaacgccccugaauggcugccguuugcccggcccaccaaucuuacagacgaguucgaauuuccuaucggcacguaccugaacuaugagugucgccccggguacuccggaagaccuuucucuauuaucugccucaagaauagcgucuggaccggcgcuaaagaucggugucgcagaaaguccugccggaaccccccggacccugugaauggcaugguucacgugauuaaagggauccaauuuggaucucagauuaaguauagcuguacaaaaggcuaccgccugaucggguccagcucugccaccugcaucauuuccggagauacagucaucugggacaacgaaacccccauuugugauagaaucccuugcggccugccccccacaauuaccaauggggacuucaucagcacgaaccgggagaauuuucauuauggaucugugguuaccuaccgcuguaacccuggcuccggcgggagaaagguguucgagcucgucggagaaccgagcauuuauugcacaucuaaugaugaccaggugggcaucugguccgggcccgcuccucagugcaucauucccaacaaguguaccccucccaauguggagaacggaauccuggucagcgauaaucggucccuuuuuucucugaacgaaguuguggaguuccgcugccaaccgggcuuugugaugaaagggccuagacgggucaagugucaggcccucaacaaaugggagcccgaacugccuagcugcucccgcgugugucagcccccucccgacguucuucacgcggagagaacacagcgggauaaggacaauuucagcccgggacaagaaguguuuuacucuugcgagccuggcuacgaucugagaggcgccgcuuccaugcgcuguaccccccagggggacuggagccccgccgcuccuacgugcgaagucaaaucuugugacgauuucaugggacagcuccugaacggccgggugcuguucccgguuaaucuccagcugggggccaagguggacuuugucugcgaugagggauuccaacuuaagggcagcuccgcgucuuauugugugcuggccgggauggagagccucuggaacuccagcguccccgugugcgaacagauuuuuugcccuucucccccuguuauccccaauggcagacauacaggaaaaccucuggagguguuccccuuuggcaagaccgucaacuacacaugugacccgcacccugaucgcgggaccuccuucgaccuuauuggagaaagcaccauccggugcacaucugauccccagggcaauggggugugguccagcccugcucccagauguggaauccugggccauugccaagccccggaccacuuucucuucgcuaaacugaagacgcagaccaacgccuccgauuuuccuauugggacaucucugaaauaugagugucgccccgaauacuauggccggccuuucagcaucaccugccucgacaaucugguuugguccucucccaaggauguguguaaaagaaagagcugcaagacacccccugacccggucaacggaauggugcacgugauuaccgacauccagguuggcucccgcauuaauuacagcuguacgacagggcaucggcuuaucggacacucuuccgccgagugcauccugagcggcaacgcugcgcauuggucuaccaaacccccuauuugucagagaauccccugcgggcucccucccaccauugccaauggagauuuuaucuccacaaaccgcgagaauuuccacuauggcagcgucgugaccuaccggugcaacccugggucuggcggaagaaagguguuugaacuggucggcgagccgagcauuuacuguacauccaacgacgaucaaguggggaucuggagcggacccgcuccucagugcauuauccccaauaaauguacgccucccaacguugaaaauggcauccuugugucugacaaccggucccuguucagccucaaugaggucguggaauuccgcugccagccgggguuuguuaugaagggaccuagacgggugaaaugucaggcccugaacaagugggagcccgagcugcccuccugcucuagagucugucaaccucccccugaugugcuccacgccgaacgcacccagcgggacaaggauaauuucagcccgggccaggagguuuuuuauuccugcgaacccggguacgaccugagaggcgcugccucuaugcgcuguacaccucagggagauuggagccccgcggcuccuaccugcgaggugaaauccugugacgauuucaugggccaacuucugaacgggagaguccucuuucccgugaaucugcagcugggagccaagguggacuucgucugcgaugagggcuuucagcuuaaagggucuagcgccuccuauugcguucucgcuggaauggaaagccuguggaacucuuccgugccggugugugagcagauuuucugcccuagccccccugucauccccaauggccggcauacaggcaagccucuggaaguguuucccuucgggaaagccguuaacuacaccugugacccgcacccugaccgcggaacgucuuuugaucucauuggcgaguccaccaucagaugcacaagcgacccccaagggaauggaguguggucuucccccgcuccucgguguggcauucuggggcauugccaggccccggaucacuuccuuuuugcgaagcugaagacccagacaaacgccagcgacuuccccaucggaaccucccucaaauaugaaugucgcccugaguacuauggcagacccuucagcaucacgugccuggauaaucuggucuggucuagcccuaaggacguguguaaacggaaguccugcaaaacacccccugauccgguuaacggcauggugcaugucauuaccgacauccaaguggggucucgcauuaacuacagcuguacaaccggacacagacuuaucggccacuccucugcugagugcauucucagcgggaauaccgcccauugguccacaaagcccccuaucugccagcggauccccuguggacugccucccacgauugcuaacggcgauuuuaucucuaccaaucgcgaaaacuuccacuacgggagcguugugacauauagaugcaaucugggaucccggggcagaaaggucuuugagcucgugggcgaaccgagcauuuacuguaccucuaacgacgaucagguggggaucugguccggaccugccccccagugcauuauccccaauaaauguacaccucccaacgucgagaauggcauccugguuagcgacaaccgcucucuuuucucccugaaugaagugguggaguuucggugccaaccuggguucgucaugaagggaccgagacgcgugaaaugucaggcgcucaacaagugggagcccgaacugccuagcugcucccggguuugucagcccccucccgagauucugcauggcgaacacaccccgucucaccaggauaauuuuagcccugggcaagagguguucuauuccugcgaacccggauacgaccuuagaggcgccgcuagccuccauuguacgccucagggcgacuggucucccgaggccccucgcugcgcugucaaauccugcgaugacuuucuggggcagcugccccacggacgggugcucuucccgcugaaccuucagcugggcgccaagguuagcuuugugugugaugagggguucagacucaaaggaucuagcgucucccauugcgugcuggucggcaugcgcucucuguggaauaacagcgugccuguuugugaacacaucuucugccccaaccccccugccauucuuaaugggcggcauacaggaaccccguccggcgacauccccuauggcaaggagauuucuuacaccugugauccucaccccgacagagggaugacauuuaaccucaucggagaaagcaccauucggugcacauccgauccucacggcaaugggguguggagcucucccgcuccucgcugugagcuguccgucagagcgggacauugcaagacgcccgagcaauucccguuugccagcccuaccauccccaucaacgacuucgaauuuccugugggcacaucccugaauuaugagugucggcccggguacuucggaaaaauguuuucuauuagcugccucgaaaaccugguuugguccucuguggaggauaauugucgcagaaagagcugcggcccgccucccgaacccuucaacggcaugguccacaucaauaccgacacacaguuuggguccaccgugaacuacagcuguaaugagggauuccggcuuauuggcucuccuuccacgaccugccuggugagcgggaacaauguuacaugggauaaaaaggcucccaucugcgagauuaucucuugugaaccuccgcccaccaucuccaacggagacuuuuauagcaauaacagaacaucuuuccauaauggcaccgucgugacauaccagugccacaccgggccugacggagagcaacucuuugaacuggugggcgagcgcagcauuuauuguacguccaaagaugaccaggucggcguguggucuagccccccuccccggugcaucuccacaaacaaguguaccgccccugaaguugagaacgccauuagagugccggggaaucgcagcuucuucacccugacagagaucauucgguuuagaugccagcccggauucgucauggugggcucccauaccguucagugucaaacgaacgggcgcuggggaccuaagcuuccccacugcucucgggugugucagccucccccggaaauccugcacggcgagcauacacucagccaccaggauaauuuuuccccugggcaggaagucuucuacucuugcgagcccagcuaugaccugagaggcgcugccucccuccauuguaccccccaaggagauuggucuccugaagcgccccgcugcacagugaaaagcugcgacgauuuucugggccagcuuccucacgggagaguucugcucccgcugaaccugcagcuuggagcuaagguguccuucgucugugacgagggcuuucggcugaaagggcgcagcgccucucacugcgugcucgccggaaugaaggcucuguggaauuccagcgugcccgucugugagcagaucuucugcccuaaccccccugccauucucaauggcagacauaccgggacacccuuuggcgauaucccguacggaaaagaaauuucuuaugcgugugacacccacccugaucggggcaugacguucaaccugaucggggaguccagcauucgcugcaccucugacccccaaggaaauggcguuugguccagcccugcucccagaugugaacuuuccgugccggccgccugcccucauccccccaagauccagaacgggcacuacauuggaggccaugugagccuguaccucccugggaugacaaucucuuauaucugugaucccggcuaccugcuggucggaaagggcuuuauuuucugcaccgaccaggggaucuggagccagcuugaccacuauuguaaagaggugaauugcuccuuuccucuguucaugaacggaauuucuaaggagcucgaaaugaaaaagguuuaccacuauggcgauuacgugacacugaaaugcgaggacggguauacccucgaaggaagcccguggucccaaugucaggcugaugaccggugggaucccccucuggccaagugcacgucuagaacacaugacgcucuuaucgucggcacccugagcggcacaauuuucuuuauccugcucaucauuuuccuguccuggaucauucuuaagcaccgcaaagggaauaacgcccaugagaaucccaaggaaguggcgauccaccugcacucucagggaggcagcuccguucauccucggacccuccaaaccaacgaggagaacagcagagugcugcccuga

SEQ ID NO: 67836 - RNA, 3279 nt, Artificial Sequence
  derived and/or modified sequence opt5 from CR2__Homo_sapiens__NP_001006659
augggcgccgcugggcugcucggaguguuccuggcccuugucgcgcccggcguucuggggaucagcugcggauccccuccgcccauucucaacggcagaaucucuuacuauagcaccccuauugcuguggggacagugauccgguacuccuguucuggaacguuucgccugauuggcgaaaagagccuucugugcaucaccaaagacaaggucgauggcacaugggacaaacccgccccuaagugugaguauuucaauaaauacuccucuugccccgagccuaucgugcccgggggauauaagauuagaggcagcacccccuaccggcacggggauuccguuacauuugccuguaagaccaacuucagcaugaauggaaacaaaucuguguggugccaggcuaauaacauguggggcccuacacgccuccccaccugugucuccguguuuccucuggaaugccccgcccugccgaugauccauaaugggcaccauacgagcgagaacguuggaucuauugcuccuggccucuccgugaccuauagcugugaaucuggcuaccugcuugucggggagaagaucauuaauugccuguccagcggaaaaugguccgccgugcccccuacaugugaggaagcgagaugcaagucucucggccgguuccccaacgggaaagugaaggagcccccuauccugcgcgucggaguuaccgccaacuuuuucugcgacgaaggcuacagacuucaagggccgcccagcucccggugugugauugcuggacagggcguggccuggacaaagaugccugucugcgaggagaucuuuugucccagcccucccccgauccugaacggccgccacauuggaaauucucucgcuaacguguccuaugggagcaucguuaccuacacgugcgauccugaccccgaagagggcgugaauuucauucugaucggggaaucuacacugagauguaccgucgauagccagaaaacaggaaccugguccggcccugcgccccggugcgagcucucuaccagcgccgugcaguguccucauccccaaauucugcgcgggagaaugguuuccggccagaaggaccgguauacauacaacgauacggugaucuuugccugcauguucggauuuacccuuaaaggcagcaagcagauccgcuguaacgcucaggggacaugggaaccgucugccccugucugcgagaaagagugucaagcuccgcccaauauucugaacggacagaaggaagacagacacauggugcgguucgauccuggcaccuccaucaaauauagcugcaauccgggguacguccucgugggagaggaaucuauucagugcacauccgagggcguuuggacgcccccugugccccaguguaaggucgccgccugcgaagcuaccgggagacaacugcuuacaaagccucagcaccaguucgugcgccccgacguuaacagcuccuguggcgagggauauaaacugucuggcagcguguaccaagagugccaggggaccaucccuugguuuauggaaauucggcucuguaaggagaucaccugucccccgccucccgucaucuacaauggagcgcauacaggcuccucucuggaagauuucccuuaugggaccacagugacguauaccugcaaccccggaccggagagaggcguggaauuuagccugauuggggaguccacaauccgcugcaccagcaaugaccaggagcggggcacauggucuggaccugcuccccucuguaaacugucccuucuggccguucagugcagccacguccauauugccaacggcuacaagaucucugggaaagaagccccuuacuucuauaaugacaccgugacguuuaaguguuacuccggauucacccucaagggcagcucucaaauuagaugcaaagcugauaacacaugggaccccgagauccccgugugcgaaaaggggugucagagcccuccgggacugcaccacggccgccauaccgggggcaauacagucuuuuucguguccggaaugaccguugauuauacgugcgaccccggcuaccuucugguggggaacaaaagcauucacuguaugccuucuggaaauuggucccccagcgccccucggugcgaggagacaugucagcaugucagacagucccuccaagaacugcccgcgggcucucgcguggagcugguuaacaccagcugccaggauggguaccagcucacaggacacgcuuaucagaugugucaagacgccgaaaauggcaucugguuuaagaaaaucccucugugcaaggugauucauugucacccgcccccugucaucgugaacggcaagcacaccgggaugauggccgagaacuuccuuuacggaaaugaaguuuccuaugagugcgaucagggcuuuuaccugcucggggagaaaaagcugcagugucggucugacagcaaaggacauggcuccuggucugggcccagcccucagugccugagaagcccgcccgugacccgcugcccuaaccccgaagucaagcacggauauaaacuuaauaagacacauuccgcuuacucucacaacgauauuguguauguggacuguaaucccggcuucaucaugaacggcucccgggucauuagaugccacacggauaauaccuggguuccuggggugcccacauguaucaagaaagccuuuaucggaugcccuccgcccccuaagacccccaacggcaaucauacagggggaaacauugcucgguucagcccuggcaugucuauccucuacuccugugaccaaggguaccugcuggugggagaggcccuccugcuuugcacccacgaaggcacguggagccagcccgcgccgcauuguaaagaggucaauuguucuuccccugccgacauggauggcauucagaaggggcuggaaccccgcaaaauguaucaauacggagcugugguuacacucgagugcgaggacggcuauaugcuggaagggagcccucagucccagugccagagcgaucaccaauggaaucccccucuggccguguguagaucucggagccuugcucccguccucugcggaaucgccgcgggccugauucugcucaccuuccugaucgugaucacccuuuacguuauuuccaagcauagagcccgcaauuauuacacagacaccucucagaaagaggcuuuucaccuggaagcccgggagguguauagcgucgauccguacaacccugcuuccuga

SEQ ID NO: 67837 - RNA, 414 nt, Artificial Sequence
  derived and/or modified sequence opt5 from CRABP1__Homo_sapiens__NP_004369
augcccaacuucgccggcaccuggaagaugagaagcuccgagaauuuugacgaacugcucaaagcucugggggugaacgccaugcuucggaaggucgcgguugcugccgccucuaaaccucacguggagauccgccaggauggagaccaauucuacauuaagacaagcacgaccgugagaacaaccgaaaucaauuuuaaagucggcgagggguucgaagaggagacaguggauggacggaagugccgcucccuggcuaccugggaaaacgagaauaagauucauuguacacagacccuccuggaaggcgacgggccgaaaacguauuggaccagagagcuugccaacgaugagcugauccucacauuuggagcugacgauguugugugcacccggauuuacguccgcgaauga

SEQ ID NO: 67838 - RNA, 417 nt, Artificial Sequence
  derived and/or modified sequence opt5 from CRABP2__Homo_sapiens__NP_001186652
augcccaacuucagcggcaauuggaagaucauuagauccgagaacuuugaagaacugcucaaagugcugggggucaauguuaugcuucggaagaucgccguggcugccgcgucuaaaccugcuguggaaauuaagcaggagggagacaccuucuacaucaaaacaagcacgaccguccgcacaaccgaaauuaacuuuaaggugggcgaggaguucgaggagcaaacaguugaugggagaccgugcaagucccuggugaaaugggaaucugagaauaagauggucugugagcagaaacuccugaagggagaaggccccaaaaccagcuggacacgggagcuuaccaacgacggggaacugauccucacgaugaccgccgaugacgugguuugcacacgcguguaugucagagaguga

SEQ ID NO: 67839 - RNA, 2196 nt, Artificial Sequence
  derived and/or modified sequence opt5 from CRACR2A__Homo_sapiens__NP_001138430
auggccgcucccgacggcagaguggucagccggccucagcgccuggggcaaggauccggccaggggccgaagggaucuggcgccugccuccacccccuggauagccuugagcagaaagaaacccaggagcaaacauccgggcagcugguuaugcucagaaaggcgcaggaguucuuucagacgugugacgcugagggaaaaggcuucaucgcccggaaggauaugcaacgccugcauaaagaacuuccucugucucucgaggagcuggaagacguguuugaugcccuggacgcugauggcaacggguaccucacaccccaggaguucaccaccggauuuagccacuucuuuuucucccagaauaacccuucucaggaagacgccggcgagcaaguggcucagagacaugaggaaaaggucuaucugagccggggagaugaggaccuuggagauaugggcgaagacgaggaagcccaguuucgcaugcugauggauagacucggggcgcaaaaggugcuggaggacgaguccgacguuaaacagcuuuggcugcagcucaagaaagaagaaccccaucugcugagcaauuucgaagauuuucucacacggauuaucucucagcugcaagaggcccacgaagagaagaacgagcuugaaugcgcucugaaacgcaagauugccgcuuacgacgaggaaauccagcaccucuaugaggaaauggagcagcagauuaaguccgagaaagaacaauuccugcuuaaggauaccgagagauuucaggcccggagccaggaacuggagcagaaacuccuguguaaggagcaagaacuggagcagcucacacagaaacagaagcgccuggaaggacaaugcaccgcgcuucaccaugacaaacacgagacgaaggccgaaaauaccaagcugaaacucacaaaccaggagcuggcuagagagcuugaacggaccucuugggagcugcaggaugcccaacagcagcucgaaucccugcagcaagaggcuuguaagcugcaucaggaaaaagagauggagguguaccgcgucacagaaagccuccagagagagaaggccggccugcuuaaacagcuggacuuccuccgggaaagaaauaagcaucugcgcgaugagcgggacaucugcuuccaaaagaacaaagccgcuaaggcgaauaccgccgcuucuagagccuccuggaaaaagcgcagcggcuccgugaucgggaaauauguugauucucgggggauucugagaagccaguccgaagaggaggaagagguguuuggcaucccucgccggagcucucuugggcucuccggauacccgcugacggaagaggagcccggcacaggggaaccuggacccggcggcccuuaucccagaccgcugcgccggauuaucagcgucgaggaagacccucucccccagcugcuugaugggggauucgagcagccucugucuaaguguagcgaagaggaggaaguguccgaccaaggcgugcaggggcagauucccgaggcucccccucucaagcugaccccgacaucucccagaggacaaccugucggcaaagaagcccugugcaaggaggaaagcucccccagcgccccugaccgccuuuuuaaaaucguuuucguggggaacucugcggugggcaagaccuccuuucuccggagauucugugaggaucgguuuagccccggaauggcugccaccgucggcauugacuaccgcgugaaaacacugaauguugauaacucucagguggcccugcagcucugggacacggcugggcaggagagauaccggugcaucacccaacaguucuuuagaaaggccgauggagucaucgugauguaugaccugacagauaagcaguccuuccuuagcguucgccgguggcuguccucuguggaagaggcugucggcgacagagugccgguccuccugcuggggaauaaacuugauaacgaaaaggagcgcgaagugccuagaggacucggcgagcagcuggccaccgagaauaaccugaucuuuuacgaauguagcgcguauuccgggcacaacacaaaagagucucuccugcaccuugcccgguuccugaaggaacaagaggacaccguucgcgaggauacgauucaggugggccaccccgcuaaaaagaaaagcugcugcggauga

SEQ ID NO: 67840 - RNA, 600 nt, Artificial Sequence
  derived and/or modified sequence opt5 from CRADD__Homo_sapiens__NP_003796
auggaggccagagacaaacaggugcugcggagccuccgccuggaacuuggcgcugagguccugguugaagggcucgugcugcaauaccuuuaucaggagggaauccugaccgaaaaccacauucaggagaucaaugcccagacaacgggccucagaaagaccaugcugcugcucgauauucugcccucccgggggccuaaggcguucgacacauuucuugauucucugcaagaguucccgugggugcgcgaaaaacucaagaaagcuagagaggaagccaugaccgaccugcccgccggagaucggcuuacaggcaucccuagccauauucugaacuccucucccagcgaccgccagaucaaucagcucgcucagagacuggggccugagugggagcccaugguccugucccucggacugucucaaaccgauaucuaccggugcaaggccaaccacccucauaaugugcagagccagguuguggaggcuuuuauucgcuggagacagcgguucggcaagcaagccacauuucagucccuucacaacggccugcgcgcggucgaaguggacccgagccuccugcuucauaugcuggaauga

SEQ ID NO: 67841 - RNA, 3810 nt, Artificial Sequence
  derived and/or modified sequence opt5 from CRAMP1L__Homo_sapiens__NP_065876
augaccgugaagcugggcgacgggggaagcggcgaggaugggcucaaaaagcugggaaaaagagccgcugacgaagagucccuugaaggcgagggggccggaggcgcggaugcugccgaagagucuagcggcacaaagcgggacgagaaaacgccccgcgccggggcugauggaccuccggcgcccccuggcgcuccccaggccccuagcccuccccaagggucuccgcaggaccagcaccauuuccugagaagcuccguccggccccagucuaagcgcccuagaaaggaucccccuagcgcgguuggauccggcaacgccgggggaagcggcccccggggcaaaggggcugaaggaggcgggucuuccagcggaaaugugucuggcguggccccggcugccccugccgggggaucccgcuccucuuccagaaaccucggcagcuccggcggggagaaggaagagggaaagaagguccggcgccaaugggagucuuggagcaccgaagacaaaaauacauuuuucgagggccuguacgaacacgggaaggauuuugaggccauccagaacaauauugcucuuaaguauaaaaagaaaggaaagcccgccuccauggugaaaaacaaggaacagguuagacauuucuacuaucggaccuggcacaaaaucacaaaguacauugacuuugaucauguguucagccgcggccugaagaaaucuucccaggagcucuaugggcugaucugcuacggcgagcugagaaagaaaauuggaggcuguauggacgauaagaaugcuaccaaacucaacgaacugauccaagucggggccacaaccgugcgguauaagggacgcaaucuuagaaucaaggccccuaugugccgggcucugaaaaagcucugugaccccgacggccugagcgaugaggaagaccagaaacccguuagacuuccucugaaggugccgauugagcuccagccccgcaacaaucacgcgugggcccggguccagucucuggcucaaaacccuagacugcgcaugaucguggaacuccaccggaaagugagcucccugauugaguuucuuaagcagaagugggcccugcaugaggucagaguucgcaaaacgcucgaggaacggcagcugcaagauucuugcagcgcccccaugcaggaaaaggugacccuucaccuguucccuggggagaauuguacacucacaccccugccgggaguggcuagagucgugcauuccaaagccuuuugcaccguucacuggcaggaaggcgggcgcuguaagcagagcgcgaaagacgcucacgugcugccucccgcccaaauccucggcauucagucuggacagggcaccgcccgggggcaggucaagugcccuagauccggagcugagggcaagggggugggacggcccccucccgccgcugaugcccugcaaagcucuggcgaguccagcccggaauccgcgccuggggagggcgccgcucuuucucugagcucccccgacgcccccgaucgcccuccgcccagacaucaggacacgggaccuugucucgagaaaacacccgcugaaggccgggauucuccuacccgcgagcccggggcccugccuugcgcguguggacagcuucccgaccuggaagaugagcucagccugcuggacccgcucccuagauaccugaaguccugccaggaccuuaucguucccgaacaaugccggugugccgauacaagaccuggcagcgagcagcccccgcucgggggagcugccucuccugaagugcuggcucccgucuccaaagaggccgccgaccuggcuccuaccggccccagcccccgcccugggccgggccugcuucucgaugugugcaccaaggaccuggcggaugcccccgcugaggaacugcaggagaaaggaucuccugccggacccccucccucccaggggcaaccugccgcucggccgcccaaggaagucccugccagcagacucgcgcagcagcugcgcgaggaaggauggaaccuucaaacaucugagagccugacgcucgcugagguguaccugaugaugggcaaacccuccaagcugcagcuugaauaugacuggcucgggccuggaagacaggauccccggccgggcagccugccuaccgcccugcacaagcagcgccuccugucuugucuucugaaacucauuuccacagagguuaaucccaagcuggcccuggaagcuaacaccaucagcacagccuccgugagacccgcgcaagaggaacagucuaugaccccucccggcaaagucgugacgguuagcucccggucuccucgcugcccgagaaaccaggcuagccuucgguccucuaagacauuucccccuagcuccgcccccuguagcucugggcuccgcaauccucccagaccgcugcuggugccuggacccuccagcaccggcucuaacgacuccgaugggggacucuucgccgucccuaccacacugcccccuaauagccggcauggcaaacuuuucucucccuccaaggaggcugagcugaccuuucgccagcaccucaacagcaucuccaugcaaagcgacuucuuccugccgaagccuagaaaacugcggaauagacaucuucgcaagccccucguggugcagcggacacugcugcccagaccuucugaaaaccagagccacaauguuugcuccuuuucuauucucagcaacuccucugucacggggcgcggcagcuuccggccgauccaguccucucugaccaaagccgcucuuagcagacccauugugccuaaggugcugcccccucaagccacaucccaccucgcgagcgccaucgaucuggcugccaccucugcuggcauucuguccggcaauccccuuccugcccuggacacagaggggcucagcggaaucucuccgcuguccagcgaugaagucaccggcgccaucuccgggcaggacucuacgggaacccaucaggacggcgauacacuccccaccguugggggaagcgacccuuuuguguccauucccagccgcccugagcaagagcccguggcugauucuuuccagggcuccagcguccugucucuuagcgaacugccgaaagcgccucuccagaacggccuguccaucccccugucuagcuccgagucuagcuccacacggcuuucucccccugacgugagcgcccugcucgauauuucccugcccgggccuccggaagacgcucucagccagggagagcccgccacccacaucuccgauucuauuaucgaaaucgccauuagcuccggccaauacggggagggaguuccucugucucccgcuaaacuuaauggcagcgacuccagcaagucucugccuucccccucuagcuccccgcagccucauuggaucgccagccccacgcacgauccucagugguaucccucugacagcacagauuccucucucagcucccuguuugcgagcuucauuuccccugagaaaucuagaaagaugcugcccaccccgaucgggacaaacagcggaaccucccuucugggcccuucucuccuggacggcaauagccgcgauuccuuugugucucggagccucgcugacgucgccgaagugguugacucccagcugguguguaugaugaacgagaauagcauugauuacaucucuagauucaacgaccuugcccaagaacuguccauugcugagcccgggcggcgcgaagcccuguuugauggaggcgggggaggccccgcggucagcgaccucucucaguga

SEQ ID NO: 67842 - RNA, 1881 nt, Artificial Sequence
  derived and/or modified sequence opt5 from CRAT__Homo_sapiens__NP_000746
augcuggccuucgcugccagaaccguggucaagccccucggcuuucugaaaccuuucagccuuaugaaggcguccucucgguuuaaagcucaccaggacgcccugccgcgccuccccguuccuccccugcaacagagccuugaucauuaccugaaggcccuccagccuaucguguccgaggaagagugggcucacacaaaacagcugguggacgaguuccaagccucugggggagucggcgaaagacugcagaaggggcucgaacggcgcgcuagaaagacggagaacuggcugagcgagugguggcuuaaaaccgccuaucugcaguaccggcagcccgugguuauuuauuccucuccuggagugaugcucccgaagcaagauuuugucgaccugcagggccagcuucgcuucgcggccaaacugaucgaaggggugcucgauuuuaagguuaugauugacaaugagacacugcccguggaauaccugggaggcaaaccucucugcaugaaccaguauuaccaaauccugagcuccuguagaguccccggcccuaagcaggauaccgugagcaauuucucuaagaccaaaaagcccccgacacauauuacagugguccacaacuaucaguuuuucgagcuugacguuuaccauuccgaugggaccccucugacggcugaccaaaucuuugugcagcucgagaaaaucuggaauagcucucugcagaccaacaaggaacccgugggcauucuuacauccaaucaccggaacagcugggccaaggcuuacaauacccugaucaaggauaaagucaaccgcgacucugugagauccauucagaaaagcaucuucacaguuugccucgaugccaccaugccucggguguccgaggacgucuaucgcucucacguggcgggacaaaugcugcaugggggaggcagcagacuuaauuccgggaaccggugguuugacaagacgcuccaguucauuguugccgaagauggaagcuguggccugguguacgagcacgcugccgcugaaggcccucccaucgucacacuucuggacuaugugauugaguacaccaaaaagcccgagcucguccgcucuccgauggugccccugccuaugcccaaaaagcugagauucaauaucacaccugaaaucaaauccgauauugagaaggccaagcagaaccugagcaucaugauucaggaccucgauaucaccguuaugguguuucaucacuucgggaaagacuuucccaagucugaaaaacugagcccggaugccuucauucaaauggcucugcagcucgcguauuaccggaucuauggacaggccugcgcuaccuacgaguccgccucucugagaauguuucaccuuggccgcacagacacgauccggagcgccuccauggauagccugaccuucgucaaggcuauggacgauucuuccgugacagaacaucagaaaguugagcuccugagaaaggccgugcaagcgcaccgcggguacaccgaccgggcuauuagaggagaggccuuugaccgccaucugcuuggccucaagcugcaggccaucgaagaucuggucagcaugccugacauuuucauggauacaucuuaugcuaucgccaugcacuuucaucucuccaccagccaggugcccgcuaaaacggacugugugauguucuuugggccuguuguccccgauggauacggcgugugcuauaauccuauggaggcccacauuaacuucucccugucugcguacaacagcugugccgaaacaaaugcugcccggcuugcucacuaucuggagaaggcccuccuggacaugagagcgcugcuucagucccauccccgcgccaaacucuga

SEQ ID NO: 67843 - RNA, 3885 nt, Artificial Sequence
  derived and/or modified sequence opt5 from CRB1__Homo_sapiens__NP_001180569
auggcccugaagaacaucaauuaccuccugauuuucuaucuuagcuuuucccugcucaucuacauuaaaaacucuuucugcaauaagaacaauaccagaugucugagcaacuccugccagaauaacucuacauguaaagacuuuagcaaggauaaugacugcuccuguucugauacggcuaacaaucuugacaaagauugcgacaacaugaaggaucccuguuucagcaauccuugccaaggcuccgccaccugugugaacacaccgggggagcggagcuuucugugcaagugucccccuggauauucuggcaccaucugcgaaacaaccauuggguccugcggcaaaaauagcugucagcacggagggaucugccaucaggaccccaucuacccugucuguauuugccccgcgggauaugcuggccgcuucugugagaucgaucacgacgaaugcgccucuuccccuugucagaacggcgccguuugccaagaugggauugacggauacagcuguuuuugcgugccgggcuaucaggggagacauugugaucucgagguggacgaaugcgcuucugaccccugcaagaacgaggccacaugucugaaugagaucggacgguauaccugcauuuguccucacaacuacuccggcuacacgggggcucagugcgaaaucgaucugaaugaguguaacagcaaucccugccaguccaacggagaaugugucgagcucucuagcgagaaacaauacggccgcauuaccggccugccuuccagcuucucuuaucaugaagccuccggguacgugugcaucugucagcccggauuuacaggcauccacugcgaggaagacguuaaugaguguagcucuaacccgugccagaaugggggaaccugcgaaaaccuuccuggcaauuauacaugucacugccccuucgauaaccugagcagaaccuuuuacgggggacgggacuguuccgauauucuccugggcugcacgcaucagcaaugucuuaauaacggcacaugcaucccucacuuccaggacgggcagcauggauuuucuugucugugccccagcggcuauaccgggucccucugugagauugcgacaacccugagcuucgagggagauggcuuccugugggugaagucuggguccgucaccacaaaaggcagcgugugcaauaucgcccuccgcuuucaaacgguucagcccauggcucugcuucuguucagaucuaaccgggacguguuugucaagcucgaacugcuuuccggauacauucaccugagcauccaggugaacaaucaguccaaggugcuccuguucaucucucacaacaccagcgauggcgaguggcauuuugucgaaguuauuuucgccgaggcugugacacugacccucaucgacgauuccuguaaagaaaagugcauugccaaagcgccuacaccgcuggagucugaccaaagcaucugcgccuuucaaaauuccuuccuugggggacugcccgugggcaugaccagcaacggggucgcucuccugaauuuuuacaacaugccuucuacgcccuccuucgugggaugucuucaggacauuaagaucgauuggaaucacaucacacuggagaacauuagcucuggcuccagccucaauguuaaagccgggugcgugcgcaaggacuggugugaaucucagccuugccagagcagaggccgguguaucaaccuguggcuguccuaucagugcgauugucaucgccccuacgagggaccgaauugccucagagaauaugucgcuggccgguuugggcaggacgauagcaccggauacgugauuuucacccuggacgagucuuauggcgauacaaucucccuuagcauguuuguucgcacccugcagccuuccgggcuccugcuggcccuugaaaacucuacauaccaauauauuagaguguggcucgagcggggaagacuggccaugcugacgcccaauagcccuaaacucgucgugaaguucguccugaacgacggcaaugugcaccuuaucucccugaagauuaaacccuacaagaucgagcucuaccagucuagccagaaccugggguucaucuccgcuucuaccuggaaaauugaaaagggcgauguuaucuauauuggaggccugccugacaaacaggagacagaacuuaacgggggauuuuucaagggcuguauccaagaugugcgccucaauaaccagaaucuggaguuuuuccccaacccgaccaauaacgcgagccugaauccuguccucgugaacguuacacaggggugcgccggagacaauuccuguaagagcaaccccugccauaauggcggggugugccacucucggugggaugacuuuuccuguagcugccccgcucugaccucuggcaaagccugugaggaaguccaauggugcggauucuccccuuguccgcacggcgcccagugccagcccgugcuucagggguuugaguguauugcuaacgccguguucaauggacaaagcggccagauccuguuuagaucuaacgggaauaucacgcgcgaacucaccaacauuacauucggauuucggaccagagacgcgaacguuaucauucugcaugcugagaaggaaccugaguuccugaauaucuccauucaggauagccgccucuuuuuccagcuucaauccggcaacagcuucuacaugcugucucugacaagccuccaguccgucaaugacggcaccuggcacgaggugacgcugucuaugacagauccccuuagccagaccucccgguggcagauggaaguggacaacgagacaccuuuugucaccucuaccaucgccacagggagccugaauuuccucaaagauaacacggacaucuaugugggagauagagccauugacaauaucaagggccugcaagggugccuguccaccauugaaaucggaggcauuuaccuuucuuauuuugagaacguucauggguucaucaauaaaccccaggaggaacaguuucucaagaucagcacaaacuccguggucaccggaugucugcaacugaaugugugcaacagcaauccuugucuccacggcggcaacugcgaggauauuuacucuuccuaucacugcagcuguccccugggguggucuggaaagcauugcgaacuuaauaucgacgaguguuucuccaacccgugcauucacggcaauuguagcgaucgcguugcugccuaccauugcacaugugaaccuggguacaccggagugaacugcgaggucgacaucgauaacugucagucccaccagugcgcuaauggcgccacguguauuucucauacaaacggguauagcugccuguguuuuggaaauuucaccggcaaauuuugccggcaguccagacuccccagcaccgugugcggcaacgaaaagacaaaucugaccuguuacaacgggggaaauugcacagaguuccaaacggagcugaaauguaugugccgcccuggcuuuaccggggaauggugugagaaggacaucgacgaaugcgcgucugaucccuguguuaacggaggccuuugccaggaccugcucaauaaauuccagugucugugcgauguggccuucgcuggggagcggugugaggucgaccucgccgaugaccugauuuccgauaucuuuacaaccaucggaagcgugacaguggcccuucugcucauucugcugcuugcuaucgucgcgucuguugugaccagcaacaagagagccacgcagggcaccuauuccccgucucggcaagaaaaggagggcagccgcguggaaauguggaaucugaugccucccccugcuauggagagacucauuuga

SEQ ID NO: 67844 - RNA, 3858 nt, Artificial Sequence
  derived and/or modified sequence opt5 from CRB2__Homo_sapiens__NP_775960
auggcccuggcuagacccggcaccccugacccgcaggcccucgcgagcgugcugcuucugcuccugugggcucccgcccuuucccugcucgccgggacagucccuucugagcccccuagcgcuugcgccuccgaucccugugcuccuggaacggaaugccaagccaccgagucuggcggguacacauguggaccgauggaaccccggggcugcgcgacccagccuugucaccauggggcccugugcguuccccagggaccugaccccacaggcuuccgcuguuauugcgugccgggcuuucaggggccuagaugugagcuggauaucgacgaaugcgcuagccggcccugucaccauggagcgaccugccgcaaccucgcugauagauacgagugccacuguccucugggcuaugccggggugacaugcgagauggaagucgacgagugugcguccgcccccugccuucauggaggcucuugucuggauggggugggcagcuuccggugcguuugugcucccggcuacggcgggacccgcugccaacucgaccuggaugaaugucagucccagccuugcgcccacggaggcacgugucacgaccuugugaauggguuuagaugcgauugcgcuggaaccggcuaugaggggacacauugugagcgggaaguccuggagugcgccagcgccccgugugaacacaacgcuucuugccucgagggacugggcuccuuccgcugucugugcuggcccggcuacagcggggaacucugugagguggacgaggaugaaugcgcgucuuccccuugucagcauggaggcagaugccugcaacggagcgaccccgcccuuuaugggggaguucaggcugccuuuccuggcgccuucucuuuucgccacgcugccggguuccugugucacugucccccgggcuuugagggagcggacugcggcguggaagucgaugagugcgcuuccagaccuugccucaaugggggacauugucaggaccugcccaacggcuuccagugccacuguccugauggguacgccggaccuaccugcgaagaggacguggaugagugucuuagcgacccuugccugcauggcgggacauguuccgauaccguggccggcuacauuugccggugucccgaaacguggggaggccgcgacugcucuguccaacucacagggugccagggacacaccuguccgcuggcugccacaugcaucccuauuuuugagagcggcguucauuccuaugugugucacugcccucccgggacccacggacccuucuguggccagaauaccacauuuagcgugauggcugggucuccgauccaagccuccguccccgcgggcggaccucugggccucgcccugagauuccggacgacccuucccgcugggacacuggccaccagaaacgauacaaaggaaagccucgagcuggcucuuguggccgcgacccugcaggccacgcucuggucuuacagcacaaccguucuggugcugcgccucccugaccuggcucuuaaugauggacauuggcaccaggucgaagugguucugcaucucgccacccuggagcugcggcuuuggcacgagggcugccccgcuagacucuguguggccuccgggccugucgcccuggcuucuacagcgagcgccacaccccugccggcuggaauuuccagcgcccagcucggcgacgccaccuucgcugggugccugcaagacgugcgcgucgauggccaccuucugcucccugaagaccugggagagaacgugcugcuuggcugugaacggagagagcagugccgcccccucccuuguguucaugggggaucuugcguggaucuguggacgcacuuucggugcgacugugccagaccccaucgcggcccgaccugcgcggaugagaucccugcugccacauucgggcugggaggcgcccccuccagcgcuucuuuucuccugcaggaacuuccuggccccaaucugaccgucuccuuccuccugcggacaagagagagcgccgggcugcuucuccaguuugcgaacgacuccgcugccggacugaccguguuccugucugaaggccgcauccgggccgagguucccgggagcccugcugugguccucccgggaagaugggaugacggccugcggcaccuugugaugcuguccuuugggcccgaucaacuccaggaccugggacagcaugugcacguuggcggccgccugcuugccgcugauucucagccuuggggagggcccuucagaggcugucuccaagaccugcggcuggaugggugccaccuccccuuuuucccccugccucuugacaauagcucccagccgagcgaacugggaggcagacagucuuggaaccucacggccgggugugucuccgaggacaugugcagccccgauccuuguuuuaauggaggaaccugccuggugacauggaacgacuuccauuguaccugccccgcgaauuuuacaggcccuaccugugcccagcaacuguggugccccgggcagccgugccuuccucccgcuacgugugaggaagugcccgauggauucgucugcguggccgaggcuacauuccgcgaaggcccucccgccgccuuuucugggcacaacgcuuccagcggacggcugcucggcgggcugucucucgcguucagaacccgcgacagcgaggccuggcugcuuagagcugccgccggagcucuggaaggcguuuggcucgccgugcggaacggcucccuggccgggggaguccgcggcgggcauggacugccuggcgcugugcuuccgauucccgggccuagaguugccgauggagccuggcaccgggugcgccuggcuauggagagacccgccgcgacaaccagccgguggcuccuguggcucgacggcgcugccaccccugucgcccugcgcggccuugcuucugaucugggguuucuccagggacccggcgccgugagaauccugcuggcugagaauuucacagggugucuuggacggguugcccugggcgggcucccgcugccucucgcgcgccccagaccuggagccgcucccggcgcccgggaacauuuugcuuccuggccuggcacgcccgccccgauucuggggugcagaggagccccugugugugcucccagccccugccuucacgacggcgcgugucgcgaucuguucgacgccuuugcuugcgccugugggccuggaugggagggcccgcggugcgaagcccacgucgaucccugucauuccgcuccuugcgccagagggcgcugucacacccaucccgacggacgguucgagugcagaugcccucccggcuuuggcgggccucgcugucggcugccggugcccucuaaagaaugcagccucaacgugacaugucuggauggauccccuugcgagggcgggucucccgcggcuaauuguagcugccuugagggacuggccggccaaagaugucaggucccuacccuccccugcgaagccaacccgugucugaaugggggcacaugccgcgcugccggaggcguuuccgaguguaucugcaacgcgcgguucucugggcaguuuugcgaaguggccaagggacucccucugccccuucccuucccucugcuggagguggcuguccccgccgcuugugccugccuccugcuucugcuccugggccuccugagcgggauucuugcugccagaaaacggcgccaguccgagggaaccuauagcccuucucaacaggaaguggcgggcgccagacuggagauggacuccguucugaaggugccgcccgaggaacggcucaucuga

SEQ ID NO: 67845 - RNA, 372 nt, Artificial Sequence
  derived and/or modified sequence opt5 from CRB3__Homo_sapiens__NP_777377
auggccaaccccggccuggggcuccugcuugcccugggacucccuuuccugcuugccagauggggccgggcgugggggcagauccaaaccacaagcgcuaaugagaacuccacggugcugccgucuagcaccuccucuagcuccgacggaaaucuccgccccgaagccauuacagccaucauugucguguuuucucugcuggcugcccuccugcuugcuguuggccuggcccuccuggugagaaaacuucgggagaagcgccagaccgaagggacauacagaccuagcuccgaggaacaguucagccacgcggccgaggcucgggcuccccaggauucuaaggagaccguccaaggaugccugccuaucuga

SEQ ID NO: 67846 - RNA, 1326 nt, Artificial Sequence
  derived and/or modified sequence opt5 from CRBN__Homo_sapiens__NP_001166953
auggccggcgagggggaccagcaagaugcugcccacaacaugggaaaucaucugccccuccugccugaaagcgaggaagaggacgaaauggagguggaggaucaggacuccaaggaagcgaaaaagccgaacaucauuaauuucgauaccucucuucccacaagccacacguaccugggcgcugacauggaggaauuucaugggagaacccuccacgaugacgauuccugccaggucaucccuguucugccccaggugaugaugauucuuaucccuggacaaacacugccccuccagcuguuccauccucaggaggugucuaugguccggaaccugauucagaaagaccgcaccuuugccgugcucgccuauagcaauguucaagagagagaagcucaguucggcacaaccgccgagaucuacgcuuaucgggaggaacaggauuuugggaucgaaauugugaaggucaaagccaucggacgccagagauucaaggugcuggagcuucggacacaauccgacggcauucagcaggcgaagguucaaauccugccggagugugugcuccccucuaccaugagcgccguccagcuggaaucccuuaacaaaugccagauuuuuccuagcaagcccgugucucgcgaggaucaguguuccuacaaaugguggcaaaaguaucagaaaagaaaguuccacugcgcuaaucugacgagcuggccucgguggcucuacucucuguaugacgccgaaacccugauggaccgcaucaagaaacagcucagagagugggaugaaaaccugaaggacgauucccuucccagcaauccgauugacuuuucuuaccggguggcugccugucugccuaucgaugacguccuccgcauccagcugcuuaaaauuggcuccgcgauccaaagacugcggugcgagcucgauauuaugaacaaguguacaagccugugcuguaaacagugccaggagaccgaaaucacaaccaagaaugagauuuucucccugucucucugugggcccauggccgcuuacguuaacccucacggauaugugcaugaaacgcugacaguguacaaagccugcaaucuuaaccugaucggccgccccagcaccgagcacuccugguuucccggguaugcuuggacagucgcccagugcaagaucugugccagccauauuggauggaaguucaccgcuaccaaaaaggacaugucuccucaaaaauuuuggggccucacaagauccgcgcugcuuccgacgauccccgauaccgaagacgagauuagcccugauaaggugauccugugccucuga

SEQ ID NO: 67847 - RNA, 348 nt, Artificial Sequence
  derived and/or modified sequence opt5 from CRCP__Homo_sapiens__NP_001035737
auggaggugaaggacgccaacagcgcucugcucuccaauuacgaaacccugaaauauaucucuaagacacccugcagacaccagagcccugagauuguccgggaguuccuuacggcccugaaaucccauaagcucaccaaagcggagaagcugcaacuucugaaccaccgcccgguuacagcuguggaaauccagcucaugguggaggagucugaagagagacugaccgaagaacagauugaggcccugcuccauacagucaccagcauccugcccgccgaaccugaggcugaacagaagaaaaauacaaacuccaauguggccauggaugaggaagaccccgcuuga

SEQ ID NO: 67848 - RNA, 300 nt, Artificial Sequence
  derived and/or modified sequence opt5 from CRCT1__Homo_sapiens__NP_061933
augagcucccagcaaucugccgugagcgcuaagggcuucuccaaagggucuagccagggacccgccccuugcccggcgcccgcuccuacccccgccccugccuccucuagcuccuguugcggcagcgggagaggauguugcggcgacucuggguguugcggauccagcucuacauccuguugcuguuuuccccggcgcagacggcgccagagaagcucuggcugcuguugcugcggcgggggaucccagcggagccaacgcuccaacaauagaucuagcggcuguugcuccggguguuga

SEQ ID NO: 67849 - RNA, 1026 nt, Artificial Sequence
  derived and/or modified sequence opt5 from CREB1__Homo_sapiens__XP_011508947
augaccauggagagcggcgccgaaaaccagcaauccggggacgcugccgugacagaggcggaaaaucagcagaugacgguccaggcucaaccccagaucgccacccuggcccagguuucuaugccugcugcccacgcuacaagcuccgccccgaccgugacacucgugcagcugcccaacggacaaaccguccaggugcauggcguuauucaggcggcccagccuucugugauccaaagcccccagguccagacagugcaauccucuugcaaggaucuuaaaagacuguucagcgggacccagauuuccacgaucgcugagagcgaagacucucaggaguccguugauagcgugaccgacucucagaagcggcgcgagauucucuccagacggccuagcuaccgcaaaauccugaaugaucuuucuuccgacgcccccggagucccuagaaucgaagaggaaaagagcgaggaggaaacauccgcuccggccauuaccacagugaccgugcccacgccuaucuaucaaacaucuagcggccaguacauugcgaucacccaagggggagccauucagcuggcuaacaauggcacagauggcguccaggggcuccagacccugaccaugacaaacgccgcugccacgcagcccggaaccacaauccugcaguaugcccaaaccacagacggccagcagauucucguuccuuccaaucagguggugguccaagcugcgagcggggaugugcagaccuaccagauccggacggcccccacaucuaccaucgcuccgggaguugugauggccuccagcccugcccugcccacccaaccugcugaggaagccgcgcgcaaaagagagguccggcuuaugaagaaccgcgaagcugccagagagugucggcgcaagaaaaaggaguaugugaaaugccuggaaaauagaguugccgugcucgagaaccagaauaagacacugauugaggaacuuaaagcucugaaggaccucuacugucacaagucugauuga

SEQ ID NO: 67850 - RNA, 1116 nt, Artificial Sequence
  derived and/or modified sequence opt5 from CREB3__Homo_sapiens__NP_006359
auggagcuggaacucgacgccggcgaucaggaccugcuugcuuuccugcucgaggaaagcggggaucugggaaccgcccccgacgaggcggugagagcuccucuugauugggcccugccgcucuccgaaguccccucugacugggagguugaugaccugcugugcagccuccuguccccucccgccucucuuaacauccugagcuccucuaauccuugucucgugcaccaugaucacacauacagccugccccgggagacgguguccauggaccuugaaagcgagucuugccgcaaggaaggcacccaaaugacaccucagcauauggaggagcuggcugaacaggagauugccagacucguccugaccgaugaagagaaaucccugcucgaaaaggaggggcugauccuuccggagacacugccccucaccaaaacagaggaacagauucugaagcgggugcgcagaaaaauccggaacaagcgcagcgcucaagaaucuagacggaagaaaaagguuuaugugggaggccuugagucccgcguccugaaauacaccgcccagaauauggaacuccagaacaaggugcagcugcuggaggagcaaaaucucagccugcuugaccagcugagaaaacuccaggcgaugguuauugaaaucucuaacaagacguccagcuccucuaccuguauccuggugcuucuggucagcuuuugccuccugcuggugccugccauguauuccagcgauacacgggggucucuccccgcugagcacggagugcugucccgccagcuuagagcccugccuagcgaagaccccuaccaacucgagcugccggcucugcagucugaagucccuaaggacagcacccaucaguggcuugauggcuccgacuguguucuccaagcccccggcaauacaucuugccugcugcacuauaugccucaggcgcccagcgccgagcccccucucgaguggccguuccccgaucuguuuuccgaaccucuuugucgggggcccauucugccucuccaggcuaaccugacccgcaaaggaggcuggcugcccacggggagcccgucugugauccuucaggacagauacuccggauga

SEQ ID NO: 67851 - RNA, 1560 nt, Artificial Sequence
  derived and/or modified sequence opt5 from CREB3L1__Homo_sapiens__NP_443086
auggacgccgugcuggagcccuucccugcugauagacucuuuccgggcagcuccuuccuggaccuuggggaucugaacgaaucugacuuucucaauaacgcccacuuccccgagcaucuggaucacuuuaccgaaaauauggaggacuucagcaacgaucuguuuuccucuuucuuugacgauccuguccuugacgaaaagagcccccuccuggauauggagcuggacuccccuacacccggaauccaggcggagcauucuuacagccucuccggcgauagcgcuccucaaucuccgcugguucccauuaaaauggaagacacgacccaggacgccgagcacggggccugggcucuuggacauaagcugugcuccaucauggugaaacaggaacagagcccugagcuccccguggauccucuggccgcucccucugccauggcggccgcugccgcuauggccacaaccccgcuucugggccucuccccucugagccggcugcccauuccucaccaagcgcccggggagaugacacagcuccccgucaucaaggccgaaccucuggaggugaaucaguuccuuaaaguuaccccggaagaccuggugcagaugcccccuacacccccuucuucccacggaagcgauuccgacggcucucaaagcccccgcucccucccgccuagcucucccgucagaccuauggcucgguccagcaccgccauuucuacgagcccccugcuuaccgcuccucauaagcugcagggcacauccgggccccuccugcugaccgaggaagagaagcgcacacucaucgccgagggauauccgaucccuaccaaacugccccuuacgaaggccgaagagaaagcucugaagagagugcggcgcaaaauuaagaacaagaucucugcgcaggaaagcagacggaaaaagaaagaguacguugaaugucucgagaagaaaguggagacauuuaccuccgaaaauaacgagcuguggaagaaagucgaaacacuugagaaugccaaccgcacccugcuccagcaacugcagaagcugcagacccucgugacaaauaagauuagcagacccuauaaaauggcugccacgcaaaccggcacaugccugaugguggccgcucuuuguuucguccugguucucgggucucuggugccuugccugccggaauuuuccagcggaucucagaccgugaaggaggauccccuugccgcggacggcgucuacacagcuucccagaugccuagccggucccuccuguucuaugaugacggggccggacugugggaggauggccgcucuacccuccugcccauggaaccucccgacggcugggagaucaacccugggggacccgccgaacagagaccgcgggaucaccuucaacaugaccaccuggacagcacgcacgagacaaccaaauaccucuccgaggcuuggccuaaggauggcgggaauggaaccucucccgacuucagccauuccaaagaaugguuucacgaucgcgaccugggcccuaacacaaccauuaagcugagcuga

SEQ ID NO: 67852 - RNA, 747 nt, Artificial Sequence
  derived and/or modified sequence opt5 from CREB3L2__Homo_sapiens__NP_001240704
auggaggugcuggaaagcggcgagcaggggguccuccaaugggacagaaagcuguccgaacuuucugagcccggagauggcgaagcccugauguaccacacccauuucagcgagcuccuggacgaguuuucccagaacguucuugggcagcugcucaaugauccuuuccugucugaaaagagcguguccauggagguggaaccgucucccacaagcccugcuccccugauccaggccgagcacuccuauagccucugcgaggaaccucgggcgcaaucucccuuuacgcauauuaccacauccgacagcuucaacgaugacgaggucgaaucugagaagugguaccuguccaccgauuuuccuagcacaucuaucaaaaccgaaccggugacagacgagcccccucccggacuuguuccuuccgugacccugacgauuaccgcuaucagcacaccccucgagaaggaggaaccgccucuggaaaugaauaccggcgucgauuccucuugucagacaauuauccccaaaaucaaacuugagccucacgaaguggaccaguuccugaacuuuagccccaaggaggggcucuccgcccugcccguuagccugugggugauggauauggucucuggauccaccgagcgcgaauauggcgagagagccggcaugagccucuaccaucggugcuguucuuggcuguaugaaauugcucuuuuccugaaaaauaagaacuuugccagcaaauga

SEQ ID NO: 67853 - RNA, 1383 nt, Artificial Sequence
  derived and/or modified sequence opt5 from CREB3L3__Homo_sapiens__NP_001258924
augaacaccgaccuggccgcuggcaagauggccagcgcggcuugcuccauggaucccaucgacucuuucgagcuccuggaucuucuguuugacagacaggaugggauucuccggcacguggaacugggagagggcugggggcaugucaaagaccaaguucuuccuaauccggauagcgacgauuuccuguccucuauccucggaagcggcgacucccugcccucuagcccucuguggucccccgaagggagcgauucuggaauuuccgaggaccucccuagcgauccccaggacacaccuccgcgcucuggccccgccacguccccugccggcugucaccccgcucagccugggaagggacccugccugagcuaccauccgggcaacucuuguuccaccacaaccccugggcccgugauccaggugccugaagccagcgucacaauugaccuugagauguggucccccggaggcagaaucugcgcugagaaacccgccgauccuguggaccugucuccgcgguguaaucucaccguuaaggaucugcuucugagcggguccagcggagaccuccaacagcaccaucugggcgcgucuuaucugcuccgccccggcgccgggcacugccaggaacuggugcuuacagaggaugagaaaaagcugcucgcuaaggaaggaaucacccugccuacgcagcuuccccugaccaaauacgaggaaagaguccucaagaaaauucggcgcaagaucagaaacaaacaauccgcccaggagagccggaagaagaaaaaggaauauauugacggccuggagacacgcaugucugcuuguaccgcccagaaucaggaacugcaaagaaaagugcuccaccuggagaagcagaaccuuagccugcucgagcagcugaaaaagcugcaagcgaucguugugcaguccacaucuaaaagcgcccagaccgggacgugcgucgcugugcuucuccuguccuuugcccugauuauccucccuagcauuucucccuucggaccgaauaagacagaauccccuggcgauuuugcucccgugcgggucuucagccgcacccugcauaacgacgccgccucuagaguugcugcggaugccgugccuggguccgaggcucccggaccucggcccgaagccgacacaacccgcgaggaaagcccgggcuccccuggcgccgauuggggguuucaggacaccgcuaaucuuacaaacucuacggaggagcuggacaaugccacccucgugcugagaaacgcgacagaaggacugggccaagucgcccuucucgauuggguggcucccgggcccagcaccggauccggccgggccgggcuggaggcugccggcgacgaacuguga

SEQ ID NO: 67854 - RNA, 1188 nt, Artificial Sequence
  derived and/or modified sequence opt5 from CREB3L4__Homo_sapiens__NP_001242908
auggaccugggcauccccgaucuccuggacgccuggcuugagccuccggaagauauuuucagcaccggguccgugcuggagcucggacugcacugucccccucccgaagucccuguuacaagacuucaggagcaaggccugcagggguggaagucuggaggcgaccgggggugcggacuccaggaaagcgagcccgaggauuuucugaaacuguucaucgacccuaacgaaguguacugcuccgaggcuucuccgggcagcgauuccggcauuucugaagaccccugucauccugauagcccucccgcccccagagcgacguccagcccgaugcucuaugagguggucuacgaggcuggggcccuggaaagaaugcagggagagaccggcccuaauguggggcuuaucucuauucaacuggaccaguggucccccgccuuuaugguuccugauagcugcauggugucugaacuccccuucgacgcucacgcccauauccugccccgggcuggaacagucgccccugugccguguaccacacuucugcccugccagacccucuuucugacagaugaggaaaagcgccugcucggccaggaggggguuucccugccuagccaccuuccccugaccaaagcggaggaaagagugcucaagaaaguccggcgcaagaucagaaacaagcaaucugcccaggacucccggcgccgcaaaaaggaguauauugacggacuggaaagccggguggcugccuguuccgcucagaaucaggagcuucagaaaaaggugcaagaacuggagcgccauaacaucucucucgucgcccagcugagacaacugcagacgcucauugcgcagaccagcaauaaagccgcucagacauccacaugcguucugauccuucuguucagccucgcccugauuauccuuccuucuuuuucccccuuccaaagccggccggaggcuggcucugaagauuaccagccucacggcgugaccagccgcaacauucugacccacaaggacgugacggagaaucucgaaacacaggucguggaguccagacugcgggaacccccuggggccaaggaugccaacggaucuaccagaacacugcucgagaaaaugggcgggaagccccgcccuagcggacggaucagauccguucugcaugcugacgagauguga

SEQ ID NO: 67855 - RNA, 1110 nt, Artificial Sequence
  derived and/or modified sequence opt5 from CREB5__Homo_sapiens__NP_001011666
auguucugcaccagcggcgggaacuccgccucugugaugagcaugagacccgucccuggaucccugucuagccuccugcaccuucauaaucggcagcgccaaccgaugcccgcuuccaugccuggcacacugcccaacccuacgaugcccgggucuagcgccguucucaugccuauggagagacagauguccgugaauagcucuaucaugggaaugcagggcccgaaccuguccaaucccugugcgagcccucaggugcaacccaugcacucugaagcuaagaugcggcuuaaagccgcccugacccaucacccugcugccauguccaacgggaauaugaacacaaugggacauaugauggagaugaugggcagccgccaggaccagacaccccaccaccauaugcacucucauccgcaccagcaccaaacccucccuccccaucacccuuacccccaucagcaccagcaucccgcucaccacccucauccgcagccccaccaucaacagaaucacccucaccaucacucccauagccaucugcacgcccaccccgcgcaccaucagaccuccccucaucccccgcugcacacaggcaaccaagcccaggucucuccugcuacccagcagaugcaacccacgcagaccauucagccuccccagccuacagggggaagacggcgcagagugguugaugaagaccccgaugagcggcgcagaaaguuucucgaacggaaucgcgccgcugccaccagaugccggcaaaaacgcaaggugugggucaugagccuggagaaaaaggcggaggaacuuacacagaccaacaugcagcugcagaaugagguguccaugcucaagaacgaaguugcccaacugaaacagcuucugcucacgcacaaggacuguccgaucacagcuaugcagaaagagagccagggcuaucugucuccugaguccagcccucccgccucucccgugccggcuugcagccaacagcaggucauucaacauaauaccaucacaaccuccucuagcguguccgaaguggucgggagcucuacccugucccagcucacaacgcacagaaccgaucugaaccccauucuuuga

SEQ ID NO: 67856 - RNA, 7215 nt, Artificial Sequence
  derived and/or modified sequence opt5 from CREBBP__Homo_sapiens__NP_001073315
auggcugaaaaccugcuggacggacccccuaauccgaagcgggcuaaacugagcucccccggguucucugccaacgauagcaccgacuuugggucccuuuucgaucuggaaaaugaccucccugaugagcugauccccaacggcggggaacuuggacugcucaauucuggcaaccuggugccugacgcggcuagcaagcacaaacagcuguccgagcuccugagagggggcucuggcagcuccauuaaucccggcaucgggaacgucagcgccucuuccccuguucaacagggacuuggcgggcaggcccagggacaaccgaauagcgcuaacauggccucucuguccgcuaugggcaagagcccccucucucagggggauuccagcgccccuucccugcccaaacaggccgccucuaccagcggaccuacgcccgcugccucccaggcucuuaauccgcaagcccagaagcaagugggccuggcgaccagcucuccugccaccucccagaccggccccgggauuugcaugaacgcuaauuuuaaccaaacccacccuggacuccugaauagcaacucuggccacagccugaucaaccaggccucccaggggcaagcucaggugaugaauggaucucucggcgccgccgggcgcggaagaggcgcuggcaugcccuaccccaccccugcgaugcagggggccagcuccagcguccuggcugaaacacuuacccaggugucuccgcaaaugacgggacaugccggccugaacaccgcccaggcugggggaauggccaagaugggcauuacagggaauaccucccccuucggccagccuuuuagccaggcgggaggccaacccaugggggcuacaggaguuaacccucagcucgccucuaaacaguccauggugaauagccugcccaccuucccgacggacaucaagaacacauccgucaccaaugugccuaacaugucucagaugcaaacaagcguuggcaucgugcccacccaggccauugcuaccgggccuacagccgaucccgagaaacggaaacuuauccagcagcaacugguccuccugcugcacgcucauaaaugccagcgcagagagcaggccaauggagaagugcgggcgugcucccucccucacugccgcacgaugaagaacgugcugaaucacaugacccauugccaagccggcaaggcuugucaggccauucuugggucucccgcuagcggcauccagaacacaauuggauccgucggcaccgggcagcaaaaugccacaagccugucuaacccgaauccuaucgaccccuccagcaugcagagagcguaugccgcucucggacugcccuacaugaaccagccucagacccaacuucagccgcagguucccggccagcaaccugcccagccccagacgcaccaacagaugcggacacugaacccucucgggaauaaccccaugaauauuccugcuggaggcaucaccaccgaucagcagcccccgaaccugaucucugaguccgcccugccuacaagccucggggccaccaauccccugaugaacgacggcucuaauagcggaaacauuggcacacuuuccacgaucccuaccgcugcgcccccgagcucuacaggggugcgcaaaggauggcaugaacacgugacccaagaucugagaucccaccucguccauaagcuggugcaggccauuuuuccuacacccgacccugcugcccugaaagaccggcgcauggagaaucuuguugccuaugcuaagaaaguggagggcgauauguacgaaagcgccaacuccagagacgaguauuaccaccuccuggcggaaaagaucuauaaaauucagaaggagcuggaagagaagcggcgcucuagacuccauaaacaggggauccugggaaaucaacccgcccuucccgccccuggcgcccagccgcccgucaucccucaggcucagcccgugcggccucccaacgggccucugagccucccgguuaauagaaugcaagugucccagggcaugaacucuuucaaucccaugagccugggaaacguccagcugccucaggcccccaugggcccucgcgcggcuucccccaugaaccacucugugcaaaugaauagcaugggguccgucccgggaauggccauuagcccuucucggaugccccagcccccuaacaugaugggcgcccauaccaauaacaugauggcucaggcccccgcucaaucccaguuucuuccucagaaucaguucccguccucuagcggggccaugagcgugggaaugggccaacccccugcgcagacgggcguuucucagggacaggugcccggagccgcucucccuaacccccugaauaugcugggcccgcaagccucccagcucccuugucccccugucacccagagcccccugcacccuacacccccgccugcuuccaccgccgccgggaugcccagccuucagcacacaacacccccuggaaugacgccgccccaaccugcugcgcccacacagccuucuacccccgugagcuccucuggccagacaccuaccccgacccccgggagcguuccuuccgccacacaaacgcagucuacccccacagugcaggcugccgcccaggcucaagucaccccucagccccagacaccggugcagccucccagcguggccacaccccaauccucucagcagcagccuacgcccguucaugcgcaaccuccgggaacaccccugagccaggcugccgccuccaucgauaacagagucccuacccccagcucuguggcuuccgccgagaccaauagccagcagccuggccccgacgugccgguccucgaaaugaagacagagacccaagcggaagauacagagccugaccccggcgaaucuaaaggggagccucgcuccgagaugauggaagaggaucugcagggagcuagccaggugaaggaagagacggacauugccgaacaaaaauccgagcccauggagguugaugaaaagaagccugaggugaaagucgaagugaaggaggaggaagagucuagcuccaacggcaccgccagccagucuacaucccccagccagccgcggaaaaagaucuuuaaaccugaggaacugagacaggcucuuaugcccacccucgaagcccuguaccgccaagaccccgagucucugccuuuccggcagccgguugauccccagcuccuggggauuccugacuacuuugacaucgugaagaaucccauggaucuuagcacaaucaagagaaaacuggacaccggacaguaucaagagccuuggcaguacgucgaugacguguggcucauguucaacaaugcuuggcuguauaaccgcaagacgucccggguuuacaaauucuguucuaagcuggccgaaguguuugagcaggaaauugaucccgucaugcagagccuuggcuauugcugugggagaaaauacgaguucuccccucaaacccucugcuguuauggaaagcagcugugcacaaucccccgcgacgcggccuacuacucuuaucagaaucgguaccacuuuugcgaaaaguguuucaccgagauucaaggcgagaacgugacacugggcgaugacccgagccagccucagaccacaaucuccaaagaucaguuugaaaagaaaaagaacgacacccucgaucccgagccuuucguggacugcaaagaaugugggagaaagaugcaucaaauuugcguccugcacuaugauaucauuuggcccagcggauuuguuugugacaauugccuuaaaaagacgggccggccgcgcaaggagaacaaauucucugcuaagagacugcagacaacccggcucgggaaucaccuggaagacagagugaacaaauuucugcgccggcagaaucauccugaggccggagagguguucgucagagugguugcuuccagcgauaagaccguggaagucaaacccggcaugaagucccgcuuuguggacucuggggagaugagcgaauccuuccccuacagaacaaaggcccuuuuugccuucgaggagaucgauggaguugacguguguuucuuuggcaugcacguccaggaauauggcucugauugcccucccccuaacacccggcgcguguacaucagcuaucuggacuccauucauuucuuuagaccgcggugucuccgcacggcuguuuaccacgagauccugauuggguaccucgaauaugugaaaaagcugggauacgucacaggccauaucugggcgugucccccuagcgagggggaugacuauauuuuccacugucaucccccugaucagaagauccccaagccuaaaagacuucaggaaugguacaagaagaugcuggacaaagccuuugcugagcggaucauucaugauuauaaggacaucuucaaacaggccaccgaggaucgccucacaucugccaaggaacugccguacuuugagggagacuucuggcccaaugugcuggaagaguccauuaaagaacuugagcaggaggaagaggaaagaaagaaggaggaaagcaccgcugccucugagacaaccgagggcucccaaggggacagcaaaaacgcgaagaaaaagaauaacaaaaagacgaauaaaaacaagucuagcaucucccgggcuaauaagaaaaagccuucuaugcccaacgugagcaaugaucugucccagaaacucuaugccaccauggaaaagcacaaagaggucuuuuucguuauucaucugcacgccggaccugugaucaacacacugcccccgaucguggacccugauccccugcuuagcugcgaccugauggauggccgcgacgcuuuucucacccuggccagagauaagcauugggaguucuccucucugcggagaagcaagugguccacacuuugcaugcuggucgagcuccacacccagggccaagaccgcuuuguguacacguguaaugagugcaaacaccauguugaaacacgguggcacuguaccgugugcgaggauuacgaccuguguauuaacugcuauaacacaaagucucaugcgcacaaaauggucaagugggggcucggacuggaugacgaaggcagcucccagggggagccccagucuaaaagcccucaggaauccagacgccuuagcauccaacgguguauucagucucuggugcacgccugccaguguagaaaugcuaacugcucccugcccagcugucagaagaugaagcgcguugugcaacauaccaaaggaugcaagcggaaaaccaauggcgggugcccugucuguaagcagcucaucgcccugugcuguuaccacgcuaaacauugccaggagaacaaguguccggugcccuucugccuuaauauuaagcacaaacugagacagcaacagauccagcaucgccuccagcaagcccagcugaugcggagacggauggcuacaaugaacacgcgcaaugucccucagcaaucucuccccuccccuaccagcgcgcccccgggaacaccuacccagcagcccucuacaccucagacaccccaaccgccugcgcagccccagcccuccccugugagcaugucccccgccggcuucccuagcguugcuagaacgcagccgcccacaaccgugucuaccggcaagccuacaagccaaguccccgccccucccccuccggcucagcccccucccgccgccguggaggcugcgcggcagaucgaacgcgaggcccagcaacagcagcaccuguauagaguuaacauuaauaacuccaugccucccgggcggaccggaaugggcacaccggggucucaaauggcuccugugagccuuaauguccccagacccaaccagguguccggaccugugaugcccucuaugccuccgggccaguggcagcaagcuccccucccucagcagcagcccaugccugggcugccccgcccgguuaucagcaugcaagcccaggcugccgucgcgggaccucggaugcccuccgugcagccucccagaucuauuagcccuuccgcccuccaggaccugcuucgcacgcugaaaagccccucuuccccgcaacagcagcagcaagugcucaauauccucaagagcaacccccagcucauggcugccuuuauuaaacagcggaccgcuaaguacgucgccaaucaaccuggcaugcagccccagccuggccugcagucucaaccggggaugcagccccagccuggaaugcaccagcaacccucccuucagaaccugaacgcgaugcaggccggcgugccuagacccgggguuccuccccagcaacaggcuaugggaggccugaauccgcaggggcaagcccucaacaucaugaauccuggccauaaccccaauauggcuagcaugaacccucaguaucgcgaaaugcugcggagacagcuucugcagcaacagcagcagcaacagcagcagcaacagcagcaacagcagcagcaacagggauccgccggcauggcugggggaauggccggccacgggcaguuccagcaaccccagggaccgggcggguacccucccgcgaugcagcagcaacagcgcaugcagcagcaucucccccugcaaggcucuagcaugggacagauggccgcucagaugggccaacucgggcagaugggacagccuggccugggggccgauuccacacccaauauucagcaagcccuucagcagagaauccugcagcaacagcagaugaagcagcaaaucggaagcccuggccagccgaaccccaugucuccucagcaacacaugcuguccgggcagccccaggccagccaccucccuggccagcaaauugccaccucucugagcaaucaggugcggucccccgcgccgguccagucuccucgcccccagagccaaccuccccauuccucuccuagccccagaauccagccgcagcccuccccucaccaugugagcccccagacaggaucuccucaccccggccuugcuguuaccauggccuccagcauugaccaagggcaucugggaaacccugagcaguccgcuaugcucccgcagcugaauacgcccucucggagcgcccuguccucugaacucagccuugugggcgauaccacaggggacacccuggagaaauuugucgagggacuguga

SEQ ID NO: 67857 - RNA, 1254 nt, Artificial Sequence
  derived and/or modified sequence opt5 from CREBRF__Homo_sapiens__NP_001161865
augccccagccuagcguguccggcauggacccgcccuucggggaugccuuuagaucucacaccuucagcgagcaaacacugauguccacggaccuccuggcuaacucuagcgauccugacuuuauguacgaacuugaucgggagaugaauuaucagcagaacccccgcgacaauuuccugucccucgaagauugcaaggacaucgagaaccuggaaucuuuuaccgauguccuugacaaugagggagcccugacaagcaacugggagcagugggauaccuacugugaagaccucacaaaauauaccaagcugacauccugcgauauuuggggcaccaaagagguugacuaccuggggcucgacgauuucagcucuccuuaucaagacgaagaggugaucuccaagacgcccacccuggcgcagcuuaauagcgaggauucucaguccgugagcgacucucuguacuauccugauucccucuuuagcgucaaacagaacccgcugcccuccucuuucccuggaaagaagauuacaagcagagcugccgcccccguguguuccagcaaaacccuucaagcugaaguuccucugucugacugcgugcagaaggccuccaaacccacaagcucuacccagaucauggucaagacgaauauguaccauaacgagaaagugaauuuucacguugaauguaaggauuacgugaagaaagcuaaggucaaaauuaacccggugcagcaaagccggccucuccugucccagauccauacagacgccgcgaaggagaauaccugcuauuguggcgccguggcuaaacgccaggaaaagaaagggauggagccccugcaaggacacgccaccccugcucuccccuucaaggagacacaggaacugcuucugucuccccucccucaggagggcccgggcagccuggccgcgggggaauccagcucucuuuccgccagcaccucugucuccgauagcucccagaagaaagaggaacauaacuacucucuguuuguuagcgacaaucucggagagcaacccacaaagugcuccccugaggaagaugaggaagacgaggaagacguggaugacgaggaucacgacgagggcuucgggucugaacacgagcugagcgaaaacgaggaggaagaggaagaggaagaggauuaugaggacgauaaagacgaugacaucuccgauacguuuagcgaacccggaauuaucaugcuggcuucucucccugacuga

SEQ ID NO: 67858 - RNA, 1065 nt, Artificial Sequence
  derived and/or modified sequence opt5 from CREBZF__Homo_sapiens__NP_001034707
augagacacagccugaccaagcuccuggccgcuuccggcucuaacagccccacacgguccgaaucuccugaaccggccgcgacgugcagccuucccuccgaccugacccgcgcugccgccggggaggaagagacagcugccgcuggaucuccuggcagaaaacagcaauucggggaugaaggagagcucgaggccggccgggggagccgcggaggcguggcggucagagcccccuccccugaagagauggaagaggaggcuaucgccagccugcccggcgaagagaccgaagacauggauuuucuuucugggcuggagcucgcugaccugcuggauccucggcagccggacuggcaucucgaucccggacuguccagcccuggcccccuuucuuccagcgggggaggcucugacuccgggggacuguggcgcggcgaugacgaugacgaagccgcggccgcugagaugcagagauucagcgaucuccugcagcggcuucugaauggcauugggggauguuccucuagcuccgacagcggcucugccgagaagcgcagacggaaauccccugggggaggcgggggaggcggcagcgggaacgacaauaaccaagcugccacaaagucuccccgcaaagccgcugcggccgcugccagacucaaucggcugaagaagaaagaauacguuaugggacuggagagccgcgugagaggccucgccgcugaaaaccaggagcugcgggccgaaaauagagagcuugggaagcgcgugcaggcgcugcaggaggaaucccgguaucucagagcuguccuggccaacgagaccggacuugcccgccugcucucucggcugagcggcguggggcugagacucacaaccucccuguuucgcgauagcccggcuggcgaccacgauuacgcccuuccuguuggaaaacaaaagcaggaccugcucgaagaggaugacucugcuggcggggugugccugcaugucgauaaagacaagguguccguugaguucuguagcgccugcgcgcggaaggccucuuccagccuuaaaauguga

SEQ ID NO: 67859 - RNA, 663 nt, Artificial Sequence
  derived and/or modified sequence opt5 from CREG1__Homo_sapiens__NP_003842
auggccggccugagcagaggguccgcucgggcccuccuggcggcccuucuggcuucuacccuccuggcccuucuggugagccccgcucgcggaagaggcgggcgggaccacggagauugggacgaggccucccgccucccuccgcugcccccuagagaagaugcugcccgggucgcgcgcuucguuacacaugugucugacuggggcgcccuggcuacgaucagcacccucgaggccgugagagggcggcccuuugcugauguccugucccuuucugacggaccucccggcgccggcagcggggugccuuacuucuaucuguccccgcuccagcugagcguuucuaaccuucaagaaaaucccuacgcgacacugaccaugacacucgcccagaccaacuuuugcaagaaacacggauucgauccucagagcccccugugugugcauauuaugcuguccggcacagucaccaaggugaaugagacggaaauggacaucgcuaaacacucucucuuuauucgccauccugagaugaagaccuggcccuccagccacaacugguucuuugccaaacugaauaucacaaacauuuggguucuugauuauuucgggggaccgaagaucgugaccccugaggaauacuauaaugucacagugcaguga

SEQ ID NO: 67860 - RNA, 1269 nt, Artificial Sequence
  derived and/or modified sequence opt5 from CRELD1__Homo_sapiens__NP_001026887
auggcccccuggccuccgaagggccuggugcccgcuguccucugggggcugagccuuuuccugaaccucccuggacccaucuggcugcagccuagcccucccccgcaaucuucucccccuccccagccucaccccugccauaccuguagaggccuuguugacuccuuuaauaaagggcuggagcggacaauucgcgauaacuucggaggcgggaauacggccugggaagaggaaaaccucuccaaguacaaagacagcgagaccagacugguggaagugcuggagggagucugcuccaagucugauuuugagugucaccggcuccuggaacuuagcgaggaacugguggaguccuggugguuccauaaacagcaggaggcgccggaccucuuucaauggcugugcagcgauucucuuaagcuguguugcccugcuggcacauucggccccuccugucucccuugccccgggggaaccgaacgccccuguggcggguauggacagugcgagggcgaagggacaagaggaggcagcggccacugugacugccaggccggguacggaggcgaggccugcgggcaguguggacugggcuauuuugaagcugagcggaaugccucucaucugguuugcuccgcuuguuucgggccuugcgcccgcuguagcggaccggaggaaucuaacugccuccaauguaagaaaggcugggcgcugcaccaccuuaagugcguggauaucgacgaguguggcaccgaaggggccaauugcggagcugaucaguuuugugucaacacagagggcuccuacgaaugcagagacugcgccaaggcuugucuggggugcaugggagccggccccgggcgguguaagaaaugcagcccuggcuaucaacaggugggauccaagugucucgauguugacgagugcgagaccgaagugugucccggcgagaauaagcagugcgaaaacacggaagggggauaccgcuguauuugcgcggagggcuauaaacagauggaggggaucugugucaaggagcagauuccuggagccuuccccauccugaccgaucuuacaccggaaaccacaagacgguggaaacugggcucucauccucacagcaccuacgugaagaugaaaaugcaacgcgacgaggcuacguuucccgggcucuacggcaaacagguggccaaacugggaucccagagcagacagucugaccggggcacacgccugauccauucccaacaggcuagcucucagagauga

SEQ ID NO: 67861 - RNA, 1209 nt, Artificial Sequence
  derived and/or modified sequence opt5 from CRELD2__Homo_sapiens__NP_001128573
augagacugccccggcgcgccgcucucggccugcuuccucugcuccugcuucugccgcccgccccugaggcggcuaagaaacccaccccuugccacagaugucgggggcucguggacaaguucaaccagggaauggucgauacagccaaaaagaauuuuggcgggggaaacacggccugggaagagaaaacccugagcaaguacgaauccucugagauccgccugcucgaaauucuggagggccuuugcgagagcuccgacuucgaauguaaucaaaugcuggaggcucaggaggaacaucucgaggccugguggcugcagcuuaagucugaauaucccgaucuguuugagugguucugcguuaaaacacucaagguguguugcagcccugggaccuacggaccggacugucuggcuugccagggcggcucccaaagacccuguucugggaacggacacugcagcggcgaugggucccggcagggagacggcagcugucgcugccauaugggguaucagggaccucugugcacagauuguauggacggcuacuuuucuucccucagaaaugaaacccacagcaucugcacagugcggaccggccugucugauuccuaucccccuuguugccuuagccugggguguuggcgcggagucggccaugccuggauuagagggcggaacacgcacacccagcccggauacucuucccgcguguggaucgcggccuucagcccggcuugcgacgaguccuguaaaacaugcucuggccucaccaauagagauuguggggaaugcgagguuggaugggugcuggacgagggcgccugugucgauguggacgaaugcgcugccgagccucccccuugcagcgcggcccaauuuuguaagaacgcuaauggcuccuauacaugcgaagagugugacagcucuugcguuggguguaccggagaaggccccgggaacugcaaagaguguauuuccggauacgcccgggagcacggccagugcgcugauguggacgaauguagccuugccgagaagacgugcguccgcaagaaugaaaacuguuacaauacacccgggucuuaugugugcgugugcccugauggcuucgaggaaaccgaggacgccugugucccgcccgcugaggcggaagccacagagggagaaagcccuacccagcugcccuccagagaggaucucuga

SEQ ID NO: 67862 - RNA, 540 nt, Artificial Sequence
  derived and/or modified sequence opt5 from CREM__Homo_sapiens__NP_001254491
auggccgugcccaccagcaucuaccagacauccacgggccaauauauugcuaucgcccaagggggaaccauucagaucucuaacccuggcagcgacgggguccagggacugcaggcgcucacaaugaccaauuccggcgcuccgcccccuggggccacaauuguucaguacgccgcucagucugccgauggaacccagcaauucuuugugcccggcagccagguggucgugcaggcugccacaggcgacaugccuaccuaucagaucagagcgcccacggccgcucugccucaagggguugugauggccgcuuccccgggaucucuucacagcccccagcagcuggccgaggaagcgacccggaagcgcgagcucagacugaugaaaaaccgggaagccgcuaaggagugccgcagacggaaaaaggaauacgucaaaugucuugagucccgcguggccguucuggaggugcaaaauaagaagcucaucgaggaacuggaaacacugaaagauauuugcagcccuaagaccgacuauuga

SEQ ID NO: 67863 - RNA, 969 nt, Artificial Sequence
  derived and/or modified sequence opt5 from CRHBP__Homo_sapiens__NP_001873
augagccccaacuucaagcugcagugccacuuuauccucauuuuccugaccgcccuuagaggcgagucccgguaccuggaacuccgcgaggcugccgacuaugauccuuuucugcuuuucucugcgaaucugaaaagagaacucgcuggggagcaaccguaccggcgcgcccugagaugucuggacaugcucagccugcagggacaguuuacauucacggccgaucggccccagcuucauugcgcugccuuuuucaucuccgaaccugaggaguuuauuaccauccacuaugaccaagugucuauugauugucagggcggggacuuccugaaggucuuugauggauggauccucaaaggcgaaaaguuccccagcucccaggaccauccucugcccucugcugagcgcuacaucgauuuuugcgaaagcgggcuuuccagacggagcauuagaucuucccagaacguugccaugaucuucuuccgcgugcacgagccuggaaauggcuuuacacugaccauuaaaacagacccgaaccucuuccccuguaaugugaucagccaaaccccuaacggcaaguuuacacuggucgugccccaucagcaccggaauugcucuuucuccauuaucuauccuguugugauuaagaucagcgaucugacccucgggcacgucaacggacugcagcuuaaaaagucuuccgcgggcugugaggggaucggagacuuuguggaacugcucggcgggacgggacuggaucccagcaaaaugaccccgcuugccgaccugugcuacccuuuccauggccccgcucagaugaagguuggcugugacaauacagugguccgcaugguguccucugggaaacacgugaacagagucaccuuugaguaucggcaacucgaaccuuacgagcuggaaaaucccaacggaaauagcauuggcgaguucugccuguccgggcucuga

SEQ ID NO: 67864 - RNA, 591 nt, Artificial Sequence
  derived and/or modified sequence opt5 from CRH__Homo_sapiens__NP_000747
augagacugccccuccuggugagcgccggcguccuucugguugcucuccugccuugcccgcccugucgggcccuucugucccgcgggccugugcccggagcgagacaggcuccucaacacccccagccucucgacuucuuucagccgcccccucagucugagcaaccccagcagccucaggcccggcccgugcugcugcgcaugggcgaagaguacuuccucagacuggggaaccuuaauaagagcccggccgcuccucugucccccgccucuagccuccuggcuggaggcuccgggucucggccuagccccgaacaagccaccgcgaacuuuuuccgcguccuucugcagcagcuccugcugcccagacggucccucgauagcccugccgcucuggccgagcgcggagcuagaaaugcccuuggcggccaucaggaagcgccggagcgggagcgcagaucugaggaacccccuaucucccuggaccucacauuucaucugcuucgggaagugcuggagauggcccgcgcugagcaacucgcccagcaggcucacagcaacagaaaacugauggaaauuaucgggaaguga

SEQ ID NO: 67865 - RNA, 1335 nt, Artificial Sequence
  derived and/or modified sequence opt5 from CRHR1__Homo_sapiens__NP_001138618
augggcgggcacccccagcugagacucgugaaggcccugcuucugcucggacugaacccugucagcgcuucccuucaagaccagcauugcgagucucugagccucgccuccaauaucucuggccugcaguguaacgcgagcguugaucugauugggaccugcuggccgcggucccccgcuggacagcucguggugcgcccuugucccgccuucuuuuacggcgucagauauaauacaacgaacaauggguaccgggaaugccuggccaacggaucuugggcugcccgcgugaauuauagcgagugucaagaaauccuuaacgaggagaaaaaguccaaaguucacuaccauguggcugucauuaucaauuaucugggccacugcauuagccucguggcccugcuuguugcguucgugcuguuucucagacugcggccuggcuguacccauuggggagaccaggccgauggggcucuggaagucggcgcccccuggucuggggcuccuuuccaggugcgcagauccauccggugccuccgcaacaucauucacuggaaucugaucagcgccuuuauucuuagaaacgcgacaugguucgugguccagcugaccaugucuccggagguucaccaauccaaugugggauggugucggcucgugacagccgcuuacaacuauuuucaugucaccaauuucuuuuggauguucggcgaagggugcuaccugcacacagccaucgugcuuaccuacagcacggaccgccugagaaaguggauguuuauuuguaucggauggggcguucccuucccuauuaucguggcuugggccaucggcaaacucuauuacgauaacgagaagugcugguuugggaagcggcccggagucuauaccgacuacauuuaucagggcccuaugauccuggugcugcucauuaacuucaucuuccuguuuaauauuguucgcauccuuaugacaaaacugagagccucuaccacauccgaaaccauccaguaccggaaggcugugaaagcgacgcucguccugcuuccccugcucgggauuacauauaugcuguucuuugugaacccgggagaggaugaggucagcagagugguuuucaucuacuuuaauuccuuccuggaaucuuuucagggcuucuuugugagcgucuucuacugcuuucucaacuccgaggugcgcagcgccauucggaagagauggcaucgcuggcaagacaaacacucuauccgggcuagaguugcccgcgccauguccauuccuaccagccccacacgggugucuuuccacagcaucaagcaguccaccgcugucuga

SEQ ID NO: 67866 - RNA, 1317 nt, Artificial Sequence
  derived and/or modified sequence opt5 from CRHR2__Homo_sapiens__NP_001189404
augagaggccccagcgggccuccgggacugcucuacgugccccaucugcuucugugucuccugugucuucugccucccccucuccaguaugccgcuggccaaucccagaugcccaaggaccagccucugugggcccugcucgagcaguacugccacaccaucaugacacugacgaaccuuucugggccguauagcuacuguaauaccacacuggaucaaauuggaaccugcuggccccgguccgcggcuggcgcccucgucgaacgcccuugucccgaguauuucaacgggguuaaauacaauacaaccagaaacgccuaucgggaaugccuggagaauggaacaugggcuucuaagaucaacuacagccagugugaaccuauucuugacgauaaacagcgcaaguacgaccugcacuauagaaucgcccucguggugaauuaccugggccauugcgucuccguggcugcccugguugcggccuuucuccuguuccuugcucugcggucuauucgcugucucagaaacgugauccacuggaaucugaucaccacguuuauucuucggaacgucaugugguuccugcuccagcugguggaucaugagguucacgagagcaaugaaguguggugccgcuguaucaccacaauuuuuaacuauuucgucgugaccaacuuuuucuggauguuuguggagggcugcuaccugcacacagccaucgucaugaccuauuccacggaaagacuccggaaaugccuguuccuuuuuauugggugguguauccccuucccgauuaucguugcuugggccaucggaaagcuguacuaugagaaugagcaaugcugguuuggcaaggaaccuggggaccucguggauuacauuuaccagggacccaucauucuggugcuucugaucaauuucgucuuccucuuuaacauugugcgcauccugaugacaaaacugagagcgagcaccacaucugagaccauccaguaucggaaggccguuaaagcuacccucgugcugcuuccucugcucggcauuacauacaugcuguucuuugucaaccccggggaagacgaucugucccagaucauguucauuuauuuuaauagcuuccuucaaucuuuucagggauucuuuguguccguuuucuacugcuuuuucaacggcgaggugcgcagcgccgucagaaagcgguggcauagauggcaggaccaccauucucuccgcgugcccauggcucgggccauguccaucccuacgagcccgaccagaauuuccuuucacucuaucaaacaaacagccgcugucuga

SEQ ID NO: 67867 - RNA, 3111 nt, Artificial Sequence
  derived and/or modified sequence opt5 from CRIM1__Homo_sapiens__NP_057525
auguaccugguggccggcgacagagggcucgcuggaugcggccaucugcuugucagccugcucgggcugcuucugcuccuggcccgguccggaacccgcgcgcugguuugucuccccugcgaugagucuaagugugaagaaccuagaaacugcccgggcagcaucgugcaggggguguguggaugcuguuauacaugcgcuucccaacggaaugaaucuuguggcggcacguucgggauuuacggaaccugcgaccgcggccugagaugugucauccggcccccucuuaacggggauagccugacagaguaugaagccggagugugcgaggacgagaauuggaccgaugaccagcuccugggcuuuaaacccugcaacgaaaaucuuauugccggguguaacaucauuaauggaaagugcgaguguaacacaaucagaaccugcuccaauccuuucgaauuucccucucaggauaugugucugagcgcucucaaacgcaucgaggaggaaaagccugacugcuccaaagcccggugugagguucaguucagcccgcgcugccccgaagauucugugcugauugagggcuacgcuccucccggcgaauguugcccucugcccuccagaugugucugcaacccggccgggugccuccggaaggugugucaaccuggaaaucugaacauccuuguuagcaaggcgucuggcaaacccggggagugcugugaccuguaugagugcaagccuguguuuggagucgauugucgcacaguggaaugcccucccgugcagcagaccgccugucccccggacuccuacgagacgcaggucagacucaccgcugauggcugcuguacacugcccacccggugcgaaugucuuagcgggcugugcggauucccuguuugcgaggugggcucuacaccccgcauuguguccagaggcgacgggaccccuggaaaauguugcgacgucuuugaaugugugaaugauacgaagcccgccugcguuuucaacaauguggaguauuacgacggcgauauguuucggauggacaacuguagauucugccgcugucaagggggagucgcuaucugcuuuacagcccaguguggcgagauuaacugcgaacgguacuaugugccggagggggaauguugcccuguuugcgaggaucccguguacccuuucaauaaccccgcgggcuguuaugccaauggacucauccuggcucacggcgacagauggcgcgaagaugacugcaccuuuugucagugcgucaacggggagcggcacuguguggccacagucugcggacagaccuguaccaauccugugaaaguucccggcgagugcuguccggugugcgaggagccuacaauuaucacggucgauccucccgcuuguggggaacugagcaacugcacccucacaggaaaggacugcaucaauggcuucaagagagaucacaacgggugucggaccugccaauguauuaauacagaggagcugugcuccgaacgcaaacagggcuguacccuuaacugccccuucggauuucugacggacgcccagaauugugagaucugcgaauguagaccgcgccccaagaaaugccggccuauuaucugugacaaguacugcccccucggccugcuuaaaaacaagcacgggugcgauauuuguagaugcaaaaaguguccugagcugucuugcagcaagaucuguccccucggauuccaacaggacucccauggcugccugaucuguaaaugccgcgaagccagcgcuucugcggggccucccauucuguccggaacaugucucaccguggauggccaccaccauaagaaugaggagagcuggcacgacgggugccgggaauguuauugccugaacggcagagagaugugugcccuuauuaccugcccgguuccugcuugcggaaaucccacaauccauccuggccaguguugccccucuugugccgaugacuuugugguccagaaaccggaacugagcaccccuuccaucugccacgcccccgggggagaguacuucguggaaggcgagacauggaacauugauucuuguacgcaaugcaccugucacagcgggcgggugcucugcgagacagaaguuuguccuccccugcugugccagaaccccucccgcacccaggacagcuguugcccucagugcacagaucaaccguuuagacccucucuuucccggaauaacagcgucccuaauuauuguaagaacgacgagggagauaucuuccucgcugccgaaucuuggaaacccgacgugugcaccuccuguaucugcauugauagcgugaucuccuguuuuucugagagcugcccuuccgucucuugugaaagacccgugcugcgcaagggccagugcuguccuuacugcauugaggacacgaucccgaagaaaguugugugucauuucagcgggaaggcguacgcugacgaggaacggugggaucuggacuccugcacccacugcuauugucuccagggccagacacugugcagcaccgucucuugucccccucuucccugcguggagccuauuaauguugaaggauccuguugccccauguguccggagauguacgugccugagcccacaaacauccccauugagaaaaccaaucauagaggcgaagucgaucuggaagugccucucuggcccacgccuagcgagaacgacaucguucaccuuccgcgcgauauggggcaucugcaaguggacuauagagauaaucggcugcaccccucugaagacuccagccucgauucuaucgccagcgucguggugccuauuaucauuugccuguccaucauuaucgccuuucuguucaucaaccagaagaaacaguggauuccccuccuguguugguaccgcacaccuaccaagcccagcucucuuaauaaccagcuggucuccguugacugcaagaaaggaacaagagugcaaguggauagcucccagcggaugcuccgcaucgcugagccggacgccagauuuucuggcuucuauagcaugcagaagcaaaaucaucugcaggcugauaacuuuuaccagaccgucuga

SEQ ID NO: 67868 - RNA, 849 nt, Artificial Sequence
  derived and/or modified sequence opt5 from CRIP2__Homo_sapiens__NP_001257766
augcccccucaccaucugcucccguggcuggcccaggugcccagcgcugagggcgaacuugucagacugguuucccgggccgggggacgcggcgcgugcuucuggccugcugugaccauggagauggccguggccgcugggugugucugcaagggaggcggguguugccacagagaacccucucaagaccaucacgagagccaggaacaucggggaccucucgugggcucccagacaugucugguucaccaggccgagggcacggcugagaaagugucuagccuugggaaggauuggcacaaauuuugccugaagugugaacgcugcuccaaaacccucacacccggaggccaugccgagcacgacgggaagccuuucugucauaagccgugcuacgcgacccuguuuggacccaaaggcgucaacaucgggggagccggcucuuauauuuacgaaaagccucuggcugagggcccccaagugacagggccuaucgagguucccgccgcuagagccgaggaacggaaagcgagcggaccgccuaagggccccucccgcgccagcucugugaccacauucaccggggaaccuaauacgugucccagaugcuccaaaaaggucuauuuugcugagaaggugaccagccucggaaaagauuggcaccggcccugccugcgcugugaaagaugcggcaagacacuuaccccugggggacacgccgagcaugacggccagccguacugucacaaacccugcuauggcauucuguucgggccuaagggagugaacacaggcgcugucgggucuuacaucuaugaucgggaccccgagggaaaaguucagccuuga

SEQ ID NO: 67869 - RNA, 615 nt, Artificial Sequence
  derived and/or modified sequence opt5 from CRIP3__Homo_sapiens__NP_996805
augagcuggaccugccccagaugucagcaaccuguguucuuugccgagaaggucuccucucugggcaaaaacuggcaccgguucugccucaagugugaacgcugccauagcauccugucccccgggggacacgcugagcauaauggcagacccuacugucacaaaccuugcuauggggcccuuuuuggaccccggggcguuaacauugggggagugggcucuuaccuguauaauccucccacaccuagcccgggcuguacgacaccccucuccccuucuagcuucuccccgccucgccccagaaccgggcugccgcagggaaagaaaagcccuccccauaugaagaccuuuacaggcgaaaccucucuuugcccuggguguggagagcccguguacuucgcggaaaaggucaugucccugggccggaacuggcaccgccccugccucagaugucagcggugccacaaaacacugaccgcugggagccaugccgagcacgacggagugccuuauugccauguuccguguuacggcuaucuguuuggccccaagggggugaauaucggagaugucggcugcuacauuuacgacccugugaaaaucaaguucaaauga

SEQ ID NO: 67870 - RNA, 1341 nt, Artificial Sequence
  derived and/or modified sequence opt5 from CRIPAK__Homo_sapiens__NP_787114
augcacgagcccagccugugcgccaacguggaauguccuccggcucauaccugccccuguggcgucccugccugcuccugugcgcacguugagugucccccugcucauacaugcagaugcggggugcccgccuguucucacaugccuauguggagcgcccggcuccugacgcgcgcucauguggaaugcccgcccgcccacaccagaguccacguggaguguccucccgcucauguuccuaugugguccgcccaccuucugacaugcgcggacguggaaugccaucuccugacccacguccccauguggucugcccggcuucugacauguccgugcggagugccugcuuguagccacguucccaugcgcuccgccagacuccugacccgggcucaugccgagugcccucccgcgcacacaugucccugcggcgugccugccuguucucaugucccgaugcgcagcgcuagacugcucacccgggccgauguggagugucccccugcucacacgugccccugcggggugccugccuguucccauguccccaccuggagcgcccgccugaucacaagagcucacguugaaugcucuccggcgcauaccugccgguguggagugccugccugcucccacgugcccauguggagcguccgccuucugacaagagcugacgccgaguguccucccgcccauaccugccgguguggcgugccugcuugcucucacguucccaugugguccgcccgccuccugacguguagaugcggggugccggcguguagccacgucccuauguggucugcucggcuucugacaugcagauguggagugcccgccugcucccacguucccauguggagcgcccgccuccugacccgggcucauguggaaugcccuccggcccacacauguagacgcggcguccccgcuugcucccgggcccauauggaguguccucccgcgcauaccugccacuguggcgugccugccugcucucacaccuguagaugcgggguccccgcuuguagccacgugccuaugugguccgcccgccugcucacacgggcucauguugagugucccccggcccacacgagagcgcauguggaaugcccucccgcccauaccugcccuugcggaguccccgcuuguagccacacaugcccguguggcgugccugccugcucucacaaggcucuggccuggugguucugucgcuuucccguucuuccugccgaguccgaugcugugaccguccacagcacacaugggggauuccugauucgguuuuacgugaaagaccccuucuauaucucucuccaccuggaaauuaccuga

SEQ ID NO: 67871 - RNA, 306 nt, Artificial Sequence
  derived and/or modified sequence opt5 from CRIPT__Homo_sapiens__NP_054890
auggugugcgagaagugugagaaaaagcugggcaccgucaucacacccgacacguggaaagauggggccagaaacaccacagaaagcggaggccggaagcucaaugaaaacaaagcucugaccuccaagaaggcccgcuucgacccuuacgggaaaaauaaguuuucuacaugcagaauuuguaaaagcuccguucaccagccgggaucucauuauugccaaggcugugcguacaagaaagggaucugcgcuauguguggaaagaaggugcuugauaccaaaaacuauaagcagacaagcguguga

SEQ ID NO: 67872 - RNA, 750 nt, Artificial Sequence
  derived and/or modified sequence opt5 from CRISP1__Homo_sapiens__NP_001122
auggagaucaagcaccuccuguuccugguggccgcugccugccuucugcccaugcucagcaugaaaaagaaauccgcgagagaccaguuuaacaagcuggucaccgaucuuccuaauguucaagaagagauugugaacauccauaaugcucugcggcgcagaguggucccgcccgccucuaacaugcucaaaaugagcugguccgaagaggccgcucagaaugcccggauuuucucuaaguacugugacaugacagaaagcaacccucuggagcgcagacugcccaauacguuuugcggcgagaacaugcacaugaccuccuauccugugucuuggagcuccguuaucggggugugguacagcgaaucuacauccuucaagcauggagaguggaccacaaccgaugacgauauuacaaccgaccacuauacgcagaucgucugggcuaccagcuaccucaucggcugugccauugcgucuugccggcagcaagggagcccccgcuaucuguacgugugucauuauugccacgaaggaaaugauccugagaccaaaaacgagccguacaagacaggcguucccugugaagccugcccuuccaauugugaggacaaacuuugcacaaaccccuguaucuacuaugaugaauacuuugacugcgauauucaggugcacuaucuggggugcaaucauucuaccacgauccucuucuguaaggcuacaugccugugugacaccgagauuaaauga

SEQ ID NO: 67873 - RNA, 732 nt, Artificial Sequence
  derived and/or modified sequence opt5 from CRISP2__Homo_sapiens__NP_001135879
auggcccugcuccccgugcuguuccuugucaccguucugcucccuagccugccggcugagggcaaggaccccgccuuuacagcgcuucugacgacccagcuccaagugcagagagaaaucgugaacaaacacaaugagcugagaaaggcugucuccccucccgccucuaacaugcugaaaauggaauggagccgcgaggugacaaccaaugcccagagaugggcuaacaagugcacacuccagcauuccgauccugaagaccggaaaaccucuacacgcuguggggagaaucuguacaugagcuccgaucccaccucuuggagcuccgccauucaaagcugguaugacgagauccuugauuucguuuacggagugggcccuaagucuccgaacgcugucguggggcacuauacgcagcugguuugguacuccaccuaucaggugggaugcggcauugccuacugucccaaucaggacagccucaaguauuacuacgucugccaauauuguccugcggggaacaauaugaaccggaaaaauacacccuaccagcagggaaccccuugcgccggcugucccgaugacugcgauaagggccuguguacaaacucuugccaguaucaagaccuucuguccaauugugauagccucaaaaacaccgcugggugcgaacaugagcugcugaaggaaaaaugcaaggccacgugucucugcgagaauaagaucuacuga

SEQ ID NO: 67874 - RNA, 807 nt, Artificial Sequence
  derived and/or modified sequence opt5 from CRISP3__Homo_sapiens__NP_001177915
augaaacagauccugcaccccgcccucgagaccacagacccuugcagcacgggcuucguguuuccggcuaugacccuguuccccguccuucuguuucucguugccgggcugcuuccuuccuuccccgcgaacgaagauaaagacccugcuuuuacagcccugcucaccacacaaacccaggugcagagagagauugugaauaagcauaacgaacugcggcgcgccgucucucccccugcuagaaauaugcugaaaauggaguggaacaaggaagccgcugccaaugcgcagaaaugggccaaccaauguaauuaccggcacagcaacccgaaggaucgcaugacaucccucaagugcggagagaaucuguauaugucuagcgcuuccucuagcuggucccaggccauccagagcugguucgacgaguacaacgauuuugacuucggcguggggcccaaaaccccuaaugcuguugugggacauuauacgcaggucgugugguacucuuccuaucuuguuggcugugggaacgccuacugccccaaucaaaaggugcugaaauauuacuacgucugucaguauugcccugcgggaaacugggccaauagacucuacgugcccuaugaacagggcgcuccgugugccagcugcccugauaacugugacgauggccugugcaccaacggguguaaguacgaggaccuuuauucuaauugcaaaucccugaagcucacacugaccugcaagcaccagcuggugcgggauagcuguaaggcuucuugcaacuguuccaauagcauuuacuga

SEQ ID NO: 67875 - RNA, 939 nt, Artificial Sequence
  derived and/or modified sequence opt5 from CRISPLD1__Homo_sapiens__NP_001273707
augaacauuuggggccagauuuggcccaaggccguguaccuggucugcaauuauagcccuaaagggaacugguggggacacgcuccguacaagcauggcagacccuguuccgccugcccucccucuuucgggggaggcugucgggagaaucucugcuauaaagaagggagcgaccgcuacuauccucccagagaggaagagaccaacgaaaucgagcggcaacagucccagguucacgauacacaugugcgcacgagaucugacgauagcucccggaaugaggugauuucugcgcagcaaaugagccagaucgucuccugugaagugcgccugagagaccagugcaagggaaccacauguaaccgguacgagugcccugcuggcugucuugauagcaaagccaagguuauuggcucugugcacuaugaaaugcaguccagcaucugccgcgccgcuauccauuacgggauuaucgacaaugauggaggcugggucgacauuaccagacaagggcggaagcacuacuuuaucaaaucuaaccgcaauggcauucagacaaucggaaaguaucaguccgccaacagcuucaccgugucuaaaguuacagugcaggcugucaccugugagacgaccguggagcaacugugcccguuucacaagcccgccucccauugcccuagaguguacuguccccggaauugcaugcaggcgaacccucacuaugcccgcgucauugggacaagaguuuacagcgaucucuccucuaucugucgggcugccgugcaugcuggaguggucagaaaucacggcggcuauguggacguuaugcccguggauaaacgcaagaccuacaucgccagcuuccagaacgggaucuuuuccgaaagccugcaaaauccgccuggaggcaaggcguuccgggucuuugccgugguuuga

SEQ ID NO: 67876 - RNA, 1494 nt, Artificial Sequence
  derived and/or modified sequence opt5 from CRISPLD2__Homo_sapiens__NP_113664
augagcugcgugcugggcggggucaucccccucggacugcuuuuccugguuuguggcucccagggguaccuccugccuaacgugacccuucuggaggaacuccugucuaaauaucaacacaaugagagccauuccagagugcggcgcgccauuccgagagaagacaaagaggaaauccugaugcuccacaacaagcugcggggacagguccagccccaggcuucuaauauggaguacaugacaugggaugacgagcuugagaaaagcgccgcggcuugggccucccaaugcauuugggaacauggcccuacgucucugcucgugagcaucgggcagaaccugggagcccacuggggccgcuauagaucccccggcuuucauguucagagcugguacgaugaagugaaggacuauaccuacccuuaucccucugaguguaauccuuggugcccggagcgguguuccgggcccaugugcacacacuacacccagauugucugggcuacaaccaacaaaaucggaugugccgugaauacaugccgcaagaugaccguuuggggcgaagugugggagaacgcugucuacuucguguguaauuauagcccuaaggggaacuggaucggagaagcccccuacaaaaauggcagaccuugcucugagugucccccguccuaugggggaagcugccggaacaaucuuugcuaccgcgaagagacguauaccccuaagcccgagacagaugaaaugaacgagguggaaaccgcgccuauucccgaggaaaaucacgucuggcugcaacccagaguuaugcggccuacaaaaccgaagaaaaccucugccgugaacuacaugacacaggugguccgcugugacacgaagaugaaggauagaugcaaaggcuccaccuguaaccgguaucagugccccgcuggcugucucaaucauaaggccaaaaucuuugggacacuguucuacgagagcuccucuagcauuugccgcgcugccauccacuacggcauucuggacgauaagggagggcucguggacaucaccagaaacggaaaaguucccuuuuucgugaaguccgagcggcauggcguccagagccugucuaaauauaagccuuccagcucuuuuauggugagcaagguuaaagugcaagaucuugacuguuacaccacagucgcgcagcugugcccuuucgaaaagcccgccacgcacuguccgcgcauucacugcccugcucauuguaaagaugagcccuccuauugggccccuguguuugggaccaauaucuacgcugacacaucuagcaucugcaagaccgccguccacgccggagugauuuccaacgaaagcggcggcgacguugaugugaugcccgucgacaaaaagaagacauauguggggucucucagaaauggaguucaguccgagagccugggcaccccucgggaugggaaggcuuucagaaucuuugcggugcgccaauga

SEQ ID NO: 67877 - RNA, 615 nt, Artificial Sequence
  derived and/or modified sequence opt5 from CRK__Homo_sapiens__NP_005197
auggccggcaacuucgacagcgaggaaagauccucuugguacugggggcggcugagccgccaggaggcuguggcccuccugcaaggacagagacacggcgucuuucuuguucgggauuccucuaccagccccggggacuaugugcuguccgugucugaaaauagccgcgucucccauuacaucauuaacagcucuggaccuagaccgcccgugccucccuccccugcgcagcccccuccgggcguuagccccucucggcuccgcaucggggaucaggaguucgacucccugccugcccuucuggaauuuuauaagauucacuaccucgauacaacgacccugaucgagcccgugagcagaucucggcaaggauccggcgucauucugcgccaggaggaagcugaguaugugagagcccucuucgacuuuaauggcaacgaugaagaggaccugccuuucaaaaagggggauauccuucggauccgcgacaaacccgaggaacagugguggaaugcugaggauagcgaaggaaagagaggcaugauuccgguuccuuacguggagaaauaucggcccgccuccgcuucugucagcgcccugaucgggggacgcuga

SEQ ID NO: 67878 - RNA, 912 nt, Artificial Sequence
  derived and/or modified sequence opt5 from CRKL__Homo_sapiens__NP_005198
augagcuccgccagauucgacucuagcgaucgguccgcuugguacaugggccccgugucucgccaggaggcccaaaccagacugcaggggcagcggcacggaauguuucucguccgcgacagcuccacaugcccuggcgauuauguucugucugugagcgaaaacuccagagugagccauuacaucauuaauucucuuccgaaccggcgcuucaagaucggggaccaggaguuugaucaccuucccgcgcuccuggaguucuauaaaauucauuaccuugacacgaccacacugaucgagccugcucccagauauccuuccccucccaugggaagcgucucugccccgaaucuccccaccgccgaagauaaccuggaguacgugcggacacuguaugacuuuccuggcaaugaugcugaggaccuccccuucaagaaaggggaaauucugguuaucaucgagaagccugaagaacaauggugguccgcccgcaacaaagauggaagagugggcaugauucccgucccguacguggagaagcugguucggagcucuccucacggcaagcaugggaaucgcaacuccaauagcuacggaauccccgaaccugcucacgccuaugcgcagccccagaccacaaccccucugcccgccguguccggcucuccgggggcugccauuacgccccucccuagcacccagaacggacccgucuuugcuaaagccauccaaaagagagugccuugugcguacgacaaaacagcccuggcucuugaggugggcgauauugucaagguuacccggaugaauaucaacgggcagugggaaggagaggugaauggccgcaaaggccuguuccccuuuacacacgugaagauuuucgacccgcagaacccugacgaaaaugaguga

SEQ ID NO: 67879 - RNA, 1269 nt, Artificial Sequence
  derived and/or modified sequence opt5 from CRLF1__Homo_sapiens__NP_004741
augcccgccggcagacgggggccugcugcccagagcgcgcgcagaccgcccccucugcucccccugcuucugcuccugugcgugcuuggagcuccucgggccggcuccggggcccacaccgcugucaucucuccccaagacccuacacugcucauuggaagcucccugcuggccacguguucuguucauggcgauccgcccggggcuaccgccgagggacucuacuggacacugaacggccgcagacuuccucccgaacugagccgggugcucaaugcguccacccuggcccuugcucuggccaaccucaauggcucucgccagagaagcggggacaaccuggugugccacgcucgggauggauccauccuggccggcagcugucucuaugucgggcugccucccgagaagccggugaauauuucuugcugguccaaaaacaugaaggaccuuacaugucgcuggaccccuggagcgcauggcgaaacauuccugcacaccaauuacagccucaaauauaagcugagaugguacgggcaggauaacacgugcgaggaauaucauaccguuggaccccacucuugucacaucccuaaagaccuugcccuguuuacacccuacgagauuuggguggaggcuaccaaucggcucggcuccgcccgcagcgauguccugacacuggacauccucgaugugguuaccacggaucccccuccggacgugcaugucucuagagugggcgggcuggaagaccagcuuuccgugcggugggucagcccucccgcucugaaggauuuccucuuucaagccaaguaucagauccgcuacagaguugaggacuccguggacuggaaaguggucgaugacgugucuaaccagacaagcugccggcuggccggacuuaagcccggcaccguuuacuucgugcaggucagauguaauccuuuugggauuuauggauccaaaaaggcuggcaucuggagcgaauggucucaccccacagcggccuccaccccgcgcagcgagcggccugggcccggaggcggcgcuugcgagccuagagggggagaacccucuagcggcccugugcgccgggagcugaaacaauuccucggguggcugaagaagcaugccuacuguuccaaccugucuuuuagacucuaugaucaguggcgcgccuggaugcagaaaagccacaagacccggaaucaggacgaaggcauucugcccuccggaagacgcgggacagcucggggcccggccagauga

SEQ ID NO: 67880 - RNA, 1116 nt, Artificial Sequence
  derived and/or modified sequence opt5 from CRLF2__Homo_sapiens__NP_071431
augggcagacuggugcuccuguggggagccgcugucuuccuucucgggggcuggauggcccuggggcagggaggcgcggcugaggggguucaaauccagauuaucuacuuuaaccuggaaaccguccaggugacauggaaugccagcaaguauucccggacgaaccuuaccuuccacuaccgcuuuaauggagacgaggccuaugaucagugcacaaacuaccugcuccaagaaggccauaccucuggcugucugcuggacgcugagcagagagaugacauucucuauuucagcauccggaaugggacacaccccgucuuuaccgccucccgcuggaugguguacuaucugaaaccuucuagcccgaagcauguuagauucuccuggcaccaggaugcugugacagugaccugcucugaccuuagcuacggagaucugcucuacgaagugcaguaucggucccccuuugacacggaguggcaaagcaaacaggagaacaccuguaauguuacaauugaaggccuggaugccgagaagugcuacucuuucugggugcgcgucaaagcgauggaagacguguaugggccugauaccuaccccuccgacuggagcgaggugacauguuggcagagaggagagauccgggaugccugcgcugaaaccccuacgcccccuaagccgaaacuuucuaaguuuauccugauuuccagccucgccauccugcugauggucucucuccugcuucugucccucuggaagcuguggcgcguuaaaaaguuccuuauucccagcgugccugaccccaaauccaucuuuccuggccuguucgagauucaucaggggaacuuucaagaauggaucacagacacccagaauguggcucaccuccacaagauggccggagcggagcaggaaucuggccccgaggagccgcuggucgugcaacuggccaagacagaagcugagagcccuagaaugcucgauccccagaccgaagagaaagaagccuccggcgggagccugcagcuuccucaucagccccugcaaggaggcgacguugugaccauugggggauucacauucgucaugaacgaucggucuuauguggcucucuga

SEQ ID NO: 67881 - RNA, 1329 nt, Artificial Sequence
  derived and/or modified sequence opt5 from CRLF3__Homo_sapiens__NP_057070
augagaggcgccauggagcuggaacccgagcuccugcuucaggaagcucgggagaacguggaagccgcgcaaagcuaccgcagagagcuggggcaccggcucgagggacugcgcgaagcuagacggcagaucaaggaguccgccucucagacccgcgacguccuuaaacagcauuucaaugaucugaagggcacacucgggaaacugcuggacgaaagacucguuacgcugcuucaagagguggauaccauugagcaggaaacaaucaagccucuggacgauugccagaaacucauugagcacggagugaacaccgccgaagaccugguccgggagggcgaaaucgcuaugcuugggggagugggcgaggagaaugaaaagcuguggagcuuuacaaagaaagccucccauauucagcucgauucucugccggagguuccccugcucguggacgucccuugucugagcgcucaacuugaugacuccauccugaacaucgugaaggaucacauuuucaaacauggcaccguugccucucggcccccugugcagaucgaggaacucauugaaaagcccgggggaaucauugucagauggugcaaaguggacgaugacuuuacagcgcaggacuaucggcugcaguuccgcaaguguaccagcaaucacuuugaggauguguacgucggcuccgagacggaauuuaucguucuucacauugacccuaacguggauuaucaauuuagagugugcgcccgcggggacggacgccaggaguggagcccguggucugucccccagaucggccauuccacccuggugccucacgaauggacagcuggguucgagggauacagccucucuuccagacggaauaucgcccugagaaacgauagcgaaucuuccggcguucuguauagccgcgcucccaccuacuuuuguggccaaacacucaccuuccggguggagacggucgggcagccugacagacgcgauuccauuggagugugcgccgagaagcaggacggcuaugauucucugcagcgggaccaagcgguuuguaucagcacaaauggggccguguuugucaacggaaaagaaaugaccaaucagcuucccgcugugacauccggcagcaccgucaccuucgauauugaggccgugacacuggggacgaccucuaacaaugaaggaggccauuuuaagcucagaguuacaaucuccagcaacaaucgcgagguggucuucgacuggcugcuugaccagucuugcggcagccuguacuucggguguuccuuuuucuacccgggauggaaagugcucguuuucuga

SEQ ID NO: 67882 - RNA, 609 nt, Artificial Sequence
  derived and/or modified sequence opt5 from CRLS1__Homo_sapiens__NP_001120930
augccccaguacgagaacccuuggaccaucccgaauaugcugagcaugacaagaauuggccucgcccccgugcugggguaucuuaucauugaagaggacuucaacaucgcucugggagucuuugcccucgcgggccugacggaucuucuggacggguucauugcucggaauugggccaaccaacgcuccgcccucggaucugcucuggauccucuggccgacaagauccucaucagcauucuguacguuucccuuaccuaugcugaucugauccccgugccucucacauacaugauuaucucuagagacgugaugcugauugccgcggucuuuuaugugcgguaccgcacccuucccacaccuagaacccuggccaaauauuucaauccgugcuacgcuacagcccggcucaagcccaccuuuaucagcaaaguuaacacggcugugcagcugauucuggucgccgcgucccucgccgcuccuguguucaauuacgccgauucuaucuaucugcagauccuuugguguuuuaccgcuuucacaaccgccgccagcgcuuacuccuauuaccacuauggccgcaagacaguucaggugauuaaagacuga

SEQ ID NO: 67883 - RNA, 2061 nt, Artificial Sequence
  derived and/or modified sequence opt5 from CRMP1__Homo_sapiens__NP_001014809
auggccgacagacggcgcgcuuggaacaccgaggaugaccugcccguguaccucgccagaccuggcagcgcggcucagacaccgcggcaaaaguaugggggaauguucgccgccgucgaaggcgcuuacgagaauaaaacgaucgauuuugacgccuauuccguugggcgcagaggaucugcucggacaccccgcagcgccggcagaccugaugcgguggggcugcccggaccuggcggcuccgaagacacagccucugaugugagcgagcccuccgggucugcugucagcuccccuggagaacgggacgagcgcccgcccacccuucggauuagacgcccugcccccagagaucugccucucggccgggacaacgggcagagcgaucgccugcuuaucaagggaggcagaauuaucaaugacgaucagucucuguacgcugacguguaucucgaggacgggcugauuaaacagaucggagaaaaccugaucguucccggcggcgugaagacaauugaggccaaugggcggauggucaucccgggaggcauugaugugaacaccuaccuccaaaaaccuucccaggggaugacagcggccgacgauuucuuucagggaaccagagcugcccugguuggcgggacgaccaugaucauugaccacgugguccccgaaccuggaagcucucuucugacauccuucgagaaguggcaugaggcugccgauaccaagagcugcugugacuauucucuccacguggauaucacauccugguacgacggcgugcgcgaagaacuggaaguccuuguucaggauaaaggcgugaauagcuuucaaguguacauggccuauaaggacgucuaccagauguccgauucucagcuguaugaggcuuucaccuuucucaaagggcugggagcggugauucugguucaugccgaaaacggcgaccucaucgcucaggagcaaaagcggauccuggagauggggauuacgggacccgaaggccacgcccuuagcagacccgaggaacuggaggccgaagcuguguuccgcgccaucacaauugcggggcggaucaauugcccugucuacauuaccaaagugauguccaagagcgcugccgacaucaucgcccucgcuagaaagaaaggcccgcugguuuuuggagagcccauugccgcuucucuuggcacagaugggacccauuauugguccaagaacugggccaaagcggccgcuuucgugaccagcccuccccugucuccugaccccacaacgccggauuaccucaccagccugcuggccuguggagaccuccaggucacaggcuccgggcacugcccuuauucuaccgcucagaaggccgugggaaaagauaauuuuacacugauccccgagggcgucaacgggauugaggagcgcaugaccgugguuugggacaaggcgguggccacgggcaaaauggaugaaaaucaauucgucgcugugacaagcaccaacgccgcuaagaucuuuaaucuuuacccucggaagggaagaauugccguuggcuccgacgccgauguggucaucugggaccccgauaaacugaagaccaucacagcuaaaagccacaagucugcgguggaguacaacauuuucgaagggauggagugucauggauccccucucgugguuaucagccagggcaaaauugucuucgaggacgggaacaucaaugugaacaagggaaugggccgcuuuauuccccggaaggccuucccggaacaccuguaucagagagugaaaauccgcaauaaggucuuugggcuucagggcgugucucggggaauguacgauggcccuguuuaugaggugcccgcuacccccaaauacgccaccccugccccguccgcuaagagcucccccucuaaacaucaaccucccccuauuagaaaccugcaccagagcaauuucucccucucuggggcccagaucgacgacaacaauccccggcgcacgggacacagaaucgucgcgccucccggcgggcggagcaacauuaccucccugggauga

SEQ ID NO: 67884 - RNA, 2511 nt, Artificial Sequence
  derived and/or modified sequence opt5 from CRNKL1__Homo_sapiens__NP_001265554
augaccgccacaguggagaaccugacguuccagaaggacacccucggcaaugcugucgauaaaaacagacggcacgggagcacagaaccccugguucuugccugguccucucaauuucgcagacugaccuggggaugcgcgcucgacgcucugcaucggagcccuuguguggccgccucccagcacggcgugacacaucuuauccgcucuagcagaaccccgcacuccacacggugccgcaaggaggaugcucagcccgggcaucacggaaauggcgccgcuucugucaccgcccaggcgagagggcaacggagcgugcugcagguuccucuccccgugccucgcuccugucuguucagcgaaucuuuugucguguccguuagcucucaguccagauuccuggccagcgugcccggaacgggcguccagcggucuaccgcugccgacauggcugccuccacagcggccggcaaacaacgcauuccuaagguggcuaaagugaagaacaaggccccggcugagguccagaucaccgccgaacagcuccugagagaggccaaagagcgggaacuugagcugcugcccccucccccucagcaaaagauuacagaugaagaggagcucaaugacuacaaacuucgcaagagaaaaaccuuugaagauaacauccggaagaauagaacgguuauuagcaacuggaucaaguaugcucagugggaggaaucccugaaagagauccagcgcgcgcggucuauuuacgaaagagcccucgacguggauuaucgcaauaucacacuguggcugaaguacgcugagauggagaugaaaaaccggcaagugaaucacgccagaaacauuugggaccgcgccaucaccacacucccccgggucaaucaguucugguauaaguacaccuauauggaagagaugcuggggaacguggcuggagccagacagguuuuugaacgcuggauggaguggcagccggaagaacaagcguggcauagcuacauuaauuucgagcuucgguacaaagaaguggauagagcucgcaccaucuaugagcgguuuguccuggugcacccugacguuaagaacuggauuaaauacgccagauucgaagagaagcaugccuauuuugcucacgcccggaagguguacgaacgcgcugucgaguucuuuggcgaugagcacauggacgaacaucucuauguggccuucgcgaaauucgaggaaaaccagaaggaguuugagagaguccgggugaucuacaaauaugcccuggacagaaucuccaagcaggaugcucaggaacuuuucaaaaauuacacaauuuuugagaagaaguucggggaccgccggggaaucgaagauauuaucguuagcaaaagacgcuuucaauacgaggaagaggugaaggccaacccccacaauuaugacgcuugguucgauuaccugagacucgucgagucugacgccgaagcggaggccgugcgggaaguuuaugagcgcgcuauugccaacgugccucccauccaggagaaaagacauuggaagcgguacaucuaucuguggauuaauuacgcucuguaugaggagcucgaagccaaagaucccgagcgcacgagacaggucuaccaggccucccuggaacuuaucccucacaagaaguuuaccuucgcuaaaauguggauucuguacgcgcaauuugagauccggcagaagaaccucagccuggcccgcagagcucuuggcacaucuauugggaaaugcccgaagaauaaacuguucaagguguauaucgaacucgagcugcagcugcgggaguuugaccgcuguagaaagcucuacgaaaaauuccuggaguuuggacccgaaaacugcaccagcuggaucaaguucgccgagcuugagacaauucugggcgauaucgaccgggccagagcuauuuaugaacucgccaucucccagccucgccuggauaugcccgaggugcuguggaaaucuuacauugacuucgaaaucgagcaagaagagaccgagcggacgagaaaucuuuaucgccggcuccugcagagaacacagcauguuaaggucuggauuagcuuugcgcaauucgaacuguccagcggcaaagaggggucucucaccaagugucgccagaucuacgaagaggcuaacaaaaccaugcggaauugcgaagagaaggaggaaagacugaugcuucuggaguccuggcgcagcuuugaagaggaguucggaacagccucugacaaggaacggguggauaaacucaugccugagaaggugaaaaagagacggaaaguccagaccgacgauggcuccgacgccgggugggaagaguauuuugauuacaucuuccccgaagacgcugccaaccagccgaaucugaagcugcuugcgauggcuaagcucuggaaaaagcaacagcaggagaaagaggaugccgaacaccacccugacgaggauguggacgaaagcgaguccuga

SEQ ID NO: 67885 - RNA, 1488 nt, Artificial Sequence
  derived and/or modified sequence opt5 from CRNN__Homo_sapiens__NP_057274
augccccagcugcuccaaaacaucaauggcauuaucgaggccuucagacgguacgcucgcaccgaagggaacugcacagcccugacgagaggagagcuuaagcggcugcucgaacaggaguuugcggacgugauugucaaaccucacgauccggcuaccguugacgaagugcugcgccuucuggaugaggaccauacaggcaccguggaguucaaggaauuucucguccugguguucaaaguugcccaggccuguuuuaagacacugagcgaguccgcugaaggggccugcggaucucaggagagcggcucccuccacucuggggcuagccaagagcugggagaaggccagagauccggcaccgagguggggcgggccggaaaaggccagcauuaugaagggucuagccaccgccagucccaacagggaagcagaggccagaaucggcccgggguccagacacaaggacaggcgaccggcucugccuggguguccagcuacgaucgccaggcugagucucaaucccaggaaagaaucagcccucagauucagcuuucuggccaaacggagcagacccagaaggccggggagggaaagcggaaccagacaaccgaaaugcgccccgagagacaaccucagacacgggaacaggaccgcgcucaucagaccggcgagacgguuacaggguccggaacccaaacacaggccggcgcgacccagaccguggaacaggauagcucccaccaaacagggagaacgucuaaacagacccaggaggccacaaaugaccaaaaccggggaaccgagacacacggccagggcagaagccagaccucccaggcugucacagggggacaugcccaaauccaggcuggcacgcacacccagacccccacacagaccguggaacaagauagcucucaucagacaggguccacgagcacccagacacaggagucuaccaauggacaaaaccgcggcacagaaauccacgggcagggccggagccagaccucccaagccgugacgggaggccacacccagauucaggccgggucucauacagagaccgucgaacaggacagaagccaaacaguuucccacggaggcgcucgcgagcaggggcagacccagacgcaaccuggaagcggccagcgguggaugcaagugucuaauccggaggcgggggaaacagugcccggcggacaggcccagaccggcgcuuccacagagagcgggagacaggaauggucuuccacccauccucgccggugugucaccgagggacagggcgauagacagcccacagugguuggggaggaauggguggacgaucacagccgcgagacggucauccugcggcucgaccaaggaaaccugcauaccuccgugucuagcgcccagggccaggacgccgcucaauccgaagagaagagagggauuacagcccgcgaacuuuauucuuaccugcggagcaccaaaccuuga

SEQ ID NO: 67886 - RNA, 5316 nt, Artificial Sequence
  derived and/or modified sequence opt5 from CROCC__Homo_sapiens__XP_011540774
augaccagcugggacccccagaacccugccggccugugggggagaacacucggaauggagccgcggacgcuggaauccucugugcuuugccaagagaagggccugggggcucgcgaucucgcccaggacgcgcagaucaccagccugcccgcucuuauuagagaaaucgucacacggaaucugucccagccugagucucccguucuccugccugccaccgaaauggccagccugcucucccugcaagaggagaaccagcuucugcagcaggaacucucucgcguggaggaucugcuugcucaaagcagagccgaacgggacgagcuggcuauuaaauacaaugccguguccgagcgccucgaacaggcgcugagacuggagcccggagaacucgagacacaggaaccucggggccugguccgccagagcguggagcuuagacggcaacugcaggaggaacaggccucuuaucgcagaaagcuccaagcuuaccaggaggggcagcagcggcaagcccagcugguucagcgccuucagggaaaaauccugcaauauaagaaaagauguuccgaacucgagcagcagcugcuggaacggagcggcgagcucgagcagcaaagacugcgcgauaccgaacacucucaggaccuugaguccgcucugauucggcucgaagaggaacagcagagaagcgccucucuggcgcaagugaacgccaugcuucgcgagcagcuggaucaggcuggcuccgccaaucaagcucucagcgaggacauccggaaggucacaaacgauuggaccagaugccgcaaggaacuggagcaucgggaagccgccuggagacgcgaggaggaauccuucaaugcuuacuuuucuaacgagcacagccggcugcuccugcuuuggagacaggugguuggguuccgccggcugguguccgaagucaaaauguuuacggagagagaccuccugcagcugggaggcgaacuugcgcggaccagccgcgccgugcaggaggcugggcucggacugucuacaggccugagacucgccgagucccgggccgaagcugcccuggagaagcaagcgcuucugcaggcucagcucgaagagcagcugagagauaaagugcugcgcgaaaaggaccuugcccaacagcagaugcagagcgaucucgacaaagccgaccugucugcucgggucaccgagcuggggcucgccguuaagagacuggagaagcaaaaucuugaaaaagaucaggugaacaaggaccugacagagaaacucgaagcucuggagagccugcgccuucaggaacaagccgcgcucgagaccgaggauggagaaggccugcagcagacgcugagagaccucgcccaggcugugcuguccgauucugagagcggcguccaacuuuccgggagcgaacggacagccgacgcuucuaauggaucccugcgcggccucagcgggcagagaaccccgucucccccucggcgcuccagccccggaagaggccgguccccucgcagagggcccucuccggccuguagcgauuccucuacacuggcgcugauccauagcgcccuucacaagcggcagcuccaggugcaagacaugcgcggaagauaugaggcuucccaggaucugcugggcacccuccggaaacagcugagcgacucugaguccgaaagacgcgcccuugaggaacagcugcaacggcucagagauaagaccgacggcgcuaugcaggcccaugaggacgcccagcgcgaaguucagcggcugagaagcgcuaacgagcugcuuucucgcgagaaauccaaucuggcgcacagccuccaaguggcccagcagcaagcugaagagcugcggcaggaaagagagaagcuccaggccgcccaggaagagcugcgccggcaaagagaucggcuugaggaagagcaggaagacgcuguccaggauggggcccgcgugagacgggagcuggaacgcucucacagacagcucgagcaacuggagggaaagcggagcguucuggcgaaagaacuuguggaggucagagaagcucugucccgcgccacacuccagcgggacaugcugcaggccgagaaggcugagguggccgaagcgcucacgaaagcugaggccggcagagucgaacuggagcuuagcaugaccaagcugcgcgccgaagaggcuucucuccaggauucccugagcaaacuguccgcccuuaacgagucucuggcucaagacaagcucgaucugaaucggcucguggcccagcuggaagaggaaaagagcgcgcuucaggggagacaacgccaggccgagcaggaagcuacaguugcccgggaggagcaggaaagacuggaggaacugcgccucgagcaagaaguggcuagacagggacuggagggcucccuucgggucgccgagcaggcccaggaagcucuggagcaacagcucccuacccugcgccaugaaagaucucagcuccaggagcaacuggcgcagcuuagccggcagcuguccgggcgcgagcaggaacuggagcaagccagacgggaagcucagagacagguggaggcccucgaacgcgccgcucgggagaaagaggcccuggcgaaggaacacgcuggccuugccguucaacugguggccgcugagagagaaggacgcacacucucugaggaagccacccggcugagacucgagaaagaggcgcuggaaggcagccuuuucgagguccagcggcagcuggcucagcuggaagcccgcagagagcaacucgaagccgaggggcaggcucugcuucuggccaaggagacgcucacaggagaacuggcuggccuccggcagcagauuaucgccacccaagagaaagcgucccuggacaaggaacuuauggcccagaagcuggugcaggcugagcgcgaggcccaggcuagccugagagaacaacgggccgcccaugaggaagaucuccagcgccugcagagagagaaagaagcugcguggcgggagcuugaggccgaacgcgcucaacugcagucucagcuccagagagagcaagaagagcugcuggcccggcucgaagccgagaaggaggaacuuuccgaggaaauugcugcccugcagcaggagagagacgaagggcugcuccuggcggagagcgagaaacagcaagcucuuucucugaaggaauccgagaaaaccgcccucagcgaaaagcugaugggaacacgccacucucuggccaccaucucccucgagauggagcggcagaagagagaugcucagagccgccaggaacaagaccgguccacagugaacgcccuuacgagcgagcugagagaucugcgcgcgcagcgggaagaggccgcugccgcucacgcccaggaaguuagacgccuccaagagcaggcucgggaccugggcaaacagagagacucuugccuucgcgaggccgaagagcugcggacccagcucagacugcuggaagaugcgcgcgacgggcucagacgggagcuucuggaagcccaacgcaagcugagagagagccaggagggccgggaaguccagagacaggaggcuggagaacuccggcgcucccugggcgagggggccaaagaaagagaggcucuucggcgcucuaacgaggaacugagaagcgccgugaagaaagccgaguccgaacggauuucucucaagcuggcuaaugaggauaaagagcaaaagcuggcgcuccuugaagaggcccgcacagcugugggaaaggaagccggcgagcugagaaccgggcugcaggaagucgagcggagccgccucgaggccagacgggaacugcaggagcuucgcagacagaugaaaaugcuggacuccgaaaacacacggcucggacgcgagcuggcugaacugcaaggcagacucgcccuuggggagcgggcggagaaggaaucuagacgcgagacccugggccugcggcagagacuccugaaaggagaagccagccuugaggugaugcgccaggaacugcagguugcucaacggaagcuccaggagcaggagggcgaauuuagaacgcgcgagcggagacugcuggggucccucgaagaggcccgcggaaccgagaaacaacagcuugaucaugcucggggccuggaacugaagcucgaggccgcgagagccgaagcugccgagcuggggcuucgccugagcgcugccgaaggacgggcucagggccucgaggccgagcuggcgagaguggaaguccagcggagagccgcugaggcccaacuggggggccuccgcucugcucuucggagaggacugggccuggggcgcgcccccuccccugcccccagacccgugccuggaagcccggcgcgggacgcucccgccgaaggcucuggggagggacucaauuccccuagcacacuggaauguucccccggcucucagccucccagcccgggcccugcuaccucccccgccagcccugaucuugaccccgaggccguucgcggggcucugagagaguuccuccaggaacugcggucugcccagcgcgagagagaugaacugcggacacaaaccuccgcgcucaaccgccagcuugccgagauggaagcugagagagacagcgccacgucucgggcucgccagcugcagaaggccguggcggagagcgaagaggccagacgguccgucgauggacgccugucuggcgugcaagcugaacucgcccugcaggaggagagcguuagacgguccgaaagagagcgccgggcuacacuugaccagguggccacccuggaaagaucucuccaagcuacagagagcgaacugcgcgccucccaggagaaaaucagcaagaugaaagcgaaugagaccaagcuggaaggggauaaacggagacucaaggagguccuugacgccucugaaucccgcaccgugaagcuggagcugcagcggagaagccucgaaggagagcugcagcgcucccggcuuggccugucugacagagaggcucaagcccaggcucuccaggaucggguggacagccugcagcgccaagucgccgauuccgaaguuaaagccgggacacugcagcucacgguggagagacugaacggagcgcuugcuaagguggaagagucugaaggcgcccugcgggacaaaguccgcggccucaccgaggcccuggcucagagcuccgccagccuuaauucuacaagagauaagaaccugcaccuccagaaagcucugaccgccugcgagcaugaccggcaagugcugcagguuagauga

SEQ ID NO: 67887 - RNA, 1923 nt, Artificial Sequence
  derived and/or modified sequence opt5 from CROT__Homo_sapiens__NP_001137407
auggagaaccagcuggccaagagcaccgaagagagaacauuccaauaccaggacucccuccccucucugccugugccgagccuugaagagucccugaaaaaguaucucgaaucugucacgcggaccugcuaccagauccgcggccuggaucccgacgcuaaaagaggguuucuugaucugacacgggagggcauucagguuaagccuuucgccaaucaagaggaauauaaaaagaccgaggaaaucgugcagaaguuucagagcggaauuggggagaaacuccaccagaagcugcuggagcgcgcgaaaggaaagagaaacuggcucgaagagugguggcugaauguggcuuaccuugacguccggauccccucccaacugaacgugaauuucgccggcccugccgcucauuuugaacacuauuggcccccuaaagaggggacacagcucgaacgcggaucuauuacccuguggcauaaccuuaauuacuggcagcugcucagaaaggagaagguuccggugcacaaagucggcaacacaccccuggauaugaaucaguuccggaugcuguuuagcaccuguaaggugccuggcaucacgcgcgacuccaucaugaacuauuucagaaccgagagcgaagggcggucucccaaucauauuguugugcucugccgcggacgcgccuuugucuucgaugugauccacgagggcugucuggugacaccucccgaacuucugcggcaacucaccuacauucacaaaaagugccauuccgagccggacgggccuggaaucgcugcccugacaagcgaagagagaaccagaugggcgaaagcccgggaguaccuuauuggccuggaucccgaaaaccucgcucugcuggagaagauccagucuucccuccuggucuauagcauggaagacucuuccccucacguuacgcccgaggauuacagcgaaauuaucgccgcuauccuuauuggggaccccacagugagauggggagauaaauccuauaaucugaucucuuuuagcaacggcguguucggcuguaauugcgaccaugccccuuuugacgcgaugauuauggucaacaucuccuacuauguggaugagaagauuuuccagaacgaggggcgcuggaagggaagcgaaaaaguucgggacaucccgcuccccgaggaacugaucuucauuguggaugagaagguccuuaaugacaucaaccaagccaaagcucaguaccugagagaggccucugaucuccagauugcugccuaugccuuuaccuccuucggcaagaaacugacaaagaauaagaugcugcacccugacaccuuuauccagcucgcucugcaacuugcguacuaccgccugcacgggcaucccggauguugcuaugaaaccgccaugacacggcacuucuaccauggcagaacggagaccaugcgcagcuguacaguggaagcuguucgguggugccagucuaugcaggauccuagcgugaaccucagagagcgccagcagaaaaugcugcaagccuuugccaagcacaauaaaaugaugaaggacuguuccgcugggaaaggauucgaucggcaucugcuuggccuccugcugauugccaaggaagagggccuccccgucccggagcuguuuaccgacccucuuuucucuaagagcgggggaggcgggaacuuugugcuguccacaagccucgucggauaucugagagugcagggcguugugguccccauggugcacaauggguacggcuucuuuuaucacauccgcgaugaccgguucguuguggcgugcucugcuuggaaauccugcccugaaaccgacgccgagaagcugguccagcuuacguuuugugccuuccaugauaugauccaacucaugaacagcacacaccuguga

SEQ ID NO: 67888 - RNA, 675 nt, Artificial Sequence
  derived and/or modified sequence opt5 from CRP__Homo_sapiens__XP_011507509
auggagaagcugcucugcuuccuggugcuuaccagccugucccacgccuuuggccagacagacaugucuagaaaggcuuucgucuuucccaaagaaagcgauacguccuacguuucucucaaagccccucugaccaagccgcuuaaagcguucacagugugucugcauuuuuauaccgagcucagcuccacacggggguacucuaucuucagcuaugcuaccaagcgccaagacaacgaaauucugaucuuuugguccaaggauauuggauacagcuucacagugggcgggucugagauccuguuugaaguccccgaggugaccguugccccugugcacauuugcacguccugggagagcgccucuggaaucgucgaguucuggguggacggcaaacccagaguucggaagucccucaaaaagggguauaccgugggagcugaagccagcaucauucugggccaggaacaggauucuuuuggcgggaauuucgagggaucccagagccuugucggcgacaucgggaacgugaauaugugggauuuugugcuguccccugacgagauuaacacaaucuaccucggaggccccuucucuccuaauguccugaacuggcgcgcucuuaaauaugaaguucaaggggagguguucaccaagccgcagcuguggcccuga

SEQ ID NO: 67889 - RNA, 1938 nt, Artificial Sequence
  derived and/or modified sequence opt5 from CRTAC1__Homo_sapiens__NP_001193457
auggcccccagcgcugacccuggcauguccagaaugcugccguuccuccugcuucugugguuucuccccaucaccgaggggucucagcgggccgaaccuauguucacagcggugacgaacagcguccugcccccugauuacgacuccaaucccacccaacuuaacuauggaguugcugugacagauguggaccacgauggcgacuuugagauugucguggccggguacaauggaccuaaccugguucucaaguaugaucgcgcccagaaaagacuggugaauaucgcugucgacgaacggucuagcccguacuaugcccugcgcgauagacagggcaacgcuauuggggugaccgccugcgacaucgauggagacggccgggaggaaauuuacuuccucaauacaaacaaugcguuuuccggcguugccaccuauacagauaagcuguucaaauuucgcaacaauagaugggaggacauccuuucugacgaggugaacgucgcucggggaguggccagccuguucgcugggcgcuccguggccugugucgauagaaagggcagcgggcgguacucuaucuacauugcgaauuaugccuacggaaacguuggccccgacgcucucaucgaaauggauccugaggccuccgaccugagccgcgggauucuugcucugagagauguggccgccgaagcuggagugucuaaauauaccggcggccgcggggucuccgugggacccauccucucuagcuccgcgagcgacaucuuuugcgauaaugagaacggcccuaacuuccuguuucauaaucgcggggacggaacguucguugaugccgcugccuccgccggcguggacgauccccaccagcaugggagaggagucgcucuggccgacuuuaaccgggacggcaagguggauauuguuuacggcaauuggaacgggccgcacagacucuaucugcaaaugucuacccauggaaaggugcgcuuccgggacauugcgagcccuaaauucuccaugcccagcccugucagaacagugaucaccgcugauuuugacaaugaucaggagcuugaaaucuucuuuaacaauauugccuaccggucuuccagcgccaaccggcuguucagagucauccgccgggagcacggcgacccccucauugaggaacugaaucccggggaugcucuugaaccugagggaagaggcacagggggcgugguuaccgacuuugauggagacggcaugcuggaucucauccugucucacggggagagcauggcccagccgcuguccguguuccgcggaaaccagggcuuuaauaacaauuggcuccgggucgugcccagaacgcgcuucggggcuuuugcccggggagcgaagguugugcuguauaccaaaaagucuggcgcccaucuuagaauuaucgacgggggcagcggauaccugugugaaauggagccugucgcucacuucggccucgggaaagaugaagccuccagcguggaggugacauggcccgacggaaagaugguuucucggaacgucgcuuccggcgaaaugaauagcgugcuggagauccuuuacccucgcgacgaggauacacugcaagaccccgccccgcucgaaugcgggcagggauuuucucagcaggagaacggccauuguauggauaccaacgaaugcauucaauucccuuuugugugucccagagacaagccugucugcgugaauaccuauggguccuaccgguguagaacaaacaaaaagugcagccgcggcuaugagcccaaugaagauggaacggcguguguugcccagguggcuuuccugggcggguacuccucugccgcuagccggaucuccgagccucugucuagagccagcuaucucucccugggacuuggccugugccuccagcuguacgcccuguga

SEQ ID NO: 67890 - RNA, 585 nt, Artificial Sequence
  derived and/or modified sequence opt5 from CRTAM__Homo_sapiens__NP_001291711
augugggugaagcugcucagcaucgucgccgaguucugcuuuucccccuuccugguuaccgacgaagagacagcuucugaugcccuugaaagaaacagccuguccucucaggacccucaacagccgacgagcaccguguccgugacagaggauucuagcaccuccgaaauugacaaagaggagaaggaacagacaacccaggaucccgaccucacaaccgaggcgaauccucaauaccugggccuugcucggaaaaagagcgggauccugcuccugacgcuggucucuuuucucauuuucauccuguuuauuaucgugcagcuuuucaucaugaaacugcgcaaggcccacguuauuuggaagaaagaaaacgagguguccgagcauacccucgaaagcuauagaucucgguccaauaacgaggaaacaagcucugaggaaaagaauggacaguccagccaccccaugcgcuguaugaacuacaucaccaaacuguauuccgaggccaagacaaaaagaaaggagaauguccagcauucuaaacuugaagagaagcacauucaagugccugaaagcaucguuuga

SEQ ID NO: 67891 - RNA, 1206 nt, Artificial Sequence
  derived and/or modified sequence opt5 from CRTAP__Homo_sapiens__NP_006362
auggagcccggcagacggggagccgcugcccugcucgcgcugcuuugcguggcuugugcccugcgcgccgggagagcucaguacgaacgguauagcuuccgcuccuuuccuagagacgagcucaugccgcuggaaucugccuaccggcacgcucuugauaaguauagcggcgagcauugggccgaauccgucggguaccuggagaucucucuccgccugcacagacugcuccgggacagcgaggcguucugccaucgcaacuguuccgccgcuccccaaccugaacccgccgcuggacuggccucuuauccugagcuuagacuguuuggcgggcuccugcggcgcgcgcacugccuuaaaagauguaagcagggacugcccgccuuccggcagagccagccuucccgcgaaguucucgcugauuuucaaagacgggagccguacaaauuccugcaguuugccuauuucaaggcuaauaaccugcccaaagccauugccgcugcgcauaccuuucuccugaagcacccugacgaugagaugaugaagagaaauauggccuacuacaaaagccuucccggcgcugaagacuauaucaaggaucuggagacaaaaucuuacgaaucccucuucauucgcgccgugcgggccuauaacggcgagaauuggagaacgagcaucaccgacauggaacuggcccuuccugacuuuuucaaggcuuuuuacgagugccuggcggcuugugaggggucucgcgaaauuaaagauuucaaggauuucuaucucuccaucgccgaccacuacguggagguccuggaaugcaagauccagugugaggaaaaccugacacccgugauuggaggcuauccgguugagaaauuuguggccaccauguaccauuaccuccaguucgcuuauuacaagcugaaugaucuuaaaaacgccgcuccuugcgccgucagcuaucugcucuuugaccaaaaugacaaggugaugcagcagaaccugguuuacuaucaguaccaccgggauacaugggggcuuucugacgagcauuuccaacccagaccugaagcggugcaguuuuucaaugucaccacacugcagaaagagcucuaugauuuugccaaggaaaacaucauggacgaugacgagggagaagugguggaguacgucgaugaccugcuggagcucgaagagaccuccuga

SEQ ID NO: 67892 - RNA, 1953 nt, Artificial Sequence
  derived and/or modified sequence opt5 from CRTC1__Homo_sapiens__NP_001091952
auggccaccagcaacaaucccagaaaguucuccgagaaaaucgcucugcacaaccagaagcaagccgaagagacagcggcuuuugaagaggugaugaaagaccucucucugacgcgggccgcccgccuucagcugcaaaagagccaguaccuccagcugggcccuuccagagggcaguauuacggaggcucucuuccgaaugucaaccagauugggagcggaaccauggaucugcccuuccagccuuccggcuuucucggggaagcucuggccgcugcccccguuucucugacaccuuuccaaagcuccggacucgacaccagccggacaacccgccaucacggccugguggauagaguguaucgggagcgcggcagacuugggucuccccaucggcgcccucuguccgucgacaaacacggaagacaggcggauagcugcccguacggcacaauguaucucucucccccugccgacaccuccuggcggcgcacgaauagcgauucugcucugcaucaguccaccaugacacccacccagccugagagcuuuuccucugggagccaagacgugcaccagaagagaguucuucugcucacagugcccggaauggaagagaccacguccgaagccgauaagaaccugagcaaacaggcuugggacacaaagaaaaccggcucucggccgaaguccugugaggucccugggaucaauauuuuccccagcgccgaucaagagaacacaaccgcgcugaucccugccacccacaauacaggaggcucucuccccgaccugacgaacauucauuuucccagcccucuuccgacaccccuggauccugaggaacccaccuucccugcucucuccucuagcuccagcaccggcaaucuggccgcuaaccuuacacaccuggggaucggaggcgccgggcagggaaugucuacccccggcuccagcccgcagcaucgcccugccggggugucuccccucucccugagcacggaagcuagacggcagcaagcguccccuacacugucuccccucagcccuaucacccaggccguugcuauggacgcccugucccuugagcagcagcugcccuacgccuuuuucacccaagcuggaucucagcagccgccuccccagccccaaccuccgcccccucccccucccgccagccagcagccucccccgccucccccuccccaggcgccggugagacucccucccggcggcccucugcuucccuccgcuagccugacacgcgggccccaaccuccgccccucgccgucaccgugccuucuucccugccccagagcccucccgaaaauccuggacagccgucuaugggcauugacaucgccuccgcucccgcccugcaacaguaucggacaagcgcugggucuccugccaaccagagccccacguccccugugagcaaucagggauuuucucccggcuccagcccgcaacacaccuccacacucgggucugucuucggcgaugcguacuacgagcagcagauggccgcuagacaggccaacgcucugagccaccaacuugagcaguuuaacaugauggaaaaugccauuuccucuagcucccuguauucuccuggaagcacccucaacuacucccaggcggccaugaugggccugacagggagccauggaucucugcccgacucccagcaacuuggcuaugcuagccacucugggauccccaauauuauccucaccguuacgggagaguccccucccagccugucuaaagaacugaccuccagccucgccggcgugggggauguguccuucgacagcgauucucaguucccucuggacgagcuuaagauugauccgcugacacucgacggccugcauaugcugaacgaucccgacaugguccuugcugauccugccaccgaagacacauuucgcauggaccggcucuga

SEQ ID NO: 67893 - RNA, 2082 nt, Artificial Sequence
  derived and/or modified sequence opt5 from CRTC2__Homo_sapiens__NP_859066
auggccaccagcggcgcuaacgggcccggauccgccacagcgucugcuagcaauccuagaaaguucuccgagaaaaucgcccugcagaagcaacggcaggccgaagagacggcugccuuugaagaggugaugauggacauuggcucuacccgccuccaggcucagaaacugagacuugccuacacacggagcucccacuaugggggaucucugccgaacgucaaucaaaucggcagcgggcucgcggaguuccagagcccccugcauuccccucuugauucuucccgcagcaccagacaccauggacugguugaacgggugcagcgcgaccccagacggauggugucuccucuccgcagauacacacggcacauugauuccagccccuauucuccugccuaccuguccccgcccccugagagcuccuggcgcagaaccauggcuuggggcaacuuucccgccgaaaagggccagcuguuccggcucccuucugcucugaaucgcacaagcuccgacagcgcccuucauaccucugucaugaaccccuccccgcaagauacguauccugggcccaccccucccagcauccugcccucuagacggggaggcauucucgacggggagauggauccuaaagugccggcgaucgaagagaaucugcuugacgauaagcaucugcucaagcccugggacgccaaaaagcugagcuccucuagcuccagaccucgcagcugcgagguucccggaaucaacauuuuuccuucucccgaucagccggcuaaugugccuguccugcccccugccaugaacacaggcgggucccuccccgaccugaccaaucuucacuucccucccccgcugccuacaccccucgaucccgaagagaccgcuuacccuagccugucuggaggcaacuccacgagcaaucuuacacacaccaugacacaccugggcaucucccgggggaugggacucggcccgggguaugacgcccccggacugcauucuccucugagccaccccucccuccagucuagccuguccaacccuaaucuucaggccagccugucuagcccccaaccucagcuccagggcucccacucucaucccucccugccggcuagcucucuugcgagacacgugcugccuaccaccagccucgggcaucccucccugagcgccccugcucugucuuccagcuccucuagcuccucuacaagcucccccguucucggagccccgucuuacccugccagcacgcccggcgcuuccccucaccaucgccgggugccccugagcccccuuucucugcucgccggcccugcggacgcuagacgcucccaacagcagcugccgaaacaguuuagccccaccaugucuccuacacuguccagcauuacccaaggggucccccuugauacaucuaagcucuccaccgaccagcggcugccucccuacccuuauagcuccccgagccuggugcuccccacgcagccucacacacccaaaucucugcagcaaccuggacuucccagccaguccuguucugugcagagcuccggcgggcagccgccuggaagacaaucucacuacggcacccccuaucccccugggcccagcggccauggacagcaguccuaccaccgcccuaugucugauuucaaccugggcaaccucgaacaguuuagcauggaguccccgagcgccucucugguccuggaucccccuggguucuccgaaggacccggcuuucuugggggagagggcccuaugggcgggccccaagacccgcauaccuucaaucaccagaaccucacacacugcagccggcauggaucuggcccuaauaucauucugaccggggacuccagccccggauuuuccaaggagaucgccgcugcccuggcuggcguuccuggguucgaagugucugccgcgggacucgagcugggccuugggcuggaagaugagcucagaauggaaccccugggccuggagggacuuaacaugcucagcgacccuugugcccugcugcccgauccggcuguggaggaauccuuccgcagcgaccggcuccaguga

SEQ ID NO: 67894 - RNA, 1857 nt, Artificial Sequence
  derived and/or modified sequence opt5 from CRTC3__Homo_sapiens__NP_001036039
auggccgcuagccccggcuccgggucugccaacccuagaaaguucagcgagaaaaucgcgcugcacacccagcggcaagcugaagagacacgcgccuuugaacagcucaugacggaccugacccuuuccagagugcaguuccagaagcugcaacagcuccggcugacacaguaccacggaggcucucuuccgaaugucagccagcugcgcuccucugccagcgaguuucaacccuccuuccaccaggcugauaacguuagagggacccggcaucacggacucguggaacgcccuagcagaaaucgguuucauccccugcaccgcagaucuggcgacaaaccugggcggcaguucgauggauccgccuuuggcgcuaacuauagcucucagccccuggacgaguccuggccucgccaacagccgcccuggaaggaugagaaacacccuggcuucagacucacaagcgcccugaaucggaccaacucugacuccgcgcuucauacaagcgcccuguccaccaagccccaggauccuuacgggggaggcgggcaaucugcuuggcccgccccguauaugggauuuugcgacggcgaaaauaacgggcacggagagguggcuagcuucccuggcccccucaaggaagagaaucugcuuaacgucccuaaaccccugcccaagcagcucugggagacgaaagaaauucagucccugagcggccgcccuagaucuugugauguugggggaggcaaugccuuuccgcauaacgggcagaaucugggacucucccccuuccugggcacccuuaacacagggggaagccugccugaccucaccaaucugcacuacucuacaccccuuccugcgagccuggauaccacggaccaccauuuuggcuccaugucugugggcaacagcgugaacaauauccccgccgcuaugacacaccucgggauucgguccagcucuggacugcaauccagcagaucuaacccguccauccaggccacccugaauaagacaguccucagcuccucucugaacaaucauccucagaccagcgugcccaacgcuuccgcccuucacccuucucugcgccucuucagccuguccaaucccagccuuucuaccacaaaccuguccggcccuagccggagacgccagcccccgguuucuccucucacgcugucccccgggcccgaggcccaucaaggauucagccggcagcugucuagcaccuccccucucgcuccguaucccacaagccagauggugucuuccgauagaagccagcuguccuuucuuccuaccgaagcgcaagcccaggucucucccccucccccuuaccccgcuccgcaggagcugacacagccucuccugcaacagccccgcgccccugaagcccccgcucagcaaccgcaggccgcgagcucccugccucagucugacuuccagcuucuccccgcucaaggcagcucccugaccaacuuuuucccugacgugggguuugaucagcagucuaugcggcccggccccgccuucccucagcaagugccgcugguccagcagggaagcagagagcuccaggacuccuuucaucugcgccccagcccuuauucuaauugcggcucccuucccaauacgauucugccugauagcucuacaucccucuucaaagaccugaacagcgcccuggcugggcuucccgagguuucucucaauguggauaccccuuuuccgcuggaagaggaacugcaaaucgagccccucucccuggacggacuuaacaugcugagcgauuccagcaugggccuccuggacccuucuguggaagagaccuuccgggccgauagacuguga

SEQ ID NO: 67895 - RNA, 900 nt, Artificial Sequence
  derived and/or modified sequence opt5 from CRX__Homo_sapiens__NP_000545
augauggccuacaugaaccccggcccucacuauagcgugaaugcucuggcccucuccgggccgucugucgaccugaugcaucaggcgguucccuacccuagcgcucccagaaagcaacggcgcgagagaaccacauucacgcggucccagcuugaggaacuggaagcccucuuugccaaaacccaguauccugauguguacgcucgcgaggaaguggcccugaagaucaaccuucccgagucuagaguccaggugugguucaaaaaucggcgcgcuaagugcagacaacagcggcagcagcaaaaacagcagcagcaaccuccgggaggccaggccaaggcgcgccccgccaagagaaaagcugggacaagcccucggcccuccaccgacguuuguccugauccccugggaauuucugacagcuauuccccgccucuccccggcccuagcgggucucccacaaccgccguggcuacagucuccaucuggagccccgccucugaguccccucugccggaagcgcagcgcgccggacugguggcuagcggccccucucucaccuccgccccuuacgcuaugacguaugcccccgccagcgcuuuuugcuccucuccuagcgcguacggcucccccagcucuuacuucuccgggcuggauccguaucuuagcccuaugguuccccaacugggaggcccugcccucucuccccugagcgggccuuccgugggacccucucuugcucagagcccgaccucccugagcggccagucuuacggggccuauuccccugucgacagccucgaguuuaaggaucccacaggaaccuggaaauucacauacaaccccauggacccucuggauuauaaggaccagucugccuggaaauuucaaauucuguga

SEQ ID NO: 67896 - RNA, 1761 nt, Artificial Sequence
  derived and/or modified sequence opt5 from CRY1__Homo_sapiens__NP_004066
augggcgugaacgccguccacugguucagaaaggggcugcggcuccacgacaaucccgcucugaaagagugcauccagggagccgauaccauucgcuguguuuacauccuugacccuugguuugcgggcagcuccaacguggggauuaauagauggcgguuccugcuccaaugccuggaagaucuugacgcuaaccugcgcaagcucaauucuagacuguuugugauccggggacagccggccgaugucuucccccgccuguuuaaagaguggaacauuacaaagcucagcaucgaauaugacuccgagccuuucggcaaagaaagagaugccgcuaucaagaagcuggccacggaggcugggguggagguuauugugcggaucucucacacccuuuacgaccuggauaaaauuaucgaacucaauggaggccagcccccucugacauauaagcgcuuucagacccuuauuagcaaaauggagccccuggaaaucccugucgagacaauuaccuccgaggugaucgaaaaguguacaaccccgcucucugacgaucaugacgagaaauacggcguucccagccuggaagaacugggguucgauacggacggacucuccagcgccguguggccuggcggggaaaccgaggcgcugacaagacuugagcggcaccuggaacgcaaggccugggucgcuaacuuugagagaccccggaugaaugccaacucucuccuggcuuccccuaccggacuuagccccuaucugcgcuucggcugccucucuuguagacuguuuuacuucaagcugacagaccucuauaaaaaggugaaaaagaacuccagcccgccucugucucuuuacgggcaacugcucuggcgggaauuuuucuacaccgccgcgacgaauaaucccagauucgauaaaauggagggaaacccuaucugcgugcagauucccugggacaagaaucccgaagcccuggcuaaaugggccgagggccgcacaggcuuuccuuggaucgaugcuauuaugacccagcuucggcaggagggguggauccaucaccuggccagacacgccgucgcuuguuuccucacacgcggagaccuguggauuuccugggaagagggcaugaagguuuuugaggagcugcuccuggaugcggacuggagcaucaacgccggguccuggauguggcuuucuugcagcuccuucuuucaacaguucuuucauuguuauugcccggugggauucggccggagaaccgaucccaacggggacuacauccgccgguaucugccugugcucagaggauuucccgcuaaguacauuuaugauccuuggaaugcccccgaaggcauccagaaagucgccaagugucugauuggcgugaacuacccgaaaccuaugguuaaucacgcugaggccagccgccugaacaucgagcggaugaagcagauuuaucaacagcuuucuagauaccgcgggcucggacugcuggcguccgugcccagcaauccuaacggcaaugggggauucaugggcuacucugcugaaaacauccccgggugcagcuccucuggcagcugcucccagggaagcggcauccuccauuaugcccacggggacucucaacagacccaucugcuuaaacagggacgguccagcaugggcacagggcugucuggaggcaagagaccuucccaggaggaagauacgcaaagcauugggcccaagguccagcggcaguccaccaauuga

SEQ ID NO: 67897 - RNA, 1599 nt, Artificial Sequence
  derived and/or modified sequence opt5 from CRY2__Homo_sapiens__NP_001120929
augcccgccccuccgggcagaacccacacaugguuccugcuccagagccuggaggaccuugauacgucccugcggaagcucaacucucgccuguuuguggucagagggcaacccgcugacguuuucccucggcuuuuuaaagaauggggagugacccgccugacauucgaguacgauagcgaacccuuuggcaaggagagagacgccgcgaucaugaaaauggcuaaggaagccgggguggaggucgugaccgaaaauucccauacacucuaugaucuggaccggauuaucgagcugaacggacagaaaccuccccucaccuacaagcgcuuccaggccauuaucucuagaauggagcugccuaagaaaccgguuggccuugugacaagccagcaaauggaauccugccgggcugagauucaggagaaucacgaugaaaccuaugggguccccucucuggaggaacucggauuuccuacggagggccugggccccgccguguggcaagggggagaaaccgaggcucuugcccgccuggacaagcaucucgagagaaaagcguggguugccaacuacgaacggccucgcaugaaugcuaacagccugcuggccucccccacaggccucagcccguaucugagauucgggugucuuucuugccggcuguuuuacuaucgccucugggaucuguacaagaaagugaagagaaauuccaccccuccccuuagccuguucggacagcuccuguggcgggaguuuuucuacacagcugccaccaacaauccuagauuugaccgcauggaaggcaaccccaucuguauccagauucccugggaucggaauccugaggcgcuggccaagugggcugaagggaaaacgggauucccguggaucgacgccauuaugacacagcucagacaggagggcuggauccaccaucuggcucgccacgccgucgccugcuuccuuacccggggcgaucugugggugucuugggaguccggggugagagucuuugacgaacuccugcuugacgcugauuucagcguuaacgcgggaucuuggauguggcuguccuguagcgccuuuuuccagcaauuuuuccacugcuauugucccgugggcuuugggcgccggacagacccuuccggagauuacauuagacgcuaucuccccaagcugaaggcuuucccuucucgguacaucuaugagcccuggaaugccccggaaagcauucagaaagccgcuaaaugcaucaucggcguggacuacccuagacccauugucaaccaugccgagaccucccgccugaauaucgaacggaugaagcagauuuaucaacagcucagcagauaccgggggcugugucuucuggcgucugugccuuccugcguugaggaucucagccaccccguggcugagccuucuagcucccaggccggaucuaugagcuccgccggcccccgcccgcugccuagcggccccgcuucucccaaaagaaagcuggaagccgcugaggaaccuccgggggaggagcuuuccaagcgggccagagucgcggaacuccccaccccugagcugcccagcaaagacgccuga

SEQ ID NO: 67898 - RNA, 528 nt, Artificial Sequence
  derived and/or modified sequence opt5 from CRYAB__Homo_sapiens__NP_001276737
auggacaucgccauucaccaucccuggaucagacggccuuucuuuccguuccacagccccucccgccuguuugaucaguucuuuggcgagcaucuccuggaaucugaccuuuucccuaccagcacaucccugucucccuuuuaccucagaccucccagcuuccugcgggcuccuuccugguuugauacggggcuuucugagaugcgccuggaaaaggacagauucagcgugaaccucgaugucaaacacuuuuccccggaggaacugaagguuaaagugcugggagacgugauugagguccauggcaagcacgaggaacggcaagaugagcacggguucaucagccgcgaauuucauagaaaauaucggauucccgccgacguggauccucucaccaucacaucuucccugagcucugacggaguucuuaccgugaauggcccccgcaagcaggucuccgggccugagagaacaauccccauuacccgggaggaaaagccggcggugacagcugccccuaaaaaguga

SEQ ID NO: 67899 - RNA, 648 nt, Artificial Sequence
  derived and/or modified sequence opt5 from CRYBA1__Homo_sapiens__NP_005199
auggagacccaggccgaacaacaggagcuggaaacacuccccacgaccaagauggcucagacaaacccuaccccgggcagccuggggcccuggaaaaucacaauuuacgaccaggagaauuuccaaggaaagagaauggaauuuaccuccucuugcccuaacgugagcgagcgguccuucgauaauguccgcucucuuaaaguugagagcggcgccuggaucggguaugaacacacauccuuuuguggacagcaguucauucuggagagaggcgaauacccccggugggacgcguggucugggagcaacgcuuaucauaucgagcgccucauguccuuuagaccuauuugcagcgccaaucacaaggagucuaaaaugaccaucuucgaaaaggagaacuuuaucggacggcagugggaaauuuccgaugacuaccccagccugcaagccaugggcugguucaauaacgaggugggcucuaugaagauccaguccggggcuuggguguguuaucaguacccuggauaucgcggcuaccaguacauucuugaaugcgaucaucacgggggagacuauaaacauuggagagaguggggcagccacgcccaaacgucucagauccaguccauucggcgcauccaacaguga

SEQ ID NO: 67900 - RNA, 594 nt, Artificial Sequence
  derived and/or modified sequence opt5 from CRYBA2__Homo_sapiens__NP_476434
augagcuccgcccccgcuccuggcccggcccccgcgucucugacccucugggacgaggaagauuuccaggggagacggugccgccugcuuagcgacugugcuaacgugugcgagagaggaggccugccucggguccgcuccguuaagguggaaaauggggugugggucgccuuugaguaccccgauuuccaaggacagcaguuuauccucgaaaaaggcgacuauccuagauggucugccuggagcggguccucuagccacaacuccaaucagcugcuuagcuuccggcccgugcugugugcuaaccauaaugauucucgcguuacacucuuugagggagacaacuuccaaggcugcaaguuugaucugguggacgauuacccuucccugccgagcaugggcugggccucuaaagacgucgggucccucaaggugagcucuggagcuuggguugccuaucaguaccccggcuauagaggguaccaguaugugcuggagcgggaucgccacuccggagaguucuguacguacggcgaacuugggacccaggcgcauacaggacaacugcagagcauuagacggguccagcacuga

SEQ ID NO: 67901 - RNA, 591 nt, Artificial Sequence
  derived and/or modified sequence opt5 from CRYBA4__Homo_sapiens__NP_001877
augacccugcagugcacaaagagcgccggccccuggaaaaugguggucugggacgaggauggguuccaaggaagacggcacgaauuuacggcugaguguccuuccguucucgaacugggcuucgagaccgugcgcucucuuaaggugcugagcggggccugggucggauuugaacaugcgggcuuccaggggcagcaguacauccucgagagaggagaguauccguccugggacgcuuggggcggcaacacagccuaccccgccgaacggcugaccucuuuucgcccugcugccugcgcuaaucacagagauagccggcuuacaauuuucgagcaagaaaacuuucuggggaaaaagggagagcucuccgacgauuaucccucucugcaggccaugggcugggaggggaaugaagugggcagcuuccauguucacuccggagcguggguguguagccaguuuccuggguaccgcggauuccaguauguccuggagugcgaccaucacucuggcgauuacaaacacuuuagagaauggggcucccaugcccccaccuuccaagugcagagcauccggcgcauucagcaguga

SEQ ID NO: 67902 - RNA, 759 nt, Artificial Sequence
  derived and/or modified sequence opt5 from CRYBB1__Homo_sapiens__NP_001878
augagccaggccgcuaaggccuccgcgucugcuaccguggccgucaaccccggcccugacacaaaagggaagggagccccgcccgcuggcacgagcccuucccccgggaccacacuggccccuaccacaguucccaucaccucugcuaaagccgcggagcucccuccgggaaauuacagacuggugguguucgaacuugagaacuuucaaggccggcgcgccgaguucagcggggaaugcuccaaucuggcugauagaggauuugaccggguccgcucuauuaucgugagcgccggccccuggguugcuuucgaacaguccaacuuuagaggcgagauguucauucucgagaagggggaauauccucgguggaauacauggucuagcuccuaccgcagcgauagacugaugucuuuucggcccaucaaaauggacgcccaggagcacaagauuucccuuuucgaaggagcgaacuuuaagggcaauaccaucgagauccagggggaugacgccccuagccuguggguguauggauucucugaucgcgucggcuccgugaaaguuagcuccgggacgugggugggauaccaauaucccggcuacagaggcuaucaguaccuccuggagccgggggacuuucggcauuggaacgaauggggagcuuuccagccucagaugcaaucucugcgcagacuccgggauaagcaguggcaccuggagggcagcuuucccguccuugccaccgaaccucccaaauga

SEQ ID NO: 67903 - RNA, 618 nt, Artificial Sequence
  derived and/or modified sequence opt5 from CRYBB2__Homo_sapiens__NP_000487
auggccagcgaccaccagacccaagcuggcaagccccagucccugaacccuaaaaucauuaucuucgagcaggaaaauuuucaggggcauucucacgagcucaacggaccgugccccaaucugaaggaaacaggcguggagaaagccgggagcguccuuguucaagcgggaccuugggugggcuacgaacaggcuaacuguaagggggagcaguucguguuugagaaaggagaauaucccagaugggauuccuggacgucuagccggcgcaccgacucccugucuagccucagaccuauuaaggucgauucccaggagcauaagaucauucuguacgaaaaucccaacuucacaggcaaaaagauggagaucaucgacgaugacgugccuagcuuucacgcccauggcuaucaagagaaaguuucuuccgugcggguccagagcgggaccugggugggauaccaguauccgggcuaccgcgggcuucaguaucugcucgaaaagggagauuacaaagacucuuccgauuucggcgcuccccacccucaaguucagagcgugagacggauucgcgacaugcaguggcaccaaagaggggccuuucaucccucuaauuga

SEQ ID NO: 67904 - RNA, 636 nt, Artificial Sequence
  derived and/or modified sequence opt5 from CRYBB3__Homo_sapiens__NP_004067
auggccgagcagcacggcgcucccgaacaagccgcggcugggaagucccauggagaccugggcggguccuacaaagugauccucuaugagcuggaaaacuuccagggaaagagaugcgagcuuucugccgaauguccuagccugaccgauucccuccuggagaaagucggcucuauucagguugagagcgggccguggcuugccuuugaaucccgggcuuuccgcggagagcaguuugugcuggaaaagggcgacuaccccagaugggaugccuggucuaauagccgggacuccgauagccuccugucucugcgcccucucaacaucgacagcccccaccauaaacugcaccuuuucgagaauccugcuuuuagcggcagaaagauggagauuguggaugacgauguccccucucugugggcccauggguuccaagaccggguggcguccguucgcgccaucaacggaacaugggugggcuaugaauuuccuggguacagaggacggcaguaugucuucgagcgcggcgaauacagacacuggaaugagugggaugcuagccagccgcagcuccaaucugugcggcgcauuagagaccagaaguggcacaaacgggggcgcuuucccuccagcuga

SEQ ID NO: 67905 - RNA, 528 nt, Artificial Sequence
  derived and/or modified sequence opt5 from CRYGB__Homo_sapiens__NP_005201
augggcaagaucaccuucuacgaggacagagccuuucaggggcggagcuaugaaugcacaacggauugucccaaccugcaaccuuacuucucccgcugcaauucuauuagaguggagagcggauguuggaugaucuaugaacggccgaacuaccagggccaccaguauuuucuccgcagaggggaguaccccgacuaucagcaauggaugggacuguccgauucuauucggagcugcugucuuaucccuccccauuccggcgcuuaccgcaugaaaauuuacgacagagaugaacugcgggggcagaugucugagcucaccgacgauugcaucagcguccaggaccgcuuccaccugacagagauccauucccuuaauguucuggaaggaagcuggauucucuaugagaugccuaacuacagaggccggcaguaucugcugcgccccggcgaauacagacgguuucucgauuggggagccccuaaugcgaagguggggucucugcgcagagugauggaccuuuauuga

SEQ ID NO: 67906 - RNA, 525 nt, Artificial Sequence
  derived and/or modified sequence opt5 from CRYGC__Homo_sapiens__NP_066269
augggcaagaucaccuucuacgaggacagagccuuucaggggcggagcuaugaaacaacgaccgauugccccaaccugcaaccuuacuucucccgcuguaauucuauuagaguggagagcggaugcuggaugcucuaugaacggccgaacuaccagggccagcaguaucugcuucgcagaggggaguaccccgacuaucaacaguggaugggacuguccgauucuauccggagcuguugccucauuccucagacagucucccaccgccugagacuuuacgaacgggaggaccauaaaggccugaugauggagcucucugaagauugucccagcauccaggaccgcuuucaccuguccgagauuagaagccugcauguucucgaagggugcugggugcuguacgagcuuccuaauuaucggggacgccaauaccugcucagaccccaggaguaucggcgcugucaggauuggggcgcuauggacgccaaggcgggcucucugagacggguggucgaucuuuacuga

SEQ ID NO: 67907 - RNA, 525 nt, Artificial Sequence
  derived and/or modified sequence opt5 from CRYGD__Homo_sapiens__NP_008822
augggcaagaucacccuguacgaggacagaggguuccagggacggcacuaugaaugcagcuccgaucaucccaaccuccaaccuuaccugucucgcuguaauagcgccagaguggacuccggcugcuggaugcuuuaugagcagccgaacuacucugggcugcaguauuuucuccggcgcggagauuacgcugaccaccagcaauggaugggccugagcgauuccgucagaucuugucggcuuauuccccauagcgggucccaccgcaucagacuguaugaacgggaggacuaccgcggacagaugauugaguucacagaagauugcagcugucuccaggacagauuucgguucaaugagauccauucucugaacguucuggaaggcuccugggugcucuacgagcugagcaauuaucgcggcagacaguaccuucugaugccuggggauuaucggcgcuaccaagacuggggagccacgaacgcgagagugggcucucuccggagagucauugauuuuuccuga

SEQ ID NO: 67908 - RNA, 537 nt, Artificial Sequence
  derived and/or modified sequence opt5 from CRYGS__Homo_sapiens__NP_060011
augagcaagaccggcacaaaaaucacguucuacgaggacaagaacuuucaggggagacgguaugauugcgacugugauugcgccgacuuccacaccuaccugucccgcuguaauucuauuaaaguggaaggaggcacaugggcugucuaugagagacccaacuuugccggguacauguauauccucccucaaggagaauacccggaguaucagcgguggaugggccugaaugaucgccuuagcuccugcagagcgguucaucugcccucugggggacaguacaagauucagaucuucgaaaaaggcgacuuuagcggccaaauguacgagaccacagaggauuguccuuccauuauggaacaguuccacaugcgggagauccauucuugcaaggugcucgaagggguguggaucuuuuaugagcugcccaacuaccgcggaagacaguaucuucuggacaagaaagaguaccggaagccuauugauuggggcgcugccagccccgccguccaguccuuccgcagaaucguggaauga

SEQ ID NO: 67909 - RNA, 960 nt, Artificial Sequence
  derived and/or modified sequence opt5 from CRYL1__Homo_sapiens__NP_057058
auggccagcuccgcugccggcugcguggucaucguugggucuggagugauuggcagaagcugggcgaugcuguucgcuuccgggggauuucaggugaagcucuacgacaucgagcaacagcagauucggaacgcccuggaaaauauccgcaaagagaugaagcugcuggaacaggccggcucucucaaagggagccuguccgucgaggaacaacuuucucugauuagcggaugucccaacauccaggaggcuguggagggcgccaugcacauccaggaaugcguuccugaggaucucgaacugaagaaaaagauuuucgcucagcuggacuccaucauugaugacagagugauccucucuagcuccaccagcugucugaugccgucuaaacuuuuugccggccugguccaugugaagcaaugcauuguugcgcaccccgugaauccucccuauuacaucccucucgucgagcuggugccccauccugagacagccccgacgaccguggaucggacacacgcucuuaugaagaaaauugggcagugucccaugcgcguccagaaggaaguugccggauucgugcugaacagacuccaguaugcuaucaucuccgaggccuggcggcugguggaagagggcauugucagcccuucugaccuggaucucgugauguccgaagggcugggaaugcgcuacgcguuuaucggcccccuugagaccaugcaucugaaugccgaggggaugcucagcuauugcgacagauacuccgaaggaauuaaacacguucugcaaacauucggcccuauccccgaguuuucucgggcuaccgccgaaaaggugaaccaggauauguguaugaaggucccggacgauccugagcaccuugcugcccgcagacaguggcgggacgaaugccugaugcgccucgccaaacuuaagagccaagugcagccccaguga

SEQ ID NO: 67910 - RNA, 945 nt, Artificial Sequence
  derived and/or modified sequence opt5 from CRYM__Homo_sapiens__NP_001879
augagcagagugcccgccuuccuguccgcugccgaggucgaggagcaccuccggucuagcucccugcuuaucccuccgcuggaaaccgcgcucgcuaacuuuucuagcggccccgaagggggaguuaugcagccugugcgcacagugguccccgugacgaagcauagaggcuaccuggggguuaugccugccuauuccgccgcugaagacgcccuuaccacaaaacuggugaccuucuacgaggaucggggaauuacaucugucgugcccagccaccaagcuaccguucuccuguuugagccuuccaauggcacacugcucgccgugauggacgggaacgucaucaccgcgaagcgcacggccgcugugagcgccauugcuaccaaauuccugaagccgcccucuuccgaagugcuuugcauccugggagccggcguccaggcguauagccauuacgagauuuuuacagaacaguucucuuuuaaagagguuagaaucuggaaucggaccaaggagaacgccgaaaaguucgcugauacagugcagggcgaggugcgcgucuguuccagcgugcaagaagccguugcuggggccgacgugaucauuaccgucacgcucgccacagagccuauccuguuuggagaaugggugaaacccggcgcucacauuaaugcgguuggggccucuagaccugauuggcgggagcuugacgaugagcugaugaaggaagcugugcucuaugucgacucccaggaggccgcccugaaagaaagcggagaugugcugcucuccggcgcugagaucuucgccgaacugggggaggucauuaagggagugaaacccgcgcauugcgagaagaccacaguuuuuaagucucuuggcauggcuguggaagacaccgucgccgccaaacugaucuacgauagcugguccagcggcaaguga

SEQ ID NO: 67911 - RNA, 1050 nt, Artificial Sequence
  derived and/or modified sequence opt5 from CRYZL1__Homo_sapiens__NP_665857
augaagggccuguacuuccagcaaagcuccaccgacgaggaaaucacauuuguguuccaggagaaagaagaucuccccgucacggaggacaacuuuguuaagcugcaagugaaagccugcgcucuuucucagauuaauaccaagcugcucgccgaaaugaaaaugaagaaggaucuguucccuguggggagagagaucgcgggaauuguccuugacgugggcagcaaaguuuccuuuuuccagccggaugacgagguggucgggauccugccccucgauucugaagacccuggacugugugaggugguucgggugcacgaacauuaucugguccacaagcccgagaaagugacauggaccgaggcugccggcagcauucgcgauggggugagagccuacacagcucuccauuaucugucccaccuuucuccuggaaagagcguccugaucauggacggcgccuccgcuuuuggcaccaucgccauucagcucgcgcaucaccgcggggccaaaguuaucagcacagcuugcucucuggaagauaagcagugucuugagcgguucagacccccuauugcccgggugaucgacguguccaacggaaagguccacguggcugaaagcugccuggaggaaaccggcgggcucggaguugauauugugcuggacgccggcguccgccuguacucuaaagacgaugagccggcggugaagcuccagcugcuuccccauaaacacgacaucauuacgcugcucgggguuggaggccauugggugaccacagaggaaaaucugcaacuugauccucccgacucccacugucuguuucucaagggcgccacccuggcuuuccugaacgaugaggucuggaaucucagcaacgugcagcaggggaaauaucugugcauccuuaaggacgucauggaaaaacugucuacaggaguguuuagaccucagcucgaugagcccaucccgcuguacgaagccaagguuuccauggaggcugugcaaaagaaucagggccggaaaaagcaggucgugcaauucuga

SEQ ID NO: 67912 - RNA, 1482 nt, Artificial Sequence
  derived and/or modified sequence opt5 from CSAD__Homo_sapiens__NP_001231634
auggccgacagcgaggcucugcccucccucgccggcgauccuguggcggucgaagcucugcuuagagccguuuucggggugguggucgacgaggccauccagaagggaaccucugugagccaaaaaguuugcgaauggaaggagccggaggaacugaaacagcuccuggaucuugagcugcggucccagggcgaaucucagaagcaaauucucgagcgcuguagagcugugauccgguacagcgucaaaacagggcacccccgcuuuuucaaccagcuguuuuccggacuggacccucaugcccucgcuggcagaauuaucacggaaucucugaauaccagccaguauacauacgagauugcccccguguucguucuuauggaggaagaggugcugcggaagcuccgcgcgcuggucgggugguccagcggagauggcaucuuuugcccuggcgggucuaucuccaacauguaugccgugaaucuugcuagauaccagcgguaucccgacuguaagcaacgcggacugagaacccucccuccgcuggcccuguucacaagcaaagaaugccacuacucuauucagaagggcgcugccuuucucgggcugggaaccgauuccgugcgggucguuaaagcggacgagcgcggcaagauggugcccgaagaucuugagagacagaucgggauggccgaggcugaaggagccgugccuuuccuggucagcgcuacaucuggcaccacggugcucggcgccuuugacccccuggaggccauugcugauguuugucagcggcaugggcuuuggcugcacguggacgcggccuggggaggcuccguccuccugagccaaacccaucgccaucugcucgaugggauccagagagcugacuccguggccuggaacccucacaaacugcuugccgcuggacugcagugcucugcccuccugcuucaagacacaagcaaucugcucaagcggugucacggcucccaggcgagcuaucuguuccagcaggauaaguuuuacgacguugcucuggauaccggggacaaagugguccaaugcggaagacgcguggauugucucaagcuguggcuuauguggaaagcccagggcgaccagggccuggaacggagaauugaucaggccuucguccucgcucgcuaccugguggaggaaaugaagaaacgggagggguuugagcugguuauggaacccgaguucgugaacgucugcuucugguuugugccgccuucucuuagaggaaagcaagaaucccccgacuaucacgagcgccucagcaaaguugccccugugcugaaggaacggauggucaaggagggcucuaugaugaucggguaccagccccauggaacaagaggcaauuucuuucgcguggugguugcuaacagcgcccugaccugugcggauauggacuuccuccugaaugagcuugaacggcuggggcaggaucucuga

SEQ ID NO: 67913 - RNA, 333 nt, Artificial Sequence
  derived and/or modified sequence opt5 from CSAG3__Homo_sapiens__NP_001123300
auguggaugggccugauccagcucguggagggggucaagagaaaagaccaaggauuccuggaaaaggaguuuuaccacaaaaccaacauuaagaugcggugcgaguuccuugccuguuggcccgcuuuuacaguucugggcgaagccuggcgcgaucagguggacuggagcagacuccugcgggaugcggggcuugugaaaaugucccgcaagccuagagcuucuagcccgcuguccaauaaccaucccccuacgcccaagcgguucccucgccagcccggaagagaaaaaggcccuaucaaggaggucccggggaccaaaggaucucccuga

SEQ ID NO: 67914 - RNA, 2748 nt, Artificial Sequence
  derived and/or modified sequence opt5 from CSE1L__Homo_sapiens__NP_001243064
auggagcugagcgacgccaaccuccagacccugacagaauaccuuaagaaaacgcuggaucccgacccugcuaucagacggccggccgagaaguuccucgaauccguggagggcaaucaaaacuauccccugcuucugcucacccugcuggaaaaaucucaggauaaugucauuaagguuugcgcgagcgugacauuuaaaaacuacaucaagcgcaauuggagaauuguggaggacgagccuaacaagaucugugaagcugaucgggucgccauuaaagccaauaucgugcaccucaugcuguccucucccgagcagauccagaagcaacuuagcgacgcuauuuccaucauugggcgcgaagauuucccucagaaauggcccgaccugcucaccgagaugguuaacagauuucagucuggagauuuccaugugaucaauggcguccugcggacagcccacagccuuuuuaagcgcuauagacaugaguucaaauccaacgaacuguggaccgagauuaagcucgugcuggacgcuuuugcccugccucucacaaaucuguucaaggcgaccaucgaacuuugcagcacgcacgccaacgaugcuucugcccugcggauucucuuuuccagccugauccuuaucucuaaacuguucuacucccucaauuuucaggaccugccggaguucuuugaagauaacauggagaccuggaugaauaacuuccauacacugcucacccuggacaacaaacuucugcaaacagaccucguuagcaaugcuauucaguuccuggccucugugugugagcgcccccacuauaaaaaccuuuuugaagaucagaauacccugacguccaucugcgagaaggucauugugccuaacauggaguucagagcggccgacgaagaggcuuuugaagauaauagcgaggaauacauccggcgcgaccucgagggguccgauauugacacaagacggcgcgccgcuugugaucuggugagaggacugugcaaauucuuugaaggccccgucaccgggaucuucucuggauauguuaacagcaugcuccaggaguacgccaagaauccuuccgugaacuggaaacacaaggacgccgcuaucuaccuggugacaagccuugcgucuaaggcccaaacccagaaacauggcauuacccaggcuaaugaacuggucaaccucacagaguuuuucgugaaucacauccugcccgaucugaaguccgccaacguuaaugaguuuccggugcuuaaagccgacggcauuaaguauaucaugauuuuccggaaccaagucccuaaagaacaucuccuggugagcaucccccugcucaucaaucaucugcaggcugagucuauuguugugcacacguacgccgcgcacgcucuugaaagacuguuuaccaugcgcgggccuaacaacgccacacucuucaccgccgcugagaucgcccccuuugucgagauucugcugacaaaucuuuucaaggcucucacccugcccggaagcuccgaaaacgaguauaucaugaaggccauuaugcggucuuucagccugcuccaggaagcgaucauuccuuacaucccgacgcugaucacacagcuuacccaaaaacugcucgccguguccaagaaucccagcaaaccucacuuuaaccauuauauguucgaggcuauuugucugucuaucagaauuaccugcaaggccaaucccgcugccgucgugaacuuugaagaggcgcuguuccuuguuuuuacagagauccuccagaaugaugugcaggaguucauuccuuacgucuuucaggugaugucccugcugcucgaaacccacaaaaacgacauccccagcucuuauauggcccuguucccgcaucuucugcaaccuguucucugggaacgcacaggcaauauccccgcucuggugcggcugcuucaggccuuucucgagagaggguccaacacgauugcuagcgccgccgcugacaagaucccuggacugcugggcgucuuccagaagcucauugcguccaaagccaaugaucaccagggguuuuaccugcuuaacucuaucauugaacacaugcccccugagagcguggaccaauaccgcaagcagaucuucauccugcucuuucagcggcugcaaaauuccaaaaccacaaaguucauuaaaucuuuccugguguuuaucaaccuuuauuguauuaaguacggagcucuggcccuccaggagaucuucgauggcauucagcccaagauguuuggcaugguucuggaaaagaucaucauuccggagauccagaaggucagcgggaauguggaaaagaagauuugcgccgugggaaucaccaaacuccugacagaguguccucccaugauggacaccgaauauacgaaacuuuggacaccccugcuccaaucccugauuggccuguucgagcuuccugaggaugacaccaucccggaugaggaacauuuuauugacaucgaagauacccccggguaccagacagcuuucagccagcuggccuuugcgggcaaaaaggagcacgacccugucggacagauggugaacaaccccaagauccaucucgcucaaucucugcacaaacucuccaccgccugcccugggagaguucccagcauggugucuacgucccugaaugccgaggcccuucaguaucugcagggauaccuccaggcugcgagcgucacacugcuguga

SEQ ID NO: 67915 - RNA, 2919 nt, Artificial Sequence
  derived and/or modified sequence opt5 from CSF1R__Homo_sapiens__NP_005202
augggccccggggugcugcuccugcuucuggucgccaccgcuuggcacggacagggcaucccuguuauugagccgagcgugcccgaacucguggucaagccuggggccacagugacgcugagaugcguuggaaacggcuccguggagugggacgggcccccuucuccccauuggacccuuuacagcgauggauccucuagcauccuguccacaaauaacgcgaccuuccaaaauacaggcaccuaucgguguacagaaccuggcgacccgcucgggggaucugcugccauucaccuguacgucaaagaucccgcccgcccuuggaacgugcuggcucaggagguuguggucuuugaagaccaggaugcccuccugcccugccuucugaccgacccugugcucgaggcuggcgugagccuggucagaguucgggggcgcccccuuaugagacauacgaauuauuccuucagcccguggcacggauuuaccauccaucgggccaaguucauucagucucaagauuaccaguguuccgcgcugaugggcgggcgcaaagugaugagcaucucuaucagacucaaggugcagaaagucauuccuggacccccugcccugacacuggugcccgcugagcucguucggauccgcggcgaagccgcucagauugugugcuccgccagcucugucgacgugaacuuugauguuuuccugcaacacaauaacaccaagcuggcgaucccccagcaguccgacuuucacaauaacagauaucagaaggugcugacacucaaucuggaucaagucgacuuccagcaugccggcaacuacagcuguguggcuuccaauguccaggggaaacacucuaccagcauguuuuuccgggugguugaguccgccuaucuuaaccugagcucugaacaaaaucucauucaggaggugacggucggagagggccugaaccugaaggugaugguugaggcuuacccugggcuccagggauuuaacuggacauaccugggcccguucuccgaucaucagcccgagccuaaacuugccaaugccaccacaaaggacaccuaucgccacaccuuuacacugagccuccccagacugaaaccuucugaagcugggcgguacagcuuccuugcgcgcaaccccggaggcuggagagcccugacguucgagcucacccugcgguauccgccugaaguguccgucaucuggacauuuauuaauggcucugggacccugcucugcgcugccagcggauacccccaaccuaacgugacauggcugcaguguuccggccacaccgacagaugcgaugaggcccaggugcuucagguuugggacgaucccuauccugagguccugagccaagaacccuuccauaaggugacggugcagucucuccugacagucgagacccuggaacacaaucagaccuacgagugucgcgcucauaacuccguggggagcggaucuugggccuuuaucccgaucuccgcgggcgcucacacacauccucccgacgaauuucuuuuuacccccguuguggucgccugcaugagcauuauggcccuccugcugcuccugcuucugcuccugcuguauaaguacaaacagaagccuaaauaccaagugcgguggaagaucauugaguccuaugaggggaauagcuacacauucaucgauccgacgcagcuucccuauaacgaaaaaugggaguuuccuagaaauaaccuccaguucggcaagacccugggagcuggcgccuuugggaaaguuguggaagcuacagccuucggacugggcaaggaggacgcgguccucaagguggccguuaaaaugcuuaagagcaccgcucacgccgaugaaaaagaggcucuuauguccgagcugaagauuaugucucaccucgggcagcaugaaaauaucgugaaccugcugggagccuguacacacggcgggcccguccuugugaucaccgaguacugcugcuauggcgaccuccugaauuuucugcgccggaaagcggaagccaugcucggaccuagccugucccccggccaagauccugaagggggaguggacuacaagaacauucaucuugagaagaaauaugucagacgcgauagcggcuucucuucccaggggguugacacguacguggaaaugcggcccgugagcaccucuuccaaugacagcuuuucugagcaggaucuggacaaggaagauggaagaccgcucgagcugcgcgaccugcuucacuucagcucccaagucgcucagggcauggccuuccucgcuagcaaaaacuguauccaccgggauguggccgccagaaacguucugcugacaaaugggcauguggcuaagauuggcgacuuuggacucgcgcgcgauaucaugaacgacucuaauuacauugucaaaggcaacgcccggcugccugugaaguggauggcucccgaauccaucuucgauugcguuuauaccgugcagagcgacgucugguccuacgggauccuucugugggagauuuucucucucggacugaauccuuaucccggcauccuggugaacagcaaguucuacaaacuuguuaaggauggguaucagauggcccaaccggccuuugcuccuaaaaauauuuacuccaucaugcaggccuguugggcgcuggagcccacacacagaccuaccuuccagcagauuugcucuuuucuccaagaacaggcucaggaggaccggcgcgaaagagauuauacgaaccugcccagcuccucucggagcggaggcuccgggucuucuuccagcgagcucgaagaggagucuuccagcgaacaucugacauguugcgagcagggcgacaucgcccaaccccuucugcagccuaauaacuaccaguucuguuga

SEQ ID NO: 67916 - RNA, 435 nt, Artificial Sequence
  derived and/or modified sequence opt5 from CSF2__Homo_sapiens__NP_000749
auguggcugcagagccuccugcuucugggcaccguggccugcuccaucucugcucccgccagaagcccuuccccgucuacacaacccugggagcacgucaacgcgauucaggaagcucggcgccuccugaaucuuagcagagacacggccgccgagaugaacgaaaccguugaggugaucuccgaaauguucgaucugcaggagccuacaugucuccagacccggcuggagcuguacaagcaagggcuccgcggaucucugacaaaacuuaagggcccccugaccaugauggcuagccauuauaaacagcacugcccucccacaccugaaaccuccugugccacgcagauuaucaccuuugagagcuucaaggaaaaucucaaagacuuucugcuugugauuccguucgauugcugggagcccguccaggaguga

SEQ ID NO: 67917 - RNA, 1305 nt, Artificial Sequence
  derived and/or modified sequence opt5 from CSF2RA__Homo_sapiens__NP_001155002
augcugcuccuggugaccagccuucugcucugcgagcugccccacccugccuuccuucugaucccggaaaaguccgaccucagaacagucgcucccgccucuagccugaacguucgguuugauucccgcacgaugaaucugucuugggacugucaggagaacaccacauucagcaaaugcuuucucaccgauaagaaaaauagagugguggaaccucggcuguccaacaaugaguguucuugcacauuccgcgaaauuugucuucaugagggcgucaccuuugaggugcacguuaacacaagccaaagaggguuccagcagaagcugcucuaccccaauuccggacgggaaggcaccgcggcucagaacuuuagcugcuucaucuauaaugccgaccugaugaacuguacgugggcccgcgggccuaccgcucccagagaugugcaauacuuucuuuauauucgcaauucuaaacggagacgggagauccgcugcccuuacuauauucaggacuccggaacacaugucggcugucaccuggauaaccucagcgggcugaccucuagaaauuacuuccuggugaacggaacaucccgggaaaucggcauccaguuuuucgacagccuccuggauaccaagaagauugagcgcuuuaauccgcccucuaacguuacggugagaugcaacacaacccauugucuuguccgguggaaacagccuagaacauaucaaaagcuguccuaccucgacuuccaguaccagcuggaugugcaccgcaaaaauacccagcccggcaccgagaaccuucugaucaaugugagcggggaccucgaaaaccgguauaauuucccuuccucugagcccagagccaagcacagcgucaaaauucgcgcugccgauguucggauccugaacugguccagcuggucugaagcgauugaguuuggaucccauagcgugacacaagccggcgugcaguggcacaaucuggggucucuccagccgccuagccccagacugaagcgcuucuccugccuucggcugccuggaucugacgacggcaaccucgggagcgucuacaucuaugugcugcuuauuguuggaacgcuggugugcggcaucguccucggcuuucuguucaagagauuucugcgcauccaacggcucuuuccucccgugccccagauuaaagauaagcugaaugacaaccaugaaguugaggaugagaucauuugggaagaguucaccccggaagaggggaaaggauacagagaagaggugcuuacagucaaggagaucaccuga

SEQ ID NO: 67918 - RNA, 2694 nt, Artificial Sequence
  derived and/or modified sequence opt5 from CSF2RB__Homo_sapiens__NP_000386
auggugcuggcccagggccuccugagcauggcccuucuggcucucugcugggagagaucccuggcgggggcugaagagaccaucccccuucaaacacugcgguguuacaacgacuauacgucucacauuaccugccgcugggccgauacacaggacgcccagagacucgucaauguuacccugauccggcgcgugaacgaagaucugcucgagccugugagcugugaccuguccgaugacaugccguggucugcuugcccccauccuagaugugucccccggcgcugcgugauuccuugucagagcuucguugugacagaugucgacuacuuuuccuuccaacccgauagaccucuuggaacccggcugacagugacccucacgcagcacguucagccgcccgaaccucgcgaccugcagaucucuaccgaucaagaccauuuucuucugacauggagcguggcccucggcagcccccagucccacuggcugucuccuggggaucuggaguucgaggucguguauaagagacuccaggacuccugggaagacgcugccauucugcuuagcaauaccucucaggcgacacugggacccgagcaucucaugccguccagcaccuacguggcccggguccgcacgagacuggcuccuggcucucggcuuuccgggcgccccagcaaaugguccccugaaguuugcugggauucucaacccggagacgaggcccagccccagaaccuggagugcuuuuucgauggcgcugccgugcucagcuguuccugggaagugagaaaggaggucgcgagcucuguguccuuuggccuguucuauaaaccuagcccggacgccggggaagaggaauguucucccguucugcgggagggacucggcagccugcacacaagacaccauugccaaaucccugugcccgauccugcuacccacgggcaguacaucgucuccgugcagccccgccgggccgagaagcauauuaaaucuagcguuaauauccagauggcuccgccuucccuuaacgugacaaaggacggagauagcuauucucugagaugggaaaccaugaagaugcgcuacgagcacauugaccacaccuuugaaauccaauaccggaaagauacagccacguggaaggacuccaaaaccgagacacuccagaaugcccauagcauggcucugcccgcgcuugaaccuucuaccagauauugggcccgcguccgggugagaacaucccgcaccggcuacaacgggauuuggagcgagugguccgaggcucggucuugggauacggaaagcguccugcccaugugggugcucgcccugaucguuauuuuccugacaaucgccgugcuccuggcucuuagauuuugcggaaucuauggcuaccgccugcggagaaagugggaggagaaaauuccuaaucccuccaagucucaccucuuccagaacggcagcgccgaacuguggccgccuggguccaugagcgcguuuaccucuggauccccuccccaucagggccccugggggagccgguucccggaacuggagggagucuuccccgugggcuuuggggacucugagguuuccccucuuaccaucgaagaccccaagcacgugugugauccucccagcggaccugacacaacccccgcugccucugaucucccgacagagcaaccucccagcccucagcccggcccgccugccgcuucccauacgcccgaaaaacaggccagcucuuucgacuuuaauggcccuuaucuggggccuccccacucccgcagccugcccgauauucucggacagccggagcccccucaagagggcgggucccagaagucucccccucccggaagccuggaauaccuuugccugccugcuggcgggcagguccagcucgugccgcuggcccaagcgaugggccccggacaggccguggagguugaaagacggccuucccagggcgcugccgggucucccagccuggaguccggaggcgggccugcucccccggcccuuggaccuagagucggcgggcaagaccagaaagauucucccguggcgauccccaugagcuccggcgacaccgaagauccuggaguggccagcggcuaugucucuuccgcugaccucguguucacacccaacagcggggccucuuccguuagccuggugccuucucugggacucccguccgaucagacccccagccuguguccuggccuugcuuccgggcccccuggagcccccggcccggucaagagcggguuugagggcuacguggagcugccucccauugaaggacgcucuccucggagccccagaaauaacccuguucccccggaggccaaauccccugugcucaaucccggcgaacgccccgcugacgucucuccuacaagcccgcagcccgaggggcugcuggugcuucaacagguuggagauuacugcuuccucccuggccuggggcccggaccucugucccucagaucuaagcccagcuccccuggcccggggcccgaaaucaaaaaccuggaccaggcguuucaggugaagaagccucccggccaagccgucccucaggugcccgugauccagcuuuucaaagcucugaagcagcaagacuaucucucucugccgccuugggaggucaacaaacccggagagguuuguuga

SEQ ID NO: 67919 - RNA, 624 nt, Artificial Sequence
  derived and/or modified sequence opt5 from CSF3__Homo_sapiens__NP_000750
auggccggccccgcuacccagagcccuaugaagcugauggcccuccaacugcuucuguggcacuccgcgcucuggacagugcaggaggcuacgccgcuggggcccgccucuagccuuccucaguccuuccugcucaaaugccuggaacaggucagaaagauccaaggagacggcgccgcucugcaggagaaacucguuucugaaugugccaccuacaagcugugccaucccgaggaacuugugcugcucgggcacagccugggcauuccuugggcuccccuuuccucuuguccuagccaggcccugcagcucgcgggaugccugucccaacugcauagcgggcucuuucuguaucagggacuucugcaggcccucgagggcaucucuccggagcugggccccacacuugauacccugcagcucgacguggcugauuucgccacaaccauuuggcaacagauggaggaacuggggauggcuccugcccugcagcccacacaaggagcgaugccugccuuugcuuccgccuuccagcggcgcgcuggcgggguccucguggccagccaucugcagucuuuucuugaaguuuccuacagagugcugcggcaccucgcccagcccuga

SEQ ID NO: 67920 - RNA, 1599 nt, Artificial Sequence
  derived and/or modified sequence opt5 from CSGALNACT1__Homo_sapiens__NP_001123990
augaugauggugagacggggccugcucgccuggaucagccgcgucguugugcugcuugugcugcucugcugugcuauuuccguccuguacaugcuugccugcacccccaagggggacgaggaacagcuggcgcucccuagagcuaacucuccgacaggaaaagagggcuaucaagccgugcugcaggaaugggaggaacagcaccggaauuacguuagcucccugaagcgccagaucgcccaacucaaagaggagcugcaggaaagaucugagcagcuucggaacgggcaguaucaagcuagcgaugccgcuggacugggccucgaccgcucucccccugaaaagacgcaggccgaucugcuugcguuccugcauucccagguggacaaagccgaggucaaugcuggggugaagcucgccaccgaguacgcugccguucccuuugauagcuucacacugcagaagguguaucaacuggaaaccggacucacaagacacccugaggaaaaacccguccggaaggacaaacgcgaugagcugguggaagcgauugaguccgcccuugagacccugaacagcccugcugaaaauucuccgaaccauagacccuacacagccuccgacuuuaucgagggcauuuaucggaccgaacgcgauaagggcacgcucuacgagcugaccuucaaaggggaccacaagcaugaauuuaagagacuuauccuguuccggccuuuuggacccaucaugaaagugaagaaugagaaacucaacauggcuaauacacugauuaacgucaucguuccucuggccaagcgcguggauaaauucagacaguuuaugcagaauuuccgggagauguguauugaacaagacggcagagugcaccucaccgucguguacuuugggaaggaggaaaucaacgagguuaaaggcauucuggaaaauacaagcaaggccgcuaacuuccgcaauuuuaccuucauccagcuuaacggagaguucucucgggggaagggacuggaugugggcgcgagauuuuggaaaggcuccaacguccuccuguucuuuugcgacguggacauuuauuucacgagcgaguuucuuaauacaugucgccugaacacccagcccgggaagaaaguuuucuacccggugcucuuuucucaguauaauccuggaaucaucuacggccaccaugaugccgugcccccucuggaacaacagcuggucauuaagaaagagacaggguucuggcgggacuuuggauucggcaugaccugccaguauagauccgauuuuaucaacauugggggauucgaccucgauaucaagggcuggggcggggaagacguccaccuguaccgcaaguaucuucauagcaaucugauugugguucggacccccgugagaggacucuuucaccuguggcacgagaaacgcuguauggaugagcugacacccgaacaguacaagaugugcaugcaauccaaagcuaugaacgaggccucucauggccagcuugggaugcucgucuuccggcacgaaaucgaggcccaucugagaaagcagaaacagaagacgagcuccaagaaaaccuga

SEQ ID NO: 67921 - RNA, 1629 nt, Artificial Sequence
  derived and/or modified sequence opt5 from CSGALNACT2__Homo_sapiens__NP_061060
augcccagacggggccugauccuccacacccgcacacauuggcugcuucuggggcucgcccugcuuugcagccuggugcuguucauguaccugcuggagugugcuccucagacggacggaaacgccucccucccgggcgucguuggggaaaauuauggaaaggaguacuaucaagcgcugcuucaggaacaggaggaacacuaccagaccagagcuacaucucugaaacggcaaauugcccagcucaagcaggagcugcaggagaugagcgaaaagaugcgcucccuucaagagagacggaacgugggcgccaaugggaucggauaucagucuaacaaggaacaggcucccagcgaucugcucgaguuucugcauucccagauugacaaagccgaggugucuaucggcgcuaagcugccuagcgaauacggcgucauucccuucgaguccuuuacccucaugaagguguuccaacuggaaauggggcuuacacgccacccugaggaaaaacccguuagaaaggauaaacgggacgagcugguggaggucaucgaagccggacucgaggugaucaauaacccugaugaagacgaugagcaggaagacgaggagggcccgcugggggaaaaacuuauuuuuaaugagaacgauuucguugaaggauauuaccgcaccgagagagacaaaggcacacaguacgaacuguuuuucaagaaggcggaucucaccgaguaucggcaugugacgcuguuucgccccuucgggccucugaugaaagucaagagcgagaugaucgacauuaccagaucuaucauuaauaucauugugccccucgccgaacggacagaggcuuuugugcaauucaugcagaacuuucgcgaugucugcauccaccaggacaaaaagauccaccugaccguuguguacuucggaaaagaaggccuuuccaaggugaaaagcauucuggagucugucacauccgagagcaauuuccauaacuauacccucgugucucugaaugaagaguuuaacagaggccgggggcuuaauguuggagccagagcuugggacaagggcgaagugcugauguucuuuugugaugucgacaucuacuucuccgccgaguuucucaacagcugccgccugaacgcggaaccugggaagaaaguguucuaucccguuguguuuucccuguacaauccggccauugucuaugcuaaccaggaggugccucccccugucgagcaacagcucgugcacaagaaagauucuggauucuggcgggacuuuggcuucgggaugacgugucaguacagaagcgauuuucugacaaucggaggcuucgacauggaaguuaagggcuggggaggggaggaugugcaucuuuaccgcaaauaucugcacggcgaccucauugucauccggacccccgugcccgggcuguuucaccuguggcaugaaaagagaugcgccgaugagcuuacaccugaacaguaccgcauguguauccaauccaaggcuaugaaugaggccagccacucucaucucggaaugcugguuuuccgggaggaaauugagacccaccuccauaaacaggccuauagaaccaacuccgaagcugugggcuga

SEQ ID NO: 67922 - RNA, 654 nt, Artificial Sequence
  derived and/or modified sequence opt5 from CSH1__Homo_sapiens__NP_001308
auggcccccggcagcagaaccucccugcuccuggcuuucgcccuucugugccucccuuggcugcaggaggcgggggcugugcaaacagucccgcuuucucggcuguuugaccacgccaugcuccaggcccaucgcgcucaccagcuggccaucgauacguaccaggaguucgaagaaaccuauauucccaaggaccaaaaauacagcuuucugcaugauucccagacaucuuucuguuuuagcgacuccaucccuacccccucuaacauggaggaaacacagcaaaagagcaaucucgagcugcuuagaauuucccugcuccugaucgagagcuggcuugaaccuguucgguuccugcgcucuauguuugcuaacaaucucguguaugauaccuccgacagcgaugacuaccaucugcugaaagaucucgaggaaggcauucagacacugaugggaagacuugaggacgggucucggcgcaccggacagauccugaagcagacguauuccaaauucgauaccaacagccacaaucacgacgcccuccugaagaacuacggccuucuguauugcuuuagaaaggauauggacaaaguggagacauuccuccggaugguccagugucgcucuguggaaggguccugcggauuuuga

SEQ ID NO: 67923 - RNA, 654 nt, Artificial Sequence
  derived and/or modified sequence opt5 from CSH2__Homo_sapiens__NP_066271
auggccgcuggcagcagaaccucccugcuccuggccuucgcgcuucugugccuccccuggcugcaggaggcuggggccgugcaaacagucccucuuucucggcuguuugaccacgccaugcuccaggcucaucgcgcccaccagcuggcuaucgauacguaccaggaguucgaagaaaccuauauuccgaaggaccaaaaauacagcuuucugcaugauucccagacaucuuucuguuuuagcgacuccauccccaccccuucuaacauggaggaaacacagcaaaagagcaaucucgagcugcuuagaauuucccugcuccugaucgagagcuggcuugaacccguucgguuccugcgcucuauguuugccaacaaucucguguaugauaccuccgacagcgaugacuaccaucugcugaaagaucucgaggaaggcauucagacacugaugggaagacuugaggacgggucucggcgcaccggacagauccugaagcagacguauuccaaauucgauaccaacagccacaaucacgacgcgcuccugaagaacuacggccuucuguauugcuuuagaaaggauauggacaaaguggagacauuccuccggaugguccagugucgcucuguggaaggguccugcggauuuuga

SEQ ID NO: 67924 - RNA, 387 nt, Artificial Sequence
  derived and/or modified sequence opt5 from CSHL1__Homo_sapiens__NP_001309
auggaggaaacccagcaaaagagcaaccuggagcuccugcacaucucccuucugcucauugaaucuagacuggagcccgugcgguuccuucgcagcacauuuacgaauaaccuggucuacgacaccuccgauucugacgauuaucaucuccugaaagaccuggaagagggcauccagaugcucauggggagacuggaggauggaagccaccuuacaggccagacccugaagcagacauacuccaaauucgacaccaauucucauaaccacgaugcccuccugaagaauuaugggcuucugcauugcuuucggaaagacauggauaagguugaaacauuccuccgcauggugcaauguagaagcguggagggauccugcggcuuuuga

SEQ ID NO: 67925 - RNA, 1401 nt, Artificial Sequence
  derived and/or modified sequence opt5 from CS__Homo_sapiens__NP_004068
auggcccugcucaccgcugccgcgagacugcuuggcacaaagaacgcuagcugccuggugcucgccgcccggcacgcuuccgccucuagcacgaaucugaaagacauccuugcugaucugauucccaaggagcaggcccgcaucaaaaccuucagacaacagcaugggaagacagucguuggacagauuaccguggacaugauguacggcgggaugcggggaaugaaaggccucguguaugaaacauccguccuggauccugacgaggggauccgcuuuagaggauucucuauuccggaaugucagaagcugcuccccaaggcgaaaggcggcgaggaaccucugcccgaggggcuguuuuggcuucucgugaccggacacaucccuacagaggaacaaguuagcuggcuguccaaggagugggccaaacgggcugcccuucccucucauguggucaccaugcuggauaacuucccuacgaaucuccacccgaugagccagcuguccgcugccgugaccgcgcugaacagcgaaucuaauuuugcccgcgcuuacgcccagggcaucuccagaacaaaguauugggagcucauuuacgaggacagcauggaucugaucgcuaaacuucccugcguugccgccaagauuuaucggaaccuguaccgcgaagggucuggaaucggcgcuauugacuccaaucucgauuggagccauaacuucaccaauaugcugggguauacagaccaccaguuuaccgagcuuacgagacuguaccucacaauccacucugaucaugaaggaggcaacguguccgcgcacaccagccaucuggucggcuccgcccugucugacccuuaccucagcuucgcugccgccaugaaugggcuggcuggaccccuucacggccuggccaaccaagaggugcucguguggcugacacagcuucagaaggaagucgggaaagauguuuccgacgagaagcugcgggacuauauuuggaauacccucaacagcggacgcguggugccuggcuacgggcacgcgguccugagaaaaaccgauccccgguauacaugucagcgcgaguuugcucugaagcaucucccgaaugacccuauguucaaacugguggcccaacuuuacaagaucguucccaacgugcugcucgaacagggaaaagccaagaacccuuggcccaaugucgaugcucacucuggcgugcugcugcaguauuacggcaugacggagaugaacuauuacaccguucuuuuugggguguccagagcccucggaguccuggcucaacugaucuggagccgggcccucggcuucccccuggaaagaccuaagucuaugagcacagaggggcuuaugaaauuuguggacuccaagucuggauga

SEQ ID NO: 67926 - RNA, 1353 nt, Artificial Sequence
  derived and/or modified sequence opt5 from CSK__Homo_sapiens__XP_005254222
augagcgccauccaggcugccuggcccuccggcaccgagugcauugcgaaguacaacuuccacgggacagcugaacaagaccugccuuuuuguaaaggagaugugcucacgaucgucgccguuaccaaggacccgaauugguauaaagccaagaacaaagugggcagagaggggauuauccccgcuaauuacgugcagaagcgggaaggagucaaggccggcacaaaacugucucuuaugccuugguuccaugggaagauuacccgcgagcaggcugaaagacugcucuaucccccugagacaggacuguuucuugugcgggagagcaccaacuaccccggcgauuauacacugugcguuuccugugacggcaaaguggaacacuaccgcaucauguaucaugccucuaagcucagcaucgaugaggaagucuacuucgagaaucugaugcagcugguggagcacuacaccuccgacgcggaugggcucugcacgagacugauuaaaccuaagguuauggaaggaaccguggccgcucaagacgaguuuuaucggucuggcugggcccuuaacaugaaggaacugaaacuccugcagacaaucgggaagggagaguucggcgaugucaugcuuggggacuaccgcggaaauaaaguggcugugaaguguauuaaaaacgaugccaccgcgcaggccuuucuggcugaagccagcgucaugacacagcucagacauuccaaucugguucaacugcucggcgugaucguggaggagaagggcgggcuguauauugucaccgaauacauggcuaaaggaagccuuguggacuaucugcggucucgcggcagauccguucucgggggagauugccugcuuaaguucagccuggacgugugugaggccauggaauaccucgagggcaacaauuuuguccaccgggaccuggccgcucgcaacgugcugguuucugaagauaauguggcgaaggucuccgacuucgggcucacgaaagaggccagcucuacacaggauaccggaaagcugccggugaaauggacagcucccgaggcccuuagagaaaagaaauuuuccaccaagagcgacgucugguccuucggcauccugcucugggagauuuauucuuuuggccgggugccuuacccccgcaucccucugaaggauguugugcccagagucgaaaaaggguacaagauggacgccccggauggaugcccucccgcuguguaugagguuaugaaaaacuguuggcaccuugacgccgcgaugcggccuagcuuccugcagcucagagaacagcuggagcauaucaagacccacgagcugcaucucuga

SEQ ID NO: 67927 - RNA, 10695 nt, Artificial Sequence
  derived and/or modified sequence opt5 from CSMD1__Homo_sapiens__NP_150094
augaccgccuggagacgguuccagagccugcuccugcuucugggccuccuggugcuuugcgcucgccugcucacagccgcgaaggggcaaaacuguggaggccugguccaggggcccaauggaacgaucgaguccccuggcuuuccgcacggguaccccaacuaugcuaauugcaccuggauuaucauuacaggagaaagaaaccggauccagcugucuuuccauaccuuugcccucgaggaagacuucgauauucugagcguuuacgacggccagccucaacagggcaaucuuaaagugcgccuguccggguuucagcuccccucuagcaucguguccacaggaucuauccugacccuuugguucacaaccgauuuugccgucagcgcucagggcuucaaggcccuguaugaggugcucccuucccacacgugugggaaccccggagaaauucugaaaggcguucugcaugggaccagauuuaauaucggagacaagauucgguacagcugccucccuggcuauauccuggagggccacgcuauucuuacauguaucgugucuccggggaacggagccuccugggauuuccccgcgccuuuuugccgcgccgagggcgcuugugggggaacccugagaggcacaagcucuuccauuagcucuccccauuucccuuccgaauacgagaauaacgccgacugcaccuggacgauccucgcugaacccggggauacaaucgcccuggucuuuaccgacuuccaacuugaggagggauaugauuuccuggaaauuagcggcacagaggcgccguccaucuggcucaccggcaugaaucugccuucucccgugauuagcuccaaaaacuggcugcggcuccacuuuaccagcgacucuaaucaccgcagaaagggguucaacgcccaguuucagguuaagaaagcuaucgaacugaagucccggggagugaaaaugcuuccuagcaaggauggcucucauaaaaauagcguccugucccaggggggaguggcccucgugucugacaugugucccgaucccggcauuccugagaacgggcgcagagcuggcagcgacuuccgggucggagccaacguucaauuuuccugcgaagacaauuacgugcugcagggcagcaagucuaucacaugucagcgcgugacggagacccuugccgcuugguccgaucacagaccgaucugccgggcgagaacaugcgggagcaaccugcgcggacccucuggcgucauuaccuccccuaauuaccccgugcaauaugaggacaacgcccauuguguuugggugaucacaaccacggauccugacaaggucauuaaacucgcuuucgaagaguuugaacuggagcggggguacgauacacugaccgugggagacgccggcaagguuggggauaccagaagcgugcucuauguccugacaggcuccucugugcccgaccuuaucgucagcauguccaaucagauguggcugcaccuccagucugaugacagcauuggauccccgggcuucaaagccguguaccaggaaaucgagaaggggggaugcggcgauccugggauccccgcuuauggaaaacgcaccggcagcucuuuucugcacggggacacacugacguucgaguguccugccgcguuugaacuuguuggcgagcgggugauuaccugccaacagaacaaucagugguccggaaacaagcccagcugugucuucucuugcuuuuucaauuucacagcuuccagcggcaucauucucucuccuaacuaccccgaagaguaugggaauaacaugaauuguguguggcugaucauuagcgaaccgggauccagaauccaucugauuuuuaacgacuucgauguugagccucaguuugacuuccucgccgugaaagaugacggcaucagcgauaucaccguccuggggacauuuucuggaaaugaggugcccucccaacuugccagcuccggccacauugugcgccuggaauuccagucugaccauagcaccacggggcggggcuuuaacaucaccuacacaaccuucggacagaacgagugccacgaucccggcauuccuaucaaugggagacgcuuuggagaccgguuccuccugggcuccucuguuagcuuucauugugaugacggguucgucaagacacagggauccgaaucuauuaccugcauccugcaagauggcaacgugguguggagcuccacggucccgagaugugaggcucccugcggcgggcaccuuacagccagcucuggagugauccucccucccggcuggccuggguacuauaaggacucccugcacugcgaguggauuaucgaagcuaaacccggacauagcauuaagaucaccuuugaucgcuuccagacagagguuaauuacgacacccuggaagugcgggacggcccugccucuuccagcccccucauuggggaguaucacggaacccaggcgccgcaguuccugaucucuacaggcaacuuuauguaccuucuguucacgaccgauaauuccagaagcuccaucggcuuucucauucauuaugaaagcgucacacuggagucugacagcugucuggauccugggauccccgugaacggacaccggcacggcggggacuucggaauucgcuccaccguuacauuuucuugcgauccuggcuacacccuuagcgacgaugagccccucgugugugaaagaaaucaucaauggaaccacgcccugccguccugcgacgcucugugugggggauauauccagggcaaaucuggcacgguccucagcccuggguuccccgauuuuuacccuaauucccugaacugcacauggaccauugaggugucucauggaaagggcguucagaugaucuuccacaccuuucaucuugaaagcucccacgacuaccugcucaucacagaggaugggagcuucucugaacccguggcccggcugaccggauccguccugccccacacaauuaaagcuggccuuuuugggaauuucacggcccaacucagauucaucagcgacuuuucuauuuccuaugagggauucaacaucaccuuuagcgaguacgaucuggaaccuugugacgacccgggcgugcccgcguucucccgccggauuggcuuucauuucggggugggagauucucugacauuuagcugcuuccucggcuauagacuggagggggccaccaagcuuacaugucugggaggcgggcgcagagucugguccgcuccucucccccggugcguugccgaauguggagcuagcgugaagggcaaugagggcacccugcugucuccuaacuuucccuccaauuacgacaacaaccacgaaugcaucuauaaaauugagacggaggccgggaagggaauccaucuucgcaccagaagcuuccagcuguuugaaggcgauacacucaaaguguacgacgggaaggauucuagcucccggccucugggaaccuucacaaaaaaugagcuccugggccuuauccugaacucuaccagcaaucaccucuggcuggaauuuaacacaaauggguccgacaccgaucagggauuccagcugacguauacaucuuucgaccuugucaagugcgaggauccgggcauucccaacuacggcuaccgcaucagagacgaggggcauuuuaccgauaccgugguucuguauagcuguaauccuggauacgccaugcacggcuccaacacacucaccugccugagcggggaccggcgcgugugggacaagccccucccuucuuguauugcugaaugcggaggccaaauccacgcggccacguccgggagaauucugagccccggauauccggcuccuuacgauaauaaccuucauuguacauggaucaucgaggccgaccccggcaaaaccauuucccugcacuucaucgucuuugauacagaaauggcccaugacauucucaaggugugggauggccccguugacucugauauccugcugaaagaguggagcggguccgcucuuccugaagacauucacucuaccuucaauagccugacacuccaguuugauuccgacuucuuuaucagcaagucuggauucuccauccaguuuagcaccucuauugccgcgacgugcaacgaucccggcaugccucagaaugggacccgguauggagacucccgcgaggcuggcgauacagugaccuuccaaugugacccgggguaccagcugcagggccaggccaaaaucacaugcguccaacucaacaauagauuuuucuggcagcccgacccucccaccuguauugccgcuugcggaggcaaccugacggggccugccggagugauccuuagccccaacuauccgcagccuuaccccccuggcaaggagugugauuggcggguuaaggugaaucccgacuuugucauugcgcugaucuucaaaucuuucaacauggaaccuagcuacgauuuucugcacauuuaugagggggaagacuccaauucuccccucaucggaagcuaccaaggcucccaggcuccggagagaaucgaaagcuccgggaacucucuguuccuugccuuucgcagcgaugccuccgugggccugucuggauucgcuauugaguuuaaggagaaaccucgggaagccugcuucgaccccggcaauaucaugaacgggacaagagugggaaccgauuuuaagcucggcagcacaauuaccuaucagugcgacuccggguacaaaauccuggaucccucuagcauuaccugugucaucggagcugacggcaagccuuccugggaucagguucucccgagcugcaaugcccccugugggggccaauauacaggaucugagggcguggugcuguccccuaacuacccccauaauuauacggcggggcagaucugccuuuacagcauuaccgucccuaaagaauucgugguuuuuggacaguucgccuacuuucagacagcucugaacgaccuggccgagcucuucgauggcacccacgcucaagcccgccugcuuucuucccugagcgggucucauuccggagaaacacucccccuggccaccagcaaucagauccuccugcgguuuuccgcuaagagcggcgcgucugccagaggcuuccacuucguguaucaggcugucccucgcacgagcgacacacaguguuccucugugccggagccccgguacgggagacgcauuggaagcgaguuuuccgccggcucuaucguucgguucgaaugcaacccuggguaucuucugcaaggaagcaccgcccugcauugucaguccgugcccaaugcucucgcccaguggaacgacaccauuccuucuugcgucgugcccuguagcggcaauuuuacacagagacgggggaccauccuguccccgggauacccugagcccuauggcaacaaucuuaacugcaucuggaagauuaucgucacagaaggcagcgggauucaaauccaggugauuucuuucgcgacggagcagaacugggauucccuggagauccacgacggaggcgauguuaccgcuccccgccucgggagcuuuucuggaacaaccgugccugcccugcucaauuccacaagcaaccaacuguaccuucacuuccaguccgacauuucugucgccgcugccggcuuucaucuggaauauaaaaccguggggcuggcggcuugucaggagcccgcccucccuagcaauuccaucaagaucggagauagauacaugguuaacgacgugcugagcuuccagugcgaaccgggcuacacgcuucaaggccggucucacauuuccugcaugcccgggaccguccgcagauggaauuauccuagcccccuguguaucgccacaugcggaggcacccucucuacacuggggggagugauucugagcccuggcuuucccggguccuacccgaacaaucucgauuguaccuggcggaucucucuuccuauuggauauggcgcucauauccaguuccugaacuuuagcacagaggccaaucacgacuuccuggaaauccagaacggccccuaccacacguccccuaugauugggcaguuuucuggaaccgaucuccccgcugcccugcuuagcacaacccaugagacccugauccacuucuauuccgaccauagccaaaauagacagggcuucaaacucgcguaccaggccuaugagcugcagaacugcccugaucccccgccuuuucaaaauggguacaugauuaacucugacuacuccgugggacagagcguuuccuucgaauguuaucccggcuacauccugauugggcaccccguccucacaugccagcauggaaucaaucgcaacuggaacuauccuuuuccgcggugugacgcucccugcggcuacaaugugacgucucaaaacggcaccaucuauagcccuggguuccccgaugaguacccuauucuuaaggacuguaucuggcugauuacagugcccccuggacacggcgucuauaucaauuuuacccugcuccagacagaagccgugaacgauuacauugcuguuugggacgggcccgaucagaauuccccgcagcugggaguguucucuggcaacaccgcccuugagacggccuacagcuccacaaaucaaguccugcucaaauuucacagcgacuucucuaacgggggauuuuucgugcugaauuuucaugcuuuccagcugaagaagugccagccucccccugcgguuccccaggccgaaaugcucaccgaggaugacgauuuugagaucggcgacuucgugaaauaucaaugucacccgggcuacacccuugucgggacagauauucugaccugcaagcuguccagccagcuccaguucgaaggaucucugccuacaugcgaggcucagugucccgccaacgaagugagaaccggcuccagcgggguuauccuuucucccggauauccuggcaauuacuuuaacucccaaacgugcagcuggucuaucaaaguggagcccaauuauaacauuacaaucuucgucgacaccuuucagagcgaaaagcaguucgaugcccuggagguguuugacggguccagcggacaguccccucuccuggugguccugucuggcaaucauacagagcaaagcaacuucaccucccgcucuaaccagcucuaccuucgguggagcacggaccacgcuaccuccaaaaagggcuuuaagauuagauaugccgcgccguacuguucucugacacacccccugaaaaaugggggaauccucaaccgcaccgcuggcgccguugggagcaaggugcauuacuucugcaaaccuggauaucggauggugggccacuccaaugccacauguagacgcaacccccuggggauguaccagugggauagccuuaccccucugugccaagcugucucuuguggcauucccgaauccccuggaaauggcagcuuuacagggaacgaguucacccucgacucuaaggugguuuaugaaugccaugagggauuuaaacuggaguccagccagcaggccacggcggugugucaggaagauggccuguggucuaauaaggggaagccgcccacaugcaaaccugucgccugucccuccaucgaggcucaacucagcgaacacgugaucuggagacuuguuucuggaucccugaacgaguacggcgcccaggugcugcucagcugcagcccuggguauuaccuggaaggcuggcggcuucugcgcugucaggcuaauggaaccuggaacauuggcgacgagagacccuccugccgggucaucucuugcgggagccucuccuucccgccuaauggaaacaagauuggcacccugacaguguauggggccaccgcuaucuuuacauguaauacgggauacacccuggucggcucucaugugcgcgagugccucgccaacgggcuuuggagcggcuccgaaacaagaugucuggcgggacacugcggcucucccgaucccauuguuaaugggcacaucagcggagacggcuucuccuaccgggauaccgugguguaucaguguaacccuggguucagacuggucggaacaagcguucgcaucugccuccaagaccauaaauggucuggccagacccccgugugugugccuauuacgugcgggcacccgggcaaccccgcccauggauuuaccaauggcuccgaguucaaccugaaugaugucgugaacuuuacauguaauaccggguaccuucugcagggaguuagccgggcucagugcagaucuaacggccaaugguccagcccucuccccacaugucgcguggucaauugcuccgacccuggguucguggaaaacgccauccggcacggacagcagaauuuucccgagucuuucgaauauggcaugagcauucuguaccauugcaagaaaggcuuuuaucugcucggguccucugcucuuaccuguauggccaacggacugugggauagaagccugccgaagugccucgccaucuccuguggccacccugggguccccgcuaaugcggugcugacgggagagcuuuucacauacggcgccguugugcacuauagcugccgggggucugagucccugauuggaaacgacacccgcgucugucaagaagacagccauuggucuggcgcucucccucacugcacaggcaauaaccccggguuuuguggagauccgggcaccccugcccaugggagcagacugggagacgauuucaaaaccaagucccugcuccgguuuucuugcgagaugggccaccagcuucgcgggagccccgaaagaacaugucugcugaauggauccuggagcggccuccagcccgugugcgaggccguuucuuguggcaacccugggacgcccaccaacggaaugaucguguccagcgacggcauucuguucuccucuagcgucaucuacgcuugcugggaaggguacaagacauccggacuuaugacccggcacugcacagccaauggcaccuggacggggacagcgccugauuguaccaucauuucuugcggagacccgggcacccuggccaacggcauccaguucgggacagauuuuaccuucaauaaaacagugagcuaucaauguaaccccggauacgugauggaggcuguuacguccgccaccauucgcugcacaaaggacggcagauggaauccuucuaaacccgucuguaaggcugugcucugcccucagcccccuccggugcagaacgggaccgucgagggaagcgauuuucgguggggcuccagcaucucuuauuccuguauggacggguaccagcugagccauucugccauucuguccugcgaaggacgcggcguuuggaaaggcgagaucccccaaugucucccuguguucugcggggaucccggaaucccugcggaaggcagacuuagcgggaagucuuuuacauauaagagcgagguguucuuucaguguaaaucccccuucauucuggucggaagcucccggagagugugccaggccgacggcaccuggucugggauccagccgacgugcauugauccugcucacaauaccugucccgaccccggaacaccucauuuuggcauccaaaacagcucccgcggcuacgagguugggucuaccguguucuuucggugcagaaagggauaucacauucagggcagcacaacccgcacaugucuggccaaucucaccugguccgggauccagacggaaugcaucccccaugcuugucggcaaccugagacaccggcccacgcugacgucagagccauugaucugcccaccuucggauacacccuuguguacacaugccacccuggcuuuuuccuggcggggggaucugaacaucgcacguguaaagccgacaugaaguggaccggcaaaagccccguuugcaaguccaagggcgugcgggaggucaacgaaacagugaccaaaacaccugugcccagcgaugucuucuuuguuaauucucucuggaagggguauuacgaguaucugggaaaaagacagccggcuacccugacaguggacugguucaacgccaccuccagcaaggugaaugcuacguuuucugaggccuccccugucgaacucaaacugaccggcaucuacaagaaggaggaagcccaccuucugcucaaagcguuccagauuaaggggcaggcugauaucuuugugagcaaauucgagaacgacaauuggggacuggauggcuauguuucuuccgggcuugaacgcggcggauuuacauuccaaggcgacauucaugggaaggauuuuggaaaauucaagcuggagcggcaggacccccucaacccugaucaggacagcucuucccacuaccacggcaccagcuccgggagcguggccgcugccauccugguccccuuuuucgcccugauccucucuggauuugcuuucuaucuguacaagcauagaacacgcccuaaagugcaguacaacggcuaugccgggcacgagaauagcaacggccaagcguccuucgaaaaucccauguacgauaccaaccuuaagccgacggaggccaaagcuguucgguuugacacaacccugaauacaguguguaccgucguguga

SEQ ID NO: 67928 - RNA, 10824 nt, Artificial Sequence
  derived and/or modified sequence opt5 from CSMD2__Homo_sapiens__XP_011538874
augccccgcagccggggacgcgagcuggggagaugcgggugcccugcuggacgggcucgcggggaaaccggaaucuccgcccucgugcccggagcggggucuagauggggacggcccccucccccuacacccccuccgcugcuucugcuccugggcugcggccuucugagcguuuccgcugccgccgggcagaauuguacguuccaacuccacggacccaauggcaccguugagucuccuggguuucccuacggauauccuaacuacgcuaauugcacauggaccauuacagccgaggaacagcaccgcauccagcugguguuccagagcuuugcucuggaagaggacuucgaugugcucuccgucuuugacggaccuccccaacccgagaaccugagaacccggcuuacaggguuccagcugcccgccaccauugugucugcggccacgacccucagccugcgccuuaucuccgauuaugcuguuagcgcccagggauuucacgcuacauacgaagugcugccuucucacaccuguggcaaucccggcagacuccccaacgggauucagcaaggauccacauucaaucugggcgacaagguccgguauagcugcaaccugggguuuuuccucgagggacacgccgugcugaccugucaugcgggcucugaaaauuccgccacgugggauuuuccucuuccgagcugccgcgcugacgaugccugugggggaacacugagaggccagucuggcaucaucuccagcccccacuucccuuccgaguaccacaacaaugcugacugcaccuggacaauucucgccgagcugggggauaccaucgcccuuguuuuuauugacuuccagcuggaagauggauaugacuuccucgaggugaccggcacagaagggucuagccugugguuuacgggagcuucccugcccgcgccugucaucagcucuaaaaacuggcuccggcugcauuucaccuccgauggcaaucaccgccagagaggguuuagcgcccaauaccaggugaagaaacagauugagcuuaagucucggggcgugaaacugaugcccagcaaggacaacucccaaaagacaucuguccucacccagguuggagugagccagggccauaauauguguccggacccugggauccccgaaagaggaaaacgccugggcuccgauuuccggcuugggagcucugugcaguuuacaugcaacgagggauacgaccugcaaggcuccaagagaauuaccugcaugaaagucagcgauauguucgcugccuggucugaccaccgcccugugugucgggccagaaugugcgaugcucaccuccgcgggcccuccggcaucaucacgagcccuaacuuucccauucaguaugacaauaacgcccauuguguuuggaucauuacagcgcugaauccguccaaggugaucaaacuggcuuucgaggaauuugaucucgagcggggauacgacacccugaccgucggcgaugggggacaggacggcgaucagaagacagugcuuuauauucugaccgggacaucuguuccugaccucaucgugagcacgaaccaccaaauguggcugcuguuccagaccgacggauccggcucuagccuuggguuuaaggccuccuacgaagagaucgaacagggcagcugcggagaucccggcauucccgccuaugggagacgcgagggaucucgguuccaucacggcgacacacucaaauuugagugucagccugcuuucgaacuggucgggcaaaaggccauuaccugccagaaaaauaaccagugguccgcuaagaaaccgggauguguguucagcugcuuuuucaauuuuacaucucccuccggcgucgugcugagcccuaacuaccccgaggauuaugggaaucaucuccacuguguuuggcugauucuugccagaccugaaucucgcauccaccuggcguucaacgacauugauguggagccccaguuugacuuccucgucaucaaggauggcgccaccgcugaagccccugugcugggaacguuuagcggcaaucaacugcccuccagcaucaccucuuccgggcauguugcucggcuugaguuccagacagaccacagcaccggaaaaagaggcuuuaacauuacauucaccacguuucggcauaaugagugcccggauccuggggugcccgucaacggaaagcgcuucggcgacucccuccagcugggcucuagcaucuccuuucugugugaugaaggguuccucggaacacaaggcucugagaccauuacaugcgugcugaaggaagggagcgugguuuggaacuccgccguccuuagaugcgaggcgccuuguggaggccaccugaccucucccagcgggaccauccucuccccgggauggccuggcuucuacaaagacgcccugagcugcgcuugggugauugaggcccagcccggcuacccuaucaagauuacauuugaucgguucaaaacggaagugaacuaugacacccuggaggucagagacgggcgcacauacucugcuccccuuaucggaguguaucacggcacccagguuccccaguuucucaucuccacaagcaacuaccuguaucuccuguucucuaccgauaagucccauagcgacauuggguuucaacugcgguacgaaacgaucacacuucagucugaucacugucuggacccuggcauccccgugaauggccagagacaugggaacgauuucuaugucggagcccucgugaccuuuuccugcgacagcggcuacacccuguccgauggcgagccccuggaaugugagccuaauuuccaguggagccgcgcccuucccucuugcgaggcucucugugggggauuuauccaaggcagcuccgggacaauucugucuccuggauuccccgacuuuuacccuaacaaucugaacugcaccuggaucaucgaaacaagccacggcaaagggguuuucuucacguuucauaccuuccaccucgaguccggacacgauuaucugcuuauuacagaaaauggcucuuuuacccagccgcugagacagcucacaggcagccggcugcccgcgccuaucuccgccgggcuguacggaaacuucaccgcucaggugcgcuuuauuucugacuucagcauguccuaugagggcuuuaauaucacguucagcgaauacgaucuugagcccugugaggaaccugagguccccgccuauucuauuagaaaggggcugcaauuuggagugggcgacacccucacauucuccugcuuuccgggguaccggcuggaaggaaccgcccgcaucacaugucucggcggcagacggcgccuguggagcucuccucuucccagaugcguugcugagugcgggaacuccgugaccggaacacagggcacccugcucagccccaauuucccugucaacuauaauaacaaucaugaauguaucuacuccauucagacgcaacccgggaagggaauccagcugaaagcccgggcguuugagcugucugagggcgaugugcuuaagguguacgacgggaacaacaauagcgcucgccugcucggagucuucucccacagcgaaaugaugggcguuacacugaacucuaccuccagcucucucuggcuggacuucauuaccgaugccgagaauacaagcaaaggcuuugaacuucauuucuccucuuuugagcugaucaagugcgaggacccugggaccccgaaauucggauauaaggugcacgaugaaggccauuuugccgggagcuccgugucuuucagcugugaccccggauacucccucagaggcagcgaggaacugcugugccuuucuggggagcggagaacgugggaucgcccucugcccacaugugucgcugaaugcggaggcaccgugcggggcgagguuuccggacaggugcucagcccuggauaucccgccccguacgagcacaaccugaauuguauuuggacaaucgaagcggaggcuggcugcaccaucgggcuccacuuucuggucuucgacacagaagaggugcaugauguucuuagaauuugggacggaccuguggaauccggcguccugcugaaggagcucucugggcccgcccugccuaaagaucuucacagcaccuuuaacuccgugguucugcaguucucuacggacuuuuucaccagcaagcaaggcuuugccauccaguucuccgugagcacagcuaccucuuguaaugaucccggcauuccucagaacggcucccgcagcggggacucuugggaggccggagacuccacagucuuccagugcgaucccggcuaugcucuccaagggagcgccgaaaucucuugugugaaaauugagaaucgguuuuucuggcagccgagcccuccgaccugcaucgcgcccugcggaggcgaccugacggggccuuccggcgugauucucucuccgaacuaccccgaaccuuaucccccuggaaaggagugugauuggaaagucacaguuagccccgacuacgugaucgcccugguguuuaauaucuucaaccuugaaccuggcuacgauuuucugcauauuuaugacgggagagauucccugagcccgcucaucggauccuucuacggcucucagcugcccgggcgcauugagagcuccucuaauagccuuuuucuggcuuuccgguccgacgccucugucagcaacgcuggauuugugaucgauuauaccgagaauccuagagaauccugcuucgaccccggcagcauuaagaacgggacacgcguuggcucugaucucaagcugggauccagcgugaccuacuauugucacggcggguacgaggucgaaggaaccucuacacucuccugcauccugggcccugacgggaaacccguguggaacaauccgcggccuguuuguacggcccccugcggaggccaguaugugggcagcgauggggucgugcuuucucccaacuacccucaaaauuacaccuccggacagaucugucuguauuuugucacagugcccaaggacuacguuguguucggccaguuugccuucuuccacaccgcucugaacgacgucguggagguucaugaugggcacagccagcauuccagacuccugagcucucuuagcggaucccacacaggcgagucucugccucucgcgaccagcaaucaagugcugauuaaauuuuccgccaaggggcucgcuccggcccggggauuccauuuugucuaucaggccgugccccgcacgucugcuacacagugcagcuccgugccugaacccagauacggcaaacggcugggcucugacuucagcguuggggccaucguccgcuuugaguguaacuccggauaugcgcuucaaggcagcccugaaauugagugccugcccgugccgggggcucuggcccaguggaaugugucugccccuaccugugucgugcccugcggaggcaaccucaccgaaagacgggggacaauccuguccccuggauuccccgagccuuaccuuaauagccugaacugcguuuggaagauugugguccccgagggcgcuggcauccagauccaggugguuucuuuugugaccgaacaaaauugggauucccucgaggucuucgacggggccgauaacacagugacgaugcugggcagcuuuuccggcaccacaguuccggcgcugcucaauucuaccagcaaccagcuuuaucugcacuucuacuccgacauuagcgugucugcugccggguuucaccuggaauacaaaacagucggacucuccagcuguccugagcccgccgugcccucuaauggcgugaagaccggggaaagauaucuggucaacgauguugugagcuuccagugcgagccuggauacgcccuucagggccaugcccacaucuccuguaugccgggcacggugcgccgguggaauuaucccccuccccugugcauugcucaaugugggggaaccgucgaggaaauggagggcgugauccucucuccuggguuucccggaaacuacccuagcaacauggacugcuccuggaagauugcccugcccguuggcuucggggcgcauauccaguuccugaauuuuucuacagaaccgaaccacgauuauauugagaucagaaauggaccuuacgaaaccagccgcaugaugggccgguucuccggcagcgagcuccccucuucccuucugagcacaucccacgagaccacaguguauuuucauucugaccacagccagaacagaccuggguucaaacuggaauaccaggccuacgagcuccaagaaugucccgauccggagccuuuugcuaauggaaucguccgcggcgccggguauaacgugggacaguccguuacguucgagugccugcccggcuaccagcuuaccgggcaucccgugcugacaugucaacacggaaccaaucggaacugggaccauccucuccccaagugcgaagucccuuguggcggcaauauuaccucuagcaacgggacaguguauuccccgggauuucccagcccuuacucuuccagccaggauugcgucuggcugaucacggugcccauuggccacgggguuagacugaaucucucucuucugcagaccgagccuuccggagacuucaucacaauuugggacggcccccagcaaaccgcuccucgccuggggguguuuacaagaagcauggccaaaaagaccgugcagucuuccagcaaccagguccuccugaaauuccaccgggaugccgcuacgggaggcaucuuugcgaucgccuucucugcuuauccgcuuacaaagugucccccucccaccauucugccuaaugccgaaguugugaccgagaacgaagaguuuaauaucggcgacauugugcgcuacagaugucuccccggguucacacuggucggaaacgagauccugaccugcaagcucggcacauaucuucaguucgaagggccgccucccauuugugaggugcauugccccaccaacgaacugcugacggauagcacaggaguuauccucucccaaagcuacccuggcuccuacccccaguuucagaccuguucuuggcuggugcgggucgagccugacuauaauaucagccuuacaguggaauacuuccuguccgagaaacaguaugaugaguuugaaauuuucgacgggccgucuggccaaagcccccuccugaaggcccuguccggaaacuacucugcuccucucaucgucaccagcuccagcaauucuguguaucuucgcugguccagcgaucacgccuacaacagaaaaggcuuuaagauucgguauucugcgcccuacugcucccugccuagagcuccccugcauggguucauccucggacagacgagcacccagccgggcgggucuauucacuuuggauguaaugccggcuaccgccugguugggcacuccauggccaucugcacacggcauccucagggcuaucaccuuuggagcgaggcuauuccccugugucaagcccucucuugcggacugccugaagcgcccaaaaacggcaugguguucgggaaggaguacaccgucggaacaaaggccauguauuccuguagcgaaggcuaccaucugcaggcuggggccgaggcuaccgccgagugccucgacacaggacuuuggagcaauagaaacgugccgccucaguguguucccgugaccugccccgaugucuccucuaucagcguggaacacggccgcuggcggcugaucuuugagacgcaauaucaguuccaggcucagcugaugcucauuugcgacccuggguacuauuacacaggccaaagagugauccggugucaggccaauggaaaauggucccugggcgauucuaccccgaccugccgcauuaucagcuguggggaacuuccuauuccgcccaacggacauagaaucggcacacuguccguuuacggggcgaccgccaucuuuucuugcaauagcggauauacacucgucggcucccgggugcgcgaguguauggcuaacgggcuguggagcggcucugaggugagaugccuggccggacacuguggcacgccugaacccauugucaaugggcacaucaacggagagaauuacuccuaucggggcagcguuguguaccagugcaacgcuggguuccgccucauuggaaugucugugagaaucugucagcaagaccaucacugguccggcaagaccccuuuuugcguccccauuacauguggccauccugggaacccggugaauggacuuacccagggcaaccaguucaaucugaacgacguugugaaauucgucugcaaucccggguauauggccgaaggagccgcucggagccagugccuggcguccggccaauggucugauaugcucccuacaugucgcaucaucaacugcaccgaccccgggcaccaggagaauagcgugagacagguucaugccuccggaccucaccgguuuucuuucggcacgaccgugagcuacagauguaaccacggcuuuuaucugcuugggacacccguccuguccugccaaggagauggcaccugggaccgcccgcggccucagugucuccuggugagcugcgggcaucccggaucucccccucacucccagaugagcggcgauucuuacacagugggggcugucguuagauacagcuguauuggaaagcgcacccuggugggcaauuccacgcggaugugcggccucgacgggcauuggacaggaucucuuccccacuguagcggcaccuccgugggggucugcggagauccuggcaucccggcccacgggauuagacugggagacagcuucgaucccggcacagugaugcgcuuuucuugugaagccggccauguucugcggggguccagcgagagaaccugccaggcuaacggauccuggucuggcagccaaccugagugcggggugaucuccuguggaaaucccggcaccccuucuaacgcccgcgucguguucagcgacgggcucgucuuuuccucuagcauuguguaugaaugccgggagggauacuaugcgacaggccugcuuuccagacacuguagcgucaauggcacguggaccgggucugaucccgaaugccuggugaucaacuguggagacccgggcauuccugccaaugggcuccgccugggaaacgauuuccgguacaacaaaacaguuaccuaucagugcgugcccggcuacaugauggagucccauagagucagcgugcugucuuguacaaaggaccgcaccuggaaugggacgaagccugucugcaaagcucucauguguaagcccccuccccuuaucccgaacggaaaagugguuggcuccgacuuuauguggggcagcucugugacauaugccugccuggaaggguaccagcugagccuccccgcugucuucaccugugagggaaauggcuccuggaccggggagcugccucagugcuuucccguguucugcggagauccuggcgugccgagcagagggcggcgcgaagacagaggauucuccuaccggucuagcguuuccuuuucuugucaucccccucuugugcuggucggcagccccagacgguucugccaauccgauggcacauggucugggacccagccuagcuguaucgaccccacacucacgaccugcgccgauccuggagugccccaguuuggcauucagaacaauucccaaggguaucagguuggaagcacagugcuguuccgcugucagaagggcuaccugcuccaagggucuaccacaagaaccugccugccgaaccuuacgugguccggcaccccucccgacugugucccucaucacugccggcagcccgagacaccgacccacgcgaaugugggagcccuggaucucccuagcaugggcuauacacugaucuacucuugucaggaaggguuuucccuuaaaggaggcagcgagcauagaaccugcaaggcugacgggucuuggacaggaaaaccgcccauuugucuggccgaagucagaccuuccggccggcccaucaacaccgcucgcgagccuccgcucacgcaggcccugauucccggggauguguucgcuaagaauagccuguggaagggcgccuaugaguaccaaggcaaaaagcagccugcgaugcucagaguuacaggcuuucagguggccaacucuaaagucaaugcuaccaugaucgaccacuccgggguggaacugcaucuugccggaaccuauaagaaagaggauuuccaucugcuccugcagguuuaccaaaucacaggccccguggaaauuuuuaugaacaaguucaaggacgaccacugggcucuugaugggcaugucagcuccgagagcucuggagccacguuuaucuaccagggcagcgugaaagggcagggcuucggacaguuuggcuuccaacggcuggaccuccgccugcuggaguccgauccugaaucuauugggagacacuucgccagcaauuccucuagcguggcggcugccauccucguucccuuuauugcucugaucaucgccggauucguccuuuaucuguacaagcaucggcgcagaccgaaagugccuuuuaacggcuaugccgggcacgagaauaccaacgugcgggcuacauucgaaaaccccauguacgaccgcaauauucagccuaccgauaucauggccuccgaggcggaauuuacagucagcaccgugugcacagccguuuga

SEQ ID NO: 67929 - RNA, 10617 nt, Artificial Sequence
  derived and/or modified sequence opt5 from CSMD3__Homo_sapiens__NP_443132
augaagggcaucagaaaaggggaaagccgggccaaggaauccaaacccugggagccuggaaagcgcagaugcgcuaaauguggccggcuggacuucauucucaugaagaagauggggaucaaaucuggauuuaccuucuggaaccuggucuuucuucugacaguuagcugcguuaagggcuucauuuacacgugugggggaacccucaaaggccugaauggcacaaucgaauccccgggguuucccuauggauacccuaacggcgccaauugcaccugggugauuaucgcggaggaacgcaacagaauccagauuguguuccaaucuuuugcucuugaggaggaauaugauuaccugagccucuaugacgggcacccccacccuacaaauuuccggacccgccugacaggauuucaucugcccccuccggucaccuccacgaagucuguguucagccucagacugaccuccgauuuugccguuagcgcccacggcuucaaaguguacuaugaggaacuucagucuuccagcugugggaaccccggagucccucccaagggcgugcuguacggcacacgguuugacguuggggauaagauccgcuacucuugcgugaccggauauauucucgacggccacccucagcugacauguaucgcuaauuccgucaacaccgccagcugggauuuccccgugccgauuugcagagcugaggacgccugugggggaacgaugcggggaucuuccgggaucauuagcuccccuucuuuccccaaugaguaccacaacaaugcggauugcacauggaccaucguggccgaaccuggagacacaaucagccuuauuuuuaccgauuuccagauggaggaaaaauaugacuaccuggagaucgaaggcuccgagccgcccaccauuuggcucagcggcaugaacaucccuccgcccauuaucucuaauaagaacuggcugcgccugcacuuugucacagauuccaaucacagauaucggggguucagcgcuccuuaccaaguuaaaaaggccaucgacuuuaaaucucgcggauucaagcucuuucccggcaaagacaacagcaacaaguucuccauucugaaugaagggggaaucaagacggcuucuaaccuuuguccugaucccggcgaaccggagaaugggaaaagaauuggcagcgacuuuucccugggaagcaccgugcaguucucuugcgaugaagacuaugugcuccagggcgccaaguccaucacaugccagcggauugcggaggucuuugccgcuuggagcgaucauagaccuguguguaaaguuaagaccugcgggucuaaccugcaaggacccuccggcacauucaccagcccuaauuuucccuuccaguacgacuccaacgcccagugugugugggucaucacggcugugaauacaaacaaaguuauccagauuaauuucgaagaguuugaucuugagaucggguacgacacccugaccauuggagauggcggggaagugggcgacccucgcacaguccuccaagugcugaccggaucuuucguccccgaucugaucgugagcauguccucucagauguggcuccaucugcagacagacgagagcguuggcuccgugggguuuaaggucaacuauaaggaaauugagaaagaaagcugcggagacccgggcacgccucuuuacgggauccgggagggagauggcuucucuaauagagacgugcugcgcuuugagugucaauucggguuugaacucauuggcgagaaguccaucguuugccaggaaaacaaucaguggagcgccaacauccccauuuguaucuuccccugccugucuaauuuuaccgccccuaugggaacagugcuuuccccggauuaucccgagggcuacgggaacaaccugaauuguauuuggaccaucauuagcgacccuggaucucggauccaucucagcuucaacgauuuugaccuggagucccaguucgauuuucuggcugucaaagacggcgauagccccgaaucuccuauccucgggacauucaccggagcggaggugcccucccaccugacgagcaauucccacauucuuagacuggaguuccaagccgaccauucuaugagcggccgcggguuuaacaucaccuauaauacauucggccacaacgagugcccugaucccggcauuccgaucaaugcucggagauuuggagacaacuuccagcucggguccucuauuagcgugaucugugaagagggauuuaucaagacccagggcacagagaccauuacgugcauccugauggaugggaaaguuaugugguccggacugauuccuaagugcggcgcccccuguggcgggcauuucucugccccuagcggagucauccuuucccccggcuggccgggguacuauaaggacagccucaauugcgaaugggugauugaggcugaaccuggacacucuaucaaaaucacauuugagcgcuuccagaccgaacugaacuacgacgugcuggagguccaugauggccccaaucuccuguccccucuucuggggagcuacaacggaacacaagugccccaguuucucuucucuuccagcaauuuuauuuaucugcuguucaccaccgacaacucucgguccaauaacggcuucaagauccacuacgagagcguuacagugaacacguauuccugucuugaucccggcauuccuguccacgggagacgcuacggacaugacuuuagcaucggcucuaccgugagcuucuccugcgauucuggguaucggcucagccacgaagaaccccugcugugugagaaaaaucauugguggucccacccccucccuacaugcgacgcccuguguggaggcgauguuagagggcccucuggaaccauucuuagcccuggcuaccccgaguuuuauccuaacucccugaauugcacauggaccguggacgucacgcacggcaagggggugcaguucaacuuucauacauuccaccucgaagaucaucacgacuaccugcugaucaccgagaauggaucuuuuacccagccgcuugcgcggcucacaggcagcgaucugcccccuaccauuaacgcugggcuguacggaaauuuccgcgcccaacucagauuuaucuccgacuucagcaucucuuaugagggcuuuaacauuacauucuccgaauacaaucuggagcccugugaagauccugggaucccccaguauggaagccggauuggcuuuaacuucggcaucggggacacgcuuaccuucucuugcuccagcggauacagacuggagggcacauccgagauuaucugucucgggggaggccgccggguuuggucugccccgcugccuagaugcguggcugaaugcggggccagcgcuaccaauaacgagggaauccugcuuucccccaauuauccccucaacuacgaaaauaaccaugaguguauuuauagcauccagguccaggccggcaaaggcauuaacaucucugcgcgcacauuucaccuggcccaaggggacgugcugaagauuuacgauggaaaggacaaaaccacgcaccuccugggcgcuuucaccggggccuccaugagaggacuuacacugagcucuaccagcaaucagcucuggcuggaauuuaacuccgauacagagggcaccgacgagggguuccagcugguguacacaucuuuugaacuuagccauugcgaggauccuggaaucccccaauucggcuauaagaucuccgaccagggccacuuugcugggucuaccauuaucuacggauguaauccuggcuauacgcugcaugggagcucccuccugaaaugcaugacaggagaacggcgcgccugggauuacccgcuccccagcuguauugcggagugcggcgggagauucaagggagaaucuuccggccggauccugagcccuggcuaucccuuuccuuacgacaacaaucuucgcuguauguggaugauugaggucgaucccgggaacaucguuucccugcaguuccucgccuuugacaccgaggcuucucacgauauucugagagugugggacggaccgccugaaaaugacaugcugcuuaaagagaucagcggcucccugauccccgaagggauucauucuacccucaacaucgugacaauucaguucgauaccgacuuuuauaucagcaaguccggauucgccauucaauucuccucuuccgucgcuacggccugccgggauccuggcgugcccaugaaugggacacgcaacggcgacggaagagagccuggcgauaccguuguguuucagugugaccccggguacgaacugcagggagaggagcggaucacaugcauccaggucgaaaaucgcuacuucuggcaaccgagcccucccguguguauugcccccugcggcgggaaccucaccggaucuuccggcuuuauccugagcccuaauuucccgcaccccuauccucacucuagagauugcgacuggacaauuaccguuaacgcugauuacgugaucagccuugcguuuauuuccuucucuaucgagcccaauuaugacuuucuguacaucuaugaugggccugacagcaacagcccccucauuggcagcuuccaggauuccaaacugccugaacggaucgagucuagcuccaauacgaugcaucuggccuuuagaucugacggaagcgucuccuacaccggcuuccaccuugaguauaaggcuaagcugcgcgaaucuuguuuugacccggggaacauuaugaacggaacacggcucggcauggauuacaaacuggggagcaccgugacauacuauugcgacgccggauacguucuccagggcuauuccacccugacguguaucaugggggaugacggcagacccggauggaaucgcgcccuuccuagcugccaugcucccuguggcucucgguccacagggagcgagggaaccgugcugucuccuaacuaccccaagaauuauuccgucggccacaacugcguguacagcauugccgugccgaaagaguucgucguuuuugggcaguucguguucuuucaaacaucucugcacgauguggucgagguguaugacggaccuacccagcaguccagccuccuguccagccuuucuggcagccauuccggcgaaucucugccccucagcuccgggaaucaaaucaccauuagauucacaucuguuggacccaucacggcgaagggcuuucacuucguguaccaggcugucccucgcaccagcuccacacaguguucuagcgugcccgagccucgguuugggagacgcaucggaaacgaguucgccguuggcuccagcgugcuguuugauugcaauccgggguacauucuccauggaucuaucgccauucggugugaaaccguccccaacucccuggcucaguggaaugacagccuuccuacaugcaucgugcccuguggcggcauucugaccaaaagaaaggggacgauccugucuccuggauaucccgagccguacgauaacaaucucaacugcgucuggaagaucacagugccugaaggcgccgggauucaaguucagguggucuccuucgcgaccgagcacaauugggacagccuggauuuuuaugacggaggcgauaacaaugcuccccggcuuggguccuacucuggaaccacaaucccucaucugcucaacagcaccuccaacaaucuguaucucaacuuccagagcgacauuucuguguccgccgccggcuuucaccuggaauacacagcuaucggccuugacagcugccccgagccucagacgcccucuagcgggauuaaaaucggagaucgcuauaugguuggcgacguggucuccuuccaaugugaucagggguacucucugcagggacacagccauauuaccugcaugccgggcccugugagacgguggaauuaccccauucccaucugucuggcccagugcgggggagcuauguccgacuuuucuggcgugauucucagcccuggcuucccggggaacuaucccuccagccuggauuguacauggaccaucaaucuuccuauuggauucggcguucaucugcaguuugucaacuucucuacagagaccauccacgacuaccucgaagugcgcuccgggagcuccgagacgucuaccgugauuggaagacugagcggcccccagaucccuuccucucucuuuagcacaacccacgaaacaucccuguauuuccacagcgauuacucucagaauaagcagggguuucauaucgucuaucaagccuaccagcuucaguccugccccgacccucggcccuucagaaacggauuugugauuggcaaugauuucaccguuggccaaacaaucagcuuugaguguuucccgggguauacgcugauuggaaacucugcgcugaccugccuccacggcgugucccgcaauuggaaccauccucugccccggugugaagcccuuugcgggggaaauaucacagcuaugaacggcaccauuuacagcccuggguaccccgacgaguauccgaauuuucaggauuguuucuggcuggucagagugccucccggaaacggcaucuacaucaacuuuaccguucuccagacagagcccauuuaugacuucaucacggugugggacggcccugaucaaaauucuccccaaauugggcaguucuccggaaacaccgcccuggaaagcgucuacucuacaagcaaucagauccugauuaaauuucacuccgacuucaccacaagcggcuuuuucgugcucuccuaucaugcuuaccagcuucgcguuugccaaccuccgcccccugugcccaacgccgagauccugaccgaagaugacgaguuugagaucggggauauuauccgguaucagugccugccuggauucacgcucgucggcaaugccauucugacauguagacuuggggaacgccugcagauggacggagcucccccugugugccaggugcucuguccggcgaacgagcugcggcuggauucuaccggcgucauccucagccccggcuacccugacuccuaccccaaucuucaaaugugcgccuggucuauuagcguugaaaagggguauaacaucaccauguuuguggaguucuuucagacagaaaaagaguucgaugugcugcaggucuacgacggaccuaauauucaaucccccgugcugaucucucucagcggcgauuauuccagcgcuuuuaacaucaccucuaaugggcacgagguuuuccugcagugguccgccgaccacggaaacaauaagaagggcuuucgcaucagauacaucgccuucuauuguagcacaccggaaucuccuccccauggguacauuaucucccagaccggcggacagcuuaacagcguggucagaugggcuugcgaucggggcuuccgccugguggggaaaucuuccgccguuuguagaaagagcucuuauggauaccacgcgugggacgcucccgugccugccugccaagccauuuccuguggcauccccaaagcuccuacgaaugggggaauccucacaaccgacuaccuggucggcacacgggugaccuauuuuugcaacgauggguaccgccugagcagcaaggagcucacgaccgccgucugucaguccgacggcacauggucuaaccauaauaaaaccccgagaugcgugguuauuagcuguggagaacuucccacaccucccaacggcaauaagaucgggacccagacauccuauggaucuaccgcgauuuucacgugcgaucugggcuuuaugcugguggggagcgcugugcgggagugccucuccucuggacuguggagcgaauccgagacaagaugucuugccggccacugcgggaucccugagcugauugucaacggccagguuaucggagaaaauuacggcuaucgcgacaccgugguguaccaauguaaccccggguuccggcucaucggaagcucugucagaauuugccagcaggaucacaauugguccggccagcugccgagcugugugccuguuucuugcgggcaucccggauccccuaucuauggccgcaccagcgggaacggcuuuaauuucaacgacguggucacauuuuccuguaauauuggauaccugaugcaaggccccaccaaggcccagugccaggcuaaccggcaguggucucacccgccucccauguguaaaguggucaauugcagcgaucccgggaucccugccaacuccaagagagagucuaaaauugaacauggaaauuucacauacggcacgguggucuuuuaugacuguaaccccggguacuuccucuuuggaagcuccgugcuuaucugccaaccuaacggccagugggauaagccgcugcccgagugcaucaugauugacuguggccacccuggggugcccccuaaugcugugcugagcggagaaaaauauaccuucggcucuacaguucauuacuccugcaccgggaagcggagccuccugggacagucuagccgcacaugucaacuuaacggccacugguccgggucucagccccacugcagcggagaugccaccggcacguguggcgacccugggaccccgggacauggcuccagacaggagagcaauuuccggacaaaaucuaccgugcgcuaugcgugcgacacaggguacauccugcacggauccgaggaaagaaccugucucgccaacggcagcuggacggggcggcagcccgagugcaaggcuguccaauguggaaauccuggcacaaccgccaacggcaagguguuucgcauugaugggacaaccuucuccucuagcgugaucuauuccugcauggaaggauacauucugucuggccccagcguuagacaguguaccgcuaaugggacaugguccggaacgcugccuaacugcaccaucauuucuugcggcgaccccgggaucccggccaauggacuccgguacggcgaugacuaugucgugggccagaacgugagcuacaugugucagccuggguauacaauggagcuuaauggaucccgcaucagaaccugcacaauuaacggcaccuggagcggggucaugcccacgugucgggccguuacaugccccaccccuccccaaaucucuaauggaagacuggagggcaccaacuuugauuggggguucuccauuagcuacaucuguucuccuggauaugaacuguccuuuccggcugugcucacaugcgugggcaauggcaccuggagcggggaggucccccagugucugccuaaauucugcggagaccccggcauuccugcgcaggggaagcgcgaaggaaaaucuuuuaucuaccagagcgagguguccuucagcuguaacuuucccuucauccuuguuggcuccucuacacggauuugccaagccgaugggacguggagcggauccucuccgcauuguaucgaaccuacccagacaagcugcgagaaccccggcgugccuagacacggcucccagaauaacaccuuuggguuccaagucggaucugugguucaguuucauugcaagaaaggccaucugcuccaggggagcacaacccgcacgugucugcccgaccugaccugguccggcauucagccugagugcaucccccacagcuguaagcaaccggaaacacccgcucaugccaauguggucggcauggaucucccuucucacggguacacccuuauuuauacaugccagcccggauucuuccuggccggcggcaccgagcaucggguguguagauccgacaacacauggaccgggaaggugccuaucugcgaagcuggaagcaaaauccuggucaaggauccgcgccccgcccucggcacgccuucucccaaacuguccguuccugacgauguguuugcgcagaauuacauuuggaaggggagcuauaacuucaaaggacggaagcagcccaugacacuuaccgugaccucuuuuaaugcuuccacaggcagagucaacgccacgcugagcaauucuaacauggagcuccugcuguccgggguguacaagagccaagaagcccgccucaugcuucggaucuaucugauuaaaguuccugcucacgccuccgugaagaaaaugaaggaggagaauugggcgauggacggcuucgucagcgccgaacccgacggagcuaccuacguguuucagggcuucauccaggggaaagauuauggacaguuuggccugcaaagacucgggcugaacaugucugagggaagcaauuccucuaaccagccgcacggcacaaauagcuccucuguugccauugcuauccuugugccuuucuuugcccugauuuucgcuggguuuggcuucuaccucuacaagcagcgcaccgcccccaagacacaauauaccggauguagcguccaugaaaacaacaauggccaggcggccuuugagaacccuauguacgacacaaaugcuaaauccguggaagggaaggccguucgguucgaucccaaccugaauaccgugugcacgauggucuga

SEQ ID NO: 67930 - RNA, 531 nt, Artificial Sequence
  derived and/or modified sequence opt5 from CSN1S1__Homo_sapiens__NP_001020275
augagacugcucauccugaccugccuuguggccgucgcucuggcccggcccaagcucccucugcgcuacccggagagacuucagaaccccagcgaauccucugagccuauuccccuggaaagccgggaggaauauaugaauggcaugaaccgcagaaauauccuccgggagaaacaaacagacgagauuaaggauacgcgcaacgaauccacccagaauuguguuguggcggagccugagaaaauggaaucuagcaucuccucuagcuccgaggaacaguucugcagacugaacgaguacaaucagcugcaacuccaggcugcccacgcccaggaacagauucggcgcaugaacgagaauagccaugugcaaguccccuuucagcagcugaaccagcuugcugccuauccuuacgcugugugguauuacccgcaaaucaugcaguauguucccuucccucccuuuucugacaucuccaauccuacagcccacgaaaacuacgagaagaauaacgugaugcugcagugguga

SEQ ID NO: 67931 - RNA, 681 nt, Artificial Sequence
  derived and/or modified sequence opt5 from CSN2__Homo_sapiens__XP_011529920
augaaggugcugauccucgccugccuggucgcucuugcccuggcgagagagaccauugaaagccucuccucuagcgaggaauccaucacagaguacaaacagaagguugaaaaagugaagcacgaggaccaacagcagggcgaggaugaacaucaggacaaaauuuaucccucuuuccaaccucagccgcugaucuaccccuuuguggagccuauucccuauggguuccuuccucagaacauccugccccucgcucagccugccgucgugcugccgguuccccaaccugaaaucauggaggugcccaaggccaaggauacggucuacaccaaaggacgggugaugccuguucucaagagccccacaauuccguuuuucgacccucagauccccaaacugaccgaucuggagaaucuucaucugccucucccccugcuucagccccugaugcagcaagugccucagccgauuccccagacacucgcucugccuccccaaccucugugguccgucccccagccgaaggugcucccuaucccccaacagguggucccuuauccccagcgcgccguuccugugcaggcucugcuucugaaccaggaacuccugcuuaaucccacccaccagauuuacccggugacacaaccucuggcccccguccacaaccccaucucuguguga

SEQ ID NO: 67932 - RNA, 549 nt, Artificial Sequence
  derived and/or modified sequence opt5 from CSN3__Homo_sapiens__NP_005203
augaaguccuuccugcucguggucaacgcccuggcucuuacccugcccuuucucgccguugaggugcagaaucaaaaacagccugcgugccacgaaaacgacgagagaccguucuaccagaagacagcucccuaugugccuauguacuauguccccaauagcuacccuuauuacggcacgaaccuguaucagcggcgccccgccaucgccauuaauaacccuuacgugccgagaaccuacuaugcuaaucccgccguugugcggccucaugcucaaaucccccagcgccaguaccuuccuaacucucaucccccgacagucgugagacggccuaaucugcaccccagcuuuauugccaucccucccaaaaagauucaggauaaaaucaucauucccaccaucaacacaauugcgaccguugaaccuacaccggcccccgcuaccgagccuacgguggacuccgucgugacccccgaagccuucucugagagcaucauuacauccaccccugagacaaccacgguggcugucacacccccgaccgccuga

SEQ ID NO: 67933 - RNA, 1098 nt, Artificial Sequence
  derived and/or modified sequence opt5 from CSNK1A1__Homo_sapiens__NP_001020276
auggccagcuccucuggcagcaaggcugaguucaucgucgggggaaaauacaagcuggugagaaaaauuggcuccgggucuuuuggagacaucuaucucgccauuaacaucaccaauggcgaagagguugcggugaagcuggaaagccagaaagcucggcacccccaacuucuguacgaguccaagcucuauaagauucugcaagggggagugggcaucccucauauccgcugguacggccaggaaaaagauuauaacguccuugugauggaccugcucgggccgucucuggaggaucuguucaauuuuugcagcagacgguucacaaugaagacgguucucaugcuggccgaccagaugauuucccgcaucgaguacgugcacaccaaaaacuuuauucauagagauaucaagcccgacaauuuccuuaugggaauuggccggcacuguaacaaaugccuggaaagcccugucgggaagcgcaagagaucuaugacaguguccaccagccaggaucccucuuuuuccggacucaaucagcuguuccuuaucgacuuuggccuggccaaaaaguaucgggauaaccgcacaagacagcauauuccuuaccgggaggacaaaaaucucaccgggacagcucgcuacgccagcaucaacgcucaccugggaaucgaacagucuagacgggaugacauggagucccugggcuauguucucauguacuucaaucgcaccagccugcccuggcaaggccuuaaggccgcgacgaaaaagcagaaauaugagaagauuuccgaaaagaaaaugucuaccccuguggagguccuguguaagggguuuccggccgaguucgcuauguaccucaacuauugcagaggacugcgguuugaagaagcccccgauuacauguaucuuagacagcuguuccgcauccucuuccggacacugaaucaccaguacgacuacaccuuugacuggacaaugcugaaacaaaaggcugcccagcaggcggccagcuccagcggccaagggcagcaggcucagaccccuacgggaaaacaaacagauaagaccaagucuaacaugaaaggcuucuga

SEQ ID NO: 67934 - RNA, 1248 nt, Artificial Sequence
  derived and/or modified sequence opt5 from CSNK1D__Homo_sapiens__NP_001884
auggagcugagagugggcaaccgguaccgccucgggagaaagaucggaagcggcuccuucggggacauuuaucugggaaccgauaucgccgcuggcgaagaggucgccauuaaacuugaaugcguuaagacaaaacacccccagcugcauaucgagucuaagauuuacaaaaugaugcaagggggagugggcaucccuacgauccggugguguggcgcggaaggggacuauaaugugauggucauggagcuccugggaccgagccuugaggaucuguuuaacuucugcucccgcaaguuuucucucaagaccgugcugcugcucgcugaccagaugauuagcagaaucgaauacauucacuccaaaaauuucauccaucgggauguuaagcccgacaacuuucugaugggccuugggaaaaagggaaaucugguguauauuaucgauuucggccucgccaaaaaguaccgcgacgccagaacacaccagcauauuccuuaucgggagaacaagaaucugaccgggacagcucgcuacgccucuaucaacacccaccuuggaaucgaacagagcagacgggaugaccuggagucccucggcuacguccugauguauuuuaaucugggcagccuccccuggcaagggcugaaagcugccacaaagcgccagaaauacgagagaauuucugaaaagaaaauguccaccccuaucgaggugcuuuguaagggauaucccagcgaguucgcgacguaccugaacuuuugccggucucuccgcuucgaugacaaaccugauuauuccuaccugagacagcuuuuucggaaucuguuccacagacagggcuuuagcuaugacuacguuuucgacuggaacaugcucaaguucggggccucucgcgcugccgaugacgcugaacgggaaagacgcgaucgggaggagagacugcgccauucccggaauccggccaccagaggacugcccagcacagcguccggccgccuccgggggacccaagaaguggccccucccacaccucugacccccacgucucacacagcuaacaccagcccgagaccugucuccggaauggagcgcgaacggaaggugagcaugagacuucaucggggcgcccccgugaauauuucuuccagcgaccugacaggccgccaggauaccucuagaaugagcaccucccagaucccugggcgggucgcuucuagcggacuccaguccguugugcacagauga

SEQ ID NO: 67935 - RNA, 1272 nt, Artificial Sequence
  derived and/or modified sequence opt5 from CSNK1G3__Homo_sapiens__NP_001026982
auggagaacaagaaaaaggacaaagauaagagcgacgauagaauggcccggcccuccggccgcucugggcacaauaccagaggaacaggcagcuccucuagcggggugcugauggucggaccuaacuuccggguuggcaaaaagaucggguguggaaauuuuggcgaacuccgccugggcaagaaccuuuacacgaaugaguauguggcuauuaaacuggaaccgaugaaguccagagcgccccagcuccaucuggaguaccgguucuauaaacaacuugggucuggagacggcaucccucagguguacuauuuugggcccuguggaaaguacaacgccaugguccuggaacuccugggcccuagccuggaggaucucuucgaccugugcgaucgcaccuuuucccuuaaaacagugcugaugauugcuauccagcucauuagcagaauggaguauguucacucuaagaaucugaucuaccgggacgugaagcccgaaaacuuccuuaucgggcgcccuggaaauaaaacccagcaagucauucauaucauugauuuuggccuggccaaggaguacaucgacccggaaaccaaaaagcacauucccuauagagagcauaaaucccucacaggcacagcccgguacaugagcaucaacacccaccuggggaaggagcagucucgcagagaugaccuggaagcucucggacacauguucauguauuuucugcggggcucccuuccuuggcaggggcugaaagccgauacgcucaaggagcgcuaccagaagauuggagacaccaaaagagcuacacccaucgaagugcugugugagaauuucccugaaauggccaccuaucuucgguacguuagacgccuggacuuuuucgagaagcccgauuaugacuaccuccggaaacuguuuacagaucuguucgacagaaagggcuacauguucgauuaugaguacgacuggaucgggaaacaacucccgaccccugugggagcgguccagcaggaucccgcccugagcucuaaccgcgaagcucaucagcaccgggacaagaugcaacaguccaagaaucagguggugagcuccacgaacggcgagcuuaauacagaugacccuaccgccggcagaucuaacgcucccauuacagcccccaccgaagucgagguuauggaugaaaccaacugccaaaaagugcugaauaugugguguugcugcuuuuucaagcgccggaaaagaaagacaauccagcgccauaaauga

SEQ ID NO: 67936 - RNA, 1176 nt, Artificial Sequence
  derived and/or modified sequence opt5 from CSNK2A1__Homo_sapiens__XP_011527477
augagcggccccgugccuuccagagcccgggucuacaccgacguuaacacacaccgcccgagagaguauugggauuacgaaucucaugugguggagugggggaaucaggacgauuaucaacugguccggaagcucggacgcggcaaauacagcgaaguguucgaggcuaucaacauuacgaauaacgaaaagguuguggucaaaauccugaagcccgugaaaaagaagaaaauuaagagagagaucaaaauucuugagaaucugcgcgggggaccuaacaucaucacccucgccgacauuguuaaggaucccgugucccggaccccugcgcuggucuuugaacacgugaauaacacagacuucaaacagcuuuaucagacacugaccgauuacgacaucagauuuuauauguacgagauucucaaggcucuggauuacugccauucuaugggcaucaugcaccgggacgugaagccccauaaugucaugauugaucacgaacaccgcaaacugagacucaucgacugggggcuggccgaguucuaucauccuggacaggaguacaacguucggguggccagccgcuauuuuaagggcccggaacuucugguggauuaccaaauguaugacuacucccucgacauguggucucugggcuguaugcuugcuagcaugauuuucagaaaagagcccuuuuuccacgggcaugauaauuaugaccagcugguccggaucgccaaggugcucggaacagaagaucuguacgacuacaucgauaaauauaacauugagcuggacccucgcuuuaaugauauccucggcagacacucccggaagagaugggaacgcuucguucacagcgagaaccagcaucuggugucucccgaggcucuugacuuucuggauaaacuccugcgguacgaccaccaguccagacuuaccgcccgcgaagcgauggagcauccuuauuucuacacggucgugaaggaucaagcccggauggggucuagcuccaugcccggaggcagcaccccgguuucuuccgcuaauaugaugagcgggauuuccucugugccuacacccagcccucugggaccccucgccggcucccccgucaucgcugccgcgaacccucugggcaugccggugcccgccgcugccggggcucagcaguga

SEQ ID NO: 67937 - RNA, 1053 nt, Artificial Sequence
  derived and/or modified sequence opt5 from CSNK2A2__Homo_sapiens__NP_001887
augcccggcccugccgcugggagcagagcccggguguacgcggaggucaacucccugcgcucuagagaauauugggacuacgaggcucacguuccgagcuggggaaaucaggaugacuaucaacucgugcggaagcugggccgcgggaaauacuccgaaguguucgaggccaucaacauuaccaauaacgaaagagucgugguuaagauccuuaaacccgugaagaaaaagaagauuaaacgggaggucaagauccuggagaaucuccgcggaggcacaaacauuaucaaacugaucgauacggugaaggacccuguuucuaaaacccccgcccuuguguuugaauauauuaauaacacagauuucaagcagcuguaccagauccucaccgacuuugauauuagauucuauauguacgagcugcugaaggcucucgacuacugccauagcaaagggaucaugcaccgggaugucaagccucauaaugugaugauugaccaccagcagaaaaagcugcgccuuaucgauuggggacuggccgaauuuuaucaucccgcucaagaguacaacgugagagucgccucccgguauuucaaaggcccugagcuccugguugacuaccagauguaugauuacucucuugacauguggagccugggcuguaugcucgcguccaugauuuuucgcagagaaccguucuuucacgggcaggacaauuaugaucaacuggugcggaucgccaaggugcugggaacagaggaacucuacggcuaccugaaaaaguaucacaucgaccuugauccccauuucaacgacauucuggggcagcacagccgcaagagaugggagaauuuuauccauucugaaaaccggcaccucgucuccccugaggcucuggaucuucuggacaaacuccugagauacgaucaccagcagcgccugaccgccaaggaggcuauggaacaucccuauuucuacccugugguuaaagagcaaagccagcccugcgccgacaaugcggugcucucuuccggacugacagccgcucgguga

SEQ ID NO: 67938 - RNA, 648 nt, Artificial Sequence
  derived and/or modified sequence opt5 from CSNK2B__Homo_sapiens__NP_001311
augagcuccucugaggaagugagcuggaucuccugguucugcggccugagagggaacgaguuuuucugugaagucgacgaggauuacauucaggacaaguuuaaucucaccggacugaacgaacaaguuccccacuaucggcaggcccuugauaugauccuggaccucgagccugaugaggaacuggaggacaauccgaaccagucugaucuuauugaacaggcugccgagaugcuguacggccucauccaugcgcgcuauauucugacaaauagagggaucgcucaaaugcuggagaaauaccagcagggagacuucggcuauugcccccggguguacugugaaaaccagccuaugcuccccaucgggcugagcgauauuccuggagaggccauggugaaacuuuauugccccaaguguauggacgucuacacgccuaaguccucucgccaccaucacaccgauggcgccuacuuuggcacaggguucccgcauaugcuguuuauggugcaccccgaauauagaccuaaacggcccgcuaaucaauucguuccucgccucuacggauuuaagauccaccccauggccuaucagcugcagcuucaggcugccagcaacuucaaguccccggugaaaaccauuagauga

SEQ ID NO: 67939 - RNA, 6969 nt, Artificial Sequence
  derived and/or modified sequence opt5 from CSPG4__Homo_sapiens__NP_001888
augcagagcggccccagaccuccccugcccgccccugggcucgcucuggcccuuacccugacaaugcucgcccggcuggcuuccgccgccucuuucuuuggagaaaaccaccuugaagugcccguggcuacggcccugaccgacaucgaucuccagcugcaguucuccacaucccagccugaggcucugcuccugcuugccgccggccccgccgaccaucugcuccugcagcuuuacucugggcgccugcaaguuagacucgugcugggacaggaagaacugcggcuccagaccccugcugaaacacugcuuuccgauuccauuccgcacaccgugguccugacagugguugagggcugggccacccucucuguggacggguuucugaaugcuagcuccgccguccccggagcgccucuugaggugcccuauggccuguucguuggcgggacgggaacccucggccugccuuaccugcgcgggacaagcagaccccuccggggaugccugcacgccgcuacccuuaacggccgcucucugcucagaccgcugacaccugaugugcacgaagggugugccgaggaauuuuccgcuagcgacgaugucgcccuuggauucucuggcccccauucccuggccgcuuuuccugcguggggcacccaggacgaggggacgcucgaguucacacugaccacacaaagccggcaggcgccccuggcuuuucaggccggaggccgcagaggggauuucaucuauguggacauuuuugaaggacaccuccgggccguggucgagaagggccaggggaccguucugcuucacaauucugugcccguggcugauggacaaccucaugaagucuccgugcacaucaacgcccaucgccuggagauuagcguugaccaguacccgacccacacauccaauagaggcgugcucucuuaucuggaaccccggggcagccugcuucucgggggacuggaugcggaggcuucccgccaucugcaggagcauagacucggccugacgccugaagccaccaacgccagccuucuggggugcauggaggaccucucugucaauggacaacggagaggccugcgcgaagcucugcuuacacggaacauggccgcuggguguagacucgaggaagaggaguacgaagacgaugccuauggccacuacgaggcguucuccacccuggcccccgaggcuuggccugccauggagcugcccgaaccgugcgugccugagcccggacucccucccguuuuugcuaauuucacacagcugcuuaccaucagcccucugguggucgccgagggcgggacggcguggcucgaauggcgccaugugcagcccacacuggaccugauggaggccgaacuucggaaaucucagguccucuucagcgugaccagaggagcucgccacggcgagcuggagcuggauaucccgggggcccaagcucggaagauguuuacccuccuggacguugugaacagaaaagcccgcuucauucaugauggauccgaagacacaucugaucagcuuguccuggaggugagcguuaccgcccgggugccuaugcccuccugucucagacgcggccagacauaccugcugcccauccaggucaauccugugaacgacccgccccacauuaucuuuccucacgggagccuuauggugauucucgaacauacgcaaaagccccugggcccugagguuuuccaggcuuaugaucccgacucugcgugcgaaggacugaccuuucagguccucggcacauccagcgggcugccuguggagcggagagaucagcccggagagccggccaccgaguucucuugucgggagcuugaagcuggcucccugguguacguccaccgcgggggaccugcccaagaccucacauuuagagugagcgacggccugcaggccucucccccugcuacccugaaaguuguggccauccggcccgcgauucagauccauagaagcacggggcuucgccuggcucagggcagcgccaugccgauccucccugccaaucuguccgucgagaccaacgcugugggacaagauguuucugugcuuuuccgggucacaggcgcccugcaguuuggggaacuucagaagcaaggagcgggcgggguggagggagcugaguggugggccacccaggccuuccaccagagagacguugaacagggccgcgugagauaucugagcacagauccccaacaccaugcuuacgacaccgucgagaaucucgcccuggaaguccagguggggcaggagauucuguccaaccuuagcuuuccugucacgauccagcgggcuacaguuuggaugcugcgccucgaaccccugcacacccaaaacacacagcaggagacccucaccacagcccaucuggaggcgacgcuugaagaggccggccccucuccuccgaccuuccacuaugaaguggugcaggcucccagaaagggaaaucugcaacuccagggcacacggcuguccgaugggcagggauuuacccaagacgauauucaggccggccgcgucacauacggggcuaccgccagagccagcgaggcuguggaggacacguuccgguuccgcguuacagcgccucccuauuuuucuccucuguacaccuuccccauccauauuggaggcgauccugacgccccggugcuuaccaacguccugcucgugguucccgaaggcggggagggagugcuguccgcugaucaccucuuugucaaaagccucaauucugccagcuaccuuuaugaagugauggagagaccucggcacggccgccuggccuggagagggacacaggacaagaccacaaugguuacguccuucaccaacgaagaucugcuccggggaagacugguguaccagcaugacgacagcgagacaaccgaggaugacauccccuuugucgcuacacgccaaggcgaaucuuccggggauauggccugggaggaagugcggggaguguucagagucgcgauccagccuguuaaugaccacgcucccgugcagaccauuagccgcaucuuucauguggcccggggcggcagacgccuucugacgaccgaugacgucgccuucuccgaugcugacucuggguuugccgaugcgcagcucgugcugacacggaaagaccuccuguucggaagcauuguugcuguggaugagccgaccagaccuaucuaucgcuuuacacaagaagaccuucggaagagacggguccuguucgugcacuccggcgccgaucgcggguggauucagcugcagguuucugacggacagcaucaagccaccgcucuccuggaggugcaggccagcgagcccuaccuuagagucgcuaacggcuccucucugguggucccccaagggggacagggcacaaucgacaccgccgugcuccaccuggauacgaaucucgacauccggagcggcgaugaaguucacuaucaugugacagcggggccucgcuggggacaacuggucagagccggccagcccgcuaccgccuuuucccagcaagaccuucuggauggggcugugcuguacagccacaacggaucucucuccccucgggacaccauggccuucagcguugaggccggcccggugcauacagaugcuacccugcaggucacgauugcgcuugaagggccccuggccccucucaaacuggugagacacaagaagaucuauguguuccagggagaggcugccgaaauucgccgggaccagcucgaggccgcucaagaggccguucccccugcggauaucgucuuuucugugaaaucucccccgagcgcuggcuaccuggugauggucagcagaggcgcccuugccgacgaaccucccucccuggauccugugcagagcuucucccaggaggcuguugacacagggcgcgugcuguaccuccacagccggcccgaagccuggucugacgcguuuagccuggaugucgccuccggacuuggcgcuccucuggagggggugcucguugagcuggaagugcugcccgccgcuauuccgcucgaggcccagaauuucucugucccugaaggaggcagccuuacccuggcuccgccccugcucagaguguccgggccuuauuuuccgacacugcuuggacugucucuccaaguucuggagcccccucagcauggcgcccugcagaaggaagacggcccccaggcgcgcacccucagcgccuucuccuggcggaugguggaggagcaacuuaucagauacguccacgaugggucugaaacacugaccgacagcuuugugcugauggcuaacgccuccgagauggaucgccagagccauccuguggcuuucacggucaccguucuccccgugaaugaccagccuccgauucugacaaccaacacaggacuucaaaugugggaaggcgccaccgcccccaucccugcugaggcgcugagaucuacggauggggacuccggaagcgaagaucucguguauacaaucgagcagcccucuaauggccgggucgugcugcgcggggccccuggaaccgagguuagauccuuuacacaggcucagcuggacggcggccucgugcuuuucagccaccgggggacccuggauggaggcuuucgcuucagacuguccgacggggaacauaccucucccggacacuucuuucgggucacagcccaaaaacaggugcuccugagccuuaagggcucccagacgcugaccguuugcccggggagcgugcagccucucucuucccaaacacugagagccagcucuagcgcuggaaccgauccccagcugcuccuuuaccgcgucgugcggggcccccagcugggcagacuguuccacgcccagcaagacuccacaggggaggcgcucgucaacuuuacccaggccgaaguguaugcuggaaauauucuguacgagcaugaaaugccucccgagccuuucugggaggcccacgacacgcuugaacugcagcucucuagcccgcccgcucgcgauguugccgcgacacuggccguggcuguguccuuugaggccgcuuguccucagcggcccucucaucuguggaaaaacaagggccucugggucccugaagggcaaagagcccggaucaccguugcugcccuugacgcgagcaaccugcuggccuccgugcccagcccgcagcgcucugagcacgaugugcuguuccaggucacccaauuuccuuccagaggacagcugcuugugagcgaggaaccccugcacgcuggccagccucauuuccuccagucccaacuggccgcugggcagcugguuuaugcccacggcggaggcgggacacagcaggacggauuucauuuccgggcccaccuccaaggccccgcgggggcuucuguggccggaccucagaccagcgaggcuuuugccauuacaguccgcgaugugaaugaaagacccccgcagccucaggccuccgucccccuucggcugacgcgcggcucuagagcucccaucagccgggcccaacuguccgugguugacccugauagcgcgccgggggagauugaauacgaggugcagcgcgcgccccacaacggcuuccucucucuggucggaggcgggcuuggaccugugaccagauuuacacaggcugacguugauuccggccggcuggccuucguggcuaaugggagcucugucgccggaaucuuccaacucuccaugagcgacggcgcgucucccccucugcccaugagccuggccguggauauccucccuuccgcuauugaggugcagcuuagagcuccccuggaaguuccgcaggcccuggggcgcucuagccucucccagcaacagcugcgggucgugagcgacagagaggaaccugaggccgcuuaccgccuuauccagggcccccaguauggacaucugcucgugggcgggcggccuaccuccgccuuuucucaauuccagauugaucagggagaagucguuuuugcguucacaaacuuuagcuccucucacgaccauuucagagugcuggcccuggcucgcggcgugaaugccagcgcugucgugaacguuaccgugcgggcccuccuucacgucugggccgggggacccuggccgcagggcgcgacgcugagacuggacccuaccgugcucgaugcuggcgagcuggccaaucgcacaggguccguuccccgguuuagacuucuggagggaccccgccauggccggguggucagagugccucgcgccagaaccgaacccgggggaucucaacucguggagcaguucacacagcaagaccuggaagauggccggcuggggcucgaggucggacgcccugaaggcagagcuccgggccccgccggggacagccuuacccuggagcugugggcucagggaguuccucccgccguggcgucccucgauuuugccacagagccuuacaacgcugcccggcccuauagcguggcucugcuuucugucccugaagccgcgagaacggaggccggcaaaccggaauccagcacccccacaggggagccuggacccauggcuucuuccccugagcccgccguggcuaagggcggguuccugagcuuucucgaagccaauauguucucuguuaucauuccgaugugccuggugcugcuccugcuugcucugauccucccucugcucuuuuaccugcggaagcgcaacaaaaccggaaagcacgacguccaggugcucaccgccaaacccagaaauggccuggcgggcgauacagagacguuccggaagguugaacccgggcaggccaucccucugaccgcugugcccggacaaggcccuccgcccgggggacagccugaccccgagcuccugcaguucugucgcacaccuaaccccgcccuuaaaaauggccaguauugggucuga

SEQ ID NO: 67940 - RNA, 1206 nt, Artificial Sequence
  derived and/or modified sequence opt5 from CSPG5__Homo_sapiens__NP_001193871
augcccccugccaucccggaggcuaccgaagccagcgggcccccuucccccacaccuggcgacaagcugucucccgcgagcgagcucccuaaagaauccccgcuggagguguggcuuaaccugggaggcucuacgcccgauccucaggggcccgaacucaccuacccuuuccaaggaacacuggagccccagccggcuagcgacauuaucgauauugacuauuuugagggccuugauggggaaggaagaggcgccgaccugggcuccuucccugggucucccggaaccagcgagaaucacccugauacagaaggcgagacccccuccuggagccuccuggaccuguacgaugacuuuacacccuucgaugagucugacuuuuauccuaccacguccuucuacgaugaccucgacgaagaggaagaggaagaggaggaugacaaggaugccgucgggggaggcgaccuggaagaugagaacgaacuucugguuccgaccgggaaacccggacucggcccuggcacagggcagcccaccagccgguggcaugcugugccuccccagcacacacugggaucugugccgggcuccagcaucgcccuucgcccuagacccggggagccuggacgggaccuggcuucuuccgaaaauggcaccgagugccgcagcggguuugucagacauaacggauccugucggucugugugcgaucucuuccccagcuauugucacaauggcggccaaugcuaccugguugagaacauuggggccuuuugucgcugcaauacgcaggacuauaucuggcauaagggaaugagaugugaauccaucauuacagauuuccaggugaugugcgucgcggugggcagcgccgcucugguucuccugcuucuguuuaugaugaccguguucuuugccaaaaagcucuaccugcuuaagacagagaacaccaaacugcggcgcaccaauaaguucagaacaccuucugaacuccacaacgacaauuucucccugagcacgaucgcugaggggucucaccccaacgaugacccgagcgccccucauaaaauucaggaaguccugaaguccugucucaaagaggaggaaucuuuuaauauccaaaacagcaugucccccaagcuggagggaggcaagggggaccaggcggaucuugacgugaauugccugcagaacaaccucaccuga

SEQ ID NO: 67941 - RNA, 2631 nt, Artificial Sequence
  derived and/or modified sequence opt5 from CSPP1__Homo_sapiens__NP_001278268
auggacgagagauuccgguacgaaagcgauuuugaccgcagacugucccggguguauaccaacgaucgcaugcacagaaauaagcggggcaacaugcccccuauggagcaugacggggaugucaucgaacagucuaauauucgcaucagcuccgccgagaacaaaucugcuccggacaaugaaacaagcaaguccgccaaccaagauacgugcucucccuucgcgggaaugcucuuuggcggggaggacagagagcugauucagcggcgcaaagaaaaguacagacuugagcugcucgaacagauggcugagcagcaacggaauaaacgcagagagaaggaucuggaacuucggguugccgccagcggagcucaggacccugagaagucccccgaucgccugaaacaguucagcguggccccuagacacuuugaagagaugauucccccugaacggccgagaaucgcuuuccagacaccccucccuccccugucugccccuuccgugcccccgaucccuagcguccaucccgugccuucucaaaacgaggaccugcgcuccggccucagcucugcgcugggggagaugguuucccccagaaucgcuccccuuccuccgcccccucugcugcccccucucgccaccaauuauagaacccccuacgaugacgccuauuacuuuuauggaagccgcaacacauucgacccgucccuugcuuacuacggcucuggcaugaugggggugcagccugccgcguaugucagcgcccccgugacccaccagcuggcucagccuguugugaauacagucggacaaaacgaacucaagauuaccuccgaucaggugaucaauagcggccugauuuuugaggacaaacccaagccuucuaaacagucccugcaaagcuaccaggaagcccuccagcagcaaauccgggagagagaagaacgccggaagaaggagagagaagagaaagaagaguaugaagcuaagcuggaggccgagaugcgcacguacaaccccugggggaaaggaggcgggggagccccgcuucgggaugcuaagggcaaucugauuucucauaugcagacccagagcuccccuuucgcgagaggcaacguguuuggggaaccucccacagagcuccagaucaaacaacaggaacuguauaagaacuuccuucgcuuucagauugaggagaaaaagcagcgggaagaggccgaaagagagcggcugcgcaucgcugaagagaaggaggaaagacggcucgccgagcaaagagcccgcauccagcaggaauacgaggaggagcaggagaaaaagcgggaaaaagaggaggaacaaagacugaagaaugaggaacacauucgccuggcugaggaaagacagaaagaggccgaacggaagaagaaagaggaggaagagaaguauaaccuccagcugcaacacuacugugaacgcgacaaucuuaucggagaggaaaccaaacauaugagacagcccucuccgauuguccccgcgcugcagaacaagaucgcuagcaaacuccagcggccucccuccguugauagcauuauccgcucuuucauccacgaguccagcaugucuagagcccaauccccucccgugccugcccggaagaaucagcugcgcgcugaggaagagaagaaaaacgugauuauggaacuuagcgagaugagaaagcagcugcgguccgaggaacgcagacuccaggagcggcugcugcauauggacucugaugacgaaauccccauucggaaaaaggagcgcaauccgauggauaucuucgacauggcccggcacagacuccaagcuccuguccgccggcagagccccaaaggccuggaugccgcgacauuucagaacgugcacgacuucaaugaacuuaaggacagagauuccgagacccgcguugaccugaaguuuauguaccucgauccuccccgggaccaucacacgcuggaaauucagcaacaggcccugcuuagagagcagcaaaaacgccucaaccggaucaagaugcaggagggggcuaaaguggaucuggacgccaucccgucugcuaaggucagagaacagcggaugccucgcgaugacacaagcgauuuccugaaaaauucccuccuggagagcgacucugccuuuauuggagcguauggcgaaaccuaccccgccaucgaggaugacgugcuuccuccucccucccagcugcccagcgcuagagagcggcgcagaaacaaguggaaagggcucgauauugacucuucccggccgaauguugcccccgacggacugagccugaagucuaucagcuccgugaacgucgaugaacuuagagugcgcaaugaggaacggaugagacgccucaacgaguuccauaacaagccuauuaauacagacgaugaaagcucucuggucgaccccgaugacaucaugaaacacauuggcgaugacggcuccaacagcguggcuaccgagccuuggcugcggcccgggaccuccgagacacucaagagauuuauggccgaacaacugaaucaggagcagcagcaaaucccuggaaaaccgggcacguucaccuggcaggggcuuucuacagcccauggauga

SEQ ID NO: 67942 - RNA, 1770 nt, Artificial Sequence
  derived and/or modified sequence opt5 from CSRNP1__Homo_sapiens__NP_149016
augaccggccugcucaagagaaaauucgaccagcuggaugaggacaacagcuccgugucuagcuccucuagcuccucugggugccaaagccgguccuguagccccucuuccagcgucucucgcgccugggauuccgaagaggaaggaccuugggaccagaugccgcuucccgauagagacuuuugcggcccucggagcuucacaccccugucuauccucaagcgcgcuagacgggagcgcccugggagaguugccuuugauggaauuacgguguucuacuuuccccggugucagggcuucaccuccgugccuagccgcgggggaugcacacugggcauggcgcuuagacacuccgcuugucggcgcuuuucucuggccgaguucgcccaggaacaagcuagagcccggcaugagaaacuccgccagagacugaaggaagagaaacuggaaaugcuccaguggaagcugagcgcugccggcgucccgcaggcggaggccgggcuucccccugugguugacgcuaucgaugacgccuccguggaggaagaucuggcugucgccguggcgggaggccggcucgaggaaguuagcuuucugcaacccuauccugccagacgccggagagcccuucugcgcgcuucuggggugcggagaauugaccgcgaggaaaagcgggagcuccaggcucugagacagucccgcgaggauugcggaugucacugcgaccggaucugugaccccgaaaccugcagcuguucucuggccggcauuaaaugccagauggaucauacagccuucccgugcggguguugcagagagggaugugaaaauccuaugggccgcgucgaguuuaaccaagcucgggugcagacccacuucauccauacacucaccagacugcagcuugaacaagaggcggagagcuuucgggaacuggaggcccccgcucagggcuccccucccucucccggggaagaggcccucgugccuacguucccgcuggccaagcccccuaugaauaacgaacuuggagacaauagcugcuccagcgauaugaccgacucuuccacagcuagcagcuccgccagcggcaccuccgaggcgcccgauuguccuacacaccccgggcugccgggaccuggcuuccagcccggggucgacgaugacucucucgcucgcauccugagcuuuuccgauucugacuucggaggcgaggaagaggaagaggaggaaggcagcguugggaaccuggauaaucucuccugcuuucacccugccgacauuuucggaaccagcgaccccggcgggcuggccucuuggacgcauuccuacagcggauguucuuuuacauccggcgugcuugaugagaacgcuaaucuggacgccagcugcuuccucaacgggggccuggaaggaucuagagagggcagccuuccugggaccuccgugcccccgagcauggaugcuggacggucuuccagcgucgaccugucccucucuagcugugauuccuuugaacugcugcaggcccucccugacuauucucugggcccccacuacacaagccaaaaaguguccgauucucuugacaauaucgaggcgccccauuucccucugccggggcucucucccccuggagaugccuccagcugcuuucuggagucucugaugggcuucuccgaacccgcugccgaggcucuugacccuuuuauugauagccaguucgaagacaccguucccgccucucucauggagccugugcccgucuga

SEQ ID NO: 67943 - RNA, 1758 nt, Artificial Sequence
  derived and/or modified sequence opt5 from CSRNP3__Homo_sapiens__NP_079245
augagcggcauccugaagagaaaauucgaggaaguggacggguccucucccugcagcuccguccgggagucugaugacgaaguuagcuccucugagagcgccgauuccggagacagcgugaacccuucuaccuccagccacuuuacaccgucuuccauucucaagcgcgagaaaagacugcggacgaagaaugugcauuucagcugugucaccguguacuauuuuacacgcagacagggcuucaccucuguucccucccaagggggaagcacacuuggcauguccucucggcacaacagcgugcgccaguacacccugggggaauuugcuagagagcaggaacggcuccaucgcgagaugcugagagaacaccuucgggaggagaaacugaauagccucaagcugaagaugaccaaaaacggaacagucgaaagcgaggaagccucuacgcugacccucgaugacaucuccgaugacgauauugaccuggauaauacagagguggacgaauauuucuuucuucagccucugcccaccaagaaacgcagagcgcuccugcgggcuagcggcguuaagaaaaucgauguggaggagaagcaugaacuucgcgccauuagacugucucgggaggacugcggcugugacugcagagucuucugugauccugacacaugcaccuguagccucgccgggaucaagugccaaguggaucgcauguccuuucccuguggaugcacgaaagaaggcuguucuaacacagcugggcggaucgaguucaauccuauuagagugcgcacccacuuucugcacacaaucaugaagcuggaacucgagaaaaaccgggagcagcagauuccgacccugaauggaugccauagcgaaaucuccgcccacuccucuuccaugggccccgucgcucauagcguugaguacucuauugccgacuccuucgaaaucgagaccgaaccucaggcggccgugcuucaucugcaaagcgcugaggagcucgauugccagggggaagaggaagaggaggaagaggacggauccucuuuuuguagcggcgugacagauuccucuacgcagagccuggcccccuccgaaagcgacgaggaagaggaggaagaggaagaggaagaggaggaagaggaugacgaugacgacaagggcgauggguucgucgaaggacuuggcacccacgcugaggugguuccucugcccucugugcucugcuauuccgacgggacagccguccacgaaagccacgcgaaaaacgccucuuucuacgcuaauuccagcacccuguauuaccagauugauucucauaucccgggaacaccuaaccaaaucagcgagaauuacuccgagagagacaccgugaagaacggcacgcugagccucguucccuauacaaugaccccugaacaguuuguggauuacgcccgccaggcugaggaagccuauggggccucucacuaccccgcugcgaaucccuccgucauuguguguugcagcuccucugagaacgacagcggagucccuuguaacucccuguauccggagcaucggucuaaucacccccaaguggaguuccacagcuaccuuaaaggcccuucccaggaaggcuuuguuucugcccugaacggggauagccauaucuccgaacaccccgcugagaauagccucucucuggccgaaaaguccauucuucaugaggagugcaucaagagcccuguggucgaaaccgugcccguuuga

SEQ ID NO: 67944 - RNA, 582 nt, Artificial Sequence
  derived and/or modified sequence opt5 from CSRP1__Homo_sapiens__NP_001180500
augcccaacuggggcgggggaaagaaaugcggcgugugucagaagaccgucuacuucgccgaggaaguucaaugcgaggggaauagcuuucacaaauccuguuuccugugcaugguguguaagaaaaaccucgacucuacaacgguggcuguccauggagaagagaucuauugcaagagcuguuacggcaagaaauaugggccuaagggauacggcuauggccagggggccggaacccuguccacagauaaaggcgaaucucuugggauuaagcacgaggaggcgccgggacauagacccaccacaaauccuaacgcuagcaaauuugcccagaagaucggcggguccgaacggugcccccgcuguucucaggccguguacgcugccgagaagguuauuggagcuggcaaaagcuggcacaaggccugcuucagaugugcgaaaugcggcaaggggcuggaauccaccacacucgccgacaaagauggagagaucuauugcaagggcuguuacgcuaaaaauuuugggccuaagggauucggcuuugggcaaggagccggcgcucuggugcauagcgaguga

SEQ ID NO: 67945 - RNA, 2349 nt, Artificial Sequence
  derived and/or modified sequence opt5 from CSRP2BP__Homo_sapiens__NP_065397
auggacagcuccauccaccugucuagccucauuuccagacaugaugacgaggccacccggacaucuacgagcgaaggccuggaggaaggggagguggaaggagagacccuucugaucgucgaguccgaagaucaggcuucuguugaccucagccacgaucaauccggcgacagccugaacucugaugagggggacguguccuggauggaggaacagcuuagcuacuucugcgauaagugucagaaauggauucccgccucucagcugcgcgagcaacucuccuaucugaagggagacaacuuuuucagauuuacaugcagcgauuguucugcggacggcaaagaacaguacgagcggcugaagcucaccuggcaacagguggucaugcuggcuauguauaaucuuucccuggaagggagcggacgccagggcuacuucagauggaaagaggauaucugcgccuuuauugaaaagcauuggacauuccuccugggcaaucggaagaaaaccuccacaugguggucuaccguggccgggugucuuagcguuggauccccuauguauuuucgcagcggcgcucaggaguucggggagccgggaugguggaagcuggugcacaacaaacccccuacgaugaagcccgaaggcgagaaacucucugccuccacccugaagaucaaggcugccagcaaaccuacacuggaccccaucauuaccgucgaagggcucagaaagcgggcgucucgcaauccuguggagagcgccauggaacugaaagagaagagaucccggacacaggaggcuaaagacauccgcagagcccagaaggaagcugccggauuucuugaucggucuaccagcuccacgccgguuaaauucauuagccgcggcagacggcccgacgugauccuggagaagggcgaagucauugauuuuucuucccucucuagcuccgacagaacaccucugaccagccccuccccuucucccagccuugauuucuccgcgccggggacacccgccucucauagcgcuacccccucccugcucagcgaggccgaccugaucccugaugugaugccuccccaagcucuguuucacgacgaugacgaaauggagggagauggcgugauugacccugggauggaguacgucccgcccccugccggaucuguugccuccggccccguggucgggggacgcaagaaagugcggggcccugaacagaucaagcaggagguggaaagcgaggaggaaaaacccgacagaauggauaucgacucugaggauaccgacuccaacacaagccuccaaacgcgcgcucgggaaaagagaaaaccgcagcuggagaaggauaccaagccuaaagaaccccgcuauacaccuguuucuauuuacgaggagaaacuucugcucaagcggcuggaagcgugccccggcgccguggcuaugaccccugaggccagacgccuuaagcggaaacugaucgucagacaggccaagcgcgaccgggggcucccccuguucgaucuggaccaggugguuaaugcugcccuccugcuuguggauggaauuuacggcgcgaaggaagggggaaucagcagacugccggcuggccaagccacauaucggaccacgugucaggacuuccgcauucucgauagauaccagacaucccugccuagccggaaaggguuuagacaccagaccaccaaguuccuguaucgccuugucggcucugaggacauggccguggaucaauccaucgucagccccuacacaucccggauccucaaacccuauauuagacgcgacuacgaaaccaagccuccgaaacugcagcugcucucucagaucagaagccaucugcaccgguccgacccccauuggacaccugagcccgaugcuccucuugacuauugcuacgugcgccccaaccacauuccuacgaucaauucuaugugucaggaguuuuucuggcccggaauugaucugagcgaaugccuccaauacccggacuuuuccguugugguccuguauaagaaggugaucaucgccuucggcuuuaugguuccugaugugaaauacaacgaggcuuauauuucuuuccuguuuguccaccccgaauggagacgggccgggaucgcgaccuucaugauuuaccaucuuauccagacauguaugggaaaggacgugacccuccacgugagcgccuccaauccugcuaugcugcuguaucagaaauuuggcuucaagacagaggaauacguucucgauuuuuaugacaaauacuacccccuggagagcaccgagugcaagcaugccuucuuccuucgccugagacgguga

SEQ ID NO: 67946 - RNA, 582 nt, Artificial Sequence
  derived and/or modified sequence opt5 from CSRP2__Homo_sapiens__NP_001287894
augcccguguggggcgggggaaacaagugcggcgccugugggagaaccgucuaccacgcugaggaaguucagugcgacggacggagcuuccaucgcuguugcuuucuguguauggugugccggaaaaaucucgauuccacaacgguggccauccacgacgaggaaauuuauuguaagucuugcuacggcaaaaaguaugggccuaaaggauacggcuauggccaaggggcgggaacccugaacauggauagaggcgagcgccuugggaucaagccggaaagcguccagccccauagaccuacaaccaaucccaacacauccaaguucgcucagaaauacggaggcgccgagaaguguucucggugcggggacagcguguaugccgcugagaaaauuaucggagccggcaagccuuggcacaaaaauuguuuucgcugcgcuaagugcggcaagucccuggaaucuaccacacucaccgagaaagaaggggagauuuacuguaagggaugcuacgccaaaaacuucggccccaagggguuuggauauggccagggggcgggagcccugguucaugcucaauga

SEQ ID NO: 67947 - RNA, 585 nt, Artificial Sequence
  derived and/or modified sequence opt5 from CSRP3__Homo_sapiens__NP_003467
augcccaacuggggcgggggagccaagugcggcgcuugugagaaaaccguguaccacgccgaagagauccagugcaaugggcggagcuuccauaagacauguuuucacugcauggcguguagaaaagcucuggacuccacgaccgucgccgcccaugaaucugagauuuauugcaagguuuguuacggacgcagauauggcccuaaagggaucggauacggccaaggcgcugggugccucagcacagauaccggagaacaccugggccuucaguuccagcaguccccgaagcccgcccggucugugacaaccagcaacccuuccaaguuuacagcuaaauucggggagucugagaaguguccccgcugcggaaaaagcguguaugccgcggaaaaggucaugggcgggggaaaaccuuggcauaagaccuguuuuagaugcgccauuugcggcaagucccuggagagcacgaaugugaccgacaaagauggcgaacucuacuguaagguuugcuaugcuaaaaacuucgggcccacaggaaucggcuuugggggacugacccaacagguggagaagaaagaguga

SEQ ID NO: 67948 - RNA, 426 nt, Artificial Sequence
  derived and/or modified sequence opt5 from CST1__Homo_sapiens__NP_001889
auggcccaguaccugagcacccuccugcuucugcucgcuacacuggccguggcgcuugcuuggucccccaaggaggaagacagaaucauuccuggcgggaucuauaacgccgaucugaaugacgagugggugcaacgggcccuccacuucgcuauuucugaauacaacaaagccacgaaggaugacuauuaccgcagaccgcugcggguucugcgcgcuagacagcagaccgugggaggcgugaauuacuuuuucgaugucgagguggggcggacaaucugcaccaaaagccagcccaaccucgacacaugugccuuucaugaacaaccugagcugcagaagaaacagcuuugcuccuucgagauuuaugaaguucccugggagaaucgcagaucucuggucaagagccggugucaggaauccuga

SEQ ID NO: 67949 - RNA, 426 nt, Artificial Sequence
  derived and/or modified sequence opt5 from CST2__Homo_sapiens__NP_001313
auggccuggccccugugcacccuccugcuucugcucgcuacacaggccguggcgcuggcuuggagcccucaagaggaagacagaaucauugagggcgggaucuacgaugccgaccuuaacgaugaacggguccagcgcgcccugcacuucguuauuuccgaguauaauaaggcuacggaagacgaguacuauagacggcuccugcgcgugcugagagcccgggagcagaucgugggaggcgucaacuacuuuuucgauauugaaguggggcgcaccaucuguacaaaaucucagccgaaucucgauaccugcgcuuuucaugagcaacccgaacugcagaagaaacagcuuuguagcuuccagaucuaugagguuccuugggaggacagaaugucccuggugaacucucggugccaagaagccuga

SEQ ID NO: 67950 - RNA, 441 nt, Artificial Sequence
  derived and/or modified sequence opt5 from CST3__Homo_sapiens__NP_001275543
auggccggcccccugagagcuccucuccugcuucuggccauccucgcgguggcucuggccgucagcccggccgcuggguccucucccggaaagccuccccggcuuguuggcgggccuauggacgccagcguggaggaagagggagugcgcagagcucuggauuucgccgucggcgaauacaacaaagcguccaaugacauguaucacucucgggcccuccaggugguucgcgcuagaaagcaaauuguggccggggucaacuacuuucuggauguggagcugggacggaccacaugcacgaaaacccagcccaaucucgacaacuguccuuuccaugaucagccgcaccugaagcgcaaggcuuuuugcagcuuccagaucuaugccguucccuggcaaggcacaaugacccuuuccaaaucuacaugucaggacgcguga

SEQ ID NO: 67951 - RNA, 426 nt, Artificial Sequence
  derived and/or modified sequence opt5 from CST4__Homo_sapiens__NP_001890
auggccagaccccugugcacccuccugcuucugauggcuacacucgccggcgcgcuggcuagcuccucuaaggaggaaaaccggaucauuccugggggaaucuacgacgccgaucuuaaugacgagugggugcagcgcgcccugcacuucgcuauuagcgaauauaacaaagccacggaggaugaauacuauagacggccgcuccaagugcugcgcgcuagagagcagaccuuuggcgggguuaauuacuucuuugacguggaggugggacggacaaucuguaccaagucccagcccaaccuggauacaugcgccuuccaugaacagccugagcuccagaaaaagcaacuguguucuuuugaaauuuaugagguccccugggaggaccgcaugagccuugucaauuccagaugccaggaagcguga

SEQ ID NO: 67952 - RNA, 429 nt, Artificial Sequence
  derived and/or modified sequence opt5 from CST5__Homo_sapiens__NP_001891
augauguggcccaugcacaccccucugcuccugcuuacagcccugaugguggcugucgccggcagcgcguccgcucagucuagaacgcucgccgggggaauccaugccaccgaccugaacgauaagagcguucaaugcgcucuugacuucgccauuuccgaguacaauaaagugaucaacaaggaugaauauuacucucggccgcuccaggugauggcugccuaucagcagauugucggcggggugaauuacuauuuuaacguuaaauucggacgcacaaccuguacaaagagccaacccaaucuggacaacugcccuuuuaaugaucagcccaaacugaaggaggaagaguucuguuccuuucagaucaacgaagugccuugggaggacaagauuucuauccugaauuacaaaugcagaaaggucuga

SEQ ID NO: 67953 - RNA, 450 nt, Artificial Sequence
  derived and/or modified sequence opt5 from CST6__Homo_sapiens__NP_001314
auggccagaagcaaccugccccucgcucugggccuugcccugguggcguucugccuccuggcccuuccucgggacgcucgcgccagaccgcaggagcggauggucggggaacugcgcgaucucucccccgacgauccucaaguucagaaggcugcccaggcugccguggcgucuuacaauaugggaagcaacuccaucuauuacuuuagagacacccacauuaucaaagcccagucucaacugguggcuggcauuaaguauuuccugacaauggagauggggagcacggauugucggaaaacccgcgucacaggagaccauguggaucucaccacaugcccccuggccgcuggcgcccagcaggaaaaacuuagaugugacuuugagguucugguggucccuuggcaaaauuccucucagcuccugaagcacaacugcgugcagauguga

SEQ ID NO: 67954 - RNA, 438 nt, Artificial Sequence
  derived and/or modified sequence opt5 from CST7__Homo_sapiens__NP_003641
augagagccgcuggcacccugcucgccuucugcugucuggugcuuagcacaaccgggggacccuccccugacacgugcucucaggaucugaacagccgggucaagccgggcuuucccaaaacaaucaagaccaaugacccugggguucuccaagcggcucgcuacuccguggagaaauucaacaauuguacaaacgauauguuucuguucaaggaaucuagaauuacccgggcccuugugcagaucgucaaaggacugaaguauaugcucgagguggaaauuggccgcacaaccugcaagaaaaaucagcaccugagacuggacgauugugacuuucagacgaaccauacccucaagcaaacacugagcugcuacuccgagguuugggugguccccuggcuucagcacuucgaagugccuguucugcggugucauuga

SEQ ID NO: 67955 - RNA, 429 nt, Artificial Sequence
  derived and/or modified sequence opt5 from CST8__Homo_sapiens__NP_005483
augcccagaugccgguggcugagccucauccugcuuaccauuccucuggcccucguggcucgcaaggacccgaaaaagaacgagacaggcguccugagaaaacuuaagcccguuaaugccuccaacgcgaaugugaaacagugucugugguucgcuaugcaagaauacaacaaggagucugaagauaaguauguguuucucgucgugaaaacgcugcaggcccagcugcagguuaccaaucuccuggaguaccuuaucgacguggaaauugcccggagcgauugccgcaagccucuguccacaaacgagaucugugcuauucaagaaaauucuaaacucaagagaaaacugagcugcuccuuccuugucggggcccugcccuggaacggagaguuuaccgugauggagaagaagugugaagacgcuuga

SEQ ID NO: 67956 - RNA, 480 nt, Artificial Sequence
  derived and/or modified sequence opt5 from CST9__Homo_sapiens__NP_001008693
augagcucuccccagagacggaaggccaugccuugggcucugucccuccugcuuaugggcuuccaacugcucgugaccuacgccuggugcagcgaggaagagaugggagggaacaauaaaaucguccaggacccgauguuucuggcgacaguugaguucgcucuuaacacguuuaaugugcaguccaaggaagaacacgccuaucgccugcucagagugcugucuagcuggcgggaggauuccauggaccgcaaauggagaggcaagauggucuucucuaugaaccugcagcuccggcaaaccgugugucgcaaauuugaggaugacauugauaauugccccuuccaggaaagccuggagcuuaacaauguuagacaggggaucuccuuuccucaggugcauagcuguggaugcuguaugggcugcggggucggaacaggcgccgcugacaaggccauuccccgggauaagggcaaauga

SEQ ID NO: 67957 - RNA, 444 nt, Artificial Sequence
  derived and/or modified sequence opt5 from CST9L__Homo_sapiens__NP_542177
augcugggccuccccuggaaagggggacugagcugggcccuucugcuccugcuucugggcucccagauccuccugauuuacgcuuggcacuuccaugagcaaagagacugcgaugaacacaacgugauggcccgguaucugccugcgaccgucgaguuugcuguucauacauucaaucagcagucuaaggacuacuaugccuaccgccucgggcacauccugaacagcuggaaggaacagguggaguccaaaacgguguuuucuauggaacuucugcucggaagaacccgguguggcaaguucgaggaugacauugauaauugccauuuucaagagagcacagaacugaacaauaccuucacaugcuuuuucaccaucuccacacgcccguggaugacccaguuuucucuucugaacaaaacgugucucgagggguuccacuga

SEQ ID NO: 67958 - RNA, 297 nt, Artificial Sequence
  derived and/or modified sequence opt5 from CSTA__Homo_sapiens__NP_005204
augauccccggcgggcugagcgaggccaagccugcuaccccggaaauucaggagaucguggacaaagucaagccccaacucgaagagaaaacaaacgaaacguacggaaagcuggaggccguucaguauaaaacccaggugguggcgggcacaaauuacuauauuaaggucagagcuggggauaacaaguacaugcaccuuaaaguguucaagucccugccuggacagaaugaggaccucguucugaccggcuaucaaguggauaaaaacaaggacgaugaacuuacaggguuuuga

SEQ ID NO: 67959 - RNA, 297 nt, Artificial Sequence
  derived and/or modified sequence opt5 from CSTB__Homo_sapiens__NP_000091
augaugugcggcgcccccagcgcuacccagccugccacagcggagacgcaacacaucgcugaccaggugagaucccagcuggaagagaaggaaaacaaaaaguucccggucuuuaaagccguuucuuucaagagccaggugguggccgggaccaauuacuuuauuaaaguccaugugggagaugaggacuucguucaccuccggguguuucaaucccugccccaugaaaacaagccucuuacacugucuaauuaucagaccaacaaggcuaaacacgaugagcucacauacuucuga

SEQ ID NO: 67960 - RNA, 1296 nt, Artificial Sequence
  derived and/or modified sequence opt5 from CSTF1__Homo_sapiens__NP_001315
auguacagaaccaaggugggccugaaggaccggcagcaacucuauaagcugaucauuagccagcuucuguacgauggguauaucuccauugccaacggacucaucaaugagauuaaaccccagucugucugcgcuccuagcgaacagcugcuucaccugaucaagcucggcauggagaacgacgauacagccguucaauacgcgaucgggcgcuccgacacgguggcuccgggaaccggcauugaucuggaguucgacgccgaugugcagacaaugucucccgaagccagcgaauaugagaccuguuacgucacaucccauaaagggccuugcagaguggcuaccuauucucgggacggacagcugaucgccacaggcagcgcugaugccuccauuaagauccucgacaccgagcgcaugcuggccaagagcgcgaugcccauugaaguuaugaugaaugagacggcucagcaaaacauggaaaaucacccugugaucagaacccuuuacgaucaugucgacgaggugacaugucuggccuuucaccccaccgagcagauucucgcuucuggcucccgggauuacacacugaaacuuuucgacuauagcaagccuucugccaaacgcgcguuuaaguacauccaggaagccgagaugcugagauccaucagcuuccauccgucuggggacuuuauucucguuggaacccagcaccccacgcugcggcuguaugauaucaacacauuccaaugcuuuguguccuguaauccucaggaccagcacaccgaugcuauuugcagcgucaacuacaauuccucugccaacauguaugugacaggcagcaaagacggguguaucaagcucugggauggaguguccaaucgcugcauuaccaccuucgaaaaggcucaugacggcgccgaggucuguagcgccaucuuuucuaaaaacuccaaguacauccugagcucugggaaagauagcguugcuaaacuuugggaaauuuccacaggaagaacgcuggugcgguauaccggcgcgggccucucugggcgccaagugcacagaacacaggccgucuucaaucauaccgaggacuacgugcugcuucccgaugagcggacaaucagccugugcuguugggacucccgcaccgcugaaagacggaaccuccugagccugggacacaauaacauuguuagaugcaucgugcacucuccuacgaaccccggcuuuaugacaugcuccgaugacuuccgcgcccgguuuugguacagacgcagcaccaccgacuga

SEQ ID NO: 67961 - RNA, 1734 nt, Artificial Sequence
  derived and/or modified sequence opt5 from CSTF2__Homo_sapiens__NP_001316
auggccggccugaccgugagagaccccgcugucgaucggagccuccgcuccguuuucguggggaacaucccuuacgaggccacagaggaacagcugaaggacaucuuuucugaagugggaccggucgugagcuucagacuuguuuaugaucgggagacgggcaaacccaagggguacggauuuugcgaauaucaagaccaggagaccgcgcuguccgcuaugcgcaaucucaacggcagagaguucucugggcgggcccugcgcguggauaaugccgcuagcgagaaaaacaaggaagaacuuaaaucccugggaacaggcgccccugucauugagucucccuacggcgagaccauuagcccugaagacgcucccgaguccaucagcaaggccguggcgucucucccuccggaacagauguuugagcugaugaagcagaugaaacuguguguucaaaauagcccccaggaagccagaaacaugcuccugcagaauccucagcuugcuuaugcccugcuccaagcucagguggucaugcggauuguggaucccgagaucgcccugaagauccuucaccgccagacaaacauuccuacccugaucgcggggaauccccagccggugcauggagccggcccuggguccggaucuaacgucuccaugaaucaacagaacccccaggcuccucaagcccagagccucggcgggaugcacguuaauggagcuccuccccugaugcaggccucuaugcagggcggcgugcccgccccggggcaaaugcccgcugcggugacaggaccuggccccgggucccuggccccuggaggcgggaugcaggcucaggucggaaugcccggcagcggcccgguguccauggagagagggcagguuccuaugcaagacccccgggccgccaugcagcgcggaucucucccugcuaacgugcccaccccuagaggccugcuuggggaugcccccaaugacccgcggggaggcacgcugcucagcgucaccggggaaguggagccucgcggcuaccugggaccuccccaucaggggcccccgaugcaccauguucccggccacgaauccagaggaccucccccucacgagcuucggggcgggccccugccugaacccagaccgcucauggcggagccucgcggacccaugcuggaucagcggggcccuccccuggacgggagaggcggacgcgauccgcggggcauugacgcuagagggauggaggcccgcgccauggaagcucggggacucgacgccagaggccuggaggcucgcgccauggaagcgcgggccauggaggcuagagccauggaagcucgcgccauggaggcgcgggccauggaggugagagggauggaagcucggggaauggauacacgcggcccuguccccgggccuagaggccccauccccagcggaaugcaaggcccuucuccgauuaacaugggggccguggucccccagggauccagacaggugccuguuaugcagggcaccgggaugcaaggagcuagcauccagggcgggucucagcccggcggauucagcccuggccaaaaccaggugacaccccaggaccaugagaaagccgcccuuauuaugcagguccugcaacucaccgcugaucagaucgcgaugcugccuccggaacagcggcaguccauccuuauucugaaggagcaaauccagaaaucuacgggggcccccuga

SEQ ID NO: 67962 - RNA, 1851 nt, Artificial Sequence
  derived and/or modified sequence opt5 from CSTF2T__Homo_sapiens__NP_056050
augagcucccuggccgugagagaccccgcuauggaucggucucuccgcagcgucuucguuggcaacaucccuuacgaggccaccgaggaacagcugaaggacaucuuuuccgaaguggggucuguggucagcuucagacuuguguaugaucgggagacaggaaaaccgaagggcuacggguuuugcgaauaucaagaccaggagacggcgcuguccgcuaugcgcaaucucaacggaagagaguucucuggccgggcccugcgcguugauaaugccgcuagcgagaaaaacaaggaagaacuuaaaucccuggggcccgccgcuccuauuauugacagccccuacggagauccuaucgaccccgaggaugccccugagucuauuaccagagcgguggccucccucccgcccgaacagauguuugagcugaugaagcagaugaagcuguguguccaaaauagccaccaggaagcucggaacaugcuccugcagaauccucagcuugccuaugcucugcuccaagcccaggugguuaugcgcaucauggaccccgagaucgcgcugaaaauucuucauagaaagauccacgugacaccucugauucccggcaaaucucaguccgucagcgugucuggcccggggccuggacccggcccugggcucugccccggacccaacgugcugcugaaucagcaaaacccuccggcuccccagccucagcaucucgcccggcgccccgucaaggauaucccuccccugaugcaaaccccgauucagggcgggaucccugcccccggaccuauucccgcugccguuccuggcgccggccccgggucccuuacaccgggaggcgcuaugcagccucagcuggggaugcccggagugggccccgugccucucgaaagagggcaaguccagaugagcgacccgcgggcgcccaucccucgcggacccgugaccccuggcggccugcccccuagagggcuucugggagaugcccccaaugacccgcggggcgggacacuccuguccguuaccggagagguggagccuagaggcuaccuggggcccccucaccagggacccccgaugcaucacgcuucuggacacgacacgcgcggcccuagcucccaugaaaugagagggggaccccucggcgauccucggcugcuuaucggggagccccgcggacccaugauugaccagcggggccugccuauggaugggagaggcggacgcgacagccgggccauggaaaccagagccauggagacagaaguccucgagacccgcgugauggagcggagaggcauggaaacaugugcuauggagacccgcgggauggaagcccggggaauggaugcgagaggccuggagaugcgggggccgguucccucuucccgcggaccuaugacgggcgggauccaaggccccggaccuauuaacaucggcgcugggggacccccucagggcccgagacaggugcccgggauuagcggagucggcaauccuggggccggcaugcagggaacaggcauccaagggaccggaaugcagggcgccgggauccagggaggcggcaugcagggggcuggcauucaaggcgugucuauccaagggggaggcauucaagggggaggcauccagggcgccagcaaacaagggggaucccagcccucuagcuucuccccuggccagagccaggucacaccccaggaccaggaaaaggcugcccuuauuaugcaagugcugcagcucaccgcggaucagaucgccaugcugccgccugagcagcggcagucuauccugauucucaaggagcagauccagaaauccaccggggcuagcuga

SEQ ID NO: 67963 - RNA, 438 nt, Artificial Sequence
  derived and/or modified sequence opt5 from CSTL1__Homo_sapiens__NP_612140
augggcaucgggugcuggagaaacccccugcuccugcuuauugcccuggugcucagcgcuaagcugggacacuuccagcggugggagggcuuucaacagaaacuuauguccaagaaaaauaugaacucuacccugaauuucuuuauccagagcuacaacaaugccuccaacgacacauaucucuaccgcguccagagacugauucggucucaaaugcagcugacgaccgggguugaauauaucgugacagugaagauuggauggaccaaauguaagcgcaaugauacaagcaacuccucuugcccucuccagagcaagaaacugagaaagucccuuaucugugagagccugaucuacaccaugccguggauuaauuauuuccagcucuggaacaauucuugccuggaagcggagcaugucggccggaaccuucgcuga

SEQ ID NO: 67964 - RNA, 570 nt, Artificial Sequence
  derived and/or modified sequence opt5 from CT45A1__Homo_sapiens__NP_001017417
augaccgacaagacagagaaaguggccgucgaucccgaaacgguuuucaagagaccucgggagugcgacagcccguccuaccagaaacgccaaagaauggcucugcucgcccggaagcagggcgcgggggauucucugaucgcuggaagcgccauguccaaagccaagaaacuuaugaccggccacgcuauucccccuucucagcuggacagccagaucgaugacuuuacaggguucuccaaggaucgcaugaugcaaaagcccggaucuaacgccccugugggcgggaaugugaccagcuccuuuagcggagacgaucucgaauguagagagacagcuucuucccccaaaagccagcgggaaauuaacgccgacaucaagcgcaaacuggucaaggagcuuagaugcgugggccagaaguaugagaaaauuuucgaaaugcuggagggcguucaggggccuaccgcggugcggaagcgcuuuuucgaaucuaucaucaaagaggccgcuagauguaugcggcgcgauuuugucaagcaucucaaaaagaaacugaagagaaugauuuga

SEQ ID NO: 67965 - RNA, 795 nt, Artificial Sequence
  derived and/or modified sequence opt5 from CT55__Homo_sapiens__NP_001026875
augcugagacuccugcggcuugcccuggcuuucuacggccgcaccgccgaccccgcggagagacaggggccucaacagcagggacucccgcagggcgauacacaacugacgaccgugcagggggucguuaccagcuuuugcggagacuauggcaugaucgaugaauccauuuacuucucuagcgacguggugacagggaacgucccccuuaaggugggacagaaaguuaauguggucguggaggaagauaagccucacuauggccugcgggcuaucaaaguugacguggucccccgccaucucuacggcgccgggccuuccgauucuggaacaagagugcugauuggcugugugaccagcaucaacgaggacaauauuuauaucuccaacucuaucuacuuuagcauugccaucgucuccgaagauuucguucccuauaagggggaccugcucgagguggaguacagcacagaaccuggaauuucuaauaucaaagcuaccuccgugaagccgauucggugcauccacacggaggaagucuguauuaccagcgugcauggccgcaacgggguuaucgauuacacaaucuuuuucacccuggacucugugaaacuucccgauggauaugucccucagguggacgacauuguuaauguggucaugguggaguccauccaauuuugcuucauuuggagagccaucagcauuacacccguccacaagucuuccagcggcuuucaggaugacggcgggcugggacggccuaagcgcgagagacggucccagucuaucuga

SEQ ID NO: 67966 - RNA, 342 nt, Artificial Sequence
  derived and/or modified sequence opt5 from CT83__Homo_sapiens__NP_001017978
augaacuucuaccugcuccuggccagcuccauccuuugcgcucugauuguguuuuggaaguauagacgguuccagcgcaauaccggcgagaugucuagcaacuccacagcccucgcgcuggucagacccucuagcuccgggcuuaucaauucuaacacggacaauaaccuggcuguuuacgaucucagccgggacauucugaauaacuuuccucacuccaucgcccgccaaaaacggauucuggugaaucucagcaugguggaaaacaagcuggucgagcuugaacauacccugcucucuaaaggauucagaggcgccuccccgcaccgcaagagcacauga

SEQ ID NO: 67967 - RNA, 543 nt, Artificial Sequence
  derived and/or modified sequence opt5 from CTAG1A__Homo_sapiens__NP_640343
augcaggccgagggcagagggaccggaggcagcacaggggacgcugauggacccggcgggccuggaaucccggacggccccggcgggaacgccggaggcccuggggaagcgggagcuacgggcgggcggggaccccgcggcgccggcgccgcuagagccuccgggccuggaggcggggcuccccggggaccucacggcggggccgcgucuggacugaauggcugcugucgcugcggcgccagagggccggagagccggcuccuggaguucuaccuugcuaugcccuuugccaccccuauggaagcugaacuggcccgcagaucccucgcgcaagaugcucccccucugcccgugccgggaguccuucugaaggaguucacaguuucuggcaacauucucaccauccggcugacagccgccgaccaucgccagcugcagcucagcauuuccucuugucugcagcaacuuagccugcucauguggaucacccagugcuuucugccuguguuccuugcucagcccccuuccgggcagagacgguga

SEQ ID NO: 67968 - RNA, 633 nt, Artificial Sequence
  derived and/or modified sequence opt5 from CTAG2__Homo_sapiens__NP_066274
augcaggccgagggcagagggaccggaggcagcacaggggacgcugauggacccggcgggccuggaaucccggacggccccggcgggaacgccggaggcccuggggaagcgggagcuacgggcgggcggggaccccgcggcgccggcgccgcuagagccuccgggccucggggaggcgcuccccgcgggccucacggaggcgccgcgucugcccaagaugggagaugcccguguggagcucggcgccccgacagcagacugcucgagcugcauauuaccaugccuuucuccucucccauggaagccgagcuugugcggcgcauccugagcagagaugcugccccucucccccggccgggcgcgguccugaaggacuuuacaguuuccggcaaucuucuguucaugucugugcgcgaucaggacagagaaggggccggacggaugcgcguggucggcugggggcucggaagcgcuuccccugagggccagaaagccagagaucugcggacccccaagcacaaagugagcgagcagagaccugggacacccggacccccuccgcccgaaggcgcucaaggcgacgggugccgcggaguugccuuuaacgugauguucucugccccucauauuuga

SEQ ID NO: 67969 - RNA, 2238 nt, Artificial Sequence
  derived and/or modified sequence opt5 from CTAGE1__Homo_sapiens__NP_758441
augagacccgacagccacccuuacggcuucccgugggagcuggugauccgggccgcugucgccggguuuuucgcgguucucuuucuguggcgcuccuucagaucugugaccagccggcuuuaugugcgcagagaaaagaaauuugcugucgcccuguccggacucauugaggaaaagugcaaacugcuugagaaguucucucuggugcagaaagaauacgagggcuaugagguugaaagcucccucaagaacgccucuuuugagaaggaagcuacagaggcccaaagccuggaggcuacgugugaaaaacugaaucgguucaacuccgagcucgugcaugaaauccugugccuugagaaggaacugaaagaggaaaagagcaaacacucugaacagaaugagcucauggccgauauuuccaagcgcauccagagccuggaagacgagucuaagucccuuaaaagccaggucgcggaagccaagaugaccuuuaaaagauuccaagcuaacgaggagcggcuggaaauugagauccaggaugccuggaaggaaaauucugagcuccaggaaucccagaaacaacugcugcaggaggcugagguguggaaggaacagguuagcgagcucaucaaacagaagcgcacauuugaagacuccaaggugcaugccgagcaaguccugaacgauaaagagaaucacauuaagacccuuacagaaagacugcucaaaaugaaggacgggguggcgaugcuggaggaagaugugaccgacgaugacaaccuugagcuggaaaugaacucugagagcgaggauggagccuaccucgacaaucccccuaaaggcgcucugaagaagcugauccaugccgcuaaacucaaugccucccugaagacacuugaaggggagcggaaccagauuuauauccagcugagcgaagucgauaaaaccaaggaggaacucacggagcacauuaaaaaucugcaaaccgagcaggccucucuucaguccgaaaacacacacuucgagagcgaaaaucagaagcugcaacagaagcucaaaguuaugaccgagcuguaccaggaaaacgagaugaagcuguaucgcaaacucaucguggaggaaaaguguagacuggagaaagaagagaaacuuucuaagguggacgagaugauuagccaugcuacagaggagcuggaaaccuaccggaagcgcgcgaaggaccucaaagaguuugaaaagacgauccacuucuaccagaaaaagaucauucugcaugagaaaaaggcccacgauaacugguccgcugccuggacagccgagagaaaucugaacgaccuucggaaggaaaaugcucacaacagacaaaaacucaccgagaucgaguucaagauuaaacugcuggaaaaggaucccuauggacucgacgucccuaauacagccuuuggccgccagcauucucccuacggcccuagcccgcugggguggcccuccagcgaaacccgggcgucucuuuauccucccacccugcucgagggaccucugagacugagcccccuucucccgcgcggcgggggacggggcuccagagggccuggaaaucccccugaucaccagaucacaaaagagcgcggcgaaucuuccugcgaccggcugacggauccccauagagcucccagcgacgccggcccucuggccccgcccugggagcaggauuaccgcaugauguucccucccccugggcaauccuaucccgacucugcucucccgccucagcggcaggauagauuuuacagcaacugugcccgccuguccggacccgcugaacuucggucuuucaacaugccuagccuggacaagauggacggcuccaugcccagcgagauggaaucuuccagaaaugauaccaaggacaaccucgggaaucugaaagugccugauagcucucugcccgccgagaacgaggcgacaggaccgggcuuuguuccuccuccccuugcccccauucgggggcuccuguucccgguggacacccgcggacccuuuaucagacggggcccucccuucccucccccucccccgggcacagucuuuggggcuuccccugauuauuucagccccagagacgugccuggacccccgcgcgccccuuuugcuaugcggaauguuuaccugcccagaggcuuccucccuuaccgcccucccagacccgccuuuuucccgcccgcgccuaccuucuga

SEQ ID NO: 67970 - RNA, 2430 nt, Artificial Sequence
  derived and/or modified sequence opt5 from CTAGE5__Homo_sapiens__NP_001234918
auggaggaacccggcgugaccccucagccguaccuggggcuccugcuugaggaacugagacgggucguugccgcucuccccgagggaaugcgcccugacagcaaccuguauggcuuccccugggaacuugugaucugcgccgcgguggucggguuuuucgcugugcuguuuuuccucuggagauccuuucggucuguucgcagcagacuguacgugggacgggagaagaaacuggcccucaugcuguccggccuuaucgaggaaaagucuaaacugcucgagaaguucagccugguccaaaaagaauaugagggguacgagguggaauccucucuuaaggaugccagcuuugagaaggaagcuacagaggcccagucccuggaaguugagaaucagauggcuacgugugagaaacucaaccgcagcaauucugaacuggaggacgaaauccugugccucgagaaggaacugaaagaggagaaguccaaacacagcgaacaggaugagcuuauggccgacauuucuaagagaauccaaucccuggaagaugagagcaagucucucaaaucccagguggcggaagccaagaugaccuucaaaauuuuucagaugaacgaggagcggcugaagaucgcuaucaaagacgcccuuaaugaaaacagccagcugcaagagucccagaagcagcuccugcaggaagcugaggucuggaaagagcaagugucugaacugaauaagcagaaggugacauucgaggauagcaaaguccaugccgaacagguucucaacgacaaggagucccacauuaaaacccugacagaacgccuucugaagaugaaagauugggcggccaugcucggagaggacaucaccgaugacgauaaucuggagcuugaaaugaacagcgagucugaaaauggcgcuuaucuggacaacccucccaagggcgcccucaagaaacugauucaugcugccaagcugaaugccucccucaaaacacuggagggggaaagaaaccaaaucuacauucagcuuagcgagguggacaagaccaaagaggaacugacggagcacaucaagaaucuccagaccgaacaggcuucucugcaaagcgagaacacacauuuugaaaacgagaaucagaagcugcagcagaaacuuaaggugaugaccgagcucuaucaagaaaacgagaugaaacugcaccggaagcugacagucgaagagaauuaccgccucgagaaagaagagaagcuguccaagguggaugagaaaauuucucacgcgaccgaagaacuugagacguacagaaagcgggccaaagaccuggaggaggaacucgaacgcacaauccauagcuaucagggacagaucauuucccacgagaagaaagcucaugauaacuggcuggccgccagaaaugcugaacggaaccugaaugaccuuagaaaggagaacgcccacaaucgccagaaacucaccgagacagaacugaaguucgagcugcucgaaaaggauccuuacgcgcuggacguuccgaacaccgcuuuuggccgggagcacagccccuaugggccuucuccccuuggauggccuuccagcgaaaccagagccuuccugucucccccgacacuccuggagggcccucugcgccuuagcccccuccugccugggggaggcggccgggggagcagaggacccggcaauccccuggaucaucaaaucacgaacgagcgcggggaauccucuugugaccggcucaccgauccucacagagccccgagcgacacaggaucccugucucccccuugggaucaggaccgccggaugauguuucccccucccggccagagcuacccggacuccgcccuuccuccccagagacaagaucgcuucugcagcaauucugggcggcuguccggaccugcugagcucagauccuucaacaugcccucucuggacaaaauggauggcuccaugccuagcgaaauggagucuagccggaaugacaccaaggaugaccugggcaaccuuaacgugcccgauuccagccucccggcugagaaugaagccacagggccuggauuugucccuccgccccuggcgcccauucgcggcccccuguucccuguggacgccagagggcccuuucuccggagaggaccucccuucccucccccgccucccggcgcuauguuuggggccucucgcgauuauuucccucccggcgacuuuccgggaccucccccugcucccuucgccaugcggaacguuuaucccccuagaggcuuuccgcccuaccugccuccccgcccuggguucuuucccccuccgccccauuccgagggaagaagcgaguucccuuccggccuuauucccccuucuaaugaacccgcgaccgaacacccggagccucagcaggagacguga

SEQ ID NO: 67971 - RNA, 1290 nt, Artificial Sequence
  derived and/or modified sequence opt5 from CTBP1__Homo_sapiens__NP_001012632
augagcggcgugagacccccuaucaugaacgggccgcugcacccccggccucucgucgcccugcuugacggacgcgauugcaccguugagaugcccauucugaaggacguggcuacaguggccuucugugaugcgcaguccacgcaagaaauccaugagaaaguccucaaugaagcugugggcgcccugauguaccacaccauuacacuuaccagagaggaccuggaaaaguuuaaagcccuccggaucauuguucgcaucgggucuggauucgauaacaucgacauuaagagcgcuggcgaucuggggaucgccgugugcaaugucccugcugccuccguggaggagacagcggacucuacccugugucauauucucaaccuguauagacgggccacauggcuucaccaggcucugcgcgaaggaaccagaguucagagcguggagcagauccgggaagucgccuccggcgcugcccgcauuagaggcgagacgcucgggaucauuggacugggccggguggggcaagcgguggcccuucgcgcuaaagccuuuggauucaauguccuguuuuacgaucccuaucucucugacggcguugagagagcucuggggcugcagcgggugagcacccuccaggaucugcuuuuccauuccgacugcgugacacugcacuguggacucaacgaacacaaucaucaccugaucaacgauuuuaccgucaagcagaugcgccaaggcgccuuccuugugaauacagccagaggcgggcugguugacgagaaggcucucgcgcaggcccugaaagaaggacggaucagaggcgcugcccuggacgugcaugagagcgaaccuuuuucuuucucccaggggccgcucaaggaugcccccaaccugauuugcaccccucacgcugccugguacagcgagcaggcgucuaucgagaugcgcgaagaggcugcccgggaaauuagacgcgccaucacgggacggauucccgacucccuuaaaaauugugucaacaaggaucaccugacagcugccacccauugggcuagcauggacccugccgugguucaccccgagcucaauggcgcggccuauagauacccgccugggguggucggaguggcucccacaggcaucccugccgcugucgaaggcaucgugcccucugccaugucccugagccaugggcuucccccuguugcgcacccgccccaugccccuucccccggacaaaccgugaaaccugaggcugaucgcgaccacgccucugaucagcuguga

SEQ ID NO: 67972 - RNA, 1338 nt, Artificial Sequence
  derived and/or modified sequence opt5 from CTBP2__Homo_sapiens__NP_001277143
auggcccugguggacaagcacaaagucaagagacagcggcucgaucgcaucugcgagggcauuagaccccaaaucaugaacgggccucugcauccgcggccccuuguugcucugcucgacggacgcgauuguaccguggaaaugccuauucugaaagaccuugccacaguggcguucugcgaugcucagagcacgcaggagauccacgaaaagguccugaaugaggccgugggcgccaugauguaccauaccauuacacucaccagagaagaccuggagaaauuuaaggcucugcggguuaucgugcgcaucggguccggauaugauaacgucgacauuaaggccgcuggcgagcucgggaucgccguguguaauauucccucugcggccguugaagagacagcugauagcaccaucugccacauucugaaccuuuacagacggaauacauggcuguaucaggcccuccgcgaaggaaccagagugcaauccgucgagcagauccgggagguggcuucuggcgccgcgcgcauuagaggcgaaacgcuggggcuuaucggauucggccggaccgggcaggccguggcuguccgcgccaaggcuuuuggauucagcguuaucuuuuacgacccuuaucugcaggauggcauugagagaucccucggggugcaacggguguacacacugcaggaccugcucuaucagucugauugugucagccugcauugcaaccuuaaugaacacaaccaccaucugaucaaugacuucaccauuaaacagaugagacaaggagccuuucucgugaacgccgcucgcggcggccugguugacgagaaagcgcuugcccaggcucugaaggaagggcggaucagaggagccgcccucgaugugcacgaguccgagcccuucagcuuugcucagggcccucugaaagacgccccgaaucugauuuguacaccccauaccgcgugguacucugaacaggcuucccucgagaugcgcgaagccgccgcuacggagauccggagagccaucacagggcgcauuccugaaagccugcggaacugcgucaauaaggaguucuuugugaccucugcucccugguccguuaucgaucaacaggccauucacccugagcuuaacggagcgacauacagauaucccccgggcaucgugggggucgccccuggaggccugcccgcugccauggaaggcauuaucccugggggaauccccgugacccacaaucuccccaccgucgcucauccuagccaggccccgucucccaaccaaccuacaaagcacggcgacaaccgcgagcaucccaaugaacaguga

SEQ ID NO: 67973 - RNA, 3654 nt, Artificial Sequence
  derived and/or modified sequence opt5 from CTC1__Homo_sapiens__NP_079375
auggccgcuggcagagcccaggugcccagcuccgagcaagcguggcuggaagacgcucaggucuucauccagaagacccucugcccugccguuaaagagccgaacgugcagcugacaccccuugugauugauugugucaagacgguguggcugucucaagggcggaaucagggaagcacccucccucuguccuacucuuuuguuagcgugcaggaccuuaaaacacaccagcgccugcccugcuguucccaucucucuuggagcuccagcgccuaucaggcuugggcccaggaagcuggcccuaacgggaauccccugccuagagagcagcugcuccugcuuggaacccugacagaucucucugccgaccuggaacaggagugccggaacggcucccuuuacguccgcgauaauaccggggugcugagcugugagcucaucgaccuggaucugucuuggcucggacaccuguuccuuuuuccgagaugguccuaucugcccccugcgcgguggaacagcucuggcgaaggccaucucgagcugugggacgcccccguuccuguguucccccuuacaauuuccccggggccugucacccccaucccugugcuguaccccgaaagcgcuuccugccuccugcgccugagaaauaagcuccggggagugcaacgcaaccuggccggcucucuugucagacugagcgcucucguuaaauccaagcagaaggccuauuuuauucugagccuugggcggucucaccccgcggugacgcauguguccaucaucguccaggugccugcccaacugguuuggcaccgcgcucucagaccgggaaccgccuacgugcugacagagcugcgggucagcaaaauucgcggccagagacagcacguguggaugaccucucagagcucccggcuccugcuucugaagcccgaguguguucaagaacucgagcuggaacuggaggggccucuucucgaagcugaucccaaaccucugcccaugccgucuaauagcgaggacaagaaagauccugagucccuggugagauauagccgccuccugucuuacuccggagccgucacaggcgugcuuaacgaacccgccggccuguacgagcucgacgggcagcugggacugugccuugcuuaucagcaguuccggggccucagacgcgucaugcggccuggggugugucugcaacugcaggauguucaucuccugcagagcgugggaggcgggaccagacgccccguccuugcgccuugccugcggggagccgugcuccugcagucuuuuuccagacaaaagcccggcgcucacagcucccgccaggccuacggcgccucucuguaugaacagcuuguuugggagcggcagcucgggcugccgcuguaccucugggcuacgaaggcccuggaagaacuugcguguaaacugugcccucaugugcucagacaccaccaauuccugcagcauagcucccccggaucucccagccugggccuucagcuccuggcuccuacacuggaccuccuggccccgcccggguccccuguccgcaaugcccacaacgagauccuugaggagccccaucacugcccucugcaaaaguauacccggcuccagacacccagcucuuuuccuacccuggcuacccugaaagaagagggacagagaaaggccugggcuuccuucgaccccaaagcccuucugccgcucccugaagcgagcuaccugcccucuugucagcucaaucggcgccuggccugguccuggcuuugccugcucccuagcgcuuuuugucccgcccaagugcugcugggcgugcuuguugcuucuagccauaaggggugccugcagcucagagaucaguccggcagccugccgugucuccugcuugccaaacacucucagccucuguccgacccccggcucauuggaugccuggucagagcggagcgcuuccaacugaucguggagcgggaugugagaagcuccuuuccuucuuggaaggaacuuagcaugcccggcuucauucagaagcagcaggcccgcgucuaugugcaauucuuucuggcugacgcccucauccugcccguuccuagaccgugucuccacuccgcuacacccucuacgccucagaccgaucccacagggccugagggaccccaucugggccagagccggcuuuuccugcugugccacaaagaagcccucaugaagcgcaacuuuugugugccuccgggggccucccccgaggucccuaaacccgcucugucuuucuacgugcuuggaagcuggcugggcgggacccaaagaaaggagggcacaggauggggccucccugaaccccaggggaaugacgauaacgaccagaaaguucaucugauuuucuucggauccagcgugcggugguuugaguuccuccacccgggccaggucuaccgccugaucgcgccugggcccgccacccccaugcuuuuugaaaaggauggaucuuccugcaucagcagacggccucuggagcuggcuggcugugccucuugccucacggugcaagacaacuggacacuggaacuugaguccagccaggauauucaggacguucuggacgccaauaagucucuccccgaguccagccugaccgaucuccuguccgacaacuucaccgauagccuugugucuuuuagcgcugaaauccugucccgcacacugugcgagccucucgucgccucucuguggaugaaacuugggaauaccggcgcgaugagacggugugugaagcugacaguggcucucgaaacggccgagugcgaauuuccgccccaccuggacgucuauauugaggauccucaucugcccccuagccucggacuucugcccggcgcccgcguucacuuuucccagcuggagaaaagagugucucggagccauaacguguacuguugcuucagauccucuaccuauguccaagugcucagcuucccgccugaaacaaccaucuccauuccccugccucacaucuaccuugcugagcugcuccaagggggacagagccccuuucaggccacagcgucuugucauaucguuuccguguucagccugcaacuguuuugggucugcgcuuauuguaccucuauuugccgccagggcaaguguacgcggcucggguccacaugcccuacccagaccgccaucagccaggccauuaucagacuucugguggaagacggaacagcugaggccguugugaccugucgcaaucaccacgucgcugccgcgcugggccucugcccccgggaaugggccucccugcuugauuucgugcaaguuccggggagagugguccugcaguuugcuggcccuggagcccagcucgagucuagcgcucgcguggacgagcccaugacgauguuccuguggacacugugcaccucccccagcgugcuccggccuauuguccuuucuuuugaacuggagagaaaaccguccaagaucguuccccuggaaccuccccgccuccaacgguuccaguguggcgagcugccuuuucuuacacaugugaaccccagacugcggcucagcugccugucuauccgcgagagcgaauacuccucuagccuggggauucucgccuccucuuguuga

SEQ ID NO: 67974 - RNA, 1200 nt, Artificial Sequence
  derived and/or modified sequence opt5 from CTCF__Homo_sapiens__NP_001177951
auggccuucgugaccagcggcgagcuggucagacaccggcgcuacaagcauacacacgaaaaacccuuuaagugcuccaugugugacuaugcuucuguugaggugagcaaacucaagagacauauccggucccacacgggggaacgcccuuuccagugcucucuguguagcuacgccuccagagauaccuauaaacuuaagcggcauaugcgcacacacucuggagagaagccguacgaaugcuauauuugucacgcgagauuuacccaaagcggcacaaugaaaaugcauauccugcagaagcacaccgagaacguggcuaaauuccauugcccccacugugacacagucauugcccggaaguccgaucucggggugcaucugcgcaaacagcacagcuacaucgagcagggaaagaagugcagauauugugacgccguuuuucacgaacgguacgcucuuauucaacaucagaaaucucacaagaaugagaaacgcuucaagugcgaucagugugacuacgccugcagacaggaacggcauaugaucaugcacaaacgcacccacacgggcgagaagccuuaugcuugcucccauugugauaaaaccuuuagacaaaagcagcugcucgacaugcacuucaagcgguaccaugaucccaacuuugugccugccgcguucgucugcagcaaaugugggaagacauuuaccagacgcaauacaauggcccggcacgcugacaacugcgccggacccgauggcguggagggcgaaaaugggggagagaccaaaaagucuaaaagaggccgcaagcggaagaugagauccaaaaaggaagacagcucugauuccgagaacgcugaaccugaccuggacgauaaugaggacgaggaggaaccggccguugaaaucgagcccgaaccugagccccagccugugacgcccgcgccgccucccgccaaaaagcgccgggggagaccucccggacgcacaaaccagcccaaacaaaaucagccuaccgcuauuauccaggucgaggaucaaaacacaggcgccauugaaaauaucauuguggaggugaagaaggaaccggacgcugagcccgccgaaggggaggaggaagaggcccagccugcugcgaccgaugcccccaacggagaccugaccccugaaaugauccucagcaugauggaucgguga

SEQ ID NO: 67975 - RNA, 1992 nt, Artificial Sequence
  derived and/or modified sequence opt5 from CTCFL__Homo_sapiens__NP_001255970
auggccgcuaccgagaucagcgugcuguccgaacaguucacaaagauuaaagagcucgaacugaugcccgagaagggccuuaaagaagaggagaaggacggggucugcagagaaaaagaucaccggucuccuagcgagcuggaagccgagcgcacguccggagcguuucaagacucuguucucgaggaagagguggaacuggugcuugcuccgagcgaggaauccgagaaguacauccugacccuccagacaguccauuucaccucugaggccguggaacugcaggauaugagccugcucuccauucagcaacaggagggcguucagguggucgugcagcaacccgggccuggacugcuuuggcuggaagagggccccagacagagccuccagcaguguguugccaucucuauucaacaggaacuguauuccccucaggagauggaggugcuucaauuucacgcucuggaagagaacgucaugguggccagcgaagacucuaagcucgcugugucccuggccgagacaaccgggcugaucaaacucgaagaggagcaggaaaagaaucagcugcuugcggagcggacaaaagaacagcuguucuuugucgagaccaugagcggagaugagcgcucugacgaaaucguucucacgguguccaacagcaauguggaggaacaagaggaucagcccaccgccggccaggcugacgccgaaaaggcuaaauccacaaagaaccagagaaagaccaaaggcgccaaggggacauuccauugcgaugucuguauguuuaccucuagccggauguccagcuucaaucgccacaugaaaacgcauacaucugagaagccucaccugugccaccuuugucugaaaaccuuuagaacagugacccuccugcggaaccauguuaauacccacacaggaacgcgcccguacaagugcaacgacuguaauauggcguucgugaccuccggcgagcuggucagacaucggcgcuauaaacacacacacgaaaagcccuuuaagugcagcauguguaaauacgccucuguggaggcuagcaagcucaaaagacauguucggucccacaccggggaacgcccuuuccaaugcugucagugcucuuaugccagcagagauacauacaagcugaaacggcauaugagaacccacuccggagagaagcccuaugaaugccauauuugucacacgcgcuuuacacagagcggcaccaugaagauccacauucuucagaaacauggggagaacgugccuaaguaccaaugcccccacugugcuaccaucauugcccggaaaucugaccugagaguccauaugcgcaaucuccacgccuacuccgcugcggagcugaagugccgguauuguagcgccguguuccacgaaagauacgcucuuauccagcaucagaaaacacacaagaacgagaagcgcuucaaaugcaagcauuguucuuaugccugcaaacaggaacggcacaugaccgcccauauuagaacacacacgggagagaagccguuuaccugucuguccugcaauaaauguuuccgccaaaagcagcuccugaacgcucacuuucggaaguaccaugaugccaauuucaucccuacagucuauaaaugcagcaagugcggcaaaggcuuuuccagauggaucaaccugcaccgccauucugaaaagugugggagcggagaggcgaaauccgcugccucuggcaaggggcggagaacccggaaacgcaagcagacaauucucaaggaggccaccaaaggacaaaaggaagcugccaaaggcuggaaggaggcugccaacggggacgaagcggccgcugaggaggccagcacgaccaaaggagaacaguuccccggcgagauguuuccuguggcuugcagagaaacaaccgcccggguuaaggaggaaguggacgagggcgucacaugugagaugcugcuuaauaccauggauaaguga

SEQ ID NO: 67976 - RNA, 2886 nt, Artificial Sequence
  derived and/or modified sequence opt5 from CTDP1__Homo_sapiens__NP_004706
auggaggugcccgccgcuggcagagucccugccgaaggggcgccgaccgcugccguugccgaggugcggugccccggaccugcuccccugcgccuccuggaauggagaguggccgcuggcgccgcgguccggaucgggagcgugcuugccguuuucgaggcugccgcuuccgcccagucuagcggagcgucccaaucucgcguggccagcggcgggugugucagaccugcucggcccgaacgcagacugcgguccgagcgcgccggagugguuagagagcucugcgcucagccuggccagguggucgccccgggcgccgugcuggugcggcuugaaggguguucucaccccgucguuaugaagggacugugcgcugaguguggccaggaccucacacaacugcagagcaaaaacgggaagcaacaggugccucuguccacggcgaccgugagcaugguccauucugugcccgaacucaugguuuccagcgagcaggccgagcagcugggacgcgaagaucagcagagacuucaccggaaucgcaaacuggugcucauggucgaccuggaucaaacacuuauucauaccacagagcagcacugccagcaaaugucuaacaagggcaucuuucauuuccagcuggggagaggagaaccuaugcuccacacccggcugagaccccacuguaaagacuuucuggagaagauugcuaagcucuacgaacugcauguguucacauuuggcucccgccuuuaugcccacaccaucgccggcuuccuggauccggagaaaaagcucuuuagccaucggauucugucuagagacgagugcaucgauccuuucuccaaaacggggaaucuucgcaaccuguuucccuguggagacagcaugguuugcaucauugaugaccgggaagauguguggaaguucgcuccuaaucucaucaccgucaaaaaguacguguauuuucagggcacaggggacaugaacgccccucccggauccagagagucucagacccgcaagaaagucaaucacagccggggcacagaaguguccgagcccagcccgcccguuagagauccugaaggggugacccaagcgcccggagucgagccuucuaacggccuggagaagcccgcucgcgaacugaauggcuccgaggccgccacgccgcgggacagcccuagacccgggaaaccugacgaacgcgauauuuggcccccugcucaggcccccacaucuagccaggagcucgcuggagccccggaaccucagggcuccugugcgcaagggggacggguggcccccggccagagacccgcucagggggccaccggcacagaccuggauuucgaccuuucuagcgauuccgagagcagcuccgagagcgaaggaaccaagucuuccagcuccgcuucugacggcgagagcgaagggaaacggggacgccagaagccuaaagccgcgccggagggcgccggggcucuggcccaaggauccucucucgagcccggcagaccugcugcccccagccugccuggggaagccgagcccggcgcucacgcgccugauaaggaacccgagcuuggaggccaggaagagggggagcgggacggacugugcggccucgggaacggaugcgccgauagaaaggaagcugagaccgaaucccagaauagcgagcugucuggcguuacagccggggaaucccuggaccagagcauggaggaggaagaggaagaggauacggacgaagacgaucaucucaucuaccuggaggagauucuugugcgcguccacaccgacuauuacgccaaauaugaucgguaccugaacaaggaaaucgaggaagcuccggacauuagaaaaaucgugccugagcucaagucuaaagugcuggccgauguugcgaucauuuuuagcggccugcaucccacaaauuucccuaucgagaagacccgcgaacacuaccaugcuacagcccuuggagccaagauucucaccagacugguccugagccccgacgcuccggaucgggccacgcaccucaucgcggcucgcgccggcacagagaaagugcugcaagcccaggaaugugggcaccuucauguggucaacccugacuggcuguggucuugccucgagagaugggauaagguggaggaacagcuguucccccugcgggacgaucacaccaaagcucaacgcgagaauagcccugccgcuuuucccgacagagaaggaguucccccuaccgcccuuuuccauccgaugcccgugcucccuaaggcgcagcccggcccugagguccggauuuaugauuccaacacagggaaacugauccgcaccggagccagagggcccccugcuccgucuucuucccugcccauccggcaggaaccuagcuccuuucgcgccgugcccccuccccagccgcaaauguucggggaggaacucccugacgcucaggacggcgagcagcccggacccucuagacggaagagacagccuagcauguccgagacaaugccccuguacacgcuuuguaaggaagaucuggagucuauggacaaagaaguugaugacauucucggcgaggggagcgaugacuccgauucugaaaagcgccggccugaggagcaagaagaggaaccgcagcccagaaaaccuggaacccgccgggagagaacacugggcgcccccgccagcuccgagcgcagcgcugcgggcggacggggcccuagaggccacaagcgcaaacugaacgaagaggacgccgcuucugaauccagccgggagucuuccaaugaagaugagggguccucuuccgaggccgacgaaauggccaaggcucuugaggccgaacucaacgaucugauguga

SEQ ID NO: 67977 - RNA, 783 nt, Artificial Sequence
  derived and/or modified sequence opt5 from CTDSP1__Homo_sapiens__NP_001193807
augguggccgcucccugggccacccaggagcaagaagagggcagagggauccagccuggagaccggggcgaucaaaagagcgcggcuucccagaaaccgcgcucuagagggauucugcacagccucuucugcugugucugccgggacgauggagaagcccugcccgcccauuccggcgcuccucuucugguugaggaaaacggggccauccccaagacaccugugcaguaccuccugcccgaggcuaaagcccaggacucugauaagauuuguguggucaucgaccuugaugagacgcuggugcacagcuccuuuaaaccuguuaauaacgcggacuucauuaucccgguggaaaucgauggagucgugcaucagguuuaugugcucaagcgcccccacgucgacgaguuucugcagagaaugggcgaacuguucgagugcgugcucuuuaccgccucucuggcuaaguacgccgauccuguggcugaccuucuggauaaauggggcgccuuccgggcgcgccucuuuagagagagcugugucuuccaucgggggaauuauguuaaggaccugucccgccuuggaagagaccugcggcgcgugcucauucuggauaacagccccgccucuuacguguuucacccugacaaugcuguccccguggccuccugguucgauaacaugagcgacacagaacugcacgaucuccugccguuuuucgagcaacuuucuagaguugacgauguguauuccguccugcggcagccucgccccggcagcuga

SEQ ID NO: 67978 - RNA, 816 nt, Artificial Sequence
  derived and/or modified sequence opt5 from CTDSP2__Homo_sapiens__NP_005721
auggagcacggcagcaucauuacccaggccagacgggaagacgcucuggugcucacaaagcaagggcuggucuccaaaucuagccccaagaaaccucgcggaagaaacaucuucaaggcccuguuuugcuguuuccgggcgcagcauguuggccaguccucuagcuccacggagcuugcugccuacaaagaagaggccaauaccauugcuaagucugaucuccugcagugccuucaauaucaguuuuaccagaucccggggacaugucugcuccccgaagugaccgaggaggaccagggacgcauuugcguggucaucgaucuggacgaaacacuggugcacagcuccuucaagccuaucaacaaugccgauuuuauuguucccaucgagauugaaggcaccacacaucaaguguauguccucaaaagaccuuacguggacgaguuccugcggcgcaugggggagcuuuuugaauguguucuguucaccgcuagccucgccaaguaugcggaucccgugacggaccugcuugauagaugcggagucuuucgggcccgccuguucagagagucuuguguguuucaccagggcugcuacgugaaagaccucucccggcugggccgcgaucugagaaagacccucauccuggacaacagcccugcuucuuauauuuuccauccggaaaaugccguccccguucaguccugguuugaugacauggcugacacagagcuucugaaccucaucccuauuuucgaggaacugagcggggccgaggauguguacaccucucuuggacagcugcgggcgcccuga

SEQ ID NO: 67979 - RNA, 831 nt, Artificial Sequence
  derived and/or modified sequence opt5 from CTDSPL__Homo_sapiens__NP_001008393
auggacggcccugccaucauuacccaggugacaaacccuaaggaggaugaagggagacugccgggagcuggcgagaaagccagccaaugcaaugucucccucaagaaacagcggucucgcagcauccuguccucuuucuuuuguugcuucagagacuacaacguugaagcgcccccucccagcuccccuucugugcuucccccucugguggaggaaaaugggggacuccagaagggcgaucagcggcaagucauuccgauccccagcccucccgcuaaauaucugcuuccugaggugacgguucuggacuacgggaagaaguguguggucauugaucucgacgagacccuggugcacuccagcuuuaaacccaucucuaacgccgauuucaucguuccgguggaaauugacggaacaauccaucaggucuaugugcugaagcgcccucacguggaugaguuucuccagagaaugggccagcuguucgaaugcguccuuuuuaccgccucccuggcuaaauacgccgaccccguugcugaucuccuggaccgguggggcguguuccgcgccagacuuuuucgggagagcuguguguuccaucgcgggaauuaugucaaggaucugucuagacucggacgggagcuguccaaagugauuaucguugacaacagcccugcgucuuacauuuuucaccccgaaaaugccgugcccguccaauccugguucgacgauaugacagacaccgagcugcucgaucugauccccuuuuucgaaggccuuagccgcgaggacgauguguauuccaugcugcauagacucugcaaccgguga

SEQ ID NO: 67980 - RNA, 603 nt, Artificial Sequence
  derived and/or modified sequence opt5 from CTF1__Homo_sapiens__NP_001136016
augagcagacgggagggcucccuggacccccagaccgauucuagcgugucccuccugccucaccuugaagccaagauccgccaaacacauucucuggcucaccuccugacgaaauacgccgagcagcuucugcaggaauauguccagcuccaaggggacccguucggacugcccagcuuuuccccucccagacugccuguugcgggccucucugcucccgccccuagccaugccgggcugccggugcacgagcggcuucgccuggaugcugccgcucucgccgcgcugcccccucuucuggacgccgugugcagacggcaggcugaacucaacccccgcgccccuagacugcugcggcgccucgaggaugcugccagacaggcgcgggcccugggagcugccgucgaggcccuucuggcugcccucggcgcugcgaaucgcgggcccagagccgaaccgccugcugccaccgccuccgcugccagcgcgacaggaguguuccccgcuaagguucugggccuucggguguguggccuguaccgcgaguggcucucuagaaccgaaggggaccugggacagcugcucccuggcggguccgccuga

SEQ ID NO: 67981 - RNA, 1050 nt, Artificial Sequence
  derived and/or modified sequence opt5 from CTGF__Homo_sapiens__NP_001892
augaccgccgcuagcaugggccccgugagagucgccuucguugugcugcucgcgcugugcucccggccugcuguggggcagaacuguucuggaccgugccgcugucccgacgagccugcccccagaugcccugccggcgucagccuugugcuggauggguguggaugcugucggguuugcgcuaagcaacucggcgaacuguguacagagcgcgaccccugcgauccucacaaagggcuguuuugugacuucggauccccggccaauagaaagaucggcgugugcacggcuaaagauggcgcccccugcauuuuugggggaaccgucuaccggucuggcgagagcuuccaguccucuuguaaguaucagugcacaugucuugacggggcggugggaugcaugccucucuguagcauggauguucgccugcccuccccugacugccccuuuccgagacgggugaaacugccuggcaaguguugcgaagaaugggucugugaugagcccaaggaccagaccgugguggggccugcccucgcugccuaccgccuggaggauacauucggacccgaccccaccaugaucagagcuaacugccuuguccaaacaaccgaauggagcgccuguucuaaaacgugcggcaugggcauuuccacccggguuacaaaugauaacgcgagcugccgccuggagaagcagucuagacucuguauggugcggccuugcgaagccgaccuggaggagaauaucaaaaaggggaaaaaguguauucgcaccccgaagaucuccaaacccaucaaguuugaacuuagcggaugcacaucuaugaaaaccuauagagcuaaguucuguggcgugugcacggacgggcgguguugcacaccucauagaaccacaacccugcccgucgaguuuaaauguccugauggagaagugaugaagaaaaacaugauguucauuaagaccugcgccugucacuacaauugccccggcgacaacgauaucuuugagucccucuauuaccgcaagauguauggggacauggcuuga

SEQ ID NO: 67982 - RNA, 690 nt, Artificial Sequence
  derived and/or modified sequence opt5 from CTHRC1__Homo_sapiens__NP_001243028
auguggcccccuggcagaagcaucaccgugaagcugcgggagaaaacagucucccgcaagcucgaaaugaacgggccgucugccuuccagggacugauuugcggcaaauacaaugggaugugucuucaaggacccgcuggcguuccugggagagacggaagccccggcgccaacggcaucccugggacgcccggcauuccuggacgggauggguuuaagggagagaaaggcgaaugccugcgcgaguccuucgaagagucuuggaccccgaauuauaagcaguguagcugguccucucucaacuacgggaucgaccugggaaagauugcggagugcacauuuaccaaaaugagaagcaauuccgcccuucgggugcuguucagcggcucucuccgccugaaguguagaaacgcuugcugucagcggugguauuuuacauucaauggcgccgaaugcuccgggccccugccuaucgaggcuaucauuuaccucgaucagggaagccccgaaaugaacucuaccaucaauauucaccgcacauccagcguggagggccugugugaggggaucggagccggccuugucgacguggcuauuuggguugggaccugcucugauuauccuaaaggagacgccuccacgggcuggaacagcguguccagaaucauuaucgaggaacugcccaaguga

SEQ ID NO: 67983 - RNA, 1803 nt, Artificial Sequence
  derived and/or modified sequence opt5 from CTIF__Homo_sapiens__NP_001135869
auggagaacagcuccgccgcuucugccagcuccgaagcgggcucuagcagaucccaggagaucgaggaacuggaacgguucauugacucuuacgugcucgaguaucaaguccaggggcugcuugcugauaagaccgagggagacggcgaaagcgagcgcacacagucccacaucagccaguggacggccgauugcucugaaccccuggacuccagcuguucuuuuuccagagggcgggccccuccgcaacagaauggaagcaaagauaacucucucgacaugcugggcaccgauauuugggcugccaauacauucgacuccuuuagcggggcuaccugggaucuucagcccgagaagcuggacuucacacaguuucaucgcaaaguuagacacaccccuaagcaaccccucccucauaucgaucgggagggaugcggcaaaggcaagcuggaagacggggauggaauuaaccugaaugacaucgagaaggugcuccccgccuggcagggcuaccacccuaugccgcaugaaguggagaucgcgcacacaaagaagcuguuccgcagacggcgcaacgacagacggcgccagcagagacccccugggggaaauaaaccccaacagcacggcgaucaucagccuggguccgccaagcacaaccgggaccaucaaaaaucuuaucagggaggcagcgcuccccacccguccggccgcccuacccaccauggguacagccagaauagacgguggcaccauggaaacaugaagcaucccccuggcgauaagggggaagccggagcucacagaaaugccaaagagacgaugaccauugagaaccccaaacuugaagacacagcgggcgauaccgggcacucuucccuggaggcuccccgcagcccugacacacucgccccggucgccucugaacggcugcccccucagcaaagcggaggccccgagguggaaaccaaaagaaaggauuccauccuuccugagcgcauuggcgagcggcccaaaaucacgcugcuccagucuagcaaggacagacugcgccggagacugaaagaaaagguuccggaugagguggcugucgaaacaaccacaccucagcagaauaagauggacaaacucauugagauccugaacuccaugcgcaauaacagcucugauguggacaccaaacuuaccacauuuauggaagaggcccaaaacuccacgaauagcgaggaaaugcugggggagauuguucggaccaucuaucagaaggccgugucugacagauccuucgcuuuuacagcggccaagcucugugauaaaauggcucuguucauggucgaaggaaccaaguuucgcagccuucugcucaacaugcugcagaaggacuucacagugcgggaggagcugcagcaacaggauguggaaagauggcucggcuuuaucaccuuccugugcgaggucuucgggacgaugcgguccucuacaggagaacccuuucgcguucuuguguguccuauuuauaccugccugagagagcuccugcagagccaggacgugaaagaagaugccguccuuuguugcuccauggagcugcaaucuaccggccggcuccuggaggaacagcugcccgagaugaugacagaacuccuggccagcgcuagagacaagaugcuuuguccuuccgagagcaugcugacccgcucucuccugcuggaagugaucgagcuucacgccaauuccuggaacccccucacaccgccuauuacgcaguacuacaaucggaccauccaaaaacugacagcguga

SEQ ID NO: 67984 - RNA, 525 nt, Artificial Sequence
  derived and/or modified sequence opt5 from CTLA4__Homo_sapiens__NP_001032720
auggccugccugggcuuccagagacacaaggcucaacucaaccuggccacccggacauggcccuguacgcuucuguuuuuccuccuguuuaucccuguguucugcaaagcgaugcaugucgcucagccggccguugugcuugccagcucccgcgggauugcuucuuuugugugugaguacgccagccccggaaaggcuaccgaagucagagugacaguucugcggcaggccgacucccaggugaccgaggucugcgcggccacauauaugaugggcaaugaacucaccuuccuggaugacucuaucuguacagggaccagcuccggaaaccaagugaaucugacgauucagggccuccgcgcuauggauaccgggcuguacaucugcaaaguugagcuuauguauccucccccuuacuaucugggaauuggcaacggcacacagaucuacgugaucgccaaggagaaaaagcccucuuauaauagagggcucugugaaaacgcuccuaaucgggcccgcauguga

SEQ ID NO: 67985 - RNA, 2526 nt, Artificial Sequence
  derived and/or modified sequence opt5 from CTNNA1__Homo_sapiens__NP_001277236
augaccgccgugcacgcuggcaacaucaauuucaagugggaccccaaaagccuggagauuagaacacucgccgucgaacggcugcuugagccucugguuacacaggugaccacacucgugaacaccaauuccaaggggccgucuaacaaaaagcgcggaagaagcaaaaaggcgcauguccuggcugccuccguggaacaagccacagagaauuuucuugaaaagggcgauaaaaucgcuaaggagucucaguuccugaaagaggaacucguugccgcuguggaggacguccggaagcagggggaucugaugaaagccgcggccggagaauuugcugacgaucccugcagcuccgugaagcgcggcaacaugguuagagccgcucgggcccugcucucugcggugacccgccugcuuauucuggccgacauggcugaugucuacaagcuccuggugcagcuuaaaguggucgaggacgggauccugaagcucagaaaugccggaaacgagcaagaucugggcauucaguauaaagcucugaagccugaaguugacaaacucaauaucauggccgccaagcggcagcaggagcugaaagaugugggccaccgcgaccaaauggcugcggccagagggauccuucagaagaacgugcccauucuguacacagcuagccaggccugucuccagcauccugaugucgccgcuuauaaggccaaucgggaccugaucuacaaacaacuucagcaggcggugaccggaauuuccaacgcugcccaagccacggcuagcgacgaugccucucagcaccagggcgggggaggcggggaacuggcuuaugcccucaauaacuucgacaagcagaucauuguugauccccuguccuuuagcgaggaacgcuucagaccuucucuggaggagcggcucgaauccaucauuagcggagcggcccugauggcugacucuuccugcacccgcgaugacagacgggagagaaucguggccgaauguaaugcuguccgccaagcccuucaggaucugcucagcgaguacaugggcaacgcgggccggaaagaaagauccgacgcccugaacucugcuaucgauaagaugacgaaaaagacccgcgaccuucggagacagcugcgcaaggccgugauggaucauguuagcgacuccuuucucgagacaaaugugccgcugcugguccucauugaggcugccaaaaacgggaaugaaaaggaggugaaagaauaugcccaggucuuccgggagcacgcuaacaagcugaucgaaguggcgaaucuugccugcagcauuucuaacaaugaggagggaguuaaacuggugagaauguccgcuagccaacucgaagcccuguguccccaggucaucaacgccgcucuggcccuugcggcuaagccucagucuaagcucgcccaggagaauauggaccuguuuaaagaacaaugggagaaacaggugcgcguucugaccgaugccguggacgauauuacgagcaucgacgauuuccucgcugucuccgagaaccacauccuggaagacgugaauaagugcgugauugcccuucaggagaaggauguugacggccuggaucggacagcgggggcuaucagaggacgcgccgcccgggucauucauguggugaccucugaaauggacaacuacgagcccggcgucuacacagaaaaagugcucgaggcuaccaagcugcugagcaauaccguuaugccuagauuuacagaacagguggaagccgcugucgaggcccuuuccagcgaucccgcgcaaccgauggacgaaaacgaguucaucgaugccucucggcucguguaugacgggauucgcgacaucagaaaggcuguucugaugauccggacgccugaggagcuggaugacuccgauuuugagaccgaagacuucgaugugagaagccgcacaucuguccagaccgaggacgaucagcucauugccggacaauccgcucgggccaucauggcccagcugccccaggaacagaaagcuaagauugcggagcaaguggccagcuuccaggaagagaaauccaaacuugacgcugagguuucuaagugggaugacagcggcaaugauaucauugugcuggccaagcagauguguaugaucaugauggaaaugacagacuuuaccagaggcaaagggccucucaagaacacguccgaugucauuucugccgcuaagaaaaucgccgaggcgggaagccgcauggacaagcugggcagaacaaucgcugaccacugccccgauuccgccuguaaacaggaccugcuugccuaccuccaacggauugcucuguauugccaucagcugaacaucuguagcaaggugaaagccgaagugcagaaucucgggggagagcuggucguuucuggcaacugcgauaccugcggggcgcuucagggccugaagggauggcccccuccgcucuguuggccccugaccggcuggacagcuccuugccccuga

SEQ ID NO: 67986 - RNA, 2583 nt, Artificial Sequence
  derived and/or modified sequence opt5 from CTNNA2__Homo_sapiens__NP_001158355
augaccagcgccacaucccccaucauucugaagugggacccuaaaucucucgagaucagaacgcugaccguggaacggcuucuggagccgcucgucacacagguuaccacacuggugaacaccagcaauaagggccccuccgggaaaaagaaaggacgcucuaagaaggcucacgugcuugccgcgagcgucgaacaagcuacacagaacuuccuggagaaaggcgaacagauugccaaggagucccaggaucucaaagaggaacugguggccgcuguugaggacgugagaaagcaaggggaaaccaugcggaucgccucuagcgaguuugcugaugacccuugcuccagcgucaaacgcggaacgauggugagagccgcgcgggcccugcucucugcuguuacccgccugcuuauucuggccgauauggcugacgugaugagacuccugucccaucuuaagaucgucgaggaagcccuggaggcggugaagaaugccacaaacgaacaggaucucgcuaaucgguucaaagaguuuggcaaggaaauggugaaacugaacuacgucgccgcucgcagacagcaggagcugaaggacccccacugucgggaugagauggccgccgcucgcggggcgcucaaaaagaaugccaccaugcuguauacagcuagccaagccuuccuuagacauccugacguugccgcuacccgggccaaccgcgauuacguguuuaaacaggugcaggaagcgaucgcuggaauuucuaaugccgcccaggcuacgucccccacagacgaggccaagggccacaccggcaucggggaacuggcugccgcgcucaacgaguucgauaauaagauuauccuggacccuaugacauuuagcgaagccagauuccggccgucucuugaggagagacuggaauccauuaucagcggagcugcccucauggcugacuccucuugcacccgcgaugaccggagagagcgcauugucgccgaauguaacgcggugcggcaagcccugcaggaucugcucagcgaguauaugaauaacaccggcagaaaagaaaagggggacccccugaauaucgcuaucgauaaaaugacaaagaaaacgcgcgaccuucggagacagcugcgcaaggccguuauggaucauauuuccgacagcuuucucgagaccaacgugccucugcuuguccugaucgaggcugccaagucuggaaacgaaaaagaggugaaggaauacgcccaaguuuuccgggagcacgcuaauaaacucguggaggucgcgaaccuggccugcuccauuagcaauaacgaagagggcgugaagcuggucagaauggcugccacacagaucgauucucucuguccccaggugauuaaugccgcucugacccuugccgcgcgcccucagagcaaaguugcucaagacaacauggauguguuuaaggaccagugggaaaagcagguccgggugcugacagaggccguugacgauaucaccuccguggacgauuuccucucugucagcgaaaaucacauccuggaggacgugaacaaaugcgugauugcccugcaggagggggauguugacacgcuugauagaacagcuggagccauccggggccgcgcggcuagagucauucauaucauuaaugccgaaauggagaacuaugaagccggcguguacaccgagaaggugcucgaagcuaccaaacugcuguccgagacagucaugccccgguuugccgagcaaguggaaguugcuaucgaggcccucagcgcgaaugugccgcagccuuucgaagagaacgaguucaucgacgccucuagacuggucuaugauggggugcgcgacauucggaaggcuguucuuaugaucagaacccccgaggagcuggaagaugacuccgauuuugagcaggaagacuacgacgugcgcagcagaacaucuguccagacggaggaugaccaacucauugccggacaguccgcucgggccaucauggcccagcugccucaggaggaaaaagcuaagauugcggagcaaguggaaaucuuccaccaggaaaagagcaaacuggaugccgaaguugcuaagugggacgauuccggcaaugacauuaucgugcuugccaaacagauguguaugaucaugauggagaugaccgauuuuacacgcgggaagggaccccucaaaaacaccucugacgucauuaaugccgcuaagaaaaucgccgaggcgggcagcagaauggauaagcuggcucgggccguggccgaccaacuggauuccgcuacaucucucauucaggccgcgaagaaccugaugaacgcugugguccuuaccguuaaagccagcuacguggccuccacgaaguaucagaaaguguacgggaccgcugccgucaauagccccgugguuucuuggaagaugaaagcuccugaaaagaagccgcuggugaaacgcgagaagcccgaagaguuccagacaagaguccggcgcggaucccagaaaaagcauaucagcccugugcaagcccucucugaauuuaaagcgauggacuccuucuga

SEQ ID NO: 67987 - RNA, 1167 nt, Artificial Sequence
  derived and/or modified sequence opt5 from CTNNA3__Homo_sapiens__NP_001278062
augaaaagcacccagagacgggagaagcagggcuccaugucugccgaaacacccaucacgcugaacauugacccucaggaucuccaggugcagaccuucacagucgagaagcugcuugaaccgcugaucauucaaguuaccacacucgugaauugcccccagaacccuagcucccgcaaaaaggggagaucuaaacgggcuagcgugcugcuugccuccgucgaggaagcgaccuggaaucugcucgacaagggagagaagaucgcucaggaggccacagugcugaaagaugaacugaccgccucucucgaggaaguucgcaaggagagcgaggcucugaaaguguccgccgaaagauuuacggacgaucccuguuuccuuccuaagcgggaggcugucgugcaggccgcgcgcgcccugcucgcugccguuaccagacugcuuauucuggcugacaugaucgaugugaugugccuccugcaacacgucagcgccuuucagcggacauucgaaucucugaaaaacguggcgaauaaguccgaccuccagaagaccuaccagaaacugggcaaggagcuugaaaaccuggauuaucucgccuuuaaacgccaacaggaccuuaagagccccaaucagagagaugagaucgcuggggcccgggcuucucuuaaagagaacuccccucugcuccauagcauuuguucugccugccuggaacacuccgacguggccagccugaaggcuuccaaagauacagucugugaggaaauccaaaaugcgcucaacguuauuucuaaugccagccagggaauccagaacaugaccacgccgcccgagccucaggcugccacacugggcuccgcccuugacgaacuggagaaucucauugugcugaacccccuuaccgugacagaggaagagauccgcccuagccuggaaaagagacucgaggcuauuaucucuggggccgcgcugcuggcugacuccagcugcacccgggaucuccaucgcgaaagaaucauugccgaguguaaugccauccggcaagcucugcaggaccuucugucugaguacaugaacaaccucugcaaucaaaagagcgaucugggacugaccggcgucaaaauuaagcugcucgaagaguguaucauuuucuggucccuguga

SEQ ID NO: 67988 - RNA, 2157 nt, Artificial Sequence
  derived and/or modified sequence opt5 from CTNNAL1__Homo_sapiens__NP_001273903
auggccgcuagccccggcccugccggggugggaggcgcgggggcugucuacggauccggcucuagcggguucgcccuggacuccggacucgagaucaagaccagaucuguugaacagacacugcuuccgcuggugagccaaauuacgacccucaucaaccacaaagauaauacaaagaaauccgacaagacccugcaggccauucagcgggugggccaggcugucaaccuugccgugggccgcuuuguuaaagugggggaggcuaucgccaaugaaaacugggaucugaaggaggaaauuaauaucgcgugcaucgaggccaagcaagcuggagagacaauugccgcucucaccgacaucacaaaccugaaucaucuggaaucugauggccagauuaccaucuucacggacaaaaccggggucauuaaggccgcgagacuccugcuuagcuccgugacaaaaguucugcuccuggccgaucggguggucaucaagcagauuaucaccagccgcaacaaagugcuugcuacaauggagagacuggaaaaggucaauucuuuucaggaguucgugcaaaucuuuucccaguucggaaacgagaugguugaauuugcccaccucagcggcgaccggcagaaugaucugaaggacgagaaaaagaaagcuaagauggccgccgcucgcgcggugcuggaaaaauguaccaugaugcuccugacggccucuaagacaugccuuagacaucccaacugugaguccgcucacaaaaauaaggaagggguguucgaucggaugaaggucgcccuggacaaagugauugagaucguuaccgauugcaagccuaacggagagacagacauuagcucuaucuccauuuuuaccggcaucaaagaguucaagaugaauaucgaggcccuccgcgaaaaccuguauuuucagagcaaagagaaccuuuccgugacccuggaagucauucucgagagaauggaggacuucacagauucugcuuacacgagccaugaacaccgggagcgcauccuggaacuguccacccaagccagaauggagcuccagcagcugauuagcguguggauccaagcgcagucuaagaagacaaaauccauugcugaagaacuugagcugagcauccucaagaucucucacagccugaaugaacuuaaaaaggagcugcauuccaccgccacacagcucgccgcugaccugcugaaauaucacgccgaucauguugugcucaaggcucugaaacuuaccggcgucgaagggaaccuggaggcccucgcggaguacgccuguaagcugucugaacagaaggagcaacugguggaaacgugccggcuucuccgccacauuagcggaacagagccccuggaaaucaccuguauucacgcugaggagaccuuucaggucacaggccagcagaucauuuccgccgcugaaacccugacacuccauccuagcucuaaaaucgccaaggagaaucuggacguguucugcgaagcgugggagucccaaauuagcgauaugucuacgcuucugagagaaaucaacgacguuuucgaggggcggagaggagagaaauauggcuaccucucccugcccaagccuaugaagaauaacgccaaucugaaaagccuuaagccggauaaacccgacuccgaggaacaggcuaagaucgccaaacucgggcugaagcugggacuccugaccucugaugcugacugugaaauugagaaaugggaagaucaggagaacgagaucgugcaguauggccgcaauaugagcuccauggccuacucucuuuaccuguuuacacggggcgaagggccucucaagaccagccaagaccugauucaccagcuggaggucuucgccgcugaaggacuuaagcucacauccagcgugcaggcguuuucuaaacagcugaaggacgaugacaaacugaugcuccugcuugagaucaacaagcugauuccccucugccaucaacugcagaccguuacgaaaaccucccugcagaauaagguguuccuuaaggucgauaaauguaucacaaagaccagaagcaugauggcccuccuggugcaacugcucucucugugcuauaaacuucugaagaaauccgagacacgcuacuga

SEQ ID NO: 67989 - RNA, 2346 nt, Artificial Sequence
  derived and/or modified sequence opt5 from CTNNB1__Homo_sapiens__NP_001091679
auggccacccaggcugaccugauggagcucgauauggccauggaacccgacagaaaggcggcugugagccacuggcaacagcaguccuaccuggauucuggcauccauagcggggccacaacgaccgccccuucccuuucuggaaaaggcaacccggaggaagaggacgucgauacaagccagguucuguaugaaugggagcaaggguucucccagucuuuuacccaggaacagguggcugacauugauggacaauacgccaugacacgggcucagcgcgugagagccgcgauguuccccgagacccucgacgagggcaugcagaucccuagcacacaguuugaugccgcucaccccaccaauguccaacggcuggccgaaccuucccagaugcuuaagcaugcugugguuaaccugauuaauuaucaggacgaugccgagcucgcgacgcgcgccauccccgagcugaccaaacugcucaacgacgaagaucaaguggucgugaauaaggcugccguuauggugcaccagcugagcaaaaaggaggcuucuagacaugccauuaugcgguccccucagauggucagcgccaucgugcgcacaaugcagaacaccaaugacguggaaacagcuagaugcaccgcggggacgcuucacaaccugucucaccaucgggagggacuccuggccaucuucaaguccggcggcauuccggcucuugucaaaaugcuggggagccccguugacucugugcucuuuuacgccaucacaacccugcacaaucugcuccugcaucaagaaggagccaagauggcugugcgccuugccggcgggcugcagaaaauggucgcgcuccugaacaagacaaaugugaaauuccuugcuauuaccaccgauugucugcagauccucgccuauggaaaccaggaguccaagcugauuauccuggccagcggcgggccucaagcucucguuaauauuaugagaacauacacguaugagaagcugcuuuggaccacaucccgggugcugaaaguccucucugugugcagcuccaacaagcccgccaucguugaagcuggaggcaugcaggcccugggccuucaccugaccgacccuagccagcgccucgugcagaauugucuguggacacugagaaaccucucugaugcggccaccaaacaagaggggauggaaggacugcuuggcacgcugguccagcuccugggguccgacgauaucaacguggucacaugcgcugccggcauucugagcaaucuuaccuguaacaauuacaagaacaaaaugauggugugccagguuggagggaucgaggcucucgugcggaccguccugcgcgccggagacagagaagauauuacagagcccgcgaucugugcccugcggcaccucaccucuagacaucaggaggcugaaauggcccaaaaugcugugcgccugcacuacggccuuccgguuguggucaagcugcuccauccucccagccacuggccucugauuaaagccacagugggccugauccggaaccuugcccucugccccgcuaaucaugcgccccugagagagcagggggccaucccucgccuggugcagcuccugguucgggcucaccaagacacgcagagacgcaccuccaugggaggcacacagcagcaauuugucgaaggggugcggauggaggaaauuguggagggauguaccggcgcccuucacauccuggccagagauguccauaaccgcauugugauccgggggcucaauacaauuccgcuguucguucagcugcuuuauucucccaucgagaacauccagagaguggcugccggcguccucugcgaacuggcgcaggacaaggaggcugccgaagccauugaggcugagggagccaccgcgccucugacggaacuccugcacagccgcaaugagggcguggcuaccuacgccgccgcuguucuuuuucggauguccgaagauaagccccaagacuauaaaaagagacugagcguggagcucacaucuucccuguuccggaccgaaccuauggccuggaacgagacagcugaccuggggcuugauaucggagcccagggcgagccccucggguaccgccaggacgauccgagcuauagaucuuuucauuccggaggcuacgggcaggacgcgcugggcauggauccuaugauggaacacgagaugggaggccaccaucccggggccgacuauccugucgauggacugcccgaccucggccacgcucaagaucugauggacgggcuuccucccggagauagcaaucagcuggccugguucgacaccgaucucuga

SEQ ID NO: 67990 - RNA, 1611 nt, Artificial Sequence
  derived and/or modified sequence opt5 from CTNNBL1__Homo_sapiens__NP_001268424
augagacggaagcagaccggcacacgcgagagagggcgguaccgcgaagaggaaaugacgguggucgaggaagccgacgaugacaaaaagagacugcuccaaaucauugaucgggacggagaggaggaagaggaagaggaggaaccccuggaugagagcuccguuaaaaagaugauccuuaccuucgaaaaacgcucuuauaagaaccaggagcugagaauuaaguuuccugacaauccggaaaaauucauggagagcgagcucgaucugaacgacaucauucaggaaaugcacgugguggcuacaaugcccgaucuuuaccaucugcucgucgagcugaaugccgugcagucccugcucggccugcuugggcacgacaacaccgauguuucuaucgcgguggucgaccugcuccaagaacugacagauaucgacacccuucaugagagcgaagagggagcugaggugcugauugacgcccucguugauggccagguggucgcccugcuggugcagaaucucgaacggcuggacgaguccgugaaggaagaggcugaugggguccacaacacacuugccaucguugaaaauauggcugaguuucgcccugagaugugcaccgaaggagcccagcaaggccugcuccaguggcugcuuaaaagacugaaggcgaaaaugcccuucgacgccaacaagcucuauuguucugaggugcuggcuauucugcuccaggauaaugacgaaaaccgggagcugcuuggcgagcuggaugggaucgacgugcuccugcagcaacuuagcgucuuuaagcgccauaauccuuccacggccgaggaacaggaaaugauggagaaccuguucgauagccucugcucuugucugaugcuguccagcaauagagaacgguuucucaaaggagagggccugcagcuuaugaaccugaugcuccgcgagaagaaaauuucuagauccagcgcucugaaggugcuggaccacgccaugaucgggcccgaaggaaccgauaauugccacaaauucguugacauucuuggccuccggacaaucuuuccucuguucaugaagucuccgagaaaaaucaagaagguggggaccacagagaaagaacaugaggaacacgucuguuccauucuggcgagccuccugcgcaaccuucggggacaacagagaacccgccugcucaacaaguuuacggagaaugacuccgagaaaguggaucggcugauggaacugcauuucaaguaccuuggcgccaugcagguugcugacaaaaagaucgagggcgaaaagcacgauauggugagacgcggggagauuaucgacaacgauacagaagaggaguuuuaucuccggagacuggacgccggacuguucguccuccagcacauuugcuacaucauggcugaaaucuguaaugccaacgugccccaaauucgccagcggguccaucagauccugaauaugagaggcucuagcauuaaaaucgugcgccacauuaucaaggaguaugccgaaaacaucggggauggacgguccccugaguucagagagaaugaacagaaacggauucuuggccugcucgagaacuuuuga

SEQ ID NO: 67991 - RNA, 2907 nt, Artificial Sequence
  derived and/or modified sequence opt5 from CTNND1__Homo_sapiens__NP_001078927
auggacgauagcgagguggaauccaccgccucuauccuggcuagcgucaaggagcaggaagcccaauucgagaaacucacaagagcgcuggaagaggagcggcgccacguuuccgcucagcuugaaagagugcgggugucuccccaggacgccaacccucugauggccaauggcacgcucacccgcagacaucagaacgggcgguuugucggagaugcugaccuggagcgccaaaaguucagcgaucuuaaacugaauggcccgcaggaccacucccaucuccuguacucuacaauucccagaaugcaggaaccugggcagaucguggagaccuauacagaggaagaucccgagggagccaugagcguuguguccgucgaaaccagcgacgauggcacaacccggcgcacggagaccacagugaagaaaguugugaagaccgucacaaccagaacggugcaaccuguggcuauggggcccgacggacugccugucgaugccucuuccguuagcaacaauuacauucagacacucggccgggacuuucgcaagaacggcaaugggggaccgggccccuauguggggcaggcgggaaccgccacacugccuagaaacuuccacuaucccccugauggcuacucucggcauuacgaagacggguaucccggaggcuccgacaauuacggcagccuuucucgcgugaccagaaucgaggagcgguacagaccguccauggaaggguaucgcgcuccuagccggcaggaugucuacggaccccaaccucaggugagaguuggcggguccucuguggaccugcaccgcuuucaccccgagcccuauggacucgaagaugaccagcggagcaugggcuacgaugaccuggauuaugggaugauguccgacuacggaaccgccagacgcacaggcacgccuagcgauccgcggagacgccuucggucuuaugaggacaugauuggcgaagagguccccuccgaucaauacuacugggcuccucuggcccagcaugagagagggagccucgcgucucuggacagccugcgcaaaggaggacccccucccccgaacuggcggcagccugaacuccccgaggugaucgccaugcugggguucagacuugacgcuguuaaguccaaugccgcugccuaucugcagcaccucugcuaccggaacgauaaagugaagaccgacguccgcaaacugaagggaaucccugugcuugucggccugcucgaucaucccaagaaagaagugcaccugggggccuguggcgcucugaagaauauuucuuuuggaagagaccaagauaacaaaaucgcgauuaagaauugcgacggcguuccugcccucgugcggcugcuuagaaaagcucgcgauauggaccugacagaggucaucaccgggacacucuggaaccugagcucccacgauagcauuaagauggaaaucguggaccaugcccuucacgcccugaccgaugagguuauuaucccccauucuggaugggagcgggaaccgaacgaggacuguaaaccuagacacaucgaaugggaguccgugcucacgaauacagcuggcugccugcgcaacgucagcucugagagauccgaagcccggcgcaagcugagagagugugaugggcucguggacgcgcugauuuucaucgugcaggcugaaauuggacagaaggacagcgauuccaaacuuguugagaauugcgucugucugcuccggaaccugucuuaucaggugcaucgcgaaaucccccaagccgagagauaccaggaggccgcucccaauguggccaacaauaccggcccucacgcugccagcugcuuuggggcgaagaaaggcaaggacgaaugguucucccggggcaaaaagccgauugaggaucccgccaacgacaccgucgauuuuccuaagcgcacaucucccgcuagaggcuaugaacugcuuuuccagccugaggugguucggaucuacaucagccuccugaaagaauccaagacccccgccauucuggaggcuagcgccggggcgauccagaaucucugugccggacgcuggacauauggcagauacauucggucugcucugagacaagagaaagcccuuuccgcuaucgccgaccugcucacgaacgaacacgagcgcguggucaaggccgcuagcggggcgcugcggaaucuggccguggaugcuagaaacaaagaacuuauuggaaagcaugccaucccuaaucucguuaagaaccugcccggcgggcagcaaaauucuuccuggaacuuuagcgaggacaccgugaucucuauucugaacacaaucaaugaagucauugccgagaaccucgaggcugccaaaaagcugcgcgaaacccagggcaucgagaaacuugugcugauuaauaagagcggaaaccgguccgaaaaagagguuagagcggcugcccucgugcugcagacaaucuggggcuacaaggagcugcgcaagccgcuugaaaaagagggguggaagaaaagcgauuuccaggucaaucucaacaaugccucucggucccagagcucccacucuuaugacgauagcacccugccucugauugacagaaaccaaaaguccgauaaaaagcccgaccgcgaagagauccagaugucuaauaugggaagcaacacgaaaucccucgacaauaacuacucuaccccuaaugaacggggcgaucauaacagaacacuggaccggagcggggaucuuggagacauggagccccugaagggcaccacaccgcucaugcaggaugaggggcaggaaucccuggaggaggaacuggacgugcuugugcucgaugacgaaggcggacaagucagcuauccuucuaugcagaagaucuga

SEQ ID NO: 67992 - RNA, 3405 nt, Artificial Sequence
  derived and/or modified sequence opt5 from CTNND2__Homo_sapiens__NP_001275644
augagcuccaugucuagcgccgaggaacaguuccaauggcagucccaggacggccagaaggauaucgaggacgaacugaccacagggcucgagcugguggauucuugcauuagaagccuucaagaauccggaauccuggacccccaggauuacucuacgggcgagcggccuagccuccugucccagagcgcccuucagcugaacucuaaaccggagggguccuuucaauaucccgcuagcuaccacucuaaucagacccucgcgcugggagaaacaaccccuucccagcugcccgcucgcggcacacaggccagagccaccgggcagagcuucucucagggaacaaccucccgggcuggccaucucgccggcccugagcccgcuccuccgcccccucccccuccccgcgaaccguuugccccuagccugggguccgcguuccaccuucccgacgccccucccgcugccgcugccgcggcccuguauuacucuagcuccacgcuccccgcuccuccgagaggaggcagcccccuggccgcuccucaagggggaucucccaccaagcuccaacggggcggguccgccccugagggagccacauaugcugcgccccgcggcagcucuccgaaacagagcccuuccagacuggccaagucuuacagcaccuccagccccauuaacaucgucguuucuuccgcuggccucagcccuauucgggugacaucucccccuaccgugcaguccacgaucagcuccucucccauccaucagcugagcuccacaauugggaccuaugccacacugucuccgaccaaacgccucguccacgccagcgagcaauacuccaagcauagccaggaacuguacgcuaccgccacacuucagagaccuggaucucuggcggcuggcucccgggccagcuauucuucccagcacgggcaccucggacccgagcugcgcgcccuucaaagccccgaacaucacaucgauccuauuuacgaggacagaguguaucagaagccgcccaugcggucucugagccagucccagggcgauccucuucccccugcucauacggggaccuaccgcacaagcaccgcccccucuuccccuggaguugacagcgugccccugcaaagaacaggcucccagcacggcccgcagaaugcugccgcggccaccuuucagcgggcuucuuaugccgcugggccugccagcaacuacgcggaucccuauagacaacugcaguacuguccuuccgucgaaucucccuacagcaaauccggaccggcccucccucccgagggcacgcuggcucgcucuccuagcaucgacuccauucagaaggauccccgggaguucggguggagagaccccgaacuuccugaggugauccaaaugcugcagcaccaguuuccgagcguucagucuaaugccgcugccuaucuccaacaucugugcuucggagacaacaaaauuaaggccgaaauccgccggcagggcgggauccagcuucugguggaucuccuggaccacagaaugacagagguccaucgcuccgcuuguggcgcgcugcggaaucucguguacggaaaagccaacgaugacaauaagauugcucugaagaacugcggcgggauccccgcccuugugagacugcuccgcaaaaccaccgaucuggaaauucgggagcuggucacaggaguucuuuggaaucucagcucuugugacgcccugaagaugccuaucauucaggaugcucuggccgugcucaccaacgcggugaucaucccccacuccggcugggagaauagcccucugcaagacgauagaaaaauucagcuucauucuucccagguccugcgcaacgcuacagggugccuccggaaugugagcuccgccggagaagaggccagacggcgcaugagagaaugugacggccugacggaugcucugcuuuauguuauccagagcgcccucgggucuagcgagauugacuccaagaccguggaaaacugcgucuguauccugcggaaccugucuuacagacucgcggcugagacaagccaaggccagcacaugggaaccgacgagcuggauggccuucugugcggggaagccaauggaaaagacgccgaguccucuggcuguugggggaagaaaaagaagaaaaagaaaagccaggaucaaugggacggagugggcccccucccugauugcgcugaaccgcccaaggggauucagaugcuguggcacccuuccaucguuaaacccuaucugacacuucucucugagugcagcaacccugacacccuggagggcgccgcuggagcccugcagaaucucgcggccggcuccuggaaguggagcguguacauccgcgcugccguccggaaggaaaaagggcugcccauucuuguggagcugcucagaaucgauaacgaccgcgucgugugugcuguugccacggcccugagaaauauggcucuggaugugcggaacaaggaacuuauuggaaaauaugcgaugcgcgaccucguccauagacugccgggcgggaauaacucuaauaacaccgccuccaaggcuaugagcgaugacacagugaccgccguuugcuguacacugcacgaggugaucaccaaaaauauggaaaacgccaaggcucuccgggaugccggaggcauugagaagcuggucgggaucucuaaauccaagggcgacaaacauagcccuaagguggugaaagcggcuucccagguucuuaauucuauguggcaauaccgcgaccugagaagccucuacaagaaggauggauggucccaguaucacuuugucgccucuagcuccacgauugagcgggaccgccagagacccuacagcucuagccggacacccuccaucucuccugugcgcgugagccccaacaauagauccgccucugcuccugccagcccgcgggaaaugaucucccugaaagagagaaagaccgauuaugaaugcacaggcagcaacgcgaccuaccacggggcuaaaggagagcauaccucucgcaaggacgccaugacagcccagaacacgggcauuuccacccuguaucggaauagcuacggggcucccgccgaagauaucaaacacaaccaagucuccgcucagccugugccccaggagccuucuagaaaggacuaugagacauaccagcccuuccaaaauagcacccgcaacuacgaugaauccuuuuucgaggaccagguucaucaccggccgccugccucugaauauacaaugcaucuuggacugaaaagcaccggcaauuacguggauuuuuauuccgcggccagacccuacagcgagcucaacuaugaaacgucucacuacccugcuucccccgacagcugggucuga

SEQ ID NO: 67993 - RNA, 1203 nt, Artificial Sequence
  derived and/or modified sequence opt5 from CTNS__Homo_sapiens__NP_001026851
augaucagaaacuggcugaccauuuucauccucuuuccccugaaacuuguggagaagugcgaaagcuccgucucucugacaguuccuccgguggugaagcucgagaauggcagcuccacgaacgucucucugacccuucggcccccucugaaugccacacucgugauuaccuucgaaaucacauuucgcagcaaaaacauuaccauccuggagcugcccgacgaaguuguggucccucccggggugacaaauuccucuuuccagguuaccagccaaaacgugggacagcucacggucuaccugcacggcaaucauuccaaccagaccgggccuagaauccgguuucuugugauucgcagcucugcuaucuccauuaucaaucaggugauuggauggaucuauuucgucgccuggagcauuucuuuuuacccgcaaguuaucaugaacuggagacggaaguccgugaucggccugagcuucgauuuuguggcgcucaaucugacaggguucgucgcuuauucuguguuuaacauuggacuucuguggguucccuacaucaaagagcaguuccuccugaaguauccuaauggcgugaaccccgucaauuccaacgacguguuuuucagccugcacgccguugugcucacccugauuaucauuguccaguguugccuuuacgagcgcggcgggcagagaguguccuggccugccaucggauuccugguccucgcuuggcuguuugccuucgugacaaugaucguugcugccgugggcgucaccacguggcuucaauuucuguucuguuuuucuuauauuaagcucgcggugacacugguuaaauacuucccccaggccuacaugaacuuuuauuacaagagcaccgaagggugguccaucggaaaugugcugcucgauuucacaggcgggagcuuuucucugcuucagauguuccugcaguccuauaacaaugaccaauggacccucauuuuuggagauccgaccaaauucggccugggcgucuuuagcaucguguucgacgugguuuucuuuauucagcauuucugccuuuaccggaagcgcccugggcugcaggcugccagaacaggaucuggcagccggcuccgccaagauugggcucccucccugcagccuaaagcccugccccagacgaccucugucagcgcguccagccucaagggguga

SEQ ID NO: 67994 - RNA, 1308 nt, Artificial Sequence
  derived and/or modified sequence opt5 from CTPS1__Homo_sapiens__NP_001288166
augcccuucaucgaggccuuuagacaguuccaauuuaaggugaaacgggaaaacuucugcaauauucacgucagccugguuccucagccguccucuaccggcgagcagaagacaaaacccacgcagaacagcgugcgcgaacucagagggcugggacuuuccccugaccugguggucugucggugcucuaauccccucgauaccagcgugaaggagaaaaucuccauguuuugucauguugaaccugagcaagugauuugcguccacgacgugucuagcaucuaccgcguuccccugcuucuggaggaacagggcguggucgauuauuuccucagacggcuggaccugccuauugagcgccagccgagaaagaugcucaugaaguggaaagaaauggcugaucgguacgaccgccugcuugagacauguuccaucgcccugguggggaaguauaccaaauuuagcgauucuuacgcguccgugaucaaggcucucgagcauagcgcccuggccauuaaccacaaacuugaaaucaaguauauugacucugcugaucuggagcccaucacaucccaggaggaaccugucagauaccaugaagccuggcaaaagcucugcagcgcucacggaguucuggugcccggcggguucggagugcggggcaccgagggcaaaauucaggccaucgcgugggcccgcaaucagaagaaaccuuuucugggggucugucucggaaugcagcuggcugugguugaguucucuagaaacgugcuuggcuggcaagacgccaauuccacagaauuugaucccaccacgagccacccggucgugguugacaugccugagcauaaccccgggcagaugggaggcaccaugcggcuggggaagcgcagaacacucuuccagaccaaaaauuccgugaugcggaagcuguauggagaugcugacuaccuugaagagagacaccgccaucgguuugaagucaacccuguguggaaaaagugccuggaggagcaaggccucaaguucgucggccaggacguggaaggggagagaauggaaauuguugagcuggaagaucaccccuucuuugugggaguccaguaccaccccgaguuccugucucgcccuaucaaaccgagcccucccuauuuuggccuccugcuugccuccguggggcggcugagccauuaccuccagaagggauguagacugucuccccgcgacacauauuccgaucggagcggcucuagcuccccugacucugagaucaccgaacuuaaauuccccagcauuaaucacgauuga

SEQ ID NO: 67995 - RNA, 3522 nt, Artificial Sequence
  derived and/or modified sequence opt5 from CTR9__Homo_sapiens__NP_055448
augagcagaggcuccaucgagauuccccugcgggacaccgaugaagugaucgagcucgacuucgaucagcugccugaaggggacgaggucauuucuauccuuaagcaagaacacacacagcugcauauuuggaucgcccucgcucuggaguacuauaaacagggaaagacggaggaauuuguuaaacuucuggaggccgcgcgcaucgauggcaaccucgacuacagagaucacgaaaaggaccagaugaccugccuggauacacuggcugccuauuacgugcaacaggcccggaaagagaagaauaaggacaacaaaaaggaucucauuacccaggcuacacugcuuuauaccauggccgacaaaaucauuauguacgaucagaaucaucugcucgggcgcgcuuguuucugccugcuugagggagacaagauggaccaagccgaugcgcaguuucacuucgugcugaaccagagcccgaauaacauccccgcccuccugggcaaggcuuguauuuccuuuaauaagaaggacuauagaggggcccuggcuuacuacaaaaaggcccuccggacaaacccuggaugccccgcggaaguccgccugggcaugggccauuguuucgugaaacuuaauaagcuggagaaagccagacucgcuuuuucucgggcccuggaacuuaacagcaagugcguuggggcucuggugggacucgccguccuggagcugaauaacaaagaagccgauuccaucaagaauggcgugcagcuccugucucgcgcuuauaccauugacccuagcaaccccaugguucuuaaucaccuggcgaaccacuucuuuuucaagaaagauuacuccaaggugcaacaucucgcccugcacgcuuuucauaacacggaggucgaggccaugcaggccgaaagcuguuaucagcuugcuagaucuuuccacgugcaagaggacuacgaucaggccuuucaguauuacuaucaggcgacccaauucgcuuccagcucuuucgugcugcccuuuuucgggcucggacagauguacaucuaccggggcgacaaagaaaaugccucccagugcuuugagaagguccugaaagccuauccgaacaauuacgaaacaaugaagauccuggggagccucuaugcugccucugaggaucaggagaagcgcgacauugcuaaaggacaccugaagaaaguuaccgaacaauaccccgaugacguggaggccuggaucgaacuugcgcagauucuggagcagacagacauccagggcgcccucuccgcuuauggcaccgccacgcgcauucugcaagaaaaggugcaggcugaugucccucccgagauccugaacaaugugggggcccuucauuuccggcucggaaaccugggcgaggcgaaaaaguacuuucuggccagccucgaccgcgcuaaggccgaagcugagcacgaugaacauuauuacaaugccaucuccguuacaaccucuuacaaccuggccagacuuuaugaggcuaugugugaguuccacgaagcggagaaacuguacaagaauauucuccgggaacauccuaacuauguggacugcuaccugagacugggggccauggcucgcgauaaaggaaauuuuuaugaggccagcgacugguucaaggaagcccuucagaucaaccaggaucaccccgacgcuuggucccucauuggcaaucugcaccuggccaaacaagagugggggccgggacagaagaaguuugagcggauccucaaacagccuagcacacaaucugauaccuacuccaugcuggcgcuuggcaacgucuggcugcagacccuccaucagcccacaagagaccgcgaaaaggagaaacggcaccaggauagagcucuggccauuuauaagcaagugcugcgcaaugacgccaaaaaccuuuacgcugccaacggcaucggggcgguucucgcucauaagggauacuuccgggaagccagagauguguuugcccagguccgcgaggcuacggccgacaucagcgacguguggcugaaucuggcucacauuuaugucgaacagaaacaguacaucucugccgugcaaauguaugagaacugucuccggaaguucuacaagcaccagaauaccgagguugugcuguaucuugcgagagcccuguuuaaaugcggcaagcuccaggaaugcaaacagacacugcugaaggcucgccaugucgccccuagcgauaccgugcuuauguucaacguugcucucgugcugcaacggcuggccacauccguccucaaagacgagaagucuaaucugaaggaagugcuuaacgccgugaaagagcuggaacucgcucacagauacuucagcuaucuguccaagguuggggauaaaaugcgguuugaccuggcgcuugccgcuaccgaggcccgccaguguagcgaucugcucucucaggcccaauaccaugucgcuagagcccggaagcaggacgaggaagagagagaacugcgcgcgaaacaggagcaggagaaggaacuccugcggcaaaaacuucugaaagagcaggaagagaagagacuccgcgaaaaagaggagcagaagaaacugcuggaacagagagcucaauacguggagaagacgaagaauauucuuauguucacaggagaaaccgaggccaccaaagaaaagaaacggggcgggggcggaggccgcagauccaagaaagggggagaguuugaugaguucgugaacgacgauacagacgaugaccugcccaucagcaagaaaaagaagcggcgcaaaggcucuggguccgaacaggagggagaagaugaggaaggcggggagagaaagaaaaagaaacggcgcagacaccccaagggcgaggaaggaagcgacgacgaugagaccgaaaauggcccuaagccgaaaaagcggagacccccuaaagccgagaagaaaaaggcucccaagccugagagacucccuccguccaugaaagggaagauuaaaucuaaggccaucauuagcuccucugacgauagcuccgacgaagauaaacugaagaucgcggacgagggacauccucggaacagcaauucuaacuccgauagcgacgaagaugagcagagaaagaaaugcgcuucuuccgaaagcgacucugaugagaaucagaacaagagcggcuccgaggccgggagcccccgccggccuagacgccaacggucugaccaggacuccgauagcgaccagcccuccagaaaacgccggccuucuggaagcgaacaguccgauaaugagucuguccaaagcggcagaucccacucuggggugagcgaaaacgacucccgccccgccagcccgucugcugaguccgaucacgaaagcgagcggggcucugacaacgagggauccggccaggggagcggaaaugaaucugagccugaaggcuccaacaaugaggccagcgauagaggguccgaacauggaagcgacgauucugacuga

SEQ ID NO: 67996 - RNA, 792 nt, Artificial Sequence
  derived and/or modified sequence opt5 from CTRB1__Homo_sapiens__NP_001897
auggccagccuguggcuccuguccugcuucucucuugugggcgcugccuuuggguguggaguccccgcgauccacccuguucugagcggccucuccagaauugugaacggggaggacgcugugccgggaucuuggcccuggcaggucagccugcaagauaagaccggcuuccauuuuugcgggggaucccuuaucucugaagacugggugguuacagccgcccacuguggcgugcggacgagcgaugucgugguugcuggcgaguucgaccagggguccgaugaagagaauauucaggugcugaaaaucgccaaggucuuuaaaaacccuaaguucagcauucucaccgugaauaacgacaucacacugcugaaacucgcuacccccgcccgcuuuucucagacaguguccgcggucugccugccuagcgccgaugacgauuuccccgcuggaacccuuugugccacaaccggcugggggaagacgaaguacaaugcuaacaaaaccccugacaagcugcaacaggccgcgcucccgcugcuuucuaaugccgaaugcaaaaaguccuggggaagacggaucacagauguuaugauuugugcuggcgccagcggggugucuuccugcaugggagacagcggcggcccccuggugugucagaaagauggggcuuggacccucgucggaaucguguccuggggcucugacacaugcagcaccuccagcccugggguuuaugcccgcgugacgaagcugauucccuggguccagaagauccuggccgcuaacuga

SEQ ID NO: 67997 - RNA, 792 nt, Artificial Sequence
  derived and/or modified sequence opt5 from CTRB2__Homo_sapiens__NP_001020371
auggccuuccuguggcuccugagcugcugggcccuucugggcacaacauuuggguguggagugcccgcuauccacccuguccucuccggccugucuagaauuguuaacggggaggacgcggugccgggaagcuggcccuggcaagugucccuucaggauaagacgggcuuccauuuuugcgggggaucucugaucagcgaagacugggucgugaccgcugcccacuguggcguucggacauccgauguggucguggccggcgaguucgaccaggggucugaugaagagaauauucagguucucaaaaucgcuaagguguuuaaaaacccuaaguucagcauucugaccgucaauaacgacaucacacugcucaaacuggccacccccgcucgcuuuucccagacagugagcgccgugugccuuccuucugcggaugacgauuuccccgccggaacccugugugcuacgaccggcugggggaagacaaaguacaaugccaacaaaaccccugacaagcuccaacaggcugcccugccgcuucuguccaaugcggaaugcaaaaagagcuggggaagacggaucacagaugucaugauuugugccggcgcuucugggguuuccagcugcaugggagacucuggcggcccccucgugugucagaaagauggggccuggacccuggugggaaucgucuccuggggcagccgcacgugcuccacaaccaccccugcuguguaugccagaguugccaagcugauucccugggugcagaagauccucgcugcgaacuga

SEQ ID NO: 67998 - RNA, 843 nt, Artificial Sequence
  derived and/or modified sequence opt5 from CTRC__Homo_sapiens__XP_011538852
augcugggcaucaccgugcucgccgcucugcuugccugcgcgagcuccugugggguccccucuuucccuccgaaccugagcgcuagaguugugggaggcgaggacgcccggccccacuccuggccuuggcagauuucucuccaauaccugaagaaugauacauggcgccauacgugcgggggaacccuuaucgccagcaacuuugugcugacagcugcccacuguauuuccaauaccagaacauaucgggucgcugugggcaaaaacaaucucgaaguugaggacgaagaggggucucuguucgugggagucgauaccauccaugugcacaagcgcuggaacgcccugcuccugagaaaugacauugcgcuuaucaaacuggccgaacauguugagcucagcgauacaauccagguggcuugccugcccgagaaggacucccuucugccuaaagauuaccccuguuaugucaccggcuggggccggcucuggcgcgggcugagauggccuacggaacugccggugggagagcgguuucucggcgggguguggcaccgccagcuguggcuucccgccggacugcagcacccucaagaagcuggcagccuccaucccggggucagacugcaccggcuugaccagcgcgagaacgccgcgguuauuugcuguugggagagacggcagcgcgugccugccaccgcuaucaauuuccugcuccugggacccccgggcucucugauuugcgccgcuuccguggccagccuccugucuggcgccgcuccuuuucauacaauggaacccaagagagauccuacccagcccgucucccccacacuucacuga

SEQ ID NO: 67999 - RNA, 795 nt, Artificial Sequence
  derived and/or modified sequence opt5 from CTRL__Homo_sapiens__NP_001898
augcugcuccugagccuuacccugucccucgugcugcuuggcucuagcugggggugcggaauccccgccauuaagccugcucuguccuucucucagagaaucgucaacggcgagaaugccguucucgggagcuggccguggcaagugucccugcaggacucuagcggauuucacuucuguggcgggucccugauuagccagucuuggguggucacagcggcucacugcaacgugucccccggacggcacuuuguugugcucggcgaauacgaucgcagcucuaaugccgagccucugcagguccuuuccgugagcagagccaucacgcaucccucuuggaacuccaccacaaugaauaacgacguuacccugcucaaacuggcuagcccugcccaauauacaacccggauuucccccgugugucuugcuucuagcaaugaagcccugacagagggccucacaugcgucacgaccggguggggacgccuguccggcguggggaacgugaccccugcgcaucugcagcaggucgcccucccgcugguuaccgugaaucaguguagacaauacuggggaagcucuaucacagauuccaugaucugcgcuggcggggccggagcuagcucuugucagggcgacagcggcgggccccuugugugccagaagggaaacaccuggguccugauuggcaucguguccugggggacgaaaaauuguaacguucgggccccugcgguguauacacgcgucucuaaguucagcaccuggauuaaucaggugaucgccuacaacuga

SEQ ID NO: 68000 - RNA, 1497 nt, Artificial Sequence
  derived and/or modified sequence opt5 from CTSA__Homo_sapiens__NP_000299
augaccagcucccccagagccccuccgggcgagcaggggcggggaggcgcugaaaugauccgcgccgcgcccccuccccuguuccuccugcuucugcuccugcuucugcucgugucuugggcuagcagaggggaggccgccccugaccaagaugaaauucagcggcugcccggacuggcuaagcagccuuccuuucgccaguacucuggcuaucucaaagggagcggauccaagcaucugcacuacugguucgucgagucucaaaaagacccggaaaacagccccguugugcuuuggcugaauggcggcccugggugcuccagccucgauggacugcuuacagagcacggccccuuucuggugcagccugacggggucacgcucgaguauaaccccuacucuuggaaucugaucgccaacgugcuguaucucgaauccccggcuggaguuggcuucagcuacucugaugacaaguuuuaugccaccaaugauacagagguggcgcaguccaacuucgaagcccugcaggacuuuuucagacuuuuuccugaguacaaaaauaacaagcuguuccucaccggggagagcuacgcuggaauuuauauccccacacuggccguccuugugaugcaagauccuucuaugaaucugcagggccucgcuguuggcaacgggcuguccagcuacgaacagaaugacaacucccugguguauuuugccuacuaucauggacuccugggcaaucggcuuuggucuagccugcagacccacuguugcucccaaaacaaguguaauuucuacgauaacaaagaccucgagugcgucacaaaccugcaggaaguggcgcgcauuguggggaauagcggacuuaacaucuauaaucuguacgcccccugugcuggcgggguccccucucauuuuagauacgagaaggauaccguuguggugcaggaccucggaaacaucuucacgcggcugccucugaaacgcauguggcaccaagcccuccugagauccggcgacaagguccggauggauccgcccugcaccaauacaaccgcugccagcacauaucuuaacaauccuuacgugcgcaaagcccugaacauucccgaacagcucccucagugggacauguguaauuuccugguuaaccugcaguauagacggcuuuaccgcucuaugaauagccaauaucucaagcugcuguccucucagaaguaccagauccuccuguauaacggcgauguggacauggcuugcaauuuuaugggggaugagugguucgucgacagccuuaaccagaaaauggaggugcaaagacggcccuggcugguuaaguacggagauuccggcgaacagauugcgggguuugugaaagaguucagccacaucgccuuucucaccauuaagggagcuggccauauggucccgacggacaaaccucuggccgccuucacaauguuuucuagauuccugaauaagcagcccuacuga

SEQ ID NO: 68001 - RNA, 1020 nt, Artificial Sequence
  derived and/or modified sequence opt5 from CTSB__Homo_sapiens__NP_680093
auguggcagcugugggccagccucugcugucugcuugugcuggcuaacgccagaucccggcccucuuuccacccucucagcgacgagcuggucaauuacguuaacaagcgcaauaccacauggcaagcgggccauaacuuuuauaauguggauauguccuaccuuaaaagacugugcgggacguuccucggaggcccgaagcccccucagcgggugauguuuaccgaagaccugaaacugcccgcuucuuucgaugcccgcgagcaguggccucagugucccacaaucaaggaaauuagagaccaagggagcugcggauccuguugggccuuuggcgcugucgaggccaucucugaucggauuugcauccacaccaacgcucaugugagcguugaaguguccgccgaggaccuccugacauguugcgggagcauguguggagauggcugcaauggcggguauccugcggaggccuggaacuucuggacccgcaaaggacuugucucuggcgggcuguacgaaucccacgugggauguagaccguauagcauucccccuugcgagcaucacguuaauggcucucggcccccuugcacaggggaaggagacacccccaaguguuccaagaucugcgagccgggcuacagcccuacguauaaacaggauaagcacuacggcuacaacucuuauuccgugagcaauuccgagaaagacaucauggcugaaauuuacaagaacgggcccgucgagggagccuuuucuguguauagcgauuuccuccuguacaaauccggcguguaucagcaugucaccggggaaaugaugggaggccacgcuauccgcauucuuggguggggaguugagaauggcacaccuuacuggcugguggccaacagcuggaauaccgacuggggcgauaacggguuuuucaagauccucagaggacaggaccauuguggcauugaaucugagguggucgcggggaucccccggacagaccaauauugggagaagauuuga

SEQ ID NO: 68002 - RNA, 426 nt, Artificial Sequence
  derived and/or modified sequence opt5 from CTSC__Homo_sapiens__NP_001107645
augggcgccgggcccagccugcuccuggcugcccuucugcuccugcuuuccggagacggcgcggugagaugcgauaccccugcuaacuguacauaccuggaccuccuggggacgugggucuuccagguuggaucuagcggcucccaacgggaugugaauugcucugugauggggccgcaggagaagaaagucgugguuuaucugcagaagcucgacaccgccuacgaugaccugggaaacagcggccacuuuacaaucauuuauaaucagggcuucgaaaucgugcuuaacgauuacaaaugguuugccuucuuuaaggacgucaccgauuucauuucccaucuguuuaugcaacucgggacagugggaaucuaugaccugccccaccuucgcaauaaacuggcuaugaacagacgguggggcuga

SEQ ID NO: 68003 - RNA, 1239 nt, Artificial Sequence
  derived and/or modified sequence opt5 from CTSD__Homo_sapiens__NP_001900
augcagcccagcucccugcucccucuggcccuuugccugcucgcugccccggcgucugcucuggugagaaucccccuucacaaguucaccagcauucggcgcacaauguccgaggucggcgggucuguugaagaccugaucgccaaaggaccugugagcaaguacucccaagccgugcccgcugucacggagggcccuauucccgaagugcucaaaaacuauauggaugcccaguacuauggggagaucggaauuggcaccccuccgcaguguuuuacaguuguguucgacaccgggucuagcaaucuguggguccccuccauccauugcaagcugcucgauaucgcuuguuggauucaccauaaauacaacagcgacaagucuuccacauaugugaagaauggaaccagcuuugauauccacuacggcucuggcucccugagcggguaucuuucucaggacacaguuuccgugccuugccaaagcgccuccucugcgagcgcccugggaggcgucaaaguggaaagacagguguucggggaggcuaccaagcagcccggaauuacguuuaucgccgcuaaauucgauggcauucucgggauggccuacccucggaucuccgucaacaauguucugcccguguuugacaaccuuaugcagcaaaagcugguggaucagaauauuuucagcuuuuaccucucucgcgacccggaugcgcagccuggaggcgagcugaugcugggcgggaccgacuccaaauauuacaagggaagccucucuuaucugaacgucacaagaaaggccuacuggcaagugcaucuugaucagguugaaguggcuagcggccugacccucuguaaagaggggugcgaagccaucgucgacacaggaaccucccugauggugggccccguugacgaggugcgggagcuucagaaggcuaucggggccgucccucugauucagggagaauauaugauccccugugagaaagugucuacgcuccccgccauuacacugaagcugggcggcaaaggguacaagcucagcccugaagauuauacccugaaagucucccaagcuggaaagacacuuugccugagcggcuucauggggauggacaucccgcccccuucuggaccccucuggauucugggcgauguguuuaucgggcgcuacuacaccguuuucgacagagauaauaaccgggugggcuuugcggaggccgcucgccuuuga

SEQ ID NO: 68004 - RNA, 1191 nt, Artificial Sequence
  derived and/or modified sequence opt5 from CTSE__Homo_sapiens__NP_001901
augaagacccugcuccugcuucugcucgugcugcuugagcugggcgaagcccaggggagccuccacagagucccccugcggcgccacccuucccugaaaaagaaacucagagcucggucucaacugagcgaguucuggaagucccacaaccuugacaugauccaguuuacagaaucuugcagcauggaucaguccgccaaagagccgcugauuaauuaccucgacauggaauauuucggaacgaucucuauuggcagcccuccccagaacuuuaccguuaucuucgauacaggguccagcaaucugugggugcccucuguguacuguaccuccccugcgugcaagacacauagccgcuuucaacccucucaguccagcaccuauucucagccuggacaguccuucagcauucaauacggcacagggucccuuucuggaaucaucggcgcugaccaggucagcguggagggccugaccguuguggggcagcaguuuggagaguccgucacggaaccgggccaaaccuucguggaugccgaguuugacgggauucucggacugggcuaucccagccuggccguugggggagugacaccugucuucgauaacaugauggcucagaaucucguggaccugcccauguuuucuguguacauguccagcaacccugaaggcggcgccgggucugagcuuaucuucggaggcuaugaucacagccauuuuuccgggucucugaauuggguccccguuaccaagcaggcuuacuggcaaauugcccucgacaacauccaggugggaggcacagugauguucuguagcgaggggugccaggcgauugucgauaccggaacgucccugaucacaggcccgagcgacaaaauuaagcagcuucaaaaugccaucggcgcugccccuguggauggggaauacgcuguugagugugccaaccugaaugugaugcccgacgucaccuucacaaucaacggagugccuuauacccucucucccaccgcguacacacugcuggacuuuguugauggcaugcaguucugcuccagcggguuucagggacucgacauucaucccccugccggcccgcuguggauccuuggggauguguucauuagacaguuuuauucugucuucgaccggggcaauaaccgcgugggacuggcucccgccgucccuuga

SEQ ID NO: 68005 - RNA, 1455 nt, Artificial Sequence
  derived and/or modified sequence opt5 from CTSF__Homo_sapiens__NP_003784
auggcccccuggcugcagcuccugagccuucugggccuccugccuggggcuguggccgcgccggcucaacccagagccgccuccuuccaggcuuggggaccucccucuccugagcuucuggcccccacccgguuugcucucgaaauguucaaccgcggcagagccgcggggacacgggccguccugggacugguucgcggcagagugcggcgcgcugggcagggaagccucuacucccuggaggccacgcuugaggaaccuccgugcaaugaccccaugguguguagacugccugucucuaagaaaacccuccugugcagcuuucaggugcuugaugaacugggccggcacguucuccugcgcaaggacuguggccccguggauacaaaagucccuggggcuggagagcccaaguccgccuucacccaaggcucugcgaugaucagcucccugagccagaaccauccggacaauagaaacgagacauuuucuuccgugauuagccuccugaaugaagauccucuuucucaggaccugcccguuaaaauggccuccaucuucaagaacuuugugauuaccuauaaucggacauacgagagcaaggaagaggcucgcuggagacucucugucuucgugaacaauauggugcgggcccagaaaauccaagcucuggaucgcgggaccgcccaguauggagucacgaaguuuuccgaccuuaccgaggaagaguucagaacaauuuaccugaacacccuccugcggaaagaaccuggcaauaagaugaaacaggccaagagcguuggggaucuggcuccucccgagugggacuggagauccaagggagcggugacaaaagugaaggaucagggcaugugcggcucuuguugggccuuuagcgucaccgggaacguggaaggacaaugguuccucaaucagggcacgcugcuuucccugagcgagcaggagcuccuggacugcgauaaaauggacaaggcuuguaugggagggcuucccucuaacgccuauuccgccaucaaaaaucugggcgggcucgaaacagaggacgauuacagcuaucaaggacacaugcagucuugcaacuuuagcgcugaaaaggccaaaguuuacaucaacgacuccguggagcugucucagaaugaacagaagcuggcggcuuggcucgccaagcgcggcccgauuagcgucgccaucaacgcuuucggcaugcaauucuaccggcaugggauuuccagaccccugcgcccucuuuguagccccuggcugaucgaucacgccgugcuccugguuggauauggcaaucggucugacgugccuuuuugggcuauuaaaaacuccugggggaccgauuggggagagaagggcuacuauuaccugcauagagggagcggcgccugcggagucaauacaauggcgucuuccgccguggucgacuga

SEQ ID NO: 68006 - RNA, 768 nt, Artificial Sequence
  derived and/or modified sequence opt5 from CTSG__Homo_sapiens__NP_001902
augcagccccugcuccugcuucuggccuuccuccugccuaccggcgcugaggccggggaaaucauuggaggcagagagagccggccgcacucccgccccuacauggcguaucuucaaauccagucuccugcugggcagagcagaugcggaggcuuucuggugcgggaagacuucguccucaccgccgcccauuguuggggguccaacauuaauguuacgcugggagcucacaacauccagcgcagagagaauacccaacagcauauuacagcccggcgcgcuaucagacacccccaguacaaccagcggaccauccaaaaugauauuaugcugcuccagcugucucgcagagugcggcgcaacagaaaugugaacccugucgcccuuccccgggcgcaggaaggccugcgcccuggcacacucugcaccguggccggguggggaagaguuagcaugcggagaggcacagacacccugcgcgaggugcagcuucggguccaaagagaucgccagugucugcggaucuuuggguccuaugacccgagacgccagauuugcgugggagaucggagagagcgcaaggcugccuucaaaggcgacucugggggaccccuccuguguaauaacguugcucauggcaucgugagcuacggcaaguccagcggggucccucccgaaguguuuacgcgggugucuuccuuccugccuuggauuagaaccacaaugcgcagcuuuaaacuccuggaucaaauggagacaccccuuuga

SEQ ID NO: 68007 - RNA, 1008 nt, Artificial Sequence
  derived and/or modified sequence opt5 from CTSH__Homo_sapiens__NP_004381
augugggccacccugccccuccugugcgcuggcgccuggcuucugggggugccugucuguggagcggcugagcucugcguuaacagccuggaaaaguuccacuuuaaauccuggaugucuaagcauagaaaaacauacagcacggaggaauaucaccaucggcuucagaccuucgccuccaauuggcgcaagaucaacgcccacaauaacggcaaucauacauuuaaaauggcucugaaccaauucucugacaugagcuuugccgagauuaagcacaaguaccucugguccgaaccgcagaauuguucugcuaccaaaagcaacuaucugagagggacaggacccuacccucccuccguggauuggcggaagaaaggcaauuucgugagcccugucaagaaccagggggccugcggaucuuguuggaccuuuuccacaaccggcgcgcuggagagcgccaucgcuauugccacgggcaaaaugcucucucuggcugagcagcaacuuguggacugcgcccaggauuucaauaaccacgggugucagggaggccugcccucccaggcguuugaauauauccucuacaauaaggggauuaugggagaggacaccuauccuuaccaaggcaaggauggguacugcaaauuccagccgggaaaggccaucggcuuuguuaaagacguggcuaacaucacaauuuaugaugaagaggccauggucgaggcuguggcccuguacaaucccguuagcuucgccuuugaagugacccaggacuucaugauguaucgcacaggcaucuacucuuccaccagcugucauaagacgccugauaaagucaaccacgcugugcuugcggugggguauggagagaagaacggcauucccuacuggaucgucaaaaauuccugggggccucaguggggaaugaacggcuauuuccugauugaaagagggaagaauaugugcggacucgccgcuugugccucuuaccccaucccgcugguuuga

SEQ ID NO: 68008 - RNA, 1002 nt, Artificial Sequence
  derived and/or modified sequence opt5 from CTSL__Homo_sapiens__XP_005251773
augaaccccacccugauccucgccgcuuucugccugggcauugccagcgcgacacuuacguuugaccacucccuggaggcucaguggaccaaguggaaagccaugcauaauagacucuacgggaugaacgaagagggauggcggcgcgccgugugggaaaagaauaugaaaaugaucgagcugcacaaccaagaauauagagagggcaagcauucuuucacaauggcuaugaaugccuuuggggauaugaccagcgaggaauuucggcaggucaugaacggauuucagaaucgcaaaccuagaaagggcaagguuuuccaggagccgcuuuucuacgaagcuccccgguccguggacuggcgcgagaaaggguaugugacaccugucaagaaccaaggacaguguggcucuugcugggccuucagcgcgaccggcgcccuggaggggcagauguuuagaaaaacaggacggcucauuucccugucugaacagaaucugguggauuguagcggcccccaagggaacgagggaugcaauggcgggcucauggacuacgcuuuccaguauguucaggauaacggaggccuggacuccgaagagagcuacccuuaugaagccaccgaggagucuuguaaguacaaucccaaauacuccguggcuaacgauacgggcuuugucgacaucccuaagcaggaaaaggcccuuaugaaagcgguggccaccguugggccgauuagcguggcuaucgaugccggacacgagucuuuccuguuuuauaaggaaggcaucuacuucgagcccgacugcuccagcgaagauauggaccaugggguccucguggugggauauggcuucgagucuacagaguccgauaauaacaaauacuggcuggucaagaacagcuggggagaagagugggggaugggcggcuauguuaaaauggcuaaggaccgcagaaaucacugugggauugccuccgccgcuucuuacccuaccguguga

SEQ ID NO: 68009 - RNA, 966 nt, Artificial Sequence
  derived and/or modified sequence opt5 from CTSO__Homo_sapiens__NP_001325
auggacgugagagcccugcccuggcucccuuggcugcuuuggcugcucugccggggcgggggagaugcugacagccgcgccccguucacccccacauggccuagaucccgggagcgcgaagcggcugccuuuagagagucucugaaccggcaccgcuaccuuaauagccuguuccccuccgaaaacucuacggccuuuuauggcaucaaucaguucagcuaccucuuuccugaggaguucaaggcuauuuaucugagauccaaacccucuaaguuuccucgguacagcgccgaaguccauauguccaucccgaacguuagccugccccuccgcuucgauuggagagacaaacaaguggugacccagguccggaaucagcagaugugugggggaugcugggcuuuuucugugguuggcgccguggaguccgcguaugccauuaaggggaaaccucuggaagaucuuagcguccaacaggugaucgacuguucuuacaacaauuauggaugcaacggcggcuccacacugaaugcucucaacuggcugaauaagaugcagguuaaacuugugaaggauagcgaguaccccuucaaggcccagaacgggcugugucacuacuuuucuggaucccauagcggcuucuccauuaaaggguauucugcuuacgacuuuagcgaucaagaagacgagauggccaaggcgcuccugaccuucggaccucuggucgugaucguggaugccgucuccuggcaggacuaucucggcgggaucauucagcaccauugcagcucuggagaggcuaaucacgccguucugaucacaggcuucgauaaaaccggcuccacacccuacuggauugugcgcaacagcugggggucuagcuggggaguggacggcuaugcucacgucaagaugggguccaauguguguggaaucgccgacucuguuagcuccauuuuuguguga

SEQ ID NO: 68010 - RNA, 1005 nt, Artificial Sequence
  derived and/or modified sequence opt5 from CTSV__Homo_sapiens__NP_001188504
augaaccugagccucgugcuggccgcuuucugccuuggcaucgccuccgcgguccccaaguuugaccagaaucuggauaccaaaugguaccaauggaaggcuacacacagacggcucuauggggccaacgaggaaggauggcgcagagccguuugggagaaaaauaugaagaugauugaacugcauaacggcgaguacucucaggggaaacacggauucacgauggcuaugaaugccuuuggcgacaugaccaacgaagaguuccggcagaugaugggguguuuucgcaaucagaaguucagaaagggaaaaguguuucgggagccucuuuuccuggaucuccccaagagcguggacuggcgcaaaaagggcuaugucacaccggugaaaaaccaaaagcagugcggcuccuguugggcuuuuucugccaccggggcgcuggaaggacagauguucagaaagacaggcaaacugguuagccucuccgagcagaaucugguggauugcucucggccucaagggaaccagggauguaauggcggguuuauggcccgcgcuuuccaguacgucaaggaaaacggaggccuugacagcgaggaguccuaucccuacguggccguugaugaaaucugcaaauauagaccugagaauagcguggcuaacgacaccggcuuuacagucguggcccccgggaaggaaaaagcgcugaugaaggccguggcuaccgucggaccuauuucuguugccauggaugcuggccauuccagcuuccaguucuacaaaucugggaucuacuuugagccggacuguuccagcaagaaucucgaucacggagugcugguggucggcuauggguucgaaggagccaacucuaacaauuccaaguacuggcuugugaaaaacagcuggggccccgaguggggcuccaauggguauguuaagauugccaaagacaagaacaaucauugcggaaucgcuacggcggccucuuacccuaacguguga

SEQ ID NO: 68011 - RNA, 1131 nt, Artificial Sequence
  derived and/or modified sequence opt5 from CTSW__Homo_sapiens__NP_001326
auggcccugaccgcucaccccagcugccuccuggcccuucugguggcgggccucgcucaggggaucagaggaccucugcgggcccaagaccuuggcccgcagccccuggagcucaaggaagccuucaaacuguuucagauucaguucaaccgcuccuaccugucuccugaggaacaugcucacagacucgauaucuuugcccauaaucuggcucaagcccagcggcuucaggaggaagaccuggggacagcggaguucggagucacgcccuuuagcgaucucaccgaggaagaguucggccagcuguauggguaccgcagagccgcuggaggcguuccuuccaugggccgggaaauucgcucugaggagcccgaagagagcgugccuuuuuccugugacuggagaaagguggccggggcuaucucuccgauuaaagaucaaaagaacugcaauuguugcugggccauggcggccgcuggaaacaucgaaacacuuuggcggaucagcuucugggacuuugucgauguguccguucaggagcugcucgacuguggccgcugcggggauggaugucacggcggguucgugugggacgccuuuauuaccguccugaauaacagcggacuggcuucugaaaaagauuaucccuuccagggcaaggugagagcccaucggugccacccuaagaaauaccagaagguugccuggauccaagacuuuauuaugcuccagaauaacgagcaccgcaucgcucaguaucuggcgacauacggccccauuaccgugacaaucaauaugaaaccucuucaacuguauagaaagggggucauuaaagccacccccacgaccugugauccgcagcucguggaccauuccgugcugcuugucggauucggcagcguuaagucugaggaagggaucugggcugagacaguguccagccagucucagccucaacccccucaccccacccccuacuggauccugaagaacuccuggggagcccaguggggcgaaaaaggguacuuccggcuccaucgcggaagcaauacaugcggcauuaccaaguuuccucugacggccagagugcagaaaccggacaugaagccccgggucuccuguccucccuga

SEQ ID NO: 68012 - RNA, 912 nt, Artificial Sequence
  derived and/or modified sequence opt5 from CTSZ__Homo_sapiens__NP_001327
auggccagacggggccccggguggcgcccucugcuccugcuugugcugcucgcuggagccgcgcagggcgggcuguacuucagacggggacaaaccugcuaucgcccgcuuagaggcgacgggcuggcuccccucggacggagcacauacccucgcccccacgaguaucuguccccugccgaucugcccaagucuugggacuggagaaacgucgauggcguuaauuacgccagcaucacgcggaaccagcauauuccucaguauuguggcuccugcugggcucacgccucuaccagcgcuauggccgaccgcaucaauauuaaaagaaagggggcguggccguccacacuccugucugugcagaacgugaucgauuguggaaaugccggcagcugcgaagggggaaacgaccuuuccgucugggauuacgcucaucaacacggcauucccgacgagaccuguaauaacuaucaggccaaagaucaggaaugcgacaaguuuaaucagugugggacaugcaacgaguucaaagaaugucaugcuauccggaauuacacccuguggcgcgugggagauuacggcagccucucuggcagagagaagaugauggccgagaucuaugcgaacgggccuauuuccugcggaaucauggccacagaacggcuggcuaauuacaccggcgggauuuaugccgaguaccaagacacgaccuauaucaaccacguugugagcgucgcuggauggggcauuucugaugggacagaauacuggaucgugcgcaauuccuggggagagcccuggggcgagagaggcuggcuucggauuguuaccagcacauauaaggacgggaaaggagccagauacaaccuggccaucgaggaacacuguaccuuuggcgacccuaucguguga

SEQ ID NO: 68013 - RNA, 4992 nt, Artificial Sequence
  derived and/or modified sequence opt5 from CTTNBP2__Homo_sapiens__NP_219499
auggccaccgacggcgcuagcugcgagcccgaucuguccagagccccugaagacgcggcuggggccgccgcugaggccgcuaagaaagaguucgauguggacacacucucuaagagcgaacugcggaugcuucuguccgucauggaaggagagcucgaggcccgcgaucugguuaucgaagcgcuuagagcccggcgcaaagagguguuuauucaggaaagauacggccgguucaaccugaaugacccguuucucgcucugcaacgcgauuaugaggccggggcuggagacaaggagaaaaagcccguguguacgaacccucugucuauccucgaagccgucauggcgcacugcaagaaaaugcaggagagaaugagcgcccagcuggcugccgcugaaucccggcagaagaaacuugagauggaaaagcugcaacuccaggcccuggagcaggagcauaaaaagcuggccgcucgccuggaagaggaaagaggcaagaauaaacaggugguucucaugcuggugaaggaguguaaacaacugucugggaaggucauugaagaggcgcagaaacucgaggaugugauggccaagcuggaagaggagaaaaagaagaccaacgaacuugaagaggagcugagcgcugaaaaacggcgcuccacagagauggaagcccagauggagaagcagcucagcgaguucgacaccgaaagagagcaacugcgggccaaacuuaaucgcgaagaggcucacacaaccgaucugaaggaagagaucgacaaaaugagaaagaugauugagcagcucaagcggggaucugauuccaaacccagccugucucugccuagaaagacaaaagaccgccggcucguuuccaucagcgugggcaccgaaggcacggucaccagaucuguggccugccagacagaccuggugaccgagaacgcggaucauaugaagaaacuuccccugacaaugccugucaagccguccaccgggagcccccucguuuccgcuaaugccaagggaucuguguguacgagcgccacaauggcucgcccuggcaucgaccggcaagccuccuacggggaucugauuggagcuagcgugcccgccuuuccucccccgucugcgaacaaaaucgaagagaauggcccuuccaccgggagcacacccgacccuaccucuagcaccccuccccuucccuccaacgccgcuccgcccacagcccagacgccuggaauugcuccccaaaauucucaggccccucccaugcacagccugcauuccccgugcgcgaacaccagccuccacccuggccugaaucccagaauccaggccgcucgcuuccgguuucagggcaacgccaaugauccugaccagaacgggaacacaacccagucucccccuuccagagaugucagccccacaucucgcgacaaucugguggcuaagcaacucgcccggaacaccguuacgcaggcccuguccagauucacaagcccgcaggcuggagcgccuucccgccccggcgugcccccuaccggggaugucggaacccacccgcccgugggccggacaucucuuaaaacccaugggguugccagaguggaccggggaaauccucccccuauucccccuaagaaacccggccugagccagacaccguccccuccccacccucaacucaaggucaucauugauucuagccgcgcuuccaacacgggcgccaagguggacaauaaaaccgucgccagcacacccucuucccugccgcaggggaacagagugaucaaugaagagaaccugccuaagagcucuagcccccagcuuccucccaaacccuccaucgaccucaccguugcuccugccggaugugcggugucugcucuggccacaagccaggucggcgccuggccggcugccacccccgggcugaaucaaccugcgugcuccgauagcucucucgugauucccacgaccaucgcuuuuuguuccagcauuaacccuguuuccgccucuagcugccggcccggagccuccgacucucugcuugugacagcuagcggcugguccccuucucugaccccgcuccugaugagcgggggccccgccccucuggcuggaagacccacacuucuccagcaggccgcggcccaaggcaaugucacccugcuguccaugcuccugaacgaggaagggcuugauaucaauuauagcugugaggacggacauucugcucuguacuccgccgcuaagaacggccacacggauugcgugcgccuccugcugagcgccgaagcccaggugaaugcugcggacaaaaacggguucacaccucuuugcgccgcugccgcccagggacacuuugaguguguugaacuccugauuucuuaugaugcuaacaucaaucaugccgcggacggcgggcagacaccccuguaccucgcuugcaagaacggcaauaaagaguguaucaagcugcuucuggaggccggaaccaaccgguccgucaagaccaccgauggcuggacaccggugcacgccgcuguggacacggggaaugucgauagccucaaacugcugauguaucaucgcauuccugcccacggaaacucuuucaaugaagaggaauccgagagcuccguguuugaccuugauggcggggaggaaagccccgagggaaucucuaagcccguugugccugcggaccucauuaaccaugcuaauagagaaggcuggaccgccgcccacaucgcugccagcaaaggguucaagaacugccuggagauucuguguagacacggcggacucgaacccgagcggcgcgacaaaugcaauagaacaguccaugauguggcuaccgacgauuguaagcaucugcuugagaaccugaaugcccucaagaucccucugcggaucuccguuggcgaaauugagccgucuaacuacgggagcgacgaucuggaaugcgagaauacaaucugugcgcuuaacauucgcaaacaaaccuccugggacgauuucucuaaggccgugagccaggcucugacgaaccacuuucaggccaucuccucugacggaugguggagccucgaagaugucacaugcaauaacaccaccgacuccaauauuggccugagcgcuagaucuauccgguccauuacacucgggaacgugcccuggagcguuggacagucuuucgcccaauccccuugggauuuuaugcgcaaaaauaaggccgagcacaucaccgugcugcuuagcggcccccaggaggggugucuguccucugucacauacgcuagcaugaucccucuccagaugaugcagaacuaucugagacugguggaacaauaccacaaugugauuuuccauggccccgagggaucccuucaggacuauaucguccaccagcuggcgcucugccugaaacaucggcaaauggccgcuggcuuuagcugcgaaauuguucgcgccgagguggaugccggguucucuaaggaacagcuccuggaccuuuuuaucuccagcgcuugucugauuccggugaagcagucuccuagcaaaaagaaaaucaucauuauccucgagaaccuggagaaguccucucugagcgaacuucugagagacuuccucgcgccccuggagaaucgguccacggaaucuccuugcaccuuucagaaaggaaacggccucagcgaguguuacuauuuccacgagaauugcuuucugauggggacaauugccaaggcuugucuucaaggauccgaucugcugguccagcagcauuucagaugggugcagcuccgcugggacggcgaacccaugcaaggccugcuucagcgguuucugagacgcaagguugugaacaaauucaaggggcaggccccuagccccugcgauccggucuguaaaaucguggacugggcccucucuguuuggcggcagcuuaauuccugccucgcuagacugggaaccccugaggcccuucugggccccaaguacuuccugagcugucccguggucccugggcacgcgcaagugacaguuaaauggauguccaagcucuggaacggagugauugccccgcgcguccaggaagcuauccugucucgggccagcgugaaaagacagcccggcuuugggcagaccacggcuaagcgccacccuucccaaggacagcaggccguggucaaggcugcccuuucuauccugcucaauaaagcgguucugcauggcugcccccucccucgggccgagcuggaucaacacaccgcugacuucaagggcgggagcuuuccccuuuccauugugagcucuuauaacacauguaacaaaaagaaaggagaauccggcgccuggagaaaggugaauaccagcccucggcgcaagucugggagauucucccugccgacauggaacaaacccgaucugagcaccgagggaaugaagaauaaaacaaucucucagcucaacugcaaucggaacgcuagccuguccaagcagaaaucucuugagaaugaccugagccucacccugaaccucgaucagcgccugucccuuggcagcgacgaugaagccgaccuggucaaggagcugcaauccaugugcucuagcaaguccgaaucugacauuagcaaaaucgccgauuccagagacgaucuccggauguuugacucuagcgggaauaacccugugcuguccgcuacgauuaauaaccuuagaaugcccguuagccagaaggaggugucuccucuguccagccaucagacaaccgaauguucuaauuccaaaagcaagaccgagcucggagucucucgcgugaaauccuuccugcccguuccgcggagcaaggugacacagugcucccaaaacaccaagagaagcucuagcuccucuaauacgcgccagaucgagaucaacaauaacagcaaagaagucaacuggaaucugcacaagaacgagcaucucgaaaaaccuaauaaguga

SEQ ID NO: 68014 - RNA, 1905 nt, Artificial Sequence
  derived and/or modified sequence opt5 from CTTN__Homo_sapiens__NP_001171669
auguggaaggccagcgcuggccacgccguguccaucgcgcaggacgaugcuggggccgacgauugggagaccgaccccgauuucgucaacgacguuucugaaaaagagcaaagauggggagccaagacagugcagggcagcgggcaucaggaacacauuaauauccauaaacugcgggagaacguguuucaggaacaccaaacgcucaaggagaaagagcuggaaaccggaccuaaggcuucccauggcuacgggggaaaguucggcgucgagcaggaucgcauggacaaaucugccgugggccacgaauaucagagcaaacuuuccaagcacugcucucagguugauagcgugagaggguuuggaggcaaguucgggguccaaauggaccggguggaucaguccgcuguuggauuugaguaccagggcaaaacagagaagcaugccagccagaaggacuauucuuccggguucggaggcaaauacggcgugcaagcggaucgcgucgacaagagcgccgugggguuugacuaucagggaaaaaccgaaaagcacgagucucagagagauuacuccaaaggcuucgggggaaaguauggcauugacaaagauaagguggacaagagcgcugucggguuugaauaccaaggaaaaacagagaagcaugaaucucagaaagauuacguuaagggcuucggcgggaaauuuggagugcagaccgaccggcaggauaagugugcccugggcugggaccaccaagagaagcuccagcugcacgagucccagaaagauuauagcaagggguucggaggcaaauacggggugcagaaggaccgcauggauaaaaaugcuuccacauuugaagacgucacccaagugucuagcgccuaucagaagacgguuccgguggaggcggucaccuccaagacaagcaacaucagagccaauuucgaaaaccuugcuaaagagaaggaacaggaggaccggcgcaaagccgaggcugaaagagcccagcggauggccaaggagcgccaagaacaggaggaagcuagacggaaacuggaggagcaggcgcgcgccaagacccagacacccccugugucucccgcuccucaacccaccgaagagagacucccuuccagcccgguuuacgaagaugccgccucuuucaaggcugagcugagcuaucggggccccguguccggaacggagccugaacccgucuacucuauggaggccgcggacuauagagaagcuagcucccagcagggccuggccuacgccacagaggcuguguacgaaagcgccgaggcuccugggcauuaucccgccgaggauucuaccuacgacgaauaugagaaugaucucggaauuacagcggucgcccuguacgacuaucaagcugccggcgaugacgaaaucuccuuugauccggacgauaucauuaccaacaucgagaugauugacgaugggugguggcgcggagugugcaaaggccgguucagagaacuugcuuuuagcuguguucgcguggcccuggucccuaucaagugcucucgggaccuccccgggcaggcgagaggccugcgcuccgcccuuuggcgggugggaagaaaagacuguccucgccggggcgcuagcuccagaguuucucugcucgggcgccggggacugggccugauggaggugaaucccgagcucagccaccccgaacauagauccugccacguccggugggagauuugucugugccauaccgugacagcccgcagaauccggaaacuuauuucuuuccugagaagccgcgaagcugggccugugccguccuguagccagguuggaggcgucucuuuucagaaggugacguggaagugccucgggaccugggugcccgaguguccuuga

SEQ ID NO: 68015 - RNA, 1047 nt, Artificial Sequence
  derived and/or modified sequence opt5 from CTU1__Homo_sapiens__NP_660275
augcccgccccuccgugcgcuagcugucacgccgcgagagcugcccugcggcgcccccucuccggccaggcccugugcggggcuuguuucugcgccgcuuuugaggccgaagugcuucauaccguccuggcgggaagacuccugccucccggcgccguuguggcugugggggccucuggaggcaaggacagcacaguccuugcucacgugcugcgggcccucgcgccucgccuggggaucucccugcaacucguugccguggaugagggaauuggcggcuacagagacgcugcccuggcugccguccggcgccaggccgcuagaugggaacuuccccugacggugguugcguaugaggaucucuucgggggauggaccauggacgccguggcucggucuacagccggcagcgggcgcuccagaucuuguugcaccuuuuguggaguccugcggcgcagagcccuugaagagggcgcucggcgcgugggggccacacauaucgugaccggacacaacgcggaugacauggcugagacaguccugaugaauuuccucagaggcgaugccggccggcuggccagagggggaggccuggggagcccuggagaaggcggggcucucccgcgcugccggccccugcaguuugccucccagaaagagguugugcuuuacgcucauuucagacgccuggacuauuuuagcgaagaguguguguacgccccugaggcguuccggggacacgccagagaucuccugaagcgccuugaagcugcccggcccucugcuguccuggaccucgugcacuccgccgagagacuggcgcuggccccugcugcccggcccccgcgcccuggcgcuugcagcagauguggcgcccucgccucucgcgcucugugccaagcgugcgcccuucuggaugggcucaaccggggaagaccccggcuggcuauuggcaaagggcgcagaggacuugacgaagaggccaccccuggcacgcccggggaucccgcccggccuccggcuuccaaggccguucccaccuuuuga

SEQ ID NO: 68016 - RNA, 246 nt, Artificial Sequence
  derived and/or modified sequence opt5 from CTXN3__Homo_sapiens__NP_001041717
auggacggcgggcagcccaucccuagcucccuggugccgcucggaaacgagucugccgauagcuccaugucucuggaacaaaagaugaccuucgucuuuguuauucuucuguucaucuuucucggcauucugaucgugagaugcuuccggauucuucuggaccccuaccgcagcaugccuacauccacgugggcugaugggcucgagggacuggaaaaaggccaguuugaccacgcccuggcguga

SEQ ID NO: 68017 - RNA, 10872 nt, Artificial Sequence
  derived and/or modified sequence opt5 from CUBN__Homo_sapiens__NP_001072
augaugaacaugagccugcccuuccucuggucccugcuuacccugcucaucuuugccgaggugaauggagaggcuggggagcuggaacuucagcgccaaaagcggucuauuaaccugcagcagccucgcauggccaccgagagaggaaaucucguuuuccugacgggaagcgcccagaacaucgaauuucggaccgggucccugggaaagauuaagcucaaugacgaggaucugucugagugccuucaccaaauccagaaaaacaaggaagacauuaucgagcugaaaggcagcgcuaucgggcucccgcagaauauuuccucucagaucuaccaacugaacagcaaacuuguugaucuggaacgcaaguuccagggacuccagcagacgguggacaaaaagguguguuccagcaaucccugccaaaacggcggcaccugucugaaucugcacgauagcuuuuucugcauuuguccuccccaguggaaagggccucucugcuccgccgacgucaacgagugugagaucuauagcggaacaccccugucuugccagaauggcgggaccugugugaacacaaugggauccuacagcugccacuguccuccggaaaccuauggcccccaaugcgccucuaaguacgaugacugcgaagggggauccguugcuagaugugugcauggcauuugcgaagaucuuaugcgggagcaggccggcgaaccuaaauauagcugugucugcgacgcuggguggauguuuucccccaauucuccugccuguacgcuggaucgcgacgagugcagcuuccagcccggaccguguuccacccucgugcagugcuuuaacacacaaggcagcuucuacuguggggccugcccuaccggauggcagggcaacggguauaucugugaggauauuaaugaaugcgagaucaacaauggaggcugcucuguugcgccuccuguggaaugugucaacacacccggcuccagccacugccaggcuugucccccuggguaccagggagacggcagagugugcacccugacggacaucuguucugugagcaaugggggaugccauccggaugccuccuguucuagcacacuuggcucccugccccucugcaccugucugccuggguacacaggcaacggauauggccccaaugggugcguccaacugagcaacauuugucucucucacccuugccugaauggacagugcaucgacaccguuuccggcuacuuuuguaagugcgauagcggguggaccggagugaacuguacagagaauauuaacgaaugccuuucuaaucccugucugaacggcgggacgugcguggacggcgucgauuccuucagcugugagugcacccggcucuggacaggagcucugugucaggugccgcagcaaguuugcggcgagucccuuucugggaucaauggaucuuuuuccuaucgcucuccugacgugggcuacguccacgaugugaacuguuucuggguuauuaagaccgaaauggggaaagugcugagaaucacauucaccuuuuuccggcucgagagcauggacaacugcccccaugaauuucugcaggucuaugauggagacuccagcucugccuuccagcugggccgcuuuugcggguccagccucccucacgagcugcuuucuuccgauaaugcccuguacuuccaucucuauagcgaacaccugagaaacggccggggauuuacggugcgcugggagacacagcaacccgaguguggcgggauccugaccggaccuuacggcucuauuaagagccccggguacccgggaaauuauccucccggcagagacugcgucuggaucgugguuaccucccccgaccuucucgugacauucaccuuugggacacugagccuggaacaccaugaugacuguaacaaagauuaccucgagauucgggacggcccucuguaucaggauccgcuucugggaaaguucugcacgaccuuuucugugcccccucuccagacaaccggccccuucgccagaauccacuuucauuccgacagccaaauuuccgaucagggguuccacaucacauaccugaccucuccuagcgaccugcgcuguggaggcaauuauacggaucccgaaggggagcuuuuccucccugagcuguccggacccuuuacccauacacggcagugcguguacaugaugaaacagccgcaaggcgaacagauccagauuaacuucacccacguugagcugcagugucaaucugacagcucccagaauuauaucgaagugagagauggcgagacacuccuggggaaggucugcggaaacggcaccauuucucacaucaaaagcauuacaaauagcguguggauccgcuuuaagauugacgcuagcguggaaaaggccucuuuccgggcuguuuaccaggucgccuguggggaugagcuuacaggagagggcgugaucagaucccccuuuuuccccaacguguacccuggggaaagaaccugccgguggacaauccaucagccccaaagccaggucauucugcucaauuuuaccguguucgagaucggaucuuccgcccacugugaaaccgacuauguugagauuggcuccucuuccauccugggcagcccggaaaacaaaaaguacugcgggacagacauuccuuccuuuaucacgagcguguauaauuuccuguacgucaccuuugugaaaucuagcuccacagagaaccauggauucauggcuaaguuuucugccgaggaucuugccugcggcgaaauccucaccgagagcacagggaccauucagucccccggacacccuaauguuuauccccacggcaucaacuguacguggcauauucuggugcaacccaaccaccugauccaucucauguucgaaacauuccaccuggaguuucauuacaauugcaccaacgacuaucuugaagucuacgauaccgacucugagacaagccuggggagauacuguggaaaauccauuccuccgucucucaccagcuccggcaauagccugaugcugguguucguuacagauucugaccuugcuuaugagggcuuucucaucaacuacgaagccaucuccgccgcuacggccugccugcaggauuauaccgacgaucuggggacauucaccagccccaauuuuccuaacaauuaccccaacaauugggaguguauuuaucgcaucacagugcggaccggacagcucauugcgguccacuucacgaacuuuucucuggaagaggcuaucggcaauuacuauaccgacuuccuugagauuagagaugggggauacgaaaaguccccucugcucggcaucuuuuacgggagcaaccugcccccuacaaucauuucccacucuaauaagcuguggcuuaaauucaagagcgaccagaucgauacccgcuccggauuuagcgccuauugggacggaucuuccacaggcugcgggggaaaccugaccacaagcucuggcaccuucauuagcccgaauuaccccaugccuuauuaccauuccucugaguguuauugguggcucaaaagcucccacgggucugccuucgaacuggaguuuaaggacuuccaucucgaacaccaucccaacugcacgcuggauuaccuugcuguguaugacggaccuagcuccaacagccaucugcucacacaacuguguggcgaugagaaacccccgcugauccggucuuccggggacagcauguuuauuaaacuuagaaccgaugagggacagcagggccggggcuucaaggccgaauaccgccagaccugcgagaauguggucaucguuaaccaaacauacgggauucuggaauccaucggauauccuaaucccuacucugagaaccagcacuguaauuggaccaucagagcuacgacaggcaacaccgugaauuauacauuucucgccuucgaccuggaacaucacauuaacugcagcaccgauuaccucgagcuguaugacgggccccggcagaugggaagauacugcggcguggaucuuccucccccuggguccacaaccucuagcaaacugcagguccuccugcugacggacggagugggccgccgggagaagggcuuucaaaugcagugguucguuuauggguguggaggcgaacuuuccggggcgaccggcagcuuuucuuccccgggcuuccccaauagauacccucccaacaaagagugcaucugguacauucgcacagauccugggagcucuauccagcugaccauucaugacuuugacguggaauaucacuccagauguaauuucgauguccucgagaucuacggaggccccgacuuucacagcccgcggaucgcccagcugugcacacaacgcucuccugaaaaccccaugcaggucagcuccaccggcaaugagcucgcuauuagauucaagacggaucugucuaucaacgggcggggauucaaugccagcuggcaggcuguuacaggcggguguggaggcauuuuucaagccccuuccggggagauccauagccccaacuauccuucccccuaccgcucuaauaccgacugcagcugggugauuagagucgaucggaaccaccgcgugcuucugaacuucacagacuuugaucuggaaccgcaggacuccuguaucauggcguaugauggccucucuagcaccauguccagacuggcccggaccugcggacgcgagcagcuugcuaauccuaucguuucuagcggcaacucccuguuccucagauuucagagcgggcccucucggcaaaauagaggauuccgcgcccaguuucggcaggcuuguggcgggcauauucugacauccagcuucgacacggugucuucccccagauuuccugccaacuacccgaauaaccagaauugcagcuggaucauucaagcccagcccccucucaaccacaucacccugucuuucacacauuuugaacuugagcgcuccaccacaugugcucgggauuucgucgagauucuggacggaggccacgaagaugcgccccugagagggcgcuauugcggcaccgacaugccucaccccaucacgagcuuuuccagcgcccucacacugcgguucgugucugacagcuccauuucugcuggaggcuuccauaccaccgugacagccagcgucuccgccugugggggaaccuuuuacauggcugagggcaucuucaauucuccuggguacccggauaucuaucccccuaacguugaaugcguguggaauauugugagcucccccggaaacagacuucagcugucuuuuaucagcuuccagcucgaggacucccaagauugcagccgcgacuuugucgaaauucgggagggcaaugccacagggcaccuggugggcagauacuguggaaacucuuucccucucaauuauuccagcaucguuggccauacgcugugggugcgguuuauuucugauggguccggaagcggcaccggguuccaggcgacauuuaugaaaaucuucggaaacgacaacaucgucggcacccacggcaagguggcuucccccuuuuggccggagaauuacccucacaacucuaauuaucaguggacaguuaacgugaaugccagccaugucgugcacgggcgcauucuugaaauggauaucgaggaaauucaaaacugcuacuaugacaagcugagaaucuacgauggacccuccauucaugcccggcugaucggcgcuuacugugggacccagacggagagcuucucuuccaccggaaauagccucacauuucacuucuauucugacagcuccaucucuggcaaaggguuccugcuugaaugguuugccgucgaugcgcccgacggagugcugccuaccauugcucccggcgccugcggcggguuccuccgcacaggagaugccccuguuuuucuguucagcccgggcuggcccgacuccuacucuaacagaguggacuguaccuggcucauccaggcuccugauagcacagucgagcugaauauucuuucccuggacaucgagagccaucggacgugcgccuaugauucucuggugauuagagacggggauaacaaucucgcucagcaacuggccguucuuuguggacgcgaaauccccggcccuauucgguccaccggggaguacauguuuaucagauucacaagcgacuccucugugacccgcgcgggauuuaacgccagcuuccacaaguccugcggcggcuaucugcacgcugaucgggggaucauuaccucucccaaauacccggaaacauauccuagcaaucucaacuguuccuggcauguccuggugcagagcggacugacgaucgccgugcacuuugagcagcccuuccagauuccuaauggcgacucuuccugcaaccaaggggauuaccucguucuuagaaacggacccgacaucuguagcccuccccugggcccgccugggggaaauggccauuuuugcggcucucacgcuuccagcacccuguucacaucugauaaccagauguuuguccaguucauuuccgaccacagcaaugaagggcagggauucaagaucaaauacgaggccaagucucucgccugcggcgggaacguguauauccaugacgcugauagcgcgggauacgugaccucccccaaucacccccauaacuauccuccgcacgccgacuguauuuggauccuggcugcgcccccugagacacgcauucaacuucaguuugaagaucgguucgacaucgaggucacccccaauugcacgagcaacuaccuggaacucagagauggcguggacuccgaugccccuauucugucuaaauuuugugggacaagccugcccuccucucaguggagcuccggagagguuauguaucuccgcuucagaucugacaauagcccuacccaugugggcuuuaaggcuaaguacuccaucgcccagugcggcgggcggguccccggacaaagcggcgugguugagucuaucgggcacccgacccuuccuuaucgcgauaaccuguucugugaauggcaucugcagggacucuccggccacuaccugacaauuagcuuugaggacuucaaucuucagaacucuuccgggugcgaaaaagauuuuguggagaucugggacaaucacaccagcggaaacauucugggcagauacuguggcaauacaauccccgauucuauugacaccuccagcaacacggcggucgugcgguucguuacagacgggucugugaccgcuuccggauuucgccucagauucgaaagcagcauggaggagugcggcggggaucugcaaggauccaucggcacauuuaccucuccuaacuaucccaauccgaacccucaugggcggauuugugaauggagaaucacggcccccgagggacgccggaucacccugauguucaauaaccucagacuugccacacaccccagcugcaauaacgaacaugucauuguguucaauggcauccgcuccaacucuccucagcuggagaagcuguguagcuccgugaaugucucuaacgaaauuaaaagcuccggcaauaccaugaagguuaucuuuuucacagacgggagccggcccuacggaggcuuuaccgcuucuuauacauccagcgaggaugccgugugcgggggaucucucccuaacaccccggagggcaauuucacgucccccggguacgacggcgugagaaacuauagccggaaucugaacugcgaauggacacuuuccaacccuaaucagggaaacucuagcauuuccauccacuuugaggauuucuaccuggaaucucaccaggacugucaauuugauguccucgaguuccgcgugggcgacgcggaugggccccugauguggagacugugcggaccuagcaaacccacccucccucuuguuaucccguauucccagguguggauucauuuugucaccaaugaacggguggagcacaucggcuuccaugcuaaguacagcuuuacagacugugggggcauucagaucggcgauucugggguuauuaccucccccaacuacccuaaugccuaugacagccugacacacugcucuagccugcucgaggcgccccagggccacacgaucacccugacauucuccgacuuugauaucgaaccucauaccacaugugcuugggacucugugaccguccgcaacggaggcagccccgaguccccgauuaucgggcaauacugcggaaauagcaacccuagaacgauucagucuggcuccaaucagcuuguggucaccuucaacagcgaucacucccugcaagggggaggcuucuaugccacauggaauacccaaacacucggguguggcggaaucuuucauucugacaacggcaccauucggagcccccacuggccccagaauuucccugaaaacucccgcugcucuuggacggcuaucacacauaagagcaaacaccuggagauuuccuuugauaauaacuuccugauccccucuggggacggacagugucaaaacagcuuugugaagguuugggccggcaccgaggaaguggauaaagcgcuccuugccacagggugcggaaauguggcuccuggcccggucaucacccccuccaacaccuucacagccguuuuucagagccaggaggcuccugcccagggguucucugccuccuuugugagcagauguggcucuaauuucacgggacccuccggcuacauuaucagcccuaacuaucccaagcaauacgacaauaacaugaauugcaccuaugugauugaagcuaacccgcugucugucgugcugcucacauuuguuagcuuccaccuggaggcgcgguccgccgugaccgggagcugcgucaaugauggagugcauaucauucgcggcuacuccgucaugucuacaccuuucgcuaccguguguggggacgaaaugcccgccccucuuacgaucgccggacccguucugcucaacuuuuacagcaaugagcagaucacagauuucggcuuuaaauucuccuauagaauuaucucuugcggcgggguguuuaacuucagcuccggaauuaucaccucuccggcuuacagcuaugccgacuacccuaaugauaugcacugucuguauaccauuacagucuccgacgacaaggugaucgagcugaaguuuagcgauuucgacguugugcccucuaccuccugcagccaugauuaccucgcgaucuaugacggcgcuaacacaucugauccccuucuggggaaauuuuguggauccaagcggccucccaaugucaaaagcucuaacaacuccaugcugcucguguucaagacggacagcuuucagaccgccaaaggcuggaagaugucuuucagacagacacuggggccucaacagggaugcggcggcuaccuuaccggguccaauaacacauuugccagcccggauuccgacagcaauggaauguacgauaagaaccugaauuguguguggauuaucauugcucccguuaacaaagucauccaccucaccuucaauacguucgcccuggaagcggccucuacccgccagcggugccuguaugacuacgugaagcucuaugauggcgacagcgagaacgcuaaucuugccgggacauuuuguggauccaccgugccugcucccuucauuucuagcggcaacuuucugacaguccaguucaucuccgaucugacccucgaaagagagggguuuaaugccacauacaccaucauggacaugccuugcggaggcacguauaacgcuacauggacaccccagaauauuucuagcccuaacuccagcgacccggauguucccuucucuaucuguaccugggugauugacuccccuccccaccaacaggugaaaaucacagucugggcccugcaacuuacgagccaggauugcacccagaauuaccugcagcuccaagacucuccucagggccaugggaacucccgcuuucaguucugcggacggaacgcgagcgccgugcccgucuuuuacucuuccaugagcacagcuauggugauuuucaaguccggcgucgugaauagaaacucucgcaugagcuuuaccuaucagaucgccgauuguaaucgggacuaccacaaggcuuucgggaaccugagauccccgggauggccugauaauuaugacaacgauaaggacugcacaguuacccugacagcgccccagaaucauaccauuagccucuuuuuccacucucuuggcaucgaaaacuccguggagugucgcaaugauuuccuggagguccggaacgggagcaauucuaacagcccccugcucggaaaauacugcggcacgcugcuuccuaaucccguguuuucccagaacaaugaacuguaucucagauucaagucugacagcgugaccuccgaccgcggcuacgagaucauuuggacaagcucuccuuccggguguggaggcacccuguauggggaucggggcagcuuuacaucuccgggcuaccccgggaccuacccuaacaauacguauugcgaauggguccugguugcccccgcuggaagacucgugacaaucaacuucuacuuuauuuccaucgacgauccuggcgacugugugcagaacuaucuuacccuguacgauggccccaaugcgagcuccccgucuagcgggccuuauugcggaggcgacacauccauugcccccuucgucgcuucuagcaaccagguguuuaucaaguuccaugccgauuacgcccgcagaccuuccgcuuuucggcugaccugggacagcuga

SEQ ID NO: 68018 - RNA, 1161 nt, Artificial Sequence
  derived and/or modified sequence opt5 from CUEDC1__Homo_sapiens__NP_001278954
augaccagccuguucagacgguccucuagcggcuccgggggaggcgggacagccggagcucgcggcgggggaggcggcacggccgcgccccaggagcucaacaauucuagaccugcucggcaagugcgcagacuggaauuuaaccaggccauggacgauuucaagaccauguuuccgaauauggacuacgauaucauugagugcguccuucgggccaacagcggggcuguugacgccacaaucgaucagcugcuccagaugaaucuggaaggaggcggguccucuggaggcguguaugaggacagcuccgauagcgaagacucuauucccccugagauccuugagcgcacccuggaacccgauuccagcgacgaggaaccucccccuguguacucuccgcccgcuuaucacaugcaugucuucgauagaccuuacccccucgccccucccacaccgccuccccggauugacgcgcugggguccggagccccuaccagccaacgcagauaucggaacuggaauccuccccugcucggcaaccugcccgaugacuuucuucgcauccugccgcagcagcucgacucuauccagggcaaugcugggggacccaaaccuggcuccggggagggaugucccccugccauggcuggccccgggccgggagaucaagagagcagauggaagcaguaccuggaagacgagcggauugcccuuuuccugcagaacgaagaguuuaugaaagaacuccagcgcaauagagauuuccugcuggcgcucgagcgggacagacugaaguaugagucccaaaaaucuaagagcuccagcguggccguuggcaacgauuuuggcuucucuuccccugugcccgggacaggagacgcuaauccugccgucagcgaagaugcucuuuuucgcgacaagcugaaacacaugggcaagucuacccggagaaaacucuucgagcuggcccgcgccuuuagcgaaaagacgaaaaugcggaaguccaagagaaaacaucuucugaagcaccagucucucggggcugcggccagcaccgcuaaccugcuggaugacguggagggacaugccugcgaugaagacuuccgcggccggagacaggaggcccccaaaguugaggaagggcuccgcgagggccaauga

SEQ ID NO: 68019 - RNA, 864 nt, Artificial Sequence
  derived and/or modified sequence opt5 from CUEDC2__Homo_sapiens__NP_076945
auggagcuggaaagaaucgugagcgccgcucuccuggccuucguccagacccaccuucccgaggcggaccuguccggccucgaugaaguuaucuuuucuuacgugcugggggugcuugaggaccugggaccuagcggcccguccgaagagaacuucgauauggaggcuuuuacagaaaugauggaggccuauguccccggguucgcccauauuccucggggaacgauuggcgacaugaugcaaaagcucucugggcagcugagcgaugcucgcaauaaagaaaaccugcagccccaguccucuggagugcaaggccagguuccuaucagccccgagccucuccagagaccggagaugcugaaggaagagacccgguccagcgccgcugccgcggccgacacacaggaugaagcuaccggcgccgaggaggaacuucugcccgggguggacguccuccuggagguguuuccuacaugcucuguugaacaagcucagugggugcuugccaaagcgcgcggagaucuggaggaagccguccagaugcucguggagggcaaggaagaggggcccgcugccugggagggaccuaaucaggaccugcccagacggcugcgcggcccgcaaaaagaugaacucaaguccuucauucugcagaaguacaugaugguggacagcgcugaggaucagaaaauccacagaccuauggcccccaaggaagccccuaaaaagcugauccgguauauugacaaccaagucguuucuaccaaaggggagcgcuuuaaggacgugagaaaucccgaagcugaggagaugaaggcgacauacaucaaccuuaaacccgcccggaaguaucgcuuccauuga

SEQ ID NO: 68020 - RNA, 2331 nt, Artificial Sequence
  derived and/or modified sequence opt5 from CUL1__Homo_sapiens__XP_011514934
augagcuccaccagaucucagaacccccacggccugaagcaaaucgggcucgaccagauuugggaugaccugcgggccggaauccaacagguguacacacgccagagcauggcuaaauccagauauauggagcuuuacacgcaugucuauaauuacugcaccucuguucaccagagcaaccaggcccggggcgcgggggugccuccguccaagucuaaaaagggacagacacccggcggggcucaauucgugggacuggaacucuauaaacgccugaaggaguuucuuaagaauuaccugaccaaccuccugaaagauggcgaagaccugauggaugagagcguccucaaguucuauacacagcagugggaagacuacagauuuuccagcaaagugcugaauggcauuugugccuaccuuaaccggcauuggguucgcagagagugcgaugaggggcggaagggaaucuaugaaauuuacucucuggcccucgugaccuggcgcgacugucuguucagaccucuuaauaaacaggucacaaacgcugugcugaagcucaucgagaaggaacggaauggcgagaccaucaacacgcgccugauuuccgggguugugcaaagcuaugucgagcugggacucaaugaagaugacgccuuugcuaaaggccccacccugacaguguacaaggagucuuucgaaucccaguuucuugccgauaccgagagauucuauacacgggaaagcaccgaguuucugcagcaaaacccugugacggaguacaugaaaaaggcggaagcccgccuccuggaggaacagagacggguccagguuuaucuucacgagucuacacaggacgaacuggcuagaaaaugcgagcaagugcucaucgagaagcaucuggaaauuuuccacaccgaguuucagaaucugcucgaugccgacaaaaacgaagaccuggggcgcauguacaaucuugugucccggauccaggauggacugggcgagcucaagaagcugcuugaaacacacauucauaaccagggccuggcugccaucgagaaauguggggaggcggcccucaacgaccccaagauguacguccaaaccgugcuggauguucacaaaaaguauaaugcucuggugaugagcgccuucaacaaugacgcuggauuugucgccgcccucgauaaggcuugcggcagauucauuaacaauaacgcggugaccaagauggcccaguccucuagcaaguccccugaacugcuugcucgcuacugugacagccugcucaaaaagucuuccaaaaauccggaggaagccgagcuggaggauacacugaaccagguuaugguggucuucaaguauaucgaagacaaagauguguuucagaaguucuacgccaagaugcuugcuaaacggcucguccaucaaaauagcgccucugacgaugcggaggcuagcaugaucuccaagcugaaacaggccugcggguuugaauauacgucuaagcugcagagaauguuccaggacauuggagugagcaaagaccucaacgagcaauuuaagaagcaccugaccaauuccgaaccccuugaucuggacuucagcauccagguucucucuuccggcagcuggccuuuucagcaaucuuguacauucgcccugcccuccgagcuggagcgcagcuaccagcgguuuaccgcuuucuaugccuccagacacucugggcgcaaacuuacauggcucuaccagcugagcaagggagaacuggugaccaacugcuuuaaaaaucgguacacgcuccaggcuuccacauuccaaauggccauucugcuucaguauaacaccgaggaugcguacaccguccagcagcugacagacucuacccaaaucaagauggauauucucgcccaggugcugcagauccugcuuaaaagcaagcuccugguucuggaagacgagaaugcuaacguggaugaagucgagcucaaaccugacacacugaucaaacuuuaucugggcuacaagaacaaaaagcucagagugaauauuaacgugcccaugaaaacggagcagaagcaagaacaggagaccacacauaaaaauaucgaagaggaucgcaagcugcugauucaggccgcuaucguucggauuaugaagaugagaaaaguccuuaagcaccaacagcuccugggcgaagugcugacccagcucuccagccgguuuaaaccgcgcgugccugucaucaagaaauguaucgacauucugaucgagaaggaguaucuugaaagaguggauggggagaaggacacauacucuuaucuggccuga

SEQ ID NO: 68021 - RNA, 2295 nt, Artificial Sequence
  derived and/or modified sequence opt5 from CUL2__Homo_sapiens__NP_001185707
auguacagagugaccuggagcacauucuggcugcgguuucagcacuauacgugcaccaugucccucaagccccgcgucguugacuucgaugagacauggaacaaacugcuuaccacaaucaaggccguggugaugcuggaauacgucgagagagcuaccuggaaugaccgguuuucugauauuuaugcccucuguguggcguacccugaaccgcugggcgagcgccuuuauacagaaaccaaaaucuuccuggagaaccauguuagacaccuccauaagcgggugcuggagagcgaggagcaaguccuggugauguaccaccgcuauugggaagaguacuccaaaggggcugacuacauggauugccucuauagauaccugaauacgcaguuuauuaagaagaacaaacuuaccgaggccgaccugcaguauggauacggcgggguugauaugaaugaaccccucauggagaucggagaacuggcccuugacauguggcggaagcugaugguggagccucuccaggcuauucugauccgcaugcugcucagagaaaucaaaaacgaucggggcggggaggaccccaaucaaaaggucauucauggagugaucaacucuuucgugcacgucgagcaguauaaaaagaaguuuccucugaaauucuaccaggaaauuuuugagagccccuuccuuacagaaaccggcgaguauuacaagcaggaagccuccaaucugcuccaagagucuaacuguagccaguacauggagaaaguucugggccgccuuaaggaugaagagaucagaugccggaaauaucugcacccuuccagcuacacaaaggugauucaugaaugucagcagcgcaugguggcugaccaccuccaauuucugcaugccgagugccacaauaucauuagacaggagaaaaagaacgauauggcgaauauguauguccugcuccgggccgugucuaccgggcugccgcacaugauccaggaacuucaaaaccauauccacgacgagggacugagagcuacguccaaucucacacaggaaaacaugcccacccuguucguugagagcgugcuugaaguccauggcaaguuugugcagcugauuaacacaguucucaauggggaccagcacuucaugucugcccuggauaaagcucugaccuccguggucaacuaccgcgagccuaagagcguguguaaagcccccgagcuccuggcgaaguauugcgacaaucuucugaaaaagucugccaagggaaugaccgaaaacgaggucgaagaucggcucacauccuucaucacgguguuuaaauacauugacgauaaggacguuuuccaaaaauuuuaugcuagaaugcuggccaagcgccugauccauggccuuagcauguccauggauucugaggaagcuaugauuaauaaacucaagcaggccuguggguacgaguucaccagcaagcugcaccggauguacacagacauguccgugagcgccgaucugaacaauaaauuuaacaauuucaucaagaaccaggacaccgucaucgaucucggaauuucuuuucagaucuaugugcugcaagcuggcgcguggccucuuacacaggcccccuccagcaccuucgcuauuccgcaggagcuggaaaaaucuguucagauguuugaacucuucuacagccaacacuuuuccggcagaaagcugacguggcugcauuaucuuugcacaggggaagugaaaaugaauuaccucggaaagccuuaugucgccauggugaccaccuaccagauggccgugcugcuggcuuucaacaauucugagacaguuagcuauaaggaacuccaggacuccacccagaugaacgagaaagagcugacaaagacgaucaaaagccuucuggacgucaagaugauuaaucacgauucugaaaaagaggacaucgaugccgaauccagcuuuucucucaacaugaacuucuccagcaagcgcaccaaauucaagaucacaaccuccaugcaaaaggacacaccccaggagauggaacagacccggucugcgguggaugaggacagaaaaauguaccugcaagcugccauugugcgcaucaugaaggcccggaaaguccugagacauaaugcucuuauucaggaggugaucagccagucccgcgcccgguuuaacccuucuauuagcaugaucaagaaauguauugaaguucucaucgauaagcaguacaucgagagaucccaagcuagcgccgacgaauauucuuacguggcguga

SEQ ID NO: 68022 - RNA, 2109 nt, Artificial Sequence
  derived and/or modified sequence opt5 from CUL3__Homo_sapiens__NP_001244126
augagcaaccuguccaagggcaccgggucuagaaaagacacaaagaugcggauccgcgccuuccccgugagagaggauguccucaauagccugaacaauaacuuucuucagacgcugaaucaggcuuggaacgaccaccaaaccgccaugguuaugauucgggauauccucauguacauggaccgcguguaugugcagcagaauaacgucgaaaauguguacaaccugggacuuauuaucuucagagaucaaguugugcgguauggcugcauucgcgaccaucugagacagacacuccuggauaugaucgcgcgggagcgcaaaggggaagucguggacagaggagcuauccggaaugccugucagaugcugaugauucucggccuggaggggcgcuccguuuacgaagaggauuuugaggccccuuuccuugaaaugucugcugaguuuuuccagauggaaagccaaaaguuucuggccgagaacuccgcuucuguguauaucaaaaaggucgaggccagaauuaaugaagagaucgaacgggugaugcacugccucgacaagagcaccgaggaaccgauugugaaagucguugagcgcgagcugaucuccaagcauaugaaaacaauuguggaaauggagaacagcggacuugugcacaugcugaagaauggcaaaaccgaagaucucggcuguauguacaagcuguucucuagaguccccaacgggcugaagacaaugugcgaguguauguccagcuaucuccgggaacagggaaaagcgcuggugucugaggagggcgaagggaagaacccuguugacuacauccagggacuucuggaucucaaauccagauuugaccgcuuccugcuugagagcuuuaauaacgaccggcuguucaagcagaccaucgccggcgauuuugaauacuuccucaaucugaacucuagaucccccgaguaucugagccucuucauugacgauaaacugaagaaaggggugaagggacuuacggaacaagaggucgagaccauccuggacaaggcuauggugcucuuucgcuucaugcaggaaaaagauguuuuugagcgguacuauaagcagcaucuggccagacgccuucugacaaauaaauccgugucugacgauagcgaaaagaacaugauuuccaaacucaagaccgagugcggcugucaauucacaagcaagcuggagggcauguuucgggacaugucuaucuccaauaccacgauggaugaguucagacagcaucugcaggcuacaggggucagccucggaggcguggaccugaccguccgcgugcuuacaaccggguacuggccuacccagucugccacacccaaaugcaacauuccuccggcgccccggcacgccuuugaaaucuucagacgcuuuuaucuggcuaagcacagcggacggcaacucacgcugcagcaccauaugggcuccgccgaucugaaugcuaccuucuacgggccuguuaaaaaggaagacggaucugaggugggcgucggcggggcccaggugacaggaagcaacaccagaaaacacauccuucagguuuccacauuucaaaugaccauucucaugcuguucaauaaccgggaaaaguauacguuugaggagauccagcaggaaacagacauucccgagcgcgaacuggugagagcccuccagagccuggcuuguggcaagccuacccaacggguccuuaccaaagagcccaagucuaaagaaaucgagaaugggcacauuuucacagugaacgaucaguucaccuccaagcugcauagagugaaaauccagacaguugcggccaagcagggagagagcgacccggaacgcaaggagacgcggcaaaaagucgaugacgauagaaagcacgaaaucgaggcugccauugugcgcaucaugaaaucuagaaagaaaaugcagcauaaugugcucgucgccgaagugacccagcaacugaaggcucgguuucugccuucccccguugugauuaaaaagcgcaucgagggccuuauugagagagaauaccucgcccggacaccugaggaccgcaaggucuacaccuauguggcguga

SEQ ID NO: 68023 - RNA, 2280 nt, Artificial Sequence
  derived and/or modified sequence opt5 from CUL4A__Homo_sapiens__NP_001008895
auggccgacgaggcucccagaaagggcagcuucuccgcccugguggggcggaccaacggacucacaaaaccugcggcucuggccgccgcuccggccaagcccggcggggcuggaggcucuaaaaagcucgucaucaaaaauuuucgcgauagaccucggcugcccgacaacuacacgcaggauaccuggcgcaagcuccacgaagccguuagagcggugcaaagcuccacaucuauucgguauaaucuggaggaacuuuaccaggccguggagaaccugugcagccauaaggucuccccuaugcucuauaaacagcugcgccaggcuugugaagaccacgugcaagcccagauccugcccuucagagaggauucucucgacagcguucuguuucuuaagaaaauuaauaccugcuggcaggaucauugucggcagaugaucaugauucgcuccaucuuccuguuucucgacagaacauacgugcugcaaaacagcacccuuccuucuaucugggauauggggcuggagcuuuuccggacacacauuaucuccgacaagaugguccagagcaaaaccauugauggaauccugcugcucauugaacgcgagagaucuggcgaagcuguggaccggucccugcuucgcagccugcucggcaugcugucugaucuucagguuuauaaggacuccuuugagcugaaguuccucgaggaaacgaauugccuguacgccgcggaggggcagagacugaugcaagaacgggaggugccggaauaucucaaccaugucagcaaaagacuggaggaggaaggagaccgcgugaucaccuaccuugaucacuccacacagaagccccugauugccuguguggagaaacagcuccugggcgaacaccuuaccgcuauccugcaaaaggggcucgaccaucugcuggaugagaaucgggucccugaccucgcccagauguaccagcuguuuucuagaguucgcggaggccagcaagcccuucugcagcacuggagcgaauauaucaaaacauucgggaccgcuauugugaucaaccccgagaaggauaaagacauggugcaggaucuccuggacuuuaaggauaaggucgaccaugugauugagguuugcuuccagaaaaaugaacgguuugugaaccugaugaaggaguccuucgaaacguucaucaauaaaagaccuaacaagcccgccgagcuuauugcuaaacacgucgauagcaagcuccgcgcgggaaauaaggaagccacagacgaggagcuggaacggacccuggacaaaaucaugauccucuuuagauucauucacggcaaggauguguuugaggcuuucuacaaaaaggaccuggccaaacgccuucugguuggcaagucugccuccguggaugcugaaaagagcaugcucucuaaacugaagcaugaguguggggccgcguuuacaagcaaacuggagggaauguucaaggacauggaacuuuccaaagauaucaugguccacuuuaagcaacauaugcagaaccagucugacagcggcccgauugaucucaccgugaacauccugaccaugggguauuggccuacauacacgcccauggagguccaccugaccccugaaaugauuaagcuccaggagguguucaaggcuuuuuaucugggaaagcauuccggccggaaacuucaauggcagacaacccuggggcacgccguucucaaggccgaguucaaagagggaaagaaagaguuucaggugagccuguuccagacacugguccuucucauguuuaaugaaggcgacggcuucucuuucgaggaaaucaagauggcuaccgggaucgaggauuccgaacugagacgcacgcugcaaagccucgccugcggaaaggcucgggugcugauuaaaucucccaagggcaaagagguugaggacggggauaaguuuaucuucaacggagaauuuaaacacaaacuuuucagaauuaagaucaaucagauucagaugaaagagacaguggaagaacaagucuccaccaccgaacggguguuucaggaccgccaguaccagaucgaugccgcgauugugagaaucaugaagaugcggaaaacacugggccauaaccuccugguuagcgagcuguauaaucaacuuaaguuccccgucaaaccuggggaccucaagaagagaaucgagucccugauugaccgcgauuacauggaacgggacaaagauaacccgaaucaguaccacuauguggccuga

SEQ ID NO: 68024 - RNA, 2688 nt, Artificial Sequence
  derived and/or modified sequence opt5 from CUL4B__Homo_sapiens__NP_001073341
auguuccccaccggcuuuagcuccccuucuccgagcgccgcugccgcggcucaggaggugagauccgccacagacgggaacacgucuaccacacccccuaccagcgccaagaaacggaagcugaauagcucuagcuccuccucuuccaacagcucuaaugaacgcgaggauuucgacuccacaucuucuuccagcuccacacccccucuccaacccagagauucugcuagcccuuccaccagcucuuuuugccugggagucuccguugccgcuagcucucacgugccgauccagaaaaagcugcgguucgaagacacccuggaguuugugggcuucgaugccaaaauggcggaagagagcuccucuagcuccucuucuuccagccccacggccgcuaccucucagcagcaacagcucaagaacaaguccauucugaucagcuccgucgccucugugcaucacgcuaaugggcuugccaaaagcuccacaaccguuucuagcuuugcgaacuccaagccuggaagcgccaaaaagcuggugauuaaaaauuucaaggacaagcccaaacucccugagaacuacacagaugaaaccuggcagaagcugaaagaggcugucgaagccauccagaauagcacguccauuaaguauaaccuggaggagcucuaccaagcuguggaaaaucuguguagcuauaaaaucucugccaaccuuuacaagcagcugcgccagaucugcgaggaccauauuaaagcccagauccaccaauuuagagaagauucccucgacagcguucuguuccuuaagaagauugaucgguguuggcagaaucauugccgccagaugaucaugauuagaucuaucuuucuguuccucgaccggacauaugugcugcaaaacagcaugcugcccuccauuugggauaugggccucgagcuguuucgcgcucacaucaucagcgaccagaaaguccagaauaagaccauugacgggauccuucugcucauugaaagagagcggaacggagaggcgaucgaucgcucucugcuuagaucccugcucagcaugcuguccgaccugcagauuuaccaagauucuuucgaacagcgguuccucgaggaaacaaaccgccuguaugccgcugagggccagaaacuuaugcaggaaagagaggugccggaguaccugcaccaugugaauaagcggcucgaagaggaagccgacagacugaucaccuaccuugaucaaaccacacagaaaagccugaucgccacggucgagaagcagcuccugggcgaacaccugaccgcuauucuccagaaggggcugaacaaucuucuggacgagaaccgcauccaagaucucucccugcuguaucagcuuuuuagccggguuagaggaggcguccaggugcuccugcagcaauggauugaguacaucaaagccuucgggagcacaauugugaucaauccugaaaaggacaaaaccauggugcaggagcugcucgauuuuaaggacaaaguugaucauaucauugacaucuguuuccugaagaacgaaaaguuuauuaaugcgaugaaagaggcuuucgagacauuuaucaacaagcgccccaauaaaccugccgaacuuauugccaaguauguggacuccaaacugcgggcuggaaacaaggaggccaccgaugaggaacucgaaaagaugcuggacaaaaucaugauuaucuucagauuuaucuacggcaaggaugucuucgaggcuuuuuauaaaaaggaccuggccaaacgccuucucguggggaagucugcgagcguugaugccgagaaauccaugcugagcaagcugaagcacgaaugcggagcugccuucacgucuaaacucgagggcauguuuaaggacauggaacuguccaaagauauuaugauccaguucaagcaauacaugcagaaucagaacgugcccggcaauauugagcuuacagucaacauccugaccaugggguauuggcccaccuacgugccuauggaaguccaccucccgcccgagauggugaaacugcaggagauuuucaagacauuuuaccugggaaagcauagcggccggaaacuucaauggcagucuacccucgggcacuguguucugaaggcugaguucaaagaaggaaagaaagaacuucaggugucccucuuucagacacugguccuucugauguucaaugagggcgaagaguuuagccucgaggaaaucaagcaagccacggggaucgaggacggagaacugagacgcacccugcagucucuugcgugcggcaaggcccgggugcucgcuaaaaacccuaagggcaaagauauugaggacggggauaaguucaucuguaacgacgauuuuaaacauaagcuguucagaauuaagaucaaucagauucagaugaaagagacaguugaggaacaagccuccaccacagaacgcguguuucaggaccggcaguaucaaaucgacgcugccaucgucagaauuaugaagaugcggaaaacccugagccacaaccuccugguguccgagguguacaaucagcuuaaguuccccguuaaaccugccgaucugaagaaacgcaucgaaagccucauugacagagauuauauggagcgggacaaggagaaccccaaucaguacaacuauaucgcuuga

SEQ ID NO: 68025 - RNA, 2343 nt, Artificial Sequence
  derived and/or modified sequence opt5 from CUL5__Homo_sapiens__NP_003469
auggccaccagcaaccugcucaagaauaaaggcucccugcaguucgaggacaagugggauuuuaugagacccaucgugcuuaaacugcuccggcaagaaucugucacaaagcagcagugguucgaccuguuuagcgauguucacgcugugugccuuugggacgauaaagggccugccaagauucaucaggcgcugaaggaggacauccucgaguucauuaaacaagcucaggcccgcgugcugucccaccaggaugacacggcccugcucaaggcuuacaucgucgaauggagaaaauuuuucacccagugugauauucugccgaagcccuuuugccaacuugaaaucacacugaugggaaaacagggcucuaacaaaaagagcaauguggaggacuccaucguucggaaacucaugcuggauaccuggaacgagucuauuuucagcaauaucaagaaccgccuucaggacuccgccaugaaacuggugcaugcugaaagacucggggaggccuuugauagccagcuggucauuggagugcgggaaucuuauguuaaucuguguuccaacccugaggacaagcuccaaaucuaccgcgacaauuucgagaaagcguaucuggauagcacagaaagauuuuaccggacccaggcccccucuuaucuucagcaaaacggcgugcagaauuacaugaaguaugcugacgccaaacugaaggaggaagagaagcgcgcucucagauaccuggaaacacggcgcgagugcaacuccgucgaggcccuuauggaauguugcgugaaugcgcuggugaccagcuucaaagagacgauucucgccgaaugucaggggaugaucaagagaaacgagaccgaaaaacugcaccugauguuuucucucauggauaaggucccuaauggaauugagcccaugcugaaagaccuugaggaacauaucaucuccgcuggccuggccgauaugguugcugccgccgagacaauuaccacagacagcgaaaaguacguggagcagcuccugacccuuuucaaccgguucuccaagcuggugaaagaggcuuuucaagaugacccucgcuuccucacggcgagagauaaggccuauaaagcugucgugaacgacgccacaaucuuuaagcuggaacugccgcucaaacagaagggcguugggcugaagacccagcccgagucuaaaugcccugaacuucuggccaauuacugugauaugcuccugcggaagacaccccugagcaaaaagcucaccuccgaggaaauugaggcuaaacuuaaggaggugcugcugguccucaaguaugugcagaacaaagacguuuucaugagauaccacaaggcccaccugacccgccggcuuauccuggacauuagcgcggauucugaaaucgaggaaaauaugguggaguggcucagagaagucggaaugccugcugacuaugugaacaaacuggcccgcauguuucaagauaucaaggucuccgaggaccugaaucaggccuucaaagagaugcauaagaacaauaaacuugcucuccccgccgauagcgugaacauuaagauccugaaugcuggcgccuggucucggagcuccgaaaagguuuuugugucucugccgacagagcucgaagaccugauuccugaggucgaagaguucuacaaaaagaaccacagcgggagaaaacuucauuggcaccaccugauguccaauggaaucauuacguuuaagaacgaggugggccaguaugaucucgaaguuaccacauuccagcuggcggugcuguuugccuggaaucaacgcccccgggagaaaaucagcuucgaaaaccuuaagcucgcuaccgagcugccugacgccgaacugagacgcacacucuggucucuggucgcuuuucccaaacuuaagagacaggugcugcucuacgagccccagguuaauuccccuaaggauuucaccgaggggacgcuguucagcgugaaccaggaauuuucucugaucaaaaacgccaagguccaaaagagaggaaagauuaaucuuaucggccgccuccagcugacaaccgagcggaugagagaagaggagaacgaaggcauugugcagcugcggauccuccgcacccaagaggcgauuauccagauuaugaagaugcggaaaaagaucuccaaugcccagcugcagacagaacuuguggagauccugaaaaacauguuccucccgcaaaagaaaaugauuaaggaacagaucgaguggcugauugagcauaaguacauccggagagacgaaagcgauauuaauaccuuuaucuauauggcuuga

SEQ ID NO: 68026 - RNA, 5349 nt, Artificial Sequence
  derived and/or modified sequence opt5 from CUL7__Homo_sapiens__NP_001161842
augagccgcggauucuggcuggccgaaccccucgcugggaccggaccucacccggcccccguggcggcugacucccggggcugcucuagcgugccucgcagacaugcccccucccggcugucuguuagcacaccuucccgcgggcccggagccagaauggugggcgaacuucgguaccgcgaguuuagagugccucuggggccgggacuccacgcuuaucccgaugaacugauucggcagcgcgucggccaugacggccacccugaguaccagauuagauggcuuauccugcggcgcggggaugaaggagacggcgggucuggacagguggauuguaaggccgagcauauucuccuguggaugagcaaggacgagaucuaugcuaacugccacaagaugcugggcgaagaugggcagguuauuggacccucccaggagagcgccggcgaagugggcgcccucgacaagucuguccuggaggagauggaaacggaugugaagucccuuauccaaagagcccugcggcagcucgaggaauguguugggaccaucccucccgcuccgcugcuucacacagugcauguccugagcgccuacgcuucuauugagccucucaccggaguguucaaagacccccgcgugcuggaucugcucaugcacaugcuguccagcccugacuaucagaucagauggucugccggccggaugauucaggcgcuuuccagccaugaugccggggaaggacaaugcggcgaggaggggaaggcuggagaaggccugggcagacuccgcgacucccaggacacagucgccggggcuucugaucugauccggaccagaacacagauucuucugagccucucccagcaagaggccaucgaaaagcaccuggacuuugauagccgcugugcccugcucgcucuguucgcgcaggccacccuuucugagcaccccauguccuuugaaggcauucagcugccccaaguuccuggccggguccucuucagccuggugaaaagauaccuucaugucacgucucugcucgaccagcugaaugauagcgcugccgagccgggggcccagaacaccuccgcucccgaggaacugucuggagagcgcggccagcucgaacuggaguuuagcauggccauggggacacuuaucuccgaacuggugcaagcgaugcggugggaccaggcuagcgauagaccuagaucuuccgcccggagccccggcucuaucuuccagccucagcucgccgacguuucccccggacugccggcugcccaagcucagccuagcuuuagacgcucccggagauuccggccccgcucugaguuugccagcggcaauaccuaugcgcuguacgugagagauacacuucagccugggaugcgggucagaaugcucgacgauuacgaggaaauuuccgccggagacgagggcgaguuccgccagucuaacaauggggugcccccuguucaaguguuuugggagagcaccggacggacguauuggguccacuggcauaugcuggagauccugggcuucgaagaggacauugaagauaugguggaggcugacgaauaccagggggccgucgcuuccagagugcucggccgcgcccugcccgcguggagauggcggccgaugacagagcuuuaugccguuccuuacgugcugcccgaggaugaagacaccgaggaaugcgagcaccucacacuggcugaauggugggagcugcuuuucuuuaucaagaaacucgauggacccgaccaucaggagguccugcagauucugcaagaaaaccucgauggcgagauccuggacgaugaaauccuugccgagcuggcugugccuauugaacucgcccaggaccugcugcuuacccucccgcagcgccugaaugauagcgcccugagagaccucaucaacugucacguuuauaagaaauacgggcccgaggcucuggcgggaaaucaagccuauccuucucuucuggaggcucaggaagaugugcuccugcuggacgcccaggcccaggcuaaggacuccgaggaugccgcgaaggucgaagcuaaagagcccccuagccaaucucccaacaccccucuucagcggcucguggagggcuacgggcccgccggaaagauucugcuggaccucgaacaggcccuguccagcgagggcacacaggaaaauaaagugaagccgcuucugcuccaacugcagcgccagccucagcccuuccuggcucuuaugcaaucucuggauacgccugagaccaacagaacacuccaccugaccguucuccggauccugaaacagcuugucgacuuucccgaagcccugcuccugccguggcaugaggcgguggaugcuugcauggccugucugcgcagcccuaauacagacagagaggugcuucaggaacugauuuucuuucuccaccggcugaccuccgucagccgcgauuacgccgugguucucaaccaacugggggcuagagacgccaucucuaaggcucuugagaaacaucugggcaagcucgaacuggcccaggagcugcgggauaugguguucaagugcgaaaaacacgcgcaccuuuauagaaagcugaucacgaauauucucggaggcuguauccagaugguccuggggcagauugaggaccaucgccggacacaccaacccaucaacauucccuuuuucgauguguuucucagauaccugugccagggauccagcguugaggugaaagaagacaagugcugggagaaagucgaaguguccucuaacccccaucgcgccagcaaacuuaccgaucacaaucccaagaccuauugggaguccaacggcucugcugggagccauuacaucacacugcacaugcggagaggcauucugauccgccagcucacccugcuuguugccuccgaagacucuagcuauaugccugcucggguggucguguguggaggggacuccacaagcucucugcacacggagcucaauuccgugaacgucaugccgagcgccucuagaguuauccugcucgagaaucugacccgcuucuggcccauuauccagauucggaucaaaagaugccaacagggcggaauugauacacggauccgcggccuugaaauccuggggccuaagcccaccuuuuggccuguguucagagagcagcugugucggcauacacgccucuuuuacauggugagagcccaggcuuggucccaagacauggcggaagaucggagaagccugcuucaccugucuucccgccucaacggagcccugcggcaggagcagaauuucgcugacagauuccuccccgaugacgaggccgcccaggcucugggcaaaaccugcugggaagcccuugucagcccugugguucaaaacauuacguccccggaugaggacgggaucagcccccugggauggcugcucgaucaguaucuggaaugucaggaggcgguguuuaauccucaaucucgcggccccgcuuucuuuagccgggucagacgccuuacccaucugcucgugcacguugaaccuugcgaggcgccuccgccuguggucgccacaccccggcccaagggcagaaaccgcucccaugacuggucuagccuggcuaccagagggcucccuuccucuauuaugcggaaucugacacgcuguuggagagccgugguugagaaacaggugaacaauuuccuuaccagcuccuggcgggaugacgacuuugucccccgcuacugcgaacacuucaacauccugcaaaauucuagcuccgagcuguuuggaccuagagcggcuuuccuccuggcccuucagaacggcugugccggggcucugcucaagcugccguuucugaaggccgcucacgugagcgaacaauucgcccggcauauugaucagcagauccagggaucuagaaucggcggggcgcaagagauggaacgccucgcccagcuucagcagugccugcaagcugugcugaucuuuuccggacucgagaucgccacgacauucgagcacuacuaucagcauuacauggcugaccggcugcuuggcgucguuagcucuuggcuggaaggcgccgugcucgagcagauugggcccuguuuuccuaacagacugccccaacagaugcugcagucccucagcaccuccaaagaacuucagcgccaauuccacguguaucagcugcagcagcuggaucaagagcuccugaaacuugaagacacagagaaaaagauccaggucggacugggcgccucugggaaagagcacaagagcgaaaaggaggaagaggcuggagcggccgcugugguugauguggccgagggcgaagaggaagaggaagagaaugaggaccucuacuaugaaggggccaugccugaggucuccgugcugguucugagccggcauucuuggcccguggcuuccauuugccacacccucaacccgagaaccugccuuccuagcuaccugcggggaacacugaaucgcuauucuaacuucuacaauaaaagccagucccaucccgcccucgaaagaggcucucagcggcgccugcaauggacguggcuuggcugggcggagcugcaguuugggaaccagacccuccacgucagcacagugcagauguggcugcugcucuaccuuaaugaucugaaggcugucuccguggaaucucugcucgccuucagcggacuguccgccgacaugcuuaaccaagcuaucggcccucugaccagcucuagagggccccucgaucugcaugagcagaaagacaucccuggaggcguucugaagauucgggauggguccaaagagccccgcagcagaugggacaucgugcggcucauuccgccucagacauaucuucaagccgaaggagaggauggccagaaucuggaaaagcgcagaaaccugcucaauugucugaucguccggauucuuaaagcgcacggcgacgaggggcugcacaucgaccagcucgugugccugguucuggaagccuggcagaagggacccugucccccuagaggccucguguccucucuugggaagggaagcgcuugcuccucuaccgauguccugagcuguauucugcaucuccugggcaaagggacgcuucgccggcacgacgauagaccgcaagugcuguccuacgccgugcccguuacagucauggagccucauaccgagagccucaaccccggaucuuccggcccuaaucccccucugaccuuucacacacugcagauccgcagccggggcgugccguaugcuucuugcaccgccacacaguccuucagcacguuuagauga

SEQ ID NO: 68027 - RNA, 7554 nt, Artificial Sequence
  derived and/or modified sequence opt5 from CUL9__Homo_sapiens__NP_055904
auggugggagagcggcacgccggggaccugauggucccgcugggaccucggcugcaggcuuacccggaagaacuuauccgccaaagacccggccacgaugggcacccugaauaucugauucgguggagcguucucaagugcggagaggugggcaaggugggggucgaagagggaaaggccgagcauauccugauguggcuuuccgcgcccgaaguguacgcuaacugcccuggccugcucggcgagcgcgcccugucuaaagggcugcagcacgaacccgccggaguuagcggcuccuucccuagagaccccggcgggcucgaugagguggcuaugggggagauggaagccgacguccaggcucuggugcggcgcgccgcgagacagcuugccgagucugggacccccagccugacagcugccguucuccauacgauucacgugcuguccgcuuaugccucuaucggaccucuuaccggcgucuuucgggaaacaggcgcgcuggaucuccugaugcacaugcugugcaaucccgagccucaaauucgcagaagcgccgggaagaugcuccaggcucuggccgcucaugacgccggaucccgggcccacgugcuucugagccucucucagcaggauggcaucgaacaacauauggacuucgauucccgcuacacccugcuugagcuguuugcugagacaaccagcucugaggaacacuguauggcguucgaagggauccaccucccccagauuccgggaaaacugcuguuuucccucgugaagagauaucugugcgucacaagccuucuggaccagcucaacucuuccccugagcugggcgccggggaucagagcucccccugugcuacccgggaaaagucucgcggacaaagagagcuugaguucagcauggccguuggcaaucugaucuccgaacucgugcggagcaugggcugggccagaaaccugucugagcaggggauguccccuccccgccccacgcggagcauuuuucagccuuacaucucuggaccgagccugcuccugcccaccauugugacaaccccuagacgccaaggcugggucuuccggcagagauccgaauuuucuagccgcuccggguauggagaguacgugcagcagacacuucaacccggcaugcggguuagaaugcuggacgauuacgaagagaucagcgcuggggacgagggcgaguuccgccagucuaauaacggcauuccucccgugcaggucuuuuggcaguccaccggccggacguauugggugcauuggcacaugcucgagauccuggggccggaagaggccacagaggacaaagcgagcgcugccguugaaaagggagccggcgcuaccgugcuggggacagccuucccuucuugggauuggaaucccauggacggacuuuacccucuccccuaucugcaaccugagccccagaaaaacgaaagagucggcuaccugacccaggcugaguggugggaacuccuguuuuucaucaagaaacuugaucugugcgagcagcaaccgauuuuccagaaucucuggaagaaccuggacgagacccugggggaaaaggcccuuggcgagaucuccgugagcgucgaaauggcggagucccuccuccaggugcugucuagccgcuuugaaggauccacacucaaugaucugcuuaacucucagauuuauacgaaauacggccugcucagcaaugagccuuccuccucuuccaccagccggaaccauucuuguacacccgaccccgaggaagaguccaagagcgaagccucuuucagcgaggaagagaccgagucccugaaagcuaaggccgaagcuccuaaaacagaggccgaaccgaccaagacgagaacagagacccccauggcgcaaagcgauucucagcuguuuaaucagcuucucguuaccgaggggaugacacugccuaccgaaaugaaagaggccgcuuccgaaauggcccgggcucugcgcggacccggcccuagaagcucccucgaccaacacguggccgccgucguggcuacaguucagaucucuagccuggauacgaaccuucagcuguccgggcucucugcgcugagccaggccguggaggaagucaccgagcgggaccauccccuggugagaccugaucgcucccuucgggagaagcucgugaagaugcugguugaacugcucacaaaccaagucggagagaaaaugguggugguccaggcucugagacuucuguaucuccugaugaccaagcacgaauggcgcccccuguucgccagagagggcgggauuuacgccgugcuuguuugcaugcaggaauacaaaacaucugugcugguccagcaagcuggccucgccgcgcugaagaugcucgcuguggccagcuccagcgagaucccgaccuuuguuacgggacgggacucuauccacucccuguucgacgcccagaugacccgcgagauuuuugcuagcaucgauucugccacaagaccuggcuccgaaagccuucugcucaccgugcccgcggcugucauucugaugcugaauacagagggguguucuuccgccgcccggaacggacuucugcuccugaaucuccugcuuugcaaccaucacacccugggcgaccagaucauuacgcaggaacuccgcgauacacuguucagacauagcgggaucgcuccucggaccgagcccaugccgacaacccgcaccauccugaugaugcuucugaauagauauuccgaaccucccggaagcccugagcgggccgcucucgagacacccauuauccaaggccaggacgggucucccgaacugcucauucgcagccuggugggcggaccuuccgccgagcuucugcuggaucucgaaagaguucugugucgggagggcucucccgggggagcggugagaccccuucugaaacgccuccagcaagagacgcagccuuuucugcuccugcuucggacccuggacgcccccggcccuaacaagacacugcuccugagcguccuuagagugaucacccgccugcucgauuuccccgaagcuauggugcugccuuggcacgagguccucgaaccgugccugaauugccuuuccgggcccucuagcgacuccgagauuguucaggaacugacauguuuucugcaccggcucgccucuaugcauaaggauuacgcuguggugcugugcugucuuggagccaaagagauccugagcaagguccucgacaaacacuccgcccagcugcuccugggcugcgagcuuagagaucuggugaccgaaugugagaaguaugcucaacuguacagcaaccucacgucuuccauucuggcgggcugcauccagaugguucuugggcagaucgaagaccaucgccggacacaccagccuauuaauauccccuucuuugauguguuccugagacaucucugucaaggaagcucugucgaggugaaagaagacaagugcugggagaagguugagguguccagcaacccucaccgcgccuccaaacugaccgaccacaaucccaagaccuauugggaaucuaacggcagcacagggucccauuacauuacccugcacaugcaucggggaguccucgugagacagcuuacacugcugguugcuagcgaggauucuuccuauaugccggcccggguggucguguucggcggggacagcacgucuuguaucggaaccgaacucaauacagugaacgucaugccuagcgccucccgcguuauucugcuugagaaucugaacagauuuuggcccaucauccagauucggaucaaacgcugccagcaaggcggcauugauaccagagugagagggguggaaguccucggacccaagccuacauucuggccccuguuuagagagcagcugugucgccggaccugccucuucuacacgaucagagcucaggccuggucucgcgacauugcggaggaucaccggagacuucugcagcugugcccucgccucaaccgggugcugagacaugaacaaaauuuugcugaccgcuuccuuccggaugacgaggccgcccaggcucugggcaaaaccuguugggaagcccucguuagcccccuggugcagaacaucacauccccugaugcggagggggucucugcucugggauggcuccuugaccaauaccuggagcagagagaaaccagccggaauccccugucccgcgccgccagcuuugcuucuagagugcggcgccucugccaucugcuuguucacguggagccucccccgggcccuucccccgaaccuagcacaagacccuucuccaagaacucuaaggggcgggauagaagcccugcccccuccccgguccugccuucuagcucccuccgcaauaucacccaguguuggcugagcgugguccaggagcaagugucucgguuucuggcugccgcguggagagcccccgacuucguuccccgcuauugcaaacucuacgaacaucuucagcgggcuggauccgagcuguuuggcccuagagccgcuuucaugcuggcccuccggagcggcuuuucuggggcccugcuucagcaguccuuccugacagcugcgcacaugagcgagcaauucgcccgcuauauugaucagcagauccagggaggccucauugggggagcuccgggcguggaaaugcuggggcaacugcagagacaucucgagcccaucaugguccuuucuggacuggaacuggccaccacguuugagcacuucuaccagcacuauauggccgaccggcuccugagcuuuggcuccucuuggcuugaaggcgcugugcuggagcaaauugggcucuguuucccuaaccgccugccccagcugaugcuccagagccuuuccacaagcgaggaacugcagagacaauuucaucuguuccagcuccagcggcuggacaaacuuuuucuggagcaggaagaugaggaagagaaacgccucgaggaagaggaagaggaggaagaggaagaggaagccgagaaggagcuguucaucgaagacccuucccccgcgaucucuauucugguucucagcccuagaugcuggccggugagcccgcuuuguuaccuguaucacccucggaaaugccugcccaccgaguuuugugaugcucucgaccgcuucucuagcuuuuacucccaaucucagaaucauccuguccuggauaugggaccccacagacggcuucaguggaccuggcugggcagagccgaacuccaguucgggaagcaaauccugcaugugagcacagugcagauguggcugcuccuuaaauucaaccagaccgaggaaguuuccgucgagacgcugcugaaggacagcgaucucucuccggagcugcuucugcaggcccucgugccucugacauccggaaauggcccccugacccuccacgaagggcaagacuuuccccacggaggcgugcuucgccugcaugagccuggcccccagcggagcggggaagcucuguggcucauuccuccgcaggccuaccugaacgucgagaaggaugaaggaagaacacuugagcaaaaacgcaaucugcucucuugccugcuggugcggauccucaaggcgcacggcgagaaagggcugcauauugaccagcuuguuugucuggugcucgaagccuggcagaagggacccaacccucccggcacccuggggcacacagucgcuggaggcguggccugcaccuccacggauguucuuagcugcauccugcaccuccugggccagggguaugugaaaagacgcgacgaccggccucaaauucugauguacgcugcccccgagccgaugggaccuuguagaggccaggcugauguccccuucugcgggucucaguccgaaaccagcaagccuucccccgaggccguggcgacacucgccagccugcagcuuccugcuggacgcaccaugucuccccaagagguugaaggccugaugaagcagacagugcggcagguccaggagacccucaaucuggaaccggacguggcccaacaucuucuggcucacagccauuggggagcugagcagcuccugcaguccuauucugaagauccugagccccugcuccuggccgcuggacuuugugugcaccaagcgcaggccguccccguuagaccugaccauugcccggugugugugagcccccugggcugcgaugacgaucucccuucccuguguugcaugcacuacuguugcaaaucuuguuggaacgaguaucuuacgacacgcaucgaacagaaucugguccucaacuguaccugccccaucgcugacuguccugcccagcccacaggcgccuuuauucgggcuaucgugagcuccccugagguuauuucuaaguacgaaaaagcccugcugagaggguauguggagagcugcuccaaccucaccugguguaccaauccccaaggaugcgaucgcauccuguguagacagggccuugggugcggaacaacguguagcaagugcggcugggcgucuuguuucaacugcuccuuuccggaagcccacuacccugcuagcugugggcauaugucucagugggucgacgauggcggauacuaugacggcauguccguggaggcccagagcaaacaccuggcuaagcucauuuccaagcggugccccucuugccaagccccuaucgagaaaaaugaagggugucugcauaugaccugcgcgaaguguaaccacggauucugcuggcgcugucuuaaaagcuggaagcccaaucacaaagauuacuauaacugcuccgccaugguuagcaaggcugccagacaggagaagcgguuucaggacuacaaugaaagauguacauuccaucaccaggcucgggaguuugccgugaaccugcgcaauagagucucugcuauccaugaagugccgccuccccgguccuucaccuuucucaacgacgccugccaaggccuggagcaggcgcgcaaaguccuggccuaugcuuguguguacagcuucuauucucaggaugccgaguacauggacguuguggaacaacagacagagaaucucgaacugcacaccaacgcccuucagauucugcucgaggagacgcugcuuagaugccgggaucuggccagcucccuccgccugcugagagccgacugucucucuacagggauggaacugcuucggcgcauccaggagagacugcucgcgauucugcaacauagcgcucaggauuuucgggugggacuucagucccccucugucgaagccugggaggcuaagggcccuaauaugcccgggagccagccucaagccuccagcggcccggaagccgaggaggaagaggaagacgaugaggacgauguucccgaauggcagcaggacgaguucgaugaggaacuggacaacgauucuuucuccuacgacgagagcgaaaaucucgaccaggagaccuuuuucuuuggagaugaagaggaggacgaagaugaggcuuaugacuga

SEQ ID NO: 68028 - RNA, 597 nt, Artificial Sequence
  derived and/or modified sequence opt5 from CUTA__Homo_sapiens__NP_001014433
augaucggcagcgggcuggcuggauccggcggggcuggaggccccucuagcaccgugacauggugcgcccucuucuccaaccacgucgcggcuacgcaggccucucugcuucugagcuuuguuuggaugccugcccuccugccgguggcuuccagacuucugcuccugccccgggugcugcucaccauggccucugggagcccucccacacaaccuucccccgcuagcgacucuggauccggcuacgucccuggcagcgugucugccgcguucguuaccuguccgaaugagaagguggccaaagaaauugcucgcgccgucguggagaagagacuggcugccugcguuaaccuuaucccccagauuacauccaucuaugaauggaaagggaagauugaggaagauagcgaggugcugaugaugaucaaaacccagucuucccucgucccugcgcugacagacuuugugcggagcgugcaucccuacgaggucgccgaaguuaucgcccuuccuguggagcagggaaauuuccccuaucugcaaugggugcgccaggucaccgaauccgugucugauagcauuacgguucucccguga

SEQ ID NO: 68029 - RNA, 4551 nt, Artificial Sequence
  derived and/or modified sequence opt5 from CUX1__Homo_sapiens__NP_001189472
auggccgcuaacgugggcagcauguuccaguacuggaagagauuugaccugcaacagcuccagcgggagcuggaugccaccgcgacaguccuugcuaaucgccaggacgaauccgagcaaucuagaaaacggcugaucgaacagagccgcgaguucaagaaaaacacgcccgaagaucucagaaagcagguugccccucugcuuaaauccuuucagggggagauugacgcccugucuaagcggagcaaggaggcugaagccgcuuuccucaauguguauaaacgccugaucgaugugccggaccccgucccugcccuggaucucggacaacagcugcagcuuaaggugcagagacugcacgacauugagaccgaaaaccaaaaacuccgggagacacuggaggaauacaauaaggaguuugcggaaguuaaaaaccaggaggugaccaucaaggcccuuaaggaaaagauucgcgaguaugagcagacacugaagaaucaagcugaaaccaucgcccucgagaaagaacagaagcugcagaacgauuucgcugagaaagaaagaaagcugcaggagacacaaauguccaccacgucuaaacucgaggaagccgagcauaagguccagagccugcagaccgcgcuugaaaagacacggaccgagcuguuugaccucaaaacaaaguacgaugaagagaccacggccaaagcugacgagaucgaaaugauuaugacagaucuggagcgcgccaaucagagagcugaaguggcccaacgggaggccgagacccuucgcgaacagcuguccagcgcuaaccacucucuccagcuggcgucccagauccaaaaggcccccgacguugagcaggcuauugaagugcugacaagaagcucucucgaggucgaacuggccgccaaagagcgggagaucgcucagcuuguggaagacgugcagagacugcaagccucccucaccaagcugcgcgagaauagcgcgucucagauuucccagcuugaacaacagcugagcgcuaagaacuccacccucaaacagcuggaggaaaagcugaaaggccaggccgauuaugaggaggucaagaaagaacucaauauccugaagucuauggaguucgccccuagcgaaggggcuggaacacaagacgccgcuaagccccuugagguucugcuccuggaaaagaaccggucccugcagagcgagaaugccgcgcuuagaauuucuaacuccgaucucagcggcucugcccgccggaaggggaaagaccagccugagagcagacgcccgggaucccugcccgcuccucccccuucucagcugccccggaacccgggcgaacaagccagcaauacgaacggcacccaucaguuuuccccugcugggcucagccaggauuucuuuucuuccagccuggccucucccucccuuccucuggcgagcacaggaaaguucgcccucaauucccugcugcagagacaacuuaugcagucuuuuuacagcaaagcuaugcaggaggccggcuccaccucuaugaucuucagcacagggcccuauuccaccaacagcaucucuucccaaagcccccuccagcagucuccugacgugaauggaauggcuccgucccccagccagucugaaagcgccggcuccgugagcgagggggaggaaauggauacggccgagauugcucgccaagucaaggaacagcugaucaagcacaacauuggacagcggaucuucggccauuacgugcugggccucucucagggguccguuagcgagauucuggcgagaccuaaacccuggaauaaacuuacagugcgcggaaaagaaccuuuucacaagaugaaacaauuccuguccgacgagcagaacauccucgcccugcggucuauccagggcagacagcgggagaaucccgggcaaagccugaaccgccuuuuucaggaagucccgaagagacggaauggauccgagggcaacauuaccaccagaauccgcgcuucugaaacagggagcgaugaggccauuaaauccauccucgaacaggccaagcgggagcuccaggugcaaaagaccgcugagccugcccagcccucuagcgcguccggaagcggcaauucugacgaugcuauuagauccauccugcagcaagcccgcagagaaauggaggcccagcaggcugcccuggacccugcgcugaaacaggcuccccuuagccaaucugacaucacaauucugacgccuaagcuccuguccaccagccccaugccgacaguuucuuccuacccuccccuggccaucagccuuaaaaagcccuccgccgcuccugaagccggcgcuagcgcccucccgaaucccccugcgcugaaaaaggaggcccaggaugcucccgggcuggacccucagggagccgcugauugcgcccagggcgugcuccggcaagucaagaacgaaguggggcgcucuggagccuggaaagaccacugguggagcgcuguccagcccgagagacggaacgcggccuccucugaggaagcuaaggccgaggaaaccggcgggggcaaagagaagggaagcggcggguccggaggcgggucucagccucgcgccgagagaagccagcugcaaggacccuccucuagcgaauauuggaaagaguggccguccgcugaaagcccuuacucucaguccagcgagcuuucucugacaggcgccucccggagcgaaacgccccagaacuccccucuccccucuagcccgauugugccuauguccaagcccaccaagccuagcguuccuccccugacccccgagcaauaugagguguacauguaucaggaagucgauacaaucgagcugacccgccaggugaaagaaaaacuugcgaaaaaugggauuugucagagaaucuucggcgagaagguucugggacucucucaaggcuccgugagcgacaugcugucucggccgaaacccuggagcaagcucacacagaaggggcgcgaaccuuuuauuagaaugcagcuguggcuuaacggagagcugggccaggggguccuccccgugcaaggacagcagcagggcccugugcugcauuccguuaccucucugcaagauccccuucagcaggggugcgucagcuccgagucuacgccuaaaacaagcgcuuccuguagcccggcccccgaaucuccuauguccagcuccgagucugucaagagccugaccgaacucgugcagcaacccugcccucccaucgaggccuccaaagacucuaagccgccugaacccagcgaucccccugcuuccgacagccagcccacaaccccucugccgcucucuggccacuccgcccugagcauccaggagcuuguggcgaugucucccgagcuggauaccuacggaauuacaaaacgggugaaggaaguucucacggacaauaaccugggccaaagacuguucggggagaccauccuuggacugacacagggcuccgugagcgaucuccuggcucgcccuaaacccuggcauaagcucucucugaaggggcgggaaccuuuugucagaaugcagcuuuggcugaaugaccccaacaauguggagaaacugauggacaugaagcgcauggagaaaaaggccuauaugaaacggagacacagcuccguuucugauagccagccgugugaaccucccuccgugggaaccgaguacagccaaggcgccuccccucagccccagcaccagcucaagaagccucgcgucgugcuggcucccgaagagaaagaagcccuuaagcgggcuuaccaacagaaaccguauccuucucccaagacaauugaggaccuggccacccagcucaaccugaaaacgagcacaguuaucaauugguuccauaacuacagaucccgcauucggagagagcucuuuaucgaagagauccaggcggggucucaaggccaggccggagcuagcgauucccccucugcccggagcggccgcgcugccccuuccagcgaaggggacucuugcgauggaguggaggccaccgaaggcccgggguccgcugacaccgaggagcccaagagccagggagaagcggagagagaagaggucccucggcccgccgaacaaacagagccucccccuucuggcaccccgggccccgaugacgcucgcgaugacgaucacgaagggggaccuguggaaggccccgggccucugcccuccccggccagcgccacagcuacggccgcgccugcugcccccgaggacgccgcuaccucugccgcggccgcucccggagaaggcccugccgcucccuccagcgccccuccgcccuccaauagcucuagcuccucugcuccuagacggcccagcucccuucagucucuguucgggcugccugaggccgcgggagccagagauagccgcgacaacccccuccggaagaaaaaggcugccaaucugaacuccauuauccauagacuugagaaagcugccucucgcgaggagccgauugaaugggaguuuuga

SEQ ID NO: 68030 - RNA, 4461 nt, Artificial Sequence
  derived and/or modified sequence opt5 from CUX2__Homo_sapiens__NP_056082
auggccgcuaacgugggcagcauguuccaguacuggaagagauuugaccugcggcgccuccaaaaagagcuuaauuccgucgccucugaacugagcgcgagacaggaggaauccgagcacucucauaagcaccugaucgaacuccggcgcgaguucaaaaagaacguucccgaggaaauuagagagaugguggcuccugugcugaaauccuuucaggccgaagucguggcccuuagcaagcggucucaggaggcugaggccgcuuuccugagcguuuauaagcaacucaucgaagccccggaucccgugccugucuuugaggcggcccgcucccuggacgauagacugcagcccccuagcuucgaccccucugggcagccucggcgcgaucuccauaccuccuggaaaagaaauccggaacugcuuagccccaaggagcagcgggaaggaacaucuccugcuggccccacgcugaccgaggggucccgccucccuggcauucccggaaaagcccugcuuacagagacccugcuccaaagaaacgaagcugagaagcagaaagggcugcaggaagugcagaucacacuggccgcgcggcucggagaggccgaagagaagauuaagguucugcacagcgcucuuaaagccacccaagcugagcugcucgaacugcgcagaaaguacgacgaggaagccgccucuaaagcugaugaggugggccuuaucaugacaaaucuggaaaaggcgaaccagcgggccgaggcugcccagagagaggucgaaucccuccgcgagcaacuggccagcgucaauuccucuauccggcuggcuugcuguagcccgcagggcccuuccggggacaaagugaacuuuacccucugcagcggacccagacuggaagccgcgcuugcuucuaaggaucgcgagauucugcggcuccugaaagacgugcagcaucuucaguccagccugcaagagcucgaagaggccucugccaaucagaucgcugaucuggaaagacagcugacggccaagagcgaggcuauugaaaagcucgaggagaaacugcaggcccaauccgacuaugaagagaucaagaccgaacuuucuauucugaaagcgaugaagcucgccagcuccacauguagccugccucagggcauggcuaaacccgaggauucucugcuuaucgccaaggaggcuuucuuucccacccagaaguuccuccuggaaaaaccuucccugcucgccagcccggaggaagaccccucugaggacgauuccauuaaggacagccuggggacagaacaguccuacccuucuccccaacagcuuccucccccgccuggacccgaggauccucugagccccuccccuggccagccccuccuggggccgucucugggaccugacggcacccgcacguuuagccuuucccccuuccccagccucgcgucuggcgaacggcugaugaugccuccggccgcuuuuaaaggggaggccggaggccugcucguuuuucccccugcuuucuauggggccaagcccccuacagcccccgcuaccccugcgcccggaccggagccucugggcgggcccgaaccugccgauggaggcggcgggggagcugccggccccggggccgaggaggaacagcuugacacagcugagaucgccuuccaagugaaagaacagcugcucaagcacaacaucggacagagaguguucggccacuacguccuggggcugucccaaggcagcgugucugagauucuugcgcgcccgaagccuuggcggaaacucaccguuaagggaaaagaacccuuuaucaagaugaaacaguuccuguccgaugagcagaaugugcuggcucucagaaccauucagguccgccaacggggcagcaucacaccucggauucggacgcccgaaaccgggucugacgaugccaucaagagcauccuggagcaggccaagaaagagauugaaucccagaagggaggcgagcccaaaacaagcguggcuccucuuucuaucgccaacgggaccacaccggcguccaccagcgaagacgcuauuaaguccauccuggagcaggcccgcagagaaaugcaagcccagcagcaggcucuccuggagauggagguugcccccagaggaagaucugugccucccagcccucccgaacgcccuucccuggcuacggccucucaaaauggcgcgccggcccuugucaaacaggaggaagggagcggcggacccgcucaggccccucuccccgugcuguccccugcugccuuuguccaaucuauuauccggaaggugaaaagcgagaucggcgaugccggguauuucgaccaucacugggcuuccgacagaggacugcucagccgccccuacgcgucuguuuccccgagccugucuuccucuagcuccagcggcuacuccgggcagccuaacggcagagccuggccccggggagaugaagcucccgugccucccgaggacgaggccgccgcuggggccgaagaugagccuccgcgcacaggcgaacuuaaggcggagggagcuaccgccgaggccggcgcuagacugcccuauuacccugccuaugucccccggacccucaagccuacagugcccccgcugaccccugaacaguacgagcuguauauguaccgcgaaguugacacacuugagcugacgagacaggugaaagaaaagcucgcgaaaaaugggauuugccaacggaucuuuggagagaagguccugggccucagccaggggucugugagcgauaugcugucccgccccaaaccuuggucuaaacuuacccagaagggaagagagcccuucauucggaugcagcuguggcucagcgaccaacugggccaggcuguggggcagcagccuggcgccucccaagccucucccacagaaccgcgcagcuccccuucucccccucccagcccgaccgagcccgaaaaguccagccaggagccucugucucuuucccuggaaagcucuaaggagaaccagcagcccgagggaagauccagcuccucucucagcggcaaaauguauuccgggagccaagcuccuggaggcauccaggaaauuguugccaugucucccgagcuggauacauacuccaucaccaagcgggucaaagaagugcucacggacaacaaucuggggcagagacuuuuuggagagagcauucugggccucacccaaggcucugugagcgaucugcugucccgcccuaagccguggcauaaacuuucucugaaggggcgggaacccuucgucagaaugcagcucuggcugaacgacccucacaauguggagaagcuccgcgauaugaaaaagcuggagaaaaaggcuuaccuuaagcggagauauggacugaucagcacaggcuccgacucugaaagccccgccacccgcuccgaguguccuagccccugccugcagccgcaggaucucucucugcuucaaaucaaaaagccucggguugugcuggcgcccgaagagaaagaggcccucagaaaggcuuaccagcuggaacccuauccuucccagcagacaauugagcuccugagcuuucaacuuaaccugaaaaccaauacggucaucaacugguuccacaauuaccgcucccggaugagacgggaaaugcugguggaggggacacaggacgaacccgaccucgauccuucuggaggcccggggauucugcccccuggacauagccaccccgacccuacaccccaguccccggauucugagaccgaggaccagaagccuaccguuaaagaacuugagcugcaagaaggccccgaggaaaacagcaccccucucacaacgcaggauaaggcccaggugcgcaucaagcaagagcagauggaggaagacgcugaggaagaggccggcucccagccccaggauagcggggaacuggacaaaggacaaggcccucccaaggaggagcauccggauccucccgggaaugacggacuccccaaagucgccccuggcccgcugcuucccgggggaucuaccccugauugucccucccugcacccucagcaggaaagcgaggcuggcgaaagacugcaucccgacccucucucuuuuaaguccgcgagcgagucuagccggugcucccuggaggugucucuuaacagccccuccgccgcuagcuccccgggccugaugaugucuguuagcccugugcccuccucuagcgccccuauuucccccucuccgccuggggccccucccgcuaaaguccccagcgccucccccacagcggauauggcuggagcccuccacccuagcgccaaggugaauccgaaccugcagcgcagacacgaaaagauggcuaaucucaacaauaucaucuaucggguggagagagccgcgaaccgcgaagaggcccuggaaugggaguucuga

SEQ ID NO: 68031 - RNA, 1824 nt, Artificial Sequence
  derived and/or modified sequence opt5 from CUZD1__Homo_sapiens__NP_071317
auggagcuggugagacggcucaugccccugacccuucugauccucagcugccuggccgaacuuacaauggcugaggccgaaggcaacgcguccuguacggucucucuugggggagcuaauauggccgagacccacaaggccaugauucuccagcugaacccuagcgaaaauugcacauggaccaucgagcgcccggagaacaaauccauuagaaucauuuucucuuacguucaacuggaccccgauggcagcugugaauccgagaauaucaagguguuugacgggacaucuagcaacggaccucuccugggccaggugugcuccaaaaaugauuauguccccguguucgaaucuagcuccagcacccuuacauuucagaucguuaccgacucugcucggauucagcgcacgguguucgucuuuuacuauuucuuuuccccuaacaucagcauucccaauugugggggauaccuggauacccucgagggcucuuucacauccccuaacuauccgaagccccauccugagcuggccuacugcguguggcacauccaaguugaaaaagacuauaagauuaagcugaauuuuaaagagaucuuccuggaaauugauaagcaguguaaauuugacuuccucgcuaucuacgauggccccagcaccaacuccgggcugaucggacaggugugcggcagagucacaccuaccuuugagucuagcuccaauagccugacgguggugcucucuacagacuacgccaacuccuaucggggguucagcgcgucuuacaccagcauuuaugccgaaaauaucaacacaaccucccugaccuguucuagcgaucgcaugagagucauuaucuccaagagcuaccuugaggcuuucaacucuaauggaaacaaucugcagcucaaagaccccacaugccggccgaagcuguccaacguuguggaguuuagcgugccucuuaauggcugugggacgauucgcaaggucgaagaucaaucuaucaccuauacaaacaucauuaccuucuccgccagcuccacaucugaggugaucaccagacagaaacagcugcagauuaucguuaagugcgaaaugggacauaauagcacgguggagauuaucuacaucacagaagacgacgucauucaaucccagaacgcucucggcaaauauaauaccucuauggcccuguuugagagcaacuccuucgagaagaccauccuggaaagccccuacuacguggaucucaaucagacacuguuuguucaagugucucuucacaccuccgacccuaaccuggucguguuccucgauacaugccgggcgagccccacgucugacuuugccucccccaccuaugaucugauuaaaagcggcuguucucgcgacgagacaugcaaggucuacccucuuuucgggcauuauggaagauuucaguucaaugcuuuuaaauuccugcggagcauguccagcguguaccuccaguguaagguucugaucugcgauucuuccgaccaccagagccgcuguaaccaaggcugcguguccagaucuaagcgggauauuagcuccuauaaauggaagaccgacucuaucauugggccgaucagacugaaacgcgaucggagcgccuccggaaauucuggcuuucagcacgaaacacaugcugaggaaacccccaaccagccuuucaacagcguccaccucuucuccuuuauggugcuggcccuuaauguugugacggucgccaccaucacagugagacauuucgugaaccagcgcgcugacuacaaguaucaaaaacugcagaauuacuga

SEQ ID NO: 68032 - RNA, 2727 nt, Artificial Sequence
  derived and/or modified sequence opt5 from CWC22__Homo_sapiens__NP_065994
augaaaagcuccguggcccagaucaaacccucuagcggccacgacagacgggagaaccuuaauuccuaccaacgcaacucuagcccugaagauagauaugaggaacaggagcgguccccgcgcgacagagauuacuucgacuauucucggagcgauuacgaacauucccgcagagggcggagcuaugacucuuccauggagagccgcaauagagaucgggagaagcgcagagaacgggagcgcgacaccgauagaaaacggucuagaaagucccccagcccuggacgccggaaccccgaaacaucugucacgcaguccagcuccgcucaggacgagccugccaccaaaaagaagaaagaugagcucgacccccugcuuacaagaaccggcggggcguacauuccuccggcuaagcugcgcaugaugcaagaacagaucacagauaaaaauucucucgccuaucagcggaugagcugggaggcccugaagaaauccauuaacggacuuaucaauaagguuaacauuagcaauaucucuaucauuauccaggaacugcuccaagagaacauugugagaggccgcgggcugcugucccggagcgugcuccaggcucagucugccagccccaucuuuacccacgucuacgcugcccugguggcgauuaucaauuccaaguucccucagauuggagaacuuauccugaaaagacucauccugaacuuucgcaagggcuaccggagaaaugacaaacaacuuugccugacagccucuaaguucguugcucaucucauuaaccagaauguggcccacgagguccugugucuggagaugcucacccugcuucuggaacgccccacggacgauagcguggagguugcuaucggcuuucucaaagaaugcgggcugaagcugacccagguguccccucggggaauuaacgccaucuucgagagacugcggaacauucuccaugaaagcgagaucgacaaacgcguccaauauaugaucgaggugauguuugcggugagaaaggauggcuucaaggaccaccccauuauccuggaagggcuggaucucgucgaggaagacgaucaguuuacacacaugcugccgcuugaggacgauuacaauccugaagacguucugaacguguucaaaauggaucccaauuuuauggagaacgaggaaaaguauaaagccauuaagaaagagauccucgacgaaggagacaccgauucuaauacagaccaggaugcuggcuccagcgaggaggacgaagaggaagaggaagaggagggggaagaggaugaagagggacagaaggugaccauucaugacaagacggaaaucaaccuggucucuuuccggagaacaaucuaccuugccauucaauccagccuggauuuugaggagugugcucacaaacuccugaagauggaauuuccugagucccagaccaaagaacugugcaauaugauccucgacuguugcgcccagcagcgcacauaugagaaguucuuuggccugcuugccggccgguucuguaugcugaaaaaggaauacauggagucuuuugaggggauuuucaaggaacaauaugauaccauccauagacucgagaccaacaaacugcgcaauguggcuaagauguuugcgcaucugcuuuacacagacagccuccccugguccguucuggaaugcauuaaacugucugaggagacgaccacaagcuccagcagaaucuucgugaagauuuucuuccaggaacucugugaguacaugggacugcccaaacuuaacgcccggcugaaggaugaaacccuccagccguuuuucgagggccugcugccucgcgacaaucccagaaacacacgguuugcuaucaauuucuuuaccucuaucgggcuuggaggccucacggaugaacugcgcgagcaccugaagaacacaccuaaagucauuguggcccagaagcccgacguugagcaaaauaaauccagcccuucuuccagcucuagcgccuccucuagcuccgaaagcgacuccucugauagcgacuccgauucuagcgacuccucuagcgaguccagcucugaagaguccgauucuagcuccaucagcucucacuccagcgcuuccgccaacgacgugagaaagaaagggcacggaaagacccggagcaaagaagucgauaagcucauucgcaaccagcagaccaaugacagaaagcagaaagagcggcgccaagagcauggccaccaggaaacaagaaccgagcgggaaagacgcucugagaagcaucgggaucagaacagcuccggcucuaauuggagagaccccaucacaaaauauacgagcgauaaggacgugccguccgaacgcaacaauuacucucgggucgcgaacgauagagaccaagagaugcacauugaccuggagaauaaacacggggauccuaagaagaaacgcggagaacggagaaacagcuucuccgagaaugaaaagcauacccaccgcaucaaagacucugagaacuuccggagaaaggaucggagcaaauccaaggagaugaaucgcaagcauagcggcucuagauccgacgaagaucgguaucagaacggggcugagcgcagaugggaaaagagcucucgguacuccgagcagagcagagaauccaagaaaaaucaggaccgccggagagagaagucucccgccaaacaaaaguga

SEQ ID NO: 68033 - RNA, 1176 nt, Artificial Sequence
  derived and/or modified sequence opt5 from CWC27__Homo_sapiens__NP_001284573
augagcaacaucuacauucaggagcccccuaccaauggcaaggugcugcucaaaacaacggccggggacaucgauauugaacugugguccaaggaggcuccgaaagccugcagaaacuucauccaacuuugucuggaagcguauuacgacaauaccauuuuucaccgggucguucccggauucaucgugcagggcggggauccuacaggaaccggcucugggggagagagcaucuauggcgcucccuuuaaggacgaguuccauucccgccucagauuuaaccggcgcggccugguggccauggccaaugcugggucucacgauaacggaagccaguucuuuuucacacuuggcagagccgacgagcugaauaacaaacauaccauuuuugggaaggucacaggagauaccguguacaauaugcuccggcuguccgagguugacaucgaugacgaugaacgcccucacaacccccauaagauuaaaucuugcgaggugcuguucaauccuuuugacgauaucauuccgagagaaaucaagcggcucaaaaaggagaaacccgaggaagaggucaagaagcugaaaccuaagggcacgaaaaacuucagccuucuguccuuuggggaagaggcugaagaggaggaagaggaagugaaucgcguuagccagucuaugaagggaaaauccaagagcucucacgaccuccugaaagacgauccccaccuuuccagcgugccugucguggagucugaaaagggcgacgcccccgaucugguggacgauggcgaggacgaguccgcggaacaugaugaguauauugacggggaugaaaagaaccucaugagagagcggaucgccaaaaagcugaaaaaggacaccagcgcuaaugucaaauccgccggagaaggcgagguugagaagaagucugugagccgcuccgaagaacugagaaaagaagcucggcaacucaagcgcgagcugcuugccgcgaaacagaagaaaguggagaacgccgcuaagcaggccgaaaagagaagcgaggaagaggaagcuccgccugauggggccgucgccgaguaccggagagagaaacagaaguaugaagcucugcgcaaacaacagucuaagaaaggaacaucccgggaggaccaggacgugaccuguacaagcguuuga

SEQ ID NO: 68034 - RNA, 1497 nt, Artificial Sequence
  derived and/or modified sequence opt5 from CWF19L1__Homo_sapiens__NP_001290333
auggcccagaagccccugagacuccuggcuugcggcgacguggaggggaaauucgauauccuuuuuaaccggguccaagccauucagaagaaaagcggaaauuucgaccugcuccuguguguuggcaacuuuuucggguccacccaggaugcggaaugggaggaauacaagacaggaaucaaaaaggcuccuauucagacguaugugcuuggcgccaauaaccaagagaccgugaaguacuuucaggacgccgaugggugcgaacuggcugagaauaucacauaucucggacgcaaaggcauuuucaccggcucuagcgggcugcagaucgucuaccuguccggaacagagucucucaacgaaccggugcccggcuauagcuuuuccccuaaggacguuucuagccugagaaugaugcuuuguaccacaucccaguucaaagggguggauauccugcucaccagccccuggccuaagugcgucggaaauuuuggcaacucuuccggggagguggacacgaaaaaguguggaagcgcccugguuucuucccuugcuaccggccugaagccccgguaccacuucgccgcgcucgaaaagacauauuacgagcgccugccuuacagaaaucauauuauccugcaagagaacgcccagcacgcuacccgguuuauugcccucgcuaaugugggcaacccggaaaagaaaaaguaucuguacgccuucagcaucguccccaugaaacuuauggaugcggccgagcuggugaagcagccucccgacgugacagaaaauccuuaucgcaaaucugggcaggaggcuuccauuggaaagcaaauccucgcccccgucgaagagagcgcuugccaguuuuucuucgaucugaacgagaagcagggcagaaaacgguccucuaccgggcgcgacagcaaguccagcccgcauccuaaacaacccagaaagccuccccagcccccuggaccguguugguuuugccuugccucucccgaaguugagaaacaccugguggugaauauuggcacgcauuguuaccucgcccuggcuaaagggggacuguccgaugaccacguccucauccugccuaucggccacuaucagagcgugguugaacuuucugcggagguggucgaagagguggagaaguacaaagccacacugcggcgcuucuuuaagagcagaggcaaauggugcguuguguucgaacggaacuauaagucccaucaccuccagcugcaaauugcucagcccggggccgccuacuuuuacgucgagcuugacaccggagaaaaacuguuccaucgcaucaagaagaacuuuccucuccaguucggcagagaggugcuggcuucugaagccauucugaauguccccgauaaaagcgacuggcggcagugucaaaucuccaaggaggaugaggaaacacucgcgagacgcuuucggaaagacuucgagccguaugauuuuacccuggacgauuga

SEQ ID NO: 68035 - RNA, 2685 nt, Artificial Sequence
  derived and/or modified sequence opt5 from CWF19L2__Homo_sapiens__NP_689647
auggccaccagcauggcugccgcguccggcagauucgagucugcuaagagcaucgaagaacggaaagaacagacacgcaacgccagagccgaggugcugcggcaagcuaaggccaauuuugaaaaagaggagcgcagaaaggaacucaaacggcugcgcggggaggacacguggaugcuucccgaugucaacgaaagaauugagcaguucucccaggagcacucuguuaagaagaaaaagaaaaaggacaaacauagcaagaaggcuaaaaaggaaaagaagaaaaaguccaaaaagcagaaguacgagaaaaauaacgaaucuagcgauuccucuagcuccagcgaggacgaauggguggaggccgugccuucucaaaccccggauaaggagaaagcguggaaggucaaagacgaaaaguccggaaaggaugacacacagaucauuaaacgggaugaguggaugaccguggacuuuaugagcguuaagacagugucuuccagcucccugaaagccgaaaaggagaccaugcgcaaaaucgaacaggagaagaaucaggcucucgagcaaucuaagcugauggaaagagagcuuaaccccuauuggaaagauggcgggacaggacugccucccgaagacugcagcgucuccagcauuaccaaggugucuguuguggaggauggcgggcucuccuggcugcggaaaagcuaccugcgcaugaaggaacaggccgagaaacagucuagaaauuucgaggacaucgucgcugaacgguauggaagcauggagaucuuucaguccaagcucgaagacgccgagaaggcggccucuacgaaagaggauuaccgcagagaacgguggagaaagccuaccuauagcgacaaagcucaaaacugucaggagucccgcgaaagcgaucuggugaaguacggcaauucuucccgggacagauaugccacaaccgauacagcuaaaaacagcaauaacgagaaguucauuggcgacgaaaaagauaagcgccccgggucucuugagaccugccggagagaguccaauccucgccagaaccaagaauuuagcuucggaaaucugcgggccaaguuucucagaccguccgacgaugaggaacugucuuuccacagcaaaggccgcaaguuugagccccuuuccucuagcuccgcccugguggcucaggggagccucuguucuggauuccggaaaccuacgaagaacuccgaagagagacugacaagcuggucucgcuccgacggcagaggggauaaaaagcauagcaaccagaagcccucugagaccagcacagacgaacaccagcaugucccugaggacccccgggaaaaaucccaagaugagguucugcgggacgauccgccuaagaaagaacaccuccgcgacaccaagagcaccuuugcgggaucucccgagagagaguccauccacauucugagcguggaugagaaaaauaaacuuggcgccaagaucauuaaagcugagaugaugggcaacauggaacuggccgagcagcucaaggugcagcuggagaaagccaauaaguucaaagaaacaaucacgcagauuccuaagaaguccggggucgagaacgaagaccaacaggaggugauccuuguucggaccgaucagucuggaagaguguggcccgucaauacacccggcaaaagccuggaaucccaagggggacgccggaagagacagauggugucuacccaugaggagcgcgaaagaguucgguacuuccacgacgaugacaaccucagccugaaugaucuggugaaaaacgagaagaugggcacagcugaaaaucagaacaaacucuuuaugcgcauggccuccaaguucauggggaaaaccgacggagauuacuauacgcuggacgacauguuugucucuaaggcggcugagagagaacggcuuggcgaggaggaagagaaucagcgcaagaaagccaucgccgaacauagaagccuggcugcccagauggagaagugccucuacuguuucgauuccagccaauuuccuaaacaccugauuguggcuaucggcgucaagguguaucuuugccugccgaacguucggucucucacagaagggcacugucugauugugccccugcagcaucaccgcgccgcgacccuccuggacgaggauaucugggaggaaauucagauguucagaaaaucccuugucaagauguuugaggacaagggacuggauugcaucuuccucgaaaccaauaugagcaugaaaaagcaauaccauaugguguaugaguguaucccucugcccaaagagguuggcgacauggccccuauuuacuuuaagaaagcuaucauggaaucugaugaggaaugguccaugaacaagaagcugauugaccuuagcucuaaagauauccggaaguccgugccccgcgggcucccguauuucagcgucgacuuuggacugcacggcggguucgcccaugugauugaggaucagcacaaauuuccucacuacuucggcaaggaaaucaucggaggcaugcuggacauugagcccagacucuggcggaaagggaucagagaguccuucgaagaucagcgcaagaaggcucugcaguuugcccaaugguggaaaccuuacgacuucacaaagagcaaaaauuauuga

SEQ ID NO: 68036 - RNA, 2100 nt, Artificial Sequence
  derived and/or modified sequence opt5 from CWH43__Homo_sapiens__NP_079363
augcccagccuguggagagagauccuccuggaaucccuucugggcugcgugucuuggagccucuaccacgaccuggggccuaugauuuauuacuucccgcuucagacccuggagcucacaggacuggaaggcuuuuccaucgccuuccugucucccauuuuucucacgaucaccccuuucuggaagcuggucaacaaaaaguggaugcuuacacugcuccggauuaucaccaucgggagcauugcuuccuuucaagcccccaaugcgaaacugcgccuuaugguucuggcucucggagugucuagcucccugaucgugcaggccgucacaugguggagcggcucucaucugcagagauaucuccggauuuggggguucauccugggacagauugugcuuguugugcugcgcaucugguacaccucccucaacccuauuuggagcuaucaaaugucuaauaaggucauccugacacuuuccgccaucgcuacccuggauagaauuggcacggacggcgauuguagcaaacccgaggaaaagaagaccggggagguggccacaggaauggcuucucggccuaacuggcuccuggccggcgcggccuuugggucccugguuuuccucacccacuggguguuuggagaggucagccuggugucccgcugggcugugucuggccauccgcaccccgggccugaccccaauccuuucggaggcgccguccuucugugccucgcuagcggccugaugcuucccuccugucugugguuuagagggacaggacucaucugguggguuaccggcacggccagcgcggccgggcugcuguaccuccauacaugggcugccgcugugucuggaugcguguucgccauuuuuaccgccuccauguggccgcagacacugggccaccuuaucaacagcgggaccaauccuggaaaaaccaugacaauugcuaugaucuucuaucugcucgaaaucuucuuuugugcguggugcacggccuucaaguuuguccccggcggcguguacgcucgggagcgcucugauguucugcuggggaccaugaugcuuauuaucggacucaacaugcuguucggcccuaaaaagaaucuggaccuccugcuucagacaaagaacagcuccaaggugcuguuuagaaagucugaaaaauacaugaaacucuuccuguggcugcuugucggggugggacuccugggccuggggcuccggcacaaagccuaugagcgcaagcugggcaaaguugcccccaccaaggaggugagcgcugccauuuggcccuuuagauucggauacgauaaugaaggcugguccagccuugagcggucugcgcaucugcucaacgaaacaggggcugacuuuaucaccauucuggaguccgaugccagcaaaccuuauaugggaaauaacgaccugacgauguggcuuggcgaaaagcucggguucuacacagauuuuggaccgucuacccgcuaucacaccuggggcaucauggcccuguccagauaccccaucgucaagagcgagcaucaucugcucccuucccccgagggggaaauugcuccugccaucacacugaccgugaauauuucuggcaaacuugucgacuucgugguuacacacuuuggaaaccacgaggaugaccuggaccggaagcuccaggcuaucgccgugagcaaacugcugaaguccucuagcaaccaagucauuuuccuuggcuauaucacguccgcgcccgggagcagagauuaccuccagcugaccgaacacggaaaugugaaagacauugauucuacagaccaugaucgcuggugugaguacaucauguaucggggccugaucagacucggguacgcccgcauuucccacgcugaacugagcgacucugagauccagauggccaaguuccggauuccggaugacccuaccaacuauagagauaaucagaagguugugaucgaccaucgcgaggucuccgagaaaauucacuuuaacccccgguucggaagcuacaaggaaggccacaauuaugaaaacaaucaucacuuucauaugaacacaccuaaauacuuccuuuga

SEQ ID NO: 68037 - RNA, 1194 nt, Artificial Sequence
  derived and/or modified sequence opt5 from CX3CL1__Homo_sapiens__NP_002987
auggcccccaucagccuguccuggcuccugagacuugcuaccuucugccaccugacagugcuccuggccggccagcaucacggggucacgaaguguaacauuaccugcucuaaaaugacaagcaagaucccuguugcgcuucugauucauuaccaacagaaucaggcuuccuguggaaaacgggccaucauucucgagacccgccagcacagacuguuuugcgccgacccgaaggaacaaugggugaaagaugcuaugcagcaucuggaccggcaggccgcugcccucacacgcaacggcgggaccuucgagaagcagaucggagaagugaagcccagaacaaccccugcggccggcgggauggaugagucugucgugcuggaacccgaggcuacgggagagagcuccucucuugaaccuacccccagcucccaagaggcccagcgggcucugggcacaagcccugaacucccgaccggcguuacagggucuuccggaacccgccugcccccuacgcccaaagcccaggacggcgggccugugggaacagagcuuuuuagagugcccccggucagcaccgcggccacauggcagucuuccgcuccucaccaacccggcccuagccugugggccgaggcuaagaccucugaagcccccuccacccaggaucccagcacacaggccuccacggcuucuagcccugcgccggaggaaaaugcccccuccgaggggcaacggguuuggggacagggccagagcccucgccccgaaaacucucucgagagagaggaaaugggcccugugcccgcucacaccgacgccuuccaggauugggggccgggauccauggcccaugucagcguggugccugucucuagcgagggcacacccucccgggaaccuguugcuucugggagcuggacccccaaagccgaggaaccuauccacgcgacaauggacccccaacgccugggagugcugauuaccccggugccugaugcucaggccgccacgagacggcaggcugucggccuccuggccuuucuugggcuccuguucugucugggaguggcuauguuuacauaucagucccuucaaggcugcccccgcaagauggccggcgagauggcggaggggcugagauacaucccccggagcuguggaucuaauuccuauguucucgugccugucuga

SEQ ID NO: 68038 - RNA, 1164 nt, Artificial Sequence
  derived and/or modified sequence opt5 from CX3CR1__Homo_sapiens__NP_001164645
augagagagccccuggaagccuucaagcucgcugaccuggauuuucggaaaagcucccuugccucuggcuggcgcauggcgagcggggcuuucaccauggaccaguuuccugaguccgugacagaaaacuucgaguacgaugaccuggccgaagccugcuauaucggagauauugucguuuuuggcacgguguuccucucuaucuuuuacagcgugauuuucgcuaucgggcuggucggaaaucuucuggugguuuuugcccucaccaacuccaagaaaccgaagucugugacagacauuuaucugcugaaucucgcucugagcgaucuucuguucgucgccacccuccccuuuuggacacacuaccugaucaacgagaaaggccuucauaaugcgauguguaaguucaccacagccuuuuucuucaucggguuuuucggauccaucuuuuucauuaccgugauuagcaucgacagauaucuggcuauuguucucgccgcuaacucuaugaauaaccggacggugcaacacggcgucaccaucucccugggcgugugggccgcggccauucugguggcugccccucaguuuauguucacaaagcagaaagagaaugaaugccucggggauuaccccgagguccugcaggaaaucuggccuguucuucgcaacguggagaccaauuuucugggauuccuccugccccuucugaucaugagcuauuguuacuuuagaauuauccaaacacucuucucuugcaagaaccauaaaaaggcuaaagccauuaagcugauccugcucguggucauuguguuuuuccuguuuuggaccccuuacaauguuaugaucuuccuugagacgcugaagcucuaugacuucuuuccguccugugauaugcggaaagaccugcgccuugcccugagcgugacagaaaccgucgcuuucucucacugcugucucaacccccugaucuacgcguuugccggcgagaaguucagacgguaucuguaccaucucuaugggaaaugccuggcugugcuuuguggacgcuccguucacguggauuuuagcuccucugaaagccagagaucccggcacggcagcguccugucuuccaauuucacauaccauaccagcgacggggacgcccuccugcugcuuuga

SEQ ID NO: 68039 - RNA, 603 nt, Artificial Sequence
  derived and/or modified sequence opt5 from CXADR__Homo_sapiens__NP_001193993
auggcccugcuccugugcuucgugcuucuguguggcgucguugacuuugcuagaagccucuccaucaccacacccgaggaaaugauugagaaggccaaaggggaaacggcguaccugccuugcaaguucacccuuucuccggaggaucagggaccccuggacaucgaauggcucauuagcccugcugauaaccaaaaaguggaccaggugaucauucuguauuccggcgauaagaucuacgacgauuauuaccccgaccugaaagggcggguccacuuuacaucuaaugaucucaagagcggagacgccuccaucaacgugaccaaucugcagcuuucugauauuggcacauaucaguguaagguuaaaaaggccccugggguggcuaacaaaaagauccaccuggucgugcucggaaaaaugugccaucugcaacgcgccguuagaccccuuccugaggcuaccagcgccgugauuauccacccguggggccccugucugcucccuacauggaaggacauuccccggcuguccaucaccaaguaccaggucaaaacgcugaaugcgcuccugcgcgugagacuuagccaucugcuccgguga

SEQ ID NO: 68040 - RNA, 297 nt, Artificial Sequence
  derived and/or modified sequence opt5 from CXCL10__Homo_sapiens__NP_001556
augaaccagaccgccauccugauuugcugucucaucuuccugacacuuagcggcauucaaggggugccccuguccagaacgguccggugcaccuguaucucuauuagcaaucagccuguuaacccgcgcucccucgagaagcuggaaaucauccccgcuucucaguuuugcccuagaguggagauuaucgccacaaugaaaaagaaaggagaaaagcggugucuuaaucccgagagcaaagcgauuaagaaccugcucaaggcuguguccaaagaacgcucuaagagaagcccuuga

SEQ ID NO: 68041 - RNA, 285 nt, Artificial Sequence
  derived and/or modified sequence opt5 from CXCL11__Homo_sapiens__NP_005400
augagcgugaagggcauggccaucgcucuggccgucauucucugcgcgaccguugugcagggguuccccauguuuaaaagaggacggugucugugcaucggcccuggggugaaggcugucaaaguggccgacauugagaaggccuccaucauguacccgucuaacaauugugauaaaauugaaguuaucaucacacuuaaggagaacaagggacaacgcugccugaaucccaaaagcaagcaggcuagacucauuaucaaaaagguggaacggaaaaacuucuga

SEQ ID NO: 68042 - RNA, 282 nt, Artificial Sequence
  derived and/or modified sequence opt5 from CXCL12__Homo_sapiens__NP_000600
augaacgccaagguggucguugugcuggugcucguccugaccgcucuuugccugagcgacggcaaacccgugucccucucuuacagauguccuugccgguucuuugagagccacguugcccgcgcgaaugugaagcaucugaaaauccuuaacacaccgaauugugcucugcagauugucgccagacucaagaacaauaaccggcaagugugcaucgaucccaaacugaaguggauucaggaauaucuggagaaggcccucaauaaacgcuucaagauguga

SEQ ID NO: 68043 - RNA, 330 nt, Artificial Sequence
  derived and/or modified sequence opt5 from CXCL13__Homo_sapiens__NP_006410
augaaguucaucagcaccucccugcuccugaugcuucuggugucuagccucucccccguccagggcguucuggagguguacuauacaucucuuagaugccggugugugcaagaaagcuccgucuuuauuccucgcagauucaucgaccggauucagauccugccgcgcgggaacggaugccccagaaaagagauuaucguguggaagaaaaauaagucuaucguuuguguggauccucaggccgaauggauucagcggaugauggagguccuccgcaaaagaagcuccagcacgcugcccgugccuguuuuuaagcggaagauccccuga

SEQ ID NO: 68044 - RNA, 336 nt, Artificial Sequence
  derived and/or modified sequence opt5 from CXCL14__Homo_sapiens__NP_004878
augagccugcuccccagacgggccccuccgguguccaugcgccugcuugcugccgcgcugcuccugcuucugcucgcucuguacaccgccagagucgacggcucuaagugcaaauguagccggaaggggcccaaaauccgcuauuccgauguuaagaaacuggagaugaagccuaaguacccccacugcgaagagaaaauggugauuaucacaacgaagucugugagcagauaucggggacaggaacauugucuccacccuaaacugcaauccaccaagcgcuucauuaaaugguacaacgccuggaaugagaagagacgggucuaugaagaguga

SEQ ID NO: 68045 - RNA, 822 nt, Artificial Sequence
  derived and/or modified sequence opt5 from CXCL16__Homo_sapiens__NP_001094282
augagcggcucccagucugagguggcccccagcccucaauccccgagaucucccgaaauggggcgggaccugcgcccuggaagcagaguccuccugcuucugcuccugcuucugcucguuuaccugacccagcccggcaacgggaaugagggauccgugacaggcucuugcuauugugggaagcggaucagcuccgauagcccucccucugugcaguucaugaaccgccugagaaaacaccuccgggcuuaccaucgcugccuguauuacacgagauuucagcuucuguccuggagcgucuguggaggcaauaaggacccuugggugcaagaacucaugucuugccuggaucuuaaagaguguggccacgccuauuccgggauuguugcgcaucagaagcaucugcucccgaccucucccccuaucagccaggcuuccgaaggagccagcuccgacauucacacacccgcccagaugcugcugucuacccuccaaagcacacagcggccuacccugcccgugggcucccuuagcucugauaaagagcugacacgcccgaacgagaccacgauccacaccgcugggcacucccucgccgcuggaccugaagccggcgagaaucagaagcagcccgaaaagaacgcggggccuacagccagaaccagcgcuacaguccccgugcugugccuucuggccauuaucuucauccucaccgcugcccugucuuacguucuguguaaacggcgcagaggacaaagcccccaguccucuccugaccucccggugcauuauauucccgucgcgccugauagcaauacguga

SEQ ID NO: 68046 - RNA, 360 nt, Artificial Sequence
  derived and/or modified sequence opt5 from CXCL17__Homo_sapiens__NP_940879
augaaggugcugaucagcucccuccugcuucugcucccccugaugcuuaugucuauggucagcuccucucugaacccuggcguugcuagagggcacagagaccgcggacaggcuagcagacgguggcuccaagagggcgggcaggaaugcgaguguaaagauugguuccugcgcgccccgagacggaaguuuaugaccguguccggacugcccaaaaagcagugcccuugugaccauuucaaaggcaaugugaagaagacacgccaccagagacaucaccggaaacccaacaagcauucucgcgcgugccaacaguuucucaaacagugucagcugcggagcuucgcccuuccucuguga

SEQ ID NO: 68047 - RNA, 324 nt, Artificial Sequence
  derived and/or modified sequence opt5 from CXCL1__Homo_sapiens__NP_001502
auggccagagcugcccugagcgcggcucccuccaacccucggcuccugcgcguggcccuucugcuccugcuucuggucgccgcuggcagacgggccgcuggggccucuguugcgaccgagcuccgcugccagugucugcaaacacugcagggaauccacccgaagaauauucagagcgugaacgugaaaucccccggcccucauugcgcccagacggaagucaucgcuacccucaagaaugggagaaaagccugucugaaccccgcuucuccuauugugaagaaaaucauugagaagaugcuuaauagcgacaaguccaacuga

SEQ ID NO: 68048 - RNA, 324 nt, Artificial Sequence
  derived and/or modified sequence opt5 from CXCL2__Homo_sapiens__NP_002080
auggccagagcuacccugagcgccgcgcccuccaacccucggcuccugcgcguggcccuucugcuccugcuucuggucgcugccucuagacgggcugccggggcuccgcucgccacagagcugcgcugccagugucugcaaacgcuccaggggauccaccugaagaauauucagagcguuaaagugaagucccccggaccucauugcgcgcagaccgaagugaucgccacacuuaaaaacggccaaaaggcuugucugaaucccgccucuccuauggucaaaaagauuaucgagaagaugcucaaaaacggcaagagcaauuga

SEQ ID NO: 68049 - RNA, 324 nt, Artificial Sequence
  derived and/or modified sequence opt5 from CXCL3__Homo_sapiens__NP_002081
auggcccacgcuacccugagcgccgcgcccuccaacccuagacuccugcggguggcccuucugcuccugcuucuggucgcugccucucgcagagcugccggcgcuagcguugugacagagcuccggugccagugucugcaaacgcugcaggggauccaucucaagaauauucaguccgugaacguccgcucuccgggaccccacugcgcccagaccgaagugaucgcgacacugaaaaauggcaagaaagccugucuuaacccugcuagccccaugguucaaaagauuaucgagaaaauucugaauaagggguccaccaacuga

SEQ ID NO: 68050 - RNA, 345 nt, Artificial Sequence
  derived and/or modified sequence opt5 from CXCL5__Homo_sapiens__NP_002985
augagccugcucuccucuagagccgcucgggugcccggcccuagcuccucucugugcgcccuucugguccuccugcuucugcucacccagccggggcccaucgcgagcgcuggaccugccgccgcuguucugcgcgagcugagaugugugugccuccaaacaacgcagggcgugcaccccaagaugauuuccaaccugcaggucuucgccaucgggccucaguguucuaaaguggaaguuguggcuagccuuaagaauggaaaagagauuugccuggaccccgaagccccuuuucucaagaaagucauccaaaagauucuggauggcgggaacaaggagaauuga

SEQ ID NO: 68051 - RNA, 345 nt, Artificial Sequence
  derived and/or modified sequence opt5 from CXCL6__Homo_sapiens__NP_002984
augagccugcccuccucuagagccgcucgggugccuggcccgagcgggucccucugcgcccugcuugcgcugcuccugcuucugacacccccuggaccccucgcuucugccggcccugucagcgccguucugaccgagcugcgcuguacgugccucagagugacccugcgggugaaccccaagacaaucgggaaacuucaggucuucccugcuggaccgcaauguuccaagguggaaguuguggccucucugaaaaauggcaagcaggucugccucgaccccgaggcuccuuuucugaaaaaggugauucagaagauccuugauagcgggaacaaaaagaauuga

SEQ ID NO: 68052 - RNA, 300 nt, Artificial Sequence
  derived and/or modified sequence opt5 from CXCL8__Homo_sapiens__NP_000575
augaccagcaagcuggccguggcucuccuggccgcguuccuuaucuccgcugcccugugcgagggcgccguccuccccagaucugcuaaagaacugcggugucagugcauuaagacauacagcaaaccuuuucacccgaaguucaucaaagagcuucgcguuauugaauccgggccccauugugccaacacggagaucauugugaagcugucugacggaagagaacucugccuggauccuaaggagaauugggugcaacgggucguggagaaauuucugaagcgcgcugaaaacagcuga

SEQ ID NO: 68053 - RNA, 378 nt, Artificial Sequence
  derived and/or modified sequence opt5 from CXCL9__Homo_sapiens__NP_002407
augaagaaaagcggcgugcuguuccuccuggggaucauucuucugguccucaucggaguucagggcacccccguggugagaaaggggcggugcuccuguauuucuacaaaccaaggaacgauccaucugcagagccuuaaagaccugaagcaguuugccccuuccccgucuugcgagaaaauugaaaucaucgcuacccucaagaauggcguccagacaugucugaaccccgauagcgccgacgugaaggagcugauuaaaaagugggaaaaacaaguuucccagaagaaaaagcagaagaaugggaaaaagcaccagaaaaagaaagugcucaagguccgcaaaucucaaagaagccggcagaagaagaccacauga

SEQ ID NO: 68054 - RNA, 1053 nt, Artificial Sequence
  derived and/or modified sequence opt5 from CXCR1__Homo_sapiens__NP_000625
augagcaacaucaccgacccccagaugugggauuucgacgaucugaauuuuacaggcaugccuccggccgacgaagauuacucccccugcaugcucgaaacggagacccugaacaaguauguggucauuaucgcuuacgcccuuguuuuccugcucucucugcuugggaauagccuggugaugcucgugauucuguauuccagagucggacggucugugacagacguuuaccugcucaaccuggcgcuugcugaucugcucuuugcccugacccuuccuaucugggccgcuagcaaagugaauggcuggauuuucgggacauuucuguguaaggucgugucccuccugaaagaaguuaacuucuauucuggaauccugcuccuggccugcaucagcguggaccgcuaccuugcuauuguccacgccaccagaacacugacccaaaagcggcaucucgugaaauuugugugucugggcugcugggggcuuuccaugaaucugagccuccccuucuuucuguuccgccaggcguaucacccuaacaauucuucccccgucuguuacgagguucugggaaacgauacggccaaguggagaauggugcuccggauccugccucauaccuuuggcuucauugugccgcuuuuugucaugcuguucugcuacggcuucacacuccgcacccuguuuaaggcucacauggggcagaaacauagagccaugcgggugaucuucgcuguugugcuuauuuuucugcucuguuggcugcccuauaaucugguccuccuggccgacacacuuaugcgcacccaggugauccaagaaagcugcgagagacggaacaauauuggacgcgcgcuggaugccacggagauccucggcuuccugcacucuugucugaacccuaucauuuacgcuuuuaucgggcagaauuucagacacggauuucuuaagauucucgccaugcauggccugguuuccaaagaguuccuggcucggcaccgcgugacaagcuauaccucuuccagcgucaacguguccucuaaccucuga

SEQ ID NO: 68055 - RNA, 1083 nt, Artificial Sequence
  derived and/or modified sequence opt5 from CXCR2__Homo_sapiens__NP_001161770
auggaggacuucaacauggaaagcgauuccuuugaggacuucuggaagggcgaagaucugucuaauuacagcuauuccucuacccugcccccuuuucuccuugacgccgcuccgugcgagcccgaaagccuggagaucaacaaauacuucguggucauuaucuaugcccucguuuuucugcuuucccugcucgggaauagccuggugaugcuggugauucucuacagcagagucggacgguccgugacagauguuuaucugcuuaaccuggcgcucgcugaccugcuuuucgcccugacgcucccuaucugggccgcuagcaaggugaauggcuggauuuuugggaccuuccuguguaaagucgugucucugcucaaggagguuaacuuuuacuccggaauccugcuucuggccugcaucagcguggaucgcuaucucgcuauuguccacgccacaagaacccugacacagaaacgguaccuugugaaguucaucugucugucuauuuggggccucucccugcugcucgcgcugcccgugcuucuguuucgcagaaccgucuacagcucuaauguuuccccugccugcuaugaagacauggggaacaauacagcuaacuggcggaugcuccugcgcauccuuccccaaucuuucggauuuauugugccucugcucaucaugcuguucuguuacggcuucacccugagaacgcucuuuaaggcccauaugggccagaaacaccgggcuaugcgcgugauuuucgccgucgugcugaucuuucuucugugcuggcucccguauaaucugguucugcuugcggauacccucaugagaacacaggugauccaggagaccugugaacggcgcaaccauauugacagagcccuggaugcuacagagauccuggggauucuccacuccugccugaauccccuuaucuacgccuucauuggacaaaaguuucggcauggccugcucaaaauccuggcuauccacgggcugauuucuaaggacagccuuccuaaagauucccgccccagcuucgucggaucuuccagcggccacaccucuacgacacucuga

SEQ ID NO: 68056 - RNA, 1248 nt, Artificial Sequence
  derived and/or modified sequence opt5 from CXCR3__Homo_sapiens__NP_001136269
auggagcugagaaaguacggccccgggcggcucgccggaaccgugaucggcggggcugcccagagcaaaucccaaacaaagucugacagcauuacgaaagaguuccugccuggacuuuauaccgcgccguccucucccuuuccucccagccaggucuccgaucaccagguucugaacgacgcugaaguggccgcccuccuggaaaauuucucuagcuccuacgauuauggcgagaacgaaagcgacucuugcuguacauccccucccugcccucaggauuuuagccuuaauuucgaccgcgcuuuucugccggcccucuacucucugcuguuccuccuggggcuucugggaaacggcgcuguggccgcgguccuccuguccagacggaccgcccuuagcucuacagauaccuuucugcuccaucuggcuguggccgacacacugcucguucugacccuuccccugugggcuguggaugccgcgguccaauggguguucggcuccgggcucuguaagguugccggagcucuguuuaauaucaacuucuaugccggcgcucugcugcucgccugcauuagcuuugaccgcuaccugaauaucgugcacgccacgcagcuguauagacgggggccucccgcucgcgucacccucacaugucuggcgguguggggacuuugccuucucuucgcccugccugauuuuauuuuccuuuccgcucaucacgacgagagacugaacgccacccauugucaguacaauuucccccaggugggccggacagcccuccgcguccugcaacugguugcuggguuucuccugccgcuucuggugauggccuacugcuaugcgcacauccucgcugugcugcuggucucuagaggacagcggcgccuuagagccaugcggcucgugguuguggucgugguugccuucgcucuguguuggaccccuuaccaccuggugguccucguggauauccugauggaccuuggcgcccuggcucgcaacugcggcagagagagccgggucgacguggccaaauccguuacgagcgggcucggauauaugcauuguugccugaauccccugcuuuacgcguuugugggcgucaaguucagagaacgcauguggaugcuccugcugcggcucgggugcccuaaccagagaggacugcagcgccaacccucuuccagccggagagauucuagcugguccgagacaucugaagccagcuauuccggccuuuga

SEQ ID NO: 68057 - RNA, 1071 nt, Artificial Sequence
  derived and/or modified sequence opt5 from CXCR4__Homo_sapiens__NP_001008540
augagcaucccccugccucuccugcagauuuacaccuccgacaacuauacagaggaaaugggcucuggggauuacgacagcaugaaggagccgugcuucagagaagagaaugccaacuuuaauaaaaucuuccuucccacgauuuauuccaucauuuuucugaccggaaucgugggcaacgggcucgucauccugguuaugggauaccaaaagaaacuucggucuaugacagauaaguaucgccugcaccucagcguggcugaccugcuguucgugauuacccucccuuuuugggccgucgaugcgguggcuaauugguacuucggcaacuuucuguguaaagccguucaugugaucuauacagucaaucuuuacuccucugugcugauucucgccuucaucagccuggacagauaccuugcuauuguucacgccaccaacucccagcggccccgcaagcugcucgcugaaaagguggucuauguggggguguggaucccugcccugcugcucacaauucccgauuuuaucuucgcgaaugucagcgaggccgacgauagauacaucugcgaccgguuuuauccuaacgaucuguggguugugguguuccaguuucagcauauuauggucggacuuauccugccgggcauugugauccucucuuguuacugcauuaucaucuccaaacugagccacucuaagggccaucaaaaacgcaaggcucuuaaaaccacgguuauucugauccucgccuucuucgcuuguuggcugcccuauuacauugggaucuccauugacagcuuuauccugcucgagaucauuaagcagggaugcgaguucgaaaauaccgugcacaaguggaucucuauuacagaagcccuggcguuuuuccacuguugccuuaacccuauccuguaugccuuucucggcgcuaaauucaagaccuccgcccagcaugcucugacaagcgucuccagagggucuagccuuaaaauucuguccaagggaaaacggggcgggcacagcucuguguccaccgagagcgagucuagcuccuuucauucuagcuga

SEQ ID NO: 68058 - RNA, 1119 nt, Artificial Sequence
  derived and/or modified sequence opt5 from CXCR5__Homo_sapiens__NP_001707
augaacuacccccugacccucgagauggaccuggaaaaucuugaggaucuguucugggaacucgacagacuggauaacuauaaugacacaagccuuguggagaaccaccugugcccugccacggaaggcccgcucauggcuuccuuuaaggccgucuucguucccguggcguacucucugaucuuucugcucggggugauuggaaauguccuggugcuuguuauccuggagcggcaucgccagaccagaagcuccacagagaccuuccucuuucaccuggcuguggccgaucuucugcucgucuucauucugccuuuugccguggcugaaggcucuguugggugggugcugggaacauuccucuguaaaaccgucaucgcccugcauaaggugaacuuuuauugcagcucccuucugcucgcuuguauugccguggaccgguaccuggcgaucguccacgccguucaugcuuaucgccacagacggcuucugucuauccacauuacaugcggcaccaucuggcucgugggguuccugcuggcccuccccgagauucuguuugcuaaagugagccaaggacaucacaauaacucccuuccucgcuguacguucagccaggaaaaucaggccgagacccaugcgugguuuacaucuagauuccuguaccacgucgccggcuuccuccugcccaugcuugugaugggcuggugcuauguuggggugguccaccggcugcgccaggcucaaagacggccucagcgccagaaggccgugagaguugcuauccucgugaccuccaucuuuuuccuguguuggagcccguaccauauugucauuuuucuggauacacucgcccggcugaaagccguggacaauaccugcaaacuuaacggaucucugcccgucgcuaucacgaugugugaguuccucggccuggcgcacugcugucugaacccuaugcuuuacacauuugccggggugaaguuccgcuccgaucucagcagacugcugaccaagcucggaugcacaggccccgcuucucugugccagcuuuuuccuuccuggcggagaagcucccugucugaaagcgagaaugccaccucccucaccacauucuga

SEQ ID NO: 68059 - RNA, 1029 nt, Artificial Sequence
  derived and/or modified sequence opt5 from CXCR6__Homo_sapiens__NP_006555
auggccgagcacgacuaccaugaagauuauggcuucagcuccuuuaacgacucuagccaggaggaacaccaagauuuccugcaguuuuccaagguguuccuccccugcauguaccuggucguuuuugugugugggcuugugggaaauucucugguccucgugaucagcauuuucuaucauaaacugcagucccuuaccgacguuuuucuggugaaccucccucuggcugaucuggucuucgugugcacacucccguuuugggccuacgcgggcauccacgaguggguuuucggacaggugauguguaagucucugcuugggauuuauacgaucaauuuuuacaccagcaugcugauucucacaugcaucaccgucgacagauucaucgugguggucaaagcuacaaaggccuauaaccaacaggccaaacggaugaccuggggcaagguuacaucccugcuuauuugggugaucagccugcucgugucucugccccagauuaucuacgggaaugucuuuaaccuggauaagcucauuuguggauaccaugacgaagcuaucuccaccgugguucuggccacgcagaugacccuuggcuucuuccugccucuccugacaaugauugugugcuauagcgucaucaucaaaacccuucugcacgcuggcggguuucaaaagcaccgcucucucaaaauuaucuuccuggugauggccguuuuucugcucacacagaugcccuucaaucugaugaaguuuauuagauccacccauugggaguacuaugcgaugacgagcuuccacuacacaaucauggugaccgaggccauugcuuaucuucgggccugucugaacccuguccucuacgcuuuugugucucugaaauuccgcaagaauuuuuggaaacuugucaaggauaucggaugccugcccuaucucggcgugucccaucaguggaaaagcuccgaagacaacucuaagacauucagcgccucccacaauguugaggcgaccagcauguuucagcuguga

SEQ ID NO: 68060 - RNA, 549 nt, Artificial Sequence
  derived and/or modified sequence opt5 from CXorf36__Homo_sapiens__NP_078965
auggagccccagcugggcccugaagccgcugcccucagaccgggguggcuggcgcuucugcucugggugagcgcucuguccugcucuuucagccuucccgccuccucucugagcucccucgucccucaaguucggaccucuuacaacuuuggacgcacauuccugggccuggacaaguguaaugccugcaucgggacgagcauuuguaaaaaguuuuucaaagaggaaaucagauccgauaacuggcucgcuagccaccugggacuucccccugacucucugcucuccuaucccgccaauuacagcgaugacucuaagauuuggcggccuguggagaucuuucgccugguguccaaauaucagaacgaaauuagcgauagacggaucugcgcuucugccuccgcgccgaagaccuguagcaucgagcgcguccuuagaaagacagagcgguuccagaaauggcugcaggccaagcgccucacccccgaccuggugcaagauugccaucagggccagagagaacugaaauuucucuguaugcugcgguga

SEQ ID NO: 68061 - RNA, 1086 nt, Artificial Sequence
  derived and/or modified sequence opt5 from CXorf66__Homo_sapiens__NP_001013421
augaaccuggugaucugcguccuccugcuuagcauuuggaagaauaacuguaugaccacaaaucagacgaacggcuccucuaccacaggggacaaacccguugagagcaugcaaaccaagcugaauuaccucagacggaaccugcuuauccuggugggaauuaucauuaugguguucgucuuuaucugcuucuguuaucuccacuacaauugccuguccgaugacgccucuaaagcuggcauggugaagaaaaaggggaucgccgcuaagagcuccaaaacaucuuuuagcgaagcuaagaccgccucccaguguagcccugagacacagccgaugcugucuaccgccgauaaauccagcgacucuuccagccccgaacgcgcuucugcccaguccagcacggagaagcucauuagaccuuccucucugcaaaaacccagcaucccuaacuccgcuggaaaacuuacccggcccagcuauccuaagcgcuccucuaagagcucuugcagcaagaaacuguccaagucuagccaucucgaaaaagcccacaagaaaggcucccuggagaaacuuuguaagcuggauuacgcgugcaagcucgccagcucugacaagccgguuagacccccucagcuguucaaaccccuguauuccagccauccucagaaugagauuucucccuccaagccguuugggccucaggaacucgcuaaacccccuaagcacuucaaccccaagcggagcgugucccugggacgcgccgcgcuucugucuaauagcgagcucgccgaaacaugucaacccuacaaaaagaaacaucuggucgcgaagaccuauagaccucuugugaacgauaucuccgaggccaaagagaagaauacacagaaccugcacguuucuagcaaggugaaauccagcucucgguccuuucgcaagcucgacagcagaaauaacgcuuacggcgaucacgucaacgacucugauaccaugaaauacuauuccgaaguggacagcgauaaggugauuaucauuacgugcgaccggggcuacaaucaggucacaucugagguuacccugaacgacuga

SEQ ID NO: 68062 - RNA, 1512 nt, Artificial Sequence
  derived and/or modified sequence opt5 from CXorf67__Homo_sapiens__NP_981952
auggccacccagagcgacauggagaaggaacaaaaacaccagcaggaugagggccaagggggacugaacaaugaaaccgcucucgccuccggcgacgcgugcgggacgggaaaccaggaucccgcugccucugugaccacagucagcucccaggccucuccuagcggcggggcugcccuguccucuagcaccgcuggauccagcgccgcggccgcuacaucugccgcuaucuucauuaccgacgaggccuccggccuuccgaucauugcggccguucugacagaaagacauagcgaucggcaggacugucgcucuccccacgagguguuuggcugcguggucccugaagggggaucccaggcugccgugggcccccaaaaggcuaccgggcaugccgaugagcaccucgcccagacgaaaagcccuggaaauucuagacggcgcaagcagcccuguagaaaccaggcugcgccugcccaaaaaccgcccggccggcgccuguucccugagccccuuccucccuccagcccgggguuuagaccuuccucuuaccccugcagcggagcuuccaccagcucucaggccacacagccuggccccgcccugcucucccaugcuagcgaagcccggcccgcgacccgcucuagaaucacacugguugcuagcgcccugcggcgcagagccuccggcccugggccggugauucggggauguaccgcucaacccggcccugccuucccccaccgcgcuacgcaccucgacccugccagacugucucccgagagcgcgccggggccugcccggagaggacgcgcuuccguccccggcccugcccggagagggugcgauagcgcucccggaccugcccgccggggcagagacucugcgcccguguccgccccgcgcggccgggauagcgcuccugggucugccagacgcggacgggacuccgcucccggccccgcccuuagaguucgcacagcccggagcgaugcugggcauagauccaccucuacaaccccuggaaccggccugcggagccgcuccacacagcagagaucugcgcuccugagccggagaucccuuagcgggucugccgacgagaauccguccuguggcacgggaagcgaacgccuggcuuuucagucucgguccggcagccccgacccugaggugcccucuagagccagcccucccgucuggcacgccgugcgcaugagagcuuccagcccuucucccccggggcgguucuuucucccuaucccccaacagugggaugaauccagcuccucuagcuaugccuccaacucuagcuccccuucucgcagccccggacuguccccgagcucuccuucccccgaguuccugggccucagaagcaucucuaccccuucccccgaaagccugcgguacgcgcuuaugcccgaguuuuaugcucugucuccugugccgcccgaggaacaggccgagauugaauccacagcccauccugcuacacccccugagcccuga

SEQ ID NO: 68063 - RNA, 1983 nt, Artificial Sequence
  derived and/or modified sequence opt5 from CXXC1__Homo_sapiens__NP_001095124
auggagggcgacgggagcgaucccgaaccuccggacgccggagaggauuccaagucugaaaacggcgagaaugcucccaucuacugcauuuguagaaaaccugacaucaacugcuucaugauugggugugauaauugcaacgaaugguuucacggagacuguauccggauuaccgagaagauggccaaagcgauccgcgagugguauugcagagaaugucgggagaaggaucccaaacuggaaauccgcuacagacauaaaaagagccgggagcgcgacggcaaugagagagauuccucugaaccucgggacgaagggggaggccgcaaaagacccgugccugauccggaccuccagcggcgcgcuggcagcgggacaggagucggcgccaugcuggccagaggguccgcuucuccccacaagagcuccccucaaccccuuguugccacgccuagccagcaucaccagcagcaacagcagcagauuaaacggucugcucgcaugugcggagaaugugaggccugcagacggaccgaagauuguggccauugcgacuucugcagagacaugaagaaauuugggggacccaacaagauccgccaaaagugucggcugagacagugccagcuccgcgcgcgggaguccuauaaauacuucccgagcucucuguccccugugacacccagcgagucucuuccuagaccccgccggccccugccuacccagcaacagccgcagcccucccaaaagcucggccgcauuagagaagaugagggcgccguggcuagcuccacagucaaagaaccucccgaggccaccgcuacaccugaaccccugucugacgaggaucugccgcucgacccugaucuguaucaggacuuuugugccggggcguucgaugaccacggacuucccuggaugagcgauaccgaggaauccccuuuucuggaccccgcccuccggaagagagcugugaaaguuaagcacgugaaacgccgggagaaaaagagcgaaaagaaggucauggagagaaaggaggagcgguacaagcgccauagacagaaacagaagcacaaggauaaauggaagcauccugagcgggccgacgcuaaagaccccgccucucugccgcaaugccuuggcccugggugugugagacccgcccagcccuccagcaaguauugcucugaugacuguggaaugaaacuggcugcgaaucgcaucuacgaaauucucccucagcggauccagcaauggcagcagagcccgugcauugccgaggaacacggcaagaagcugcuggagagaauccgcagagagcagcaauccgcucggacgcgccuccaggaaauggagagacgguuccacgaacuggaggccaucauucuucgcgccaaacagcaggcuguuagagaagaugaggagucuaacgaaggggacagcgaugacaccgaucugcaaaucuuuuguguguccugcggacaucccauuaauccucgggucgcccuccgccacauggagagauguuacgcgaaguaugaaagccagacaucuuucggcuccauguaccccacccggaucgagggcgcuacacgccuguuuugcgacguguauaacccucagagcaaaaccuacugcaagagacuucaagugcugugucccgaacauucucgggauccuaaaguccccgccgacgagguuugcggguguccgcucgugagagauguguucgagcugacgggagacuuuugccgccugccuaagcggcaguguaauagacacuauugcugggaaaagcuccgccgggccgaggucgaucuggaaagagugcgcguuugguacaaacuugacgagcuguucgaacaggagcggaacgugagaacagcuaugaccaaucgcgccggccuccuggcucuuaugcugcaucagacaauucaacacgacccccucaccaccgaucugcgguccagcgccgacagauga

SEQ ID NO: 68064 - RNA, 1104 nt, Artificial Sequence
  derived and/or modified sequence opt5 from CXXC4__Homo_sapiens__NP_079488
augaacaccaaugugugcgucgagcccggcccuagcccggaagcccccgggcugccuaaggagucccaccuccccgaaggagcucugaacucucuuguugacuacaauagcgagauggaaagauaucgguccuucgccacaucuuuuuacaaaacgaacggcggggcguucccucaggcugccaagaucgcccgcauuaccacacccaucuuuccuagcuccgcugccgcugccgcggccgcugccagaauuggaaugucuccguggaauugugauaacgcugccaccgcggccgcugccacagcuaugcuguggggcagcgggggaggcggcgggggaggcgggggaggcgggggaggcggcgggggaggcgggggaggcgggggaggcggcgggggaggccggaaauccagcucugccgccgcuuccagcucugcguccagcagcuccgccauccuccccgcugggggaggcgggggcggaggcgggggaggcagccgcaccuccaugcaucacagaaaugacucucaacggcuggggaaggccggaugcccucccgagccuagccuucagauggccaacacaaauuuccuguccacccucagccccgagcauugucgcccgcuggcuggcgaaugcaugaacaaacugaaguguggggccgcggaggcugaaauuaugaaucucccugagagagugggcacguuuucugccauccccgcccugggaggcaucucccuuccucccggggugauugucaugaccgcucugcacagccccgccgcugccucugcggccgugacagauagcgcuuuccagaucgccaaccucgcugacugcccucagaaucauuccucuagcuccucuucuuccagcggaggcgccgggggagcgaacccggccaagaaaaagcggaaacgcuguggcguuugcgugcccuguaagagacugauuaauugcggggucuguucuuccugccggaaccgcaaaaccggccaccaaaucugcaaguuuagaaagugugaggaacuuaaaaagaaaccuggaacaagccuggagcggacccccgugccuuccgcugaagccuuccgcugguuuuucuga

SEQ ID NO: 68065 - RNA, 669 nt, Artificial Sequence
  derived and/or modified sequence opt5 from CYB561D2__Homo_sapiens__NP_001278213
auggcccugagcgcugagaccgaaucccacaucuacagagcccuccggacagcgucuggcgcugccgcccaucugguggcucuuggguucacgauuuuugucgccguucuggcucgccccggaagcucccucuucucuuggcacccugugcugaugagccuugccuuuuccuuccugaugaccgaggcgcuccugguguuuucuccggaaagcucccugcuccauagccugucuagaaagggccgggcccgcugccacuggguccuucagcugcucgcucugcuuugugcccugcucgggcugggacuggugauccuccauaaagagcaacugggcaaggcucaccuuguuacaagacacgggcaggccggacugcucgcggugcugugggccggccuucagugcuccggcggggucggacugcucuaucccaaacugcugccucgguggccccucgcuaagcugaaacuuuaccaugccaccagcggccuggugggguaucuccugggaucugcuucccuucugcucggcauguguagccugugguucacagccucuguuaccggggccgcuugguaccuggcggugcucugcccuguccugacaucccuugugauuaugaaccaggugagcaaugccuaucuguaccgcaagagaauccaacccuga

SEQ ID NO: 68066 - RNA, 756 nt, Artificial Sequence
  derived and/or modified sequence opt5 from CYB561__Homo_sapiens__XP_005257148
auggagggcggggccgcugccgcgacccccacagcucugccuuacuauguggccuucagccagcuccugggacuuacgcuggucgccaugaccggcgcuuggcucgggcuguacagaggaggcaucgccugggaauccgaccuucaauuuaacgcucacccgcugugcaugguuauugggcucaucuuccugcagggaaaugcccugcucguguaucggguguuucgcaacgaggcgaagagaacaaccaaaguccugcauggccuucugcacauuuucgcccucgugaucgcucugguuggccuuguggccgucuuugauuaccaucggaagaaaggguaugcugaccuguacucucuccacagcugguguggcauucugguguucguucuguauuuugugcaguggcucgucggauucuccuuuuuccuguuucccggggccucuuucagccuucgcuccagauaccggccucagcauaucuuuuucggagcgacaaucuuccugcucucugugggcaccgcccugcuugggcugaaggaagcucuccuguuuaaucugggaggcaaauacagcgccuucgagcccgaaggcgugcucgcuaacguccuggggcuucugcucgccugcuuuggaggcgccguucuguauauucuuacacgcgcugauuggaagagaccuucccaagcggaggagcaggcccugagcauggacuucaagacccucacggaaggggauucucccggaucccaguga

SEQ ID NO: 68067 - RNA, 375 nt, Artificial Sequence
  derived and/or modified sequence opt5 from CYB5A__Homo_sapiens__NP_001177736
auggccgagcagagcgacgaagcugugaaguacuauacccuggaggaaauccaaaaacacaaccauuccaagucuacauggcucauucugcaccauaaagucuacgaucuuacgaaguuccuggaggaacaccccggcggggaggagguucucagagaacaggccggaggcgacgcgaccgagaauuuugaagauguggggcauagcacagacgcucgggagauguccaaaaccuucaucauuggagagcugcacccugaaacacuuaucaccacaauugauucuagcuccucuugguggaccaacugggugaucccggccaucagcgccgucgcuguggcccugauguaucgccucuacauggcugaggacuga

SEQ ID NO: 68068 - RNA, 453 nt, Artificial Sequence
  derived and/or modified sequence opt5 from CYB5B__Homo_sapiens__NP_085056
augagcggcuccauggccaccgcugaggccucugggagcgacggaaagggccaggaaguggagacauccgucacguacuauagacuggaagagguugcgaaacggaacucucucaaggaacuguggcuugugauccacgggcgcguguacgaugucaccagauuccugaaugagcaucccggaggcgaggaagugcuccuggagcaagcugggguugacgccagcgaauccuuugaggaugugggacacucuagcgacgcccgggagaugcuuaaacaguauuacauuggcgauauccauccuuccgaccugaagccggaaagcggcucuaaagaucccuccaagaacgacacaugcaagagcuguugggcuuauuggauucucccuaucauuggggccguccugcugggauuccucuaccgcuauuacaccucugaguccaaaagcucuuga

SEQ ID NO: 68069 - RNA, 906 nt, Artificial Sequence
  derived and/or modified sequence opt5 from CYB5R3__Homo_sapiens__NP_000389
augggcgcccagcugagcacccucgggcacauggugcuguuccccgucugguuucuuuacucccugcucaugaagcuguuccaaagaucuacacccgcuaucacgcuugagagcccggacauuaaauauccccugcggcucaucgaucgcgaaauuaucucccaugacaccagacgguuucgcuucgcccugccuucuccccagcacauucugggacucccuguuggccagcauaucuaccugagcgcgagaaucgaugggaaccuuguggugcggcccuauacaccuauuuccucugacgaugacaagggauuugucgaucuggugaucaaaguuuacuucaaggacacccacccgaaauuucccgcuggcgggaagaugagccaguaucucgaguccaugcaaauuggagauacaaucgaguuccgcggcccuagcggccugcuuguguaccaggggaagggaaaauuugccauuagacccgacaagaaaucuaauccuaucauucggaccgucaaguccgugggcaugaucgccgggggaacaggcaucacccccaugcugcagguuauucgcgcuaucaugaaagauccggacgaucauacggugugccaccuccuguucgccaaccagaccgaaaaggacauucugcucagaccugaacuggaggagcuucggaauaagcacagcgcucgcuuuaaacugugguauacacucgacagagcccccgaagcgugggauuacgggcaaggauucgucaacgaggaaaugauccgggaccaucugccuccucccgaggaggaaccucuugugcugauguguggcccgcccccuaugauucaguacgccugccuccccaaucuggaucacgugggccauccuaccgagcgcuguuuugucuucuga

SEQ ID NO: 68070 - RNA, 1566 nt, Artificial Sequence
  derived and/or modified sequence opt5 from CYB5R4__Homo_sapiens__NP_057314
augcugaacgugcccagccaguccuucccugccccgagaucucaacagcgggucgcuagcggcgggcgcuccaagguuccccucaaacagggaagaucucugauggacuggauccggcuuaccaagagcggcaaagaucugacagggcucaagggacgccugauugaggugacggaagaggaacuuaaaaagcacaauaagaaagacgauugcuggaucuguauuagaggcuuuguguacaacgucuccccuuauauggaguaccaucccgggggagaagacgagcugaugcgggccgcgggcucugauggcaccgaacucuucgaccaggugcaccgcuggguuaauuaugaaagcaugcugaaggagugccugguggggagaauggcuaucaaaccugccguccucaaggauuaccgggaagaggagaaaaaggugcugaacggaaugcuucccaagucccaaguuacagacacccuggccaaagaaggcccuagcuauccgucuuacgauugguuucagacagacucccucgugaccauugcuaucuauacaaagcagaaagauaucaaucuggacagcauuaucgucgaucaucagaacgacucuuuccgcgccgagaccauuaucaaggacugucuuuaccugauucacaucgggcucucccaugaagugcaagaggauuuuagcgugagagucguugaaucugugggaaaaauugagaucgugcugcagaagaaagagaauacguccugggacuuccugggccacccccucaagaaccacaauagccugaucccucggaaggauaccgggcuuuacuaucgcaaaugccagcugauuuccaaggaagacgucacacaugauaccagacucuuuugucugaugcuucccccuucuacacaccuccaggugcccaucggacaacauguuuaccugaaacugccgauuaccggcacggagaucgugaagccuuauacacccgucagcggcucccugcucagcgaguucaaagagccugugcugcccaacaauaaguacauuuauuuucuuaucaagaucuaccccaccgggcuguucacaccugaacucgaccggcugcagauuggagauuuuguuucuguguccagcccggagggcaacuucaaaaucucuaaguuucaggagcuugaagaccuguuccuccuggcugccgggaccggauucacccccauggucaaaauucugaauuaugcgcucacagauaucccuagccugcgcaaggugaaacuuauguuuuucaacaagacggaggacgauauuaucuggagaucccaacuggaaaagcucgccuuuaaagacaagcggcuggacgucgaguucgugcugucugcucccaucagcgaauggaauggcaaacaggggcacauuuccccugcccuucucagcgaguuucugaagagaaaccuggauaaaucuaagguucucgugugcaucuguggacccgucccguucaccgagcagggcgugcgccugcuucacgaccugaacuuuuccaagaaugaaauucauagcuucacagcuuga

SEQ ID NO: 68071 - RNA, 588 nt, Artificial Sequence
  derived and/or modified sequence opt5 from CYBA__Homo_sapiens__NP_000092
augggccagaucgagugggccaugugggcuaacgaacaagcccuggcgagcgggcucauucugaucaccggaggcauuguggcuacagccgggagauucacgcagugguacuuuggagccuauuccaucgucgcuggcguuuucgugugccuucuggaguacccccgggggaagcgcaaaaagggaucuaccauggaaagauggggccagaaauauaugacagccguggucaagcucuuuggcccuuucacccggaauuacuaugugcgcgcuguucugcaccuucugcucagcgugccggccggguuucugcuggcgacaauucucggaaccgccugucuggcuaucgccuccggcaucuaccuucuggcugccgucagaggggagcaguggacacccauugaaccuaaaccccgggagcgcccucaaaucggaggcaccauuaagcagcccccuucuaacccgcccccuagacccccugcggaggcccggaagaaacccagcgaagaggaagcugccguggcugccgggggaccgccuggcggcccccagguuaauccuauccccgugacggacgaggucguguga

SEQ ID NO: 68072 - RNA, 1713 nt, Artificial Sequence
  derived and/or modified sequence opt5 from CYBB__Homo_sapiens__NP_000388
augggcaacugggccgugaaugaggggcugagcaucuucgucauucucguuuggcugggacuuaacguguuucuguucgugugguacuauagagucuacgacauucccccuaaguuuuucuauacccggaaacuccugggcuccgcucuugcccuggcgcgcgcuccggccgccugccucaauuuuaacuguaugcugauucugcuccccgugugcagaaaucugcuuucuuuccugcgggggagcuccgcuuguugcucuacacgcguuagacggcagcucgaucgcaaccugacguuucacaagaugguggccuggaugaucgcccuucauagcgcuauucacaccaucgcgcaucuguucaaugucgaauggugugugaacgccagaguuaauaacuccgacccuuacucuguggcucucagcgagcugggagaucggcaaaaugaauccuaucugaacuuugcccgcaaaagaaucaagaaucccgagggcgggcucuaccuggcugucacacuucuggccggaauuaccggcguggugaucacacucugccugauucuuaucauuaccagcucuacaaaaaccauccggcgcuccuauuucgaagucuuuugguacacgcaccaucuguucguuaucuuuuucaucggccucgcgauccacggggccgagagaauugugcggggacagaccgcugagagccuggccgugcacaacaucacagucugugaacagaagauuucugaguggggcaagaucaaagaaugcccuauuccccaguucgcugggaauccuccgaugaccuggaaguggaucgugggacccauguuucuguaccucugugagcgccugguuagauucuggcggucccaacagaaaguggucaucacaaaggugguuacccauccuuuuaaaacgauugagcuucagaugaagaagaaaggcuucaagauggaaguggggcaguauaucuuugucaaaugccccaaggugagcaaacuggaguggcacccuuucacacucaccucugcccccgaagaggacuuuuucuccauucauaucagaauugucggagauuggacagaaggccuguuuaacgccuguggcugcgacaagcaagaguuccaggaugcuuggaaacuuccgaagaucgcgguggacgggccuuuuggaaccgccagcgaggauguuuucuccuacgaaguggucaugcuggugggcgcugggaucggaguuacccccuuugccucuauucucaagagcgugugguauaaauacugcaacaaugccacaaaccugaagcugaaaaagaucuauuucuacuggcucugucgcgacacgcacgcuuucgagugguuugccgaucugcuucagcugcucgaaucccagaugcaagagcggaauaacgcgggcuuccugagcuauaauauuuaccugaccgggugggacgaaucucaggcuaaccacuuugccguccaucacgaugaggagaaagacgugaucacaggacuuaagcagaagacccucuacggcagaccuaauugggacaacgaguucaaaacaauugccucccaacaucccaauacccgcaucggcguguuucugugcgggcccgaagcucuggccgaaacgcucagcaagcagucuauuagcaacuccgagucuggaccucggggcguucacuucaucuuuaauaaagaaaacuucuga

SEQ ID NO: 68073 - RNA, 474 nt, Artificial Sequence
  derived and/or modified sequence opt5 from CYBRD1__Homo_sapiens__NP_001120855
auggccauggagggcuacuggagauuccuggcucuccuggggagcgcccuucuggugggauuucucuccgucaucuucgcgcugguuugggugcuucacuaucgggaaggccuggggugggacggaucugcucucgaguuuaacuggcaucccgugcugauggucaccggcuucguguuuauucaggggaucgccagcuuccgcuuuuucucccugucugccagcaugggauccgcuuuuucuccuagcauuucccacgcccauacaugccucuucuggaauugucaccuguggaacagcgauugcaauucuacguacggcaucgacagagaaaccgacuuuuucccggagcgguccuguauucaauauauccccgcucgcagaugcuuucggaaguacgccuggccuagcgaucccggcguucgcgggccucauuuccuugauucucaccagacagcgauggaaaccuccuga

SEQ ID NO: 68074 - RNA, 978 nt, Artificial Sequence
  derived and/or modified sequence opt5 from CYC1__Homo_sapiens__NP_001907
auggccgcugccgcggcuagccugagaggcgugguccucgggccccggggagccggccugccuggggcccgcgcuagaggacuucugugcuccgcccggccgggccagcucccccugcgcaccccucaagcuguugcccuuucuagcaaguccgggcugucuagaggacggaaagugaugcucagcgcgcugggcaugcuggccgcuggcggggccggacucgcuguggcccugcacuccgcggucucugccagcgaccuugagcugcaucccccuuccuaccccuggagccaccgcggccuccugucuucccuugaucauacaagcaucagacggggguuccagguguauaagcagguuugugcuucuugccacuccauggacuuuguggccuaccgccaucuggucggaguguguuauacggaagaugaggcuaaagaacucgccgccgagguugaagugcaggacggcccuaacgaggauggggagauguucaugagaccgggaaagcuguuugacuacuuccccaaaccuuaucccaauagcgaagcugcgcgggccgcuaacaauggcgcccugccucccgaucucucuuacauuguccgcgccagacacggcggggaggacuauguguuuucccugcuuaccggauacugcgaaccgccuacaggcgugagccugcgggaggggcucuacuucaaccccuauuuuccuggacaagcuaucgccauggcgccucccauuuacaccgauguccuggaguucgacgauggcacacccgcuaccaugucccagaucgccaaggacguuuguacauuucuucgcugggccucugaaccggagcacgaucauagaaagcggauggggcugaaaaugcucaugaugauggcucugcuggugccccucguguauaccauuaagagacacaaauggagcguccugaagucccgcaaacuugccuaccggccucccaaguga

SEQ ID NO: 68075 - RNA, 318 nt, Artificial Sequence
  derived and/or modified sequence opt5 from CYCS__Homo_sapiens__NP_061820
augggcgacguggagaaggggaaaaagaucuucauuaugaaaugcagccagugucacaccgucgaaaagggaggcaaacauaagacagggcccaaccugcacggacucuuuggcagaaagacggggcaagccccuggauacuccuauaccgcugccaauaaaaacaagggcaucauuuggggcgaggauacacugauggaauaccuugagaauccgaaaaaguauauccccgggaccaaaaugauuuucguuggaaucaagaagaaagaggaacgggcggaccugaucgcuuaccucaagaaagccacaaacgaguga

SEQ ID NO: 68076 - RNA, 3762 nt, Artificial Sequence
  derived and/or modified sequence opt5 from CYFIP1__Homo_sapiens__NP_001274739
auggccgcucaggugacccuggaggacgcccucagcaacgucgaucugcuugaagaacugccccucccugaccaacagccgugcaucgaacccccucccuccucucugcuuuaccagccuaauuucaacacaaauuuugaggauagaaacgcguucguuacgggcauugcucgguauaucgaacaggccaccgugcacagcuccaugaaugagaugcuggaggaagggcaagaguacgccgugaugcucuauacauggcgcucuuguagcagagcuauuccccaggucaagugcaacgaacagccuaaucggguggagaucuacgagaaaaccguugaagugcuggagccggaagucacaaagcugaugaacuuuauguauuuccagcgcaaugccauugagagauuuuguggagaagugcggcgccucugccaugcugagagacggaaagacuucguuuccgaggccuaccugaucacccuuggcaaguuuaucaacauguucgcggugcuggaugaacucaaaaauaugaaguguucugucaagaacgaccacagcgccuauaaacgcgcugcccaauuucugagaaagauggcugauccccaguccauucaggagagccagaaucuuucuauguuccuggccaaccauaauaaaaucacacaaucccuccagcagcaacuggaagugauuagcggguacgaggaacugcucgcggacaucgugaaccugugcgucgauuacuaugagaaccggauguaccuuaccccuucugagaagcacaugcugcucaaaguuaugggauuuggccuguaucuuauggacggguccgugagcaauauuuacaagcuggaugccaagaaacgcaucaaccucucuaagauugacaaauauuucaagcagcuccagguggucccccuguuuggagauaugcagaucgaacuggcuagauacaucaaaacguccgcccauuaugaggaaaauaagagccgguggaccuguacauccucuggcagcuccccucaauacaacauuugcgagcagaugauccagauucgcgaagaccacaugagauucaucagcgagcuggcucgguacucuaauuccgaggugguuaccggcagcgggagacaggaagcccaaaagacagacgccgaguaucgcaaacuuuucgaucuggcucuccagggacugcagcuucugucucaguggagcgcgcacgugauggaagucuacuccuggaagcucgugcaucccaccgacaaauauucuaacaaggauuguccggacagcgccgaggaguacgaacgggcuacgagauauaauuacacauccgaggaaaaauuugcccugguugaggugauugccaugaucaagggccugcaaguccucauggggcgcauggaaagcguguucaaccacgcuauccggcauaccgucuaugccgcgcugcaggauuuuucucaggugacacuuagagagccucugcgccaggcuauuaaaaagaagaaaaauguuauccaauccgugcuccaggccauucggaagaccgucugcgacugggagaccggacacgaacccuucaacgauccugcccugagaggcgagaaagaccccaagagcggguuugauaucaaagugccccgccgggcuguuggaccuucuuccacacagcuguacauggugagaacgaugcuugaaagccucauugccgacaaguccggcucuaagaaaacccugcgcagcucccuggagggcccgacaauccucgauaucgaaaaguuccaccgggagucuuucuucuacacccaucugauuaauuuuagcgagacacuucaacaguguugcgaccugucccagcucugguucagagaauuuuuccuggagcugaccauggggcggcgcauccaguuucccauugaaaugagcaugccuuggauccuuacggaccacauucucgagacaaaagaggcuucuaugauggaguauguccuguacucccuggaucucuauaacgacagcgcccauuacgcgcugaccagauucaauaagcaauuccuuuaugaugagaucgaagccgaggugaaccugugcuuugaccaguucguguacaaacucgcugaucagauuuuugccuauuacaagguuauggcuggaucucugcugcuugacaagcggcucagauccgaauguaaaaaucagggcgccaccauccaucugcccccuagcaaccgcuacgagacacugcucaagcaacggcacguccagcugcuugggagaucuaucgaucugaaccgccucauuacccagagagugagcgcggccauguauaaaucccuggagcuggcuaucggacgguucgaaagcgaggaccuuacaucuauuguggaacucgauggccugcuggagaucaaucgcaugacgcacaagcuccuguccagauaccuuacccuggacggguuugaugccauguuccgggaagcuaaccacaaugucagcgcccccuauggacgcauuacacuccauguguuuugggagcugaacuacgacuuccugccgaauuauugcuacaacggcuccaccaauagauuuguucggacagugcuuccuuucucucaggaguuucaacgcgauaaacagcccaacgcccagccucaauaucugcacggcagcaaggcucucaaucuggcguacuccucuaucuacgggagcuauagaaacuucgucggacccccucauuuucaggugaucugucggcuccugggcuaccaggggauugccguugugauggaagaacuucugaaagucgugaagucccuccugcagggaaccauccugcaauauguuaagacgcuuauggaagugaugcccaaaauuugccgccugccgagacacgaguacggcucuccugggauccucgaauuuuuccaccaucagcugaaggacauugucgaguaugcugagcucaaaaccguguguuuucagaaucugcgggaagugggcaacgccauccuuuucugccugcucaucgagcagagccugucccuggaagaggucugugaccuucugcacgccgcucccuuucaaaauauucuccccagaguucaugugaaggaaggagagcgccuggaugccaaaaugaagcggcucgagagcaaguacgcgccucugcaccuugugccgcugaucgaaagacugggcacaccccagcagauugcuaucgcccgcgagggggaccuccugaccaaagaacggcuuugcuguggacugucuauguucgaggucauucucacaagaauccgcuccuuucuggaugacccuaucuggcggggcccccucccuagcaacggggugaugcauguugaugagugcguggaguuccacagacuguggucugccaugcaguuugucuauuguauucccgugggaacccacgaguucacgguugaacaaugcuuuggcgacgggcuucauugggcuggcugcaugaucauugugcugcugggacagcagcgccgguucgccguccucgauuuuuguuaccaucugcuuaaggugcagaaacacgacggcaaggaugagaucauuaaaaauguuccucugaagaagaugguggaaagaauccggaaauuccaaauucucaacgacgagaucaucacaauucuggauaaguaccucaaauccggggacggagagggcacccccgucgaacacgugcgcugcuuccagccgccuauccaucagagccuggcgucuuccuga

SEQ ID NO: 68077 - RNA, 3684 nt, Artificial Sequence
  derived and/or modified sequence opt5 from CYFIP2__Homo_sapiens__NP_001278650
augaccacacacgugacgcuggaggacgcccucagcaacgucgaucugcuugaggaacugccccucccugaccagcaaccgugcaucgaacccccucccuccucuauuauguaccaggcuaauuucgauaccaacuuugaggacagaaaugccuucguuacaggcaucgcgcgguauauugaacaggcuaccgugcauagcuccauggugaaguguaacgagcagccuaaucgcgucgagaucuacgaaaagacaguggagguucuggaacccgaggugaccaagcugaugaaauuuauguauuuccaaagaaaggccauugagcgguuuugcucugaagucaaacgccugugucacgccgagagacggaaggauuucgugagcgaggcuuaccuccugacacuggggaaguuuaucaacauguucgccguucucgacgaacugaaaaauaugaagugcuccgugaaaaacgaucauucugcuuauaagcgcgccgcgcaguuucuuagaaaaauggccgacccucagagcauccaggaaucccaaaaucugagcauguuccucgcuaaccacaaucggauuacccagugucugcaucagcagcuugaggucaucccgggauacgaggaacugcucgccgauauugugaacaucugcguggacuauuacgagaauaagauguaccugacgcccucugaaaagcacaugcugcucaaagucaugggcuuugggcuguaucuuauggauggaaacguuuccaauauuuacaagcuggacgcuaaaaagcgcaucaaccucagcaaaauugauaaguucuuuaaacaacuucagguggugccucuuuucggcgacaugcagaucgagcuggccagauauaucaagaccucugcgcacuacgaagagaacaaguccaaauggacauguacccaaagcucuauuucuccccaguauaauaucugcgagcagaugguccagauucgggacgaucauauccgcuucauuagcgaacucgccagauacuccaacucugaggugguuacagggagcggacuggacucccaaaagagcgaugaagaguaucgggaacuguuugaccucgcucugcgcggccuucagcugcucucuaaaugguccgcccacgugauggaggucuacagcuggaagcuggugcauccuaccgauaaauucuguaauaaggacugccccggcacggcugaggaauacgagagagccacacgguauaacuacaccucugaagagaaguuugccuucguugaggugaucgcuaugaucaaagggcuucagguccugaugggaagaauggaaagcguguuuaaucaggcgauucgcaacacaaucuaugccgcucuccaagauuucgcccaggucacccugcgggagccgcugagacaggccgugcgcaagaaaaagaauguucucauuuccgugcugcaggcuauccggaaaaccauuugugacugggaaggcgggagagagccucccaacgauccuugccuucgcggagaaaaggaccccaagggcggguuugauaucaaagucccccggagagccgugggaccuucuagcacacaacuguacaugguucgcacgaugcucgagucccugaucgcggacaagagcggcucuaaaaagacccugcgguccagccuugacggcccgauugugcucgcuaucgaggauuuccacaaacaguccuuuuucuuuacacaucugcugaauauuuccgaagcccuccagcagugcugugaccugagccaacuuugguucagagaguuuuuccuggaacucaccauggggcgccggauccaguuccccauugagauguccaugccuuggauccugacagaucacauucuggaaaccaaggagcccucuaugauggaguauguccuuuacccucucgaccuguauaacgauagcgccuacuacgcucugacgaaguuuaaaaagcaguuccucuaugacgaaaucgaggccgaagugaaucugugcuuugaucaauucguguacaaacuugcugaccagaucuuugccuauuacaaggcgauggccggauccguucugcucgauaaaagauuccgggcugaguguaagaacuauggcgucauuauccccuacccgccuucuaaucgcuaugaaacacugcugaaacagagacacgugcagcuucucgggcggagcauugaccugaacagacugaucacccaacgcauuuccgccgcuauguacaagagccucgaucaggccaucucucgguuugaguccgaggaccugaccagcaucguggaacuugaguggcugcucgaaauuaauagacugacacaucgccugcuuugcaagcacaugacccucgauucuuucgacgcgauguuuagagaggccaaccauaacgucuccgcucccuacggacggaucacacugcacguguucugggagcugaauuuugacuuccucccuaacuauuguuacaauggcagcacgaaccgcuuuguuagaaccgccauucccuucacacaggaaccucagcgggauaaacccgcuaaugugcaaccguauuaccuguaugggucuaagccucuuaacaucgccuacagccacauuuauuccagcuaccgcaauuucgucggaccuccccauuuuaaaaccaucugcagacugcucggcuaccagggcaucgccgugguuauggaggaacugcugaagauugugaaaucucuucugcaggggacaauccuccaguaugucaagacccugauugaggugaugcccaagaucugucggcucccgcgccacgaauacggaucccccggcauucuggaguucuuucaucaccaacuuaaagacaucaucgaguaugcugaacugaagacggauguuuuccagagccucagagagguggggaacgcgauucuguuuugccugcuuaucgaacaggcccugucccaagaggaagucugugaccuccugcacgcugccccuuuccagaauauucucccccggguguacaucaaagagggagagcgccuggaagugagaaugaagcggcuugaggccaaauaugcuccucugcaucucgucccccugauugaaagacugggcaccccucagcagaucgccauugcgcgcgagggggaucuucugacaaaggaacggcucugcuguggccugucuauguuugagguuauccucaccagaauccgcagcuaccugcaagaccccauuuggcggggaccgccucccacaaacggcgugaugcacguggaugagugcgucgaauuucauagacuuugguccgcuaugcaguucguguauugcaucccuguugggaccaaugaguucacggccgaacaguguuuuggagacggccugaacugggccgggugcucuauuaucgugcugcucggacagcaacgccgguucgaucuguucgacuuuuguuaccaccuucugaagguccagagacaggauggcaaagacgagauuaucaagaaugugccccucaaaaagauggcugaucgcauccggaaauaccagauucugaacaaugagguuuucgccauccucaacaaguauaugaaaagcguggaaacagacuccucuaccgucgagcaugugagaugcuuucaaccgccuauucaccagagccuggcgacaaccuguuga

SEQ ID NO: 68078 - RNA, 573 nt, Artificial Sequence
  derived and/or modified sequence opt5 from CYGB__Homo_sapiens__NP_599030
auggagaaggugcccggcgaaauggagaucgaaagacgggagcgcagcgaagaacuguccgaggccgaaagaaaagcuguccaggccaugugggcgcggcucuacgcuaacugcgaggacguugggguggccauucuggugcgcuucuuugucaauuucccuucugccaagcaauauuuuagccaguucaaacacauggaagauccgcuugagauggagagaucuccccagcugcggaagcaugcuugucgcgugaugggagcccucaacaccguuguggaaaaucugcacgacccugauaaagucuccagcgugcuugcucugguuggcaaggcccaugcgcucaagcacaaaguggagcccgucuacuuuaagauccuguccggggugauucuggaaguggucgccgaggaguucgcuucugacuuuccucccgagacacagagagccugggcuaaacuccggggacugaucuauagccauguuacggccgcguacaaggaggugggcugggugcaacaggucccuaacgccaccacaccgcccgcuacccuuccuuccagcgggcccuga

SEQ ID NO: 68079 - RNA, 1956 nt, Artificial Sequence
  derived and/or modified sequence opt5 from CYLC1__Homo_sapiens__NP_066941
augagccugcccagacuccugaaggugaacauccggaccuacgacaauuccauuccuaucucugagagcucccgcaaaucuuggaaccagaagcacuucgcccuuacauuuccgaaaccccugcaaagaggcacgaaugauaagagccggccucucaaaucccagauuaccgucacacgccaugacaagagaaagcuggaagaggggcagaaacccgcucacaaguggauccggcauucuuuccgcaaaauucuucaguggccucccaucuauaccgccgcgagagaacaaacaccuuuucggcaccuguacaccagcaagacacaucucaaaaaggcugaguauaagaaauccaaggaugaaaaaggaggcaccccgcugaagaaagacagcaagaaaaagggagggucuuacgccacgaaccccgaguccaagcagaucguugaggagaaaaccaagcgccagaaugaggccgauaaaacaccucugaaaagcucucacgaaaacgagcaguccaaaaagagcaagucuuccagcgagaccaaucccgaaucccaaaacucuaaaacagugagcaagaauugcucccagaaagacaagaaagauagcaagaacucuaagaaaaccaauacggaguuccuccacacaaagaacaauccuaaaaaggaccugaaaagauccaagaccagcaacgaucccauuucugaaaucuguagcgaaaauucccuuaacguggacuuucugaugcucgucggccagucugaugacgaaagcauuaacuucgaugcuuggcugcggaauuauucccagaacaauagcaagaacuacucucuuaaauauacaaaguacaccaaaaaggacaccaaaaagaaugccaaaaaguccagcgacgcugagucugaggauuccaaggacgccaaaaaggauagcaaaaaggugaaaaagaacguuaagaaagacgauaagaaaaaggacgugaaaaaggauacagaauccacggacgcggagucuggggauagcaaggacgaacgcaaagauaccaagaaagacaagaaaaagcugaagaaagacgauaagaaaaaggacacaaagaaguacccggaguccaccgauacagaaucuggagacgccaaagaugcuagaaaugacagccggaaccucaagaaggccuccaaaaaugaugacaagaaaaaggaugcuaaaaagaucaccuuuagcacggacucugaguccgagcuggaaagcaaggagucucaaaaagaugaaaagaaagacaagaaagauuccaagacagacaacaagaaaagcgucaagaaugacgaggaaucuaccgaugccgacagcgagccuaaaggcgauuccaagaaaggcaagaaggacgagaaaaaggggaaaaaggauagcaaaaaggacgauaagaaaaaggacgcgaaaaagaacgccgaaucuaccgagauggaauccgaucuggagcucaaaaaggacaaaaagcauagcaaggagaaaaagggauccaaaaaggauauuaaaaaggacgcucgcaaggauacagaaucuaccgacgccgaguucgacgaaagcuccaaaacaggcuuuaagacgucuaccaaaaucaaggggagcgauacagaguccgaagagucucuguauaaacccggagcuaagaagaaaauugacgagagcgauggcaccuccgccaauagcaagauggaagggcuugagucuaaaagaggauuccggauguccagcaagaaaacaaccuuuaacgaaaagggcgagaaggccucuacgggcagagugccucccucccgcgaaaaacccccucugccggcuugcgagcccagccucccuucucccaagguucggagacuguguuggugcaaaaugccucccccgccucccaagccucgcuacgcgccccuuccugaggcccccuggauccacaaacugcucuga

SEQ ID NO: 68080 - RNA, 1047 nt, Artificial Sequence
  derived and/or modified sequence opt5 from CYLC2__Homo_sapiens__NP_001331
augagccugcccagauuccagcgggugaacuuuggcccuuacgacaauuauaucccggucuccgagcucucuaagaaaagcuggaaccaacagcacuucgcccugcuuuuucccaagccucagcgccccgggaccaaaagacgguccaagccuucucagauucgcgauaauacaguuagcaucauugacgaggaacaacugagaggagaucggcgccagccccucuggauguacagaucccugaugcggaucucugaacgcccuagcguguaucuugcugccagacggcagccgcugaaacccacgcgcaccguggaggucgacuccaaggcggcugaaauuggcaagaaaggggaggauaagacaacccagaaagacacaaccgauagcgagucugaacucaagcaaggaaagaaggacuccaagaaaggcaaggauaucgagaaagggaaggaagagaaacuggacgccaagaaagauagcaagaagggcaaaaaggacgccgagaaaggaaaggauucugcuacagaauccgaggacgaaaaaggcggggccaagaaggacaacaaaaaggauaaaaaggacagcaauaaaggaaaggauucugcuaccgaguccgaaggcgagaaagggggaacggagaaagacagcaagaaaggcaagaaagauuccaagaaggggaaagacucugccaucgaacugcaggcggugaaggccgaugagaaaaaggacgaagauggcaaaaaggacgcuaacaaaggagaugagagcaaggacgccaagaaagacgcuaaggaaauuaaaaagggcaaaaaggauaagaaaaagccuuccagcaccgacucugauuccaaagacgauguuaagaaagagagcaagaaggacgccacaaaagaugcgaagaaaguggccaagaaagacaccgagaaggaaucugcugauagcaagaaagacgccaagaaaaaugcuaagaaagaugccaagaaagacgccaagaagaacgcuaaaaaggaugagaaaaaggacgcgaaaaagaaggggaaauga

SEQ ID NO: 68081 - RNA, 2862 nt, Artificial Sequence
  derived and/or modified sequence opt5 from CYLD__Homo_sapiens__NP_001035877
augagcuccggccuguggucucaggagaaggugaccagccccuacugggaagagagaaucuucuaucuccugcuucaagaaugcuccgucacagacaaacagacgcagaagcugcucaaaguuccuaaggggucuauuggacaguacauccaagaucggagcgugggccacucccgcauuccgucugccaaagggaagaagaaccagaucggacugaaaauucuugagcagccccaugcugugcuguuugucgacgaaaaggaugugguugagaucaaugagaaauucaccgaacuccugcuggccaucacaaacugugaggaaagauuuagccucuucaagaaucggaaccgccuguccaaaggccuucagauugacguggggugcccugucaaggugcaacugagaagcggagaggagaaguuucccggcguugugcgguuccgcggcccucuccuggcggaaagaaccgucucugggaucuuuuucggaguggagcuucuggaagagggccgggggcagggauuuacagauggcguguaucaggggaaacaacucuuccagugugacgaagauugcggagucuuuguugcucuggacaagcuggagcucauugaggaugacgauaccgcccuggaauccgacuacgccggccccggcgauacaaugcaaguggagcuuccuccgcuggaaaucaauagccgcgugucucucaaagucggggagaccauugaauccggaacggugaucuucugugacguucugcccggcaaggagagccuuggguauuuugugggagucgacauggauaacccuauuggcaauugggacgggagauucgauggagugcagcugugcucuuucgcuuguguugaguccaccauccuccugcacaucaacgacauuauccccgaaagcgugacacaggagcggcgcccucccaaacuggccuuuauguccagaggcgucggcgauaaggggucuagcucccauaauaaaccgaaggcuaccggaagcacaucugacccuggcaaccggaaucgcuccgaacucuucuacacccugaacgggagcucuguggauagccagccccaguccaagucuaaaaauacgugguauauugacgaggucgccgaagauccugccaagagccuuacagagaucuccaccgacuuugauagaagcucuccuccccugcagcccccgcccgugaacucccucacaaccgagaaucgguuccacagccugccuuuuucucuuaccaaaaugcccaacacaaacggauccauuggccauagcccucugucccucucugcgcaaagcguuauggaggaacugaauacggcucccgugcaggaauccccgccucuggccaugcccccugggaacucucacggccucgaggucggaagccuggcugaggugaaggaaaaucccccuuucuacggcguuaucagauggaucgggcagcccccgggacuuaacgaggugcuggccggccucgaacuggaggacgaaugcgcgggguguaccgacggaacauuucgcggcacccgguacuucacaugcgcccugaaaaaggcucuuuuugucaagcucaaauccuguagaccugauagccgcuucgccucucugcagcccguguccaaucaaauugagcggugcaacagccuggcuuuugggggcuaucucucugaggugguugaagagaauacgcccccuaagauggaaaaagagggacuggaaaucaugauuggcaagaaaaaggggauccagggacacuacaacuccugcuaucuugacagcacccuguucugucucuuugccuucucuagcguccuggauacagugcugcuuagaccgaaggagaaaaaugacguggaguacuauuccgaaacccaggagcuccugcgcaccgaaauugucaacccccugcggaucuacggcuaugugugcgccacaaagaucaugaaacucagaaagauucuggagaaaguugaagcugcgagcggguucaccucugaggagaaggauccugaagaguuucuuaauauccuguuccaucacauucuccgcguggaaccccugcugaagauccgguccgccggacagaaaguccaagacuguuacuuuuaccagauuuucauggagaagaacgagaaagugggcguuccuacaauccagcagcuucucgaauggagcuuuauuaauuccaaccugaaguucgcugaggcccccucuugccugaucauccaaaugccuagauuugggaaagauuucaagcucuuuaaaaagauuuuccccagccuggaacuuaauaucacggaccugcucgaggauaccccgcgccagugucggauuugcggcggacuggccauguaugaauguagagagugcuacgacgauccugacaucuccgcuggcaagauuaaacaguuuuguaagacaugcaacacccaagugcaucugcaccccaaacggcuuaaccacaaguauaauccugucucucuccccaaagaucugccggacugggacuggcgccauggguguaucccuugccagaacauggagcuguucgccgugcucugcaucgaaacaagccacuacguugcguuugugaaguauggaaaggaugacuccgcuuggcuguucuucgauucuauggccgacagagauggcgggcagaauggauuuaacauuccccaggucaccccuugucccgaggugggcgaauaccuuaaaaugagccuggaggaccuccauucccuggauagccggagaauccaagggugcgcccgccggcugcuuugugacgcuuauaugugcauguaccagucucccacgaugucccuguacaaguga

SEQ ID NO: 68082 - RNA, 1566 nt, Artificial Sequence
  derived and/or modified sequence opt5 from CYP11A1__Homo_sapiens__NP_000772
augcuggccaagggccugcccccuagaagcgugcuggucaaagggugccagaccuuccuuuccgcuccgcgggagggacugggccgccucagaguucccacaggggaaggagccggcaucucuacgcggagcccucgccccuuuaacgagauuccuucccccggggacaauggauggcugaaccuuuaccacuucuggagagaaaccggcacacauaaggugcaccuccaucacgugcaaaauuuucagaaauauggcccuaucuaccgggagaagcucgggaacgucgaaucuguguauguuauugauccggaggacguggcgcugcuguucaaaagcgagggacccaauccugaacgcuuucucauucccccuugggucgcuuaccaucaguauuaccagagacccauuggcgugcugcuuaagaaguccgccgccuggaaaaaggaucggguugcucugaaccaagaggugauggccccggaagcuaccaaaaauuuccucccucugcuugacgccgucucucgcgauuuugugagcgugcugcacagacggaucaagaaagcgggguccggaaacuauagcggcgacaucucugaugaccucuuccgcuuugccuucgaguccauuacaaaugucaucuuuggggagagacagggaaugcuggaagagguugugaaccccgaagcucagcgguucauugaugccaucuaccagauguuucacaccagcgugccuaugcugaaucucccucccgaccuguuccgccuuuucagaacaaagaccuggaaggaucaugucgcugccugggacgugaucuuuucuaaagcggauaucuacacgcaaaacuucuauugggagcugcggcagaagggcuccguucaccaugacuacagaggcauucucuaucgccugcuuggggacagcaaaaugucuuuugaagauaucaaggccaaugugaccgagaugcuggcuggaggcgucgacacaaccuccaugacacuccaguggcaccuguacgagauggcccggaaccugaaagugcaggauaugcucagagcugaaguucuggccgcccgccaccaagcucagggggacauggcgaccaugcuucagcuggugccccuccugaaggccagcaucaaagagacgcuucggcugcauccgauuuccgucacacuccaaagauaucuggugaaugaucugguccuccgcgacuacaugauccccgcuaagacccuggugcagguugccauuuaugcccuuggacgggaaccuacauucuuuuucgaucccgagaacuuugacccuaccagauggcugucuaaggauaaaaacaucaccuacuuccgcaaucucggcuuuggguggggagugcggcagugucugggcagacgcauugcugaacuggagaugacaaucuuccuuaucaacaugcucgagaauuuucgggucgaaauucagcaccugagcgacgugggcacgaccuucaaccugauccucaugcccgagaagccgauuuccuuuacauucuggccuuucaaucaagaagccacccagcaguga

SEQ ID NO: 68083 - RNA, 1512 nt, Artificial Sequence
  derived and/or modified sequence opt5 from CYP11B1__Homo_sapiens__NP_000488
auggcccugagagcuaaggccgaggugugcauggcgguccccuggcucagccugcagcgggcucaagcccuuggcacccgcgccgcuagaguuccucggacagugcugccguucgaagccaugccccgcagaccugggaaccgguggcuccgccugcuucagaucuggagagagcagggauacgaagaccugcaccucgaggugcaucagacguuucaagaacugggccccauuuuccgguaugaucucgggggagcuggcauggucugugugaugcucccugaggacguugagaaacugcaacagguggauucccuucacccccaucgcaugucucuggaaccuugggucgccuacagacagcaccgggggcauaagugcggaguguuucuccugaauggcccggaguggcgcuucaacagacuucggcugaaucccgaaguucucagcccuaacgcggugcagcgcuuucugcccauggucgacgccguggcuagagauuucucccaggcccugaaaaagaaagugcuccagaaugcucggggcucucugacccuugacguccagccuagcaucuuucacuauacaauugaggccuccaaccuggcgcuguucggggagagacugggacuuguuggccacucucccagcuccgccagccugaauuuucuccaugcucuggaagugauguucaagucuaccgugcaacugauguuuaugccgcgcucccucagccgguggacaucuccuaaggucuggaaagagcacuucgaagccugggauuguaucuuucaguacggggacaacugcauucagaagaucuaucaagagcuggcuuucuccagaccccagcaguacaccagcaucguggccgaacuucugcucaaugccgagcugucuccugaugcuauuaaagcgaacuccauggagcuuacagccggaagcguugacaccacgguguucccccugcucaugacccuguuugaacuggcucgcaaucccaacguccagcaagcccuccggcaggagucccuggccgcugccgcgucuaucagcgaacauccucagaaggcuacaaccgagcuuccgcugcucagagccgcccugaaagaaacacugcgccuuuaucccgugggccucuuccuggagcggguugcuuccagcgaucuggugcuccagaauuaccacauuccugccgggacccuggucagaguguuucuuuacucucugggacgcaaccccgcucucuucccucggcccgagagauauaauccgcaacgcuggcuggacauccggggcuccggcagaaacuuuuaccacgucccuuucggguuuggaaugcggcagugucugggccgcagacuugccgaagcggagaugcuccugcugcuccaucacgugcugaagcaucuucagguugaaacgcugacacaggaggauauuaagaugguguauagcuucauccuccggcccucuauguuuccucugcugaccuucagagccauuaacuga

SEQ ID NO: 68084 - RNA, 1512 nt, Artificial Sequence
  derived and/or modified sequence opt5 from CYP11B2__Homo_sapiens__NP_000489
auggcccugagagcuaaggccgaggugugcgucgcggcucccuggcucagccugcagcgggcccgcgcccuuggcaccagagcugcccgggcuccucgcacaguucugccguucgaagccaugccccaacacccugggaacagauggcuccggcugcuucagaucuggcgcgagcagggauacgaacaucugcaccucgagaugcaucagacguuucaagaacugggccccauuuucagauauaaucucgggggaccucggauggugugugugaugcugcccgaggacgucgagaaacugcaacagguggauucccuucacccuugccgcaugauccuggaaccguggguugcguacagacagcaucggggccacaagugugggguguuucuccugaacggacccgaguggcgcuucaauagacuucggcugaacccugacguccucucucccaaagccgugcagcgcuuucugccuaugguugaugcuguggccagagacuucagccaggcucugaagaaaaagguccuccagaaugcccggggcucccugacccuugaugugcagcccucuauuuuucacuauacaaucgaagcgagcaaccuggcccucuucggcgagagacuggggcuugugggacauuccccgucuagcgcuucccugaauuuucuccacgcccuggaggucauguucaagagcaccguucaacugauguuuaugccucgcucucucucccgguggauuagccccaaaguguggaaggaacauuucgaggcuugggacugcaucuuucaguacggcgauaacuguauccagaaaauuuaucaagaacuggccuucaauagaccucagcacuacacagggaucguggccgagcuucugcucaaggcugaacugucucuugaggcgauuaaagccaacuccauggagcugaccgcuggaagcgucgacacaaccgccuucccccuccugaugacgcuguuugaacucgcccgcaaucccgaugugcagcagauccugcggcaagagucucuugcugccgcggcuuccauuagcgaacacccucagaaggccaccacagagcugccgcuccugagagccgcucugaaggaaacccuucgccucuaucccguuggccuguuccuggagcggguggucuccucugaccucgugcugcagaacuaccauaucccugccgggacacuuguucagguguuucuguacagccucggaagaaaugcugcccuguucccccgcccugagcgguauaacccccaaagauggcuggauauucgcggcuccggccggaauuuucaccaugucccguucggguuuggaaugagacagugccuuggccggcgccucgcggaagccgagaugcugcugcuccugcaccaugugcuuaaacacuuccuggucgaaacccucacgcaggaggacaucaagaugguguacagcuuuauccugagaccugggacaucuccccugcuuaccuuccgggcuauuaacuga

SEQ ID NO: 68085 - RNA, 1527 nt, Artificial Sequence
  derived and/or modified sequence opt5 from CYP17A1__Homo_sapiens__NP_000093
augugggagcugguggcccuccugcuucugacccucgcuuaccuguucuggcccaagagacggugcccuggcgccaaauaucccaagagccuucugucccucccgcuggucgggucucugccuuuucucccccgccacggacauaugcacaacaauuucuuuaaacugcagaagaaauacggcccuaucuauagcguuagaauggggacaaagacgaccgugauugugggacaucaccaacuugcgaaggaaguccugaucaaaaagggcaaagacuucuccgggcggccccagauggcuacacucgauauugccucuaacaaucgcaagggaaucgccuuugcugacagcggcgcccauuggcagcugcacagacggcuugcuauggccaccuucgcgcuguuuaaagauggcgaccagaagcucgagaagauuaucugucaagaaaucuccacacugugcgauaugcuggccacccacaacgggcagucuauugacaucagcuucccuguguuuguugcugugacaaaugucauuucccucaucuguuucaacaccagcuacaaaaauggagauccggagcugaacgugauucagaauuauaacgaaggcaucauugacaaucuuucuaaggauucccugguugaccucgugcccuggcugaaaaucuuuccuaacaagacgcuugagaaacucaagagccaugucaaaauccgcaaugaucugcugaacaagauucuggagaauuacaaggaaaaauucagaucugacuccaucaccaacaugcucgauacacugaugcaggccaagaugaacagcgacaaugggaacgcuggacccgaccaagauucugagcuucuguccgacaaucacauucucaccacaaucggcgauauuuuuggggccggaguggaaaccacgacaagcguggucaaauggacccuggcguuccuucugcauaacccucagguuaagaaaaagcucuaugaggagaucgaccagaaugugggcuucucccggacacccaccaucucugaucgcaacagacugcugcuccuggaagccaccauucgggaggugcuucgccugagaccggucgcuccuaugcucaucccccacaaggccaauguggacagcuccauuggcgaauuugcuguugauaaagggacagaggugaucauuaaccugugggcccugcaccauaaugaaaaggaguggcaccagccugaccaauucaugcccgagcgguuucuuaaccccgccggaacgcagcucaucagcccuucugucuccuaccugccguucggcgcugggccccgcagcugcaucggagaaauucuggcgagacaggagcucuuucugaucauggccuggcuucugcaacgguucgaucucgaagugccugacgauggccagcugcccucucuggaggggauuccuaaaguuguguuucuuaucgacagcuucaaggucaaaauuaaggugagacaggcuuggcgcgaagcccaggccgagggauccaccuga

SEQ ID NO: 68086 - RNA, 1512 nt, Artificial Sequence
  derived and/or modified sequence opt5 from CYP19A1__Homo_sapiens__NP_112503
auggugcuggagaugcucaaccccauccacuacaauauuaccagcaucgucccugaagccaugccggcugccacaaugcccguucugcuucugacgggccucuuccugcuuguguggaacuaugaggggaccuccucuauuccuggacccggcuacugcauggggaucggaccucugauuagccauggcagauuucucuggauggggaucggauccgcguguaauuauuacaaccggguguauggcgaguucaugcgcgucuggaucucuggcgaagaaacacugauuaucagcaaguccucuagcauguuucacauuaugaaacauaaucacuacuccagcagauucgggucuaagcugggacuccagugcaucggcaugcaugagaaagggauuaucuuuaacaauaaccccgagcuguggaagaccacacggccuuucuuuaugaaagcucuuuccggaccgggccuggugcgcaugguuaccgugugugccgaaagccucaagacacaccuggacagacuugaggaagucaccaaugagucuggguauguggauguucugacgcuccugcggcgcgugaugcuggacaccuccaacacacucuuccugagaaucccccuugaugagagcgccauugucgugaagauccaaggauacuuugacgcuuggcaggcccugcucauuaaaccugauaucuucuuuaagauuucuuggcuguacaaaaaguaugaaaaauccgugaaggaccuuaaggaugcuaucgagguccugauugccgaaaaacggcgcagaaucagcaccgaggaaaagcucgaggagugcauggacuucgcgacagaacugauccuggccgagaaacggggcgaucucacccgcgaaaauguuaaccaguguauucuggagaugcuuaucgcugcccccgacacgauguccgugucucuguuuuucaugcuguuccucauugcuaagcacccuaauguggaagaggccaucauuaaagagauccagacagucaucggcgaaagagauauuaagaucgacgauauucaaaaacuuaaggugauggagaacuuuaucuacgaaagcaugcgguaucagcccguuguggaccuggucaugcgcaaggcgcucgaggacgaugugauugacggguacccgguuaaaaagggaaccaauaucauucugaacaucggcagaaugcaucggcuggaauuuuucccuaaacccaacgaguucacacucgagaauuuugccaagaacgugccuuauagauacuuccagcccuuuggguucggaccccgcggcugcgcugggaaauauaucgccauggucaugaugaaggcuauucuggugacccuucugcggagauuucacgucaagacccuccagggacaauguguggaauccauccagaaaauucaugaucugagccugcacccugacgagacaaagaauaugcuugaaaugaucuucacgccgcgcaacucugaucggugccucgagcacuga

SEQ ID NO: 68087 - RNA, 1539 nt, Artificial Sequence
  derived and/or modified sequence opt5 from CYP1A1__Homo_sapiens__NP_000490
augcuguuccccaucagcauguccgccaccgaguuucuccuggcuucugugauuuucugccuugucuuuuggguuaucagagccagccggccucaggugccgaagggccugaaaaaucccccugggcccuggggauggccucucauuggccacaugcugacacuugggaagaacccccaucuggcgcucucccgcaugucucaacaguacggagacgugcugcagaucagaauuggcagcacgccugucgugguucuguccgggcucgauaccauccggcaggcucuggugcgccaaggagacgauuucaaaggcagaccggaccuuuauacauuuacccugaucucuaacggccagagcauguccuucagccccgauucugggccugucugggccgcccggcgcagacucgcucagaauggacugaaguccuuuagcauugccucugaccccgcuuccagcacaucuuguuaccuugaagaacacguguccaaagaagccgagguucugaucagcacccuccaggaacugauggcgggcccugggcauuucaaccccuaucgguacguggucguguccgugacaaaugucauuugcgccaucuguuuuggacgcagauaugaucacaaccaucaagagcugcucucucugguuaaucuuaacaauaacuucggcgaggugguggggagcggaaauccggcugacuuuauuccuauccugcgguaccuccccaacccuucccugaaugccuucaaggaucuuaacgaaaaguuuuauagcuucaugcagaaaauggucaaggagcacuacaaaaccuucgaaaagggccacauucgcgacaucacggauucucugaucgagcauugccaggagaaacagcucgacgaaaaugcuaacgugcaacuguccgaugagaagauuaucaacauuguucuggaccucuuuggcgccggguucgacaccgugacaaccgcgaucagcuggucucugauguaccuugucaugaaucccagagugcagcggaagauucaggaggagcuggauacaguuaucggacgcagcagacggcccagacucuccgaccgcucucaucugccuuauauggaagccuuuauccuugagaccuuccggcacagcuccuuugugccguucacgauuccccacagcacaaccagagauacaucucugaaaggcuuuuacaucccuaaggggcgcugugucuucgugaaccaauggcagauuaaucacgaccagaaacucugggucaaccccuccgaguuucugccugaacgguuccugacccccgauggagcuaucgacaaggugcucagcgagaaaguuauuaucuuuggcauggggaagagaaaaugcaucggagaaaccauugcccgcugggagguguuccuguuucuugcuauccugcuccagcgggucgaguucucugugccgcugggcguuaagguggauaugacaccuauuuauggccugacgaugaagcaugccuguugcgaacacuuccaaaugcagcuuagauccuga

SEQ ID NO: 68088 - RNA, 1551 nt, Artificial Sequence
  derived and/or modified sequence opt5 from CYP1A2__Homo_sapiens__NP_000752
auggcccugagccaguccgugcccuucucugcuaccgagcuccugcuugccagcgcgaucuuuugccuggucuucuggguucucaagggccugagaccucgggugccgaaagggcuuaagucucccccugaacccuggggauggccucugcucggccacgugcugacacuggggaaaaacccccaucucgcucugucccgcaugagccaaagauacggagacguccuucagauucggaucggcuccacgccugugcugguucucucucgccuggauaccauuagacaggcccuugugcggcagggggacgauuuuaagggacgcccggaccuguauacaagcacccucaucacagauggccaaucccugaccuucagcacagacucuggccccgucugggccgcuagacggcgccuggcccagaaugcucucaacaccuuuuccauugccagcgauccugcgucuuccagcucuuguuaccuggaggaacacguguccaaagaggccaaggcucuuaucagcagacugcaggaacucauggccgggcccggacauuucgacccuuauaaucagguuguggucuccguggcuaacgugaucggcgccaugugcuuugggcaacacuuccccgagucuagcgaugagaugcugucccuugucaagaauacgcaugaauuuguugagaccgcgagcucuggaaacccgcuggacuucuuuccuauucuccgguaccugcccaauccugcccugcagcgcuucaaggcuuuuaaccagagauuccucugguuccugcagaaaacagugcaagaacacuaucaggauuuugacaaaaauuccgugcgggauaucaccggcgcccuuuucaagcacagcaaaaaggggccccgcgcuucuggaaaccugauuccccaggagaagaucgucaaucucgugaacgacauuuuuggcgccggcuucgacacaguuaccacggccaucagcuggucccugauguaccuugugacaaaaccugagauucaaagaaagauccagaaagaacuggauaccgucaucgggcgggagagacgcccgcggcucucugacagaccccagcugccuuaucuggaggcuuuuauucucgaaacauuccgccauagcuccuuucugcccuucaccaucccucacagcaccacacgggauacgacccuuaauggauuuuacauucccaagaaauguugcguguucguuaaccaguggcaagugaaucaugacccggaacugugggaggauccuucugaguuuagacccgaacgcuuccucacagcggacggcaccgccaucaacaagccucuguccgagaaaaugaugcuguuugggaugggaaagcggagauguauuggcgaaguccuugcuaagugggagaucuuccucuuccuggccauccugcuccagcagcuggaauuuagcgugcccccuggggucaaaguggaucuuacacccauuuacggacugaccaugaagcacgcccgcugcgagcacguucaggcucggcucagauucucuaucaacuga

SEQ ID NO: 68089 - RNA, 1632 nt, Artificial Sequence
  derived and/or modified sequence opt5 from CYP1B1__Homo_sapiens__NP_000095
augggcaccagccugucccccaacgacccuuggccgcucaauccccugucuauccagcaaacaacgcuucugcuccugcuuagcgugcuggccaccguccacguugggcagagacuccugcggcagcgcagacggcagcugcgcuccgcuccucccggaccuuucgccuggccccucauuggcaacgcggcugccguggggcaagccgcucaucugucuuuugccagacuugcucggcgcuacggagauguguuccagaucagacugggcagcugcccuauugucgugcucaauggggagcgggccauccaccaggcgcugguucagcaaggauccgccuuugcugaccgcccggccuucgcuucuuuuagaguggucagcggcggccgguccauggccuucgggcauuauagcgaacacuggaaggugcagcgcagagcggcccauucuaugaugcggaacuuuuucacacgccagcccagaucccggcagguucuugagggacacgugcugagcgaagcuagagagcucgucgcccugcuggugcgcggcucugcugauggggccuuucucgacccucggccccugaccguggucgccguugcuaaugugauguccgcgguguguuucggaugcagauacagccacgaugacccugaauuucgcgagcuucugucucauaacgaggaguucggccggacagucggggccggaucccucguggauguuaugcccuggcugcaauauuuuccgaauccugugagaaccgucuuccgcgaguucgaacagcuuaaccggaauuuuagcaacuucauucuggacaaauuucucagacacugugagucccugcgccccggcgcugccccucgggauaugauggacgccuucauccugucugcugagaagaaagccgcgggcgauagccaugggggaggcgcuagacucgaccuggaaaaugugcccgccacaaucaccgauauuuuuggggccucccaggacacgcuuagcaccgcucugcaauggcuccugcuucuguucacacgcuaccccgacguucagacccgggugcaggccgagcucgaucaggucgugggaagagaccggcugccuugcaugggcgaucaaccgaaccugcccuauguccucgcuuuucuguacgaagccaugcgcuucucuuccuuugugccuguuacaaucccccacgcgaccacggccaauacaagcgugcuuggguaucacauuccuaaggacaccgucguguucguuaaccaguggucugugaaucaugauccccugaaauggccgaacccugagaacuuugaccccgcuagauuccucgauaaggacggacugaucaauaaggaucugacaagccgggucaugauuuuuagcgugggcaaaagacgcuguaucggcgaagaacuuucuaagaugcaacucuuccuguucauuagcauccuggcccaccagugcgacuuucgggcuaacccuaaugagcccgccaaaaugaacuucuccuacgggcucaccaucaagccuaaauccuuuaaggugaauguuacccugagagaaucuauggagcuucuggauuccgcgguccagaaccuccaggccaaggaaacaugucaguga

SEQ ID NO: 68090 - RNA, 1488 nt, Artificial Sequence
  derived and/or modified sequence opt5 from CYP21A2__Homo_sapiens__NP_000491
augcugcuccugggccuucugcuccugcuuccccugcucgccggggcuagacugcuguggaacugguggaagcuccggagccugcaccuuccuccgcuggcccccggauuccuccaucugcuucagccugaccugcccaucuaccuccugggccugacccaaaaauuugggccuauuuaucgccuccaccugggacuucaggauguggucguucucaauuccaagagaacaaucgaggaagcgauggugaaaaagugggcugacuucgccggccggcccgagccucugacguacaaacuggugucucgcaacuauccggaucuuagccugggggacuacucccuccuguggaaggcccauaagaaacugaccagaucugcucuccugcuuggcauucgggauagcauggaacccgucguggagcagcugacacaggaauuuugcgagcgcaugagagcccaaccuggaacccccguugcuaucgaggaagaguucucccuccugacauguucuauuaucugcuaucuuaccuuuggcgacaagaucaaagaugacaaucugaugccugccuacuauaaguguauucaggaagugcucaaaacauggagccacugguccauccagauugucgaugugauccccuuccugcgguuuuucccgaacccugggcugcgcagacucaagcaggcgauugagaagcgggaccauaucguugagaugcaacugcgccagcacaaagaaagccuuguggccggacaguggagagauaugauggacuacaugcugcagggcgucgcucaacccucuauggaggaaggguccggacagcuccuggagggccacgugcauauggccgcuguggaucugcuuauugggggaaccgaaacgaccgccaauacacucagcugggcggucguuuuucugcugcaccauccugagauccagcaacggcuccaggaggaacuggaccacgagcuuggccccggcgccucuuccagccgcgugcccuacaaggacagagcucggcugccucuccugaacgccaccaucgcugaagugcugagacuucgcccggucgugccccucgcccugccucaccggacaaccagacccucuuccauuagcggguaugauaucccugagggaacgguuauuauccccaaucugcagggcgcccaucucgacgaaacagugugggagcgcccgcacgaguucuggccugaucgguuucuggaacccgggaaaaacuccagagcucuugcguucggaugcggcgcccgcgucugucugggggagccucucgcucggcuggaacuguuugugguucuuaccagacuccugcaggccuucacacugcuccccucuggagacgcccugccuagccuucaaccccugccgcauugcuccgugauucucaagaugcagccuuuccagguccgccugcagccccggggcaugggcgcucacagccccgggcaaucucaguga

SEQ ID NO: 68091 - RNA, 1545 nt, Artificial Sequence
  derived and/or modified sequence opt5 from CYP24A1__Homo_sapiens__NP_000773
augagcucccccaucucuaagagcagaucccuggccgcuuuccuccagcaacugcggucuccucgccagccgcccagacuugugaccagcacagccuacacguccccucagccccgggaggucccuguuugcccccugaccgcgggcggggaaacacagaacgcugccgcccucccuggaccgaccucuuggccccugcuuggcagccugcuccaaauucuguggaaagggggacugaagaaacagcacgacacacucguggaguaucauaagaaauacggcaagaucuuucgcaugaagcugggguccuucgaaagcgugcaccuuggaucuccuugucugcucgaggcucuguauagaaccgaauccgccuacccccagcggcuugagauuaaaccuuggaaggcuuaucgcgauuacagaaaagagggcuauggccugcucauccuggaaggggaggacuggcagcggguccgcagcgccuuucaaaagaaacugaugaagcccggagaagugaugaagcucgauaauaaaauuaacgagguucuggcggacuucaugggcagaaucgaugagcuuugcgacgaacgggggcauguggaggaucuguacucugaacucaauaagugguccuuugagagcaucugucugguccuuuacgaaaaacgcuucggacugcuccagaagaacgccggcgacgaggcugugaauuuuauuauggccaucaaaacaaugaugucuaccuucgggagaaugaugguuacgccgguggagcugcacaagucccugaacaccaaagucuggcaggaucauacacucgcuugggacaccauuuuuaagagcgugaaggccugcaucgauaaucggcuggaaaaauauucccagcaaccuucugcggacuuccuuugugauauuuaccaccagaaccgccugagcaagaaagagcucuaugccgcugugacagaacugcagcuugccgcugucgagaccacggccaauucccugauguggauccucuacaaccugagcagaaauccccaaguucagcagaagcugcucaaagaaauucagucugugcugccugagaaccaagugccccgggccgaggaccuuagaaauaugcccuaucugaaggcuugccucaaggaauccaugcgccugacaccuagcgucccguuuaccacacggacccuggacaaagcgaccgugcuuggagaguacgcccuccccaagggcacaguucugaugcugaacacccaggugcucggcucuagcgaagauaauuucgaggacuccucucaguuuagaccugaacgcuggcugcaggagaaagagaagaucaaccccuucgcucaccuuccuuucggggucggaaaacggauguguaucggcagacgccuggccgaacuccaacugcaucuggcccuuugcuggauugugcggaaguaugauauccaggcuacggacaacgagcccguugaaaugcuccacagcgggacacuggugccguccagagagcugccuauugccuuuugucagcgcuga

SEQ ID NO: 68092 - RNA, 1494 nt, Artificial Sequence
  derived and/or modified sequence opt5 from CYP26A1__Homo_sapiens__NP_000774
augggccugcccgcccuccuggcuagcgcccuuugcaccuucgugcugccucuccugcuuuuucuggcggcuaucaagcucugggaccuguacugugucuccgggagagaucggucuugcgcccugccgcugcccccuggaacaaugggcuuccccuuuuucggggagacgcuccagaugguucuucaacgcagaaaauuucugcagaugaagcggcgcaaauauggauucauuuacaagacccaccucuuuggcagaccuacagugcgggugaugggggccgacaacguccgcagaauccugcuuggagaacaucggcuggugagcguucacuggcccgcuuccgugcgcaccauucucggcucuggcugucugagcaaucugcaugauuccucucacaaacagagaaagaaggucaucaugcgggccuucagccgcgaggcucucgaaugcuaugugccuguuauuacagaggaagugggguccagccuggagcaguggcuuucuuguggagagagaggccugcucgucuacccggaagugaaacggcugauguuucgcaucgccaugagaauccuucuggggugcgagccccaacucgcgggagacggcgauuccgaacagcagcugguggaggccuucgaggaaaugacccggaaccuguuuagccucccuauugacguccccuucucugggcuguauagaggaaugaaggcucgcaaucuuauccaugcccggauugagcagaacaucagagcuaaaauuuguggccugcgcgccuccgaagcgggccaagggugcaaggaugcccuccagcugcuuaucgagcacagcugggaacggggagagagacuggacaugcaggcucucaaacagucuuccacagagcugcuguuuggcgggcacgaaaccacggccagcgcugccaccucccucauuacauaccugggacuuuauccucauguucugcaaaaggugcgcgaggaacucaagucuaaaggccugcuguguaagagcaaucaggauaacaaacuugacauggagauccucgaacagcugaaguacaucgggugcgugauuaaagagacccugcggcucaaucccccggucccuggaggcuucagaguggcccugaagacauucgagcuuaacggcuaccaaauccccaaaggguggaauguuauuuauuccaucugugauacccacgacguggcugaaauuuuuacgaacaaggaggaguucaauccugaucgcuuuaugcugccccaucccgaagacgcgagccgguucucuuuuaucccuuucggaggcgggcucagauccugcgucggaaaggaauuugccaaaauccugcugaagauuuucacaguggagcuugcucgccacugcgacuggcagcuccugaacggcccgcccaccaugaaaacaagcccuaccguuuaccccguggauaaucugccugcccgguuuacccacuuccauggggagaucuga

SEQ ID NO: 68093 - RNA, 1314 nt, Artificial Sequence
  derived and/or modified sequence opt5 from CYP26B1__Homo_sapiens__NP_001264671
augcuguucgagggccucgaccuggugagcgcccuugcuacccuggccgcgugccucgucuccguuacacugcuucuggcugugucucagcaacucuggcagcugagaugggccgccacgcgggauaagagcuguaaacugcccaucccuaagggguccaugggauuuccgcucauuggcgaaaccgggcacuggcugcuucagguguucucuaaaaucuuuagccaugaggcucuggaauccuaccuccccaagauucagcuggucauccaagacacacuucgcgccuggucuagccacccugaggcuauuaacguguaucaggaagcccagaaacugaccuucagaauggcgauccggguucuccugggauuuuccauccccgaggaggaucugggccaucucuucgaaguguaccagcaauuugucgacaauguguucagccugccuguugaucuucccuuuucuggguaucgcagaggcauucaggcccggcagauccugcagaagggacucgagaaggcuauucgcgaaaaacugcaaugcacacagggcaaggacuaccuugaugcccuggaccuccugaucgaguccagcaaagagcacgggaaggaaaugaccaugcaggagcugaaagauggaacacucgaacugauuuucgcugccuaugcgaccacggccucugcuuccaccagccuuaucaugcaacugcucaagcauccuacagugcuggagaaacuuagagacgaacugcgggcccacggcauucuccacucugggggauguccgugcgagggcacccugcgccuggauacacucuccgggcugagauaccuugacugugucaucaaggaggugaugcggcuguuuacccccaucagcggaggcuaucgcacggugcuccagacauucgaacuggauggcuuucagauuccuaaggggugguccgucauguacucuaucagagacacccaugacacagcucccguuuucaaagaugugaacguguucgacccugaucgguuuagccaggcccgcuccgaggacaaggauggaagauuccacuaccugcccuuuggcgggggaguccggaccugccuuggcaaacaucucgccaagcuguuccugaaagugcucgcuguugaacuggcgagcaccucuagauuugagcuugccacacgcacguucccgcggauuacccuggugccuguccuccaccccguggacgggcuguccguuaaguuuuucggacuggauagcaaucaaaacgaaauccuuccugagacagaggcuaugcucucugccaccguguga

SEQ ID NO: 68094 - RNA, 1569 nt, Artificial Sequence
  derived and/or modified sequence opt5 from CYP26C1__Homo_sapiens__NP_899230
auguuccccuggggccugagcugccucuccgugcugggggccgcuggaaccgcccuucugugugcgggccuccugcuuucucuggcucagcaccucuggacacugagauggaugcugagccgggaccgcgccuccacgcucccucugccgaaggggucuaugggauggcccuuuuucggcgagacccuucauuggcugguccaagggagcagauuucacuccucucggcgcgaaagauacggaacaguuuucaaaacccaucuccugggccggccugugauccgcgugagcggcgccgagaacgucagaacaauucuucugggggaacaccggcucgugcgcucccaguggccccagagcgcucauauccugcugggaucucacacccuccugggcgccguuggggagccucacagacggcgcagaaaggugcuugcucgggucuuuucccgcgccgcgcuggaaagauaugugccccggcuccagggagcccugagacaugagguucgcagcuggugcgcugccggcgggccugugucugucuacgaugcuuccaaagcccuuacauuccggauggcggcccgcauucugcucggacugagacuggacgaggcucaaugugccacccucgcucggacguuugaacagcugguggagaaucuuuucagccugccgcucgaugugcccuuuucuggccugagaaagggcauccgcgcccgggaccagcuucacagacaucuggaaggggccauuuccgagaaacuccacgaggauaaggcugcggaaccuggagacgcccuggaucugaucauccacagcgcucgcgagcucggccaugaacccuccaugcaggagcugaaggaaucugccgucgagcuucuguucgccgccuuuuucaccacagcuagcgcguccaccagccucguucugcugcuucuccaacacccugcugccauugccaaaauccgggaggaacugguggcucaggggcugggcagagccugcggaugugcucccggggccgcgggaggcucugagggcccgccucccgacugcgggugugaaccugaucucucccuggccgcucuuggacgccugcgguauguggacugcgucgugaaggagguucucagacugcugccucccgugagcggcggguaccggacagcccuucgcaccuuugaacucgauggauaucagauuccuaaaggcuggucugucauguacagcaucagagacacgcaugagacagcugccguguaucgguccccgcccgagggguucgauccugaaagauucggcgcggcccgcgaggacucucggggagcuagcuccagauuucacuacauucccuucggcgggggagcccgcagcugucugggccaggaacuggcucaagccguucuccagcugcuugccguggagcuggucagaaccgcucggugggaacucgcgacacccgccuuucccgcuaugcagaccgugccgaucguccauccuguggacgggcugcgccuguucuuucacccccuuaccccuucuguugccggaaacggccucugccuguga

SEQ ID NO: 68095 - RNA, 1596 nt, Artificial Sequence
  derived and/or modified sequence opt5 from CYP27A1__Homo_sapiens__NP_000775
auggccgcucugggcugcgccagacuccggugggcgcugcgcggggcuggaagaggccuuuguccccacggggcccgggccaaggcugccaucccugcugcccugccgagcgacaaagcgaccggagcccccggcgcugggccuggagugcgcagacggcagcgcucccucgaggaaauucccagacugggccaacuucgguucuuuuuccagcuguuuguccagggcuacgcccuccagcugcaucaacugcagguucucuauaaggcuaaauacgggccuauguggaugucuuaucugggaccccagaugcacgugaaccuugccagcgcgccucugcucgaacaggugaugcgccaagaaggcaaguacccggucagaaaugauauggagcuguggaaagaacaucgggaccagcacgaucuuacauaugggcccuucacgaccgagggacaucacugguaccagcugcgccaggcccucaaccaaagacugcugaagccugcugaggccgcucucuauacagacgccuuuaaugaagugaucgaugacuucaugacccggcuggaucagcuucgcgccgaguccgcuucuggcaaccagguuagcgacauggcgcaacuguuuuacuacuucgcccucgaagcuauuugcuauauccuguuugagaagagaauugggugucuucagcgguccauccccgaggauacagugaccuucgucagaucuaucggacugauguuucagaauagccucuacgccacauuccugccuaaauggacccgccccgugcugccguuuuggaagcgguaucucgacggcuggaacgccauuuucuccuucggcaaaaagcugaucgaugaaaaacuugaggacauggaagcucagcugcaagccgcggggccugauggcauucagguuagcggauaccuccacuuucugcuugcuucugggcagcugucccccagagaggccaugggaagccucccugaacugcugauggccggcguggacacgaccucuaauacacucaccugggcucuguaucaucuuuccaaggaccccgagauccaggaggcccugcacgaagaggucgugggggugguccccgcuggacaaguuccucagcauaaggauuucgcccacaugccgcuccugaaagcggugcugaaggaaacacuucgccucuaccccguggucccuaccaacagccggauuaucgagaaagaaauugagguggacggcuuucuguuccccaagaauacgcaguuuguuuucugccacuauguggucucuagagauccuacagccuuuuccgagcccgagagcuuccagccgcaucgcuggcugcggaacucccaaccugcuacccccagaauccagcacccuuuuggcucugugcccuucggguacggaguucgcgccugucucggccggagaaucgcugagcuggaaaugcagcuucugcucgcccgccugauucagaaauacaaggugguccuggcgccugagacaggggaacuuaaaagcguggcccggaucguccucgugcccaauaagaagguuggacugcaauuucugcagagacagugcuga

SEQ ID NO: 68096 - RNA, 1527 nt, Artificial Sequence
  derived and/or modified sequence opt5 from CYP27B1__Homo_sapiens__NP_000776
augacccagacacugaaguacgccagcagaguguuccaccggguccgcugggcucccgagcucggcgccucccugggguauagagaauaccauucugcgcggcgcagccuugcugacaucccuggaccguccacgcccucuuuucuggccgaacucuucugcaaaggcgggcugagcagacuucacgagcugcaaguucagggagccgcucauuuuggcccuguguggcucgccuccuucgggaccgugcggacagucuauguggcugcccccgcgcugguugaggaacugcuccgccaggagggaccuagacccgagcgguguucuuuuagcccuuggaccgaacaccgcagaugccggcagcgcgccuguggccugcuuacagcugagggcgaagaguggcaaagacugcggucccuccuggccccgcuucugcuccgcccccaggcugccgcgagauacgccgggacccugaacaauguggucugcgaucuggugcggagacuccgccggcagagaggacgcggcacagggccucccgcucugguucgggacguggccggagaguucuauaaguuuggccuugaagggauugcugccguccugcucggaagcagacugggcugucuugaggcccaggugccucccgauaccgaaacguucauccgcgcugugggcucugucuuuguuuccacccugcucacaauggcgaugccgcauuggcugcggcaccuggugccugggcccuggggaagacucugccgcgacugggaucaaauguucgccuuugcucagcggcacguggagagacgcgaagccgaggccgcuaugcggaacggcgggcagccugagaaagaccuggaaagcggagcccaucuuacccacuuccuguuuagagaggaacuccccgcgcagucuauucugggcaaugucacagagcuucugcucgcugggguggauaccguuuccaacacgcugagcugggcccuguacgaacucucucggcaucccgaggugcaaacagcccugcacuccgagaucaccgcugcccuuagcccuggauccucugcuuauccgagcgccacaguccugucccagcucccccugcugaaggcggugguuaaagaagugcuucgccucuacccugucgugcccggcaauagcagagucccugacaaggauauucacgugggcgacuacaucauccccaagaacacccugguuacccugugucauuaugccacaucucgggauccggcucaguucccugagcccaauuccuucagaccugcccgcuggcucggggaaggacccacgccucaccccuuugcuagccugccguucggcuuugggaaacggucuugcaugggaagacgccuugccgagcuggaacuccaaauggcgcuggcccagauucugacccauuucgaggugcagccugagcccggcgcugcccccgucagaccuaagacacggaccgugcuuguuccggaacgcagcaucaaccuccaguuucuggacagauga

SEQ ID NO: 68097 - RNA, 1119 nt, Artificial Sequence
  derived and/or modified sequence opt5 from CYP27C1__Homo_sapiens__NP_001001665
augagaagcgugcugcggcagcgcauccucaagcccaaagacgucgccauuuacuccggcgagguuaaccaagugaucgcugaucugauuaagagaaucuaucuucugcggucucaggccgaagacggggagaccgugacaaaugucaacgaucucuucuuuaaauacagcauggaaggaguggcgacgauucuguaugagucccgccuuggcugccuggaaaauucuaucccucagcucaccguugaguacaucgaggcucuggaacugauguucagcauguuuaagacauccauguaugccggggccauuccgagauggcuccggcccuucaucccuaaacccuggcgcgaguuuuguagaucuugggacggacuguucaaguuuagccagauucacguggauaacaaacuucgggacauccaauaccagauggaucgcggcagacgggucuccgggggacugcucaccuaucuguuccuuagccaggcucugacacuccaggaaauuuacgccaaugugaccgagaugcugcuggcuggcguugacacaaccucuuuuacgcucuccuggaccguguaccugcuugcccgccauccugagguccaacagacaguguauagagaaaucgugaagaaccugggcgagcggcacguccccaccgcggccgauguuccuaaggugccgcucgugcgcgcucugcuuaaagaaacacugagacucuuccccguccugccugggaauggacgggugacccaggaggaccugguuauuggcggguaccucauccccaagggaacgcagcuggcccuuugccauuaugcuacaagcuaccaagaugaaaacuuuccuagagccaaagaguuccgccccgagcgguggcugagaaagggcgaccucgaucgcguggacaauuuugggucuaucccguucggacacggcguccgguccuguauuggcagacgcaucgcggaacuggagauucaucuugugguuauccagcugcuccagcacuucgaaauuaagaccagcucucaaacaaacgccgugcacgcuaaaacccaugggcugcugaccccuggaggccccauccacguccgguuugugaauagaaaguga

SEQ ID NO: 68098 - RNA, 1485 nt, Artificial Sequence
  derived and/or modified sequence opt5 from CYP2A13__Homo_sapiens__NP_000757
augcuggccagcggccuccugcuugugacccugcucgcuugccugacagucaugguucuuauguccguguggagacagcggaagucucgcgggaaacugcccccuggaccgacgccccucccuuucaucggcaacuaccugcaacugaauaccgagcagauguauaacagccucaugaagauuuccgaaagauacgggcccguguuuacaauccaccugggaccucggcgcgucgugguucuuuguggccaugacgccgugaaagaggcgcuggucgaucaggcugaagaguucucugggagaggagaacaggccaccuuugacuggcuguucaagggcuauggcguggccuuuagcaauggggagcgggcuaaacaacuccgcagauucuccauugccacacuucggggauuuggcguugggaagcgcggaaucgaggaacggauucaggaggaagcuggcuuccugaucgaugcccucagagggacccacggagcgaacaucgaccccacauuuuuccugucucgcaccgugagcaaugucauuuccagcaucguguuuggcgauagauucgacuacgaggauaaggaguuucugucucuccugcggaugaugcuuggcuccuuccaguucacggccaccagcacagggcagcuguaugaaauguuuucuuccgugaugaaacaucucccuggaccgcaacagcaggcuuucaaggagcugcagggccuugaagacuuuauugccaaaaaggucgagcacaaccaacgcacccuggaucccaauagcccuagagacuucaucgauucuuuucucauucggaugcaggaagaggagaaaaaccccaauacagaauuuuaccugaagaaccugguuaugaccacgcucaaucuguuuuucgcugggacagagaccguguccacaacccuuagauauggauuucugcuccugaugaagcauccugaaguggaggccaaaguccacgaagagaucgaccgcgugauuggcaagaaccggcagcccaaauucgaggauagagcgaagaugccguacaccgaagccguuauccacgagauccaacgcuuuggggacaugcuuccuaugggacuggcucaucgggugaauaaagacacaaaguucagagauuucuuccuccccaaaggcacggaagucuucccuaugcugggcagcgugcugcgcgacccccgguuuuucuccaaccccagagauuuuaauccucagcacuuccucgacaagaaggggcaguuuaaaaagucugaugccuucguuccguuuagcauuggaaaacgcuacugcuucggcgaggggcuggcucggauggaacuuuuucuguucuuuaccacaaucaugcagaacuucagauuuaagagcccccaauccccuaaagacauugaugugucucccaagcaugucggauucgccaccaucccucgcaacuauacaauguccuuccucccccgguga

SEQ ID NO: 68099 - RNA, 1485 nt, Artificial Sequence
  derived and/or modified sequence opt5 from CYP2A6__Homo_sapiens__NP_000753
augcuggccagcggcaugcuccugguggcccuucuggucugccucaccguuauggugcugauguccguguggcagcaaagaaagucuaaagggaaacuucccccuggaccgacaccccugccuuucaucggcaacuaccuccagcugaauacggagcagauguauaacagccugaugaaaauuuccgaacgguacgggcccgucuuuaccauccaccucggaccucgcagagugguugugcuguguggccaugacgcuguccgggaggcgcuuguggaucaggcugaagaguucucugggcgcggagaacaagccacauuugacuggguuuucaagggcuauggcguggucuuuagcaauggggagagagccaaacagcugcggcgcuucuccauugcuacccucagagauuuuggagugggcaagcgggggaucgaggaacgcauucaggaggaagccggauuccugaucgacgcucuuagaggcacagggggagccaacaucgaucccaccuuuuuccugucucggacagugagcaaugucauuuccagcaucguuuuuggcgaccgcuucgauuacaaggacaaagaguuucucucucugcugagaaugaugcucggcauuuuccaguucaccuccacgagcaccgggcaacuguaugagauguuuucuuccgugaugaagcaccuuccuggaccgcagcagcaggcguuccaacugcuccagggccuggaagauuuuaucgccaaaaagguggagcauaaccagcggacacuugaccccaauagcccucgcgauuucauugacucuuuucugaucagaaugcaagaagaggaaaagaaccccaauaccgaguucuaccucaagaaccuggucaugacaacccugaaucucuuuauugggggaacggagacaguguccaccacacugcgguauggcuuccuucugcucaugaagcacccugaaguugaggcuaaagugcaugaagagaucgauagagucaucgggaagaaccgccagcccaaauuugaagaccgggccaagaugccguacauggaggcugugauucacgagauccagagauucggagacguuauuccuaugagccuggcccgccgggugaaaaaggauaccaaauuuagagacuucuuucuucccaagggcaccgaagucuacccuaugcugggcuccgugcuccgcgaucccucuuucuucagcaauccccaggacuuuaacccucaacacuuccugaaugagaaggggcaguuuaaaaaguccgaugcguucgucccguuuagcaucggaaaacggaacugcuucggcgaagggcuggccagaauggagcucuuucuguucuuuacaacggugaugcagaacuuccgccuuaagucuucccagagccccaaagacauugauguuucuccuaagcaugugggauuugcuaccaucccccggaauuauacaaugagcuuccugccuagauga

SEQ ID NO: 68100 - RNA, 1485 nt, Artificial Sequence
  derived and/or modified sequence opt5 from CYP2A7__Homo_sapiens__NP_000755
augcuggccagcggccuccugcuuguggcucugcucgccugccugaccgucaugguucuuauguccguguggcagcaaagaaagucucgggggaaacugcccccuggaccgacaccccucccuuucaucggcaacuaccugcagcugaauacggagcacauuugugacagcaucaugaaguuuuccgaaugcuaugggcccguguucaccauucaucucggaccucgcagagucgugguucuguguggccacgaugcggugcgggaggcucuugucgaccaggccgaagaguuuucugggcgcggagaacaggccacauucgauuggguguuuaaaggcuacggcguugcuuucagcaacggggagagagccaagcaacugcuccgguuugcuaucgccacccugcgcgacuucggagugggcaaaagagggauugaggaacggauccaggaggaauccggauuucuuaucgaggcgauucgcucuacacauggcgccaauaucgaucccaccuucuuucugagcagaacagucuccaacgugauuagcucuaucguguucggggaccgguuugauuaugaggacaaggaguuccucucccugcugagcaugaugcucggaauuuuccaguuuaccucuacguccaccggccagcuguacgaaauguucagcucugucaugaagcaccuuccuggcccgcaacagcaggcuuuuaaacugcuccaggggcuggaagauuucaucgccaagaaaguugagcauaaucaacgcacacuugaccccaacuccccucaggauuuuauugacagcuuccugauccacaugcaggaagaggagaagaaucccaacaccgaauuuuaucucaaaaaucugaugauguccacacugaaccucuucaucgcuggaaccgagacggugucuacaacccugagauacggcuuucuucugcucaugaagcacccugaaguggaggccaagguccaugaagagauugaucgggugaucgggaaaaaucgccaacccaaguucgaggacagaacaaaaaugccguauauggaagcgguuauucacgagauccagcgguuuggagacgugauuccuaugagccuggccagacgcgucaagaaagauaccaaguuccgggacuuuuuccuucccaaaggcaccgaaguguucccuaugcugggguccguucucagagaucccagcuuuuucucuaacccccaggacuuuaauccucagcauuuccuggaugacaagggacaauuuaagaaauccgaugcuuucgugccguuuagcaucggcaagcgcaacugcuucggcgaggggcuggcccggauggaacucuuucuguucuuuacaacggucaugcagaauuucagacuuaaaucuagccagucccccaaggacaucgaugugucuccuaaacacgucguguuugcuaccauuccccgcaacuacacaaugagcuuccugccucgguga

SEQ ID NO: 68101 - RNA, 1476 nt, Artificial Sequence
  derived and/or modified sequence opt5 from CYP2B6__Homo_sapiens__NP_000758
auggagcugagcgugcuccuguuccuugcccugcucaccggccugcuucugcuccugguccagagacaccccaacacacaugaccggcugccuccggggccccgcccucucccccugcuuggaaaucugcuccaaauggauagacggggccugcuuaaguccuuucugcgcuucagagaaaaauacggggacguuuuuacggugcaccucggaccucggcccguggucaugcugugcggcguggaggcuauccgcgaagcccugguugauaaggcggaggcuuucucugggagaggaaaaauugccaugguggaccccuuuuuccggggcuauggcgucaucuuugccaacgggaaucgcuggaaggugcucagacgguucagcguuaccacaaugcgcgauuuuggaaugggcaaaagauccguggaagaacggauucaggaggaagcucagugucugaucgaggaacuucgcaagucuaagggggcccugauggacccgaccuuccucuuucagagcauuacagcuaacaucaucugcuccauugucuucggaaaaagauuucauuaccaagaucaggaguuccugaagaugcuuaaucuguucuaucagaccuuuucucucaucagcuccguguucggccagcuguuugagcuguucagcggguuucucaaauacuuccccggagcccaccggcaaguguauaagaaccugcaggaaauuaaugcguacaucggccauucugucgagaaacacagagaaacacuugacccuuccgcccccaaggaucugauugacaccuaucuccugcacauggagaaggagaaaagcaacgcucauucugaguuuucccaccagaaucuuaaccugaauacgcucagccuguucuuugccggcaccgagacaaccucuacaacccugcgcuacggguuccuccugaugcuuaaguacccucauguugcugaacggguguauagagagaucgaacaggugauuggaccccaccgcccgccugagcugcacgaucgggccaaaaugcccuacacggaagcggucaucuaugagauccaaagauuuuccgaccuccugccuaugggcgugccccauauuguuacacagcacaccagcuuccgcggguacaucauucccaaggauacagagguguuucugauccuuuccaccgcccuccaugacccucacuauuucgaaaaaccggacgcuuucaaccccgaucauuuucuggacgccaauggagcucugaagaaaaccgaggccuucauuccuuuuucucucggcaagcggaucugucugggggaaggaaucgccagagcugagcuuuuccuguuuuucacaacgauucuccagaacuuuagcauggcgucccccgucgccccugaagauaucgaccugaccccucaagagugcggcgugggcaagauuccgccuacauaccagauccgcuuccugccccgguga

SEQ ID NO: 68102 - RNA, 1473 nt, Artificial Sequence
  derived and/or modified sequence opt5 from CYP2C18__Homo_sapiens__NP_000763
auggaccccgccguggcucugguccucugccugagcugucuuuuccugcucucccuguggagacagucuagcggccgggggcgccuuccuuccggaccgacaccccugccuaucauuggcaacauccuccaacuggauguuaaggacaugucuaaaagccugaccaauuuuuccaagguguacgggcccguguucacggucuauuuuggacucaaaccuauugugguucugcacggcuacgaggccgugaaggaagcgcuuaucgaucauggggaggaguucucuggaagaggcagcuuucccgucgcugaaaaagugaacaagggccuggggauucucuucuccaauggaaagcgguggaaagaaauccgcagauuuugccugaugacccuucggaacuucggcauggggaagcgcagcaucgaggacagaguucaggaggaagcccggugucugguggaggaacuccgcaaaacaaaugccucuccuugcgauccgaccuuuauucugggaugugcucccugcaacgucaucuguuccgugauuuuccacgacagauuugauuauaaggaccagcgguuccugaaucucauggagaaauuuaacgagaaucugcgcauccuuagcucuccuuggauucaggugugcaacaauuuccccgcccugaucgauuaccucccuggcucccauaacaagauugcugaaaauuucgccuauaucaagagcuacguccuggagagaaucaaagaacaccaagagucucuugacaugaacuccgcgcgggauuuuauugacuguuuccugaucaagauggaacaggagaaacauaaucagcagagcgaguuuacaguugaaucccucauugccaccgugacagauauguucggggcuggaaccgagacgaccucuacaacccugcgcuauggccugcuccugcuucugaaguaccccgaagugacagccaaaguccaagaggaaaucgagugcgugguuggcagaaaccggagcccguguaugcaggacagaucccacaugccuuacaccgacgcugugguccacgagauucagcgcuauaucgaucuccugcccacgaaccuuccucaugccgugacaugcgacguuaaguuuaaaaauuaccugauccccaaggggaccacaauuaucaccagccucaccucugugcugcacaacgauaaggaguuccccaauccugaaauguuugacccgggacauuuccuggauaaauccggcaacuuuaagaaaagcgacuauuucaugcccuuuucugcggggaagcggaugugcaugggagaaggccucgccagaauggagcuguuccuuuuucugacaacgauucuccagaauuucaaccugaaaagccaagucgauccuaaggacaucgauauuacccccaucgcuaaugccuucgggcgcgugccuccccuguaccagcuuuguuuuaucccggucuga

SEQ ID NO: 68103 - RNA, 1473 nt, Artificial Sequence
  derived and/or modified sequence opt5 from CYP2C19__Homo_sapiens__NP_000760
auggaccccuucgugguccugguucucugccugagcugucuucugcuccuguccaucuggagacagucuagcggccgggggaaacuuccuccgggacccaccccucugcccgugauuggcaacauccuccaaauugauaucaaggacguguccaagucucugacaaaucugagcaaaauuuacgggccugucuuuacgcucuauuucggacuggagcgcauggugguucuucacggcuacgaaguggucaaggaggcccugaucgaucucggggaagaguuuuccggaagaggccauuucccccuggcugaacgggccaaccgcggcuuugggaucguguucucuaauggaaaaagauggaaggagauucggcgcuuuagccuuaugacccugagaaacuucggcauggggaagcgguccaucgaggaccgcguucaggaagaggcgagaugccucguggaggaacugcggaaaacaaaggcuagcccuugugauccgaccuuuauucugggaugcgcccccuguaaugucaucugcucuauuaucuuccagaaacgcuuugacuauaaggaucagcaauuccucaaccugauggagaaacuuaaugaaaacauuagaaucguguccacaccuuggauccagauuuguaauaacuuucccaccaucauugacuacuucccuggcacacacaauaagcugcucaagaaccuggccuucauggagagcgauauccuugaaaaagugaaggagcaucaggaaucuauggacauuaauaacccccgggauuuuaucgacugcuuccugaucaaaauggagaaggagaaacagaaucaacaguccgaauuuaccauugagaaccucgucaucacggcugccgaucugcugggggcuggaaccgaaacaaccagcacaacccuccgcuaugcccugcuucugcuccugaagcacccggagguuacggcgaaagugcaggaagagauugagagagugaucggccggaacagaucuccuuguaugcaggaccgcggccauaugcccuacacagacgccgucgugcacgaaguucaacgguauauugaucuuaucccuaccucccugccccacgcugugacaugcgacgucaaguucagaaauuaccucauccccaaggggaccaccauucugacaagccugacguccgugcuccaugauaacaaagaguuuccuaauccggaaauguucgacccccgccacuuucuggaugagggaggcaacuucaagaaaucuaauuacuuuaugccuuucagcgccgggaagcggaucuguguuggagaaggccuugcuagaauggagcuguuucucuuccugaccuuuauucugcagaacuucaaucuuaaaucccucaucgaccccaaggaucuggacacaaccccuguggucaacggguucgccagcgugcccccguuuuaucagcugugcuucauuccugucuga

SEQ ID NO: 68104 - RNA, 1473 nt, Artificial Sequence
  derived and/or modified sequence opt5 from CYP2C8__Homo_sapiens__NP_000761
auggagcccuucgugguccugguucucugccugagcuuuaugcuucuguucucccucuggagacagucuugucggcgcagaaagcugccuccgggccccaccccucuucccaucauugggaacaugcugcaaaucgacgugaaagauauuugcaagagcuuuacaaauuucuccaaaguguacggaccugucuuuacgguguauuucggcaugaaccccaucguuguguuucacggguacgaagccgucaaggaggcucucauugacaauggagaagaguucucuggccgggggaacagcccuaucucccagcgcaucaccaaaggacugggcauuaucucuagcaauggcaagagauggaaggaaauucggcgcuuuucccugacaacccucagaaacuucgggaugggaaaacggagcaucgaggaucgcgugcaggaggaagcccauugucugguugaggaacuuagaaagacaaaagcgucuccgugcgaccccaccuuuauucugggcugugcuccuugcaaugugaucuguuccgucguguuccagaagcgguuugauuauaaagaccaaaacuuccucacacugaugaagcgcuucaaugagaacuuucggauucuuaauagccccuggauccaggugugcaacaauuucccucugcucaucgauuguuuucccgggacccacaacaagguccugaaaaauguugcccugacgagaucuuacauucgcgagaaggugaaagaacaucaggccucccucgacgugaacaacccgagagauuucaucgacugcuuucugauuaagauggagcaggaaaaagauaaucaaaagagcgaguucaacaucgaaaaucuugucggaaccguggcugaccuguuuguugccggcacagagaccacaucuaccacgcuccgguaugggcugcuucugcuccugaaacacccugaggugacagcuaagguccaggaagagauugaucaugugaucggaagacaccgcucccccuguaugcaggaccggagccacaugccuuacaccgacgccguugugcaugaaauccagagauauuccgaucugguccccacaggcgugccccacgcggucaccaccgacacaaaguuccgcaacuaccucauuccuaaaggcacgaccaucauggcccugcuuacaucugugcugcaugaugacaaggaguuuccgaaucccaacauuuucgauccugggcacuuucucgacaaaaauggaaacuucaagaaaagcgauuacuuuaugcccuucuccgcuggcaagcggaucugcgccggggaaggacuggcuagaauggagcuuuuccuguuucucaccacaauucugcaaaauuucaaccucaagagcguugacgaucugaaaaaucugaacaccacggccgugacaaagggcaucgucucucuuccucccuccuaucagaucugcuuuauuccgguguga

SEQ ID NO: 68105 - RNA, 1473 nt, Artificial Sequence
  derived and/or modified sequence opt5 from CYP2C9__Homo_sapiens__NP_000762
auggacagccuggugguccucguucugugccuuuccugucugcuccugcuuucucuguggagacagagcuccggccgggggaagcugcccccuggaccgacaccccucccugugaucggcaacauucugcaaaucgggauuaaagauaucucuaagagccucaccaaucuguccaaaguguacggacccgucuucacgcuuuauuuuggccugaagccuauugugguucuccacggguacgaggccgugaaagaagcucugaucgaccuuggagaggaguucucuggccgcggcaucuuuccccuggccgaaagagcgaaccggggguucggaauugucuuuagcaauggcaagaaguggaaagaaauccgcagauucucccucaugacccugcggaacuuugggaugggaaagcgcagcauugaggauagagugcaggaggaagcucggugccugguugaggaacuccgcaaaacaaaggccucuccuugugacccgaccuucauccugggcugcgcccccuguaaugugauuugcuccaucauuuuucauaaaagauucgauuauaaggaccagcaguuucuuaaccugauggagaagcucaaugagaacaucaaaauccugagcucuccuuggauucaaaucuguaauaacuucucccccauuaucgauuacuuuccugggacacacaauaaacuucugaagaacgucgcuuucaugaaaagcuauauucucgaaaaggugaaggagcaucaggaaucuauggacaugaauaacccccaggauuucaucgacugcuuucugaugaaaauggagaaggaaaagcacaaucagccguccgaguucaccaucgagagccuggaaaacacagccguggaucucuuuggagcuggcaccgagacgaccuccacaacccugcgguacgcccuucugcuccugcuuaaacauccugaagucacagcgaagguucaagaggaaauugagcgcgugaucggcagaaaccggucucccuguaugcaggaccgcagccacaugccuuauaccgaugccgugguccacgaggugcagagauacauugaccugcuccccacgucccugccccaugcuguuacaugcgacaucaaauuccggaauuaccugauuccuaaggggaccacaauccucaucagccugaccucugugcuucacgauaacaaagaauuuccgaaucccgagauguucgacccucaucacuuucuggaugaaggaggcaacuucaagaaguccaaauauuuuaugcccuucagcgccgggaagagaauuugugucggagaggcucucgccggcauggaacuguuucuguuccuuaccucuauccuccagaauuuuaaccugaaaagccugguggacccuaagaaucucgauacaacgcccguugugaacggguucgcguccgucccgccuuucuaccaacugugcuuuauucccguguga

SEQ ID NO: 68106 - RNA, 1494 nt, Artificial Sequence
  derived and/or modified sequence opt5 from CYP2D6__Homo_sapiens__NP_000097
augggccuggaggcccucgugccccuggcugucaucguugccauuuuccuucugcucguggaccugaugcacagacggcagcgcugggcggcuagauacccuccggggccccuuccucugcccggacucggcaaccugcugcauguggauuuucaaaauaccccuuauugcuucgaccagcuccggcgcagauuuggggaugucuucagccugcagcuugccuggacacccgugguugugcugaacggacucgccgcuguccgggaagcccuggugacgcacggcgaggacaccgcugaucgcccuccgguucccaucacacagauucuuggguuuggaccuagaucccaaggcguguuccuggcccgguacggccccgcguggcgcgaacagagacgguuuucugucagcacccuccgcaaucuggggcugggaaagaaaucccucgagcagugggugacagaagaggccgcuugucugugcgccgcuuucgccaaccauucuggcagaccuuuucggcccaaugggcuucuggacaaggcggugagcaacgucaucgccucccucaccuguggacgcagauucgaguaugaugacccgcgguuucugagacuucuggaucucgcucaggaaggccugaaagaggaaucuggguuccugcgcgagguucucaaugccgugccugugcugcuucacauucccgcucuggccggaaagguccuccgguuucaaaaagccuuccugacacagcuugacgagcugcucaccgaacauagaaugacgugggauccugcucagccuccccgcgaccugaccgaggcguuccuggccgaaauggagaaggcuaagggcaaccccgaaagcuccuuuaaugaugagaaccuccggaucgugguugccgaccuguucagcgccggcauggugacaaccucuacaacccuugcuugggggcugcuccugaugauccugcacccggacguccagagacgcgugcaacaggagauugaugacguuaucggacaggugcggagacccgaaaugggcgaucaagcccacaugccuuacacgacagcggucauucaugaggugcagcgcuuuggggacaucgucccccuuggagugacccacaugacaucccgggauauugaaguucagggcuucagaaucccuaaagggaccacccucauuacaaaucugagcucugugcugaaggacgaggcugucugggaaaaacccuuucgcuuccauccggagcacuuucucgaugcccagggacacuucgugaagccugaggccuuucugcccuucuccgcuggccggagagccugccuuggcgaaccucuggcucggauggagcucuuucuguucuuuacgagccugcuucaacauuucucuuucuccguucccaccgggcagccucgccccagccaccauggaguguuugccuuccucgucuccccgucuccuuaugaacugugugcggugcccagauga

SEQ ID NO: 68107 - RNA, 1482 nt, Artificial Sequence
  derived and/or modified sequence opt5 from CYP2E1__Homo_sapiens__NP_000764
augagcgcccugggcgugaccgucgcucuccugguuugggccgcguuccuucugcucguguccauguggagacaggugcacucuagcuggaaccugcccccugggccguuuccccuuccuaucauuggaaaucuguuccaacucgagcugaagaacauccccaaauccuuuacacggcuggcucagcgcuucggcccugucuuuacgcucuacguggggucucagagaaugguugugaugcauggauauaaggccgucaaagaagcccugcuugacuacaaggaugaguucagcggccgcggggaccugcccgcuuuucacgcccaucgggauagaggaauuaucuucaauaacggcccuaccuggaaagacauucggcgcuuuucccucacaacccugagaaauuauggcauggggaagcagggaaacgaaucucggauccaacgcgaggcucacuuccuucuggaagcccucagaaagacacagggccagccguuugaucccaccuuccugaucgggugcgcgccuuguaaugugauugccgacauccuguuucggaaacauuucgauuacaacgacgagaaguuccuccgccugauguaucuuuuuaaugagaacuuccaucugcucagcacacccuggcugcagcuuuacaauaacuuuccuuccuuccugcacuaucuccccggaagccacagaaaaguuauuaagaauguggcugaagucaaagaguacgugucugaacgggugaaggagcaccaucaaucccuggauccgaacugcccucgcgaccugaccgauugucuccuggucgagauggaaaaggagaaacacagcgccgaaagacuuuacacgauggacggcaucaccguuacaguggcugaucuguuuuucgccgggaccgagacaaccucuacgacacuccgguauggacugcuuauucugaugaaguaccccgaaaucgaggagaaacuccacgaagagauugacagagugaucggcccuucccgcauccccgcgauuaaggaccggcaggaaaugcccuauauggaugccgucgugcaugagauccagagauuuauuacccugguuccuagcaaucugccgcacgaagcuacacgcgacaccaucuuccggggcuaccucauucccaaagggaccguggucgugccuacacuggauucuguucuuuaugacaaccaggaguuucccgauccugagaaguucaaacccgaacauuuucugaacgagaauggaaaguucaaguacuccgacuauuuuaaaccguucagcacgggcaagagagugugcgccggggaaggacucgcucgcauggagcuguuccugcuucucugugccauccugcaacacuuuaaccugaaaccucucgucgaucccaaggacaucgaucuguccccuauucauaucggcuucgggugcauucccccucgguacaaacuuugugugauccccagaucuuga

SEQ ID NO: 68108 - RNA, 1476 nt, Artificial Sequence
  derived and/or modified sequence opt5 from CYP2F1__Homo_sapiens__NP_000765
auggacagcaucuccaccgccauucugcuccugcuucuggcucucgugugccugcuucugacacucucuagcagagauaagggcaaacugcccccugggccgcggccccuguccauccucggaaaccugcuucugcucuguucucaggacaugcugacgagccuuaccaagcuguccaaagaguacggcucuauguauacaguccaccucgggccucgcagaguuguggugcugagcggauaccaagccgucaaggaagcgcugguggaucagggcgaggaauuuuccgggcggggagacuaucccgcuuucuucaauuuuaccaaaggcaacggcauugccuucagcucuggggaucgcuggaagguucucagacaguuuuccauccagauucugcggaauuucggaaugggcaagcgcagcaucgaggaaagaauccuugaggaggggucuuuucugcucgccgaacugcggaaaacagagggagaaccuuucgaccccaccuuugugcuuucccgcagcgucucuaacauuaucugcuccgugcuguucggcagcagauuugauuacgacgaugagcggcuccugacaauuauccgccugauuaaugacaacuuccaaaucauguccucuccuuggggagagcucuaugauauuuuuccgagccugcuugacuggguucccgggccucaucagagaaucuuccagaauuucaagugucugcgggaucucaucgcucacuccgugcaugaccaccaggccagccuggacccccgcucuccuagagauuuuauucaaugcuuccuuaccaaaauggcugaagagaaggaagacccccugucccauuuucacauggauacgcuccugaugaccacacacaaccuccuguucggcggcaccaaaacagucagcaccacgcugcaucacgccuuucuugcgcugaugaaguacccgaaggugcaggcccgggugcaggaggaaaucgaccucgucguugggagagcucgccugccugcccugaaagaucgggcugccaugcccuauacagacgcggugauucaugaggugcagagauucgccgauaucauuccuaugaaucuuccccaccgcgucacccgggacacagcuuuuagaggauuccucauccccaagggcaccgaugugaucacccugcugaacacaguucacuacgacccuucucaauuucucacgccgcaggaguucaaucccgaacauuuucuggaugccaaccagagcuucaaaaaguccccugcuuuuaugcccuucucugccgggcgccggcuuugucugggagagagccucgccagaauggaacuguuccuguaccuuaccgcuauucuccaauccuuuagccugcagccucugggcgcgcccgaggacaucgaccucacaccgcugucuuccgggcuuggaaaucugccucgccccuuccagcucugccugcggccuagauga

SEQ ID NO: 68109 - RNA, 1506 nt, Artificial Sequence
  derived and/or modified sequence opt5 from CYP2R1__Homo_sapiens__NP_078790
auguggaagcuguggagagccgaggaaggcgcugccgcgcucgggggagcucuguuccuucugcucuuugcccugggcgugcggcagcuucugaaacaacgcagacccaugggguucccuccgggacccccuggccuccccuuuaucgggaacauuuacagccuggccgcuuccucugagcugccucacgucuauaugcggaagcagagccagguuuacggagaaaucuucucccucgaccugggcggcauuucuaccguggugcuuaauggguaugaugucgugaaagagugccugguucaucagagcgaaaucuuugccgaccgccccugucucccucuguucaugaagaugacaaaaaugggaggccuucugaacuccagauacgggcggggauggguggaucaccgcagacucgcugucaauucuuuucgguauuucggcuacgggcaaaagagcuuugaguccaagauucuggaggaaacgaaauucuuuaacgacgccaucgagaccuauaagggacgcccguucgauuuuaaacagcugaucacaaaugcggugagcaacauuaccaaucucaucauuuucggcgaaagauucacauacgaggacaccgauuuucagcauaugaucgagcuguucucugaaaacguugagcuugccgcuuccgccagcguguuucuguacaaugcuuuccccuggauuggcauccucccuuuugggaagcaccagcaacuguuccggaacgccgcggucguguaugacuuucuuucucgccugauugaaaaagccuccgugaauagaaagccccagcucccucagcauuucgucgaugcuuaccuggacgagauggaucagggaaagaacgaccccagcucuacauuuuccaaagaaaaucugaucuucagcguuggcgagcucaucauugccgggaccgagacgaccacaaacgugcugcggugggcuauccuuuuuauggcccuguauccgaauauucaaggacaggugcagaaggaaaucgaucucauuaugggcccuaacgggaaacccuccugggacgacaagugcaaaaugccuuacaccgaggccguccugcacgaagugcuucgcuucuguaacaucguuccccugggaaucuuucacgcuacaucugaggaugcgguggucagaggcuauagcauucccaagggcaccacggugaucacaaaucucuacuccguucauuucgacgaaaaauauuggcgggauccugagguguuccacccggagagauuucuggacagcucuggguacuucgccaagaaggaagcucugguccccuuuucccucggacgccggcauugccugggcgagcaccuugccagaauggaaauguuccuguuuuucaccgcccuccugcaacgcuuucaucugcacuucccucacgagcuugugcccgaucucaaaccucggcuggggaugacacugcagccccagccguaccucauuugugcugaaagacgcuga

SEQ ID NO: 68110 - RNA, 1515 nt, Artificial Sequence
  derived and/or modified sequence opt5 from CYP2S1__Homo_sapiens__NP_085125
auggaggccaccggcacaugggcucugcuccuggcccuugcgcugcuccugcuucugacgcucgcucugagcgggaccagagcccggggacaccuucccccuggcccgacaccccucccucugcuugggaaccugcuccagcugcgccccggagcccuuuacuccggccugaugagacucucuaagaaauaugggccuguguucaccaucuaccugggacccuggcggccugucguugugcuggugggccaagaagcuguccgcgaggcccucggcgggcaggcugaagaguuuagcggaagaggcacaguggccaugcuggaagggaccuucgacggacauggcguguuuuucuccaauggggagcgguggcgccagcuuagaaaguuuacaaugcuggcgcuccgggaucugggaaugggcaaacgcgagggcgaggaacuuauucaggccgaagcuagaugccugguugagaccuuccaagggacggagggacggccguuugaccccucucuccugcuggcccaggcuaccagcaacgucguguguucccuccuguucggccuucgcuuuucuuaugaagauaaggaguuccaggccguugugagagcggccgggggaacacugcucggcgucagcucccaagggggacagaccuacgaaauguuuagcugguuccugcggccucuucccggcccucacaaacagcugcuccaucacgugucuacacuggcugccuuuaccgugcgccagguccagcaacaucagggcaaucuggacgcuuccgggcccgccagagaucucguugacgccuuccugcuuaagauggcucaggaggaacaaaacccgggaacggaguucacaaauaagaacaugcugaugaccgugaucuaucuccuguuugcgggcacaaugaccgugagcaccacagucggguacacgcugcuucuccugaugaaauauccucacgugcagaaguggguucgggaggaacugaauagagagcucggagccggccaggcucccucucugggggaucgcacccggcuuccuuacacagacgccgugcugcacgaagcccagagacuccuggcucugguccccaugggcauuccccgcacccuuaugcggacaaccagauuccgcggauacacgcucccucaaggcacagagguguuuccgcugcugggguccauccuccaugaucccaacauuuucaaacacccugaagaguuuaaucccgaccgguuccuggaugccgacggaagauuucgcaagcaugaggcguuccuuccuuuuagccugggcaaacggguuugccucggggaaggacuggcuaaggccgagcuguuccuguuuuucaccaccauccuccaggccuuuucucuggaaucccccuguccgccugauacacugagccucaagcccaccguguccggccuguucaacaucccucccgcuuuccagcuucaggucagaccuacagaccugcacucuacgacccaaacacgcuga

SEQ ID NO: 68111 - RNA, 1635 nt, Artificial Sequence
  derived and/or modified sequence opt5 from CYP2U1__Homo_sapiens__NP_898898
augagcucccccggcccuucucagccgcccgccgaggacccucccuggccugcuagacugcuccgggcgccccuggggcuucugcgccucgauccuagcggaggcgcccugcuucugugcgggcucguggcucugcugggaugguccuggcucagacggcgcagagcccggggcaucccgcccgggccuacccccuggccucuggucggaaacuucggccacguucuucugcccccguuucuccgcagacggucuuggcugagcucccgcacaagagccgcuggcauugacccuucugugaucgggccccaagugcuucuggcccaucucgcucgggucuacggaagcauuuucuccuuuuucaucggccacuaucuggugguugugcugagcgauuuucauucuguccgcgaagcccucgugcagcaggcggagguuuucuccgacagaccucgggugccccugauuagcaucgucacgaaggaaaaaggggugguguuugcccacuacggacccgucuggcgccagcaaagaaaguucucucauuccacccuucggcacuuuggccuggggaaacucagccuggagccuaagaucauugaagaguucaaauauguuaaggcugagaugcagaagcacggagaagauccguuuugucccuucucuaucauuuccaaugccgugagcaacaucauuugcucccuuuguuuuggccagagauucgacuacacaaauucugaguucaaaaagaugcugggcuuuaugagccgcgggcucgaaaucugccugaacucccaggugcugcucgucaauauuuguccuuggcuguauuaccuucccuucggaccuuuuaaagagcugcggcaaaucgagaaggauaucaccagcuuccucaaaaagauuaucaaggaccaucaggaaucucuggauagagagaacccccaggacuuuauugauauguaucuucugcacauggaagaggaacgcaaaaauaacuccaauagcucuuucgacgaggaguaccucuuuuacaucauuggcgaucuguucaucgcugggacagacaccacaaccaacagccugcucuggugccugcuuuauaugucccugaauccggacgugcaggaaaagguucaugaggaaaucgagcgggugauuggagccaacagagcgccuucucucacggauaaagcccaaaugcccuacaccgaagcuacaaucauggagguccagcgccugaccgugguugugccucuggccauuccccacaugacaagcgagaauaccguccuucagggcuauacgaucccuaaggggacacucauucugcccaaccugugguccgugcaccgggacccggcuaucugggaaaaaccugaggauuuuuaccccaauagauuccucgacgaucaaggacagcugaucaagaaagaaaccuuuauucccuucggcaucggcaagcgcgucuguaugggggagcagcuugccaagauggaacuguuucucauguucgugagccugaugcagucuuucgccuuugcucugccugaggacuccaaaaagccgcuucucacaggacgguucggccugacccuggcgccccauccuuuuaacauuaccaucagcagacgcuga

SEQ ID NO: 68112 - RNA, 1473 nt, Artificial Sequence
  derived and/or modified sequence opt5 from CYP2W1__Homo_sapiens__NP_060251
auggcccugcuccugcuucuguuccucggccugcuugggcuguggggacuccugugcgcuugugcccaggaccccagcccugcggcuagauggccgcccggcccucggccccugccucucguggggaaccugcaccuucugcgccucucccaacaggauagaucucugauggagcuuagcgaacgguacggacccgucuuuaccguucaucugggccgccagaagacaguggugcucacgggguucgaggccgucaaagaagcccuggcuggaccuggccaggagcuggccgacagaccgcccaucgcuauuuuucaacucauccagcggggcgggggaauuuucuuuuccucuggcgcccgcuggagagcggcccggcaguucaccgugcgcgcucugcacagccuugggguuggaagagaaccuguggccgauaagauccugcaggagcucaaaugccuguccggccaacuugacggguaucggggacgccccuuuccucuggcucuccugggcugggcccccucuaauauuacauucgcgcugcucuuuggcagacgguucgauuaccgcgacccggucuuugugagccugcuugggcugaucgaugagguuauggugcuccugggauccccuggccuucagcuguucaacgucuaucccuggcucggggcccugcugcagcuccauagaccugugcugcggaagaucgaagaggugagagcuauucuucgcacccugcucgaagcccggagaccccacgucugucccggagacccuguuugcagcuacguggaugcucugauccagcaaggccagggggacgauccggagggacuguuugccgaggccaaugcuguggcguguacacuugacauggucauggccggcaccgaaacaaccucugcuacgcuccagugggccgcccugcugaugggccgccaucccgaugugcaagggcggguucaggaggaacucgacagagugcugggaccuggccgcacaccccggcuugaggaccagcaggcucugccuuauacauccgccguccuccacgaagugcaaagauucauuacccugcugccccacguuccgcgcugcacagcggcugauacccagcuugggggauuccuccugccuaaaggcacgcccgugaucccucugcucacaagcguccugcuugacgagacccaguggcagacacccgggcaauuuaacccuggccauuuccuggaugccaauggacacuuugugaagcgggaggccuuccuccccuuuucugcuggcagacgcgucugugugggggaacggcuggccagaaccgagcuguuccuucucuuugcuggacugcugcagcgguaccgccuccugccgccucccggcguuucccccgccagccuugacaccaccccugcgagagccuucacgaugcggccgagagcucaggcccugugcgcugugccccgcccuuga

SEQ ID NO: 68113 - RNA, 1410 nt, Artificial Sequence
  derived and/or modified sequence opt5 from CYP39A1__Homo_sapiens__NP_057677
auggagcugaucagccccaccgugauuaucauucucggcugccuggcccuuuuccugcuccugcagagaaagaaccuucggcgcccuccguguaucaaaggguggauucccuggaucggagucggcuuugaguucgggaaggcuccucuggaauuuaucgaaaaagccagaauuaaguacggacccaucuucacaguuuuugcgaugggcaaucggaugacguucgugaccgaggaagaggggauuaacguguuucucaaauccaagaaggucgacuucgagcuggcugugcaaaauaucguuuaucgcacagccucuauuccuaaaaacguguuucuggcccuccacgaaaagcuguacaucaugcuuaaaggaaagaugggcaccgucaaucugcaucaguucacaggccagcucaccgaggaacugcacgagcagcuugagaaccuggggacacauggaaccauggaucucaauaaccuggugagacaucugcucuaucccguuacggugaauaugcuguuuaacaaaagccuuuucuccaccaauaagaagaaaauuaaggaauuucaccaauacuuccaggucuaugacgaggauuucgaauacggcucucagcugccugagugccuccugcggaacuggagcaaauccaagaaaugguuucuugaacuguucgagaagaauaucccggacaucaaggcuuguaaaucugccaaggauaacagcaugacacuccugcaggcuacccuggacauuguggagacagaaaccuccaaagagaauagccccaacuaugggcuccugcuucugugggccucucucuccaacgcggugccugucgccuuuuggacgcuggcuuacguucuuagccaccccgauauccacaaggccauuauggaaggaaucucuuccguguucggcaaagcugggaaggacaaaauuaaggugagcgaggaugaccuggaaaaucuccugcugaucaaguggugcguccucgagacaauccgccugaaagccccuggagugauuaccagaaagguugugaaacccgucgagauccuuaacuacauuaucccgucuggcgaucugcucaugcuguccccuuuuuggcugcaucggaaucccaaguauuucccugaacccgagcuuuuuaaacccgaacgcuggaagaaggcgaaccucgagaaacacagcuuccuggacuguuuuauggccuucggcuccgggaaguuucaaugcccugcuagaugguucgcccugcucgaagugcagauguguauuauccugauccuuuacaaauaugauugcucucugcucgacccgcugcccaagcagagcuaccugcaucuuguuggagugccucagcccgagggccaaugucggauugaguauaaacagcgcaucuga

SEQ ID NO: 68114 - RNA, 1182 nt, Artificial Sequence
  derived and/or modified sequence opt5 from CYP3A43__Homo_sapiens__NP_001265850
auggaccugauccccaacuucgccauggagaccugggugcucgucgcuacaagccugguucuucuguacauuuauggcacgcacucccauaagcucuuuaaaaagcuggggaucccuggaccgacaccccuuccuuuccugggcaccauucucuuuuaccugagacggucucugaauaaaauccccagcugggccugguggcucaccccugugauucccgcgcugugggaagcugaggccgggggauccccuaaggugcgcucuagcagaccggcccuucccacaugggucuucggcauccugaccgaaaacgugaugaaaaauacagagaagugcggggcucucuuuccuuuccugacccccguuuuugaagcccuuaacaucggacuguucccuaaggaugugacgcacuuucucaaaaauuccauugagcggaugaaggagucucgccugaaagacaagcagaaacauagagucgauuucuuucaacagaugaucgacagccagaacuccaaggaaaccaagagccacaaagcucugucugaucucgagcugguggcccaguccauuaucauuaucuucgcggccuaugacacaaccagcacaacccuucccuuuauuauguacgaacuggcuacgcauccggauguucaacagaagcuccaggaggagaucgacgccgugcugccuaauaaagcucccgucacauaugaugcccuugugcagauggaauaccuggacaugguggucaacgagacccuccggcuguucccuguugugucucgcgugacaagagucuguaagaaagauaucgaaauuaauggcguguucauccccaagggccuggcgguuauggugcccauuuaugcccuccaccacgacccuaaauacuggaccgagccggaaaaguuuugccccgagcgguucuccaagaaaaacaaggauagcaucgaccuguaccgcuauauuccuuuuggggcuggacccagaaauuguaucggcaugcgguucgcccuuaccaacaucaaacuggcugucauucgcgcccuccaaaauuuuucuuucaagccuugcaaagagacacagaucccccugaaacuugacaaccugccgauucuccagccugaaaagcccaucgugcugaagguucaucugagagaugggauuacguccggaccuuga

SEQ ID NO: 68115 - RNA, 1509 nt, Artificial Sequence
  derived and/or modified sequence opt5 from CYP3A4__Homo_sapiens__NP_001189784
auggcccugauccccgaccucgcuauggagaccuggcugcuucuggccgugagccucguccugcuuuaccuguauggcacacacucccauggacucuucaagaaacuggggauuccuggcccgacgccccugccuuuucucgggaacauccugucuuaccacaagggauucugcauguuugauauggaaugucauaaaaaguauggcaaaguuuggggguucuacgacggacagcaacccgugcuugcgauuaccgauccugacaugaucaagacagugcuggucaaggagugcuauagcguguuuaccaauagacggcccuucggcccuguuggcuuuaugaaauccgcuauuucuaucgccgaagaugaggaauggaagcgccucagaagccugcuuuccccgacauucaccucugggaaacugaaggagauggugcccaucauugcccaguacggagacguccucgugcggaaccugcgcagagaggcugaaacaggcaaaccuguuacccugaaggauguguuuggggccuauagcauggacgucaucacguccaccagcuucggagugaauauugauucucucaacaauccccaggacccuuuuguggagaacacaaagaaacugcuucgguucgauuuucuggaccccuucuuccucuccaucauuuuuccguuccugaucccuauucuugaaguccugaauaucuguguuuuuccccgcgaggugaccaacuuccucagaaagagcgugaaacggaugaaggagucucgccuggaagauacacagaaacacagagucgacuuucugcaacucaugaucgacucccagaauagcaaggagaccgaaucucauaaagcucuguccgaucuugagcugguggcccagagcauuaucuucauuuuugcgggcuacgaaacgacauccucuguucucagcuucaucauguacgagcuggccacccacccugacgugcagcaaaaacuucaggaggaaauugaugcuguccugcccaacaaggcucccccuacauaugacaccgugcuccagauggaguaccuggauaugguugugaaugaaacccugcggcucuuuccgaucgccaugcgccuggagagagucugcaagaaggacguggaaaucaacgggauguucauucccaaaggagucgugguuaugaucccuuccuaugcccuucaccgggaucccaaguacuggacagagccugagaaauuucugcccgaacgcuucagcaagaagaauaaagacaacauugauccguauaucuacacgccuuuuggcucuggccccagaaauuguauugggaugcgguucgcgcucaugaacaugaagcuggcccugaucagagugcuucagaacuucuccuuuaaaccuugcaaggagacccaaaucccccucaaacugagccugggaggccuccugcagccugaaaagcccgucgugcuuaagguugagucucgcgacgggacagugagcggagcuuga

SEQ ID NO: 68116 - RNA, 1509 nt, Artificial Sequence
  derived and/or modified sequence opt5 from CYP3A5__Homo_sapiens__NP_000768
auggaccugauccccaaccucgccguggagaccuggcugcuucuggcugucagccucguucugcuuuaccuguauggcacaagaacgcacggacucuucaagcggcuggggauuccuggcccgacaccccugccucuccuggggaaugugcuuuccuaccgccagggacuguggaaauuugauaccgaaugcuauaagaaauacggcaagaugugggggaccuaugagggacaacuccccgugcuggccaucacagacccugaugucauuagaaccgugcuuguuaaagaauguuacucuguguucacaaaccggcgcagccugggccccgucggcuuuaugaaguccgcgaucucucucgcugaggacgaagaguggaagcggauuagaagccugcuguccccuaccuucacgucugggaaacucaaggagauguuuccgaucaucgcccaguauggagaugugcugguucgcaaucuuagacgggaagccgagaaaggcaagcccgugacccugaaagacauuuucggggcuuacagcauggaugucaucacaggaaccuccuuuggcgugaacauugacagccucaauaacccucaggaucccuucguggaaucuacaaagaaguuucugaaauucggguuucuugacccucuguuccucuccaucauucuguuucccuuccugaccccggucuucgaggcccucaauguuagccuguuuccuaaggauacgaucaacuuccuuucuaaauccgugaaucgcaugaagaaaagcagacugaacgacaagcagaaacaucggcucgauuuucugcaacuuaugauugacucucaaaauuccaaggagacagaaagccacaaggcucuguccgaccucgagcuggccgcgcagucuaucaucuucauuuuugccggauacgaaaccacaagcuccgugcugagcuucacccucuaugagcuggcuacccaucccgauguccagcagaaacuucagaaggaaaucgacgccgugcugccuaacaaagcuccucccacauacgaugccguugugcagauggaguaucucgacauggucgugaaugagacgcugcgccuguuucccguugcgauuagacuugaacggaccugcaagaaagauguggagaucaacggcgucuucauuccgaagggcucuaugguggucauccccacauacgcccuccaccaugacccuaaguauuggaccgaacccgaggaauuucgcccugagagauucuccaaaaagaaagauagcaucgaccccuacauuuauacaccguuugggaccggaccucggaauuguaucggcaugagauucgcucugaugaacaugaagcuggcccucauucgcgugcugcagaacuuuucuuucaaacccugcaaggagacgcaaaucccucuuaagcuggauacacaggggcuccugcagcccgaaaaaccuauuguucugaagguggacagccgggauggaacccuuuccggcgaguga

SEQ ID NO: 68117 - RNA, 1608 nt, Artificial Sequence
  derived and/or modified sequence opt5 from CYP3A7-CYP3A51P__Homo_sapiens__NP_001243426
auggaccugauccccaaccucgccguggagaccuggcugcuucuggcugucagccucauucugcuuuaccuguauggcacaagaacgcacggacucuucaagaaacuggggaucccuggcccgacaccccugccuuuucucgggaaugcccuguccuuccggaagggauacuggaccuuugauauggaaugcuauaaaaaguaccgcaaaguuuggggcauuuaugacugucagcaacccaugcuugcgaucaccgauccugacaugauuaagacagugcuggugaaggagugcuacucugucuucaccaacagacggcccuuugggccugugggauucaugaaaaaugcuaucagcaucgccgaagaugaggaauggaagcgcauuagaucccuccugucuccgacauuuaccagcggcaaacuuaaggagaugguucccaucauugcccaguauggcgacgugcugguccggaaccuccgcagagaggcugaaacggggaaaccugugacccugaagcauguuuucggagccuacuccauggaugugaucacaucuaccagcuuuggcgucuccauugacagccugaauaacccccaggauccuuucguggagaauacaaagaaacuccugcgguuuaacccccuugacccguucgugcugucuaucaaggucuuuccuuuccucacccccauucuggaagcucuuaauaucacgguuuucccucgcaaagugaucuccuuucugacaaagagcgugaaacagauuaaggaggggagacucaaagagacccaaaagcaccgggucgauuuccugcagcugaugaucgacucucagaacuccaaggauagcgaaacacauaaagcccucucugaccuggagcuuauggcgcaguccauuaucuuuauuuucgccggauacgaaaccaccagcuccgugcugucuuuuaucaucuaugagcucgcuacacaccccgacguucaacagaaggugcagaaagaaauugauacgguccugcccaauaaggccccuccgaccuacgacacagugcuucagcuggaguaucucgauaugguugugaacgagacccugcgccuguuccccgucgcuaugagacucgaacggguguguaaaaaggacgucgagaucaauggcauguuuauuccuaagggggugguugugaugauccccagcuacguccugcaucacgauccuaaauauuggacagaacccgagaaguuccuuccggaacgcuuuuccaaaaagaacaaagacaauauugauccuuacaucuauacccccuucggaagcggcccuagaaacugcaucggcaugcgguuugcccuggugaacaugaagcucgcgcugguuagagugcugcaaaauuucucuuuuaagcccuguaaagagacgcagauuccucuuaagcuccgcuucgggggacugcugcucacagagaaacccaucguccugaaggccgaaucccgggacgagaccuucguggauauggaaccgauucacauggacuuucuuagaagccuggcuuuccagggcccucaucucugcuuuuucugggagcugcugugucccaccauccgcucucgguga

SEQ ID NO: 68118 - RNA, 1512 nt, Artificial Sequence
  derived and/or modified sequence opt5 from CYP3A7__Homo_sapiens__NP_000756
auggaccugauccccaaccucgccguggagaccuggcugcuucuggcugucagccucauucugcuuuaccuguauggcacaagaacgcacggacucuucaagaaacuggggaucccuggcccgacaccccugccuuuucucgggaaugcccuguccuuccggaagggauacuggaccuuugauauggaaugcuauaaaaaguaccgcaaaguuuggggcauuuaugacugucagcaacccaugcuugcgaucaccgauccugacaugauuaagacagugcuggugaaggagugcuacucugucuucaccaacagacggcccuuugggccugugggauucaugaaaaaugcuaucagcaucgccgaagaugaggaauggaagcgcauuagaucccuccugucuccgacauuuaccagcggcaaacuuaaggagaugguucccaucauugcccaguauggcgacgugcugguccggaaccuccgcagagaggcugaaacggggaaaccugugacccugaagcauguuuucggagccuacuccauggaugugaucacaucuaccagcuuuggcgucuccauugacagccugaauaacccccaggauccuuucguggagaauacaaagaaacuccugcgguuuaacccccuugacccguucgugcugucuaucaaggucuuuccuuuccucacccccauucuggaagcucuuaauaucacgguuuucccucgcaaagugaucuccuuucugacaaagagcgugaaacagauuaaggaggggagacucaaagagacccaaaagcaccgggucgauuuccugcagcugaugaucgacucucagaacuccaaggauagcgaaacacauaaagcccucucugaccuggagcuuauggcgcaguccauuaucuuuauuuucgccggauacgaaaccaccagcuccgugcugucuuuuaucaucuaugagcucgcuacacaccccgacguucaacagaaggugcagaaagaaauugauacgguccugcccaauaaggccccuccgaccuacgacacagugcuucagcuggaguaucucgauaugguugugaacgagacccugcgccuguuccccgucgcuaugagacucgaacggguguguaaaaaggacgucgagaucaauggcauguuuauuccuaagggggugguugugaugauccccagcuacguccugcaucacgauccuaaauauuggacagaacccgagaaguuccuuccggaacgcuuuuccaaaaagaacaaagacaauauugauccuuacaucuauacccccuucggaagcggcccuagaaacugcaucggcaugcgguuugcccuggugaacaugaagcucgcgcugguuagagugcugcaaaauuucucuuuuaagcccuguaaagagacgcagauuccucuuaagcuccgcuucgggggacugcugcucacagagaaacccaucguccugaaggccgaaucccgggacgagaccgugagcggcgcuuga

SEQ ID NO: 68119 - RNA, 1503 nt, Artificial Sequence
  derived and/or modified sequence opt5 from CYP46A1__Homo_sapiens__NP_006659
augagccccggccugcuccugcuuggguccgccgugcugcucgcuuucggacugugcuguaccuuuguccacagagcccggucucgcuacgagcauaucccuggcccgcccagaccuagcuuccuucuggggcaccuccccugcuuuuggaagaaagacgaaguuggaggccgggugcugcaggauguguuccuggacugggcgaagaaauaugggccugucgugcgcguuaacguguuucauaagacauccgucauugugacgucucccgagagcguuaaaaaguuccucauguccaccaaguacaauaaagauucuaagauguauagagcucugcaaacaguguuuggagaacggcuuuucggccagggccuggucagcgaguguaacuacgaacgcuggcacaaacagagacgggugaucgaccucgccuuuucccgcagcucucuggugucccuuauggagaccuucaaugagaaggccgaacagcuggucgagauucucgaagcuaaagccgaugggcaaacaccuguuagcaugcaggacaugcugaccuauacagcuauggauauccuggccaaggcggccuuuggaauggagaccucuaugcuccugggcgcucagaagccgcuuucccaggccgugaaacugaugcucgaggggauuacggcuagcagaaacacccuggccaaguuccuucccggaaaacggaagcaacugcgcgaagugagagagucuauccgguuucuccgccaggucggcagagacugggugcagcggagacgcgaagcgcugaaaagaggggaggaaguuccugccgauauccugacacagauucucaaggcugaggagggagcccaagacgaugaaggccugcuugacaauuucgugaccuucuuuaucgcuggccaugagacauccgccaaccaccuggccuucaccgucauggaacucagccggcagcccgagauuguggcucgccugcaggcggaaguugaugaggugaucggguccaaacgguaccuugacuuugaggaccugggaagacuccaauaucugucucagguccugaaggaaagccuccgccuguacccucccgccuggggcacguuccggcuucuggaggaagagacacucauugauggggugagagucccgggaaauaccccucugcuguuuuccacauacgugaugggccgcauggacaccuauuucgaagauccccuuaccuuuaacccugaccgguucgggcccggagcucccaagccuagauuuacauacuucccguuuagccucggccaccgcucuugcaucggccagcaguucgcccaaauggagguuaaaguggucauggccaagcugcugcagcggcucgaguuuagacuggugcccgggcagcgguucggacuucaggaacaagcuacgcugaaaccucucgaucccguucuguguacccugcgcccuagaggcuggcagcccgccccgccucccccucccugcuga

SEQ ID NO: 68120 - RNA, 804 nt, Artificial Sequence
  derived and/or modified sequence opt5 from CYP4A11__Homo_sapiens__XP_011539132
augagcguguccguccugucucccagcagacuccugggcgacguuuccgggauccuucaggccgcuucucugcucauucugcuucugcuccugaucaaggccgugcaacuguaccuccaccggcaguggcugcuuaaagcgcugcagcaguucccuugcccgcccagccauuggcucuuuggacacauucaagagcugcagcaggaucaggaacuucaacgcauccagaaguggguggagaccuucccuuccgcuuguccccauuggcuguggggcgggaaagucagagugcagcucuaugacccugauuacaugaagguuauucugggacggucugcccugagcugccucuccgaccccaaaagccacggcucuuaucgcuuucuggccccuuggaucggguacggacuucugcuccugaacggccagacaugguuccaacauagacggaugcuuacgccggcuuuucacuaugauauccugaagcccuacgugggccucauggccgacuccguccgcgugaugcuggauaagugggaggaacugcucgggcaggacagcccucuggaaguuuuccagcacgugucucuuaugacccuggauacaauuaugaaaugugcuuuuucccaucaaggaagcauccaggucgacagacccucugauccuaccgaggagggcuccacaaccgaagggggaggcgccggggaggaccaggaagaggaggcguucggauuuagcggcuaucccccgcucggccagaauggggaaugggagcaccuggugcggcaaggaccucccugcuga

SEQ ID NO: 68121 - RNA, 1494 nt, Artificial Sequence
  derived and/or modified sequence opt5 from CYP4B1__Homo_sapiens__NP_001306090
auggugcccagcuuccugucccucucuuuuagcucccugggccuuugggccucugggcugauccucguccugggauuccuuaagcugauucaccuccugcugagacggcagacccucgcuaaagccauggacaaguuuccuggcccgcccacacauuggcuguucgggcacgcgcuugagauccaagaaacgggaagccuggauaaaguuguguccugggcucaucaguuuccuuacgcccacccccucugguucggccaguuuauuggguuccugaacaucuaugagccugacuacgccaaggcuguguauucucgcggaggcagaggccuucugguccucgaagggcccaaauggcugcagcaucggaagcugcucaccccuggauuucacuacgaugugcugaagccguauguugccguguucacagagagcacccgcauuaugcuugacaaaugggaagagaaggcuagagagggcaaauccuuugauaucuucugcgacgucgggcacauggcccugaauacacucaugaaguguaccuuuggacggggcgauacagggcugggacauagccgcgacucuuccuacuaucuugcggugagcgaucugacccuccugaugcaacagagacugguuucuuuccaguaccacaacgacuucaucuacuggcucacgccccauggccggcgcuuucugagagccugccagguggcucacgaucacaccgaccaagucauucgggaacgcaaagccgcccuucaggaugagaaggugagaaagaaaauccagaaucggcgccaucuggacuuccucgacauucugcuuggcgcuagagaugaagacgauaucaagcuguccgacgcggaucuccgggccgagguggacacauuuauguucgaggggcacgauaccacaaccagcggaauuucuugguuucuguauuguauggcucuguacccugaacaucagcacagaugccgcgaggaaguccgggagauccucggcgaccaagauuucuuucagugggacgaucuggggaaaaugacguaucuuacaauguguauuaaggaauccuucagacuguaucccccuguuccccagguguaccgccaacucagcaaaccggugaccuuugucgacggacggucccugccugccggcucucugaucagcaugcauaucuacgcccuucacagaaacuccgcuguguggcccgacccugagguuuucgauagccuccgcuuuucuacagagaaugccuccaagcggcaccccuucgcuuuuaugcccuucagcgcggggccuagaaacugcauuggacagcaguucgccaugucugaaaugaaaguggucaccgcuaugugucugcugcgcuuugaguucagccucgacccgucccggcugcccaucaagaugccucagcuugugcugagaucuaagaauggcuuucaucuccaccugaaaccccugggcccugggagcggaaaguga

SEQ ID NO: 68122 - RNA, 1575 nt, Artificial Sequence
  derived and/or modified sequence opt5 from CYP4F11__Homo_sapiens__NP_067010
augccccagcugagccucuccuggcugggccuugggccuguggccgcuucuccguggcugcuccugcuucuggucggaggcagcuggcuccuggccagaguucuggcguggaccuacacauucuaugacaacugccggcgccuccaauguuuuccccagccucccaagcagaauugguucugggggcaccagggacuggugacgccuaccgaggaaggcaugaaaacacuuacccaacuggugacaaccuacccccagggguuuaagcucuggcugggaccuacauucccgcuucugauccucugccaucccgauauuaucagaccuauuaccuccgcuucugccgccgucgcucccaaagacaugaucuuuuauggcuuccugaagccuuggcugggcgaugggcuccugcuuagcggaggcgacaaauggucccggcaccgcagaaugcugacgcccgccuuucauuucaacauucucaagccguacaugaagaucuuuaauaaaucugugaacaucaugcacgauaaguggcagcggcuggcuagcgagggguccgcccgccuugacauguucgaacauauuagccugaugacccucgauucucugcagaaauguguguuuuccuucgagagcaauugccaagaaaagccuucugaguauaucgcggccauucuggagcucuccgcuuuuguugagaaaagaaaccagcagauccugcuucacacagacuuccuguacuaucucacccccgauggacagcgguuccgcagagccugucaccugguccaugacuuuacagaugcugugauucaagaacggcgcugcacccuuccuacgcagggcaucgacgauuuccugaagaauaaggccaaaagcaagacacucgacuuuauugacguucugcugcucucuaaagaugaagacgggaaggagcuguccgaugaggacaucagagcggaagccgauaccuucauguuugagggacacgacacaaccgcuagcggccuuuccugggugcuguaccaucucgccaaacaccccgaauaccaggagcaaugucggcaggaaguccaggagcugcugaaggaucgcgagcccaucgaaauugagugggacgaucuugcucagcucccuuuccugaccaugugcaucaaagaaucucugagacuccacccgcccgugccugugauuagccgguguugcacacaagacuuuguccugcccgauggcagaguuaucccuaaggggauugugugucuuaucaacaucauuggaauccauuauaaucccacgguguggccggacccugaggucuacgaccccuuccgcuuugaucaggaaaacauuaaggagcgguccccucuggccuucauccccuuuagcgccggcccuagaaauugcauugggcaggcuuucgcgauggccgagaugaaagugguucucgcucugacccugcuucacuuucgcauccuccccacacauaccgaaccgcggagaaagccugagcugauccugcgcgccgaaggaggccucuggcugcggguggagccccuuggggccaacucucaguga

SEQ ID NO: 68123 - RNA, 1575 nt, Artificial Sequence
  derived and/or modified sequence opt5 from CYP4F12__Homo_sapiens__NP_076433
augagccugcucucccugcccuggcuuggccugagaccuguggccaccucuccguggcuccugcuucugcucgucguugggagcuggcugcuggcucggauccucgccuggacauacgcguucuauaacaauugccgcagacugcaguguuuuccccaaccucccaagcggaacugguucuggggacaccuuggccugauuacgccuaccgaggaggggcucaaaaauuccacacagaugucugcuaccuacagccagggauuuacaguguggcugggccccaucauuccuuucaucgugcuuugccauccggacaccauucgcuccaucacaaacgccucugccgcuaucgcccccaaggauaaucuguuuauuagauuccucaaaccuuggcugggggagggaauccugcucagcggcggcgacaaguggucccggcaccgcagaaugcugacccccgcuuuucauuucaacauucuuaaaagcuauaucacgauuuuuaauaagucugccaacaucaugcuggauaaguggcagcaccucgcguccgaagggagcucucggcuggacauguucgagcauauuucccuuaugacccuggauagccuccaaaaauguaucuuuucuuucgacucccacugccaggaacgcccuagcgaguacaucgccacaauucuggagcuguccgcucucgucgaaaagagaucucagcacauccugcagcauauggauuuucuuuauuaccugagccacgacggacggcgcuuccauagagccugucggcucgugcacgauuucaccgacgcuguuauucgcgagagacggagaacacugcccacccaaggcaucgaugacuuuuucaaagauaaggccaaauccaagacgcuugacuuuauugacgugcugcuccugagcaaggaugaagacgggaaagcgcugucugaugaggacauccgcgccgaggcugauacauucauguuuggaggccacgacaccacagccuccgggcucagcuggguccuguauaaucuugcucggcauccggaauaccaggagagaugccgccaggaagugcaggagcugcucaaggaucgggacccuaaagaaaucgagugggaugaccuggcccaacugcccuuccuuaccauguguguuaaggagucucucagacugcacccucccgcccccuuuauuagccgcugcuguacccaggauaucgugcugccugacggacgggucauuccgaaaggcaucacaugccucauugacaucaucggcgugcaucacaaccccacgguguggccugaucccgaagucuacgacccuuucagauuugaucccgaaaauuccaaggggcgcucuccgcuggcuuucauuccuuuuagcgcgggaccccggaacuguaucggccaggccuucgcuauggccgagaugaaaguugugcuugcccugaugcuccugcauuuuagauuccugccugaccacaccgagccccgccggaagcucgaacuuauuaugagagcugaagggggacuguggcugcggguggagccucucaaugucucccugcaauga

SEQ ID NO: 68124 - RNA, 1596 nt, Artificial Sequence
  derived and/or modified sequence opt5 from CYP4F22__Homo_sapiens__NP_775754
augcugcccaucaccgacagacuccugcaccuucugggccucgagaagacagccuuccggauuuacgcugugagcacgcugcuucuguuucuccuguucuuucuguuccgccuccugcuuagauuucugcggcucugccgcuccuucuauaucaccuguagacggcugcgcugcuuuccucagccgcccagacggaacuggcuucuggggcaucucggaauguaccugccuaaugaagccggccugcaagaugagaaaaagguccucgacaacaugcaccauguucugcuuguguggauggggcccgugcugccucuccugguccuugugcaccccgauuauauuaaaccucugcucggagcgucugcugccaucgccccgaaggacgaucuguucuacggcuuucugaaacccuggcucggggacggacugcuucugagcaagggcgauaaguggucccgccauagacggcuccugaccccugcuuuccacuuugacauucuuaaacccuauaugaagaucuucaaucagucugccgauaucaugcacgcuaaauggcgccaucuggccgaaggcagcgcgguuucccucgacauguuugagcacauuucucugaugacacuggauagccuccagaaguguguguucuccuacaacagcaauugccaggagaaaaugucugacuauaucuccgccauuaucgaacugagcgcucuuucugucagacggcaauaccgccugcaucacuaccucgauuucauuuauuacagauccgccgacgggcggagauuucgccaggcuugugacauggugcaccauuucacaaccgagguuauccaggaacggagacgcgcccugcggcagcaaggagcggaggccuggcugaaggcuaagcagggcaaaacacuugauuuuauugacgugcuccugcuggccagagaugaagacgggaaggagcucagcgaugaggacauccgcgcugaagccgauaccuucauguuugagggacacgacacgaccucuuccggcaucagcuggaugcuguucaaccuugccaaauauccugaauaccaggagaagugccgggaagagauucaggaggucaugaaagggagagaacuggaggaacucgagugggaugaccugacacaacugcccuuuaccacaauguguaucaaggaaucccuucgccaguauccgccugugacccucgugucucggcagugcacggaggauauuaaacugcccgacggaagaaucauuccuaagggcaucaucugucuggucagcauuuacggcacacaucacaaucccaccguuuggcccgacuccaagguguauaacccuuaccgcuucgauccggacaauccccaacagcggagcccucucgcuuacgugcccuuuucugcggggccuagaaacugcaucggacaguccuucgccauggcugagcugcgggucgugguugcccuuacacugcuccgcuuuagacugagcguggaucggaccagaaaaguccgccggaagcccgaacugauucuuagaaccgagaauggccucuggcugaaaguggaaccgcugccuccccgcgccuga

SEQ ID NO: 68125 - RNA, 1563 nt, Artificial Sequence
  derived and/or modified sequence opt5 from CYP4F2__Homo_sapiens__NP_001073
augagccagcugucccucucuuggcugggccuuuggcccguggccgcuagcccuuggcugcuccugcuucuggucggggccuccuggcuccuggcgcacguucuggcuuggaccuacgccuucuaugacaacugcagacggcuccgcuguuuuccgcaacccccuagacggaauugguucuggggacaucagggcauggugaaccccacagaggaagggaugcgcgugcugacgcagcuugucgccaccuacccucagggauuuaagguguggaugggccccaucucuccucugcucagccugugccacccggauauuaucagauccguuauuaaugcuucugccgcuaucgcccccaaagacaaguucuuuuauagcuuccuugagccuuggcugggggauggacuccugcuguccgcgggcgacaaauggagccggcaucgcagaaugcucacacccgccuuucacuucaacauucugaagccuuacaugaaaaucuuuaaugaaucugugaacaucaugcaugcuaaguggcaacuucuggccuccgagggcagcgcuugucucgauauguucgaacacauuucucugaugacccuugacucccugcagaagugcgucuuuagcuucgauucucacugucaggagaaacccuccgaguauaucgccgcgauucucgaacugagcgcccugguguccaagcggcaucacgagauccuccugcauauugacuuucuuuacuaucugacaccggaugggcagcgcuucagacgggcuugccgccucguucacgacuucaccgaugccgugauccaagaaagacggcgcacacugccuucucagggagucgacgauuuucuucaggcuaaagccaagagcaaaacccuggacuucauugacgugcuccugcuguccaaggaugaggacggcaagaaacucagcgaugaggacaucagagccgaagcugauacguuuauguucgaggggcacgacaccacagcgucuggacuguccugggugcuuuaccaucuggccaagcaccccgaauaccaggagcgguguagacaagaaguccaggagcuccugaaagaucgcgagccuaaggaaaucgagugggacgaucuggcucaucuucccuuucucaccaugugcaugaaagaaagccugcggcugcaucccccuguuccggugauuucuagacacgugacacaggacaucguccuccccgauggccgcgugauuccuaaggggaucauuugucugaucagcguuuucggaacccaccacaaucccgccguguggccugaccccgaggucuaugacccguuucgguucgauccugaaaacaucaaagagagaucuccccuugccuuuauuccuuucuccgcuggcccccgcaauugcaucggccaaacguuugccauggcggagaugaaggugguucuggcucucacacugcugcgguucagagugcuuccugaccauaccgaaccccgccggaagccggagcucguccugagagccgaagggggacuguggcuccgcguggagccucugagcuga

SEQ ID NO: 68126 - RNA, 1563 nt, Artificial Sequence
  derived and/or modified sequence opt5 from CYP4F3__Homo_sapiens__NP_000887
augccccagcugagccucuccucucugggccuuuggccuauggccgcuagcccguggcugcuccugcuucuggugggggccuccuggcuccuggcgagaauccuggcuuggaccuacacauucuaugacaacugcugucggcuccgcugcuuuccccaaccucccaagagaaauugguuccugggacaccuuggccugauucauucuagcgaggaagggcuccuguacacgcagucccuugccuguaccuuuggagauaugugcuguuggugggucggcccuuggcacgccaucguucggauuuuccaucccacauauaucaaaccugugcuguuugcuccggccgcuauugugcccaaggacaaagucuucuacucuuuucucaagccuuggcugggggauggacugcuccugagcgccggcgagaaauggucccgccacagacggaugcuuacccccgcguuccauuuuaacauccugaagccuuauaugaagaucuucaaugaaagcgugaacauuaugcacgccaaauggcagcuccuggcuucugagggcuccgcccgccuugacauguuugaacacaucagccugaugacacucgauucucugcagaagugcguuuucuccuuugacagccauugucaagagaaacccucugaguacauugcugccauccuggaacucuccgcgcuggugaccaagagacaccagcagauucuucuguauaucgauuuccucuacuaccugacaccggacgggcagcgguuccgcagagccugccggcuuguccaugauuuuaccgacgcugugauucaagagcgcagacggacgcugccuagccagggaguugaugacuuccuccaggccaaagcuaaguccaagacccuggauuuuaucgacgugcugcuccugucuaaagacgaagauggcaagaaacuuagcgacgaggauauccgcgccgaggccgacacauucauguuugaagggcacgauaccacagcuuccggacugagcuggguccucuaucaccuggcgaagcaucccgaguaccaggaaagaugucggcaagaggugcaggaacugcuuaaagacagagagccuaaggagauugaaugggaugaccucgcccagcugcccuuccugaccaugugcaucaaagagucucuccgccugcaucccccugugccggcugucucccgguguugcacgcaagauauuguucuucccgacggcagagugaucccuaaggggauuaucugccugaucagcguguuuggaacacaccacaaucccgccgucuggccugaucccgaaguguaugacccguuccgcuuugacccuaagaacauuaaagagcggucuccccucgccuucaucccuuuuagcgcuggccccagaaauuguauuggccaggccuucgcgauggcugaaaugaagguugugcuggggcugacccuucuccgcuuucggguccugccugaucauacagagcccagacgcaaaccggagcuggugcuccgggccgaaggaggccuguggcuuagaguugagccucuguccuga

SEQ ID NO: 68127 - RNA, 1563 nt, Artificial Sequence
  derived and/or modified sequence opt5 from CYP4F8__Homo_sapiens__NP_009184
augagccugcucucccugucuuggcuuggccugagacccguggccgcuagcccuuggcuccugcuucuggucguuggggccuccuggcuccuggcgcggauccuggcuuggaccuacgccuucuaucacaacggacgcagacuccggugcuuuccgcagccccgcaagcaaaauugguuccugggccaucuugggcuggugacaccuacggaggaaggacucagagugcugacccagcuugucgccacauacccccagggcuuugugcgguggcuggggccuauuacccccaucauuaaccucugucacccugacaucguucgcucugugauuaauacaagcgaugcuaucaccgacaaagauaucgucuucuauaagacacugaaaccguggcugggagacggccuccugcuuuccgugggcgauaaguggagacaucaccggcgccugcucacccccgccuuucauuucaacauucugaaaccuuacaucaagaucuuuucuaagagcgcuaauauuaugcacgccaaauggcagagacuugcgauggagggguccacgugccuggacguuuucgaacacauuagccucaugacccuggauucucugcaaaaguguaucuuuuccuucgacagcaacugccaggagaaacccucugaauauauuacagccaucauggagcucuccgcucugguggucaagcggaauaaccaguuuuuccgcuacaaagauuuucuuuauuuccugaccccuuguggaagacgguuccaucgcgccugcagacucgugcacgacuuuacagaugcugugauccaggagcggagacgcacccugacgagccaaggcgucgacgauuuccuucaggccaaggcgaagucuaaaacacuggacuuuauugacguucuccugcuguccgaagauaagaaugggaaagagcucagcgacgaagauauccgggccgaggcugacaccuucauguuuggaggccaugauacaaccgccuccgggcugucuugggugcuuuacaaccuggcuagacaccccgaguaccaggaacgcugucggcaggaggugcaagaacuccugaaggacagagagccgaaagaaauugagugggaugaccuggcccagcuuccuuuccucaccaugugccugaaggagagccugcgccuccaucccccuauccccacauuugcccggggauguacgcaggaugucgugcugcccgacuccagaguuauuccuaaaggcaaugugugcaacaucaauaucuucgcuauucaccacaacccgagcgucuggcccgauccugaaguguaugaccccuuucgcuucgacccugagaaugcgcaaaagcggucucccauggccuuuaucccguucuccgcuggcccuagaaacuguauugggcagaaguuugccauggccgaaaugaaaguugugcuugcucugacccuccugcgcuuccggauccugcccgaucauagagagccucggcgcacacccgaaauuguccuuagagccgaggacggacucuggcugcggguggagccucugggcuga

SEQ ID NO: 68128 - RNA, 1578 nt, Artificial Sequence
  derived and/or modified sequence opt5 from CYP4V2__Homo_sapiens__NP_997235
auggccggccuguggcucgggcugguguggcagaaacuucugcucuggggagcugccagcgcgcugucccuugcuggcgccucucugguccucagccugcugcaaagaguugccuccuacgcucggaaguggcagcagaugcgccccaucccuaccguggccagagcuuauccgcucguggggcacgcccugcuuaugaagcccgacggacgggaguucuuucagcaaauuaucgaauacacagaggaauaucgccauaugccucugcucaaacugugggucggccccgugccuaugguugcgcuuuacaacgccgagaauguggaagucauucugacgucuagcaagcagaucgauaaauccucuauguauaaguuccucgagcccuggcuggggcugggacuccugaccagcacaggcaacaaguggagaucccggcgcaaaaugcuuaccccuacauuucacuucaccauucuggaggacuuucucgauaucaugaaugaacaggcuaacauccuggugaagaaacuugagaagcauauuaaucaggaagccuucaacugcuuuuucuacaucacacugugugcucucgacauuaucugcgagaccgccaugggcaaaaauauuggggcgcaaagcaacgaugacucugaguauguuagagccguguaccggauguccgaaaugaucuuucgcagaauuaagaugccguggcuguggcuggaucucugguaccugauguucaaggagggaugggaacacaaaaagagccuucagauccugcauacguuuaccaauucugucaucgcugagcgggccaacgaaaugaaugcuaacgaggacugucgcggcgaugggagaggauccgcccccagcaaaaauaagcggcgcgccuuccucgaccugcuucugucugugacagaugacgagggcaacagacucucccacgaagauauucgggaggaaguggacaccuuuauguucgaggggcacgacacaaccgcugcggccaucaauuggagccuguaucugcucggauccaacccugaaguccagaaaaagguugaucaugagcuggacgauguguucggcaaaucugacagacccgcuacgguggaggaucuuaagaagcugcgcuaccucgaaugcgucauuaaagagacacugcggcuguuuccuagcgugccccuuuucgccagauccguuagcgaagacugugagguggccggcuaucgcguccucaaggggaccgaagcugugaucauuccguacgcccugcaccgggauccuagauauuuucccaacccugaggaguuccagcccgaacgcuuuuuccccgagaaugcgcaaggacggcauccuuacgcuuauguuccguuuucugccggccccagaaacugcaucgggcagaaauucgccgugauggaagagaagacaauccuguccuguauucuccgccacuuuuggaucgagagcaaucagaaacgggaggaacugggacuugaaggccaacugauucucagaccuucuaacgggaucuggauuaagcugaagcgccggaaugcugacgagagauga

SEQ ID NO: 68129 - RNA, 1530 nt, Artificial Sequence
  derived and/or modified sequence opt5 from CYP51A1__Homo_sapiens__NP_000777
auggccgcugccgcgggcaugcugcuccuggggcuucugcaggcuggaggcagcgugcucgggcaagccauggagaaggucaccggaggcaaccugcuuuccaugcugcucaucgccugcgcuuucacacugucucugguuuaccucauuagacuggccgcugggcaccuugugcagcugcccgccggagugaaaagcccuccguauaucuuuucccccauuccuuuccucggccaugcgaucgccuuuggcaagucucccauugaguuccuggaaaaugcuuacgaaaaauaugggccugucuuuagcuucacgauggugggaaagaccuuuacauaccuucugggcuccgacgccgcugcccuccuguucaacucuaaaaaugaggaucugaacgcggaagacguuuauagccggcucaccacacccguguuugggaagggagucgccuacgaugugccuaauccgguuuuccuggagcagaagaaaaugcuuaaguccggccugaacaucgcucacuuuaaacagcaugugagcaucauugagaaggaaaccaaagaguauuucgaaucuuggggagaguccggggagaagaaugucuuugaagcccucagcgagcugaucauucuuacagcuucucacugucugcauggcaaggaaauccgcucccaacucaacgagaaaguggcccagcuguacgccgaccuggauggcggguucagccacgcugcguggcuccugcccggauggcuuccucugcccucuuucagacggcgcgacagagcccaccgggaaauuaaggauaucuuuuacaaagcuauucagaagcgcagacagucccaagagaaaaucgacgauauccuccagacccugcuugacgccacguauaaggauggccggccucugaccgacgaugagguggccgggaugcucauuggacugcugcucgcuggccagcauacaagcuccaccacaucugccuggaugggguucuuucuggcgcgcgacaaaacccuucagaagaagugcuaccuggaacagaaaacggucuguggagagaaucugcccccgcucacauaugaccaacugaaggaucuuaaccuccuggacagaugcaucaaagaaacccugcggcuccgcccucccauuaugaucaugaugagaauggcucggacaccucagaccguugccggcuacaccauuccucccggccaccaagugugugugagccccacagucaaucagcgccugaaggauuccuggguggagagacuugacuucaacccggaucgguaucugcaggacaaucccgccagcggggaaaaauuugcuuacguuccuuucggagccggcagacaucgcugcaucggggagaacuuugcuuaugugcagaucaagacgauuuggucuaccaugcuccggcuguacgaguucgaucugaucgacggauacuuucccacagucaauuauaccacaaugauucacaccccugaaaaccccgugaucagauacaagcgccgguccaaauga

SEQ ID NO: 68130 - RNA, 1515 nt, Artificial Sequence
  derived and/or modified sequence opt5 from CYP7A1__Homo_sapiens__NP_000771
augaugaccacaagccugaucuggggcauugccaucgcugccugcugcugccucuggcugauucuugggaucagacggcgccagacgggagaacccccucuggaaaacggccucauuccguaccuggggugugcgcuucaauucggagcuaauccccuggaguuucucagagccaaccagcggaagcacggccauguguuuaccugcaaacugauggggaaguauguccacuucaucacaaauccucuguccuaccauaaaguucucugucacggaaaguauuucgacuggaaaaaguuucauuucgccaccucugcuaaggccuuuggccaccgcagcaucgaucccauggacggcaacacaaccgaaaauauuaacgauacauucaucaaaacccugcaggggcacgcucuuaauucccugacggagucuaugauggaaaaccuccagagaauuaugcggccucccgugagcuccaauucuaagaccgccgcgugggugacagagggaauguacagcuuuugcuaucgcgucauguucgaggccggcuaccugaccaucuuugggagagaccuuacacggcgcgauacccaaaaagcucauauucugaacaaucucgacaacuucaagcaguuugauaaaguguucccugcccugguugcuggacugccgauccacauguucagaacggcccauaaugcgcgggaaaagcucgccgagucccugcgccacgaaaaccuucagaagagagagagcauuucugagcugaucucccuccggauguuucugaaugacacacuuagcaccuucgaugaccuggaaaaagcuaagacacaccucgugguccugugggccucucaggcuaacaccauccccgccaccuuuuggucccuguuccaaaugauucgcaacccugaggccaugaaagcugcgacagaagaggugaagagaacgcucgaaaaugccggccagaaaguuagccuggaggggaaccccaucugucuuucucaggcugagcugaaugaucucccugugcuggacuccauuaucaaggaaagccuucggcuguccucugccagccucaacauuagaaccgccaaagaggauuuuacacugcaucuggaagacggauccuauaauauccgcaaggacgauaucauugcucucuacccccagcugaugcaccuugacccggagaucuacccugauccccugaccuucaaguaugaccgguaccucgaugaaaacggcaaaacaaagaccacguuuuauugcaauggccugaaacugaaguacuauuacaugccuuucgggagcggagccacaauuugucccggcagacuuuuugcgauccaugagauuaaacaauuccucauccugaugcugucuuauuuugagcucgaacugaucgaggggcaggcuaagugucccccucuugaccagucccgcgccggacugggcauucucccgccccugaacgauaucgaguucaaguacaaauuuaagcaccuguga

SEQ ID NO: 68131 - RNA, 1521 nt, Artificial Sequence
  derived and/or modified sequence opt5 from CYP7B1__Homo_sapiens__NP_004811
auggccggcgaggugagcgcugccaccgggagauucucccuggaacggcucggacugcccggccuugcgcuggcugccgcccuccugcuucuggcucucugccugcugguccgcagaacacggcgcccuggggagccgccccucaucaagggauggcugccuuaccuuggcguugugcugaaccucagaaaagacccccugcgguuuaugaagacgcuucagaaacaacacggggauaccuucacagugcugcucggaggcaaguauauuaccuuuauccuggacccuuuccaguaccagcuggucauuaaaaaucauaagcagcucucuuuucgcguguucagcaacaagcugcuugaaaaagccuuuuccaucucucaacugcagaagaaucacgauaugaacgacgagcuccaucuguguuaucaguuccuucagggcaaaagccuggauauucuccuggaauccaugaugcaaaaucugaagcagguuuuugagccccagcuccugaaaacaaccucuugggacacagcugagcuuuacccuuucugcagcuccaucaucuuugaaauuaccuucacgaccaucuaugggaaggugauugucugugauaacaauaaguuuaucagcgagcugagagacgauuuccucaaauucgacgauaaguuugccuaccuggugucuaacauuccgaucgaacuucugggaaauguuaaauccauucgggagaagaucaucaaaugcuucagcucugagaagcucgcgaaaaugcagggcugguccgaaguguuucaaagccgccaggacguccuggagaaguauuacgugcacgaagaucuggagauuggggcccaucaccucggauuccugugggcuucuguggccaacacaauccccaccauguuuugggcuauguacuaucuucugagacacccugaagccauggcggccguccgggacgagauugaccgccuccugcaguccacaggccaaaagaaagggagcggauuccccauccaucugaccagagagcagcuugauucccucauuugucuggaaucuagcaucuuugaggcucugcggcucuccagcuacucuacgacaauccgcuucguugaagaggaccugacccuuuccagcgaaacaggcgauuauugcgugagaaagggcgaccugguggccauuuuuccucccguccuccacggggauccggagaucuucgaggcuccugaagaguuucgguacgacagauucauugaagauggcaaaaagaaaaccaccuuuuucaagcgcggaaagaaacugaaguguuaucugaugcccuucgggacaggaacgucuaaaugcccuggccgguuuuucgcccuuauggagaucaagcagcuccuggugauucugcucaccuacuuugaccuggaaaucaucgaugacaaacccauugggcuuaauuauagcagacuccuguucggaauccaguaccccgauuccgacguucuguuucgcuacaaggugaagucuuga

SEQ ID NO: 68132 - RNA, 1506 nt, Artificial Sequence
  derived and/or modified sequence opt5 from CYP8B1__Homo_sapiens__NP_004382
auggugcuguggggccccguccucggggcccugcuuguugugaucgcuggauaccugugccucccuggcaugcugagacagcggcgcccgugggagcccccucuugacaaggggaccgugcccuggcugggacacgccauggcguucagaaagaacauguuugaguuccucaagcggaugcgcacaaaacauggcgaugucuuuacggugcaacuugggggacaguauuucaccuuuguuauggacccucugagcuucggcuccauucucaaggauacacagagaaaacuggacuuuggccaguacgcuaagaagcuggugcugaaagucuucggguaucggucugugcaaggagaucacgaaaugauccauagcgccuccaccaagcaccuccgcggcgacgggcugaaagaucuuaaugaaacaaugcuggacucucucagcuuuguuaugcugaccuccaagggauggucucuggaugccagcuguuggcaugaggacucccucuucagauuuugcuacuauauucuguucacagcuggcuaccuuagccuguuuggguauaccaaagauaaggaacaggaccuccugcaggccggagagcuuuucauggaguuccggaaguuugaucuccuguucccccgcuuuguguacucucugcuguggccuagagaauggcucgaggucggccggcugcagcgccuuuuccacaaaaugcuguccgugagccacucucaagaaaaggagggcaucuccaacuggcucgggaauaugcugcaguuucuuagagagcagggagugccgagcgcuaugcaggacaaauucaacuuuaugaugcugugggccucucaaggcaauacggggcccaccuccuucugggcgcuccuguaccugcucaagcauccugaagccauucgggcuguccgcgaggaagccacacagguucugggagaggcuagacuugaaaccaaacagagcuuugccuucaagcugggcgcgcuccaacacacacccgugcuggacuccguggucgaggagacccugcggcuuagagccgcuccuacgcuccugcgccuggugcaugaagauuauacacucaaaaugucuagcgggcaggaguaccuguuucggcacggagacauccuugcccuguuccccuaucucuccguucacauggauccggacauccauccugaacccaccguguuuaaguacgauagauuccugaacccuaauggcagccgcaaggucgacuucuuuaaaacaggcaagaaaauucaccauuauaccaugcccugggggucuggaguguccaucugucccggccgguucuuugcucugagcgagguuaaacuuuucauucuccugauggugacccacuuugaucuggaacucgucgacccugauacaccgcugccccauguggacccucagagauggggguucggaacgaugcagcccucucacgauguccgcuuucgguacagacuucacccuaccgaguga

SEQ ID NO: 68133 - RNA, 477 nt, Artificial Sequence
  derived and/or modified sequence opt5 from CYS1__Homo_sapiens__NP_001032237
augggcagcggguccucuagaagcucccggacccugcgcagacggcgcucucccgagagccucccugccggaccgggcgcugccgcgcuggaagggggaacaagacggcgcgugcccgucgcugccgccgagguuccuggcgcugccgcugaagaggcccccgggagagacccuucccccguggcgccuccggauggacgggacgaaacgcuucgccugcucgaugagcugcuugccgagucugcugccugggggcccccugaacccgcuccuagacggcccgcccgccugagaccgaccgcgguggccggcagcgcugucugcgccgagcaguccacagaaggccacccuggaagcggcaacgugucugaggcucccggguccggacggaagaaaccugagcgccccgccgccaucagcuacgaccauucugaagagggccucauggcuuccauugaaagagaguauugucgguga

SEQ ID NO: 68134 - RNA, 1014 nt, Artificial Sequence
  derived and/or modified sequence opt5 from CYSLTR1__Homo_sapiens__NP_001269117
auggacgagaccggcaaccugacagugagcuccgccacgugccacgauaccaucgacgauuucagaaaucaggucuacucuacacucuauagcaugauuuccguugugggguuuuucggaaacggcuuugugcuguacguccuuaucaagaccuaucauaaaaagucugcuuuccaaguguacaugauuaaucuggccguugcggaccuccugugugugugcacacuuccccugcgggucguguauuacguucacaaagggaucuggcucuuuggagauuuccugugucgccugagcaccuaugcucucuacgugaaccuguacugcuccaucuuuuucaugacagccaugagcuuuuucagauguauugccaucgucuuuccugugcagaauauuaaccuugugacccagaagaaagcucgguucgucugcguuggcaucuggauuuuugugauccugacgucuuccccguuccucauggccaagccccagaaggacgaaaagaauaacaccaaguguuucgagccuccccaagauaaucagaccaaaaaccaugugcugguccuucacuaugugagccuguuuguuggguucauuaucccuuuugugauuaucaucgucugcuacacaaugauuauccucacacugcugaagaaaucuaugaagaagaaucucuccagccauaaaaaggcuauuggaaugaucauggugguuaccgccgcguuccuggugucuuuuaugcccuaucacauucagcgcacgauccaccuucauuuccugcacaacgaaacaaaaccuugugacuccguccucagaaugcagaaaagcguggucaucacccugucucuugccgcuuccaauugcuguuuugauccgcugcucuacuucuuuagcggcggcaacuuccggaaacgccuguccacauuuagaaagcauucucugagcuccgugaccuauguuccccggaaaaaggccagccucccugagaagggggaagagauuugcaaaguguga

SEQ ID NO: 68135 - RNA, 1197 nt, Artificial Sequence
  derived and/or modified sequence opt5 from CYTH1__Homo_sapiens__NP_004753
auggaggaagacgauagcuacgugcccuccgaccugaccgccgaggaaagacaggagcucgaaaacauccggcgcagaaagcaagagcugcuugcugauauucagcggcugaaagacgagaucgccgaagucgcgaaugagauugaaaaccucggcucuacagaggagcgcaagaauaugcagagaaacaaacagguugcuauggggcggaagaaauucaauauggauccuaagaagggaauccaauuucugauugaaaacgaccuucugaaaaauacgugcgaggauaucgcccaguuccucuauaagggcgaagggcugaacaaaaccgccaucggagacuaccugggcgagcgcgaugaauuuaauauucaggugcuccacgcuuucguggagcugcaugaguuuacagaccuuaaccugguccaggcccucagacaauuccuguggagcuuucggcuuccgggggaagcucagaagaucgaucgcaugauggaggccuucgcgcagagauauugucagugcaauaacggaguguuucaauccaccgacacauguuacguucugucuuucgccauuaucaugcucaauaccagccugcacaaccccaaugugaaagauaagccuacagucgaacgguuuauugcuaugaaccgcggcaucaacgacggcggggaccugcccgaggaacuccugagaaaucuuuaugaguccauuaagaacgagccuuucaaaauccccgaagaugacggaaaugaucugacccauacguuuuucaacccugaccgggagggcuggcuccugaaacuugggggaggccgcgugaagaccuggaagagacggugguucauccugacagauaauugccucuacuauuuugaauacaccacagacaaagagccgagagggauuaucccccuggaaaaccugucuauucgcgagguugaggauagcaagaaaccuaauuguuucgaacucuacauccccgacaacaaggaucaggugauuaaggccugcaaaaccgaggcugacggacgggucguggaaggcaaucacacgguguauagaaucuccgccccuacacccgaggagaaggaagaguggaucaaauguauuaaggcggccaucagccgcgauccguuuuacgaaaugcuggcugcccggaaaaagaaggucucuuccaccaaaagacauuga

SEQ ID NO: 68136 - RNA, 1200 nt, Artificial Sequence
  derived and/or modified sequence opt5 from CYTH3__Homo_sapiens__NP_004218
auggacgaggauggcgggggagaaggcgggggagugcccgaggaccugagccucgaagagagagaagaacugcuugauauccggcgcagaaagaaagagcugauugacgauaucgaacggcucaaguacgagauugccgaagucaugaccgagaucgacaaccugacauccguugaggaaucuaaaacgacccagcgcaauaagcaaauugcuaugggccggaaaaaguucaacauggauccuaagaaagggauccaguuucuuaucgagaaugaccugcuccagagcuccccggaagauguggcccaguuccuguauaagggagagggccugaacaaaacagugauuggcgacuaccucggggaaagagaugaguuuaauaucaagguccugcaagcguucguggagcuucacgaauuugcugaccugaaccucguucaggcccugcgccaguuccuuuggucuuuuagacugcccggagaggcccagaaaauugaucggaugauggaggcuuucgccagccgcuauugccucuguaauccuggcguguuucaauccaccgacacaugcuacguccugucuuucgcuaucauuaugcugaacaccagccuccauaaucacaacgugagagacaagcccacagccgagcgguuuaucgcgaugaaucgcgggauuaacgaaggaggcgaucugccugaggagcuucugagaaaucucuaugaauccaucaagaacgagcccuucaaaaucccugaagacgaugggaaugaccugacccauacguuuuucaacccggaucgggagggauggcuucugaagcucggcggccgcguuaaaaccuggaagagacggugguucauucugacagacaacugucuguacuauuuugaauacaccacagauaaagagcccagagggaucauuccucucgagaaucugagcauccgcgaaguggaggacccccggaagccuaacugcuucgaacuuuacaaucccucucacaaaggacaggucauuaaggccuguaagaccgaggcugauggcagagugguggaggggaaccaugucguuuaucgcaucuccgccccgagcccugaagagaaagaagaguggaugaagucuaucaaggcuuccauuagccgggaccccuuuuacgauaugcuggccacgagaaaacgccggaucgcgaauaaaaaguga

SEQ ID NO: 68137 - RNA, 1080 nt, Artificial Sequence
  derived and/or modified sequence opt5 from CYTIP__Homo_sapiens__NP_004279
augagccugcagagacuccugcaacacuccucuaacggcaaucuugccgacuucugcgcugggcccgccuacagcuccuauucuacccugacaggaagccucacgauggaugacaaccggcgcauccagaugcuggcggauaccguggcuacacuuccuagaggccggaagcagcuggcccucacccgcuccucuagccuguccgacuuuagcuggucucagagaaaacuggucacaguugagaagcaagauaaugaaaccuucggguuugagauucaguccuaccggccgcagaaccagaaugccuguagcucugaaauguucacacucaucugcaaaauucaagaggacucccccgcucauugugccggacugcaggcuggcgaugugcuugccaacaucaauggggugagcaccgaaggauuuacguauaagcaggucguggaccugauuagaucuuccggcaaccuccugaccaucgagacacuuaauggcaccaugauccugaaacgcacagagcucgaagcgaagcugcagguucugaagcaaacccucaaacagaaguggguggaguaccggagccugcagcuucaagaacaccgccugcuccauggggaugccgcuaacugcccuucccuggagaauauggaccuugaugagcugucucucuucggaccccugccuggccccgggccugcccuggucgacagaaaccggcucagcuccgaaagcucuuguaaauccuggcugagcucuaugacgauggauagcgaggacggauaucagacaugcguguccgaagacucuagccgcggcgcuuuuuccagacagaccagcacagaugacgaguguuucauuccgaaggaaggggaugacuuucuucggagaucuuccagccgccggaauagaucuaucuccaacaccagcuccggaucuaugagcccccugugggagggcaaucucuccucuauguucggcacccugccucgcaaaagccggaagggguccguuagaaagcagcuucugaaauuuauucccggacuccaccgcgccguggaggaagaggaaagccgguucuga

SEQ ID NO: 68138 - RNA, 411 nt, Artificial Sequence
  derived and/or modified sequence opt5 from CYTL1__Homo_sapiens__NP_061129
augagaacccccggcccucugccggugcuccugcuucugcucgccggggcucccgccgcgcggccuacacccccuacgugcuacagccgcaugagagcucugucccaggagaucacccgggacuucaaccuucugcaagucucugaacccagcgagccuuguguucgcuaucucccgagacuguaccuggauauucacaauuauugcgugcucgacaagcugcgggauuuuguggccucucccccuuguuggaaagucgcccagguggacucccuuaaggauaaagcucgcaagcuguacacaaucaugaacagcuucugcagacgggaccucguuuuucugcuugaugacuguaaugcccuggaauaucccauuccugugaccacaguccuccccgaucgccagagauga

SEQ ID NO: 68139 - RNA, 789 nt, Artificial Sequence
  derived and/or modified sequence opt5 from CYYR1__Homo_sapiens__NP_443186
augaagugcgagcccggcuggccuagaaccccggaauggcccccuagcccccggcuguccgccguggggcgcgacaaagagacaugggcuccuucugccgcgagacucggaccccgggcuccucagcugcgcggcgucccgcaaagccuugccagagaugcccccgggccuggaucccugggccggcucccccgccaguggccugggcuguguucuacgagacuuagcggagcucugcucucccccucugaccggccgccuagcucccccuucccucccguucccggcagcccuuuugccccgucucugcgcccucccgcuuggauggaugcccccagacugccugugcggcccggcgugcuccugccgaaacuuguccuccucuucguguacgcggacgauugccuggcccagugugggaaggacugcaaguccuauuguugcgauggaaccacaccuuacuguugcagcuauuacgcuuauaucggcaacauucuuucugggaccgccaucgcuggaauuguuuuuggcaucguguucauuaugggggucaucgccggaaucgcgauuuguaucugcauguguaugaaaaaucaccgcgccacaagagugggcauucugcggaccacacauaucaacaccguuuccagcuaccccggcccucccccuuaugggcacgaccaugaaauggaguacugcgcugaucugcccccgccuuacucucccacgccccagggaccugcccaacgcuccccgcccccucccuauccuggcaaugcuagaaaguga

SEQ ID NO: 68140 - RNA, 1164 nt, Artificial Sequence
  derived and/or modified sequence opt5 from D2HGDH__Homo_sapiens__NP_001274178
auggugggcgggagcguccccguuuucgacgagaucauucuguccaccgccagaaugaaccgggugcucucuuuucacagcguguccggaauccuggucugccaggcuggcugugugcuugaagaacugucucgcuacguugaagagagagauuucauuaugccucucgaccugggggccaagggaagcugccauaucggcgggaauguggcgacaaacgcuggaggccuucgguuucugcgcuauggcucccuccacgggacgguccugggacuggaagugguucucgccgauggcaccgugcuggacugucuuacaucucugagaaaagauaauaccggguacgaccucaagcaacuguucauuggaagcgagggcacacuugggaucaucaccacagucuccauucugugcccgcccaaaccucgggccgugaacguggcuuuucucggaugucccggcuucgccgagguccugcagaccuuuagcacgugcaagggcaugcugggggaaauccucucugcuuucgaguuuauggaugccguuuguaugcagcuggugggacgccaucuucaccuggcguccccugugcaggaaagccccuucuauguccucauugagaccucuggcuccaaugccgggcaugacgcugagaaacugggacacuuucuugaacacgcccugggcagcgggcucgugacagauggaaccauggcuacagaccaaagaaagguuaagaugcugugggcccugcgggagcgcaucaccgaagcgcucucuagagauggcuacguguauaaauacgaccugucccuuccugucgagcggcuguaugauauugugacggaccuccgcgccagacugggcccgcaugcuaagcacguugugggguacggacaucuuggcgacgggaaccugcaccucaaugucacagccgaggcuuucagccccucccugcuggccgcccucgagccucacguguacgaguggaccgcuggacagcagggcucugucagcgcggaacauggggugggcuuucggaaacgcgauguucugggauauuccaagcccccuggcgcccuucagcugaugcaacagcucaaagcucugcuggaccccaaggggauccuuaacccguacaagacacucccuagccaggccuga

SEQ ID NO: 68141 - RNA, 3207 nt, Artificial Sequence
  derived and/or modified sequence opt5 from DAAM1__Homo_sapiens__NP_001257449
auggcccccagaaagcggggcgggcgcggaaucagcuucauuuucugcuguuucagaaacaaugaccacccugagaucaccuaccggcugcgcaacgauuccaauuuugcucuccagacaauggaaccggcccugcccaugccucccguggaggaacuugacgucauguucucugagcugguugaugaacucgaccugacggauaaacauagagaggcgauguuugcccuuccugcugagaagaaauggcaaauuuauugcagcaagaaaaaggaccaggaagagaacaagggcgccaccuccuggcccgaauuuuacaucgaucagcuuaauucuauggcugcccggaaaagccuccuggcucuggagaaggaggaagaggaggagcgcuccaaaacaauugaaucucucaagaccgcccugagaacaaaaccuaugcgguuugugacccgcuucaucgaccuugaugggcugagcuguauccucaacuuucugaagacaauggacuaugagaccuccgagagccggauucacacgucucuuaucggaugcauuaaggcgcugaugaauaacucccagggcagagcccaugugcucgcucacagcgaaucuaucaaugucauugcccaaucccugagcaccgagaacaucaaaacaaagguggcuguucuggaaauucucggggccgugugucuggucccgggaggccauaaaaaggugcuucaggcgaugcugcacuaccagaaauaugccucugagcgcaccagauuccagacacucaucaaugaucuggacaaguccaccggccgguaccgcgaugaaguuagccuuaaaacggcuaucauguccuuuauuaacgccgugcugucucaaggggcuggagucgagagccucgacuucagacugcaucugcgguaugaguuucucaugcugggcauccagcccgugauugacaagcugagagaacacgaaaauuccacacuggaucgccaccucgacuucuucgaaaugcugcggaacgaggaugaacuugaguuugccaagagauucgagcuggugcauaucgacaccaaaagcgccacacagauguuugaacucacccgcaagcggcugacccacucugaggcuuacccucacuucauguccauucugcaucacugccuccagaugcccuacaaaagaagcgggaauacaguccaauauuggcugcuucuggaucgcaucauccagcagauuguuauccaaaacgacaagggacaggauccugacucuacgccccucgaaaacuuuaauauuaaaaacguggugcggaugcuggucaaugagaacgaggugaagcaguggaaggaacaggcggagaaaaugagaaaggaacauaaugagcugcaacagaaacuugaaaagaaagagcgcgagugugaugccaagacccaggaaaaggaggaaaugaugcagacacucaacaaaaugaaggagaaacuggaaaaggagaccacagagcacaaacaaguuaagcaacagguggcugaccugaccgcccagcuccaugaacugagccggagagccgucugcgcuuccaucccgggcgggccuucucccggagccccuggcggccccuuccccagcuccgugccugggagccuucugccgcccccucccccucccccgcucccuggaggcaugcugcccccucccccucccccgcugccucccgggggacccccuccgcccccugggcccccuccccuuggcgcgauuaugccucccccgggagcuccuaugggccucgcccugaagaaaaagucuaucccccagccuacgaaugcccugaaauccuuuaacuggagcaagcuccccgagaauaaacuggaaggcacaguuuggaccgagaucgaugacaccaagguguucaaaauucuugaccuggaagaucucgagcgcacauuuucugcuuaccagcggcagcagaaggaggccgacgcuaucgaugacacccuguccagcaagcugaaagucaaggaacuuuccgugauugaugggagacgggcccaaaacuguaauauccuccugucucgccugaaacucagcaacgacgagauuaagagagcgauccugacaauggaugaacaggaggaccuuccgaaagauaugcuggagcagcuccugaaguucgucccugaaaaguccgacauugaucugcuugaggaacacaaacacgagcucgaccggauggccaaggcugauagauuucuguucgaaaugucucgcaucaaucauuaucaacagcggcugcagagccucuacuuuaaaaagaaauucgccgagagaguggcugagguuaagcccaagguggaagccauccgcuccggaagcgaggaagucuucagaucuggcgcgcugaaacagcuucuggaggugguucucgccuuugggaacuauaugaauaagggacaacggggcaacgcuuacggguucaaaauuuccagccugaacaagaucgccgacacgaaaucuuccauugacaagaauaucacccugcuucacuaucugauuacaaucguggaaaacaaguacccuagcguccucaaucugaacgaggagcuccgcgauaucccccaggcugccaaagugaauaugaccgaacuggacaaggagauuucuacacuuagaagcggccugaaagccguggaaaccgagcucgaauaccagaagucccagcccccucaaccgggagauaaauuuguuagcgucgugucucaguucaucacgguggcuuccuuuagcuucuccgacgucgaggaucugcuggcggaggccaaggaccuuuuuaccaaagcugugaagcauuucggcgaagaggccgggaagauucagcccgaugaauuuuucggaaucuuugaccaguuccugcaagccguuucugaggcuaaacaggagaacgaaaauaugcggaagaaaaaggaggaagaggaacgcagagcccggauggaggcgcagcucaaagagcaacgcgaaagagagcggaagaugcgcaaggcuaaagaaaacagcgaggaauccggcgaguuugaugaccuggugucugcccucagaagcggggaggucuucgauaaggaccuguccaaacuuaagcggaauagaaaacgcauuacaaaccagaugaccgauucuagccgggaaagaccuaucacaaagcugaauuucuga

SEQ ID NO: 68142 - RNA, 3207 nt, Artificial Sequence
  derived and/or modified sequence opt5 from DAAM2__Homo_sapiens__NP_001188356
auggcccccagaaagcggagccaccauggccugggguuccucugcuguuuuggaggcuccgacaucccugagauuaaccugcgcgauaaucacccgcuucaguucauggaauuuucuagccccaucccuaacgcugaggaacugaauauuagauucgccgagcucguggacgaacuggaucuuaccgacaaaaaccgggaggcgauguuugcucugcccccugagaagaaauggcaaaucuacugcuccaagaaaaaggaacaggaggaucccaauaagcucgccacaucuuggccugacuauuacauugaucgcaucaacagcauggccgcuaugcagucccuguaugccuucgacgaagaggagacggaaaugagaaaucaggucguugaggaucugaaaaccgcucuccggacacaaccgaugcgcuuugugaccagauucaucgaacuggaggggcuuacaugucugcucaacuuucugcggucuauggaccaugcgaccugcgaaagccgcauucacacaucccuuaucggauguauuaaggcccugaugaauaacagccagggcagagcccaugugcucgcucagcccgaggccaucucuaccauugcucagucccugcggacggagaauagcaaaaccaaggucgccgugcuggaaauccucggggcgguuugccuggugccuggaggccacaaaaagguccuucaagccaugcugcacuaccagguguaugcugccgagcgcacaagauuccagacccuccugaacgaacuugaucggucucugggccgcuacagagacgagguuaaucucaagacagcuauuauguccuuuaucaacgccgugcugaaugccggggcuggagaagauaaccuggaguuccggcuccaucugagauaugaguuucuuaugcugggcauccagcccgucauugacaaacuccgccaacacgaaaacgcgauccuggacaagcaucuugauuucuucgagauggugcggaaugaagacgaucuggagcucgccagacgcuuugacauggugcacauugauaccaaaagcgcuucucagauguucgaacugauccacaagaaacugaaguacacggaggccuacccuugucuccuguccguccuucaucacugccugcagaugcccuauaaacggaacgggggauacuuucaacaguggcagcuccuggaccgcauucugcagcaaaucguucuucaggaugagagaggcguggacccggaucucgccccucuggaaaauuucaacgugaagaauaucgucaacaugcugauuaaugagaacgaagugaagcaguggcgggaccaggcugagaaauuuagaaaggagcauauggaacucguuagccgccuggagcggaaagaaagagagugugaaacaaagacccuugagaaagaggaaaugaugcgcacacugaauaagaugaaggauaaacucgcccgggagucccaagaacugagacaggcgcggggacagguggcugagcuggucgcccagcuuucugaacucagcaccgggcccguguccagcccucccccucccggcggcccgcugacccugucuuccagcaugacaacgaacgaccugcccccucccccucccccgcucccuuucgccugcugucccccucccccucccccgccucuuccucccgggggacccccgacacccccuggcgcucccccuugccuggggaugggacucccccugccucaagaccccuauccgucuagcgauguuccucugcgcaagaaaagagugccccagccuucccacccccuuaagucuuuuaauugggucaaacucaacgaggagcgggugccgggcaccgucuggaaugaaaucgacgauaugcaaguguuccgcauucuggaccuggaggauuuugaaaagauguucagcgccuaccagagacaucagaaggagcucggguccaccgaagacaucuaucuggcuagccggaaaguuaaggagcuuucugugauugauggaagacgcgcccagaacugcaucauccugcucuccaaacugaagcugagcaaugaggaaauuagacaggcgauccuuaaaauggacgagcaagaagaucucgccaaggacaugcuggagcagcugcucaaguuuauuccugagaaaucugauaucgaccugcuugaagaacacaagcacgaaauugagcggauggcucgcgccgauagauuccuguacgaaaugucccggaucgaccauuaucagcagcgccuccaagcucuguuuuucaaaaagaaauuccaggagagacuggccgaggcgaagcccaaagucgaagccauucuucuggcuagccgggagcucgugcgcuccaagagacugcggcagaugcucgaaguuauccuggccaucggcaacuuuaugaacaagggccagcgcgggggagcuuacggcuucagaguggccucucuuaauaaaauugccgacacaaagagcuccaucgaucggaacauuucucugcuccacuaccugaucaugauucuggagaaacauuuuccugacauccuuaauaugcccagcgaacugcaacaccuccccgaggcugcgaaggucaaccuggccgagcucgaaaaagagguggggaaucugagacgcggacuucgggcuguggaaguugagcuggaauaucagagacgccagguccgggagccuuccgauaaguucgugccggugaugagcgacuuuaucaccgucucuuccuucagcuuuucugagcucgaagaucagcugaacgaggccagagacaaguucgccaaagcucugaugcacuuuggcgaacaugauuccaagaugcaacccgacgaguucuuugggauuuucgauacguuucuucaggccuucagcgaggcgcgccaggaccuggaagcuaugcggagacgcaaagaggaagaggaacggagagcccggauggaggccaugcucaaggagcaacgcgaaagagagcgguggcagcgccagagaaaagugcuggcugccggcucuagccucgaagagggaggcgaguucgaugaccugguuuccgcgcuucggagcggggagguguuugauaaggaccuguguaagcugaaaagaucucgcaagcgguccggaagccaggcucucgaggucacaagagaacgcgccaucaaucggcugaacuacuga

SEQ ID NO: 68143 - RNA, 2250 nt, Artificial Sequence
  derived and/or modified sequence opt5 from DAB2__Homo_sapiens__NP_001231800
augagcaacgagguggaaaccuccgccacaaauggccagcccgaccaacaggcugccccuaaggcgccgucuaaaaaggagaaaaagaaagggcccgaaaagacggaugaguaccugcucgcuagauucaagggagacggcgucaaauauaaggccaaacugaucgggauugaugacguuccugaugcccggggagacaagaugagccaggauuccaugaugaaacuuaagggcauggcugccgcugggcgcucucagggacaacacaagcagagaaucugggugaacauuagccuguccggcaucaaaauuaucgacgaaaagaccggcgugaucgagcaugagcaccccgucaauaaaauuucuuuuaucgcccgggaugugacagacaaccgcgcguucggguacguuugcggaggcgaagggcagcaucaguuuuucgccauuaagaccggacaacaggcugagccucucguggucgaucugaaagaccuuuuucaggugaucuauaauguuaagaaaaaggaagaggagaagaaaaagauugaagaggccagcaaagcuguggaaaacggcuccgaggcccugaugauccucgaugaccagacaaauaagcugaaaagcgaaucuaaggacauucugcucgucgaucugaacuccgagaucgacaccaaucaaaacagccuuagagagaaucccuuccugacaaacgggaucaccucuuguucccucccucggccgacgccccaggcgagcuuucugccugaaaaugccuucucugcuaaccuuaacuuuuuccccaccccuaaucccgauccguuucgcgacgauccuuucacacagcccgaccaauccaccccuagcuccuuugauucucucaagagccccgaccagaaaaaggagaacuccagcagcuccagcacaccccugucuaauggaccucugaacggcgauguggacuacuucggccagcaguucgaucaaauuagcaauagaaccgggaaacaggaagcccaggcuggaccguggcccuuuuccucuagccagacgcaaccugccgugcggacacagaacggcgucuccgagcgcgaacagaauggguucagcguuaagucuucccccaacccuuuugugggaucucccccgaaaggccugucuauccagaauggggugaagcaagaccucgaguccagcguccaguccucuccucacgacagcauugccaucauucccccuccccaguccaccaagccuggaagaggccggcgcacagcuaaaucuagcgcgaacgaucugcuugccuccgacaucuucgcucccccggugagcgagccuucuggccaggccucccccaccgggcaacccaccgcccugcagccuaauccgcucgaucuguuuaagacaagcgcucccgccccuguuggaccccuugugggccucgggggagucacggugacccugccucaggcgggccccuggaacacagcuucucugguuuucaaucaauccccuagcauggcccccggggccaugaugggcggacagccgucuggcuuuagccagccugugaucuucgggaccucccccgcugucagcggauggaaccagccuucucccuuugccgcuuccacaccgccucccgugccugucguguggggccccagcgccuccguugcgcccaaugccuggucuaccacgagcccucuggggaacccguuccaauccaauauuuuucccgcuccugccgugucuacacagcccccuagcaugcauuccucucuccuggucacacccccucagccgcccccuagagcuggacccccuaaagacaucagcuccgaugccuucaccgcgcuugacccccugggcgauaaggaaauuaaagacgugaaggagauguuuaaggauuuccagcuccggcaaccgccugccguucccgcucgcaaaggggaacagaccagcucuggcacccuguccgccuucgcuagcuauuuuaacucuaaggugggaaucccccaggagaacgccgaccacgaugacuucgaugccaaucagcuucugaacaaaauuaaugaaccucccaagccugcuccgagacaagucucccuccccgugacaaaaagcacggacaacgcguuugagaauccuuucuuuaaggacucuuucggcuccagccaggccuccguggcuagcucucagcccguuagcuccgagauguaccgggauccuuuugggaaccccuucgccuga

SEQ ID NO: 68144 - RNA, 3399 nt, Artificial Sequence
  derived and/or modified sequence opt5 from DAB2IP__Homo_sapiens__NP_115941
auggagcccgacagccugcucgaucaggacgauuccuacgaaucuccucaagagagaccgggcagccggcgcucccugcccgggucucuuagcgaaaaguccccuucuauggagcccagcgccgcuaccccuuucagagugacaggauuucugucccggcgccucaaaggcagcaucaagagaacgaaaucucagcccaagcuggaccggaaccacuccuuccgccauauucuuccuggguuuagaagcgccgcggcugccgccgcugauaaugaacggucucaccugaugccgcgccucaaagaguccagaagccaugagucucugcugucccccagcuccgccgucgaagcucucgaccugucuauggaggaagagguugugaucaagccugugcacagcuccauucuuggacaggauuauugcuucgaggucaccacaagcucuggcuccaaguguuuuagcugccggucugccgcggaacgcgacaaauggauggagaaccugagacgggccgugcaucccaauaaggauaacagccgcagaguugaacacauccucaaacugugggugauugaggcuaaggaccuuccugccaaaaagaaguaccugugugaacucugccuggaugacguccuguaugcucggaccacagggaaacucaagaccgauaauguguucuggggagagcacuuugaguuccauaaccugcccccgcuuagaacaguuaccgugcaccuguaccgcgaaacggacaaaaagaaaaagaaagagcggaauagcuaucucggccuggucucucuuccugccgcgagcguggccggcagacaguuuguggaaaagugguaccccgucguuaccccuaaccccaaagggggaaaaggccccgggccuaugauccgcaucaaggcucgguaucaaacaauuaccauccugccgauggagauguacaaagaguucgccgaacauauuacaaaucacuaccucggacugugugcugcccuggagcccauccucuccgccaagaccaaagaagagauggcuagcgcgcuggugcacauucuucagucuacgggcaaggugaaggacuuucugacagaucucaugauguccgaagucgacagaugcggggauaacgagcaucugaucuuccgcgaaaauacccuugccacaaaagcuauugaggaguaucugaagcucgugggacagaaauaccugcaggacgcccugggcgaauuuaucaaggcccucuaugagagcgaugaaaacugugagguugacccuucuaaaugcuccgcugccgaucugcccgagcaccaaggcaaucuuaagauguguugcgaacuggcguucuguaagaucauuaacagcuacugcguguucccucgggagcucaaagaagucuuugcuuccuggagacaggagugcucuagccgcgggcggcccgacaucuccgaaagacugauuucugccagccuguuccuucgcuuucucuguccggccaucauguccccuagccuguucaaucugcuccaggaguaucccgaugaccggaccgcuagaacccugacacuuauugccaaggugacgcagaaccuggcuaacuuugccaaauucggaucuaaggaggaauacauguccuuuaugaaucaauuccucgagcaugaauggaccaacaugcagcgguuucugcuggagaucagcaauccugaaacacuuucuaacaccgcgggcuucgagggguauaucgaucucggacgcgagcuguccagccugcacucucuccugugggaagccguuagccagcuugagcaauccauugugagcaaacugggcccccucccuagaauccugcgggacguccauacagcucugucuacccccggguccggacagcuuccgggcacgaaugaccucgccagcacaccuggcuccgggucuagcuccauuucugcuggacugcagaagauggugaucgaaaacgaucugagcggccucauugacuuuaccagacugcccucccccaccccugagaauaaggaucuuuucuuugucacacgcucuagcggggugcagccgucccccgcccgguccucuuccuacagcgaagcgaacgagccugaccugcaaauggccaauggaggcaaaucucucuccaugguugaucugcaggacgcuagaacccuggauggggaggccggcagccccgcuggaccugacgugcuucccacagauggccaggccgccgcugcgcagcucgucgccggguggccugcucgcgccacgcccgugaaccuggccggacuggcuaccguuagacgggccggccaaacaccgaccacaccugggaccucugaaggagcgcccggccgcccucagcuccuggcuccccuuuccuuccagaauccgguguaccagauggccgccgggcugccucucagccccagaggccugggagacuccggcagcgaggggcacucuagccuguccucucacagcaacuccgaggaacuugcugccgcggcuaagcugggaucuuucagcacggccgccgaggaacucgcucggcgcccuggcgagcuggccagacggcaaaugucccucaccgaaaaagggggacagcccacagucccccgccaaaauucugcuggcccucagagacggaucgaucaaccgcccccucccccucccccuccgcccccugcgccccgcgggagaaccccucccaaccugcuuagcacacugcaguauccgcggccuuccagcggcacccucgccucugccucccccgacugggugggacccagcacgagacugcgccagcaaucuuccagcuccaagggcgauucuccugagcugaaaccccgggcugugcauaagcaggggccuagcccgguuucccccaaugcccuugacagaacagcugccuggcugcucaccaugaacgcccagcugcucgaagacgagggacugggcccugaucccccucaccgcgaccggcuuagaagcaaagaugagcugucucaggcugaaaaggaccucgcgguccugcaagauaagcugcgcaucuccacaaagaaacuugaggaauacgagacccuguuuaagugccaggaagagaccacacagaagcucgugcuggaguaucaggcccggcucgaagagggggaagagagacugcgccggcaacaggaagacaaagauauucagaugaagggaaucauuagcagacuuaugucuguggaggaggaacugaagaaagaccaugcugagaugcaggccgccgucgauagcaagcagaaaaucauugacgcucaggaaaagcggaucgccucccuggaugcggcuaacgcccgccucaugucugcccugacgcagcuuaaagagagcaugcacuga

SEQ ID NO: 68145 - RNA, 1515 nt, Artificial Sequence
  derived and/or modified sequence opt5 from DACH1__Homo_sapiens__NP_004383
auggccgugcccgcugcccugaucccuccgacccagcucguucccccucaacccccuauuagcacauccgcgucuagcuccggcacgaccacaucuaccagcuccgcuacaucuagccccgccccuuccaucgggccgcccgccagcucuggaccuacccuguucagacccgagccuauugcuuccgccgcugccgcggccgcuacagucaccagcacgggcgggggaggcgggggaggcggcucugggggaggcgggggauccagcggcaacgggggaggcggcgggggaggcgggggaggcucuaauugcaaccccaaucuugccgcugccuccaacgggagcggaggcggcgggggaggcaucuccgccgggggaggcguggcgucuagcaccccgauuaaugcuuccacagggucuagcuccagcucuagcuccucuagcuccucuagcuccucuagcuccagcuccucuagcuccucuagcuccuguggcccucugcccggaaagccuguguacagcacccccucucccgucgaaaacacaccucagaauaacgagugcaaaaugguggaccuccggggcgccaagguugcuuccuuuaccguggaagggugugagcugaucugccuuccgcaggccuucgaucuguuucucaaacaccuggucggaggccugcauacgguguauacaaagcucaaacgccuggaaaucacccccguuguguguaaugucgaacaggugcggauucuuagagggcugggagccauccaaccuggcgugaaccgcugcaagcucauuagcagaaaggacuucgagacacuguacaaugauuguaccaacgcuucuucccggcccgggcgcccucccaaaagaacccagagcgucacaucuccggagaauagccacaucaugccucauuccguucccggccuuaugagcccuggaauuauucccccuacggacgagacaccccugucuaccccgaccgcgcgggauucccucgacaagcugagccugacaggccacgggcagccucucccucccggauuucccuccccguuccuguuucccgauggccuuucuagcaucgaaacccugcucacgaacauccaggggcugcuuaaaguggccaucgacaaugcucgcgcccaagagaaacaggugcagcuggagaaaacagaacucaagauggauuuccugagagagcgggaacugcgcgagacccucgaaaagcagcuggccauggagcaaaagaacagagcuauuguccagaagcggcuuaaaaaggagaaaaaggccaaacgcaagcugcaggaagcgcucgaguuugaaaccaagagacgggagcaagcugaacagacacugaaacaggccgccuccaccgacucucuuagagugcugaacgauagccucacaccugagaucgaggcugaccgcuccggaggccggacggaugccgaaagaaccauucaggacgggcgccuguaucugaagacaaccguuauguacuga

SEQ ID NO: 68146 - RNA, 1716 nt, Artificial Sequence
  derived and/or modified sequence opt5 from DACH2__Homo_sapiens__NP_001132986
auggccgugagcgcuucccccgucaucucugccaccagcuccggcgcggggguuccuggaggccuguucagagcugagccgcucuacucuacaccccgggaaccuccccgccugacgccuaacaugauuaauagcuuuguggugaacaaucacuccaacucugccgggggaggcgggagaggaaauaccaacacaaaugagugccggauggucgacaugcauggcaugaagguggccagcuuccuuauggauggccaggaacugaucugucucccccaaguuuuugaccuguuccuuaaacaccuggucgggggacuccauaccguguauacaaagcugaaacgccuggauauuuccccugugguuugcaccguggagcaggucagaauccuccggggccugggggcuauucagccgggagugaaccgcuguaaacuuaucacaagaaaagacuuugaaacccuguucacggauugcaccaaugccagcucucggcccggccgcccucccaagagaucccucggggugcugcaggagaacgcucggcuucugacacacgccgucccuggacuccugagccccggccugaucaccccgacaggcauuaccgcggccgcuauggccgaggcuaugaagcuccaaaagaugaagcugauggccaugaauacgcuucaggggaacggaucucagaauggcacagaauccgagccugacgaucugaacagcaauaccgggggaucugaauccagcugggacaaagauaagaugcagucccccuuugcggccccuggcccccaacaugggaucgcucacgccgcucucgccggacagcccggcauuggcggggccccuacacugaacccgcuucagcagaaccaucugcucaccaaucgccuggaccugcccuucaugaugaugccucacccccuccugccuguuucucuucccccggcuagcguggcgauggccaugaaccaaaugaaucaccugaacaccaucgcuaauauggccgccgcugcccagauucauuccccucucagcagagcgggaacaucugugaucaaagagcggauucccgaguccccuagccccgcuccuucucuggaagagaaccaccgccccggcagccagacguccucucacaccagcuccagcgucucuuccagcccgucucaaauggaucaucaccuugaaagaauggaggaagugccuguucagauccccaucaugaaguccccucuggacaagauucagcucacacccgggcaggcccugccggccggauuucccggcccuuucaucuuugcugauagccuguccucuguggagacccuccugacaaauauucaagggcuucugaaagucgcccucgacaacgcucggauccaggagaagcagauucagcaagagaaaaaggaacugagacuggaacuuuaccgcgagcgggaaaucagagagaaucucgagcgccagcuggccguggaacugcagagccggaccacgaugcagaaaagacucaagaaagagaagaagacaaaacgcaagcugcaagaagcgcuugaguucgaauccaaacggagagagcagguugagcaggcccugaagcaggcuaccaccucugacagcggccuccgcaugcugaaagauacaggaauccccgacauugaaaucgagaacaauggcaccccucaugauuccgccgcuaugcaagccuga

SEQ ID NO: 68147 - RNA, 2400 nt, Artificial Sequence
  derived and/or modified sequence opt5 from DACT1__Homo_sapiens__NP_001072988
augaagcccagcccugccggcaccgcuaaagagcuggaaccgcccgccccugcgagaggggagcagcggacagcugaacccgagggacgcuggagagaaaagggcgaggccgacacggagcggcaacgcaccagagaacggcaggaggccacacucgcugggcuggccgaacuugaguaccugcgccagagacaggagcuccuggugcggggagcccuucgcggcgcugggggagcgggcgccgcugccccuagagcuggcgaacugcucggggaggccgcgcaacggucccgccuggaagagaaauuccuggaagagaacauccuccugcuuagaaagcagcugaauugccuccggcgcagagaugccggacugcuuaaccagcugcaggagcucgacaaacaaauuucugaucugcggcuggacgucgaaaagaccagcgaggaacaccucgagacagauuccagacccucuagcggcuuuuaugaacuguccgacggggcuucuggaagccuuuccaauagcucuaacuccguuuucagcgagugucugucuuccugccauagcucuaccuguuuuugcuccccucucgaggccacacugagccuuuccgauggcuguccgaagucugcugacgugaaucccaaauaccagugcgaucuggugagcaagaacgggaaugacgucuaucgcuacccuagcccccuccacgccguggccguucagagcccuauguuccugcugugucucaccggaaacccccugcgggaagaggauagacuuggcaaucaugcuucugacaucugcggcggguccgaacuggaugcggugaaaacggacagcucucucccgagcccuuccucucuguggagcgccucccaccccuccucuuccaagaaaauggacggauauauucuuagccugguccagaagaagacccauccugugcgcacaaacaaaccccggaccucuguuaaugcugaucccacaaagggccuccugagaaacggguccguguguguccgcgccccuggaggcgugagccaaggaaauuccgugaaccugaaaaauucuaagcaggccugccucccgagcgggggcauccccucccugaacaacggcaccuuuucuccucccaaacaguggagcaaggaguccaaagcugaacaagccgagagcaagcgggucccucuucccgagggguguccgucuggagcggcuuccgaccugcagagcaagcaccucccuaaaacggccaagcccgccucucaggaacacgcuagaugcuccgccauuggcacaggggagagcccuaaagaaucugcucagcugagcggagccucccccaaggagagcccuucucgcggccccgcgccgccucaagagaauaaaguugugcagccccugaagaagaugucccagaaaaacagccuucagggggugcccccugccaccccgccccuccuguccacagcuuucccugucgaggaacggcccgcccuggauuuuaagucugaaggcagcucccaaucucucgaggaagcucaucuggugaaagcccaguucaucccuggacagcagcccagcguuagacuucaccgcggccaucggaauauggggguggucaagaacuccucucugaaacacagaggaccugcgcuccaaggccuggagaaugggcugcccaccgugcgggagaagacccgcgccggaagcaagaaaugcagauuuccggacgaucuugacacaaacaagaaacucaagaaggcuuccagcaagggccggaagucugggggcggaccugaagccggcguucccgggagaccugcuggaggcgggcaccgcgccggaucccgggcccauggccacgggagagaggcuguggucgcgaaacccaagcauaaacgcacggauuacagacgguggaaaagcucugccgaaaucuccuaugaggaagcucugcgcagagcccggcgcggcagacgggagaaugugggacuguacccggccccugucccccucccuuacgcuagccccuaugccuacguggcgucugacuccgaguauagcgcugaaugugagucccuguuccacagcaccguuguggauacaucugaagacgagcagagcaacuacaccacaaauugcuuuggcgauuccgaaucuagcgucuccgagggggaguucgugggagaaucuaccacgacaagcgacuccgaggaaucuggcgggcuuauuuggagccaguuuguucagacccugcccauccaaaccgugacagccccugaccuccauaaccacccggccaaaaccuucgucaagauuaaggcuucccacaaucugaaaaagaaaauccugcgcuucagaagcggaucucuuaagcucaugacaacgguguga

SEQ ID NO: 68148 - RNA, 843 nt, Artificial Sequence
  derived and/or modified sequence opt5 from DACT2__Homo_sapiens__NP_001273280
auguggacccccggcgggccuccgggaagcgccggcugggacagacggcgccugggggcuagacuccgggccgcguucgcuggacugcaggagcuucaaggccugcgcgccacacagcaggaaagagugcgcggggcccucgcucugcagcccccucccgccccugcugcccccugcggaccucacggccuucauggcccggagcaacagcuggaagcggcccucgcugcccugcaggagcagcugucccggcucagacaacaggauaucgggcugaagacgcaccuugaccagcuggaucuccagauuucuaaacugcaacuugacgucggaaccgcuagcggcgaagcccuggauuccgacucucggcccagcuccggguuuuacgagaugucugauggaggcagcuguucccucagcacaucuugcgcguccguuuguagcgaccauaucucuccuucccuggggagccugcuccccguggcccaggcucacaaggcccgcccuucuaugggagauuggagaccccgguccguggacgagaccacagucccggcuuggcgcccucaggccaccgaagagggcgccagacccccuggcagcguggaagaugcugggcaacccuggggaacauucuggccccggccuguuuccaccgagcugugcaacgcgccgggcgagcuugacaugcaugcucccccugccggguguacgucuagcucccugaccggagugggcagcgggcuccgcggaaaaugcggccuguguggcugccagcuucccuuuuguucugucaauacauccagcaagaccaaaucuagcgggauuuccagacagcaguga

SEQ ID NO: 68149 - RNA, 1890 nt, Artificial Sequence
  derived and/or modified sequence opt5 from DACT3__Homo_sapiens__NP_659493
augaucagagccuucagcuuucccguguccccugagcggggccgccugagaggguggcucgaaggaucucuggcuggccuuugcgagcugcacuggcuccgggaacgccaggaguacagaguccaacaggcccugcggcuugcgcagccggggaugggaggcgcugaagccgaggacgaggaagaugccgacgaggaugaagacgcugccgcugcccgcagagcggccgcugcccuggaggagcagcucgaagcucugcccgggcugguuugggaucucggacaacagcugggcgaccuuagccuggaguccggcgggcucgaacaggagucuggacggagcuccggcuucuaugaagauccuucuagcaccgggggacccgacuccccucccagcacauuuuguggcgauucuggguucuccggauccucuuccuacggccgccugggcccuagcgagccgagagggauuuaugccucugagcggcccaagucccuuggagacgcgagcccuuccgcccccgaaguggugggcgcucgcgccgcugucccuagaucuuuuagcgcccccuacccgacggccgggggauccgcuggcccugaggcgugcagcucugccgaacggcgcgcuagagccgggcccuuccugaccccuagcccccuccaugccguggcuaugcggagccccagaccuuguggacgcccgcccacagauucuccugacgccggcggcgcggggcggccccuggauggauauaucagcgcucugcucagacgccggagacgccggggcgccgggcagccuagaaccucccccggaggcgccgacgggggcccgcgccggcaaaacucuguuagacagcgcccucccgacgcuagcccuucccccggaagcgcccggccugcuagagagcccucucuggaacgggugggcgggcacccgacauccccugccgcgcuuagccgcgccugggcuucuuccugggagagcgaggccgcucccgaacccgccgcgccuccggccgcucccuccccucccgauucuccugccgagggaagacuggucaaagcucaguacauucccggcgcccaggccgcuacccgggggcucccuggcagagcggcccgccggaagcccccgccucugacaagaggacgcagcguggaacaaucucccccuagagagcggccccgcgcugccgggagacggggccgcauggccgaagccuccggaagacggggcagcccgcgcgccagaaaagcgucccggagccagucugagaccucccuucuggggcgcgcuagcgccguuccuucuggacccccuaaguaucccacggccgagagagaggaaccccggccuccgagaccccgccggggcccugcucccacccucgccgcgcaggcugccggguccugcagacgcuggcggagcacagccgaaaucgacgcugccgauggaagacgcgugcggccuagagcucccgccgcgcgcgucccuggcccggggcccucuccuagcgcuccccaacggagacugcuguacggcugugcuggauccgacagcgagugcucugccggccggcucgggccucugggacgcagaggccccgcugggggagugggcgggggcuacggagaguccgaaagcuccgccucugagggcgaaagcccggccuuuuccucugcuagcuccgauucugacgggagcggaggccuuguguggccucagcagcuggucgcggccaccgcugccuccgggggaggcgccggcgcuggggcccccgcgggacccgcuaaaguuuucgugaagauuaaggccagccaugcccucaaaaagaaaauccugcgguuucgcucuggcucccuuaaggugaugacaaccgucuga

SEQ ID NO: 68150 - RNA, 342 nt, Artificial Sequence
  derived and/or modified sequence opt5 from DAD1__Homo_sapiens__NP_001335
augagcgccuccguggucucuguuaucagcagauuccuggaggaauaccucuccucuacaccccagcggcugaaacuucuggacgcuuaucuccuguacauucuucugaccggcgcccuccaauuuggguauugccugcuggugggaacguucccuuuuaacagcuuccucuccggcuuuaucucuuguguggggagcuucauucuggcggucugccuucgcauccagauuaauccgcagaacaaggcugauuuucagggaaucucccccgagagagccuucgccgacuuucuguucgcuagcaccauccuccaccuggugguuaugaauuuugugggcuga

SEQ ID NO: 68151 - RNA, 2688 nt, Artificial Sequence
  derived and/or modified sequence opt5 from DAG1__Homo_sapiens__NP_001171113
augagaaugagcgugggccugucccuccugcuuccccugugggggcggaccuuccuccugcuucugucugucguuauggcccagagccacuggccuuccgagccgucugaagcugugcgcgacugggagaaccaacucgaagccagcaugcauuccgugcugucugaucugcacgaggcgguccccacagugguuggaaucccugacggcacggcuguggucgggcggagcuuucgggugaccauucccacagaucucaucgccuccagcggagacauuaucaagguuucugccgcuggcaaagaagcccugccuuccuggcuucauugggauagccagucucacacccuggaggggcucccccuggacacagauaagggagugcauuacauuuccgucagcgcuacccgccuuggcgccaauggcucucacaucccucagacauccagcguguucuccaucgagguguauccggaagaccacucugagcugcagagcgucagaaccgcgucccccgauccuggggaaguugugagcucugccugcgcugccgacgagcccgugacgguccucaccgugauucuggaugcugaccugacaaaaaugaccccuaagcaacggaucgaucuccugcaucgcaugagauccuuuagcgagguugaacuucacaacaugaaacuggugcccgucgugaauaacagacucuucgacaugucugccuuuauggcgggaccgggcaaugccaagaagguuguggagaacggggcucugcuuagcuggaaacugggauguucccucaaucagaacucugucccugacauucauggcguggaagcccccgcucgcgagggggccaugagcgcccagcugggauacccugucgugggcuggcacaucgcuaauaagaaaccuccccugcccaagagaguucggcgccagauucacgcgacaccgacccccgugacggccaucggcccucccacaaccgcuauucaagaaccucccuccagaaucgucccgacaccuaccagccccgccaucgccccucccaccgagacaauggcuccucccgugcgggauccgguuccugggaaacccacggugaccauucgcacaagaggagccaucauucagacccccacacucggcccuauccagccgacccgggucucugaggcggggacgacagugcccggacagauuagaccuaccaugaccauccccggcuauguggaaccuacagcuguugccacacccccuaccacgaccacaaagaagccccgcgucuccaccccgaaaccugccacacccagcaccgacucuacgaccacaaccacacggagaccuaccaagaaaccccgcacgccgcggccugugcccagagugacaaccaaggucuccaucacacgccuggagaccgcuagcccucccacccggauuagaacaacgaccuccggggugccccgcggaggcgaaccuaaccaacggccggagcuuaaaaaucauaucgauagaguugacgccugggugggcacauacuucgaagucaagauucccucugauaccuuuuaugaccacgaggauacaaccacggacaaacugaagcucacacugaaacuucgcgagcagcagcuggugggggaaaagagcuggguucaauucaacuccaauucucagcucauguacggacugccugauagcucccaugugggcaagcacgaguauuuuaugcaugcuaccgacaaagggggacugagcgccgucgaugcguucgaaauccacgugcaccggagaccccagggcgaccgggccccugcucgcuuuaaggccaaauucguuggggaccccgcucucgugcugaacgauauucauaagaagaucgcccuugucaaaaagcuggcguuugccuucggcgacagaaauugcucuaccaucacacuccagaacauuacccggggauccaucgugguggaguggacaaacaauacgcugccucuggaaccgugucccaaagagcaaauugcuggccuuagcagacgcaucgccgaggaugacgggaagccucggcccgcuuucucuaacgcccucgaaccugauuuuaaagccaccuccauuacagucaccggaagcggcucuugcagacaucugcaguucauccccguugugccgccucgcagagugcccagcgaggcucccccuacagaaguccccgaccgggauccugagaaguccagcgaggacgauguguaccugcacaccguuauuccggcgguggucguggccgcuauccuccugaucgccgggauuaucgccaugauuuguuaccgcaagaaaagaaagggaaaacuuacgcuggaagaccaggcuaccuuuaucaagaaaggcguucccauuaucuucgccgaugagcucgacgauucuaagccucccccuuccagcuccaugccccugauccugcaggaagagaaggcgccgcuuccucccccugaauaucccaaucaaucugugccugagacaacaccccucaaccaggacaccaugggggaguacaccccgcugcgggacgaagauccuaaugcuccucccuaucagcccccgcccccuuuuacagcccccauggagggcaaaggaagccgcccuaagaacaugacccccuacagauccccuccgcccuaugucccucccuga

SEQ ID NO: 68152 - RNA, 570 nt, Artificial Sequence
  derived and/or modified sequence opt5 from DAND5__Homo_sapiens__NP_689867
augcugcucggccagcugagcacccuucugugccuccuguccggggcccuucccacaggaucuggcagaccugagccgcaaagcccccggccucaguccugggcugccgcgaaccagacgugggcucuggggcccggagcccucccuccccuggugccugccucugcucugggcagcuggaaggccuuccucgggcugcagaaagcucgccaacuuggaaugggcagacugcagcggggccaggacgaagucgccgcgguuacccucccgcugaauccccaggaggugauccaagggauguguaaggccgugccuuuuguccagguguucucccgccccggaugcucugcuauuagacuucggaaccaccuguguuuuggccauugcagcucccucuacaucccugggagcgaucccacaccgcugguucuguguaauucuugcaugccugcccgcaaaagaugggcucccgugguccucuggugucugaccggauccagcgccucucggcgcagagugaagauuuccacaaugcuuaucgaaggcugccacuguagcccuaaagcguga

SEQ ID NO: 68153 - RNA, 378 nt, Artificial Sequence
  derived and/or modified sequence opt5 from DAOA__Homo_sapiens__NP_001155284
augagaaccgccaucuggaaguggcaccggggcauuuaccgcgaccauuaugugcuggggagccucacauuccugucccccaugcagagagcuggaacgucuaaccaauggaauaugggcaaagucaugacccuugauagcggggacgagguuacauuucacaagaccuggccuacagaaaccggauccccguaccggcuggaggaagugucuagccaugugggcaaagucuucauggcccgcaacuaugaguuucucgcguacgaggcuuccaaggauagacggcagccccuggaacgcauguggacaugcaauuauaaccagcagaaagaccaaucuuguaaucacaaggagaucaccagcacgaaggccgaauga

SEQ ID NO: 68154 - RNA, 1044 nt, Artificial Sequence
  derived and/or modified sequence opt5 from DAO__Homo_sapiens__XP_011536307
augagaguggucguuaucggcgccggggugauuggacugagcaccgcucucugcauccacgagcgguaccauuccgugcugcagccccuugacauuaaggucuaugccgaucgcuucacaccucugacgaccacagacguggcggcuggccucuggcaaccguaccugucugaucccaacaauccucaggaagccgacuggagccagcagaccuuugauuaucuucugucccacguucauucucccaacgccgagaaucucgggcuguuccugaucagcggauacaaccucuuucacgaagcuauuccugaccccuccuggaaggauacagugcugggcuucagaaaacuuaccccucgggagcuggacauguuuccggauuauggguacggaugguuccauacaucucucauccuggaaggcaaaaauuaucuucaauggcugaccgagcgccucacggagagaggcgucaaguuuuuccagcggaaaguggagagcuuugaagaaguugcccgcgagggggcugacgugaucgucaacuguaccggagugugggccggcgcgcugcagagagauccccugcuccagccugggcggggacaaauuaugaagguggacgcccccuggaugaagcacuucauccugacacacgauccugagcgcggcauuuacaauucccccuacaucauuccggggacccagacagucacccuuggaggcaucuuucagcugggcaacuggagcgaacucaauaacauucaggaccauaauacgaucugggaggggugcuguagacuggaaccuacacuuaaaaacgcucggaucauuggagagcgcaccggcuucagacccguucggccucaaauccgccuggaaagagagcagcuccggacagggcccucuaauaccgaggugauucacaacuauggacauggcggguacggacugaccauccacuggggcugcgcccuggaagcugccaagcucuuuggccgcauucuggaggaaaagaaacuuuccagaaugcccccuagccaccuguga

SEQ ID NO: 68155 - RNA, 1197 nt, Artificial Sequence
  derived and/or modified sequence opt5 from DAP3__Homo_sapiens__NP_001186778
augaugcugaagggcaucaccagacucauuagccggauccacaaacuggaccccgggcgcuuccuucauaugggaacacaggccagacaauccauugcugcccaccuggauaaccaggugccugucgagucuccgcgggcgaucagccgcacgaaugaaaacgaccccgcuaagcauggcgaucagcacgaggggcagcauuacaauauuuccccucaagaccucgaaaccguuuuuccccacggacugccucccagauucgugaugcaagugaaaacauuuucugaggccugccuuaugguccggaagccugcccuggaacuccugcacuaucugaaaaacaccagcuucgcuuacccggccauccgcuaucuccuguacggcgagaaggggacaggaaagacccuuucccugugucaugugauccacuuuugcgcuaaacaggauuggcucauucugcauauccccgacgcccaccuuuggguuaagaauuguagagaucugcuccagucuagcuauaacaaacagcgguucgaccagccucuggaggcguccacauggcugaagaauuuuaaaaccacgaacgaacgcuuccucaaucagauuaaggugcaggagaaguacgucuggaacaaaagagaaagcaccgagaagggcucuccccugggcgaggugguugaacaagggaucacacgggugcgcaaugccaccgaugcugucggaauugugcuuaaagagcugaagagacaguccagccucggcauguuucaccuccuuguggccgucgacgggaucaacgcucuguggggacggacaacccucaaacgcgaagauaagucuccuauugcccccgaggaacuggcgcugguucauaaucucagaaaaaugaugaagaacgacuggcacggcggggccaucguguccgcucugagccagacgggaucucuuuucaagccgcggaaagccuaucugccucaagagcuccugggcaaggagggcuuugaugcucuugaccccuucaucccuauucugguguccaauuacaaccccaaagaauuugagagcugcauccaguacuaucucgaaaacaauuggcugcagcaugagaaggcccccacagaagaggggaaaaaggagcugcuguuccuguccaacgccaauccuucucuucuggaaagacacugugcuuaccucuga

SEQ ID NO: 68156 - RNA, 615 nt, Artificial Sequence
  derived and/or modified sequence opt5 from DAP__Homo_sapiens__NP_001278892
augagcuccccucccgagggcaagcuggaaaccaaagccgggcacccgcccgcugugaaggccggaggcaugagaaucguccagaaacauccucacacaggggacacgaaggaggaaaaagauaaggacgaucaagagugggaaucuccccggguuaccaagauuagcccucgcagacuccggcgcuggcugacaagaucccggaugcccccuuggaccucuauccuuccgcaggagcccagcacauccucuagccaugcguccgagccuggagugcaccagcccgcuccuuggccccgccugugcuguaccugguacuucccggacagagaaaaccagcaauuucggccuaaucccacacuccugggcaaccuucgccagaaucaggugcugugcccucuccccuauauuagcaucuucaaaaccagaaacucuuccagccccaaucuggucuacggggagucuggauggauguccuuugaagaucauugugccccucggggcgccauuagccgcaucugccaggacccgagaaagauccuggcucucgugcuguuccaacagucucccgauguucuuguguauggccugaaaaacaagaaagcccacauuuga

SEQ ID NO: 68157 - RNA, 4293 nt, Artificial Sequence
  derived and/or modified sequence opt5 from DAPK1__Homo_sapiens__NP_004929
augaccguguucagacaggagaacgucgacgauuacuaugacacaggcgaggaacuggggagcggacaauuugccguugugaagaaaugccgggaaaaguccacgggccuccaguacgcugccaaauucaucaagaaacgcagaaccaagucuagccggcgcgggguguccagagaggauauugaacgggaggucucuauccugaaggagauucagcaccccaaugugaucacacuucaugaaguuuaugagaacaaaaccgacgugauucugauccucgaacuggucgcgggaggcgagcuuuuugauuuccuggcugagaaggaaagccucacagaggaagaggccaccgaauuucugaaacagauccugaaugggguguacuaucuccacucccugcaaauugcccauuucgaccuuaagccugagaacaucaugcugcucgaucgcaauguuccgaaacccagaauuaagaucauugacuuuggacuggcucacaagaucgauuucggcaacgaguuuaaaaauauuuucggcacaccugaauuuguggcccccgagaucgucaacuacgaaccucuugggcuggaggcugacauguggucuaucggagugauuaccuauauccuccugagcggcgccucccccuuccugggggauacgaagcaggaaacccucgcgaaugugagcgccgucaacuacgaguuugaggacgaauacuucucuaauacauccgcucuggccaaagauuucauucggcgccuucugguuaaggacccuaaaaagagaaugaccauccaggacagccuccagcauccguggauuaaacccaaggauacacaacaggcucugucucggaaggccuccgcggugaacauggagaaauuuaagaaauucgccgcucgcaagaaauggaagcagagcgugagacuuaucucucugugucagcggcucucccgcagcuuucuguccagaucuaauaugagcgucgcccgguccgacgauacccuggacgaagaggauagcuucgugaugaaggcuaucauucacgccaucaacgacgauaauguuccuggacuccaacaucugcuuggcucucuguccaacuaugacgugaaccagcccaauaaacacgggacgccuccccuccugauugccgcuggaugcggcaacauccagauucuucaacugcucaucaagagaggcagccgcaucgauguccaggacaaagggggaucuaaugcgguguacugggccgcucggcacggccauguugauacacugaaguuucugagcgaaaacaaauguccgcucgacgugaaggacaaguccggggagauggcccugcacgucgccgcuagauauggacacgccgauguggcgcagcuucugugcucuuucggcagcaauccuaacauucaggacaaagaggaagagacaccccuccauugugcugccuggcacggguacuauuccgucgccaaggcucugugcgaagccggauguaaugugaacaucaaaaaucgcgagggcgagaccccucugcuuaccgcuagcgcccggggcuaccaugauauuguugaaugccucgcggagcacggggccgaccugaacgcuugugauaaggacggacauaucgcccugcaccucgcugugagacgcugccaaauggaagucauuaaaacccugcuuucucagggcuguuuuguggauuaucaggaccggcacgggaauacaccccugcauguugccugcaaggauggaaacaugcccaucguggucgcgcucugcgaggccaauuguaaccuggacauuuccaauaaguacggcagaacgccucugcaccuugcugccaacaacgggauccucgauguggugcgcuaccugugccugaugggcgcuagcguugaagcccucaccacagacggaaaaaccgccgaggaucuggcucggucugagcagcaugaacacgucgcgggccuucuggccagacuccgcaaggacacacaccgggggcuguucauccaacagcugagaccgacccagaaucuucagccccggauuaaacucaagcuguuuggacauuccggcagcgggaaaacgacacugguggagucccucaaguguggacugcuucgcucuuucuuuagacggagacgcccucggcugagcuccaccaacucuagcagauuucccccuagcccccucgcuuccaaaccgaccgugucugucuccaucaauaaccuguauccuggcugcgaaaaugugagcguucgcucuagauccaugauguucgagcccgggcugacaaagggcaugcuugaaguguucgucgccccuacccaccauccccacuguagcgccgacgaucaaucuacaaaggcuauugacauccagaacgccuaccucaauggagugggcgauuucagcguuugggaguuuuccgggaacccuguguauuucugcuguuacgacuauuuugcggcuaaugaucccacgagcauucaugucgugguuuucucucuggaggaaccguacgagauccagcugaaccaggugaucuuuuggcucuccuuccugaaaagccuugucccuguggaggaacccauugccuuuggaggcaagcugaaaaauccccuccaagugguccugguugccacccacgcugacaucaugaacgugccucggccggccgggggagaguucggcuaugauaaggacacaucccugcuuaaagaaauucgcaauagauuugggaacgaucugcacaucucuaauaaacucuucgugcuggacgcgggcgcuagcggauccaaggauaugaagguccuccggaaccaucugcaggagauucgcucucagaucgugagcguuugucccccuaugacccaccuuugcgaaaagaucauuuccacacugcccucuuggagaaaacucaacggcccuaaucaacugaugagccugcagcaguuuguguacgacguccaggaucaacuuaacccccuggccuccgaggaagaccuccggcgcaucgcccagcagcugcauagcaccggggagauuaauaucaugcagucugagacggugcaagacguucuccugcuugauccuagauggcugugcaccaacgugcucggaaagcugcuguccgucgaaacaccccgggcccuucaccauuaccgcggcagauauaccguggaggacauucagcggcugguuccggauagcgacguggaggaacuccugcagauccucgaugcuauggacaucugugcuagagaucugucuuccgggacaauggucgacgugccugcccuuauuaaaaccgauaaucugcaccgcagcugggcggacgaagaggaugaggugauggucuacggaggcguucggaucgugcccguggaacaccugacgccuuuccccugcgggauuuuucauaagguccaggugaaccucugcagauggauccaccaacagucuacagagggcgacgccgacauucgccuguggguuaauggauguaaacuugcuaaccggggcgccgaacugcucgugcugcucgucaaucaugggcagggaaucgaggugcaaguuagaggccuggaaaccgagaagauuaagugcugucuucugcuggauuccgugugcagcacaaucgagaacgucauggcuaccacccucccggggcugcuuacagugaaacacuaucuguccccucagcagcuccgcgaacaccaugagcccgucaugaucuaccagccucgggacuucuucagagcccaaacgcugaaggaaaccagccucacaaauaccaugggaggcuauaaagagucuuuuagcuccauuauguguuucggcugccacgauguguacucucaggccagccuggggauggacauccaugcuuccgaucuuaaccugcugacacgccggaagcucucuagacugcuugacccucccgauccccugggaaaggacuggugucuccuggcgaugaaucucggccugccggaucuuguugccaaauauaacaccagcaauggggcucccaaggacuuucugccuucuccccugcacgcccuccugcgggaauggacgacauacccugaguccaccgugggaacccuuaugagcaaacugcgcgagcucggcagacgggaugccgcugacuuccugcugaaggccuccagcgucuuuaaaauuaaccucgaugggaacggacaggaagcguacgcuucuuccugcaauagcggcacaucuuauaacuccaucagcuccgugguuucucgcuga

SEQ ID NO: 68158 - RNA, 1113 nt, Artificial Sequence
  derived and/or modified sequence opt5 from DAPK2__Homo_sapiens__NP_055141
auguuccaggccagcaugagaucccccaacauggagccuuuuaagcaacagaaaguggaagacuucuacgauaucggcgaggaacuggggucuggacaguuugcuauugucaagaaaugccgggaaaagagcaccggccucgaauaugccgcgaaauucaucaagaagcgccaguccagagcuucucggcgcgggguuagcagagaggagauugaacgggagguguccauccugcgccaagugcuucaccauaaugucauuacacugcacgacguguacgaaaacagaacggauguugugcucauccuggagcuugucucuggaggcgagcuguuugacuuccucgcccagaaagaaagccuguccgaggaagaggccaccagcuuuaucaagcagauucuggauggggugaauuaucuccauacaaagaagaucgcucacuucgaccugaaaccggaaaacauuaugcuucuggauaagaauauccccauuccucauaucaagcucauugacuuuggacuggcccacgagaucgaggauggcguugaguucaaaaacaucuuuggcacccccgaguucguggcuccugaaauugucaauuacgagccccuugggcuggaagccgacauguggucuaucggagugauuacauauauccuccuguccggcgcgagcccuuuucugggggauaccaagcaggagacacucgccaacauuaccgcugugucuuacgacuucgaugaggaguucuuuucccaaacgagcgaacuggccaaagacuucauccggaaacuucuggucaaagaaacccgcaagagacucacaauccaggaggcucugcggcacccguggauuacccccguugacaaucagcaggccauggugcgcagagaaucuguggucaaccuugagaauuuucggaaacaauaugugcgcagacgguggaagcuguccuucagcaucguuucccucuguaaccaucugacaagaucucugaugaagaaagugcaccuccgcccugaugaggaccugcggaauugcgaaagcgauaccgaggaagacauugcgagacgcaaggcccuucauccccggagacgcuccagcacgucuuga

SEQ ID NO: 68159 - RNA, 1365 nt, Artificial Sequence
  derived and/or modified sequence opt5 from DAPK3__Homo_sapiens__XP_005259565
augagcaccuucagacaggaggacguggaagaucacuacgagaugggcgaggaacugggguccggacaauuugccaucguccggaagugccgccagaaaggcacagggaaggaauaugcugccaaauucauuaagaaaagacggcucucuagcucccgcagaggaguuucucgggaggagaucgaacgcgaggugaacauucugagagaaauccggcaucccaauauuaucacgcuucacgacaucuuugagaacaagaccgaugugguccugauucucgagcuggugagcggcggggaacuuuucgacuuucuggcggagaaggaaucccucacagaggaugaagcuacccaguuccugaaacagauccuggacggaguucauuaccuccacucuaagcgcauugcccauuuugaucugaaaccugagaauaucaugcuucuggacaagaacgugccgaaucccagaauuaaacucaucgauuucggcauugcccacaagaucgaggcuggcaacgaauuuaagaauaucuucgggacaccugaguuugucgcccccgaaauugugaacuaugagccucugggacuugaagcugacauguggagcaucggcguuauuaccuacauccugcucuccggggccagccccuuccugggagagacaaaacaagagacccugacgaauauuucugcggugaacuaugauuuugacgaagaguacuucuccaauaccagcgaacucgccaaggauuucauccggcgccugcuugucaaagacccuaagagacggaugacaaucgcucagucucuggagcacuccuggauuaaagccauccgcagacggaacgugagaggcgaagacagcgggcgcaagccggagcggagacgccucaaaaccacacggcugaaggaguauaccauuaagucucauuccagccuucccccuaauaacuccuacgcugauuuugaaagauucucuaaagugcuggaggaagccgcggccgcugaggagggacuccgcgaacugcagcggagcagacgccugugucacgaggacgucgaagcccucgcugccaucuacgaggaaaaggaggccugguaucgggaggaauccgauagccugggccaggaccuuagacgccugcggcaagagcuccugaaaacggaagcucuuaagagacaggcgcaggaggaagccaaaggcgcucugcucgggacaucuggacugaagcggcgcuuuuccagacuggagaaucgguacgaggcccucgccaagcagguugcuagcgaaaugagauucgugcaagaucuggugcgcgcccuugagcaggaaaaacugcagggcgucgagugcgggcuccgguga

SEQ ID NO: 68160 - RNA, 1938 nt, Artificial Sequence
  derived and/or modified sequence opt5 from DARS2__Homo_sapiens__NP_060592
auguacuuccccagcuggcugucccagcucuauagaggccugucucggccuauccgcagaaccacacaaccgauuugggggagccuuuaccggucccugcuccagucuagccagcgcagaauccccgaguuuuccucuuucgugguccggacgaauaccugcggagaacugcgcagcucccaccuuggccaggagguuacacuguguggguggauucaauauagacggcagaacaccuuucucgugcugcgcgacuucgauggacuggugcaggucaucauuccucaggacgaaagcgccgcuucugugaagaaaauccucugcgaggcccccguugaauccgugguccaagugagcggcacaguuaucucuagaccugcggggcaggagaaccccaagaugccuaccggagagauugaaaucaaagugaagacagcugagcugcuuaaugccuguaaaaagcugccguuugaaauuaagaacuucgucaaaaagaccgaggcccuccggcugcaguaccgcuaucuugaucugagauccuuucagaugcaauacaaucuccggcugcgcagccagauggugaugaaaaugagagaguaucugugcaaccuccauggcuucguggacaucgaaacgcccacccuguuuaagcggacaccuggcggggcuaaagaguuccuuguccccucuagagaaccuggaaaguuuuacucccugccccagagcccgcaacaguucaagcagcuccugaugguuggcgggcuugaucgcuacuuucagguggcccgguguuauagagacgagggaucccgcccugaucggcaacccgaguucacccagauugacaucgagaugucuuucguggaucagacaggcauucagagccugaucgaggggcuccugcaauacuccuggccuaaugacaaagaucccgucgugguucccuuuccuaccaugacguucgcugaagugcuggccacauauggaaccgacaagccggauacaagauuuggcaugaaaaucauugacaucagcgacgucuuccgcaacaccgagauuggcuuucuccaggaugcgcugucuaagccccacgggaccgugaaagccaucugcauuccugaaggagcuaaguaccuuaaacggaaggacaucgaguccaucagaaauuucgccgcugaucauuuuaaccaggaaauucugcccguuuuccucaaugccaaccgcaauuggaacagcccuguggcgaauuuuaucauggagucucagcggcuggagcuuauuagacugauggaaacacaagaggaagacgucgugcuccugacggccggcgagcacaacaaggcuuguagccugcucgggaaacugcgccuugaaugcgccgaucugcucgagacccggggagucgugcugagagaccccacacuguucuccuuucuuuggguuguggauuucccgcucuuucugccuaaggaggaaaacccccgggagcuggaaucugcucaucacccuuucaccgcuccccacccuagcgacauccaucuccuguauacagagcccaaaaaggcccgcucccagcacuacgaucuuguccugaauggcaacgagauugggggaggcagcaucagaauccauaaugccgaacuccagcgguauauucuggcgacccugcuuaaagaggacgugaagaugcucucucaucugcugcaggcccucgauuacggcgcuccgccucacgggggaaucgcccugggccuugacagacugauuugucucguuacggggucccccagcauccgcgacgugauugccuuccccaagucuuuucggggacacgaucugauguccaacacaccugacagcgucccgcccgaagaacugaaaccuuaccacaucagaguguccaagcccaccgauucuaaagcugaacgcgcccauuga

SEQ ID NO: 68161 - RNA, 1206 nt, Artificial Sequence
  derived and/or modified sequence opt5 from DARS__Homo_sapiens__NP_001280241
auggugaaguucgccgcuaacaucaauaaagagagcauugucgacguugaaggcguggugagaaaggucaaccagaaaaucggguccugcacccaacaggauguggagcugcacguucagaagauuuacgugaucucucucgccgaaccccggcugccucuucagcuggacgaugcgguccgcccggaggcugaaggagaggaggaaggcagagccacagugaaucaagacacgcggcucgauaaccgcguuauugaccugagaaccagcacaucccaggccguguuucggcuucagucugggaucugucaucuguuccgcgagacccucaucaauaaaggauuugucgaaauucagacacccaagaucauuagcgcugccuccgagggcggggcuaacguguucaccgugucuuauuuuaagaauaacgccuaccuggcgcaaagcccucagcuguauaaacagaugugcaucugugccgauuucgagaaggucuuuuccauuggacccguuuucagagcugaagacagcaauacacaccggcaucucaccgaguuugugggccuggauaucgaaauggccuucaacuaccacuaucaugaggugauggaagagauugcugacacgaugguccagaucuuuaaaggccuucaagagcgcuuccagaccgaaauccagacagugaauaagcaauuuccuugcgagcccuucaaauuccuggaaccuacccucagacuggaguacugugaagcccuugcgaugcugcgggaggccgggguugagaugggagaugaagacgaucucucuacaccgaacgagaagcugcugggccaccucgugaaggaaaaauaugacaccgacuuuuacauucuggauaaguacccccuugcuguccgcccuuucuauacgaugcccgacccuagaaaucccaaacaguccaacagcuacgauauguuuaugcgcggggaggaaauccugucuggagcccagcggauucacgacccgcagcuccugacagagagagcucugcaucacggcaucgaucuugagaagauuaaagccuauaucgacuccuuccgguuuggggccccuccccaugcuggaggcggcaucgggcucgaaagagugaccaugcuguuccugggacuccacaauguucgccaaacaagcauguuuccucgggaucccaagagacugacccccuga

SEQ ID NO: 68162 - RNA, 1248 nt, Artificial Sequence
  derived and/or modified sequence opt5 from DAW1__Homo_sapiens__NP_849143
augaagcugaaaagccuccugcuuagauacuaucccccuggcaucaugcuggaguacgaaaagcacggggagcucaaaaccaaguccauugaccugcuugaucugggaccgucuacagacgugagcgcccucgucgaagagauccagaaagcugaaccccugcugacggccucccggaccgagcaaguuaagcuccugauucagcgccuucaggagaagcugggccagaacucuaaucauacauucuaucucuuuaaagugcugaaggcgcacauccuuccucugaccaacguggcucucaauaaaagcggguccugcuucauuacaggaucuuacgauagaaccuguaagcugugggacacagccagcggcgaggaacugaacacccucgaagggcaucggaaugucguguaugccaucgcuuuuaacaaucccuacggagauaaaaucgccacgggcuccuucgacaagaccugcaagcuguggagcguugagacaggcaaauguuaucacaccuuucgcgggcauacagcugagauugugugccuuucuuucaacccucaauccacccuggucgccacgggaagcauggauacaaccgcgaagcucugggacauccagaauggcgaagagguguacacacugagagggcacucugccgaaauuaucucccuuagcuuuaacaccucuggagaucggauuaucaccggcuccuucgaccacacaguuguggucugggaugcugacacggggcgcaaagugaauauucugaucggacauugugccgagaucagcuccgcuucuuuuaacugggauugcagccucauucugaccggcuccauggacaagacauguaaacugugggacgccaccaauggcaagugcguggcgacacucaccgggcacgaugacgaaauccuggauagcuguuucgacuacacgggaaaacuuauugccacagcuucugccgauggcaccgcuagaaucuuuuccgccgccacccggaagugcauugcuaagcuggaggggcaugagggagaaaucagcaaaaucucuuucaacccccagggcaaucaccuccugacagggagcuccgacaagaccgcgcgcauuugggaugcccagacaggacaaugucuucagguccuggagggccacacggacgaaaucuuuucuugcgcuuucaacuauaaaggcaacauuguuaucaccgggagcaaggauaauacaugcagaauuuggcgguga

SEQ ID NO: 68163 - RNA, 2259 nt, Artificial Sequence
  derived and/or modified sequence opt5 from DAXX__Homo_sapiens__NP_001135442
augagaggcagcgagaacugcggggaaggacggcuggagcgcagauuccucuccaucauugugcuggacgaugacgaugaagacgaggccgcugcccagcccggcccuucucacccgcuucccaaugcggcuagcccuggggccgaagcccccuccucuagcgagccucauggagcucggggcuccucuagcuccgggggaaagaaauguuacaagcuggagaacgaaaaacucuuugaggaguuccuggagcuuugcaagaugcaaaccgccgaucaccccgaggucguuccuuuucuguauaaucgccagcagagagcucauagccucuuccuggccucugcggaauuuuguaacauccugucccgggugcucagccgcgccagaucucggccggcuaaacuguacguguauauuaaugagcuuugcacaguccugaaggcccacuccgcuaagaaaaagcucaaccuggcccccgcggccacgaccagcaaugaaccuucuggcaacaaucccccuacacaucuuucccuggaccccaccaacgcugagaauacagccagccaguccccgcgcaccagaggcucucggcgccaaauccagagacucgaacagcugcuggcucucuacguggccgagauucggcgccugcaggagaaagaacuugaucugagcgagcucgacgauccugacuccgccuaucugcaagaagcuagacuuaagcggaaacugaucagacucuucgggcgccugugugagcugaaggauugcagcucucucacaggacggguuaucgaacagcgcauucccuacagaggcacccgguauccugaggugaacagacgcaucgagcggcugauuaauaagcccgggcccgacacguuuccugauuacggagacguccuuagagcgguggaaaaagccgcugcccgccacucccugggccucccgcggcagcagcugcaacuuauggcccaggacgcuuucagagauguugggauccgccugcaggagcggagacaccucgaccugauuuacaacuuuggaugucaucugaccgaugacuaucggcccggcguggauccugcccucagcgaccccguccuggcgcgcagacuucgggaaaauagaucucuggcuaugagccgccucgaugaggugaucuccaaguacgccaugcugcaagacaaaucugaagagggcgagcggaagaaaagacgcgccagacugcaggggacaagcucccacagcgcugauaccccugaagccucucuugacuccggagagggccccagcgggauggcuucucagggaugcccguccgccagccgggcggaaacagaugacgaggacgaugaggaauccgacgaggaagaggaagaggaggaagaggaagaggaagaggaggccaccgauucugaagaggaagaggaccucgaacagaugcaagagggccaggaggaugacgaagaggaagaugaggaggaagaggcugccgcugggaaggacggagauaaaagcccuauguccucucugcagauuagcaacgaaaagaaccuggagcccggcaagcagaucucccgcagcucuggcgaacaacagaauaaagggagaaucguguccccuagccuccugucugaggagccccuugccccuuccagcauugacgcggaaucuaacggagagcagcccgaagaacugacgcucgaagaggagagcccggucucccagcuguucgaacuggagaucgaagcccuuccucucgauacacccagcucuguugagaccgacauuuccagcucccggaagcaaucugaagaacccuuuacaaccgugcuggagaauggcgcugggauggugagcuccaccucuuucaacggaggcgucagcccucauaauuggggcgauuccgggccgcccuguaaaaagucucgcaaagaaaagaagcagacaggaagcggcccucuggggaacuccuauguggagagacagcggagcguucacgagaaaaauggaaagaaaaucugcacgcuccccucuccucccuccccucuggccagccuugcucccguggccgacucuuccacccgcgucgacagcccgucucacggccuggugacauccagccucuguauuccuucccccgccagacugagccagaccccucauucucaacccccgcggccugggacaugcaagaccagcguugcuacgcagugcgaucccgaggagaucaucgugcuguccgacucugauuga

SEQ ID NO: 68164 - RNA, 2235 nt, Artificial Sequence
  derived and/or modified sequence opt5 from DAZ1__Homo_sapiens__NP_004072
augagcgccgcuaaccccgagaccccuaauuccacaaucucuagagaagccagcacgcaguccucuagcgcggcugccucccaaggcugggugcugccggaggggaagauuguccccaacaccguuuucgugggaggcaucgacgcccggauggaugaaacagagauugggucuugcuuuggacgcuacggcagcgugaaagaagucaagaucauuaccaauagaacagggguguccaaaggauauggcuucguuagcuuugugaacgacgucgaugugcagaagaucguuggcucucagauccacuuccaugggaaaaagcucaagcugggaccugcuauucggaaacagaaacuuugugcccgccacgugcaacccagaccucuggucgugaaucccccuccgcccccucaguuucagaacguguggcggaaucccaacaccgagacauaccuccagccucaaaucacccccaauccggucacgcagcauguucaguccgcugccaacccugagacccccaauagcacaauuucucgcgaagcguccacccagucuucuuccgccgcugccagccaaggcugggugcugccugaggggaagaucgugcccaacacagucuucgugggaggcauugacgcuagaauggaugaaaccgagaucggguccugcuuuggacgguauggcucuguuaaggaggugaaaauuaucacgaaucgcacaggcgucagcaagggguacggauucguguccuuuguuaacgacguggauguccagaagaucgugggcagccagauucacuuccaugggaaaaagcugaaacuuggacccgccaucagaaagcaaaaacucugugcgcggcacguccagccucgcccgcuggugguuaaucccccucccccuccccaguuucagaacguguggagaaacccgaauaccgaaacauaucugcaaccucagauuacccccaacccugucacccagcacgugcagucugccgcuaaucccgagacaccuaacuccacgaucagccgggaagccucuacccaaagcuccucugcugccgccagccagggcuggguucuccccgaggggaagauugugccgaauacagucuucgugggaggcaucgacgcucgcauggaugaaaccgagaucggcuccugcuuugggagauacggaagcgugaaagagguuaagauuaucacaaaccggaccggcgucucuaagggguauggauucguguccuucgugaaugacgucgaugugcagaaaauuguuggcagccagauccauuuucacgggaagaaacugaaacuuggcccugcgauuagaaagcaaaagcugugugcccgccaugugcagccccggccccucgucgugaacccuccgcccccuccccaguuccagaauguuuggagaaacccuaauacggaaacauaccugcaaccccagaucaccccuaaccccgugacccagcacguccaggcuuacucugccuauccgcacuccccuggacaagugaucacaggcugccagcuucugguuuacaauuaucaggaguaccccaccuauccugacagcgccuuucaagugacaacgggguaccagcuccccgucuauaacuaccagccguucccugcuuacccccgcuccccuuuucaggugaccgccggauaucaacugcccguguacaauuaucaggcguuccccgcuuacccuaacucuccguuucaggucgccacaggcuaucaguuccccguuuacaacuaucaaccuuuucccgccuacccuagcucccccuuccaggugaccgcuggguaccagcugccuguguauaauuaccaagccuuuccggcuuaucccaacucuccuuuccaggucgccacaggauaccaguuucccguguauaauuaccaggcguucccugccuaucccaacagcccgguucaagugaccacgggcuaccagcucccugucuacaauuaucaggcuuuccccgccuaccccuccagcccuuuucaggugaccacaggguaucaacugcccguuuacaacuaucaggcuuucccugccuacccgaauagcgcggugcaggucaccacaggcuaucaguuucauguguacaacuaccaaaugcccccucagugucccguuggagaacagcggagaaaucuuuggaccgaggccuauaaguggugguaccuggugugccucauucagcgccgggauuga

SEQ ID NO: 68165 - RNA, 1605 nt, Artificial Sequence
  derived and/or modified sequence opt5 from DAZ2__Homo_sapiens__NP_001005785
augagcgccgcuaaccccgagaccccuaauuccacaaucucuagagaagccagcacgcaguccucuagcgcggcugccucccaaggcugggugcugccggaggggaagauuguccccaacaccguuuucgugggaggcaucgacgcccggauggaugaaacagagauugggucuugcuuuggacgcuacggcagcgugaaagaagucaagaucauuaccaauagaacagggguguccaaaggauauggcuucguuagcuuugugaacgacgucgaugugcagaagaucguuggcucucagauccacuuccaugggaaaaagcucaagcugggaccugcuauucggaaacagaaacuuugugcccgccacgugcaacccagaccucuggucgugaaucccccuccgcccccucaguuucagaacguguggcggaaucccaacaccgagacauaccuccagccucaaaucacccccaauccggucacgcagcauguucaggcuuauuccgccuacccucacagccccggccaggugauuaccgggugccaacugcuuguguauaacuaccaggaguauccuacauaccccgacucugcguuccaggucaccacaggauaccaacugcccguguauaauuaccagccuuuuccggccuauccccgcuccccuuuccagguuaccgcuggcuaccagcuccccguguauaacuaccaagccuuuccugcuuaucccaauagcccguuccaggucgccacgggguaccaguuuccuguguacaacuaucagcccuucccugcguaccccucuuccccuuuucaaguuacagccggauaucagcugcccguguacaauuaucaggcuuucccggccuacccuaacagccccuuccaggucgcuaccggcuaucaauuucccguguacaacuaccaggccuucccugccuaucccaauuccccgguccaggugacaaccggcuaccagcugccuguuuauaacuaccaggcuuuucccgcguauccuucuagccccuuccaagugaccacaggguaccagcucccugucuauaauuaccaagccuuucccgcuuacccguccagcccuuuccaggugacgaccggauaucagcugcccguuuacaacuaucaggccuuuccugccuaccccucuuccccguuccaagugacaaccggcuaucagcuuccugucuacaauuaucaggcuuuucccgccuacccuagcucucccuuccaggugacaaccggguaccaacugcccguguauaacuaccaggcguuuccugcuuauccgagcucccccuuccagguuacgacaggauaccagcucccugucuauaauuaccaagccuuucccgccuauccuucuagccccuuccaggugaccaccggcuaccagcugccuguguacaacuaucaggcuuucccggccuaccccaauuccgcuguccaagugacaaccggguaucaguuucauguuuacaacuaucagaugccuccccaauguccugugggagaacagagacggaaucuuuggacagaggccuacaaguggugguaucuggucugccucauccagcgcagagauuga

SEQ ID NO: 68166 - RNA, 1317 nt, Artificial Sequence
  derived and/or modified sequence opt5 from DAZ3__Homo_sapiens__NP_065097
augagcgccgcuaaccccgagaccccuaauuccacaaucucuagagaagccagcacgcaguccucuagcgcggcugccucccaaggcugggugcugccggaggggaagauuguccccaacaccguuuucgugggaggcaucgacgcccggauggaugaaacagagauugggucuugcuuuggacgcuacggcagcgugaaagaagucaagaucauuaccaauagaacagggguguccaaaggauauggcuucguuagcuuugugaacgacgucgaugugcagaagaucguuggcucucagauccacuuccaugggaaaaagcucaagcugggaccugcuauucggaaacagaaacuuugugcccgccacgugcaacccagaccucuggucgugaaucccccuccgcccccucaguuucagaacguguggcggaaucccaacaccgagacauaccuccagccucaaaucacccccaauccggucacgcagcauguucaggcuuauuccgccuacccucacagccccggccaggugauuaccgggugccaacugcuuguguauaacuaccaggaguauccuacauaccccgacucugcguuccaggucaccacaggauaccaacugcccguguauaauuaccagccuuuuccggccuauccccgcuccccuuuccagguuaccgcuggcuaccagcuccccguguauaacuaccaagccuuuccugcuuaucccaauagcccguuccaggucgccacgggguaccaguuuccuguguacaacuaucaggcguuccccgccuacccuaauucucccguucaagugacaaccggauaucagcugccugucuacaacuaucaggcuuuucccgccuacccgaacuccccuuuccagguggcuacaggcuaucaauuccccgucuacaauuaccaggccuuucccgccuauccuaacagcccggugcagguuaccaccggcuaccagcugcccguguauaauuaccaggcuuucccugcguaucccaacuccccuuuucaagucgccacaggguaccaguuccccguguauaauuaccaggcuuuuccugccuaccccaacucuccgguucaagugacgaccggauaucagcucccugucuacaauuaucaggccuuccccgcuuacccuaacagcgccgugcaagugacaaccggcuaucaguuucauguuuacaauuaucagaugcccccgcaguguccugucggggaacaaagacggaaccuguggacagaggcguacaaguggugguaccuugugugccugauccagcgcagagauuga

SEQ ID NO: 68167 - RNA, 1740 nt, Artificial Sequence
  derived and/or modified sequence opt5 from DAZ4__Homo_sapiens__NP_001005375
augagcgccgcuaaccccgagaccccuaauuccacaaucucuagagaagccagcacgcaguccucuagcgcggcugccucccaaggcugggugcugccggaggggaagauuguccccaacaccguuuucgugggaggcaucgacgcccggauggaugaaacagagauugggucuugcuuuggacgcuacggcagcgugaaagaagucaagaucauuaccaauagaacagggguguccaaaggauauggcuucguuagcuuugugaacgacgucgaugugcagaagaucguuggcucucagauccacuuccaugggaaaaagcucaagcugggaccugcuauucggaaacagaaacuuugugcccgccacgugcaacccagaccucuggucgugaaucccccuccgcccccucaguuucagaacguguggcggaaucccaacaccgagacauaccuccagccucaaaucacccccaauccggucacgcagcauguucaguccgcugccaacccugagacccccaauagcacaauuucucgcgaagcguccacccagucuagcuccgccgcugccagccaaggcugggugcugccugaggggaagaucgugcccaacacagucuucgugggaggcauugacgcuagaauggaugaaaccgagaucggguccugcuuuggacgguauggcucuguuaaggaggugaaaauuaucacgaaucgcacaggcgucagcaagggguacggauucguguccuuuguuaacgacguggauguccagaagaucgugggcagccagauucacuuccaugggaaaaagcugaaacuuggacccgccaucagaaagcaaaaacucugugcgcggcacguccagccucgcccgcuggugguuaaucccccucccccuccccaguuucagaacguguggagaaacccgaauaccgaaacauaucugcaaccucagauuacccccaacccugucacccagcacgugcaggccuacucugcuuauccccauuccccuggccaaguuaucacagggugccagcuccugguguacaauuaccaggaguaucccacguacccggacagcgccuuccaggucaccacaggauaucaacuuccuguguacaacuaucagcccuuucccgcuuacccucggucuccguuccaggugaccgccggcuaucagcugcccguuuacaauuaccaagccuucccugcuuaucccaacagcccuuuucaggucgcgacaggcuaccaguuccccguguauaauuaccaaccuuuucccgccuauccguccucuccuuuccaggugaccgcuggguaccagcuccccgucuauaacuaccaggccuuuccugccuaccccaauagcccguuccaaguggcuacgggauaucaguuuccuguuuacaacuaucaggccuuccccgcguacccuaauucccccgugcaggucacaaccggcuaucaacugcccguguacaacuaucaggcuuuuccugccuacccgagcucucccuuccagguuaccacaggguaccagcuuccuguguauaauuaccaagccuuucccgcuuauccuaacuccgccguccaggugaccacaggauaccaguuccacguuuauaauuaccaaaugcccccucaguguccggugggcgaacagcgcagaaaccuguggacggaggcuuauaaguggugguaccucgucugccugauucagcggagagauuga

SEQ ID NO: 68168 - RNA, 1224 nt, Artificial Sequence
  derived and/or modified sequence opt5 from DAZAP1__Homo_sapiens__NP_061832
augaacaauagcggcgccgacgagaucgggaagcuguucgugggaggccucgauugguccaccacacaggaaacgcugagaucuuacuuuagccaauauggggaggucguugacugcgugauuaugaaagauaagaccacaaaccagucccggggauucggcuuugugaaauucaaggaccccaauugugucgggaccgugcuugcuucucgcccucacacacuggauggaagaaacaucgacccgaaacccugcaccccucggggcaugcagcccgaacgcacaagaccuaaggagggcuggcagaaggggccccggagcgauaauuccaaaucuaacaagauuuuuguuggaggcaucccucauaauuguggggaaaccgagcuccgcgaguacuucaaaaaguuuggaguggucacggaagugguuaugauuuaugacgccgagaaacaaagaccgcggggcuucggguuuaucaccuucgaagaugagcagagcguggaccaggcggucaacaugcacuuucaugauaucaugggaaagaagguggaggugaaacgcgcugaacccagagacuccaagagccaggccccuggccaacccggcgccucucagugggggucccgggucguuccuaaugcugccaacggaugggcuggccagcccccgccuacauggcagcaaggguacggaccccagggcaugugggugccugccgggcaggcgauuggaggcuaugggcccccucccgccggccgcggagcuccgcccccucccccucccuucaccagcuacaucgugucuacaccgccuggcggguuucccccuccccaaggauucccucagggcuauggggcucccccgcaguucuccuuuggcuacggaccucccccucccccgcccgaucaguucgccccucccggcgucccucccccucccgccaccccgggggcggccccucuggcuuuucccccucccccgagccaagccgcuccugacaugucuaaacccccuacggcccagcccgacuuccccuacggacaguaugccggcuacgggcaggaucuuuccggauuuggccaaggguucagcgacccuucccagcagccgcccucuuauggcggaccuagcgugcccggcuccgggggaccucccgcuggcgggagcggauuuggcagagggcagaaucacaacguucaaggcuuccauccuuaccggcgcuga

SEQ ID NO: 68169 - RNA, 441 nt, Artificial Sequence
  derived and/or modified sequence opt5 from DAZAP2__Homo_sapiens__NP_001129736
augaacagcaagggccaguaccccacccaaccuacauauccggugcagcccccugggaaucccgucuacccucagacgcugcaccucccccaggccccuccguauaccgacgcucccccugccuacuccgagcuguauagacccucuuucguucauccuggagcggcuacagugcccaccaugagcgccgccaucccgauggcuuacuauccugugggccccauuuacccucccggguccacaguccuuguggaaggaggcuacgaugccggggcucgguuuggagccggcgcgaccgccggcaacauucccccuccgcccccugggugcccucccaaugcugcccaacuggcuguuaugcagggagccaacgugcucgucacacagcgcaaaggcaauuucuuuaugggagggucugacggcggguauaccaucugguga

SEQ ID NO: 68170 - RNA, 948 nt, Artificial Sequence
  derived and/or modified sequence opt5 from DAZL__Homo_sapiens__NP_001177740
auggccgcucccagcugcggcggggacagaaaggcccggcugaccccuucccucccgcacgagucuacagcgaaccccgaaacgccuaauagcaccaucucccgcgaggcuucuacacagagcuccucugccgccaccagccaaggauacauucugcccgaaggcaaaaucaugccuaacacaguguucgucgggggaauugauguuagaauggacgagaccgaaauccgguccuuuuucgcucgcuauggcagcgugaaggaggugaaaauuaucacagauagaaccggggucucuaagggauacggcuuuguguccuucuuuaaugacguugaugugcagaaaaucgucgagagccagauuaacuuccauggcaagaagcugaaacuggggcccgccauccggaagcagaaucucugugcuuaucacgugcaaccucgcccgcugguuuuuaaccaucccccucccccucaguuccagaauguguggacgaaccccaauaccgaaacauacaugcagccgaccacaaccaugaacccuauuacgcaauauguccaggccuaccccacauauccuaauucucccgugcaagugaucaccggauaccagcuucccgucuacaacuaucaaaugccuccgcaguggcccguuggcgagcagagauccuacguggugccucccgcguauagcgccgucaauuaccacugcaacgaaguggacccuggggcugagguugugcccaaugaguguucuguccaugaagccacaccgccuuccggaaacggcccccagaaaaagagcguggaucgguccauucagaccguugugucuugccuguuuaacccugagaaucgccucagaaacagcgucgugacccaggacgauuauuucaaagacaagcggguccaccacuuucgcagaucccgggcuaugcuuaagagcguguga

SEQ ID NO: 68171 - RNA, 2025 nt, Artificial Sequence
  derived and/or modified sequence opt5 from DBF4__Homo_sapiens__NP_006707
augaacagcggcgccaugagaauccacuccaaggggcauuuccagggaggcauucaagugaaaaaugagaagaaccggcccucucugaaaagccucaagaccgacaaucgcccugaaaaauccaagugcaagccgcugugggggaaagucuuuuaccuugaucugcccucuguuacaaucagcgagaagcuccagaaagacauuaaggaucugggaggcagaguggaagaguuccuuuccaaagacaucucuuaucugauuagcaacaagaaggaagcuaaauuugcccagacgcucgggcggaucuccccugugcccagcccugagucugcguacaccgcugagacaaccagcccccacccuucccaugauggaucuuccuucaagagcccggacacagucugucugucucgcggcaaacugcucguggaaaaggccaucaaagaucacgacuuuauucccuccaauagcauccuguccaacgcccuuucuuggggcguuaagauucugcauaucgaugacauuagauauuacaucgagcagaaaaagaaggaacucuaucugcuuaaaaagagcuccaccagcgugcgggaugggggaaaacgcgucggcucuggggcucaaaagacaagaaccggacggcugaaaaagccuuucgugaagguugaggacaugucccagcucuaccgccccuuuuaucugcagcugacgaauaugccuuucauuaacuacagcauccagaaacccugcucuccguuugauguggacaagccuagcuccaugcaaaaacagacccaggucaagcucagaauccagacagacggcgauaaauacgggggaaccucuauucaacugcagcuuaaggagaagaaaaagaaaggcuauugugaaugcugucugcagaaguacgaggaccucgaaacacaucugcuuagcgagcaacaccggaauuucgcccaguccaaccaguaucaggugguggaugacaucgucagcaaacugguuuuugauuucguggaauacgagaaggacacccccaagaaaaagcgcauuaaauauucugugggcucccucagcccugucucugcuuccgugcugaagaaaacggagcaaaaggaaaaaguugagcugcagcacaucagccagaaggauugccaggaagacgauacaaccgugaaggagcaaaauuuucucuacaaagaaacacaggagaccgagaagaaacugcuuuucauuuccgaacccaucccccacccuucuaacgagcugagagggcucaaugaaaagaugagcaacaaauguuccaugcugucuaccgccgaggacgauauccggcagaauuucacacagcuuccgcugcauaagaacaagcaagaaugcauucucgacaucagcgagcacacgcuguccgagaacgaccuggaagaacuccgcgucgaucacuauaaauguaauauucaggcgagcgugcauguuucugacuuuuccaccgauaacagcggaucucagcccaagcagaaauccgacacagugcuguucccugccaaggaucuuaaagaaaaggaccugcacagcaucuuuacccaugauucuggccucauuacaaucaauagcucccaagagcaccugaccguccaggcuaaggcccccuuccauacgccucccgaggaaccgaacgagugcgacuuuaaaaauauggauagccugccuucugggaagauccacagaaaagugaagauuauccuuggacggaacagaaaagaaaaucucgagcccaacgcugaguucgacaagcgcacagaguuuauuacccaggaggaaaaucggaucuguuccagcccuguccaaucccugcuggaucucuuccagaccucugaggaaaagagcgaguuucugggcuucacauccuacaccgaaaaaucugggauuugcaacgugcuugacaucugggaggaggaaaauagcgauaaccugcucacagccuuuuucuccucucccagcacguccaccuuuacaggauucuga

SEQ ID NO: 68172 - RNA, 1854 nt, Artificial Sequence
  derived and/or modified sequence opt5 from DBH__Homo_sapiens__NP_000778
augcccgcccugagcagaugggcuucccucccuggcccgucuaugcgggaggccgcguucauguacagcaccgcuguggccaucuuucuggucauucuuguugccgcucugcagggguccgcuccccgcgaaucuccucuccccuaucacaucccucuggaccccgagggaagccuugaacuguccuggaacgugucuuacacacaagaggcuauucauuuccagcuccuggugagacggcugaaggccggcguccucuuugggaugagcgaucgcggagaacuggagaaugcggaccuugugguucuguggacggauggcgacaccgccuauuucgcugaugccugguccgaccagaaagggcagauccaccucgauccucaacaggacuaccagcugcuucaggugcaaagaacaccggagggacugacccuccuguuuaagcggcccuucggcacaugcgauccuaaagacuaucugauugaagauggcaccguccaucucguguacgggauccuggaggaacccuuucgcagccuugaggcuaucaacggaucuggccugcagauggggcuccagagaguucagcugcuuaagccuaauauucccgagccggaacugccuuccgacgccuguacaauggaggugcaagcgcccaacauccagauuccuagccaggaaaccacguauuggugcuacaucaaagagcuccccaagggauucucucggcaccauauuaucaaguacgaacccauugucaccaaaggcaaugaggcccuggugcaccacauggagguguuucaaugugcuccugaaauggauuccgucccgcauuucagcgggcccugcgacucuaagaugaaaccugaccgccugaacuauuguagacacguucucgccgcuugggcccugggagccaaggcuuuuuacuaucccgaggaagcgggccuugccuucggcgggccuggauccagccgguaccugcgccucgaggugcauuaucacaauccccuggugaucgaaggcagaaacgauuccucugggauccggcuuuacuauacagcuaaacugcgcagauuuaaugccggaauuauggagcucggccuggucuacaccccggugauggccaucccuccccgggagacagcuuucauucugaccggguacugcacggacaaguguacacagcucgcccugccucccagcggaauccacauuuucgcgucccagcuucauacccaccugacaggcagaaagguugugaccguccucgugcgcgauggccgggaaugggagaucguuaaccaggacaaucauuauagcccucacuuucaagaaaucagaaugcugaaaaagguggucucugugcaucccggggauguccugauuaccuccugcacauacaacacggaggaccgcgaacuugcuaccgugggaggcuucgggauccucgaggagauguguguuaauuaugugcacuacuauccgcagacacagcuggaacugugcaaaagcgccgucgaugccggauuucuccagaaguacuuccaccugauuaaccgguuuaauaacgaggacguguguaccugcccucaagccucuguuagccagcaguucacauccgugcccuggaacucuuuuaauagagauguccuuaaagcccuguauagcuucgcucccaucuccaugcauugcaacaagagcucugccgugcgcuuucagggcgaauggaaucuccaaccucugccgaaagugauuuccacccuggaggagcccacgccucagugucccacaagccaggggcggucuccugcgggccccaccguugucuccaucggaggcgggaagggauga

SEQ ID NO: 68173 - RNA, 264 nt, Artificial Sequence
  derived and/or modified sequence opt5 from DBI__Homo_sapiens__NP_001073331
augagccaggccgaguucgaaaaggcugccgaggaagugagacaccugaaaaccaagcccuccgacgaggaaaugcucuuuaucuacggccauuauaaacaagcgacagucggggauauuaacacggagcggccuggaaugcuggacuucaccggcaaggcuaaaugggaugccuggaaugagcuuaaggggacaucuaaggaagacgccaugaaggcuuacaucaacaaaguugaggaacugaaaaagaaauauggaauuuga

SEQ ID NO: 68174 - RNA, 1950 nt, Artificial Sequence
  derived and/or modified sequence opt5 from DBN1__Homo_sapiens__NP_004386
auggccggcgugagcuucuccgggcacagacuggagcuccuggcugccuacgaagaggucauccgggaagagucugcggcugacugggcccuuuauaccuacgaagauggaagcgacgaucugaagcucgccgcuuccggcgaagggggacugcaggagcuuucuggccauuuugaaaaccaaaaaguuauguauggguucugcagcgugaaggacucccaggccgcucugcccaaauacgugcucauuaauugggucggagaggaugugccugacgcccgcaagugugcgugcgccucucacguugcuaaaguggccgaauuuuuccagggcgucgaugugaucguuaacgcuagcuccguggaggacauugaugccggcgcgaucgggcagagacugagcaauggacuggcccggcucucuuccccgguccugcaucgccuuagacugcgggaggacgaaaacgcugagcccgugggcacaacguaucaaaagaccgaugccgcuguggaaaugaagcgcauuaauagagagcaguuuugggaacaggccaaaaaggaggaggaacuccggaaagaggaagaacgcaagaaagcccuggacgaaagacuucgguucgagcaggagcgcauggaacaagagagacaggaacaggaggaacgggagcgcagauaccgggagagagaacagcaaaucgaggaacaccgccggaagcagcagacacuggaggcugaggaagcgaagagacgccucaaagagcaaagcaucuuuggggaucaucgggacgaagaggaagagacccacaugaagaaaucugaguccgaagucgaggaagccgcugccauuaucgcccagagaccugacaacccccgcgaguucuuuaagcagcaggaacggguugcuagcgccucugcgggauccugugaugugccuagccccuucaaucacagaccuggcucccaucuggacucucaccgccggauggcuccgacacccauuccuaccagaagccccuccgauagcucuacagccuccaccccuguggccgagcaaaucgagcgcgcucuggacgaagucacgagcucucagcccccgccucugcccccucccccucccccggcccaggagacccaggaacccagcccuauucucgauuccgaggaaacacgggcugccgcgccccaagccugggcugggccuauggaggagcccccgcaggcccaggcuccucccagaggaccuggcucucccgccgaagaccuuauguuuauggagagcgcggaacaggccgugcuggcugccccuguugagcccgcuaccgccgaugccacagagauccaugacgcugcggauaccauugaaacggacacagccaccgcugauacaaccguggccaacaaugucccgccugccgcuaccucccucaucgaccuguggcccggcaacggggagggagccagcacacuucaaggcgaaccccgggcgccuacgccgcccucugggaccgaggugacacuggcugaaguuccucuccuggacgagguggcccccgagccucugcuccccgccggagaaggcugcgcuacccugcuuaauuucgaugagcugccugaacccccggccacauuuugugacccugaggaagucgagggggagccccucgcggcuccucagacccccacgcugccguccgcccuugaggagcuggaacaggagcaggaaccugagccccaccuccugacaaacggagagaccacccaaaaagaaggcacacaggccagcgagggcuauuucucucagucccaagaagaggaguucgcucagagcgaggagcugugcgccaaggcuccuccucccguguuuuacaauaaacccccggaaaucgauauuaccuguugggacgccgaucccgucccugaggaagaggagggguucgaaggaggcgacuga

SEQ ID NO: 68175 - RNA, 1293 nt, Artificial Sequence
  derived and/or modified sequence opt5 from DBNL__Homo_sapiens__NP_001014436
auggccgcuaaccugagcagaaauggccccgcccuccaggaggcguacgugcgggucguuaccgaaaaguccccuacagacugggcucuguucacguaugaggggaacucuaaugauauccgcguggccggaaccggcgaagggggacuugaggaaaugguggaggagcugaacagcggcaaagucauguacgccuuuugcagagugaaggaccccaauuccgggcucccgaaauucguucugauuaacuggacaggagaaggcgugaaugauguccggaagggcgcuugugccucucacgugagcaccauggcuuccuuucuuaaaggggcccauguuacaaucaacgcgcgcgccgaggaagacguggagccugagugcauuauggaaaaggucgcuaaggccucuggagcuaauuauagcuuccacaaagaguccggcagauuucaagauguggggccccaggccccugugggaagcgucuaccagaagaccaacgcgguuucugaaaucaaacgggugggcaaggacuccuucugggccaaagcugagaaggaagaggagaaucgcagacuggaagagaagcggcgcgccgaagaggcucagagacaacucgaacaggagcggcgcgagagagaacugcgggaggccgcccgcagagaacagcgguaucaggagcaagggggagaagcuagcccccagagaacaugggagcagcagcaagagguggucucucgcaaccggaaugaacaggaguccgcggugcauccuagagaaauuuuuaaacagaaggagcgcgccaugagcaccacgucuaucuccagcccgcaacccggcaaacugcgguccccuuuccuccagaagcagcugacccagcccgagacacacuuuggcagagaaccugcugccgccaucucucgcccccgggcugaucuuccggccgaggaaccugcgcccagcaccccucccugucugguucaagcugaggaagaggccguguacgaggaacccccugagcaggaaacauucuaugagcagccgccccucguccagcaacagggggccggauccgaacauauugaccaccacauccagggccaggggcugagcggacaaggccuuugcgcuagagcccuguacgauuaccaggcugccgacgauaccgagauuucuuuugacccugagaaccucaucacggggauugaagugaucgaugagggaugguggcgcggcuauggccccgacgggcauuucggaauguuuccugcgaauuacguugaacugauugaguga

SEQ ID NO: 68176 - RNA, 978 nt, Artificial Sequence
  derived and/or modified sequence opt5 from DBP__Homo_sapiens__NP_001343
auggccagacccgugagcgaccggaccccugcuccgcugcuccugggcgggcccgccggaacaccucccggcgggggagcgcuucugggccuccgcucccugcuucaggggacgucuaagccuaaagagcccgcuagcugccugcucaaggaaaaagagagaaaggccgcccugccugcugccaccacaccgggacccggccuggaaaccgcuggcccugccgaugcgcccgccggggcugucguuggaggcggguccccucggggacgccccggcccggugccugcccccgggcuccuggcuccucuucugugggagagaacacuccccuucggagacguggaauacgucgaucuggacgccuuucuucuggagcacggccugcccccuucuccgcccccucccggcgggccuagccccgagccguccccugcgcggacccccgccccuucucccggaccuggcagcuguggguccgcuagccccagaucuuccccgggacaugccccugcucgcgccgcccucggcacagcuagcgggcaccgggcgggacugaccucucgcgauacgcccucccccguggacccugauaccguugaagugcucaugacauucgagccggaccccgccgaucuggcucuuagcucuaucccuggccaugaaaccuuugaccccagacggcaccgcuucuccgaggaggaacugaaaccucaacccauuaugaagaaggccagaaaaauccaggucccugaggaacagaaggaugagaaauauuggagccggcgcuacaagaacaaugaagccgcuaaaagaucccgggacgccagacgccucaaggagaaccagauuucugugcgggcggcuuuucuggagaaggaaaaugcccuucugagacaagagguuguggccguccgccaggaacucagccauuaucgggcugugcuguccagauaccaggcccagcacggcgcucuguga

SEQ ID NO: 68177 - RNA, 1635 nt, Artificial Sequence
  derived and/or modified sequence opt5 from DBR1__Homo_sapiens__NP_057300
augagaguggccgucgcuggcugcugucacggggagcuggacaagaucuacgaaacccucgcccuggcggagcggcgcggacccggcccuguugaucuucugcucugcuguggggacuuccaggcugugagaaacgaagccgaucugcggugcauggccgugccgcccaaauaucgccauaugcaaacauuuuacagauauuacagcggagagaagaaagcuccuguccuuacgcuguucauuggcgggaaucacgaagccuccaaccaucuccaggagcugcccuauggaggcuggguggcuccuaauaucuacuaucugggccucgccgggguugugaaguaccggggaguccgcauuggcgggaucucuggaauuuuuaaaagccacgacuacagaaagggccauuucgagugucccccuuauaacuccucuaccauccggagcaucuaccacgugcgcaauauugaaguuuauaagcugaaacagcuuaagcagccgaucgauauuuuucugucccacgacuggcccagaucuaucuaccauuaugggaacaaaaagcaacuccugaaaacaaagagcuucuuucggcaggagguggaaaauaacacccuuggauccccugcggccagcgagcugcucgagcaccugaagcccacauacugguucucugcucaucugcacgucaaauuugccgcucucaugcagcaccaggccaaggauaaaggccaaaccgcgcgcgccacaaaguuccuggcucuugacaaaugccugccucauagagauuuucuccagauucuggaaaucgagcacgaccccuccgccccggauuaucuugaauacgacauugaguggcugaccauccuccgggcuacggaugaccugaucaaugugaccggccgccuguggaacaugccugaaaauaacgggcuccaugccagaugggacuacagcgccacagaggagggaaugaaggaagugcuggagaaacuuaaucacgaucugaagguccccuguaacuucucuguuaccgcugcgugcuaugacccuuccaagccccagacacagaugcaacucauucaucggaucaauccccagaccacggaauuuugugcccagcugggcauuaucgauauuaacgugagacuucagaaaagcaaggaggaacaccacgugugcggggaguacgaggaacaagacgaugucgagucuaacgacuccggagaagaucagagcgaguauaauacagacaccuccgcucugucuagcaucaacccugaugaaaucaugcucgacgaggaggaagaugaggacuccauugugagcgcccauucuggcaugaauacaccguccguugaacccagcgaccaggccucugaguucagcgcuuccuucucugaugugcgcauccugccugggagcaugauugucuccagcgacgauaccguggacucuaccaucgaucgggagggaaaacccggcggcacaguugaauccgggaacggagaggaccugacgaaggugccucucaaaagacugagcgaugaacacgagcccgaacaacgcaagaagauuaaacggagaaaucaggccaucuacgcggcugucgacgaugacgaugacgaugccgccuga

SEQ ID NO: 68178 - RNA, 1032 nt, Artificial Sequence
  derived and/or modified sequence opt5 from DBX1__Homo_sapiens__NP_001025036
augauguuccccggccugcucgccccuccggcuggguaccccagccugcuuagaccuacccccacacugacgcucccucagucccugcaaucugccuuuagcggacacuccucuuuccuuguggaggaccugauccggauuagcagacccccugcguaucucccgagauccguccccaccgcuucuaugagcccuccccggcagggcgccccuacagcccugaccgauacaggggcuuccgaccugggaagccccggcccggggucucgcagaggaggcuccccucccaccgccuuuagcccugcuucugaaacaaccuuccucaaguuuggcguuaacgccauccuguccagcgggccccggacggagaccucucccgcgcuucugcaguccgugccuccgaaaacauucgccuuucccuacuucgaaggcagcuuucagccuuucauucgcuccucuuauuuucccgcuagcuccagcguggucccuauccccggaaccuucucuuggccgcucgccgcuagagggaagccucggcgcggaaugcugagacgggccguguuuuccgauguucaacgcaaagcgcuugagaagauguuccagaaacagaaguacauuagcaagcccgaccgcaaaaagcuggccgcuaaacucggccugaaggauucucaggugaaaaucugguuccaaaaucggcgcaugaaguggagaaacagcaaggaacgggagcugcucuccucugggggaugcagagagcagacacugccuaccaaacuuaauccccauccugaccugagcgaugucggccagaagggccccgggaacgaagaggaagaggagggaccgggcuccccuagccaccgccucgccuaucaugcuucuuccgacccccagcaucugcgggaucccagacuuccugggccgcugcccccuagccccgcccacucuuccagcccuggaaaacccuccgacuuuucugauagcgaagaggaagaggaaggcgaggagcaagaagagaucacgguguccuga

SEQ ID NO: 68179 - RNA, 1362 nt, Artificial Sequence
  derived and/or modified sequence opt5 from DCAF12__Homo_sapiens__NP_056212
auggccagaaagguggucagccggaaacgcaaggcucccgccuccccuggcgcggggucugacgcucagggaccgcaauucggcugggaucacagccugcauaaaagaaagcggcugcccccuguuaaacgcucccucguguacuaucuuaagaacagagaggugcggcugcagaaugaaaccucuuacagccgcguccuccacggguaugccgcccagcagcugcccucccuucugaaggagagagaauuucaucucggaacacugaacaaaguguucgcuucucaauggcugaaucaccggcagguugugugcggcacgaaguguaacacccucuuugucguggacguucagacaagccagaucaccaaaauuccuauccugaaggaucgcgagcccgggggagugacacaacagggcugcggcauucaugccaucgaacuuaauccuuccagaacccugcucgcuacagggggagacaacccgaauagccuggccauuuaccggcuucccacccuggauccugucugugugggcgacgaugggcacaaagacuggaucuucucuaucgcguggauuuccgauacgauggccgugagcggaucucgcgacggcuccauggggcucugggaggucaccgaugacguucugacaaagagcgaugcuagacacaacgugucucgggugcccgucuaugcccauaucacccacaaggcucugaaagacauuccuaaggaggacacaaaucccgauaacugcaaagugcgcgcccucgcguuuaauaacaagaauaaagaacugggagccguuucccuugacggcuacuuccaucuguggaaggcugagaacacccucagcaaacugcuuuccacgaagcugccguauuguagagaaaaugugugccucgccuacggcucugaguggagcgucuacgcuguggggucccaggcccacguuagcuuucuggauccucggcagcccucuuauaacgugaaguccgucuguagcagagagcgcggaucuggcauccggagcguguccuucuacgaacacauuaucacagucgggaccggacaaggcucucugcucuuuuaugacauuagagcccagcgcuuccuggaggaacggcuuagcgcuugcuacggguccaaaccuagacuggcgggagagaaccucaagcugacaaccggcaaaggcuggcuuaaucaugaugaaaccuggcgcaacuauuuuagcgacaucgauuucuuucccaaugccguguacacacacuguuaugacucuuccgggacgaagcuguucguugcuggaggcccccucccuagcgggcugcauggaaacuacgccggccuguggucuuga

SEQ ID NO: 68180 - RNA, 1794 nt, Artificial Sequence
  derived and/or modified sequence opt5 from DCAF13__Homo_sapiens__NP_056235
augcaguggcccccuccguggagacggagcccccugguguccgccaccccucccccuggccccacacgcgggcuccugugcccuagacgggucucugaggcuggagacagcuccacggaaggcgcccgcaccgggcacagacauuacguuacaccggcggagucugcuauggaaggacggagccaaccccuuccuucccugcgccccgccucuccuaccaacgcccccgcucacggcagagggagcgauuguacagccaaggagccgccucucgcuaaugugugccggcagaacuauggagccgcgcaggaccccguggaaccugccggccgcagauccgcuagccaugucaccgggucuucccugggcaaagccgagguggcuuguggacggcgcuggagaugggccgagcuucuggcggauacaagcuggucucccgccggccgggcuaccgaaaugaagguuaaaaugcucucccgcaaucccgacaacuacgugagagagacgaagcuggaucugcagcgggucccuagaaauuaugacccggcccuccaccccuucgaagugccucgcgaguacauccgggcucugaacgccaccaaacuugagagaguuuuugccaagcccuuccuggcuagccucgaugggcaucgcgacggagugaauugccuggcgaagcacccugaaaaacuugccacaguccugucuggcgcuugugauggggaggugcggauuuggaaccucacccaaagaaauugcauccgcacaauucaggcccacgaaggauuugugcggggcaucuguaccagauucugcggcacguccuuuuucacagucggggacgauaagaccguuaaacaguggaagauggacggacccggcuauggggaugaggaagaaccgcugcauacaauucugggaaaaaccguguacaccggcaucgaccaccauuggaaggaggccguguuugcuacaugugggcagcaagucgacaucugggaugaacagcgcacgaacccuauuugcagcaugaccuggggauucgacuccaucucuagcgugaaguuuaaucccauugagacauuccuccugggcuccugugccagcgaucggaacaucguucuuuaugacaugagacaggcgaccccucugaaaaaggugauucucgauaugcgcacaaauaccaucugcuggaaccccauggaggcuuuuauuuucacggccgccaaugaggacuacaaccuguacacauuugauaugcgggcucuugacaccccugucauggugcacauggaucacguuucugccgugcuggacgucgauuauucccccaccggcaaagaguucgugagcgcuucuuucgacaagagcaucagaaucuuuccggucgacaaaucccggucucgcgaaguguaccauacaaagagaaugcagcacguuauuugcgugaaauggaccagcgauuccaaguauaucaugugugggagcgacgagaugaacauucggcucuggaaggccaaugcgucugaaaaacugggaguccugacauccagagagaaggccgcuaaagauuacaaccaaaagcucaaagaaaaguuccagcauuauccucacaucaagcgcauugcccggcauagacaucugcccaaaagcaucuacucucagauccaagagcagcgcauuaugaaggaagcuagacggcgcaaagaggugaauagaaucaagcacuccaaacccggcagcguuccucuuguguccgagaagaagaaacacgucguggccgugguuaaguga

SEQ ID NO: 68181 - RNA, 1362 nt, Artificial Sequence
  derived and/or modified sequence opt5 from DCAF17__Homo_sapiens__NP_001158293
augggccccaccagaaagccuaacgugugcagccggcugucccgcagagcccucggguguuucucucgggacgcuggagucguucagcgcacaaaucugggcauccuuagagcccuggugugccaagagagcacgaaauuuaagaacguguggaccacacacucccggucuccgauugcguacgaacgcgggagaaucuauuucgauaauuaccggcgcugugucagcuccguggcuucugagcccagaaaacucuaugaaaugccuaagugcagcaaauccgagaagauugaagacgcccugcuuugggagugucccguuggagauauccugccuaacagcucugacuacaaguccagccucauugcccugaccgcucauaauuggcugcuccggaucucugccacaaccggcaaaauccuggagaagauuuaucuugcucccuacugcaaauuucgcuaucuguccugggauacaccucaggaagugaucgccgucaagagcgcgcagaacagagggucugccguggcucggcaggccgggauucaacagcacguucuccuguaccuugcuguguuccgcguccugccguuuucccucgugggcauccuggagauuaauaaaaagaucuucggcaacgugaccgacgccacgcugagccaugggauucucaucgucauguacuccucuggacugguuagacuuuauagcuuucagaccaucgcggaacaguucaugcaacagaagcuggaucucggcugugccugccgguggggaggaacaaccggcacagugggggaggcucccuuuggcauuccuuguaauaucaaaauuaccgacaugcccccucugcuuuucgagguguccagccuggaaaacgccuuucagaucggaggccaccccuggcauuacauugucacgccgaauaagaaaaagcagaaagggguguuccacaucugcgcucucaaggauaacucucugaaugagaacguucugacagugaccgccuccggaagagucgugaaaaagagcuuuaaucuccuggacgaugacccugaacaagagacauucaagaucguugauuaugaagacgagcuugaccugcucucuguggucgccgugacccagauugaugcugagggcaaagcgcaccuggacuuccauuguaacgaauacgggacccuucucaagagcaucccccuggucgaguccugggaugugacauauucucacgaaguuuacuuugaccgcgaucuggugcugcauauugagcagaaaccuaaccgggucuucagcugcuauguguaccaaaugaucugcgacacgggagaagaggaggaaaccauuaauagauccuguuga

SEQ ID NO: 68182 - RNA, 1470 nt, Artificial Sequence
  derived and/or modified sequence opt5 from DCAF4__Homo_sapiens__NP_001156980
augaacaagagcagauggcagucccggcgcagacacggccggcgcucucaucaacagaaucccugguucagacugcgggacagcgaggaucgcuccgacucuagagccgcucagccugcccacgauagcgggcauggagacgaugaauccccgucuaccagcuccggcacagcggggacgagcucugugcccgagcucccuggauuuuacuucgaccccgagaaaaagcgguauuuucgccugcuuccuggccacaacaauugcaacccccugaccaaagaauccaucagacagaaggaaauggagagcaaacggcuccgccugcuucaagaggaagauagacggaagaagauugcucgcaugggguucaaugccucuuccaugcugagaaaaagccagcucggauuucugaacgucacaaauuacugucaucuggcccacgagcuccggcugucuugcauggaaagaaagaaaguucagauccgcuccauggacccuagcgcucuugccuccgaucgguucaaccugauucucgcugacaccaauucugauagacuguuuacagugaacgacgugaaggucggcggcagcaaauaugggaucauuaaucuucagucccugaagaccccgacacucaagguguucaugcacgagaaccuguacuuuaccaaucgcaaaguuaacagcguguguugggccucucugaaucaucucgauucccacauccugcuuugccugaugggacucgcggagacgcccggcugugccacccugcuuccugcuagccuguucgucaacucucaucccgccgggaucgaccggccuggaaugcucugcagcuuucgcauucccggcgcuugguccugugccuggucucugaacauccaagcgaauaacugcuucagcacagggcuguccagacgggugcuccugaccaauguugugacaggacacagacagagcuuuggcaccaacucugacguccuugccccgcuccuguucaauggcugucgcuccggggaaauuuucgcuaucgaucugcggugcggaaaccagggcaagggguggaaagccacgagacuuuuucacgacagcgcugugacaucugugcgcauucugcaggaugagcaauaucucauggccuccgacauggccggaaagaucaaacugugggaucugcggaccacaaagugugucagacaguacgaaggccauguuaaugaguaugcuuaccucccucugcacgugcaugaagaggaggggauucuuguggcggucggacaggacugcuacacccggaucuggagccugcacgaugcccgccuccugagaaccauccccuccccuuaucccgcuucuaaagccgacauucccagcguggccuucuccucucggcugggcggcagcagaggggcuccuggacuucucauggccguuggccaagaucuguacugcuauuccuacagcuga

SEQ ID NO: 68183 - RNA, 2583 nt, Artificial Sequence
  derived and/or modified sequence opt5 from DCAF5__Homo_sapiens__NP_001271136
auggagcaggccauccacagcagagugaagcccauucaacugaaaggcgaacaucacuccaacaucuucugccucgcuuuuaauucugggaacaccaaggucuucagcggaggcaaugacgagcagguuauucugcaugauguggaauccucugagacacuugacguguuugcccacgaagaugcggucuacgggcugagcguguccccuguuaacgacaauaucuucgcuucuagcuccgaugacggacgggugcucauuugggauauccgcgagagcccgcauggcgagcccuuuugucuggccaacuauccuucugccuuccacuccgucauguuuaaucccguggaaccuagacuucuggcuacggccaacagcaaagaggggguuggacucugggacauccggaagccccagucuucccugcugcgcuacggcggcaaucucagccugcagucugcuauguccgugagauucaacagcaaugggacccaacuucuggcccuccggcgcagacugccuccgguccuuuaugauauucacucccggcugcccguguuucaguucgacaaccagggauacuuuaauucuugcacaaugaaaagcuguugcuucgcgggcgaucgcgaccaguauauccucuccgggagcgaugacuuuaaccuguacauguggcggauuccugccgaccccgaagcuggaggcaucgggagaguggucaauggagccuucaugguucugaagggccaucgcucuauugugaaccaagugagauucaacccucacaccuauaugaucuguuccagcggcgucgagaagauuaucaaaaucuggucucccuacaagcagccggggugcacaggagaucucgacggccggauugaggaugacagccgcugucuguacacccaugaagaguauaucucccuugugcugaauagcgggagcggacucucccacgauuacgcuaaccagagcguucaggaagacccuagaaugauggccuuuuucgauucucuggugcggagagagauugaaggcugguccagcgacucugauuccgaccuuagcgaguccacaauccugcaacuccacgcgggggucucugagcgcagcggauauaccgauuccgaaucuagcgccucccugccccggagcccuccucccacgguggacgagucugcugacaaugccuuucaucugggcccccucagaguuaccacaaccaacacaguggcuuccaccccgcccacgccuacaugcgaagaugccgccagccgccagcagcggcugucugcucuuagacgcuaccaagacaaacggcugcucgcgcuguccaaugagagcgauucugaagagaacgucugugagguggaacuugacaccgaucuguuccccagaccucgcagccccuccccggaggacgaaucuucuuccagcuccucuagcuccucuagcgaggaugaagaggagcucaaugaacggagagccuccacauggcagcgcaacgcuaugcggagacggcagaagaccacccgcgaggacaaaccuucugcccccauuaagccuacaaauacguauaucggcgaagauaacuacgacuauccccagaucaaggucgaugaccugagcuccagcccuaccucuucccccgagagaagcacaucuacccuggagauucaaccgucccgggccagcccuacaucugauaucgaauccguggagagaaaaauuuacaaggcuuacaaauggcuccgcuauagcuacaucuccuauagcaauaacaaggacggggaaaccucucugguuacgggagaggccgacgaaggccgggcggggacaagccacaaagauaaucccgcucccuccucuagcaaggaggccugccuuaacauugccauggcucagagaaaucaggaccugccuccggagggauguuccaaagauaccuuuaaggaagagacaccccgcacaccuucuaacggccccgggcaugaacacagcucccaugccugggcugaggugccugaaggcaccucucaggacacaggaaacagcggcuccgucgagcaccccuucgagacgaagaaacucaaugggaaggcccugagcucuagagcggaagaaccucccuccccgccugugcccaaagccagcggaucuacccugaacuccggcagcgggaauugcccucggacacaauccgaugacucugaggagcgcagccuugaaaccaucugcgcuaaccacaauaacggaagacuccauccccggccgccucacccccauaauaacggccagaaucugggggagcuggagguuguggccuacuccagcccuggccacucugauacagaccgcgauaacuccagccucaccggaacgcugcuucacaaggacuguugcggcucugaaauggcuugugagacccccaaugccgggacaagagaagaucccaccgacaccccugcgaccgauagcucccgggccguccauggacacucuggccugaaacgccagagaaucgagcucgaggacacggacagcgaaaacuccucuagcgagaagaagcugaaaacauga

SEQ ID NO: 68184 - RNA, 2583 nt, Artificial Sequence
  derived and/or modified sequence opt5 from DCAF6__Homo_sapiens__NP_001017977
augagcagaggcggguccuacccccaucugcucugggacgugcggaagcgcucucugggacuugaggauccuagcagacugcggucccgcuaucucggcagacgggaauuuauccagcgccugaaacuugaggccacccugaacguccacgacgggugcguuaauacaauuuguuggaacgauacgggagaauacauccucucuggcagcgacgauaccaagcuggugauuuccaauccguauucuagaaaagugcugacaaccauccggagcgggcaccgcgcuaacauuuucuccgccaaguuccuccccugcacaaaugacaaacaaaucgucagcuguucuggagauggcgugaucuuuuacaccaacguugagcaggacgcggaaacaaauagacagugccaguucaccugucauuauggcacgaccuacgagauuaugacagugccuaacgaucccuauaccuuucuguccugcggggaggacggaacaguccggugguucgauacccgcaucaagacgagcuguacaaaggaagacugcaaagaugacauucuuaucaauuguagacgggcugccaccucuguggccauuugcccucccaucccuuacuaccuggcuguuggcuguuccgacagcucugugcgcauuuaugauagacggaugcucgggacaagagccaccggaaacuacgcuggccgcgggaccacaggaauggucgcccgguuuaucccgucccaccugaauaacaagagcugcagagugacgucccuuugcuauucugaggacggccaagaaauccuggugagcuacuccagcgauuauauuuaccucuucgaccccaaagaugacaccgcgcgcgagcugaagacaccuucugccgaggaacggagagaggaacugcgccagcccccugucaaacggcucagacugcgcggcgauugguccgacaccgggccccgggcuagaccggagagcgaacgcgagcgggauggagagcagucuccuaauguuagccuuaugcagagaauguccgacaugcugucucggugguuugaagaggccagcgaaguggcucaauccaaccgcggcagagggcggagcagaccccgcggaggcacaucucaguccgauaucagcacccucccuacggugcccucuucccccgaccuggaggucagcgaaacagccauggagguggacaccccugcggagcaguuccuucagccguccaccucuagcacaauguccgcccaagcucauucuaccagcucccccacagaaagcccucacucuacgccccugcucuccagcccugauucugagcagcggcaguccguugaagccagcgggcaccauacccaccaucaaucugacaauaacaacgagaagcugagccccaagccgggaacaggcgaaccugugcugucccuccacuauagcaccgagggcacaaccacgucuaccauuaaacugaauuuuacagaugagugguccagcaucgcuuccucuagcagagggauuggaucccacuguaagucugaaggccaggaggaauccuucgucccccaguccucugugcagccucccgagggggacagcgagaccaaagccccugaagaguccagcgaagauguuacaaaguaccaagagggagugucugccgaaaaccccgucgagaaucauaucaacaucacccaguccgacaaauuuacggcuaagccgcuugauagcaauucuggcgagcgcaacgaccugaaucucgauagauccugcggggugccugaagagagcgcgucuuccgaaaaagccaaggagcccgaaacaagcgaccagaccuccacagagagcgcuaccaacgagaauaacaccaaucccgaaccucaguuccaaacagaggccacgggcccgucugcccacgaagagaccagcacacgggauuccgcucugcaggacaccgaugacucugacgaugaccccguccuuauuccuggagcccgcuacagagcgggccccggggaucggcgcagcgcuguggccagaauccaggaguucuuucggcgcagaaaggagcggaaagagauggaagaacuggacacacucaacauucgcagaccucugguuaagaugguguauaaaggacaucggaauagcagaaccaugaucaaggaagccaacuucuggggcgcuaauuuugucaugucugggagcgauuguggacacauuuucaucugggaccgccauacggccgagcaccugaugcuccuggaggcugauaaccacgugguuaacugccuucagccccauccuuuugaccccauccuggccuccucuggcauugauuacgacaucaaaauuuggagcccgcucgaagagucccggaucuucaauagaaagcuggcggaugaagugauuacacgcaacgagcugaugcuugaagagacccggaauaccaucacagucccugccagcuuuaugcucagaaugcuggcuucucugaaccacauucgcgccgaccggcucgagggggauagauccgaaggcagcggacaagagaaugaaaacgaggacgaagaguga

SEQ ID NO: 68185 - RNA, 1029 nt, Artificial Sequence
  derived and/or modified sequence opt5 from DCAF7__Homo_sapiens__NP_005819
augagccugcacggcaagagaaaagagaucuacaaguaugaagcccccuggaccguguacgcuaugaacugguccguccggccugacaaacgcuucagacucgcccuggggucuuuuguugaggaauauaauaacaaggugcagcuugugggacuggaugaggaaagcuccgaguucauuugccggaauacauuugaccauccguaccccacgaccaaacucauguggaucccugauacaaagggcgucuaucccgaccugcuugcgaccucuggggauuaccugcgcguguggagaguuggagagacagaaacccggcucgagugucugcugaacaauaacaagaauagcgacuucugcgcuccucucacauccuuugauuggaacgaaguggaccccuaucugcuuggcaccucuagcauugauacgaccuguacaaucugggggcuggagaccggacaaguccucggccgcgugaaucugguuuccggccacgugaaaacacagcuuauugcccaugacaaggaggucuacgauaucgccuucagcagagcugggggaggccgggacauguuugccucugugggggcugauggauccgugcgcauguucgaccugagacaccucgaacauagcaccaucauuuacgaggacccucagcaccacccgcugcugcggcucugcuggaacaaacaggaucccaauuaucuggccacgauggcgauggacggcauggaagucguuauccuugaugugcgcgugccuuguacacccgucgccagacugaacaaucaucgggcuugcgugaacgggauugccugggcuccucacucuuccugucauaucugcaccgccgcggacgaucaccaagcccucauuugggacauccagcagaugccccgcgcuauugaggauccgauccuggccuacacagcugaaggagagaucaauaacguucagugggccagcacccaaccugacuggauugccaucuguuauaacaauugccuugagauucugagaguguga

SEQ ID NO: 68186 - RNA, 1794 nt, Artificial Sequence
  derived and/or modified sequence opt5 from DCAF8__Homo_sapiens__NP_056541
augagcuccaagggcucuagcaccgacgggagaacagaucuggccaacggaucccucucuagcucccccgaggaaaugucuggcgcugaggaagggcgggagacgagcuccggaaucgaaguggaggccagcgaccugucucuuucccugaccggcgaugacgggggaccuaaucgcacaagcaccgagucuagaggcacagauaccgaauccagcggcgaggacaaagauucugacuccauggaagauacagggcacuacagcauuaacgacgagaaucggguccaugaucgcuccgaggaagaggaagaggaagaggaggaagaggaagaggaacagccgagacggcgcguucaaagaaagcgggcgaaccgcgaccaggauucuagcgacgacgagagagcucucgaggauuggguguccagcgaaaccucugcccugccccggccucgcuggcaggcccuucccgcucugagagagcgggaacucggauccagcgcccgcuucguguaugaggcuugcggcgccagagucuuugugcagcgguucagacugcaacacgggcuggaaggacauacgggcuguguuaauacccuccacuuuaaccagcgcgggacauggcuggcgucuggaagcgacgaucuuaaaguggucgugugggacuggguucggagacagccugugcuggauuucgaguccggccauaagucuaaugucuuucaggccaaauuccuccccaacagcggcgacuccacccuggcuaugugcgcccgcgaugggcaagugcggguggcugagcuuagcgccacacaguguugcaagaauaccaagagagucgcgcagcacaaaggagccucucacaagcuggcucucgaaccugacuccccguguacguuucugagcgccggcgaggaugcuguuguguucacaaucgaccugcgccaggaucggcccgccucuaaacucguggucaccaaggaaaaagagaagaagguggggcuguacacaauuuauguuaacccugccaauacccaucaauuugcugugggaggcagagaccaguucguccgcaucuacgaccagcggaaaauugaugagaacgaaaauaacggggugcuuaagaaauuuugcccccaccaucugguuaauuccgagagcaaggcgaacaucaccugucucguguauucccacgacggaacagaacugcuugccucuuacaacgaugaggacaucuaucuguucaauagcucccacucugauggcgcucaauacgucaaaagauacaagggccaucgcaacaaugccacggugaaaggggucaacuuuuauggaccuaagagcgaguucgugguuuccggcagcgacugcgggcacauuuuccucugggaaaagucuuccugucagaucauucaguuuauggagggagauaaaggcgggguggucaauugccuggaaccccauccgcaucugccugugcucgccaccagcggccuggaccacgauguuaagaucugggcucccacagccgaggcgucuaccgaacuuacaggacugaaagacgugauuaagaaaaacaagcgggagagagaugaagacucccuccaccagaccgaucuguucgacagccacaugcuuugguuucugaugcaucaccuccggcaacgcagacaucaccggagauggcgcgagccuggcgucggggcuacggacgccgauucugacgagagccccuccagcucugauacauccgacgaagaggaaggacccgaucgggugcaguguaugccuagcuga

SEQ ID NO: 68187 - RNA, 735 nt, Artificial Sequence
  derived and/or modified sequence opt5 from DCANP1__Homo_sapiens__NP_570900
augcacuacggcgccgcuacccauauccagaacagcagaucccacgggcuggagacagugcccggacaucaacggcucgaacgcggcgccgggggagagacgccugaguucccgggcugccacucucccgcgccucccgaaaauuuugggaacgaacugcuuccucugagcgcuccccuccagggacuguccgagggccuuuauccuccgggcagaaauaagacccugcccgccgggguccuccgggagggagccguucaguuccugcaucgcggccuguguaacucuaaucucagcuccgaggcuucugccagaccuagcgggacacaggacgaacugcacuccagccggcgcaaaaccggacaaacaagacgggaaggcgcucgcaagcaccuugugugcucuuuuagacuguaccccuucaccgugcauacagucuccccugggaacagccaccucgcccuguaucagguguuuaaagcgguuaaacuuugucccucugagaccuccuucuuucugagccggaagucucucaaguccagcgauccguggcauccucccucccugucuccuaauagcuggaaccgccaggccggauucagagcuugguccagccaccugauuucucucucccugacgugcagcgacucucagagccggcgcguguccucuagccaacagccuccccuucacucccugagcucucauagacgggccgcucacguccccgaguga

SEQ ID NO: 68188 - RNA, 1620 nt, Artificial Sequence
  derived and/or modified sequence opt5 from DCBLD1__Homo_sapiens__NP_775945
auggugcccggcgccagagggggaggcgcucuggcccgggcggcugggcgcggacuccuggcccuucugcucgccgucagcgcuccucugagacuucaggccgaggaacugggcgacgggugcggacaccucguuaccuaccaagauuccggcacaaugacgucuaagaacuauccgggcaccuaccccaaucauacagugugugagaaaaccaucacagugccuaaggggaaacggcugauucugcgccucggagaccuggauaucgaaagccagaccugcgcuuccgacuaucuucuguucacaucuagcuccgaucaguacggccccuauugugggucuaugaccgucccuaaggagcuccugcuuaacacgagcgaagugaccguuagauuugaguccggaagccacauuucuggccggggguuccugcucacauacgccuccagcgaccaucccgaucugauuaccugccuggagcgcgcgucucacuaucucaaaacagaauacuccaaguuuuguccugccggaugcagagacguggcuggcgauaucagcggcaauauggucgacggguaccgggauaccucucugcuuuguaaggccgcuauccaugccggaaucauugcggacgagcugggcgggcagaucuccgugcuccaacgcaaaggaauuagcagauaugaaggcauccuggccaacgggguucuuucccgggauggaucucugagcgacaagcgcuuccucuuuacguccaauggcugcagcagaucucuguccuucgagccggacggccagauucgggcuagcucuagcuggcaguccgugaacgagucuggggaucagguccacuggagccccggacaagcccgccugcaggaccagggcccuuccugggcuagcggggauucuuccaauaaccacaaacccagagaauggcucgagaucgaccugggagaaaagaaaaagauuacaggcauccggaccacagggagcacccagucuaauuuuaacuucuacgugaaguccuuugugaugaauuucaaaaacaauaacagcaaguggaaaaccuauaagggcaucgucaauaacgaggaaaaaguuuuucaaggaaacuccaauuucagagauccugugcagaacaauuuuauucccccgaucguggcccgcuacguccgggugguuccucagacauggcaucaaagaauugcccuuaagguggagcugaucggcugucagauuacgcaggggaacgacucucucgucuggcgcaaaaccagccaguccacaucugugagcaccaagaaggaggaugaaacaaucacccggcccaucccuuccgaggaaacgagcacaggaauuaauaucaccaccguugcuauuccccuggugcuucuggucgugcucgucuucgcgggcauggggaucuucgccgcuuuucgcaaaaagaaaaagaaaggaucucccuauggcuccgccgaggcccaaaagacagacugcuggaagcagauuaaauacccuuucgcuagacaccagagcgccgaauuuaccaucucuuaugauaacgagaaggagaugacacagaaacuggaccugaucacguccgauauggcgggguga

SEQ ID NO: 68189 - RNA, 2328 nt, Artificial Sequence
  derived and/or modified sequence opt5 from DCBLD2__Homo_sapiens__NP_563615
auggccagcagagcugugguccgggcccgcagaugcccccaguguccucaaguucgggcggcugccgccgcuccggccugggcugcccugccccucucccgcucucugccucccugcagcaacuccucuagcuucuccaugccucuuuuucugcuccugcuucuggugcuccugcugcuccuggaggacgcgggcgcccagcagggggauggauguggccacaccgugcuugggcccgaaucuggaacacugacgagcaucaauuacccucagaccuauccgaacuccacagucugcgagugggaaauuagagugaagaugggcgagcggguucgcaucaaauucggggacuuugauauugaagacagcgauucuugucauuucaauuaccucagaaucuauaacggaauuggcgugucccggaccgagaucggcaaguacugcgggcugggacuucaaaugaaucacagcaucgagucuaaaggcaacgaaauuacacugcucuuuauguccgggauccaugucagcggacgcggcuuccuggcuucuuauuccgugauugacaagcaggaucugaucaccugucucgacacagccagcaauuuucuggagcccgaguucuccaaauacugcccugcugggugucuucugcccuuugccgaaauuucuggaaccaucccucacggcuauagagauagcagcccccucugcauggcgggcguucaugccgggguggucuccaacacgcugggaggccagauuucuguggugaucuccaaggggaucccguacuacgagagcucucuugcuaauaacgucaccagcguugugggacaccuguccacaucucucuucaccuuuaagacaagcggcuguuaugggacccugggaauggaauccggcgugauugccgacccucagaucacggcuagcucuguccuggaguggacagaucacaccggccaagaaaauuccuggaaacccaagaaagcccggcucaagaaaccugggccucccugggccgcuuucgcgacagacgaguaccaguggcugcagauugaucuuaacaaggaaaagaaaaucaccggaauuaucaccacaggcagcacgaugguggagcauaauuauuacguuucugccuaucgcauccuguacuccgacgacgggcagaaguggaccguguauagagagcccggagucgaacaagauaaaauuuuucagggcaacaaggacuaccaccaggaugugcggaauaacuuccucccgcccaucauugcucgcuucaucagaguuaacccuacacaauggcagcagaaaauugccaugaagauggagcugcuugggugccaguuuauccccaaaggccggccucccaagcugacccaaccgccucccccuagaaauagcaacgaccucaagaauacaaccgcucccccuaaaaucgccaagggacgcgcccccaaauucacgcagccgcugcagccucgguccucuaacgaauuucccgcgcagacagagcaaaccaccgcuagccccgauauuagaaauacaaccgugacaccuaacgucacgaaggacguggcccuggccgcuguccucgugccgguucuggugaugguccuuaccacacugauccucauucuggugugcgccuggcauuggcgcaaucggaaaaagaagaccgaaggcacauacgaucugcccuauugggacagagcugggugguggaaaggaaugaagcaguuccuuccugccaaagcgguugaucacgaggagacccccgugcgcuacuccucuagcgaagucaaccaccucuccccucgggaggugacgaccgugcugcaggccgacagcgcugaauaugcccagccccugguuggcgggaucgucggaacacuccaucaaagaucuaccuuuaagccugaggaaggcaaagaggcuggguacgccgaucuggaccccuauaauuccccgggccaggagguguaccacgcguaugccgaaccucuucccauuacaggaccugaguacgcuacccccaucauuauggacaugagcggccauccgacgacaucuguggggcagccuuccaccagcacauucaaggccaccggaaaccagcccccuccccuggucggcaccuacaauacacuccugucucgcacggauagcuguuccagcgcucaagcccaguaugacacccccaaggccgggaaaccuggacugccggcucccgaugaacuuguguaccagguuccucaaucuacacaggagguguccggcgcggggcgggacggcgagugcgaugucuuuaaggaaauccucuga

SEQ ID NO: 68190 - RNA, 4344 nt, Artificial Sequence
  derived and/or modified sequence opt5 from DCC__Homo_sapiens__NP_005206
auggagaacagccugagaugcguguggguccccaagcucgccuucguucuguuuggcgcuucccuuuucucugcccaccuccaggugaccggguuucaaaucaaagcguucacagcucuccgguuucugagcgaaccuuccgacgccgugacgaugcgcggaggcaauguccuucuggauuguucugccgagagcgacagaggggugccgguuauuaaguggaaaaaggauggaauccaucucgcucugggcauggacgaacggaaacagcagcuguccaacgggucucuccugauucagaauauccuucacagccgccaucacaagcccgaugagggacuguaccaaugcgaagccucccucggcgacagcggcucuauuaucuccagaaccgcuaagguggccgucgcggggccucugcgguuccuuagccagacagagucugugaccgccuuuaugggagauacaguucugcucaaaugugaggugaucggcgaacccaugccuaccauucauuggcagaagaaccagcaagaccugacacccaucccuggggauucccgcgucguggugcugccgagcggagcucuccagauuucuagacugcagcccggcgacaucgggauuuaucggugcuccgcccgcaauccugcuagcuccagaaccggaaacgaggccgaaguccggauccuuucugaucccggccugcaccgccagcucuacuuccugcaaagaccuagcaauguuguggcgauugagggcaaagacgccgugcuugaguguugcgucuccggguaucccccgccuagcuuuacguggcugcggggagaagaggugauccagcuccgcucuaagaaauacucccugcugggcgggagcaaccuccugaucucuaauguuaccgaugacgacagcggaauguauacauguguggucaccuacaagaacgaaaauauuuccgcuucugccgagcuuacagugcugguucccccuugguuccucaaccaccccagcaaucuguaugcuuacgaauccauggauaucgaguuugagugcaccgugagcggcaagcccgucccuacggugaacuggaugaaaaauggggacgucgugauuccgucugauuacuuccagaucguuggaggcuccaaccuucggauucugggcguggucaagagcgacgaaggguuuuaucaauguguggccgagaacgaagccggaaaugcucagacaucugcgcagcucaucguucccaaaccugccauccccuccagcuccgugcugccuucugcucccagagaugucgugccggugcugguuagcuccagauucguccgccucucuuggcggccucccgccgaggccaagggcaacauucagaccuucacaguguuuuucagcagagaaggggacaaucgcgagcgggcucugaacaccacccaaccuggaucccuucagcugacagugggcaaucucaaacccgaggccauguacacguuuagagucguggcguauaacgaaugggggccuggcgagagcucucagcccaucaagguugcuacccagccggaacugcaagugccuggacccgucgagaaucugcaggccguguccacaagccccaccucuauucuuaucacaugggaaccuccggccuacgcuaacggccccguucagggguaucgccucuucugcaccgagguguccacgggaaaagagcagaauauugaagucgauggccugagcuacaagcuggaggggcucaagaaauuuacagaauauucucugcgguuccuugccuacaacagauacggaccuggcgugagcaccgacgauaucaccguugugacacuguccgacguccccagcgcuccuccccaaaaugugucucucgagguggucaacucccgcagcaucaagguuuccuggcugccucccccgucugggacccagaauggcuuuauuacaggauauaaaauccggcauagaaagacgacccgccggggcgagauggaaacacuggagccuaacaaucuuugguaccucuucaccgggcuggaaaaaggaagccaguauuccuuucaggugucugccaugacagugaacggcaccgggcccccuagcaacugguacacggcggagacccccgaaaaugaucuggacgagucccaagucccggaccagccuucuagccuccacgugagaccccagacaaacuguauuaucauguccuggaccccuccccugaaucccaacauuguugugcggggauauaucauuggcuacggggucggcagcccuuaugccgagacagugcgcguugauucuaagcaaagauacuacuccaucgaacggcuugaguccucuucccauuaugugaucagccugaaggcuuucaauaacgccggagaaggcgucccgcucuacgagucugcuaccacgagauccauuacagaccccaccgauccuguggacuauuacccccugcuggaugacuuuccuacaagcguucccgaucuuuccaccccuaugcucccgcccguggggguccaggccguggcgcugacccacgacgccgugcgcgucagcugggcugauaauucuguuccuaaaaaccagaagacaagcgaagugcggcuguauacggugagauggcgcaccuccuucucugccagcgcuaaauacaaguccgaggacacaaccucucucagcuauacagccaccggacugaaacccaauacgauguacgaguuuuccgucauggugacaaagaacagacggucuagcaccugguccaugaccgcccacgcuacaaccuacgaagcggccccuacaagcgcucccaaggaucuuacgguuaucacccgcgagggcaaaccgagagccgugauugucucuuggcagccuccccuggaagccaaugggaagaucacagcuuauauucucuucuacacccuggacaaaaacauccccaucgaugacuggauuauggagacaaucuccggagaccggcugacccaucaaauuauggaucuuaaucucgacacgauguauuacuuccgcauccaggccagaaacagcaagggcguggggccucugucugaucccauucuguuucggacccucaaaguugaacacccugacaagauggcgaaugaucagggccgccauggagacggcggguauuggccgguggauacaaaccugaucgacagauccacccuuaacgagcccccuaucggacagaugcaucccccucacggcagcgucacaccccaaaagaauagcaaccugcucgugauuaucgucgugaccguuggggugauuacaguccuggugguugugaucgucgcugugauuugcacccggcgcucuagcgcccagcagcggaaaaagagagccacgcacuccgcuggaaaaagaaagggcagccagaaagaucugcgcccgccugaccuuuggauccaccaugaggaaauggagaugaagaauaucgaaaaacccucuggcacagauccugccgggcgggacucccccauucaaagcugccaggaucugaccccugugucucacagccaguccgagacccaacucggaucuaagagcacaucccauucuggccaggacaccgaggaagcggggagcuccaugagcacgcuggagagaucucucgcugcccgccgggcccccagagcuaagcugaugaucccgauggacgcccaguccaacaauccugcuguugucagcgccauucccgugcccacacuugaauccgcgcaguacccuggaauccugccgucucccaccuguggcuauccucacccccaauucacacuccgcccugugcccuuuccuacccugagcgucgaucggggguucggagccggcagaucccagucugugagcgagggcccgacaacccagcagcccccuaugcugcccccuucccaacccgaacacucuagcuccgaggaggcuccgagccgcacgauuccuaccgccugcguucggcccacacauccccuuagaucuuuugcuaacccucugcugcccccuccgauguccgccaucgaacccaaagugccuuacacaccccugcucagccagccugggcccacccugccgaagacccacgucaaaacggccucucuuggacuggcuggcaaggcgcggagcccucuccugcccguguccguuccuacagcccccgaggugucugaagagagccauaaaccuaccgaagacuccgcuaaugucuacgagcaggaugaccugagcgagcagauggccucccuugaagggcugaugaagcaacucaacgccauuacaggaucugcuuucuga

SEQ ID NO: 68191 - RNA, 1095 nt, Artificial Sequence
  derived and/or modified sequence opt5 from DCDC2C__Homo_sapiens__NP_001274373
augggcaccagagggcccagcgccccuguggacacaacgccggcuaagaccaucgucguuuaccggaacggagaucccuucuaugugggcaaaaaguuugugcugucccgcagacgggccgcgacauucgaggcucuccuggaacagcuuaccgagcaagucgacgugccuuuugggguucgcagacuguucacacccacccggggacaccgcgugcucggccuggaugcccuucaggccgggggaaaauacgucgcugccggcagagaacgguuuaaggagcuggacuauauucauaucgugccucgcaaacccgcuaagauuagaaagcucaaagaaaucaagccuguugugcacugcgauauuaaugucccgucuaaauggcagacauaccaucggaucagccgccacaucaacguguucaccaauggcagacuguuuauucccccugccaagaucauuauccccaaauucucccugucugacugggauauugugcucgcgacgaucggggagaaggucuuuccucugggaggcguucggaaacuuuucaccaugaacgggcaucugcucggagacagcaaggaucugcaggacaaucacuuuuauguggccgugggccuugagacauucaaguacuuucccuauuggaaauccccgcgcgucccuucugaagugcaacagagauacgcuaacguugagaagaauagccagcggaaaaagaaaguggauuccaaggggaaggaacccuguaaauacgacggcauuccucccaagacccaggauagcgucuauuacgccaaagaggagaagaaaaagacacuggcugaaccccucgugcaaagaggagccgagggcgacguuuauaaggcgccuaccccgucuaaagaaacgcagggggcccuggacgugaaggaggaacacaacguccagcuggaggugcccgucgaucagcgccaagcugagaucgugaaagaagacgaggaaauccaugagaauacaccugauuucgaaggaaacaaggacaaagaggaugcccggcucugcgaggacguugaaagaaagauggcucgcgaguggaagcccguggauuga

SEQ ID NO: 68192 - RNA, 1431 nt, Artificial Sequence
  derived and/or modified sequence opt5 from DCDC2__Homo_sapiens__NP_057440
augagcggcuccucugccagaagcucccaccugucucagcccguggucaagagcguucucguguaccggaacggggacccuuucuaugcuggacgcagaguggucauccaugagaaaaagguguccucuuuugaaguuuuccugaaagaggugaccggcgggguccaagccccguuuggagcggugcggaauauuuacacaccccgcacgggccacagaauccggaaacuugaucagauucagagcgggggaaacuauguugcuggcggccaggaagccuucaaaaagcugaauuaccucgacaucggggagauuaagaaacgcccuauggaaguggucaacaccgaggugaagcccgugauccauuccagaaucaaugucagcgcccgguuucgcaaaccucugcaagagcccugcacaauuuuccuuaucgcuaacggagaucugauuaauccugccucuagacuccugaucccgcggaagacccugaaccagugggaccacguucuccagauggugacagaaaagauuacccugcgcuccggcgcugugcauagacuuuauacacuggaggggaagcucgucgaaagcggagccgagcuggagaauggccaguuuuacguggcgguugggcgggauaaguucaaaaagcugcccuauucugaacuucucuuugacaaauccaccaugcgcagaccuuucggacaaaaggccagcucucugcccccuaucgugggcucccggaaaagcaagggcuccgggaacgauagacacucuaaaagcacggucggauccagcgacaauucuagcccccagccgcugaagcgcaagggcaaaaaggaggaugugaacuccgaaaaacucaccaagcugaaacagaauguuaaacuuaagaacucucaggagacaauuccuaauagcgacgaagggaucuuuaaggcuggagccgagcgguccgagaccagaggcgcugccgaagugcaagaggaugaagacacacaggucgaggugcccgucgaucagcgcccugcggaaaucguggacgaggaggaagacggggagaaggccaacaaagaugcugaacaaaaggaggacuucucuggaaugaacggcgaucuggaagaggagggcgggcgggaagccaccgacgcucccgagcagguugaagagauucucgaucacagcgagcagcaggccagacccgcccgcgugaauggaggcacggacgaagagaacggggaggaacugcaacaggucaauaacgaacuucagcuggugcucgauaaagagcggaagucccagggagcuggcagcgggcaagacgaggcggauguugacccucagagaccgccccgcccugaagugaagaucacaucucccgaggaaaaugagaacaaucagcagaacaaagauuacgccgcugucgccuga

SEQ ID NO: 68193 - RNA, 333 nt, Artificial Sequence
  derived and/or modified sequence opt5 from DCD__Homo_sapiens__NP_444513
augagauucaugacccugcucuuucugacagcccuugcuggcgcccuggugugcgcguacgaccccgaggcugccagcgccccuggguccggaaacccgugucacgaggcuucugccgcucagaaggaaaaugccggcgaagaucccgggcucgcgcggcaagccccuaaaccccgcaagcagagaagcucccugcuugagaaaggacuggacggcgcuaagaaagccgucgggggacucggcaagcugggcaaggaugcuguugaagaccuggagucuguggggaaaggagccgugcaugaugucaaggacgugcucgauagcguucuguga

SEQ ID NO: 68194 - RNA, 9897 nt, Artificial Sequence
  derived and/or modified sequence opt5 from DCHS1__Homo_sapiens__NP_003728
augcagaaggagcugggcaucgugcccuccugcccugggaugaaauccccgagaccccaccuucugcuuccucugcuccugcuucugcuccugcugcucggagcuggcguccccggggcuuggggacaagccggcucucuggaccuucagauugaugaggaacagccugcggggacccugaucggagacauuuccgcuggccuccccgccggcacagccgcuccucugauguacuucaucuccgcccaggaagggucuggaguuggcacggaucuugcuauugacgagcauagcgggguggugcggaccgcccgcguccuggauagagaacaacgggaccgcuauagauuuaccgccgugaccccggauggagccacaguugaggugaccguccggguggcugacaucaacgaucacgcccccgcuuucccucaggcccgcgcggcccuccagguucccgagcauacagcuuuuggcaccagauacccucuggaacccgcccgggacgcugaugccgggcgccugggaacgcagggcuaugcccucuccggcgacggggcuggagagaccuucagacuggaaacacggccgggcccugaugggacccccgugccugagcuugucgugacaggagagcuggaccgcgaaaauagaucucacuacaugcuccaacuggaggcguaugacggcggguccccgccccggcgcgcccaggcccuucuggaugugacccuccuggacaucaacgaucaugccccugccuuuaaucaguccagauaccacgcugucguuagcgaaucucuggccccgggaucccccgugcuccagguguucgcgagcgacgcugaugccggcgucaacggcgccgugacguaugagauuaaucggagacaaucugaaggggacggaccuuuuuccaucgaugcucacacaggccugcuucagcuggagcgcccccucgacuucgagcagcggagaguucaugaacuggugguccaagcccgcgaugggggagcucacccugagcuuggcagcgccuuugugaccguucaugugcgggacgcgaacgauaaucagcccucuaugacagucauuuuccuguccgccgacgggagcccccagguguccgaagcugccccucccggccagcucgucgcuagaaucucugugagcgacccugaugacggagauuuugcccacguuaacgugucccuggagggcggggaaggacacuucgcgcugagcacccaagacucugucauuuaccucguguguguugcccgccggcuggauagagaggagcgcgacgcuuacaaucuucgggugaccgccacagauuccggcuccccuccccugagagcugaagccgccuuuguccuccaugugacggacgugaacgauaaugcucccgcguucgaccgccagcuguaucggccggagccucugcccgaaguugcccuucccgggucuuucgucgugagagugaccgcucgggauccugaccagggaacaaacggccaggucaccuacagccucgccccgggggcccacacacauugguuuuccaucgaucccaccucuggcauuaucacgacagcugccagccuggacuaugagcuggaaccucaaccccagcucaucgugguugcgaccgacggaggccugccuccccuugcuuccagcgccaccgugucugucgcccugcaggaugugaaugacaacgagccucaguuccaacgcacauuuuacaaugcuucccuccccgaggggacccagccgggaacaugcuuccugcagguuacggccaccgaugcggacagcggcccuuuugggcugcuuucuuauucccucggagcuggccuggggagcuccggcucucccccuuucagaauugaugcccacagcggagacguguguacaacccggacacuggauagagaccagggccccuccucuuuugauuucaccgucacggccguggacgggggaggccucaagagcaugguuuacgugaaagucuuucuguccgaugaaaacgacaacccgccucaauucuauccccgcgaguacgcugccagcaucucugcucaguccccucccgggaccgccgugcuucggcugagagcgcaugaucccgaccagggaagccacggccgccucucuuaccacauucuggccgggaacagcccuccgcuguuuacacuugacgaacaaagcggccuccugaccguggcuuggccccuggccagacgggcuaacucugucguucagcucgagaucggagccgaggauggcgggggacugcaggccgaaccuagcgcucgcguggacauuuccaucgugcccggcacaccuacacccccuaucuucgagcagcuucaauaugucuuuagcgugccggaagauguugcgcccgggacgucugugggaauuguccaggcccauaauccucccggcagacuggcuccugugacacucucccugagcggcggggacccccggggacuguucucccuugaugccguuucuggccuccugcagacccugcgcccgcucgacagagagcugcuugggccugugcuggaacucgagguccgggccggaagcggcgugccgcccgcuuucgccguugcgcgcgugagaguccugcuggaugacgugaacgauaauuccccugcuuuucccgccccugaggacacagugcuucugccgcccaacaccgccccugggacccccaucuacacacuccgggcucuggauccugacucuggagucaauagccgcguuacguucacccuccuggccggcggcgggggagcguuuacaguggaccccaccacaggccacgugagacuuaugcggccgcuggggccuuccggaggccccgcucaugaacucgagcuggaagccagagaugggggaucuccuccccgcaccagccacuuccggcugagagucgugguucaggacgugggcacgcgcggccuugccccucgguuuaacucccccacauauagagucgaucugccgagcgggaccaccgcuggaacacaagugcuccagguucaggcccaggcuccugacggcgggcccauuaccuaccaccuggccgcggagggagccucuucccccuucggccucgaaccucaaagcggguggcugugggugcgcgcugcccuugaucgggaggcucaggagcuguauauccucaaggucauggccgugucuggauccaaagccgaacugggccagcaaacaggcacggcuaccgucagagugagcauucugaaucagaacgagcauucuccgcgccuuuccgaagaccccacauuucuggcgguugccgagaaucagccucccgggaccagcgugggacgggucuucgcuacagauagagacuccggcccuaacgggcggcucaccuacagccugcagcaacucucugaagauagcaaggccuuucgcauccacccccagacgggagaggugaccacacugcagacccuugacagagagcagcaauccucuuaucagcugcugguucaggugcaggauggcgggagcccuccgcgguccacaaccggaacaguccauguggccgugcucgaccugaaugauaacucucccaccuuccuucaagcuagcggcgccgcgggcgggggacugccuauccagguucccgaccgcgucccucccggcacgcucgugacaacccugcaggcuaaggacccggaugaaggggagaauggaaccauucucuacacacugaccggcccuggguccgaacucuuuucucugcacccccauagcggagagcugcucacggccgcgccccugaucagagcugagcggccucacuacgugcuuacacuguccgcccacgaccagggcuccccucccagaucugcgucccuccaacugcucguccaggugcugccgagcgcccgccuugcugaacccccucccgaucuggccgagcgggacccugcugcccccguuccggugguccugaccgugacagcugccgaaggccucagaccugggucucugcuuggauccguugcggcccccgagccugcuggcgugggggcccugaccuauacacucgucggaggcgcugaucccgaagggaccuucgcccuggacgccgcuagcggacgccucuaccuggcgcggccucuugauuuugaggccggaccucccuggagagcucugacggugcgcgccgagggccccgggggagccggcgcucggcugcucagaguucaggugcaaguccaggacgaaaacgagcaugcccccgcguucgcccgcgauccccuggcucuugcccugccugaaaacccggagcccggggcugcccucuauaccuucagagcguccgacgccgauggaccuggccccaauucugacgugcgguaccgccugcugagacaggaaccucccgugccugcucuccggcuugaugcccgcacaggggcucugagcgcccccagaggccuggaccgggagaccacaccggcucuccugcuucuggucgaggccaccgacagaccugcgaacgccucccgccggagagcugcccgcguuagcgcucggguguuugugacggaugaaaaugacaacgcccccgucuucgccucuccuuccagagugcggcuccccgaggaucagccgccuggacccgcggcucugcacguuguggcccgcgaccccgaucugggcgaagcugccagagucagcuaucggcucgccucugggggagacggccauuuucgccuucacagcuccacaggggcucugucugugguuagaccucuggaucgggagcaacgcgccgaacaugugcucaccgucguggcgagcgaccacggaucucccccuagaagcgccacacagguccugaccgugagcguugcugaugugaaugacgaggccccgaccuuccagcagcaagaguacuccgugcuucugcgggaaaacaaucccccuggcacaagccuccugacgcugcgcgcuaccgaucccgacgucggggccaacggccagguuacauauggaggcgugucuuccgagagcuuuucccucgacccugauaccggggugcuuacaacccugagagcgcuggaccgggaggaacaggaggaaauuaaucucacggucuacgcccaggauagaggaucucccccucaacugacacacgugaccguucgcguggcugucgaggacgaaaacgaucaugccccgaccuucggcagcgcucaccuuucccuggaggugcccgaagggcaggacccucagacacucaccaugcugcgggccucugaucccgacgucggagcuaauggccaacugcaguacagaauccucgauggggacccuagcggcgccuuugugcuugaucuggcguccggagaguucggcacaaugcgcccccuggaccgggagguugaaccggccuuucagcucagaauugaggcucgcgaugggggacagccugcccugagcgcuacgcuucugcucaccgugacaguccuggacgccaacgaccaugcccccgcguuccccgugccugcuuauucuguugaagugcccgaggaugucccugccggcacccugcuccuucaacugcaggcccacgacccggaugcuggggccaauggacacgugacauacuaucugggcgcuggcaccgccggggcguuucuccuggaacccuccagcggagagcuucggacggccgcugcccuggacagagagcagugcccuucuuacaccuucuccgugagcgcuguugauggcgccgcggccgggccccucucuacaaccgucagcgugacaaucaccgugcgcgacgucaacgaucaugcuccuacauuccccacguccccgcugcggcugagacucccucgccccggaccuucuuuuagcacccccacacuugcccuggcuacccugcgggccgaagacagagaugcuggcgccaaugcguccauucucuaucgccuggccgggaccccgccucccggaacaacgguugacagcuacaccggcgagaucagaguggcucggucccccguggcccuuggcccucgcgauagaguccuguucaucguggccacagaccucgggcggcccgcuagaucugccaccggaguuauuaucgugggccugcagggggaagcggagcggggaccucgcuuuccgagagcuagcuccgaagccacaauucgggagaacgcgcccccuggcacccccaucgucucuccucgcgcugugcacgccgggggaacgaacggccccauuacauauagcauccuguccggcaaugagaaagggaccuucucuauccaaccuagcaccggagcuauuacaguuagauccgccgaaggccucgacuuugaggugagcccgcggcuucgccugguccugcaggcggaaucugggggagccuucgcuuuuaccgugcucacacugacccuucaggaugccaacgacaaugcucccagauuccugcggccucauuacguggccuuucuccccgagucccgcccucuggagggcccccugcuccaggucgaagcggaugaccuugaucaagggagcggaggccagaucucuuacucccuggccgcuagccagccggccagaggccuguuccacguugacccuacgacagggaccauuacaaccacggcuauccucgaucgggagauuugggccgaaacccgccuggugcuuauggccacagacagaggaucucccgcucuggugggcuccgcgacccucacagucauggugaucgauaccaacgacaaucggcccacaaucccucagcccugggagcugcgcguuagcgaagaugcccugcucggguccgagauugcucaagugaccggaaacgacgucgauagcggcccugugcuuugguauguucugucuccgagcgggccccaggacccuuuuuccgugggaagauacggcggccgggucucucugacggggccccucgacuucgagcagugugauagauaucaacugcagcuucuggcccaugacggaccucacgaaggccgcgccaaucucacagugcugguugaggaugugaacgacaaugcucccgccuuuagccagucccuguaccaggucaugcuccuggaacacaccccgccugggucugcgauccuuagcguguccgcuaccgaucgggacucuggagccaacggccauauuagcuaucaccuggccucccccgcugauggguucagcgucgacccuaauaacggaacacucuucaccaucgugggcacaguugcccugggccaugaugggucuggagcuguggacgucgugcuugaggccagagaucacggcgcgcccgggcgcgccgcucgggccacggugcacguucaacugcaggaccagaaugaucaugcuccuuccuuuacccucagccacuacagaguggccgucacagaagaccugcccccgggaucuacccugcucacacuggaggcgaccgacgccgauggcucccgcagccaugcugccguggacuauuccauuaucucugggaacuggggacggguuuuccagcuugagcccagacuggcugaagccggcgagagcgccggcccugggccccgcgcucucggaugccuggugcuucuggaaccucucgauuuugagucccugacgcaauacaaucugaccgucgcggccgcugaccggggccagccgccccagagcucuguggucccugugacaguuaccgugcucgaugucaacgacaaucccccuguguucacaagagccuccuaccgcguuaccgugcccgaagauacgccugucggggccgagcugcuucacguggaggcuagcgacgccgaucccggaccgcauggccuggugcgguuuacaguuucuagcggggacccuuccggccucuucgaacuggaugagucuagcggaacccuuagacuggcgcacgcucucgacugugaaacacaggcccggcaccaacuggucgugcaggccgcugaccccgccggcgcucauuuugcccuggcgccugugaccaucgagguccaggaugugaaugaccacgggcccgccuucccgcucaaccugcuuuccaccucuguugcugagaaucaaccucccggaacacuggugacgacccuccaugccauugauggcgacgcuggggccuuuggaagacugcgcuauagccuucuggaagcgggccccgggccugagggccgggaagccuucgcucucaacuccagcacaggagagcugagagcccgcguccccuuugauuacgaacacaccgagucuuucagacugcucgugggcgcugccgacgccgggaaucuguccgcuagcguuacaguguccguccuugugaccggagaggaugaauaugacccuguuuuucuggcgccggccuuccacuuccaggugcccgagggcgcucggcgcgggcauucucucggacacguccaggccacggaugaagacggcggggccgauggccuggugcuuuacagccuggcuacauccucuccuuauuuuggaaucaaccagaccaccggcgcccucuaccugagaguggacagccgggcgcccggguccggaacagcuaccagcggcgggggaggccgcacaagacgggaggccccucgcgaacugagacucgaggucauugcccgggggccccugccgggcucucgcuccgcuacgguuccugugaccguggauaucacacauaccgcccuuggacuggcucccgaccucaaucugcuucuggucggcgccguggcggccagccucgggguuguggucgugcuggcucuggccgcucucguucugggacuugugagagcccggucucgcaaggcggaggccgcuccuggccccaugucccaagccgcuccucuggccagcgacucucuccagaaacuggggagagaacccccgucucccccucccagcgagcaccuuuaucaucagacacugccuagcuacggaggccccggcgccgggggaccuuacccgcggggcgggagccucgaucccucccacagcuccggaagaggcucugccgaagcugccgaggacgaugaaauucgcaugaucaacgaguucccucgggucgcuagcguggccuccucucuggccgcuagagggcccgacagcggcauucagcaagaugccgacggccuguccgauaccucuugcgagccucccgcgccggacacgugguauaagggccgcaaagcugggcuucugcucccuggagccggcgccacccuguaccgggaagaggggcccccugcuacagccaccgcguuucucggaggcugugggcugagccccgcuccgacaggagauuauggcuucccugccgacggcaagcccugcgucgccggggcucuuaccgccaucguggcuggagaagaggagcugagaggcuccuacaauugggauuaucugcucagcugguguccccaguuucagccucuggccucuguuuucacagaaaucgcgcgccuuaaggacgaggcccggcccugcccuccggcucccagaauugauccucccccucugaucaccgccguggcucaccccggggccaaauccgucccuccgaagcccgcgaacacggccgcugcccgcgcuauuuuuccucccgccagccaucggucuccuaucucccacgaaggaagccucucuuccgccgcuaugagccccucuuucuccccgagccugagcccccucgccgcgagauccccugugguuucucccuuuggcguggcucaggggccuagcgccuccgcccugucugcugagagcggacuggaacccccugacgacacagagcuucauauuuga

SEQ ID NO: 68195 - RNA, 4110 nt, Artificial Sequence
  derived and/or modified sequence opt5 from DCHS2__Homo_sapiens__NP_001136024
augagccccugcggcagaaagaugggggagggacggcagcaacgcagagccccugugggcaaacugcuccugcuuccggggcggcgcgacacaccccacggaagauccggcucuagcggggcucggacccagcgcucccugcucuggcugcuuguccauguuuggcugugggccgcgucuggaagcuccgcucagcuguucaaccugacgcugucuguggaugaaggccucccucccgacacccuggugggcgauaucagagccgggcuuccugccgcucagcaacaggagggaagcggcuuuuuccuguccgaagacagcgaugacucuccccuccuggaugacuuucacguccauccugauacagggauuauccggaccgcccgcagacuugaccgggagcgcagagaucacuacuccuucguggcugccacacugcucggagcgguugugcaggucgaaauucgggugaaugacguuaacgaucauagcccgcgcuuuccccuggacucucugcagcucgacguguccgagcugagcccucccggcaccgccuucagacuuccugucgcucacgaucccgacgccgggcuguuuucuacacaaggauauacccucgugcagccguccgaucugccuaaggaccccgcuggcccuuucuuucagcuucgguacagaacgcccggcccccugccuagcccgcuccugcccggguccucuagcccucuggagccccucgaucuggugcuucugcgccggcucgacagagaagaggccgcggcccaccgccugcagaucgaggcuugggauggaggccggccuagacgcaccgggcuucuguccgucgagcuccggguucuggacgagaaugauaaucccccgguguucgaacaagacgaguauagagccgcugugcgcgaagaugcccagccuggagccgaggucugucgggugagagcuacagaccgcgaccugggccccaacggguuuguucgguacagcgugagagcgcggcaggucccuggagccggcucuggcgggggagcucucggcgaugccgccuauuucgcuguggaggaacuguccgggguugugcgcgucuggagaccccuugaccgggaggcccaagcguggcaucagcugguggucgaagcuagagauggaggcgccgagccugaaguggccaccguucgcgugagcauugcuguccucgacgugaacgauaaucggcccgccauccacguucuguuucugacagaagggggcguggcuagagucucugaaggagcccgcccgggcgacuacguggcgagagugagcguuuccgaugccgacggggauugggagaaagaggacgaagcuaccggagagcuuggcgucgggcucggagauggcucuaucagccugucccuggaagggggcgagggagacuucgcccuccugccuggcgggccucccggaguguucuuucuuugcguggaaggcccucuggaucgggagagccgcgaccucuaugagcugcugcuugucgcuacggacgccgggucuccgccccucuccacagaagagacccugcugcucagaguggcggaucugaacgaccagccuccccuuuucagccagcaacauuacaaggccucuguuuccgaagcugccgcuccuggaacaguggucaugugggugagcgccuccgaugccgacgaggcuggcucugaucacgcguggcugcgguacaccguugugcagcucagcgcccccuguaaucuggggucccugcagucuaaaaugguccacaccgcugagugcggcccuagcuuugccauugacuccgaaagcggagccaucucuacaauucgcacgcuugauagagaggugcaggaagcuguugagcucaagguggucgcccaagaccugggcgaacccccgcuguccgcgaccugucucgugagcaucacaguggaugacgucaacgauaaugagccuauuuucuggcggcagguuuauaacgcuaccaucgccgagcaugcccccguggggcacugcuuucuccaggugacagcuucugacgccgauuccggacuuuacggcuucauugaauauagccuguacgacggguuucucucuuaugaggcgccucaggcuuuccgcaucgacccccaugauggacaaaucugugucagccaggacauugauagagaacgggacccggccaccuacgaucugcugguggaggccaaggacggcgggggccuuuccgcucaggccuuuguucgcguggaucucgaagacgucaaugauaaccacccuguguucaaucccagcacguauguuacaucuaucuccgacgagacccagccuggaaccgagauuaucaacgugcuggcuacagaucaagacagcggcauuuacgggaccgucgccuacgaacugauccccggaaacguguccucucucuuuacaaucgacagcacgaccggcauuaucuaucugacacuuccccugucccaucucgagucuaccacacugagccugaugguuuccgcgcaggaugggggaggccuuaccgccgugauuaaugcugacgucacgauccacauuuuccagaccacacuggccccugcugaauuugagagaccgaaauacaccuuccucguguaugaagaugugcccgaggacucuccuaucggcacagucaaggcccgggagccccugaacagcuccgaaccuaucuucuacagaauuagcucuggggaucucggaggcaaauuuuccauccacccccgccuggggaccauucggacgagaaagccucuugaccaugagacacaaccgguuguggugcugaccguccaggcccagcucggaagcgcucccgcguguucuuccacagaagugaauaucaccguuauggaugugaacgacaaucacccugccuuccugcgcaccagcgaugagauucggaucucucagacaacgcccccuggcaccgcucuguaucuugccagagccgaggaccgcgauuccgggcggaacggacugauuagauacagcaucgcuagcccccaaccgggcgucuuugccaucgaccgcgcgcucggcgugcuguuccucaaugggucccugggagcuggcgaacagcgggagcuuacacugacccucagagccgaagaucaggggguucauccucaggccgcucugcuggugcuuacagucgugauugagaaacgggaacacucucccagcuggaccuuugagcaccuggucuaucaaguggagguuuccgaaucucucagccccaugacgcagaugcugcagacacaggcccauccucucggaccccaacgcgcggcuuccccucugagauacucucuugagccgagcguggacuccgccauguucggcauccggcccuacaccggguggauuuaucugcgcagacaguuugacuacgaaucuacccagacauauaacuuccgggucuuugccuggaucccugaggauggauuccugcaaaaugugagcaccacaguuauugugagagucugggacgaaaacgauaauucccccacguuucuccacgacgugcuguuccuuaagguggaggagagcccuguuccccagggcgucaucggcaagaucaccgcuauugauauggacucugggaaaaacggacagcugcucuacuuucugcucuccgauggcaaguucuucaaaaugaauccgaacacaggggaacugaucaauuggguggcccuugaccgcgagcaucggggacaccaugaaaugaccgugcuggucacagauagaggcagcccuccccgcaacgcuaccauggccguguauguuucugugacggacauuaacgauaaucggcccuuuuucccccagugccugccugggaaggagcuccacgucaaagugcuggaaggacaacccguuaacaugcuugugaccacagucuuugcgaaggacccggaugagggcaauaacgccgaggugaccuacuccguuagcuccgcuagaccuaugccccugaaaggcaagacagccuucgggaagcagucuugcaaaaagcagaccaauaaacagacaaacaagauccucaccuga

SEQ ID NO: 68196 - RNA, 783 nt, Artificial Sequence
  derived and/or modified sequence opt5 from DCK__Homo_sapiens__NP_000779
auggccacacccccuaagagaagcugcccguccuucucugcuagcuccgagggcacccggaucaaaaagauuucuaucgaagggaacauugccgcgggaaaaagcacguuugugaauauccugaagcagcucugugaggacugggaagucguucccgagccuguggcucgcuggugcaacgugcaauccacccaggaugaauuugaggagcugacaaugucucagaaaaauggcgggaacguccuucagaugauguacgaaaagcccgagagauggagcuucaccuuccaaacauaugccugucugucccggauucgcgcccagcucgcuagccugaauggaaaacuuaaggacgccgaaaagccugugcuguuuuucgagagaucuguuuacuccgaucgguauaucuuugcuagcaaccucuacgagucugaaugcaugaaugagaccgaauggacaaucuaucaggacuggcacgauuggaugaacaaucaguucggccaaucccuggagcuggacgggauuaucuaccuccaggccacccccgaaacgugucugcaucgcauuuaucuuagaggacggaacgaggagcagggcaucccucuggaauaccucgagaaacugcacuacaagcaugaaagcuggcuucugcaccgcacccucaaaacaaauuuugauuaucugcaggaggugccgauucugacccucgacgucaacgaagauuucaaggacaaguacgagucucugguggagaaaguuaaggaauuucuuuccacacuguga

SEQ ID NO: 68197 - RNA, 1269 nt, Artificial Sequence
  derived and/or modified sequence opt5 from DCLK1__Homo_sapiens__NP_001182344
augcuggagcucaucgaagugaacggcacccccgggagccagcuguccacaccuagaucuggaaagagcccgucccccucuccuacgagccccggcucccuucggaaacaacgcucuagccagcacgggggauccagcaccucucuggccuccacaaaggucugcagcucuauggacgagaaugauggcccuggggaagagguuuccgaagagggauuccagauucccgcuaccaucacagagagauacaaagugggccggaccauuggcgacgggaacuuugccguggucaaggaauguguggagcgcagcacagcgagagaauaugcucucaaaaucauuaagaagucuaaaugccggggaaaggagcauaugauccagaaugagguuuccauccugcgcagagugaaacacccuaacauuguccuucugaucgaagagauggaugugccgaccgaacucuaccugguuauggagcuggugaagggcggggaccucuucgaugccauuacgagcaccaauaaauauacagaacgggacgccuccggaaugcuguacaaccuugcuucugccaucaaguaucugcauagccucaauauuguccaccgcgauaucaagcccgagaaccugcuuguguacgagcaucaagacggcuccaaaagccugaagcucggggauuuuggacuggcuaccauuguggacggcccucuguauacagucuguggcacccccacguacguugccccugaaaucaucgcggagacaggguacggacucaaaguggauauuugggccgcuggcgugaucaccuauauucugcuuugcggguuucccccguucagaggaucuggcgacgaucaggaaguccuguucgaccagauccucaugggacagguggacuuuccuucccccuacugggauaauguuagcgacucugccaaggagcugauuacaaugaugcuucugguggaugucgaccaacgguucagcgcugugcagguucucgaacacccuugggugaacgaugacgggcugcccgagaaugagcaccagcuguccgucgccggcaaaaucaagaaacauuuuaacaccggccccaagccuaauucuaccgcggccggggugagcgucaucgcucucgaucacggauucacaauuaagcgcuccggcagccuggacuauuaccagcaaccggggauguauuggaucagacccccucuucugauucggcgcggaagauuuucugaugaagacgccacgcggauguga

SEQ ID NO: 68198 - RNA, 2301 nt, Artificial Sequence
  derived and/or modified sequence opt5 from DCLK2__Homo_sapiens__NP_001035350
auggccagcaccagauccaucgagcuggaacacuucgaggaacgggacaagcgccccagaccuggcucucggcgcggggcuccgagcuccucuggaggcagcuccucuagcgggcccaaaggaaacggccucauuccuucccccgcccauagcgcgcacugcucuuuuuacagaacacggacgcugcaggcucuuuccagcgagaagaaagccaagaaagcccgcuucuauagaaauggggaucgguacuuuaagggacugguguucgcuaucucuuccgaccgcuuuagaucuuucgaugcccuccugauugaacuuacccggucucuguccgacaacgucaaucucccucaaggcguucgcacaaucuauaccauugauggcagcagaaaggugacaucccuggacgagcugcucgagggggaaucuuacgugugugcuagcaacgagcccuuucggaaagucgauuauaccaagaauaucaacccuaauugguccgugaacaucaaaggaggcacaagccgcgcccuggcggccgcuucuuccguuaagagcgaagugaaagagucuaaggacuucauuaagccgaaacuugucaccgugaucagaagcgggguuaagccccggaaagccgugcgcauucugcucaauaagaaaacggcucauuccuuugagcagguccugaccgauaucacagaagccauuaaacuugacucuggaguggugaagagacugugcacccucgauggcaagcaggucacaugucugcaggacuucuuuggggaugacgacguuuucaucgcgugcggaccugagaaguuucgguacgcccaagaugacuucgugcuggaucacagcgaauguagagugcucaaauccagcuauucucgcuccagcgcugucaaguacucuggcuccaaaagccccggcccuucccggagaucuaagagccccgccuccgugaacgggaccccgucuagccagcuguccacgccuaaaagcacaaagucuuccagcagcucccccaccagcccuggaucuuuccgcggccuuaagcagauuagcgcucaugggcgguccagcucuaauguuaacggaggccccgagcuggacagaugcaucucccccgaaggggugaauggaaaccgcuguagcgaguccucuacacuccuggagaaauacaagaucggcaaagucauuggcgaugggaauuuugccgugguuaaggaaugcaucgaccggagcaccggaaaagaguucgcccuuaagauuaucgauaaggcuaaauguugcggcaaggaacaccugauugagaacgaaguguccauccucagacgcgucaaacacccuaacaucauuaugcugguggaggagauggaaaccgcgacagagcuguuucucgucauggaacuggugaaagggggagaccuuuucgaugccaucacgucuagcaccaaguauacagagcgggacggcuccgcuaugguuuacaaucuggccaacgcccucagauaucugcaugggcuuucuauugugcaccgggauaucaagccggaaaaucugcucgucugugaguaccccgacggcaccaagagccugaaacugggagacuuuggccucgcuacagugguugaggggccucuguauaccgugugcggaacgcccacauacgucgccccugaaauuaucgcggagaccggcuaugggcuuaagguggauaucugggcugccggagugauuaccuacauccugcucugcggcuuucccccguuccgcuccgaaaacaaucugcaggaggaccuguucgaucaaauucuugccgggaaacucgaguuuccugcucccuacugggacaacaucacagauagcgccaaggaacugauuucucagaugcugcagguuaaugucgaggcuagauguaccgccggccagauccucucccauccuugggugagcgacgaugcgucucaagaaaacaauaugcaggccgaggugacaggaaaacugaagcagcacuucaacaaugcccuucccaaacaaaacuccacgaccacaggcgucagcgugauuaugaauaccgcucuggacaaggaagggcagaucuuuugcucuaagcacugucaggauuccggacggccuggcauggagcccaucagcccgguuccucccuccguggaggaaauucccgucccuggggaggcugugccggcccccacaccucccgaaagcccuacgccccauccucccccggcggccccuggaggcgagagagcugggaccuggcgccggcacagagacuga

SEQ ID NO: 68199 - RNA, 1947 nt, Artificial Sequence
  derived and/or modified sequence opt5 from DCLK3__Homo_sapiens__NP_208382
augggcaaggagccccugacccucaaaagcauccagguggccgucgaagaacuguacccuaacaaggcuagagcccuuacacuggcgcaacacucccgggcuccgucuccccgccucagaagccggcuguucuccaaagcccuuaagggggaccaucgcugcggagaaacggagaccccuaaaucuuguagcgaaguugccggcugcaaggcugccaugagacaccaggggaagauucccgaggagcugucccucgaugaccgggcucgcacacagaaaaaguggggaagaggcaaaugggaaccugagcccucuagcaagccuccgcgggaagccacccuggaggagcgccaugcgagaggggaaaaacaccugggaguggagaucgaaaagacauccggcgagauuauccggugugaaaagugcaaacgcgagagagagcuccagcaaagccuggaacgggagcgccuuucucugggcaccuccgaacucgauauggggaagggacccauguaugacguggagaaacuggucagaacacggagcuguagacgcucuccugaagccaaucccgcuuccggcgaggagggguggaagggagauagccaucggucuuccccuagaaaccccacccaggaacuucgccggccgagcaaauccauggacaagaaagaggauagaggcccugaagaccaggagucucacgcccagggggcugccaaggcgaagaaagaucugguggaaguucuccccgugacggaggagggacugcgcgaagucaagaaagacacccggccuaugagcagauccaagcacggcggcuggcugcuccgcgagcaucaagccggguuugaaaaacugcggagaacacgcggagaggagaaggaagcugagaaggagaaaaagcccugcaugagcggcgggcggagaaugacccuucgggaugaccagcccgccaaacuggagaaggaaccuaaaacacgcccggaggagaauaagcccgaaagaccuucuggacggaagcccagaccuaugggcauuaucgcugccaacguggagaaacacuacgaaaccgggcgcguuaucggagauggcaauuucgccguggucaaggagugucggcauagagaaacgcgccaggcuuaugcgaugaaaauuaucgacaaguccagacucaaaggcaaggaggacaugguggauagcgagauucugaucauucagucucuuagccaccccaacaucgugaagcugcacgaagucuacgagacagacauggaaauuuaucucauccuggaguacguucaagggggagaucuguuugacgccaucauugaauccgugaaauucccggagccugaugcugcccucaugaucauggaccugugcaaggcccuugugcauaugcacgauaaaucuauuguccaucgggaccugaagcccgagaaucuccuggugcagcgcaacgaagauaaaagcaccacacuuaagcuggcugacuuuggccucgccaaacacguugugagaccuaucuucaccgucugugggacccccacauauguggcgccugagauucuguccgaaaagggauacggccuggagguugauaugugggcugccggggugauccucuacauccugcuuugcggcuuucccccguuccggagcccugagcgcgaccaggacgaacuguuuaauauuauccaacucggacauuucgaguuucugccucccuauugggauaacauuucugacgccgcuaaggaucuggucuccagacuucucguggucgaccccaaaaagcgguacacggcccaccaggugcugcagcacccguggaucgaaaccgcuggcaaaacaaauaccguuaagcgccagaaacaagugagccccucuuccgaggggcauuucagaagccagcacaagcgggucguggaacagguuuccuga

SEQ ID NO: 68200 - RNA, 3123 nt, Artificial Sequence
  derived and/or modified sequence opt5 from DCLRE1A__Homo_sapiens__NP_055696
augcuggaggacaucagcgaagaggauauuugggaauacaaguccaaaagaaagcccaaacggguggacccuaacaauggcucuaagaacauccucaaaagcgucgagaaggccaccgaugggaaguaucaguccaaacgcucuagaaaucggaagcgcgcugccgaagcgaaagagguuaaggaccacgaggugccgcugggaaacgcuggcugccaaacaagcguggccuccucucagaauagcuccuguggggauggcauucagcagacgcaagacaaagaaaccacacccggaaaacuuugcagaacccaaaagagccagcaugucucuccuaaaauccggcccguguacgauggguauuguccuaacugccagaugcccuucuccagccugauuggacagacaccucgcuggcacguuuuugagugucucgacucuccgcccagauccgaaaccgagugcccugauggccugcuuuguacaagcaccauccccuuccauuacaagcgguauacgcacuuucugcucgcccagucucgcgcuggcgaccauccuuucuccagccccuccccggccucugggggcagcuuuuccgagaccaaaagcggagugcugugcucucuggaagagagaugguccagcuaccagaaucagacagauaacucugucagcaaugacccucuccugaugacccaauauuucaagaaaucccccucucuuacagaagcuagcgagaagaucuccacccacauucagacgagccagcaagcccugcaguuuacagauuucguggaaaacgacaaacucguugggguggcgcugcggcuugccaauaacucugagcacaucaaucugccucuccccgagaacgacuuuuccgauugugaaauuagcuacucuccccugcaguccgacgaggauacccaugacaucgaugaaaagccugacgauagccaggagcaacuguucuuuacagaauccucuaaggacggaagccucgaggaggaugacgauuccugcggcuucuuuaaaaagcgccacgggccgcugcuuaaagaccaggacgaaucuugucccaaggucaauagcuuccugaccagagauaaauacgacgagggacucuaucgguucaacucccugaacgaucuuagccagccuauuucucagaauaacgaauccacccugcccuacgaccucgcuugcacaggcggcgauuuugugcuguucccucccgcccuggcugggaagcucgccgcgagcgugcaucaagccacgaaggcuaaaccggacgagccugaauuucacucugcccaguccaauaagcagaaacaggucaucgaggagagcucuguuuauaaccaagugagccugccccuugugaagucccugaugcucaaaccuuucgaaagccaggucgagggauaccugucuucccagcccacccagaauacaauucgcaaacuuagcuccgaaaaccugaaugcuaagaacaauaccaacucugccugcuuuuguagaaaagcccucgagggcgugccuguugggaaggcuacaauccugaauaccgagaaccugagcuccacgcccgcgccgaaauaucucaagauccugccuucuggacuuaaauacaaugcccggcaccccagcacaaaggugaugaagcaaauggauauuggcgucuauuucgggcugcccccuaaaagaaaggaagagaaacuccugggagaauccgcucuggagggcaucaaccuuaauccggugcccucuccuaaccagaagcgcagcucccagugcaaacggaaggccgaaaagagccucucugaccuggaguuugaugccuccacccugcaugagagccaacucucuguugaacuguccagcgagagaucucagcgccagaagaagcgguguagaaaauccaacagccuucaggaaggcgcuugccaaaagcgcuccgaccaccugauuaauaccgagagcgaagccgugaaccucucuaaagucaagguguucacaaaaagcgcgcaugggggacugcagcggggcaauaagaagauccccgaguccucuaacgucgggggaagcagaaagaagaccuguccuuuuuacaaaaagauucccggcacaggguucacgguggaugcuuuucaguacggcguuguggagggaugcaccgccuauuuccugacacacuuucauuccgaccacuacgccggccuuucuaaacacuucaccuucccugucuauuguagcgaaaucacagggaaucuccugaagaacaagcugcaugugcaggagcaauacauccacccccucccgcuggauaccgaaugcauuguuaauggagugaaagucgugcuucuggacgcuaaccauuguccuggcgccgugaugauccucuuuuaucugcccaaugggacgguuauucugcacaccggagacuuccgcgcugauccuuccauggagcggucucuucucgccgaccagaagguccacaugcuguaccuggauacaaccuauugcagccccgaauacacauuuccgucccagcaggaggugaucagauucgcgauuaacaccgccuuugaggcugugacgcucaauccucaugcccuggucguguguggcacauacagcaucgggaaagaaaagguuuuccuugcuaucgccgacgugcugggcucuaaagucggaaugucccaagagaaguauaagacccuccagugccugaacauucccgaaaucaauagccugauuacaaccgauauguguucuucccuugugcaccuccugccuaugaugcagaucaacuuuaaaggccugcaaagccaucucaagaaaugcgggggaaaguacaaucagauucuggcguuccgccccaccggcuggacacacuccaacaaauuuacgcggaucgccgacguuauuccccagaccaaggggaacaucucuaucuauggcauuccuuacagcgagcauuccagcuaucuugagaugaaaagauucgugcaguggcugaagccgcaaaagaucauucccacagucaaugugggaaccuggaaaucucgguccacaauggaaaaguacuuucgcgaguggaaacucgaagcuggguauuga

SEQ ID NO: 68201 - RNA, 2079 nt, Artificial Sequence
  derived and/or modified sequence opt5 from DCLRE1C__Homo_sapiens__NP_001029027
augagcuccuucgagggccagauggccgaauaccccaccaucucuauugacagauuugaucgggagaaccugcgcgcuagagccuauuuccucagccacugccauaaggaccacaugaaagggcugcgggcgccuacacuuaagcgcagacuggaauguucccucaaaguguaccuguauugcucuccggucacgaaggagcuucugcucaccagccccaaauaccgguuuuggaagaagcgcaucauuuccaucgaaauugagacaccuacccaaaucucucugguugaugaggcuagcggagaaaaagaggaaaucguggugacacugcuccccgccggccauuguccuggguccgucauguuccuguuucagggaaauaacggcaccgugcuuuauacaggggacuucagacuggcccagggagaggcugcccggauggagcuccugcacagcggcggccgcguuaaggauauucagucuguguaccuugacaccacguuuugcgaucccagauucuaucaaaucccuucccgggaagagugucugagcgggguccucgaacuggugcgcucuuggauuaccagauccccguaccauguuguguggcugaauugcaaagcugccuacggauaugaguaccucuuuacaaaccugagcgaggaacuuggcguccaggugcacgugaauaagcuggacauguuccggaacaugcccgagauccuccaccaucugaccacagaucgcaauacccagauucacgcguguagacauccuaaagccgaagaguauuuucaguggucuaagcugcccugcgggaucacgucccggaaccgcauuccucugcacaucaucagcauuaagcccuccacaaugugguucggagaaagaucucggaaaaccaaugucaucguuagaacaggcgagagcuccuaccgcgcuuguuuuagcuuccacucuuccuauagcgaaauuaaggacuuccucucuuaccugugcccggugaacgccuauccuaaugugauccccgucgggaccaccauggauaaagugguugagauucugaagccucucugucggagcucccaaucuacagagcccaaauacaagccccugggaaaacuuaagagagcucgcacggugcaucgggacagcgaagaggaagaugacuaccuguuugacgauccucucccgaucccccugagacacaaggucccuuaucccgagaccuuccauccugaaguguuuuccaugacagccguuagcgagaaacagcccgagaagcugcgccagaccccgggcugcugccgggcggaauguaugcagucuuccagauucacaaacuuuguggacugcgaggaaagcaauucugaguccgaggaagaggucggcaucccugccagccugcaaggggaucucggauccgugcugcaccuucagaaagcugacggcgaugucccccagugggaaguguucuuuaagcgcaacgacgagauuaccgaugaaucucucgagaauuucccuagcuccacgguugccgggggaucucaaagccccaaacuguuuuccgacagcgauggcgagucuacacauaucuccagccagaacucuucccagagcacccacauuaccgaacaggggucucaaggaugggacagccaguccgauacagugcuucugagcucucaggagcggaacuccggcgacaucaccagccucgacaaggcugauuacagaccuacaauuaaggaaaauauccccgccucccugauggagcagaacgucaucuguccgaaagacacguauucugaucuuaagagccgggacaaagaugugaccauuguuccuuccacaggcgaacccaccacacuuucuagcgagacccacauccccgaggaaaagucccuccugaaucugucuacgaacgccgacagccaauccagcucugauuucgaggugccuuccaccccggaagcugagcuccccaaacgcgaacaucugcaguaccuuuaugagaagcuggcgacaggggagagcauugccgucaagaaaagaaagugcucucuccuggacaccuga

SEQ ID NO: 68202 - RNA, 1080 nt, Artificial Sequence
  derived and/or modified sequence opt5 from DCN__Homo_sapiens__NP_598010
augaaggccaccaucauucugcuccugcuugcucaggugagcugggccggccccuuccaacagagagggcuguuugacuucaugcucgaggaugaagcguccggaaucggcccugaggucccggacgaucgggacuuugaacccucucuggggccuguuugccccuuccgcugucagugccaccuuagaguggugcaguguagcgaucugggacucgacaaagucccuaaggaucugcccccugacacaacgcugcucgaucugcaaaacaauaaaauuaccgagaucaaggacggcgauuuuaaaaaccuuaagaaucugcaugcucucauucuggugaacaauaagaucuccaaaguuucuccgggggccuucacaccccuugugaagcuggaacggcucuaccugagcaaaaaccagcugaaggagcucccugagaaaaugcccaagacccugcaggaacuucgcgcccacgagaaugaaaucacaaaggucagaaaagugaccuuuaacggacugaaucagaugauuguuaucgagcucggcacaaacccucugaaguccucuggcauugagaauggggcuuuccaaggaaugaaaaagcugagcuauauccggauugccgacaccaacaucacguccauuccccagggccuuccgccuagccucaccgaacugcaucuggaugggaauaaaaucucucgcguggacgcugccucccucaagggacugaacaaucuugcgaaacugggccucagcuuuaacucuaucuccgccgucgacaacgggagccuggcuaauacaccccaccuuagagagcugcaucucgauaacaauaagcugacccgggugccuggaggccuggccgaacacaaguacauucagguggucuaucuccacaacaauaacaucucuguugugggcuccagcgacuucugcccucccgggcauaauaccaaaaaggcuuccuacucuggagugagccuguuuuccaaccccguccaguauugggagauucaaccgagcacauuccgcuguguguacguuagaucugccauccagcuuggcaauuauaaauga

SEQ ID NO: 68203 - RNA, 1272 nt, Artificial Sequence
  derived and/or modified sequence opt5 from DCP1A__Homo_sapiens__NP_001277136
auggccgacguggucgaggaagagaccagacggagccagcaagcugcccgcgauaagcagucccccucucaggcgaacggcugcagcgaccacagaccuaucgauauucuggaaaugcucucccgggcuaaagacgaguacgaacgcucugccccgagcgggcauaagcaccugacaguugaggagcuuuucggaacgucccugcccaaagaacagccugccguggugggccucgauucugaggaaauggagagacugcccggggacgcuagccaaaaggagccuaauuccuuucuucccuucccuuuugaacagcugggaggcgccccgcagagcgagacccucgggguccccucugcugcccaucacuccgugcagccugaaaucacaacccccguucugauuaccccugcgagcaucacccaaucuaacgagaaacaugcccccacauauaccauuccgcuguccccugugcucagccccacgcugccugcugaagcccccaccgcucaggugcccccuucucuuccgcgcaauuccacaaugaugcaggccgucaagaccacaccccggcagagaagcccucugcucaaccaacccguuccugagcugucccacgcgucucuuaucgccaaucagagccccuuccgggcuccgcugaacgugaccaauacggccggaacaucccucccuagcgucgaucugcugcagaagcuccgccugacaccccaacacgaccagauccagacacagccucuuggcaaaggcgcuaugguggccucuuuuucccccgccgcugggcaacuggcgaccccugagagcuucauugaacccccgucuaagaccgccgcugccagaguggccgcuagcgccucccucucuaacaugguccuggcgccucuucagagcaugcagcagaaucaagaucccgagguuuuugugcagcccaaagugcuguccagcgcuaucccugucgccggagccccgcucgugacagcuacgaccacagccguuucuuccgugcugcuggcucccagcgucuuccagcagaccgugacacggucuuccgaccucgaacgcaaggccagcuccccuucuccccugaccauuggcacgccugagagccaaagaaaacccuccaucauucuuucuaagagccagcugcaggauacacucauccaucugauuaagaacgacuccagcuuucuuucuacccugcacgaaguuuaccuccaggugcugaccaaaaauaaggauaaccauaaucuguga

SEQ ID NO: 68204 - RNA, 1854 nt, Artificial Sequence
  derived and/or modified sequence opt5 from DCP1B__Homo_sapiens__NP_689853
auggccgcuguggccgcgggcgggcuggucggaaagggcagagacaucagccucgcugcccugcagcggcacgaucccuacauuaaccgcaucguugacguggccucccaaguggcucuuuauaccuucgggcauagagccaaugagugggagaaaacagaugucgaaggaacgcuguuuguguacacccggucugcuagcccuaagcacggcuucacaauuaugaaccgccucuccauggaaaauagaaccgagccgaucacaaaagaccuggauuuucagcuucaggaccccuuccugcucuaucggaacgcccgccugucuauuuacgggaucugguuuuaugauaaggaagagugccagagaaucgcggagcugaugaaaaaucucacccaauacgaacagcugaaggcccaucagggaacaggcgcuggcauuagcccuguuauccuuaacuccggggagggaaaggaaguggacauucugcggaugcucaucaaagccaaggaugaguauaccaaauguaagacgugcucugagcccaaaaagauuaccagcuccagcgcuaucuacgacaauccuaaccugauuaagcccaucccugucaaaccgucugaaaaucagcaacagcgcaucccccagccuaaccagacacuugaucccgagccucaacaccugucccucaccgcccuguucggcaagcaggacaaagcgacaugucaggaaaccguggagcccccgcaaacgcugcaucagcagcagcaacagcagcagcaacagcaggaaaagcucccuauuagacaggggguugugcggagccugucuuacgaggagccccgcagacacuccccucccaucgaaaaacaacuuugccccgccauucagaagcugaugguccggagcgcugaucuccacccucugucugagcuuccggaaaaucgccccugugagaacggauccacacauagcgccggcgaauuuuucaccgggccugugcagcccggauccccucacaauaucggcacaucuagaggcgugcagaacgcuagccggacccaaaaucuguuugagaaacuccaguccacccccggggccgccaacaagugcgacccgagcaccccugcucccgcgucuuccgccgcucugaacagaagccgcgccccuacgucugucacccccguugccccuggaaagggccuggcucagcccccgcaagccuauuucaaugggagccucccuccccagacagugggacaucaggcgcacggccgggagcaguccacccugcccagacaaacacuuccuauuucugggagccagaccggauccagcggcgugaucucuccgcaggaacugcucaaaaagcugcagaucguccaacaggagcagcagcuucacgcuuccaaccgccccgcccuggccgcuaaauuuccugugcucgcccaaagcucuggcacggggaagccccuggaauccuggauuaauaaaacaccuaacaccgagcagcagacaccccuguuccaaguuaucagcccucagcggauucccgcuacagccgcgccgucccuccugaugucuccuaugguguuugcccagcccaccagcgucccucccaaggaaagagaguccggacuucugccggugggcgggcaggagccucccgcugccgcuacaucucuccugcugccuauccaaagccccgaacccuccguuauuacgagcucuccucuuaccaagcuccagcugcaggaggcccugcucuaccugauccagaaugacgauaacuuccuuaauaucauuuaugaagcguaccuguucuccaugacacaagccgcuaugaaaaagaccauguga

SEQ ID NO: 68205 - RNA, 1014 nt, Artificial Sequence
  derived and/or modified sequence opt5 from DCPS__Homo_sapiens__NP_054745
auggccgacgcugcgccccagcugggcaagagaaaacgggagcucgauguggaagaggcccacgcugccagcaccgaagagaaggaagccggggucggaaacggcacaugcgcuccuguucgccugccguucuccggguuuagacuucaaaaagugcugcgggagucugcccgcgacaagaucauuuuccuccauggaaaagugaaugaggcuagcggcgauggggacggagaagaugccgucgugauccuggagaagacgcccuuucagguugaacagguggcgcagcuucugaccggcuccccugagcuccaacugcaguucucuaacgacauuuacagcacauaucaccuguuucccccuagacagcucaaugaugucaagaccacagugguuuaccccgccaccgagaaacaucugcagaaguaucuucggcaagaccugcgccucaucagagaaacaggcgaugacuaccggaacauuacccugccucaccuugagucccagucucugagcauccaguggguguauaauauccucgauaaaaaggcugaagccgaccgcauugucuucgagaacccggaucccuccgacggguuugugcugaucccugaccugaaauggaaucagcaacagcucgaugaccuguaccuuauugcuaucugucauagacggggcauucgcagccugagagaucucacgcccgaacaccuuccucugcugcggaacauccuccaccagggacaagaggccauucugcagcgcuauagaaugaagggggaccaucugcggguguaccuccacuaccugcccucuuauuaccaucuucacguccacuucaccgcgcugggauuugaggccccgggcuccgggguugaaagagcucaucuccuggccgaggugaucgaaaaucuugagugcgauccucgccacuaucagcagcggacacugaccuucgcucucagagccgacgauccccugcugaagcuccugcaagaagcccagcagagcuga

SEQ ID NO: 68206 - RNA, 2046 nt, Artificial Sequence
  derived and/or modified sequence opt5 from DCST1__Homo_sapiens__NP_001137159
auggacaucaagcaccaucagaacggcaccagagggcaacggcgcaaacagccccacacaacggugcagagacugcucaccuggggacugccugucagcugcuccugguuccuuuggcggcagccgggcgaguuucccguuacagcccugcuccugggggcuggagccggcgggcuucuggcgauuggacucggcgcuaugggcugggggaccucuccucauauccgcugugccagccugcugcucgugcccaagaugcugggaaaagaaggcagacuuuucgugcugggguacgcccucgcugccauuuaugucggaccuguggcuaaucugcggcacaaccuuaauaacguuaucgccucccugggcugcacaguggagcuccaaauuaauaacacccgcgcggccuggagaaucucuacagcuccccugcgggccauguuuaaggaucugcucagcuccaaagaacugcuucgcgcugagaccagaaauaucucugccacguucgaagaccuggaugcgcaggucaacagcgagaccggguacacaccugaggacaccauggauuccggagaaacagcccagggccgggaggcucgccaggccccggcuagcagacuccaucugucuacccaaaagauguaugaacuuaagacgaaacugcgguguuccuacgugguuaaucaggccauucucagcugccgcagaugguuugaccggaagcacgagcaguguaugaaacacaucugggugccccugcugacacaucuccugugccuuccuaugaaguucaaauuuuucuguggcauugccaaggucauggagguguggugcagaaaccgcauccccguggaagggaauuuuggacagaccuaugauucucugaaccaauccauucggggccucgacggggaguucagcgcuaauaucgauuuuaaggaagagaaacaggcgggaguccugggccuuaacacaucuugggaaagaguuuccaccgaggugcgcgacuacguguaucggcaggaggccagacuggaaugggcucucgggcugcugcacguccuccugagcuguaccuuccuucuggugcuccaugccuccuuuucuuacauggauagcuacaaucacgacauucgcuucgauaacaucuauaucuccacauacuucugccaaauugacgaccggagaaagaaacugggaaagcgcacgcugcuuccucuccggaaagccgaggaaaagaccguuaucuuucccuguaaaccgacaauucaggcuagcgagaugucuaacguggucagagaacugcuggagacccucccuauccugcuucugcucgugguucugugcggccuggauugggcccuuuauuccauuuucgacacaauccgccaccauagcuuucuccaguacucuuuccggagcucccacaagcuggaggugaaggucggcggggauucuaugcuggcgagacuccugcggaaaaccaucggagcucuuaauacgagcuccgaaacagugauggagagcaacaauaugcccugccugccucagcccgucggccucgacgcccgcgccuauuggagagcugccgugcccauugggcugcugguuugucuuugccuccugcaggcuuuuggauaccggcugagacgcgugaucgccgcguucuauuuuccuaagcgggagaaaaagcgcauucucuuccuguacaacgaucuucugaaaaagagagccgcuuuuaccaagcucagacgggccgcuauccugcgcagagagcggcaacagaaagccccgcgccauccccuggcggacauucuucacagaggcuguccucuccugcggcgcuggcugugcagacggugugucgugugccaggcccccgaaaccccugagucuuacguuugucgcacacucgauugcgaggcuguguauuguugguccugcugggacgauaugagacaacggugucccgucugcaccccgagagaagaacugucuagcuccgccuucagcgacuccaaugaugacacagcuuacgccggguga

SEQ ID NO: 68207 - RNA, 2322 nt, Artificial Sequence
  derived and/or modified sequence opt5 from DCST2__Homo_sapiens__NP_653223
augcccaaggugaugaaagacgucguucacccucugggcggggaggaaccgagcauggccagagcuguggugcgguccgucggaggcuucacccucgggcugucucuugccacagcguacggacugcucgagcugcuuguggaaggccauagccccugggggugccugguuggaacgcucacccuggcugccuuucugucccucggcaugggcuucucucgccaggugagagccacaguccugcuucugcucccucaggcuuuuagccggcaagggcgcacccugcuucugguggccgcuuucggacucguucugcagggccccugugccaacacacugagaaauuuuacccgggcguccgaggccguggcuugcggggccgaacucgcucugaaccagacagccgagguccuucaacgcgcgaagcagccucuggugucugcccucaauaaaaucaaggcuauugccagaaaaaccaaggagguggcugaucggguccgcaaguucuuuagaagcaucauggacggaguuaaacacauugcccgggcccugcgcaacguguggcaguggcuucugcauaucggcgauguguguaauuccgaacucgggaaccccuaucugaagugcgcuagagucuucgacgaugcgaaagacagcuguaugauggugauuccucaggccuaccaccugugcuauguucucaugccguuuaagcuggcucuuuguggacuggccucucucgugcaagucuucugcgugauccccaaauacauccagccuuuucugcggcagacgauuggcacccccguuauccagcuucugaaucgcgugagacaagaguucgaauuuaacaugacagccacccaucacuucuccgucgaucucaaugcuagccggucucugucccagguggccauggaccugcacgaggcggucagcaugaagcuccauagagugcgcgaggcucuggcccuuaugggcuucacaaccccucugcuccugguucugcuuuaucuccaggcccuguuuuaccgguauuguuaccugaacugggaucacuacgacaauauuuauaucacgucuagauuccuccgcauggaagcugugcgguccacagccgggcugcccaccguccuuccgcugagcgcucaugaggccagacgcuacauuccucccggauccaucuuucucucucaaugggaaaaguucuuuuauauucuggagacauucaaccugauccggcaccuucuccuggugcuguuucucguuuuccuggauuacgcgguguuuuggguccuugaccuggccagacaccagcuccagggcgaaaucguggcucgcagcccugugcugguuucccugaccgucgaggggaccggauaugccggcaauauuuaccgggaucuugugagcgcuuucgacgugcuccagcaagggaacaucucuauucuguccagacgcugccugcuccggcccagcgagcccgacucuacaggauauaucgucauuggcgugauguacggccugugcuuuuucaucacgcuuuuugggagcuacguuuccagacugcggcgcgugaucugugccucuuauuacccuagcagagaacaggagcggauuuccuaucucuacaauguccugcugagcagacgcaccaaccuucucgcggcccugcaucggucugugagacgcagagcugccgaucagggacaccgguccgcuuuccugguucucgccagccgcugcccgugucugggccccuucgugucucauuuuuggcuucaccaggccuauugccugggguguggacaaccucaggacgaaggcgauauggagaacacagucuccugcagcacccccgggugucagggccucuacugccugacauguuucagacugcuugacaauaccugcuccgugugugcuucuccucugagcuaucagggagaucucgaccuggaacucgauuccucugacgaggagggcccccaacuguggcuugcggccgcucagcggaaagauccggaacaggccuggcugcuccagcaacagcugcaggagguucuggggcgcagccuuuccauggaaagcacgucugaguccagcgaccuggaugaagagaagggaccucaacagagaaaacauggccagcagccccucccugaggcccaccaacccgugucuauccugacauccccugaaccccaccggccgccugagaccagcucugcuaccaagggggcccccacacccgcgagcgaaccuuccgucccgcucucucccccuagccugcccgacccuucccaucccccucccaaauga

SEQ ID NO: 68208 - RNA, 1413 nt, Artificial Sequence
  derived and/or modified sequence opt5 from DCSTAMP__Homo_sapiens__XP_005251132
augggcaucuggaccagcgggacagacauuuuccugucccucugggagaucuacgugucucccagaagcccuggauggauggauuuuauucagcaccugggcgucugcugucuuguugcccugaucuccguggggcuccugucuguggcugccugcugguuccuuccgagcauuaucgcggcugccgccuccuggaucauuacguguguccugcucugcuguucuaagcaugcucggugcuuuauccugcugguguuccucagcuguggacugcgcgaaggcagaaacgcccuuauugcugccgggaccggaaucguuauucugggccacguggagaauaucuuucauaacuucaaaggccuccuggacgggaugacaugcaaucuucgggcgaaguccuuuagcauucacuucccccugcucaaaaaguauaucgaagccauccaauggauuuacggacuggcuaccccucugucugucuuugaugaccucguguccuggaaccagacacuggccguuagccuuuucucucccucccaugugcuggaggcucagcucaaugauagcaaaggcgaaguccugucugugcuuuaucagauggccaccacaaccgaggugcuguccagccucgggcaaaagcugcuggcguuugccggacucucccugguccuucugggcacgggacucuucaugaagcgcuuucuggggccuuguggcuggaaauacgagaacaucuauauuaccagacaguucguucaguucgacgaacgggagcgccaccagcaaagacccugcgugcuuccucugaauaaggaagagagacgcaaauacgugaucauuccgacauuuuggcccaccccuaaggagcggaaaaaccucggccuguucuuucugcccauccucauccaccuguguauuuggguccuuuucgcugccguggauuaucugcucuaccggcugaucuuuucuguuagcaagcaguuccagucccugccuggguuugaagugcaucuuaagcuccacggagagaaacagggcacacaagacauuauccaugauagcucuuucaauauuuccgucuuugaacccaacugcaucccgaagccuaaauuccugcugagcgagaccugggugccccucucuguuauccugcuuauucuggugaugcucgggcugcugagcuccauccuuaugcagcucaagauucuggucucugcuagcuuuuacccuuccguggaacgcaaaagaauccaguaucugcacgccaagcuccugaaaaagcggagcaagcaaccccuuggagaggucaaacgcagacugucucucuaccugacgaagauucacuucuggcugcccgugcuuaaaaugauccggaagaaacagauggacauggccuccgcugauaagagcuga

SEQ ID NO: 68209 - RNA, 570 nt, Artificial Sequence
  derived and/or modified sequence opt5 from DCTD__Homo_sapiens__NP_001012750
auggugggcgggggacagcccugcggcccuaacaugagcgaggucuccuguaagaaaagagacgauuaccuggaauggccggaguauuucauggccguugcuuuucucucugcccaacggagcaaggaccccaauucccaggugggggcgugcaucgugaacucugaaaauaaaauugucggaaucggcuacaacgggaugccuaauggauguagcgaugacgugcugcccuggcgcagaaccgcugagaacaaacuugauacaaaguauccuuacguuugccacgccgaacugaaugccauuaugaacaaaaauuccacggacgugaagggcuguucuauguaugucgcucucuuccccugcaacgagugugccaagcugaucauucaggcuggcaucaaggaggugaucuuuaugagcgauaaauaccaugacuccgaugaagccaccgcggcccggcuucuguucaauauggcugggguuacauuucgcaaguucauuccuaaaugcagcaagaucgugauugacuuugauucuaucaacuccagaccgagccagaagcuccaauga

SEQ ID NO: 68210 - RNA, 1659 nt, Artificial Sequence
  derived and/or modified sequence opt5 from DCT__Homo_sapiens__NP_001123361
augagcccccugugguggggcuuccuccuguccugccuuggguguaagauccugccuggagcccagggccaauuuccgagagugugcaugaccgucgacucucucguuaacaaagaguguugcccccggcugggggcugaaagcgccaauguguguggaucccagcagggccgcgggcagugcacagaggugagagcggauacgcggccuuggucuggacccuacauucuucgcaaccaagacgauagagaacuguggccucggaaguucuuucaccgcaccuguaaaugcacaggcaauuucgcuggcuauaacuguggggacugcaaguuuggauggaccggccccaauugugagcggaaaaagccuccggucaucagacagaacauucauagccucagcccccaggaacgcgagcaguuccugggggcccuggaucucgccaagaaaagagugcacccugacuacguuaucacaacccaacauuggcugggacuucugggccccaaugggacacagccucaguuugcuaacugcucuguguaugauuucuuugucuggcuccacuacuauagcgugcgggacacccugcuuggacccggccgcccguacagagccauugauuucucccaucagggcccugcuuuuguuacguggcaccgguaucaucugcucugccuggagcgcgaccugcaaagacucaucgggaaugaauccuucgcccugcccuacuggaacuuugcgaccggacggaaugagugugaugugugcacagaccagcuuuucggcgccgcuagaccugaugaccccacccugaucucucgcaacucccgguucagcucuugggaaacagucugugacucccucgaugacuacaaucaccuggugacccuuugcaacgggacguaugagggacugcucagacgcaaucagaugggccggaacagcaugaagcugcccacacugaaagauauuagagacugucucucucugcaaaaguuugauaacccuccguucuuucaaaauuccaccuucagcuuucgcaacgcccuugagggguucgacaaagcugauggaacacuggacucccaggugaugucucuccacaaucugguccauagcuuucuuaacggcaccaaugcccugccccacuccgcggccaacgauccuaucuucguugugauuagcaaucggcuccuguacaacgcuaccacaaauauccuggaacacgugagaaaggagaaggccacgaaagaacuccccucucugcauguccuugugcugcacuccuuuaccgacgcuauuuucgaugaguggaugaagcgcuuuaacccucccgccgacgccuggccgcaggaacucgcuccuaucggccauaaucggauguauaacaugguucccuucuuuccucccgugacaaaugaggagcuguuccugaccagcgaccagcuuggguacucuuaugcgauugaucucccugucagcguggaagagacacccggauggccgaccacgcugcugguugugaugggcacacucgucgcccugguggggcuuuucguccugcucgcuuuucugcaguacagacgccugcggaaaggauauaccccucuuauggaaacccaccucuccucuaagagauacacagaggaagccuga

SEQ ID NO: 68211 - RNA, 3762 nt, Artificial Sequence
  derived and/or modified sequence opt5 from DCTN1__Homo_sapiens__NP_001128512
auggcccagagcaagagacacguguacucccggacccccucuggcagccgcauguccgcugaggccucugcgagaccucugcgggucgggagccgcguugaagugaucggaaaaggccauagagggacaguggcuuaugucggagccacccucuucgccacgggcaaguggguggggguuauucuggacgaggcuaaaggaaagaacgauggcacagugcaaggccggaaauacuuuaccugcgacgaagggcacggaaucuucguccgccagucccagauucagguguuugaggauggcgccgacacaaccucuccggaaacacccgauagcuccgcuagcaagguucuuaagagagaggggaccgacacgaccgccaaaacaucuaagcugccuacccggcccgcguccacaggaguggccggcgcuuccucuucccucgggccuagcggaucugccuccgcuggcgagcugagcuccucugaacccagcaccccugcccaaacgccgcuugcggcccccaucauuccuacacccguccugaccuccccuggcgcugugcccccgcucccuagccccucuaaagaggaagaggggcugcgcgcccaggugagagaucuggaggaaaagcucgagacacugcggcuuaaacgcgcugaagacaaggccaagcugaaagagcucgaaaagcauaaaauccagcuggagcagguccaagaguggaaguccaaaaugcaggaacagcaggccgaucuucaaagacggcugaaggaggcucgcaaagaagcgaaggaggcccucgaagcuaaggagagauauauggaggaaauggccgacaccgccgaugcuaucgagauggccacccuggacaaagaaauggcggaggaacgggcugagagccugcagcaggagguugaagcccucaaggagagaguggaugaacugacaacggaccuugagauucugaaagccgagaucgaagagaagggaucugacggcgcugccagcuccuaccaacucaaacagcuggaggagcagaaugcucgccuuaaggaugcccuggugcggaugagagaccucucuagcuccgaaaagcaggagcacgucaaacugcaaaagcugauggagaaaaagaaccaggaacucgaggugguucgccagcagcgggaaagacugcaagaggaacuuagccaggcggagucuaccauugaugagcugaaagaacagguggacgccgcucucggggccgaggaaauggucgagaugcugacagaucgcaaucuuaaccuggaagagaaggugcgggagcucagagaaaccguuggagaccuggaggcuaugaaugaaaugaacgaugagcugcaggagaaugcccgcgaaacagagcucgaacugcgggagcaacuugacauggcgggcgccagagugcgcgaagcucagaagcgggucgaggccgcucaggagaccguggccgauuaucagcaaacgaucaaaaaguacagacagcugacagcccaucuccaggacgucaaccgggaacugaccaaucaacaggaggcuuccguggaacgccagcagcaaccuccgcccgagaccuucgauuuuaaaauuaaguucgcggaaacaaaagcccacgcuaaggccaucgagauggagcugagacagauggaaguugcccaggcuaaccggcacaugagccuucucaccgccuuuaugccugacucuuuccugagacccgggggagaccaugauugugugcugguccuccugcuuaugccccgccugauuugcaaggcggagcucauccggaaacaggcucaagaaaaguuugagcuguccgaaaauuguagcgagagaccuggccugcgcggcgccgccggggagcagcuuuccuucgcugccggacucguguauucucugagccugcuccaggcgacacugcacagauacgaacaugcucuuucccagugcucuguugacguguacaaaaaggucggcagccuguaucccgagauguccgcccacgaacggagccucgauuuucugaucgagcugcuucacaaagaccaacucgaugagacggugaacguggaaccucugaccaaggccauuaaauacuaucagcaucuguacucuauccaccucgcugagcagcccgaagacuguacaaugcaacuggccgaucauauuaaguucacccaguccgcucuugacugcaugagcguugaggucgggcgccugagagccuuucuccagggaggccaggaagcgacagauaucgcccugcugcuucgggaccucgagaccucuuguuccgauauucgccaauucugcaagaaaaucagacggcgcaugccggggacggacgcuccuggcauccccgccgcucuggccuucggaccucaggugagcgauacccugcucgacuguagaaagcaccugacauggguggucgccgugcuucaggagguugcugcggccgcugcccagcugauugcuccccucgccgaaaaugagggccugcugguggccgcgcuugaggaacuggcuuuuaaagccucugaacaaaucuaugggaccccuagcuccagccccuacgagugccuccggcagucuuguaacauucugaucuccacaaugaauaagcucgccaccgcuaugcaggagggagaauaugacgccgagcgcccgccuagcaaacccccucccgucgaacugagagcggcugcccuucgggccgagauuacggaugcugaaggccuggggcucaagcuggaggacagagagacagugaucaaggaacugaaaaagucccuuaaaaucaagggagaggaacugucugaggccaacguucgccucagccugcucgagaaaaagcuggauuccgcugccaaggacgcggaugaacggauugagaaagugcagaccagacuugaagagacacaagcccugcuccgcaagaaagaaaaggaguucgaggaaaccauggacgcucugcaggccgauaucgaccagcuggaggcugaaaaagccgagcuuaagcagcggcugaacucucaaagcaagagaaccauugaaggccuccgcgggccgcccccuuccggcaucgccacacuggucucuggaauugcuggcggggcgauccccggacaggccccuggcagcgugcccgggccuggacucguuaaagauagcccccugcuucugcagcaaauuagcgcuaugcggcugcauaucucucagcuccagcacgaaaauuccauccugaagggcgcccagaugaaagccagccuugcuucucugccgccucuccacguggccaagcugucccaugaggggcccggcagcgaacucccugcgggagcucuguacagaaaaacgucucaacuucuggagacccugaaccagcucuccacacacacccaugucguggacauuacacgcaccagccccgccgccaaguccccgagcgcucagcugauggaacagguggcccaacuuaaaucucugagcgauacggucgagaagcucaaggacgaaguucugaaagagacagugucccagcggccuggcgcgaccgugcccaccgauuuugccacauucccuucuagcgcuuuucucagagccaaggaggaacagcaggacgacaccgucuacauggggaaagugacauucuccugcgcugccggauuuggccaacggcaccgccugguucuuacgcaggagcagcugcaccaacugcauucuagacucaucagcuga

SEQ ID NO: 68212 - RNA, 1212 nt, Artificial Sequence
  derived and/or modified sequence opt5 from DCTN2__Homo_sapiens__NP_001248341
auggccgaccccaaguacgcugaucugccuggcaucgccagaaacgagccggacguguaugaaaccagcgaucuccccgaggacgaucaggcggaguucgacgcugagcuggaagaacuuacauccacgucugucgagcacauuaucguuaauccuaacgccgccuacgauaaauuuaaggacaaacggguggggaccaagggacuggauuucagcgaccgcauuggcaaaacaaagagaaccggguaugaauccggagaguacgaaaugcucggcgaggggcugggagugaaggagacaccccaacagaaauaucagcggcuucugcaugaaguccaggagcucaccacagaaguggagaagaucaaaaccacgguuaaggaaucugcuaccgaggagaaacugacaccugugcugcucgccaagcaacuggcugcccuuaagcagcagcuggucgcgagccaccucgaaaaacugcuuggccccgaugccgcuauuaaucugaccgacccugauggcgcccucgcuaagcgccugcugcuccagcuggaggccacaaagaacuccaaagggggaucuggcgggaaaaccacgggaacaccgcccgacagcucccuugugaccuacgaacugcauagcagaccugagcaagacaaguuuucucaggcggccaaaguugcugaacucgagaagcggcugacagagcuugaaaccgccgugcgcugcgaucaggacgcucagaauccccuguccgccggccuccaaggggccugucugauggagaccgucgaacugcuccaggcuaaggugagcgcgcuggaucuugccgugcuggaccaggucgaggcuagacuccaaucuguucugggaaaagugaacgaaaucgccaagcacaaagccuccguggaggaugcugacacacagagcaagguccaucagcuuuaugagacgauccagcgguggucuccuauugccuccacccugcccgaacucgugcaacgccugguuacaaucaaacagcugcacgagcaggcgaugcaguucggccaacuccugacccaccuugauacaacccagcagaugauugcuaauagccugaaggacaacacgacacuccugacccaggugcaaaccacaaugagagaaaaucuggccaccgucgagggcaacuuugccuccaucgaugagcggaugaagaaacuugggaaguga

SEQ ID NO: 68213 - RNA, 477 nt, Artificial Sequence
  derived and/or modified sequence opt5 from DCTN3__Homo_sapiens__NP_001268354
auggccggccugaccgaccuccagagacugcaagcucggguggaggaacuugagcgcugggucuacgggcccggaggcgccagagggagccggaagguugcggauggacuggugaaagugcaggucgcucucggcaacaucuccucuaagcgcgaaagagugaaaauucuguauaagaaaaucgaggaccuuauuaaguaccuggauccugaauauaucgaccggauugccaucccggaugccagcaagcuccaguucauccuggcugccguucccgagcacgcugcccgccugcagagacucgcgcaaauucauauccagcagcaggaccaaugcguggagauuacagaagaguccaaagcccugcuugaagaguacaauaagacgaccaugcugcucucuaaacaguuuguccagugggaugagcugcuuugucagcuggaagcugccacacaagugaagccugcugaggaauga

SEQ ID NO: 68214 - RNA, 1404 nt, Artificial Sequence
  derived and/or modified sequence opt5 from DCTN4__Homo_sapiens__NP_001129115
auggccagccugcuccaguccgacagagugcuguaccuuguccaaggcgagaagaaaguucgggcuccccugucucagcucuauuucugccgcuacuguagcgaacugagaucccuugagugcgugucucacgaaguggauagccauuauuguccuuccugccuggagaacaugccgucugccgaagcgaagcucaaaaagaaucggugugcuaacugcuuugacugucccgggugcaugcacacccugagcacacgcgccacguccaucagcacccagcugccugaugaccccgccaaaacaaccaugaagaaggcuuacuaucucgccuguggauucugcagauggacaucucgggaugucggcauggcugacaaauccguggccagcgggggauggcaggagccugagaauccccauacccaacgcaugaacaagcugauugaauacuaucagcagcuugcgcagaaagagaagguugaaagagaucggaaaaagcuggcccgcagacggaauuacaugccucucgcuuuuucucaacacacaauccauguggucgacaaguacggccuggggacccgccuucagagaccgcgggccggagcuuccauuagcacgcuggccggccucucucugaaagagggcgaggaucagaaggaaaucaaaauugagcccgcgcaggccguggacgaaguugagccucugcccgaagauuauuacacccgcccugugaaccucacagaggucaccacacugcaacagagacuucugcagcccgacuuccaaccggugugugcuucccagcucuauccucggcacaagcaucugcuuaucaaaagaagccugcgcugccggaagugcgagcacaaucucuccaaacccgaauuuaacccuaccucuaucaaguucaagauucagcugguggccgucaauuacauccccgagguuagaauuaugagcauccccaaccugcgcuauaugaaagaaucccaggugcuccugacgcuuacaaauccuguggagaaccugacccacgucacacucuuugaaugugaggagggggauccggacgacauuaauagcaccgcuaaggugguugugcccccuaaagaacugguccuugccggaaaggaugccgcugcggaguacgacgaacuggccgagccccaagauuuccaggacgauccugacaucauugcuuuucggaaagccaacaaggugggcaucuucaucaagguuacaccccagagagaagagggggaggugaccgucugcuuuaaaaugaagcaugauuucaaaaaucucgccgcuccgauucgcccuaucgaagagucugaccagggaacggaagugauuuggcugacccaacacgucgagcugucccucggcccccugcuuccuuga

SEQ ID NO: 68215 - RNA, 255 nt, Artificial Sequence
  derived and/or modified sequence opt5 from DCTN5__Homo_sapiens__NP_001185940
auggagcugggcgaacuccuguacaacaagagcgaguauaucgaaaccgccuccgggaauaaagugucuagacagagcguccuuugcggaucccaaaacauuguucugaauggcaagaacuucgugaucucuguguuucucagccccuacauucggugucacuccgcuugccgcgacagaaaacggucugaugagagcguccgccuguccgugaauaacagagaauggugggggcuuguuaauuggcggauguga

SEQ ID NO: 68216 - RNA, 573 nt, Artificial Sequence
  derived and/or modified sequence opt5 from DCTN6__Homo_sapiens__NP_006562
auggccgagaagacccagaaaagcgugaagaucgcucccggcgccgucguuugcguggaauccgagauuagaggggacgugacaaucggaccucggacggucauucacccgaaagcgcgcaucauugcugaagccggccccaucgugaucggggagggaaaccugauugaggaacaagcccucaucauuaaugcuuacccugauaacaucacccccgacacagaggauccugaacccaagccuaugauuaucggcaccaauaacguuuucgaggugggguguuauucucaggccaugaaaaugggagacaauaacgucauugaaagcaaggcuuacgugggcagaaauguuauccugacauccggcugcaucauuggggccuguugcaaccuuaauaccuuugaggugaucccggagaacacagucauuuauggagcggauugucugcggcgcgugcagaccgaaagaccccagccucaaacgcuccagcuggacuuccuuaugaagauccugcccaauuaccaucaccucaaaaagaccaugaaaggcucuagcacaccugugaagaacuga

SEQ ID NO: 68217 - RNA, 780 nt, Artificial Sequence
  derived and/or modified sequence opt5 from DCUN1D1__Homo_sapiens__NP_065691
augaacaagcugaaaagcucccagaaggacaaagugagacaauucaugaucuuuacccagucuagcgagaagacagccgucuccugccucucucagaaugauuggaaacuggacguugcuacggauaacuucuuucagaaucccgaacuuuacauucgggagagcgugaagggcucccuggaccgcaagaaacucgaacaacuguauaacagauacaaggauccucaggacgagaauaaaaucgggauugauggaauccagcaguucugugacgaucuugcccuggacccggcgucuauuagcgugcucaucaucgcuuggaaguuucgggccgccacccaaugcgaguucuccaaacaggaauuuauggauggcaugacagagcuggggugugacagcauugaaaagcugaaggcucagauccccaaaauggagcaggaacucaaggagccuggacgcuucaaagauuuuuaucaauucaccuuuaacuucgccaagaaucccggccagaaagggcuggaccuugagauggcuauugccuacuggaaccugguccucaauggaagauuuaaguuccuggaccuuuggaacaaauuccugcucgaacaccauaagcggucuaucccuaaggauacauggaaucugcugcucgacuuuuccaccaugauugcggaugacaugagcaacuaugaugaggaaggcgccuggcccgugcugaucgacgauuucguugaguuugcucgcccucagauugccggcacaaaaucuaccacgguguga

SEQ ID NO: 68218 - RNA, 1326 nt, Artificial Sequence
  derived and/or modified sequence opt5 from DCX__Homo_sapiens__NP_000546
augaagacccugccccuccacagccauugcacagagaugcagagacugcuuccuaaacuggaaaugcucacgcugggcuccucuuucuguagccuucaaggggaguuuugccaggccauggacuccuucaccacagugucucacgucggaaugugugaagagaccgaugcuagcuuuaacguuuucuccccgaaguuucaguucgaccggucucauugccagagccugcgcuuucaccaaaauauggaacucgauuucggccauuuugacgagagagauaaaacaucccggaacaugcgcgggagcagaaugaauggacugcccucuccuacccacuccgcccacuguagcuucuaccggacacgcacccugcaggcgcucucuaacgagaagaaagcuaagaaggugagauuuuaucggaauggcgaccgcuacuucaaagggaucguguaugccgucuccagcgauagauuucggucuuucgacgcccugcuugcugaucugacgcgcucccucagcgacaacauuaaucugccccagggagugagauacaucuauaccauugauggcucccggaagaucggcucuauggacgaacuugaggaaggggagagcuacguuugcuccagcgauaacuucuuuaaaaagguggaguauacaaagaaugucaacccuaauuggucugugaacguuaagaccuccgccaauaugaaggcuccccagagccuggccucuagcaacuccgcgcaagcccgcgaaaauaaagacuucgugagaccuaagcucgucacaauuauccggucuggagugaaaccgagaaaggcugugcgcguccugcugaacaaaaagaccgcccauagcuuugagcagguucucacggacaucacagaagcuauuaaacuggagaccggcguggugaagaaacuuuacacacuggaugggaaacaggucaccugucuccacgacuucuuuggagaugacgauguguucaucgccugcggccccgaaaaguuucgguacgcgcaggacgauuucucccuggacgagaacgaguguagaguuaugaaagggaauccuagcgccaccgcuggacccaaggccucuccuacaccccagaaaacguccgcuaagagcccgggcccuaugcgccggucuaagucccccgccgauagcgccaacggcaccuccucuagccaacuuuccacaccuaaaucuaagcagagccccauuuccacccccacaagcccugggucucugagaaaacauaaggaccucuaucugccgcugucccucgaugacagcgacucucugggagauuccauguga

SEQ ID NO: 68219 - RNA, 735 nt, Artificial Sequence
  derived and/or modified sequence opt5 from DCXR__Homo_sapiens__NP_057370
auggagcuguuccucgccggcagacgggugcuggucaccggggcuggaaagggcaucgggcgcggaacaguucaggcccuucacgcgacgggcgcuagagugguggccgucagccggacccaagccgaccuggauucccucgugcgcgaaugccccgggauugagccuguuuguguggaccugggagauugggaagcuacagagagagcccuuggcucugucggcccgguggaccugcucguuaacaaugcugccguggcgcugcugcagcccuuucucgaagucaccaaagaggccuucgaucggagcuuugaggugaaccugcgcgcugugauccaggucucccagauuguugccagagggcuuaucgcucggggagugccuggcgccauugugaaugucucuagccaaugcucccagcgcgcggugacaaaccauucuguuuacuguagcaccaagggggcccuggacaugcucacaaaagugauggcucuggaacuuggaccccacaagaucagagucaaugccgugaacccuaccguugugaugacguccaugggccaggcuaccuggagcgauccccauaaagccaagacaaugcugaaucggaucccucucgggaaguucgccgaggucgaacacguggucaacgcuauucuguuucugcucucugaccgcuccggaaugaccacaggcagcacccugccgguggagggcggguucugggcgugcuga

SEQ ID NO: 68220 - RNA, 558 nt, Artificial Sequence
  derived and/or modified sequence opt5 from DDAH1__Homo_sapiens__XP_011539460
augguggacaugaugaaggaggcccuggaaaaacuccagcugaacaucgucgagaugaaggaugaaaaugcuacccuugacggcggggauguucuguucacaggaagagaguuuuucgugggccucagcaaacggacgaaccaacgcggggccgaaauucuggcggacaccuuuaaggauuacgcuguguccacaguccccguggccgacggacuucaccugaaaucuuucugcagcauggccggcccuaaucucaucgcuauuggguccucugagagcgcccagaaggcucugaagaucaugcagcagauguccgaucauagauaugacaaacugaccguuccggaugacauugccgcgaacuguaucuaccucaauauccccaacaagggacacgugcugcuucaucggacaccugaggaauaucccgagucugccaaagucuacgaaaagcugaaagaucacaugcucauuccugugagcauguccgagcuggagaagguugacggccuucugaccugcuguagcgugcucaucaauaagaaagucgauucuuga

SEQ ID NO: 68221 - RNA, 858 nt, Artificial Sequence
  derived and/or modified sequence opt5 from DDAH2__Homo_sapiens__NP_001289937
augggcacccccggggagggacugggcagaugcagccacgcccucauccgcggggugccugaaucccuggcuucuggagagggcgccggggcgggacuuccggcucuggaccucgccaaggcccagcgggaacauggcguccugggcgggaaacuuagacaacggcugggacuccagcugcuggagcugcccccugaagagagccucccccuuggcccucugcucggggauacagcuguuauucagggagacacggcccugaucacccgccccugguccccugcuagacggccggagguggauggcgugcgcaaggcccuucaggaccuggggcucagaauugucgaaaucggagaugagaacgcgacacuggacggcaccgaugugcuguucacaggccgggaauuuuucguugggcucucuaaauggaccaaucaccgcggagccgagauuguggcugacacauuuagagauuucgccgucagcaccgugcccguuuccggcccuucucaucugcgggggcuuuguggaaugggcgggccccgcacgguggucgcuggaagcuccgacgccgcgcaaaaggccgugagagcuauggccgugcugaccgaucacccuuacgcuagccucacacugcccgacgaugccgccgcugacugccuuuuucugcggccgggccucccuggcguucccccuuuccugcugcaucgcgggggaggcgaccuccccaacucucaggaggcgcugcagaaacuuuccgaugucacccuggugcccgugagcuguucugaacucgagaaggccggggcuggacuguccagccuuugccugguccucucuacaagaccucacuccuga

SEQ ID NO: 68222 - RNA, 3423 nt, Artificial Sequence
  derived and/or modified sequence opt5 from DDB1__Homo_sapiens__NP_001914
augagcuacaacuauguggucaccgcccagaagcccacagcuguuaauggcugcgugacggggcacuucaccuccgccgaggaccugaaccuccugaucgcgaaaaauacaagacuugaaauuuacguggucaccgcugagggacugcggccugugaaggaaguuggcauguaugggaaaaucgccgugauggagcucuuucgcccgaagggagaaucuaaagaucugcuuuucauucugacagccaaguacaacgcuuguauccucgaguauaagcaaagcggcgaguccauugacaucaucaccagagcccaugggaauguccaggaucggauuggacgccccucugaaacaggcaucauuggcaucauugacccugagugcagaaugaucgggcugcggcuguacgauggacucuuuaaagugauuccccuggaccgcgauaacaaggaacuuaaggcuuucaauaucagacuggaggagcuccacguuaucgacgugaaguuucuguauggcugucaggccccuaccauuugcuucgucuaccaggauccccaagggcggcaugugaaaacguacgaagugagccuucgcgagaaggaauuuaacaagggaccuuggaaacaggagaaugucgaagcggaggccuccaugguuaucgcugugccggagcccuucggcggggccauuaucauuggacaggaaucuaucaccuaucacaacggcgacaaguaccuggcuaucgccccucccauuaucaaacagagcacaauugugugucauaauagagucgauccuaacggcucccgguaucuccugggggacauggagggacgccuguuuaugcuccugcuugaaaaggaggaacaaauggauggcaccgugacacugaaagaccucagaguugagcugcuuggggagaccagcaucgcggaaugccugacguaccucgacaauggaguggucuucgugggcucucggcugggggauucccagcugguuaagcucaacguggacagcaaugagcagggaucuuaugucguggccauggaaacauuuaccaaccugggccccauugucgauaugugugugguugaccuugagcgccagggccaagggcagcuggugacaugcuccggagcuuucaaagaaggcagccucagaaucauccggaacgggauuggaauccacgagcacgccucuauugaucugccgggcaucaaggggcuuuggccucugagauccgaccccaaucgcgagaccgaugacacccucguccugagcuuugugggccagacacggguucugaugcucaacggagaagagguggaagagacggagcugaugggcuucgucgaugaccaacagaccuucuuuugugggaauguggcucaucagcagcuuauucaaaucacauccgccucugugagacugguuagccaggaaccuaaggcccucgucuccgaguggaaagaaccccaggcuaagaacauuagcguggcgucuugcaauuccagccagguggucguggccguuggacgcgcucuguacuaucugcaaauccacccccaggagcuucggcagaucucucauaccgaaauggagcacgagguggccugucucgauauuacaccucugggcgacagcaacgggcuguccccgcucugcgccaucggacuguggaccgacauuucugcuagaauccuuaaacugcccagcuucgaacuccugcacaaggagaugcugggcggggaaauuaucccucgcuccauccuuaugacgacauuugagagcucucauuaccuccugugcgcccugggcgauggagcccucuucuacuuuggccugaauauugaaaccgggcuucuguccgaccggaaaaaggucacccucggaacacagcccaccgugcugagaacauuccgcagccugucuacgaccaacguuuuugcuuguuccgaucggccuacagugaucuauagcuccaaucacaaacuugucuucucuaacgugaaucucaaagagguuaacuacaugugcccccugaauagcgacggcuauccggauucccuggcccucgccaacaauucuacccugacaauugggaccaucgacgagauucaaaaacuucauaucagaacggugccucuguacgaaagcccccgcaagaucuguuaucaggaggucucccagugcuuuggagugcucagcucucggauugaagugcaggauaccuccggcgggacaaccgcucugagaccuagcgccucuacacaagcucuguccagcucugucagcuccagcaaacuuuucucuuccagcaccgcgccccacgagacguccuuuggcgaagagguugaggugcauaaccuccugaucauugaccagcacacauucgaagugcugcacgcgcaucaguuucuccaaaacgaguacgcccugucucuugucagcuguaagcugggaaaggauccuaauaccuauuucaucgugggcacagcuaugguuuaccccgaagaggccgagccgaagcaggggcggauuguggucuuccaguacuccgacggaaaacuccagaccguggcugaaaaggagguuaaaggcgccguguauucuauggucgaauuuaacgggaagcugcuggcgagcaucaauuccaccgugcgccuuuacgaguggacaacggaaaaagagcugagaaccgagugcaaccacuauaauaacaucauggcccucuaccugaagacaaagggagauuucauucucguuggcgaccugaugcggucugugcuucugcucgcuuauaaaccuauggaagggaauuuugaggaaaucgccagagauuucaaccccaauuggaugagcgcugucgagauucuggacgacgauaacuuucugggcgccgaaaaugccuucaaccuuuuugugugucaaaaggacuccgcugcgaccacagaugaggagcgccagcaucugcaggaagugggacucuuccaccugggcgaguuugucaauguuuucugccacgggagccucgugaugcagaaccugggagaaaccucuacgcccacacaaggcuccgugcuuuuugggaccgucaauggaaugaucggccuggugaccagccucucugaguccugguacaaccugcugcuugacaugcagaaccggcugaauaaaguuauuaagagcgugggcaaaaucgaacauucuuucuggagauccuuucacacagagcgcaagaccgagccugccacaggguucauugauggagaccucaucgagagcuuccuggauaucuccagaccgaaaaugcaggaagucguggcuaaccuccaguaugacgauggcagcgggaugaagcgggaagccacggccgacgaucugauuaagguuguggaggagcuuacccgcauccauuga

SEQ ID NO: 68223 - RNA, 1284 nt, Artificial Sequence
  derived and/or modified sequence opt5 from DDB2__Homo_sapiens__NP_000098
auggcccccaagaaaagaccugagacccagaagacaagcgaaaucgugcugcggccgcgcaacaaaagaucccggucuccccucgagcuggaaccugaggcuaagaaacuuugcgccaagggcagcgggcccucccgcagaugugacucugauugccugugggucggacucgcgggcccucaaauucugcccccuugucggagcaucguucgcacgcuucaccagcauaagcuggggagagcuuccuggccgucugugcagcagggacuccaacagagcuuccugcacacccuggacuccuaccggauucuccagaaagccgcccccuuugaucgcagagcuacaagccuggccuggcauccuacccaccccucuacaguggcugucggcuccaaagggggagacaucaugcuuuggaauuucggcauuaaggauaagccuaccuuuaucaaaggcaucggggccggaggcagcauuacagggcugaaguucaacccccucaauaccaaccaguuuuaugcgucuuccauggaaggaacgacccggcugcaagacuucaagggcaauauccuucgcguguuugccagcucugauacaauuaacaucugguucugcucccuggacguuagcgcuuccucuagaaugguggucaccggggauaaugugggaaacguuauucuccugaauauggacggcaaagagcuguggaaccuccggaugcauaagaaaaaggugacacacgucgcccugaauccguguugcgauugguuucuugcuaccgccagcguggaccagacggugaaaaucugggaucugcgccaggucagaggcaaggcguccuuccucuacagccugccucaccggcaucccguuaacgccgcuuguuuuucuccugacggggccagacuucugacaaccgaccagaaauccgagauucgcguguauagcgcuucucaaugggauugcccccucggacugaucccccacccucaucggcacuuccagcaccugacaccgaucaaggccgccuggcaucccagauacaaucucauuguggucggccgcuauccugaccccaacuuuaagagcuguaccccuuacgaacugcggaccaucgauguguucgacggaaauuccgggaaaaugaugugccagcuuuaugaucccgagucuagcggcauuuccagccugaacgaguucaacccgaugggggacacacucgcuucugcgaugggauaccacauccugauuuggucccaagaagaggccagaacgcgcaaguga

SEQ ID NO: 68224 - RNA, 1443 nt, Artificial Sequence
  derived and/or modified sequence opt5 from DDC__Homo_sapiens__NP_000781
augaacgccagcgaguucagacggcgcggcaaggaaaugguggacuacgucgcuaauuauauggaggggaucgaaggaagacagguuuaccccgauguggagccuggcuaucugcggccgcucauucccgccgcggcuccucaagaacccgacaccuuugaggauaucauuaacgacguggagaaaaucauuaugccuggggucacacacuggcauucccccuacuucuuugccuauuucccuacggccucuagcuacccggcuaugcuggccgauaugcuuugcggagcuaucggcuguaucggguuuuccugggccgcgucucccgccugcaccgaacuggagacagugaugauggacuggcucggaaagaugcuggaacuuccuaaggcuuuccugaaugagaaggccggcgagggcgggggaguuauucagggcagcgcuuccgaagccacccucguggcgcugcuggccgcucgcacaaaagucauccacagacuccaggccgcuucucccgagcugacccaggccgccauuauggaaaaacuuguggcuuauagcuccgaucaagcgcauagcucuguugagcgggccgggcugaucggaggcgugaagcucaaagcuauuccuuccgacgggaacuuugccaugcgcgccagcgcucugcaggaagcccuugagagagauaaggcggcuggacugauccccuucuuuauggucgccacacucggcaccacgaccuguugcucuuucgacaaucugcuggaggugggcccgauuuguaacaaagaagauaucuggcuccacguggacgccgcuuacgccggguccgcuuuuaucugcccugaguuccggcaucugcuuaauggagucgaauuugccgauagcuucaacuucaauccccacaaguggcugcucguuaacuuugacuguucugcgaugugggugaaaaagcgcacagaccugaccggcgccuucagacuugauccuacauaccugaagcacucccaucaggacagcgggcucauuaccgauuaucggcacuggcagaucccccugggacgcagauuucggucccugaaaaugugguucguguuucgcauguacggcgucaaggggcuccaggcuuauauuagaaaacaugugcaacugucucacgaguucgaaagccuuguucggcaggaccccagauuugagaucugcguggaggucauucugggacucguguguuuccgccugaagggcuccaauaaaguuaacgaagcccuucugcagcggaucaauagcgcuaagaaaauccaccucgugccuugccaucugagagauaaguuuguccugcgcuucgccauuuguucucggacgguggaguccgcgcacguccaaagagccugggaacauaucaaggagcucgcugccgacgugcugcgcgcugaacgggaguga

SEQ ID NO: 68225 - RNA, 2640 nt, Artificial Sequence
  derived and/or modified sequence opt5 from DDHD1__Homo_sapiens__NP_001153619
augaacuaccccggcagagggagcccucgguccccggagcacaauggacgcggcgggggaggcggggccugggaacugggaucugacgcuagacccgccuucggcggcggggugugcuguuuugagcaucucccuggaggcgaucccgacgauggggacgucccucuggcgcuucugcggggagaacccggccuccaccuggcuccugggaccgaugaccauaaccaccaucuugcccuggauccgugccucagcgacgagaauuaugauuucuccucugccgaaagcggauccucucugcgcuacuauagcgagggcgaguccggcgggggaggcagcucucugucccuccaucccccucagcaacccccucugguucccacaaacagcgggggaggcggggcuacgggaggcucuccgggcgaaagaaagcggacccgccuugggggaccugccgcuagacaccgguacgagguggugacagaacugggccccgaggagguccgcugguuuuauaaagaagacaagaaaaccuggaagccuuucaucggguacgauucccucagaauugagcuggccuuucggacacuucugcagaccacaggagcgcgcccccagggcggggacagagauggcgaccacguguguagccccaccggaccugccucuuccagcggcgaagacgaugacgaggaucgggcuugcggguucugucaguccacgaccggacacgaaccggagaugguugagcucgugaauaucgaacccgucugcgugcgcggcgggcuguaugagguugacgugacacaaggagaauguuacccugucuacuggaaccaggccgauaaaauucccgugaugagaggccagugguuuaucgacgggaccuggcagccucuggaggaagaggagucuaaucucauugaacaagagcaucugaacugcuuccggggccagcagaugcaggaaaauuuugauaucgaggugagcaaguccaucgacggaaaggauggcagcgggauuaacuauucugcuguccacuccuucaaacuuagcagaaaucacguugacuggcauucuguggaugaaguguaccuguauagcgacgccacaaccuccaagaucgcgcgcacggucacacaaaaacucggauuuucuaaggccagcuccagcggcacccggcugcacagaggguacguggaggaggcuacacuugaagacaaacccucucagaccacccauauuguuuucgugguccacggaaucggccagaagauggaucaagggcgcauuaucaagaacacagccaugaugcgggaggcugccagaaaaauugaagaacgccauuuuuccaaucacgccacgcacguggaguuccugccgguugaauggcggagcaagcucacccuggacggcgauacaguggacucuaucaccccugauaaagucagaggacugcgcgacaugcucaacuccagcgcuauggauaucauguauuacacaucuccccuguaucgggacgagcuugugaagggccugcagcaggaacucaauagacuguacucccuuuucuguagccgcaacccugauuuugaggaaaaagggggaaaggucuccauugugucucauagccugggcugcguuaucaccuacgacauuaugacgggguggaaccccgugcggcucuaugagcagcugcugcaaaaagaggaggagcucccugaugaaagauggauguccuacgaggaacggcaucugcuugacgagcuguauaucacaaagcgcagacucaaggagauugaggaacggcugcacggacugaaagcgagcucuaugacccagacccccgcccuuaaguucaaagucgaaaauuucuucuguaugggcuccccgcucgcuguguuucuggcccugagagggauccgcccuggcaacacaggaagccaggaucacauccucccccgggagauuugcaauagacugcuuaacaucuuccaccccaccgacccuguugccuaccgccuggaaccgcucauucugaagcauuauucuaauaucucccccgugcagauucacugguacaacacaagcaauccucugcccuaugagcauaugaaaccuucuuuucuuaaccccgcuaaggagccuacgagcgucuccgaaaaugagggcaucagcaccauccccucuccggugacauccccugugcucagcagacggcacuacggggaauccauuaccaacaucggaaaggccucuauucugggcgcggcuagcaucgggaaaggacugggcggcaugcucuuuucccgcuuugggagaucuagcacaacccaauccucugagacgagcaaggacuccauggaggaugagaaaaagcccguugccagcccuucugccaccacagucggaacccagacacugccccauuccagcucuggcuuccuugacuccgcucuggaacucgaucaccggauugacuuugaacugcgcgaggggcugguggaaagcagauacuggucugccgugaccucccacacggcuuauuggagcucccuugaugucgcccucuuccugcugacauuuauguacaaacaugagcacgacgaugacgcgaagccgaaucucgauccuaucuga

SEQ ID NO: 68226 - RNA, 684 nt, Artificial Sequence
  derived and/or modified sequence opt5 from DDHD2__Homo_sapiens__NP_001157706
augagcuccgugcagucucaacaggagcagcugagccaguccgaccccucuccuagcccgaacuccugcucuagcuucgaacucaucgauauggacgccggcucccuguacgagcccgucagcccucacugguuuuauuguaagauuaucgauucuaaagaaaccuggauucccuucaauuccgaggacagccaacagcuugaagaggcuuacucuuccgggaagggaugcaacggcagaguugugccuacagaugggggacgguaugacgugcaucugggcgagcgcaugagauacgccgucuauugggaugaacucgcgagcgaggugcggcgcuguacgugguuuuacaaaggggacaaggauaauaaauauguucccuacucugaauccuucagccaggugcuggaggagaccuacaugcuugcugucacacuggacgaauggaagaagaaacucgaguccccuaacagagaaaucauuauccugcacaauccgaagcugauggugcauuaucagcccguugccggaucugaugacuggggcagcaccccuacagagcaaggccggccccgcaccgugaaaagaggggucgaaaacaucuccguggauauucacugcggaaaugugaaccggcucuuuuuccugacauuuggcuguaucugccuucugcucaagcuguga

SEQ ID NO: 68227 - RNA, 1191 nt, Artificial Sequence
  derived and/or modified sequence opt5 from DDI1__Homo_sapiens__NP_001001711
augcugaucaccguguacugcgucagacgggaccucagcgagguuacauucucccuucaggugucucccgauuuugaacugcgcaacuucaaggugcugugugaggccgaaagcagagucccuguggaggaaauucaaaucauucacauggagcggcuccugaucgaggaccauugcucccuuggcucuuaugggcugaaagauggagacauuguugugcuccugcagaaggauaaugucggcccgcgcgcucccgggagagccccuaaccagccccggguggacuuuagcggaaucgcgguuccuggcacguccucuagccgcccccagcacccugggcaacagcagcagagaaccccggcugcccaacggucccagggacuggccagcggcgaaaaaguggcuggccuccaggggcugggaucucccgcccuuauccgcuccaugcugcucagcaauccucaugaucugucucuucugaaggagagaaaucccccucucgcugaagcccugcuguccggcagccucgagacauucucucagguccugauggagcaacagcgggaaaaagcgcuucgcgagcaggaaagacugcggcucuacaccgccgacccccuggaucgcgaggcucaagccaagauugaagaggagaucagacagcagaacauugaagagaacaugaauaucgcuauugaagaggccccggaauccuuuggacaggugacaaugcuuuauaucaacuguaaggugaaugggcacccucugaaagcguucgucgacagcggcgcccaaaugaccauuaugucccaggcuugcgccgagcgguguaacaucaugagacucguugaucgccggugggcugggguggccaagggagugggcacacagagaaucauuggccgcguccaucuggcccagauccaaauugagggggacuuucugcagugcucuuucagcauccucgaagaucagcccauggacaugcugcuuggacuggacaugcuccggagacaccaguguuccauugaucugaaaaagaaugugcuuguuaucggcaccacggggacccaaacauacuuucugccugagggagaacucccccugugcagccgcauggugucuggccaggacgaguccagcgauaaagaaaucacccacucugucauggacagcgggcggaaggagcauuga

SEQ ID NO: 68228 - RNA, 2997 nt, Artificial Sequence
  derived and/or modified sequence opt5 from DDIAS__Homo_sapiens__NP_659455
augaacagacggcgcaaguuccugcucgccagcgugcuggcccuucagaauagcucuuuuaucuaccccagcugccaaaaauguuucuccagaauuauccuggucucuaagcggagcaacugcccuaaauguggcuccaccggcgagucuggaaaugcuaacuaucgcuacaagcucagccugaaaguugcggaguccaauaaacuuuuugugauuacaguguucggcagcugccuggacacguuuuucgggcucaccgcuacaggacugcacagauauauccaggauccgaacaagauucccgagacccuggacaaugauacaacccagaaccuccugacaaaagccgucgaaaccuguuuugugggccagucuuucaucuuugggguuacgaauuucgagaaccaaccuggacagggcuccgacgccagcaauuuucuucagcagugcucugaucauaagcggaaagcuaaggcccugguggcuugucaaaucguccuccccgacccuggcauugccggguucaccgugaucgauuacuuucaccagcugcuucagacauucaacuuccgcaaacugcagugcgacucccaagcgcccaauaaccaucuccuggcccuggaucacagcaauucugaccucuccagcauuuauaccuccgauucuacaagcgacuuuuucaaguccuguagcaaggauaccuuuucuaaauucuggcagccuucccuggaauuuacgugcaucguuagccagcuuacagacaacgacgauuucucugcuagcgagcaauccaaggccuuuggaacccugcagcagaacagaaaaucuauuagcaucgcugaggccacaggcuccagcucuugucaugacccgauucaggauuccuggagccucgugucuuacauggacaagaaauccaccgcggaaaagcuggggaaagagcuuggacugcaagccaaggaacucagcgcuguccacuccucucaccaugagaucggcgugaaugauagcaaccuguucucccuggagaugcgggaaccccucgagucuagcaauaccaaguccuuucacagcgccguggaaaucaaaaaccgcucucagcaugagcugccuugcuuccagcaccacgggauugacacacccacgucccuucagaagagaagcgcuugcuguccucccucucugcuccggcuggaagagaccgccuccagcucucaagauggagacccgcagaucugggaugaccuuccuuuuagcgagucccugaauaaauuccucgccguccuggaaagcgagauugcuguuacacaggcggaugugucuucccgcaagcaucacguggacaacgacaucgauaaauuucaugccgaccacagcagacuguccgucacaccccagcggaccaccggcgcucuccauacgccucccauugcccugcgcucuagccaagugaucguuaaggccaauugcuccaaggaugacuuccuuuucaacuguaaaggcaaucugucucccagcguggaaaaggagucccagccugauaacaaagucgaagcugugucuguuaaucacaacgggagagacaugagcgaguauuuucucccgaaucccuaccuguccgcccuguccucuuccagcaaggaucuugagacaaucgugacccucaaaaagaccauucggaucucuccucacagagaauccgaccauagcucucugaacaauaaguaccugaacggaugcggcgagauuuccgucagcgaaaugaacgagaaacucacaacccuguguuaucgcaaguacaaugauguguccgaccuuugcaaacuggaaaacaagcaguauugucgguggagcaaaaaucaggaugacucuuucacaaucugcagaaagcucacguacccccuggagacccuguguaacagcccuaaucgcuccacaaacacccuuaaggagaugcccugggggcacauuaauaacaaugucacacaaucuuauagcaucggauacgaaggcuccuaugaugcgucugcugaccucuuugacgauaucgccaaagagauggacauugccaccgaaaucacgaagaaaagccaggauauucugcugaagugggggaccucccucgcugagucucauccgagcgaguccgacuucagccugcggucucuuuccgaagauuuuauccagccuagccaaaaacugucucuccagucccugagcgacuccagacacucucgcacaugcagccccaccccucacuuccaguccgauagcgaguacaacuuugaaaauucucaggacuucgugcccuguucccaaagcacaccuauuucuggauuucaucagacccggauccacggcauuaacagagccuucaagaaacccguguuuuacagcgaucuggacggcaauuaugagaagauccgcaucuucccggaaaacgauaagcagcaggcuuccccuucuugccccaaaaauauuaagacgcccagccaaaagauccgguccccuauuguuucuggggucagccagccggacguguuuaaccauuaccccuucgccgagugccacgagacagauuccgacgaauggguuccucccaccacacagaagaucuucccuagcgacaugcuuggauuucagggcauugggcucggaaaaugucuggcggccuaucauuuccccgaucaacaggagcugccuagaaagaagcucaaacacauccgccagggcaccaacaaggggcugaucaaaaagaaacuuaagaauaugcuggcugccguggucaccaagaaaaagacacacaaauacaacugcaagucuuccggcuggauuagcaaaugucccgacauccaagugcucgcugccccgcagcugcauccuauucugggacccgauuccugcucugaagugaaguguugccuuccuuuuagcgagaaggggcccccguccguuugugaaacgcggucugcguggagcccugaacucuucuccuga

SEQ ID NO: 68229 - RNA, 579 nt, Artificial Sequence
  derived and/or modified sequence opt5 from DDIT3__Homo_sapiens__NP_001181983
auggagcuggugcccgccaccccucacuacccggcugacguccucuuccagacagaucccacggccgaaauggcggcugagagccugccuuuuuccuucggcacccuuucuagcugggaacuggaggccugguaugaagaccuccaagagguucuguccucugaugagaacgggggaacauacgugagcccucccggcaaugaagaggaagaguccaagaucuuuaccacacuugaccccgccucucuggcuuggcucaccgaggaggaaccugaaccggccgaggugacaagcaccucccagagcccccauucuccugauuccagccagucuucccuggcucaggaagaggaggaagaggaccaagggagaacgcggaaacgcaagcagagcggacacucucccgccagagcgggcaaacagcggaugaaggaaaaagagcaggaaaacgagcgcaaggucgcccaacuggcugaggaaaaugagagacucaagcaggaaauugagcggcugacccgcgaaguggaggccacaagacgggcucuuaucgaucgcaugguuaaccugcaucaggccuga

SEQ ID NO: 68230 - RNA, 699 nt, Artificial Sequence
  derived and/or modified sequence opt5 from DDIT4__Homo_sapiens__NP_061931
augcccagccugugggacagauucuccucuagcuccaccucuagcuccccuucuagccucccgcggacacccacgccugauagacccccucgcuccgccuggggcagcgcuacccgggaggaaggguuugaccgcucuacaucccuggagagcucugauugcgaaucccuugacagcucuaacuccggauucggccccgaggaagauaccgccuaccuggacggggugagccucccugauuuugagcugcuuuccgacccggaggaugaacaccugugugcgaaucucaugcagcugcugcaagagucucucgcucaggccagacugggaagccggcgccccgccagacuucugaugccuucccagcucgucagccagguuggcaaggaacugcuucggcuggcuuauucugagcccugcgggcuccgcggagcccugcuggacguguguguggagcaaggcaaauccugccauagcgucggccagcucgcucuggauccuucucuugugcccacauuccagcugacccucguucugagacuugacagccggcuguggccgaagauccaggggcucuuuuccucugccaacagcccuuuccugcccggauuuucccaaagccugacacucucuaccggcuuccgcgugauuaaaaagaaacuguacuccagcgaacagcuucugaucgaggaauguuga

SEQ ID NO: 68231 - RNA, 582 nt, Artificial Sequence
  derived and/or modified sequence opt5 from DDIT4L__Homo_sapiens__NP_660287
augguggccaccggcagccuguccucuaagaaccccgcuagcaucuccgagcuccuggauugcggguaccacccugaaucucuucugagcgauuucgacuauugggauuacgucguuccggagcccaaucucaacgaagugauuuuugaggaauccacaugucagaaucuggugaaaaugcuugagaacugccugucuaagagcaaacaaacgaagcucggauguuccaaaguccuggugccugagaagcugacccagagaaucgcccaggacguucuccggcugagcucuacagaacccugcggccuucgcgggugugugaugcaugucaaucuggagauugaaaacgugugcaagaaacucgauagaaucguuugugacuccagcguggucccuaccuucgagcugacacuuguguuuaagcaggagaauugcucuuggaccuccuuccgggacuuuuucuuuagccgcggaagauucucuuccggcuuucggcgcacacugauucucagcuccggguucagacuggugaaaaagaaacuguauucucucaucggaaccacggucaucgaaggcagcuga

SEQ ID NO: 68232 - RNA, 2136 nt, Artificial Sequence
  derived and/or modified sequence opt5 from DDN__Homo_sapiens__NP_055901
augcuggacggcccccucuucagcgaggggccugauuccccgagagaacugcaggacgaggaaucuggaagcugccuuugggugcaaaaguccaaacugcucgucaucgagguuaagaccauuucuugucacuacagccggcgcgcccccuccagacagccuauggauuuucaggcuucucauugggcccggggcuuccagaaccgcacaugcgggcccagaccuggaagcccccaaccuccgccccggcgcccuugggcguccagagugcugcaggaagcuacgaauuggcgggccggcccccuugccgaggugcgcgcuagagagcaggaaaaacggaaggccgcuagccaggagcgcgaagccaaagagaccgagagaaagcggcgcaaggccgggggagccagacggucuccucccggcagaccgcgcccugaaccccggaacgcuccuagagucgcccaacuggcuggccuccccgcgccccugcgcccugagcggcuggcgccgguggggagagcuccccgcccuuccgcccagccccagagcgacccuggaucugccugggcuggccccuggggagggcggagaccgggcccucccuccuaugaagcccaccuccugcuucgcgggagcgccggaacagcuccucggagacgcugggaucggcccccucccuacguugcgccgccuucuuaugagggcccccauagaacccugggcacaaaacgggggcccggaaauucccaggugccuaccagcuccgccccggcugccacacccgcccgcaccgacggcgggagaacgaagaaacggcucgauccuagaaucuaccgcgacguccugggagcuuggggccuucggcaagggcagggacugcucggcggcucucccggguguggagccgcgagagcucgcccugaacccggcaagggggugguugagaaaagccugggacuggccgccgcugaucucaacuccggcagcgacucucacccucaggccaaggcuaccggguccgccggcacagagauugcgcccgccggaagcgcuaccgccgcuccgugcgccccucaucccgcgccuagaucucggcaccaccugaagggcagccgcgaagggaaagagggagaacaaaucugguuucccaaguguuggauuccguccccuaaaaagcagcccccuagacauucucagacacuuccccggcccugggccccuggcgggaccggauggcgcgagagccugggccucggggaaggcgcuggaccggagacgcuggagggcuggaaagccacaagacgggcucacacccuuccccgcuccagccaggggcugucuagaggagaaggcguguucgucaucgaugccacaugcguggugauccggucccaauaugucccuacaccccgcacccagcagguucagcuccugccuagcggggugaccagaguggucggagacucucccucccaaagcaagccuggcaaagaggaaggggagggcgccacgguguuuccgucccccugucagaagcggcugucuagcuccagacuccugcaucagccuggaggcgggcgcggaggcgaagcugaagggggacggcccggcgauucuacccuugaggaaagaacauuccgcauucuggggcucccugcgcccgagguuaaucugcgggacgccccgacccagccuggcagccccgaacaccaagcucuuggacccgccgccuccggcgcucaggggagagccgagggaagcgagguggcggucgugcagcgccgggcuggcagagggugggcccgcacaccuggacccuacgccggcgcucugcgggaagccguuucuagaauccggcgccacaccgcgccugacuccgauacggacgaggcugaggagcucagcgugcauucuggcuccagcgaugggucugacacagaagccccgggagccagcuggagaaacgagcggacccugcccgaggucggcaauuccagcccugaagaggaugggaagaccgcugaacugucugacuccgugggagagauucucgaugucaucagccagacagaagaggugcuguuuggcguucgcgacauuagagggacccaacagggaaaccggaaaagacaguga

SEQ ID NO: 68233 - RNA, 1110 nt, Artificial Sequence
  derived and/or modified sequence opt5 from DDO__Homo_sapiens__NP_003640
augagacccgcccggcacugggagacccgcuucggcgcuagagacuuugggggauuccaggauugcuuuuuccgggaccgccugauggauacagccagaaucgcgguggucggcgcugggguugugggacucagcacggccguguguauuuccaagcuggucccucggugcucugugaccaucauuagcgacaaauuuacaccggauaccacauccgacguugccgcuggcaugcuuaucccccauaccuacccugauacacccauucacacccaaaagcagugguuccgcgaaacguuuaaccaucuguucgccaucgcuaauucugccgaggcgggggacgccggagugcaccucgucagcggcuggcagaucuuucaguccaccccuacagaagaggugcccuucugggcugauguugugcugggcuuuagaaaaaugaccgaagccgagcuuaagaaauucccucaauaugucuuugggcaggcuuucacaacccugaagugugagugcccggccuaccuccccuggcuggaaaagcggauuaaaggaucuggcggguggacgcugacacgcagaaucgaggaccucugggaacugcauccuagcuucgauauuguggugaacuguuccggacuuggcagccggcagcuggcgggggacucuaagaucuuucccguccgcggacagguucuccaagugcaggccccuuggguggagcacuucauuagagauggcuccggccugaccuauaucuaccccgggacaagccacgucacccuuggaggcacccggcagaaaggggacuggaaucugucuccggacgcugagaacucccgcgaaauucucagcagaugcugugcccuggagccuucucugcauggagcuugcaauauccgggaaaaggugggccucagacccuaucgcccugggguucggcugcagacagagcuucuggccagagauggacaacgccuccccgugguccaccauuacggccacggcuccgggggaaucagcgugcacuggggcacggcccuggaagcugcgcggcuuguuuccgagugugugcaugcccugagaacccccauuccuaaaucuaaccucuga

SEQ ID NO: 68234 - RNA, 1527 nt, Artificial Sequence
  derived and/or modified sequence opt5 from DDR1__Homo_sapiens__NP_001189450
augggccccgaggcccugagcucccuccugcuucugcuccugguggcuucuggggacgccgauaugaagggacacuucgacccugcgaaaugcagauacgcucuuggcaugcaggaucggaccaucccggacagcgauauuuccgccucuagcuccuggucugacagcacagccgcucgccauuccagacuggaaagcucugauggggacggagccuggugucccgcuggcuccgucuuuccuaaggaggaagaguaucuccaaguugaucugcagcggcugcaccucguggcccugguggggacgcagggacgccaugcgggcggccuugggaaagaguucagcagaucuuaccggcugcgcuauuccagagacggacggcgcuggaugggcuggaaggauagaugggggcaggaggucaucagcggaaacgaggaccccgaaggcgugguucucaaagaucuggggccucccaugguggcccggcuuguccgcuuuuacccuagagcugaccgggugaugucuguuugccugcgcguggagcucuauggaugucuguggagagacggccugcucuccuacaccgccccggucggccaaacaauguaucugagcgaagcuguguaccuuaaugauuccaccuacgacgggcacacagugggaggccugcaguaugggggacucggccagcuggccgauggggucguuggacuugacgauuuccggaagucucaggagcugagaguguggcccggcuacgacuaugugggcuggagcaaccauuccuuuagcucuggguacgucgagauggaguucgaauuugaucgccuccgggcguuccaagccaugcaagugcacugcaauaacaugcacacccugggagcuagacugccuggcgggguugaaugucgcuuucggagaggacccgccauggcuugggagggcgaaccuaugcgccauaaucucgggggcaaccugggagacccccgggccagagccguguccgucccgcuuggcgggcgcguggcucgguuccugcagugcagauuucucuucgcgggaccuuggcugcuuuuuagcgagauuucuuucaucagcgauguugugaauaacuccucucccgcccugggcgggacauucccucccgcucccugguggccuccgggacccccucccaccaauuuuagcucccucgagcuggaaccucgcggccagcagcccgucgccaaggccgaggggagcccgacggcuauucugaucggcugucucguggccaucauucugcuucugcuccugaucauugcgcugaugcuuuggcggcuccacuggagacggcugcugucuaaagcugaacgcagaguccucgaggaagaacugaccgugcaucuuuccguuccuggagacacaauccugauuaacaaucggcccggcccuagagagcccccucccuaucaggaaccgcgcccucgggggaacccuccccacagcgcccccugcgugccgaauggaucuggcgcccccgucuga

SEQ ID NO: 68235 - RNA, 2568 nt, Artificial Sequence
  derived and/or modified sequence opt5 from DDR2__Homo_sapiens__XP_011507889
augauccugauucccagaaugcuccuggugcuuuuccugcuccugccuauccuuagcuccgccaaggcucaggucaacccggccauuugccgguacccccugggcaugucugggggacaaaucccugacgaggauauuaccgcgagcucccaguggucugaaagcacagcugccaaauauggccgccucgacuccgaggaaggggauggagccuggugucccgagaucccuguugaacccgacgaucugaaggaguuucugcagaucgaccuccacacgcugcauuucauuacccuugugggcacacaggggagacacgcuggaggccauggcaucgaguuugccccuauguacaaaauuaauuauucucgggaugggacccgcuggaucagcuggagaaaccggcacggaaagcaagugcuggacggcaauuccaacccguacgauauuuuccucaaagaccuggaacccccuaucgucgcucgcuuugugagauucauucccguuacagaucauagcaugaaugugugcaugcgggucgagcuuuauggguguguguggcuggacggacucguuucuuacaacgccccugcgggccagcaguuugugcugcccgggggauccaucaucuaucugaaugauagcgucuacgacggcgccgugggcuacucuaugaccgaagggcucggacagcugacagacggcguguccgggcuugaugacuucacccaaacgcacgaguaucacgucuggccgggauacgauuauguuggcuggcgcaacgagagcgcuaccaauggguacauugaaaucauguuugaguucgaccggauuagaaacuuuacaaccaugaaggugcauugcaauaacauguucgccaagggagugaaaaucuuuaaggaaguccaguguuauuuccgcucugaggcuuccgaaugggagccuaaugccauuagcuucccccuggugcucgaugacguuaacccuuccgcgagauuugugacagucccccugcaccaucggauggccucugcuaucaaaugccaguaccacuucgccgauaccuggaugauguuuagcgagaucacguuccaguccgacgcugccauguauaauaacagcgaagcccuucccacaucuccuauggcuccgaccacauacgaucccaugcugaagguggacgauuccaacacccgcauucucaucggcugucugguugcgauuaucuuuauucugcucgccaucaucgugauuauccuguggagacaauucuggcagaaaaugcuugagaaggcuagccggagaaugcuggacgacgaaaugaccgucucucucagccugccuuccgauucuagcauguuuaauaacaaucgcuccagcucucccuccgagcagggcagcaacucuacauacgaccggauuuucccucuuagacccgauuaucaagaaccgucccgccugauccggaagcucccugaguuugcccccggggaggaagagagcggaugcuccggcguggucaaaccugugcagcccucugggccugaaggaguuccccacuacgccgaggcugacauugugaaucugcagggcgucaccgggggcaacacguauagcgugccggccguuacaauggaucugcucuccggaaaggacguggcggucgaagaguucccuagaaaacugcuuaccuuuaaggagaaacugggcgaagggcaguucggagaggugcaucucugugaaguggagggcauggagaaguuuaaagauaaggacuucgcucuggauguuucugccaaucaacccguccugguggccgugaagaugcuucgcgcugacgccaacaaaaaugcucggaacgauuuccucaaggaaaucaaaauuaugagcagacugaaggaccccaauaucauccaucugcucgccgucugcauuacagaugacccucuguguaugaucaccgaguacauggaaaacggggaccuuaaucaguuucugucccgccacgagccgcccaacucuagcuccagcgaugugcggacgguuucuuauacaaaucucaaauucauggcgacccagauugccuccggaaugaaguaccugagcucucugaacuuugugcacagagaccuugcuacccgcaacugccucgucggcaagaauuauacaaucaaaauugccgauuucgggaugagccggaaccuguacuccggcgacuacuauagaauccagggacgggcugugcugccuauccgcuggaugagcugggaaucuauucuccugggcaaguuuaccacagccuccgauguuugggcguucggggugacgcuuugggagaccuuuacauucugccaagagcagcccuacagccagcuguccgacgaacaggucaucgagaauaccggagaauuuuucagagaucaaggccggcagacauaucucccucagcccgccauuuguccugacucuguguacaaacugaugcugagcugcuggagacgcgauaccaagaaccggcccuccuuucaggagauccaucuucuccugcugcaacagggggacgaauga

SEQ ID NO: 68236 - RNA, 945 nt, Artificial Sequence
  derived and/or modified sequence opt5 from DDRGK1__Homo_sapiens__NP_076424
augguggcccccgucugguaccugguugcugccgcgcuccuggugggcuucauccuuuuucugaccagaagccgggggcgcgcugccuccgccggacaggagccucuccacaacgaagaacuggcuggcgccgggagaguggcucaaccgggaccccuugaaccugaggaaccccgggccggcgggcgcccuagacggcgcagagaccugggaucucggcuccaggcgcagcgcagagcccagcgggucgcuugggccgaggcugaugagaaugaagaggaagccgugauucuggcgcaagaggaggaaggcguugagaagcccgccgaaacacaucugagcggcaaaaucggggcuaagaaacuccgcaagcuggaggaaaaacaggccagaaaggcucagcgggaggccgaggaagccgagcgcgaagagagaaagcggcuugaaucccagagagaggcugaguggaaaaaggaagaggaacgccugcggcucgaggaggagcaaaaagaggaagaggaaagaaaggcgcgcgaggagcaggcccagcgggaacacgaggaauaucugaaacuuaaggaggcuuucguggucgaagaggagggagugggcgaaacgaugaccgaggaacagucucagagcuuucugacagaguucauuaacuacaucaagcaauccaaaguugugcuccuggaagaccuggccucucaggucgggcucagaacccaagauacaauuaaucgcauccaggaccugcuugccgagggaaccaucacaggcgugauugaugaccgggggaaguuuaucuauauuaccccugaggaacuggcugccguggcgaacuucaucagacagcgcggacgggucagcauugcugagcucgcccaggccuccaauagccugaucgcuuggggcagagaaucuccggcccaagcucccgccuga

SEQ ID NO: 68237 - RNA, 357 nt, Artificial Sequence
  derived and/or modified sequence opt5 from DDT__Homo_sapiens__NP_001077861
augcccuuccuggagcucgacaccaaccugccugccaauagagugccggcuggccuugaaaagcggcugugcgccgcggcugccagcauccucgggaaacccgccgaucgcgucaacguuacagugagaccuggacuggcuauggcccuuuccggcucuacggagcccugugcucagcugagcauuuccucuaucgggguggucggaaccgccgaagacaaucggagccauuccgcgcacuuuuucgaguuucucacaaaggaacuggcccugggccaagaucgcauucucaucagauucuuuccucuggagucuuggcagauugggaaaaucggaaccgugaugacauuccuuuga

SEQ ID NO: 68238 - RNA, 405 nt, Artificial Sequence
  derived and/or modified sequence opt5 from DDTL__Homo_sapiens__NP_001077862
augcccuuccuggagcucgacaccaaccugccugccaauagagugccggcuggccuugaaaagcggcugugcgccgcggcugccagcauccucgggaaacccgccgaucgcgucaacguuacagugagaccuggacuggcuauggcccuuuccggcucuacggagcccugugcucagcugagcauuuccucuaucgggguggucggaaccgccgaagacaaucggagccacuccgcgcacuuuuucgaguuucucacaaaggaacuggcccugggccaagaucgcuucccuaccgugcucucuacaagccccgcugcccaugggggaccuagaugcccgggcgagauuaucgagggcaaaaaguccugucugaacgaagaggcucuuuuuauuuacuucaucuga

SEQ ID NO: 68239 - RNA, 2628 nt, Artificial Sequence
  derived and/or modified sequence opt5 from DDX10__Homo_sapiens__NP_004389
augggcaagaccgccaacagccccggguccggagcuagaccugacccggugcggucuuucaaucgcuggaaaaagaaacacagccauagacagaacaagaaaaagcaacugcggaagcagcucaaaaagcccgaguggcaggucgaacgcgaguccaucucuagacugaugcagaauuacgaaaagauuaacguuaaugagaucacacgguuuagcgauuucccucuuuccaagaaaacgcugaagggccuccaagaagcccaguaucgccuggugaccgagauucagaagcagacaaucgggcuugcgcugcaaggaaaagacgugcucggcgcugccaagaccgggucuggaaaaacacuggccuuucugguccccgugcucgaggcucuguacagacuucaguggaccagcacagauggccugggcguucucauuaucuccccuacccgggaacuggccuaucagacguucgaggugcuucgcaaggucgggaaaaaccacgacuuuagcgcuggacugaucauuggcgggaaggaucucaaacaugaagccgagagaaucaauaacauuaauauccuggugugcacccccggacggcugcuccagcacauggacgagacaguuucuuuccaugcgaccgaucugcaaaugcuugugcuggacgaagccgaucgcauucucgacaugggcuuugcugauacaaugaacgccgucaucgagaaucugccuaagaagagacagacccuucuguucuccgcuacgcagacaaaaagcgugaaggaccucgcccggcugucucugaaaaacccggaauacguguggguccacgagaaggcgaaauauuccacccccgccacacucgaacaaaauuacauuguuugugagcugcagcagaagaucagcgugcuuuauucuuuucugcgcucccaccucaagaaaaagagcaucguguucuuuuccucuugcaaagagguccaguaccuguacagaguguucugucggcuuagaccugggguuagcauucuggcucuccauggacgccaacagcagaugcggagaauggaaguguauaacgaguuuguccgcaagcgggccgcugugcuguucgccaccgauaucgccgcuagaggccuggacuuccccgcgguuaauugggugcuccaguuugacugcccugaagaugccaacaccuacauucaccgcgcuggccggacagccagauauaaagaggacggggaagcccugcuuauccugcuccccuccgagaaggcuaugguccaacagcugcugcagaagaaagugccggucaaggagauuaaaaucaacccugaaaaacuuaucgaugugcagaaaaagcucgagagcauucuggcccaagaccaggaucugaaggaacgcgcgcagcgguguuucguuucuuacgugagauccgucuaucucaugaaagacaaggagguguuugauguuagcaaacugcccaucccugaauacgcucuuucucugggacucgccguggcuccccgcguccgguuccugcagaagaugcaaaaacagcccacgaaggagcuggugagaagccaggccgacaaagugauugagccucgggccccgucccuuaccaaugaugaaguugaggaauuucgcgcuuauuucaacgagaagaugucuauccuccaaaagggcgggaaaagacuggagggaacagaacaucggcaggacaaugauaccggcaacgaggaacaggaggaagaggaggacgacgaagaggaaauggaggaaaagcuggccaaagcgaaggggagccaggcccccucccucccuaauacaagcgaggcucagaaaauuaaggagguccccacccaauuucuggauagagacgaagaggaagaggaugccgacuuccuuaaggugaaacgccacaacguguuuggacuggaucucaaggacgagaaaacgcugcagaagaaagagccuucuaaguccagcaucaagaaaaagaugacaaaagucgcugaggccaagaaagugaugaagcggaauuucaagguuaacaaaaagaucaccuuuaccgaugaaggcgagcuggugcagcaauggccccagaugcagaaaucugcgauuaaggacgccgaagaggaugacgauacaggcgggaucaaucuucacaaagcuaaggagagacuccaggaagaggacaaauucgauaaggaagaguaccgcaagaaaauuaaggccaaacauagagaaaagcggcugaaagagcgcgaggcuagacgggaagccaacaagcgccaagccaaggcuaaagacgaggaagaggcguuucuggacugguccgaugacgaugacgaugacgaugacggauucgauccgagcacccucccugaccccgauaaguacagauccucugaagacagcgauuccgaggacauggagaauaaaaucucugacacaaagaaaaagcagggcaugaagaaacggagcaacuccgaagucgaggauguggggccuacgagccacaaucgcaagaaagccagaugggacacccuggaaccccuugauacaggacugucucucgcugaggacgaagaacugguucugcaucuucuccggucccagagcuga

SEQ ID NO: 68240 - RNA, 2643 nt, Artificial Sequence
  derived and/or modified sequence opt5 from DDX11__Homo_sapiens__NP_001244074
auggccgagcuguacagagugcucgaagcuggcaagaucgggauuuucgagagccccaccggaacaggcaaaucccugucucuuaucugcggggcccugagcuggcuccgggacuuugaacagaagaaacgcgaggaagaggcgagacugcuugagacgggaaccggcccucugcacgaugaaaaggacgagucccucugucugucuagcuccugcgaaggggcugccggaacaccgcggcccgccggcgagccugcuugggucacccaauucguucagaaaaaggaggaacgcgaucugguggacagacucaaggccgagcaggcucggcgcaaacagagagaagaacggcugcaacagcuucagcaucgcgugcagcugaaguaugccgcgaaaagacuccggcaagaagaggaggaacgcgagaaccugcuuagacugucucgggaaaugcucgagacaggccccgaagccgagcgccuggagcagcuggaaagcggggaggaggagcucguccuggcugaauacgaguccgaugaggaaaagaaaguggccagcagaguugacgaggaugaagacgaucuugaggaggaacacauuaccaagaucuauuacuguucucggacacauucccagcuggcucaguuugugcacgaggucaagaaaagcccuuucggaaaggacgugagacucguuucucugggcucccgccaaaaucuuugcgugaacgaagaugucaaaagccuggggucugugcagcucauuaaugaccgguguguggauaugcagagaucccgccaugagaagaaaaagggagccgaagaggagaaacccaagcggagacgccaagaaaagcaggcggccugcccuuuuuauaaccacgagcagaugggccugcugcgggacgaagcucucgccgaggucaaagacauggaacagcugcuugcucuggggaaggaggccagagccuguccguacuauggaagccgccucgcuauccccgcggcccaacugguugugcuuccuuaccagaugcugcuccacgcugccacccggcaggccgcuggcaucagacugcaggaucaaguggucauuaucgacgaggcccauaaucugauugauacgaucaccggcaugcacuccguggaaguuucugggagccagcucugccaggcgcauucccagcugcuucaauacguggagcgcuauggaaaacggcugaaggcuaaaaaccucauguaccugaagcagauucuguaucuucucgaaaaguucgucgccgugcugggcgggaauaucaaacagaaccccaauacacagagccugucucaaaccggaacagagcucaagaccauuaacgacuuucuguuccagucccagaucgauaauaucaaccuuuuuaaaguucaaagauacugugaaaagagcaugauuucucggaaacuguucggcuuuacggagcgcuauggggccguguucagcuccagagagcagccuaagcucgcuggauuucagcaguuccugcaaucucugcagccccggacaaccgaagcccuugcugccccggcggacgagagccaggccuccacacucagaccugcuagcccccugaugcacauccagggcuuccuggccgcucucaccaccgccaaucaagauggccgcgucauucugucucggcaggggucccuuagccagucuacacugaaguuucuccugcugaacccugcggugcacuucgcccaggucgugaaagaaugcagagcuguugugaucgccggaggcacgaugcaacccgucuccgacuuucgccagcagcuucucgcuugugccgggguggaggccgagagaguuguggaauuuagcugcggacaugucauucccccugauaauauccugccgcuggugaucugcuccggcauuucuaaccaaccccucgaguuuaccuuccagaagcgggaacugccucagaugauggacgagguggggcgcauccuuuguaaccugugcggcguuguccccggaggcgugguguguuucuucccuagcuacgaauaucucagacagguccacgcucauugggagaaagggggacugcugggccggcuugcggcccgcaagaaaauuuuucaagagcccaaguccgcucaccagguggaacagguucuccuggccuacucuagaugcauccaggccugugggcaagagcggggacaggugacaggcgcucugcuccugagcgucguugggggcaagauguccgaaggaauuaauuucagcgauaaccuuggccgcugcguggugauggucgggaugccguuuccuaauaucagaucugccgagcugcaggagaaaauggcguaccucgaccagacccugccccgggcuccuggacaagcucccccuggcaaggcccugguggaaaaccuuuguaugaaagccguuaaucaguccaucgggcgcgccauuagacaucagaaggacuucgcgagcgugguccugcucgaucagcgguaugcuagacccccggugcuggccaaacucccugccuggauccgcgcucggguggaggucaaggccacauuuggacccgcuauugccgcgguucaaaaauuccacagagaaaagucugccuccagcuga

SEQ ID NO: 68241 - RNA, 2196 nt, Artificial Sequence
  derived and/or modified sequence opt5 from DDX17__Homo_sapiens__NP_001091974
augcccaccggcuucguggcccccauccugugcguccuccugccgagccccacaagagaggcugccacgguugcguccgcuaccggggacucugccagcgaacgggaguccgccgcuccugccgcugcccccacagcggaagccccucccccuucuguggugacccgcccggagccccaggcccuuccuagccccgcuauuagagcuccucugcccgaucucuacccguuuggaacaaugcggggcgggggauucggcgaccgcgauagagaccgggaucgcgggggauuuggcgccagaggcgggggaggccugccucccaagaaauucgggaacccuggagaacggcuucgcaagaaaaagugggaccuguccgagcuccccaaauuugagaagaauuucuaugucgaacaccccgagguggcgagacugaccccuuacgaaguugaugagcugcggcgcaagaaagagaucacagugagaggcggggacgucuguccgaagcccguguuugccuuccaucacgcuaacuuuccucaauauguuauggaugugcucauggaccagcauuucaccgaacccacgccuauucagugccagggauuuccccuggcccuuucuggccgggauauggucggcaucgcucaaaccgggagcggaaaaacacuggccuaccuccugccggccauugugcacaucaaucaucagccuuaucuugagcgcggcgacgggcccaucugucuggugcucgcuccuaccagagaacuggcgcagcagguccaacagguugccgaugacuacggaaagugcucccggcugaaaagcacauguauuuauggcggggcucccaagggaccucagaucagagaccucgagcgcggcguggaaauuugcaucgccacccccggccggcugauugauuuccuugagucugggaagacgaaccugagacgcuguacauaccucgugcuggacgaggccgaucggaugcuugacaugggauuugaaccgcagaucagaaaaauugucgaucaaauccgcccugaccggcagacccugaugugguccgcuacauggcccaaggaggugagacagcucgccgaagauuuccugcgcgacuacacccaaaucaauguuggcaaccuggagcucagcgcgaaucacaacauucugcagaucguggaugucugcauggaaucugagaaagaccacaaacuuauucagcugauggaggaaaucauggcugagaaggaaaauaagaccauuaucuucguggagacaaaacggagaugugaugaccucacgcgccggaugagacgggacggguggcccgccaugugcauccauggagauaagucccagccugaacgcgacuggguucugaacgaguuuagaagcggcaaggccccgauucuuaucgcuaccgauguggccucucgggggcuggacgucgaggaugugaaauucgucauuaauuaugacuaccccaacuccagcgaagauuaugugcacagaaucggccgcacagcucgguccaccaauaagggaacagccuacaccuuuuucacgccuggcaaccucaaacaagcgagagagcugauuaagguucuggaagaggccaaucaggcuaucaaccccaaacucaugcagcugguggaccaucgcgggggaggcgggggaggcgggaagggcggaagaucucgguaucgcacaaccagcuccgccaacaauccuaaccuuauguaccaggaugagugugacagacggcugcgcggcgucaaggaugggggaagacgggacagcgcuucuuaucgcgauagauccgaaaccgaccgggccggcuacgcgaaugggagcggauacggcucucccaacagcgccuuuggggcucaagccggccaguauacauacggacagggcaccuauggggcugccgccuacggaacauccucuuauacggcucaggaguacggcgcggggaccuauggagccagcuccacaaccagcacaggccgcagcucccaaucuucuucccagcaguucagcgggaucggcagauccggacagcaaccucagccccucaugucucagcaauuugcucagccgccuggcgccaccaauaugauuggguacaugggacagacggccuaccaguaucccccucccccgccucccccuccucccagccggaaauga

SEQ ID NO: 68242 - RNA, 2013 nt, Artificial Sequence
  derived and/or modified sequence opt5 from DDX18__Homo_sapiens__NP_006764
augagccaucugcccaugaagcuccugagaaagaagaucgagaaacggaaccuuaagcugcgccagagaaaucucaaauuccaaggcgccuccaaccugacacuuucugaaacacagaauggggacgugagcgaggaaacgaugggaucccggaaggucaagaaaucuaagcagaaaccuaugaacguuggccugagcgagacccagaaugggggaaugucccaagaagcugugggcaacauuaaggugacaaaaucuccgcagaaaagcaccguccucacaaauggggaggccgcgaugcaguccagcaacucugaguccaagaaaaagaaaaagaaaaagcgcaaaauggugaaugaugcugaacccgacaccaagaaggccaaaacagagaacaagggaaaaagcgaagaggagucugccgaaaccacgaaggagaccgaaaauaacguugagaaaccugauaaugacgaagaugaguccgaggugcccagccugccucugggccucacaggcgcuuuugaagacaccucuuucgccucccugugcaaccuugucaaugagaacacacugaaggcuaucaaggaaaugggguuuaccaacaugacggagauucagcacaaaagcaucagaccccuccuggaaggacgggaucuucuggccgcggccaagacaggcuccgggaaaacccucgcuuuccugauuccugccguggagcugaucguuaagcuccgcuuuaugccgagaaauggaacaggcgugcugauccuuucucccacccgggagcuggcuaugcaaaccuucgggguccucaaagaacugaugacacaccaugugcacacguacggacuuauuaugggcggcagcaaccgcuccgccgaggcgcagaagcuggggaauggaaucaacauuaucguggccaccccuggcagacuccuggaccauaugcagaauacacccggguuuauguauaagaaccugcagugucucgucauugaugaagcugaccggauccuggauguuggauucgaggaggaacuuaaacaaauuaucaagcugcucccuacccgcagacagacaaugcuguuuagcgccacccagacgcggaaaguggaggaccuugcucgcaucucucugaagaaagaaccccucuacgugggcgucgaugacgacaaggccaaugccacaguggaugggcuggagcaaggauauguugugugcccguccgaaaagagauuccugcuccuguuuaccuuccuuaaaaagaaccggaaaaagaaacugauggucuuuuucagcucuuguaugagcgugaaguaccacuaugagcuccugaauuacauugaccugccuguucuugcuauccacggcaaacagaagcagaacaagagaaccacaaccuucuuucaguucugcaaugcggauuccggcacacuccuguguacggacguggccgcucgcgggcuggauauucccgaggucgacuggaucgugcaauaugauccucccgacgaucccaaagaauacauucaucgggucggaagaaccgcccgcggccucaacgggcggggacacgcccugcuuauccugagaccugaggaacucggcuuucugcgcuaccugaagcagucuaaagugccgcuuagcgaguucgacuuuuccuggagcaagaucucugauauucagucccagcucgaaaaacugaucgagaagaauuauuuccugcauaagagcgcucaagaggccuacaaaucuuauauucgggcguacgacucccacagccucaagcagaucuuuaacguuaauaaccugaaccuuccccagguggcucuguccuucggguuuaaagucccucccuucguggaccucaauguuaacucuaaugaaggcaagcagaaaaagagaggaggcgggggaggcuuuggguaucaaaagaccaaaaagguggagaaaagcaagauuuucaaacacaucuccaagaagucuagcgauucccgccaguuuagccauuga

SEQ ID NO: 68243 - RNA, 1437 nt, Artificial Sequence
  derived and/or modified sequence opt5 from DDX19A__Homo_sapiens__NP_060802
auggccaccgacagcugggcucuggccguggaugagcaggaagcggcugucaaguccaugacaaaccuccaaaucaaagaggaaaagguuaaagccgacacgaauggcauuaucaagaccucuacaaccgccgagaaaacagaugaagaggagaaggaagacagagcugcccagagccugcuuaacaagcugauucgguccaaucucguggauaacaccaaucagguggagguccugcagcgcgaccccaacucuccucuuuacagcgugaaauccuucgaggagcugagacucaagccgcaacugcugcaggggguuuaugcuaugggauuuaaucggcccucuaaaauccaggagaacgcccucccuaugaugcuggcggaacccccucagaaucuuauugcccaaagccaguccggcacagggaagaccgcugccuucgugcuggcuaugcucagccgcgucgagcccucugauagauacccucagugccugugucuuuccccgacguaugaacuggcccuccagaccggaaaagugaucgagcaaaugggcaaguuuuaccccgaacugaagcuggcguaugccguucgggggaacaaacucgagcgcggacagaagaucagcgagcagauugugaucggcacaccuggcaccguccuggacuggugcucuaaacuuaaguucauugaucccaaaaagaucaaaguguuugugcuggacgaagcugaugucaugauugccacacaagggcaccaggaccaguccauccggauucagagaaugcucccucgcaauugucaaaugcugcuuuucagcgcuaccuuugaggauucuguuuggaaguucgcccagaagguggugcccgacccgaacgucaucaaacugaagagagaagaggaaacgcucgacacaaucaaacaguacuaugugcugugcuccagccgggaugagaaguuucaggcccuguguaaucucuacggagcuauuaccaucgcgcaagccaugauuuucugccauacacgcaaaaccgcuuccuggcuggccgccgagcuuucuaaggaaggccaccagguugcucugcucagcggggagaugaugguggaacagagagccgcggucaucgagcgguuucgcgaaggaaaggagaaagugcugguuaccacaaacgugugugcuagaggcauugacgucgaacagguguccgucgugaucaauuucgaucuuccuguugacaaggaugggaaccccgacaacgaaacguaccugcaucggaucggaagaaccggccgcuuuggcaaacgggggcucgccgugaauauggucgauagcaagcacucuaugaacauucugaauagaauccaagagcauuucaacaaaaagauugaacgccuggacacagaugaccucgaugagaucgagaagauugccaauuga

SEQ ID NO: 68244 - RNA, 2223 nt, Artificial Sequence
  derived and/or modified sequence opt5 from DDX1__Homo_sapiens__NP_004930
auggccgcuuucagcgagaugggcgugaugcccgaaaucgcccaggcggucgaggaaauggacuggcugcucccuaccgauauucaggcugaguccaucccgcugauucuugggggaggcgacguucugauggccgccgaaacagggucuggaaagacgggcgcuuuuagcauccccgugauucagaucguguacgagacccucaaagaucagcaggaggggaagaaaggaaagacaaccaucaaaacaggcgccuccguccugaacaaguggcaaaugaauccuuaugacagaggcucugcuuucgccauugggagcgauggacuuugcugucagucccgggaagugaaggaguggcacggcugccgcgcgaccaaagggcugaugaagggaaaacauuacuaugaaguuucuugucacgaccagggccucugcagagugggguggagcacaaugcaggccucccuggaucugggaaccgacaaguuuggcuucggcuuugggggaacgggcaaaaagagccauaacaagcaauucgauaauuacggggaggaguuuaccaugcacgacacaaucggauguuaucucgauauugacaaaggccaugucaaguucucuaaaaacgggaaggaucugggacuugcuuuugaaauucccccucacaugaaaaaucaggcccuguuccccgcuugcgugcucaagaacgccgagcugaaauuuaauuucggcgaagaggaauuuaaguucccuccgaaggacggcuucguugcgcuuuccaaagcccccgacggguacauugucaagagccagcacucuggaaacgcucaggugacccaaacaaaauuucugccuaaugcccccaaggcucucaucguggagccuucccgggagcuggccgaacagacccugaacaauauuaaacaguucaagaaguauaucgauaaccccaaacuccgcgagcugcuuaucauuggcgggguggccgcuagagaccaacugagcguccucgaaaauggaguugauaucguggugggcacgccggggcggcuggacgaucuugucucuacaggcaagcugaaccucucccaggugcgcuuucugguucuggacgaggcggauggacuccugagccagggcuacuccgacuucauuaauagaaugcauaaccagaucccucaagugaccucugaugggaaacggcuucaggucauuguguguagcgccacacugcacuccuuugacguuaagaaacucagcgaaaagaucaugcauuuccccaccuggguggaucugaagggagaggacucugucccugacaccgugcaccacgucgugguucccgugaaccccaaaacagaucgccuuugggagagacugggcaagucccauauccggacggacgauguccacgcuaaagacaauacccgcccuggggccaacagcccggaaauguggucugaggccauuaagauccucaaaggagaauacgcugugagagccauuaaggagcauaagauggaucaggcgaucaucuuuugccggacaaaaaucgacugugauaaucuggaacaguauuucauccaacagggcgggggccccgacaagaaaggacaccaguuuagcugcguuugucugcauggcgaucgcaagccucacgagagaaaacagaaccucgagcgguucaagaaaggggacgugagauuucugauuugcaccgaugucgcugcccgcggaaucgacauucacggcgugcccuacgugaucaauguuacacuuccugaugaaaagcaaaacuauguccaucggauugggagagugggacgcgccgagcggaugggccuggcuaucucccucguggccaccgaaaaggagaaagucugguaccacgugugcucuagcagagggaagggcuguuauaauacgcgccugaaagaggacggaggcugcacaauuugguacaacgaaaugcagcugcuuuccgagaucgaggaacaucucaauuguaccaucagccagguugaacccgacauuaaggugccggucgaugaguucgacgggaaagugaccuauggacagaagcgggcugccggcgggggaucuuacaagggccacguugauauccuggcgccuacagugcaagagcuggccgcucucgaaaaagaggcccagaccuccuuucugcaccuuggguaccugcccaaccaacucuucagaacauucuga

SEQ ID NO: 68245 - RNA, 2352 nt, Artificial Sequence
  derived and/or modified sequence opt5 from DDX21__Homo_sapiens__NP_004719
augcccggcaagcugagaagcgacgccgggcucgaguccgauaccgcuaugaaaaagggagaaacacugcggaaacagacggaggaaaaggagaaaaaggaaaagccuaaaucugacaagaccgaggagaucgccgaagaggaagagacaguguucccgaaagcgaagcaagucaaaaagaaggcugagcccagcgaaguugauaugaacuccccuaaaucuaagaaagccaagaaaaaggaggaacccagccagaaugacauuuccccuaaaaccaagucucuucgcaagaaaaaggagcccaucgaaaagaagguggugagcuccaaaacaaagaaggucaccaaaaacgaggagccuagcgaagaggaaauugaugccccgaagcccaaaaagaugaaaaaggagaaggaaaugaauggcgagacaagagagaaaucuccuaagcugaaaaacggguuuccccacccugaacccgacugcaauccguccgaggcugccagcgaagagucuaacuccgaaaucgagcaggagauuccuguggaacagaaggagggagcuuucagcaauuuucccaucucugaagagaccaucaaacuccugaagggccggggaguuacguuccuuuuuccuauucaagccaagaccuuccaucacguguacuccggaaaagaucugaucgcgcaggcccgcacaggcaccggcaagacauuuagcuucgcuauuccccucaucgagaaacugcauggggaacugcaggacagaaagcggggacgcgcuccccagguccucgugcuggccccuaccagagagcuugccaaccaaguuuccaaagauuuuucugacauuacgaagaaacugagcguggcguguuucuauggcgggacaccguacggaggccaguuugaacggaugcgcaaugggaucgauauucucgucggaacccccggcagaaucaaggaccacauccagaacggcaagcuggaucuuacaaaacugaagcauguggugcucgacgaggucgaccagaugcuggauaugggguucgccgaccaaguugaagagauucuguccguggcuuauaaaaaggauagcgaggacaauccucagacccuccuguuuucugcuaccugcccccacuggguguucaacgucgccaaaaaguacaugaaguccacauaugaacagguggaucuuaucgggaaaaagacgcagaaaaccgccauuacaguugagcaccuggccaucaagugucauuggacccaacgggcugcggugauuggcgacgucauccgcguguacagcgggcaccagggaagaacaaucauuuucugcgaaaccaaaaaggaggcccaggaacucucucaaaauagcgcuaucaagcaggaugcccagucccugcauggcgacauuccucagaaacaacgggagaucacgcuuaagggguuucgcaacggaucuuucggcguucugguggccacaaaugucgcugccagaggccucgauauucccgagguggaccuggucauccagagcuccccgccuaaagauguggaaagcuauauccaccggucugggagaaccggacgcgcgggccggaccgggguuuguauuugcuuuuaccagcacaaggaggaauaccagcuggugcaagucgagcagaaagcuggaaucaaguucaagagaauuggcgugcccuccgccacagaaaucauuaaagccagcucuaaggacgcuauccgccuccuggacuccguuccucccaccgccauuagccauuuuaaacaguccgcugagaaacuuaucgaggaaaaaggggccguggaggcgcuggccgcugcccucgcucacaucucuggcgccacaagcgucgaucagcggucccugauuaacucuaacgugggauucgugacgaugauccuucaauguagcauugaaaugccuaauaucuccuaugcguggaaggagcugaaagagcagcucggcgaagagauugacagcaagguuaaggggauggucuuucugaaaggaaagcugggcgugugcuucgaugugcccaccgccucugucacagaaauccaggagaaauggcaugacuccagacgcuggcaacucagcguggcuaccgaacagccggagcuggaggggccucgggaaggauacggcggguuuagaggccagcgcgagggaucucggggcuucagagggcagcgcgauggaaaccggagauuucggggccaacgcgaaggguccagaggaccccggggccagagaagcgggggcggaaauaagucuaaccgcagccagaauaaaggccagaagcgguccuucagcaaggccuuugggcaauga

SEQ ID NO: 68246 - RNA, 1452 nt, Artificial Sequence
  derived and/or modified sequence opt5 from DDX25__Homo_sapiens__NP_037396
auggccagccugcucuggggcggggacgcuggagccgcggaguccgaaagacugaacucucacuucagcaaucuuucccagccccggaagaaccuguggggcaucaaaucuaccgcugugcgcaauauugaugggagcaucaacaauauuaacgaggacgaugaagaggacgucguugaucucgccgccaauucccugcuuaacaagcugauccaucaaucucucguggaaagcucccacagaguggagguccugcagaaagacccuagcucuccgcuguacuccgugaagacauuugaggaacuccggcugaaagaggaacuucugaagggaauuuaugcuaugggcuucaaucgccccagcaagauccaggagauggcccucccuaugaugcuggcucaucccccucagaaccuuaucgcccaaucucaguccgggacgggaaaaaccgcggccuuuguucuggcuaugcucagcagagugaaugcccuggagcuguucccccagugccucugucuggcuccuacauacgaacuugcccugcagaccggccgggucguggagcaaaugggcaaguuuugcguugaugugcaggucauguaugcgauucgcgggaacagaaucccgcggggaacagacauuaccaaacagaucauuaucggcacacccgggaccgugcucgauugguguuucaagcugaaacuuauugaccugacgaagauccgcguguuuguccucgaugaagccgacguuaugaucgauacccagggauucucugaccacuccauuagaauccaacgggcucugccuagcgagugccagaugcugcucuuuuccgccacauucgaagacucuguguggcauuuugcugagcgcauuauccccgauccuaaugugauuaagcugagaaaagaggaacuuacccugaacaauauccggcaguacuauguccucugugagcaccgcaaggacaaauaccaagcccugugcaacaucuauggcagcauuacaaucgggcaggccauuaucuucugucagaccagacggaacgcuaaguggcuuacgguggaaaugauucaggauggacaccaaguuucccugcucagcggcgagcugacaguggaacagagagcgucuaucauccagcgcuuucgggacggcaaagagaagguccugauuaccacaaaugugugcgccagagggaucgauguuaaacaggugaccauugucgugaacuucgaccuccccgucaagcaaggagaggaaccggauuacgagaccuaccugcaucgcaucggccggacagggagauucggaaagaaaggccuugcuuuuaauaugauugaaguggacgagcugccuucccucaugaagauccaggaucacuucaacagcucuauuaaacagcugaaugccgaagacauggaugagaucgagaagaucgacuauuga

SEQ ID NO: 68247 - RNA, 2391 nt, Artificial Sequence
  derived and/or modified sequence opt5 from DDX27__Homo_sapiens__NP_060365
auggugcuggcccagagacggcgcggcgggugcgagaagcucagagcuggaccccaagccguccuggcgagcggcuccggguucugugacaacaugcuugcugaucugggacucaucggcaccauuggggaagacgaugagguuccuguggaaccggagucugacagcggagaugaagaggaggaaggccccaucgugcugggccggcgccagaaagcccuugggaagaauagauccgccgacuuuaacccugauuucgucuuuacagagaaagaaggaacguacgacggcucuugggcucuggccgaugugaugagccagcucaagaaaaagcgggcugccaccacacuggacgagaagauugagaaaguucgcaagaaaagaaagaccgaagauaaagaggcgaaguccgggaagcuggaaaaagagaaggaagccaaagagggaucugagcccaaggaacaggaggaccuccaagaaaaugaugaggaaggcagcgaggacgaggcuuccgaaacagacuauagcucugccgaugagaacauccugaccaaagcugacacacuuaaggugaaagaucggaagaagaaaaagaaaaaggggcaggaagccggaggcuucuuugaggacgcgucccaguacgaugaaaaucugagcuuccaggacaugaaccucucucgcccucugcuuaaagccauuaccgcuaugggcuuuaagcaacccacgccuauccagaaggccugcaucccggucgggcugcucggaaaagauauuugugcuugcgccgccaccggcacagggaagaccgcugcguucgcccugcccgugcuggagagacucaucuauaaaccucggcaggcucccguuacacgcgugcugguccuugugccuaccagagagcuggggauucaggugcacuccgucacgcggcaacucgcccaguuuuguaauaucacaaccugccuggccguuggcgggcuugacgucaagagccaggaagcugcccugcgcgcggcucccgauauucucaucgccacaccgggaagacugauugaccaucugcacaacuguccuucuuuccaucucuccagcaucgaggugcugauccuugaugaagccgaccggaugcuggacgaguacuuugaggaacaaaugaaagagauuaucagaaugugcucccaccaucgccagaccaugcuguucucugcuaccaugacagaugaagugaaggaccuggccagcgugucccuuaagaaucccguucggauuuuugugaacagcaauacggaugucgcuccuuuccugagacaggaguucauccgcauucggcccaacagagaaggcgaccgcgaggccaucguggcggcccuccugacccggacauuuaccgaucacguuaugcuguucacacagaccaaaaagcaagcucacagaaugcauauccuccugggccuuauggggcuccaggugggagagcuccacggcaaucugucucagacgcagcgccuggaagcccuucggagauuuaaagacgagcaaauugauauccucgucgcuacagacguggccgcgcgcgggcuggauauugaaggagucaagaccgugaucaacuucaccaugcccaauacaauuaaacauuauguucaccgggugggcagaaccgcccgggcugggcgcgccggcagauccgucagccuggugggagaggacgaacggaagaugcucaaggagaucguuaaagcugccaaggccccugugaaagcuagaauccugccgcaggaugucauucuuaaguuucgcgacaaaaucgagaagauggaaaaagauguguacgcggugcugcagcucgaggccgaagagaaggaaaugcagcaaucugaggcucagauuaacacagccaagcggcugcuggagaaaggcaaggaagccguuguccaggagcccgaaagaagcugguuccagacgaaagaggagcgcaagaaagaaaagaucgcuaaggcccuucaagaguuugaccucgcgcugagagggaaaaagaaacggaagaaauucaugaaggacgcuaagaaaaagggagaaaugaccgccgaggaacgcucccaguuugagauucugaaagcccagauguucgcugagagacucgccaagcggaaccgcagagcgaaacgggcucgcgccaugccugaagaggaacccgugagaggcccugccaagaagcaaaaacaggggaagaaaucuguguuugaugaggaacugacaaauaccagcaagaaagcucuuaagcaguaucgggccggacccuccuucgaggagcgcaaacagcugggccucccgcaccaaagacggggaggcaacuuuaagagcaagucuagauacaaacgccggaaguga

SEQ ID NO: 68248 - RNA, 1623 nt, Artificial Sequence
  derived and/or modified sequence opt5 from DDX28__Homo_sapiens__NP_060850
auggcccugaccagacccgugcgccucuucagccuggucacacggcuucugcucgcuccuagacggggccugacgguucgcuccccggacgagccccuuccuguggugagaauccccgucgcccugcagcggcaacucgaacagcgccagucuagacggcgcaaccugccuagacccgugcugguucggccugggccgcuccuggugagcgcgcgcagacccgagcuuaaucagccugcucggcugacccucggacgcugggaaagagcuccccuggccucccaaggcuggaagucucggagagcccgccgggaucacuuuagcauugagagagcccagcaggaagcuccugccguccgcaaacuuuccucuaaggggagcuucgcggaccugggacucgagccccgggugcugcaugcccugcaggaggcugccccggaaguugugcaaccuacaaccguccaguccagcacaauccccucucuccugagaggccgccacguggugugcgcugccgagaccggguccggaaaaacacuuagcuaccugcucccucugcuucagcggcugcucggccagcccucucuggauucccugcccauuccugcgccgagaggccucguccugguucccagccgcgaacuugcccaacaggugcgggcuguggcccagccucuggggagaucucucggacugcuuguccgcgaccuggagggcgggcauggaaugcggagaauccggcuccaacugucccgccagcccagcgcugaugugcugguugccaccccuggcgcccucuggaaggcucugaaauccagacuuauuucucuggagcagcucagcuuucuggugcuggacgaagcggauacgcuucucgacgaguccuuccuggaacuggucgauuauauccucgaaaagagccacaucgccgaggggcccgcugaccuggaggauccguuuaacccuaaggcccagcuugugcugguuggagccaccuuccccgagggcgugggccaacuccugaauaaagucgcuucuccugacgccgugacaaccauuacauccagcaagcugcauuguaucaugccccacgucaaacagaccuuucuucggcucaagggggcggauaaaguggcugaacugguucacauucugaagcauagagaccgcgccgagcggacgggaccuucuggcacagugcucgucuucugcaacagcuccucuaccgugaauuggcugggguacauccuugacgaucacaagauucagcaucugagacuccagggacaaaugcccgcccugaugcgcguuggcaucuuucagagcuuccagaaauccagcagagacauucugcuuuguacagauaucgcuucucgggggcucgacuccaccggaguggaacuggucgugaacuaugauuuuccgccuacccugcaggacuacauccaccgcgccggcagagugggccggguugggagcgagguccccggaacagugauuucuuucgugacgcaccccugggaugucucccucgugcaaaagaucgaacuggcugcccgcagacggcgcagccuuccuggccuggcguccucuguuaaagagccgcucccccaggccaccuga

SEQ ID NO: 68249 - RNA, 2556 nt, Artificial Sequence
  derived and/or modified sequence opt5 from DDX31__Homo_sapiens__NP_073616
auggcccccgaccuggcuagccagagacacuccgagucuuucccuagcgugaacucccggccgaaugucauccuccccggccgcgaagggagacgggagggacugccucccggcgggggaacccgcggcucucuuguuccuacaagacccgugccuccgagccccgccccucuggggacgucccccuacucuuggagccgguccggaccuggccgcggcgggggagcgggcagcucuagagugcccagaggggucccgggaccugcugugugcgcccccggcucccuccugcaucacgccagcccuacccaaacaauggcugccgcugaugggucucuuuuugacaacccccgcaccuucuccagacggcccccugcccaggcgagccgccaggccaaggcuacaaaaagaaaguaucaggccucuuccgaagcuccgcccgccaaacggcgcaaugagaccagcuuucugccugcgaagaaaacauccguuaaggaaacccaaagaacguucaagggaaacgcccagaaaauguuuucucccaagaaacauagcguguccaccagcgaucggaaucaggaggagagacaguguauuaagacaucuucccucuucaaaaacaauccugacauccccgaacugcaccgcccggucgugaagcaaguucaggagaagguguuuaccagcgcugccuuccaugaacugggccuccacccucaccugauuucuacaaucaacaccguccuuaaaaugagcuccaugacgucugugcagaagcagagcauucccgugcugcucgagggccgggaugcucuggucagaucccaaacagggagcggaaaaacccuugccuacugcaucccuguugugcagucucugcaggccauggaguccaagauccaacgcagcgacggccccuaugcucucgugcuggucccuacacgggaacuggcgcuccagucuuuugauaccgugcagaaacugcuuaagcccuucaccuggauuguuccgggggugcugaugggaggcgagaaaagaaaguccgaaaaggcccgccuccggaaagggaucaauauucugaucagcacaccuggaagacuugucgaccauauuaaguccacgaaaaacauccacuuuucucgccugcgguggcucguguucgaugaggcugaccggauucuggaucugggcuuugaaaaggacaucaccguuauccucaaugccgugaacgccgagugucagaaacgccaaaauguccugcuuagcgcuacacugaccgagggcgugacacggcucgccgauauuucccugcaugaccccgucucuaucagcgugcuugacaagucccacgaucagcugaaccccaaggacaaagcgguucaggaagugugcccuccgcccgcuggggauaagcucgacagcuucgccauuccugagucucugaaacagcacgucaccgugguucccuccaagcugagacucgugugucuggccgcuuucauccuucaaaaaugcaaguuugaagaggaucagaagauggucguguucuuuagcucuugugaacugguggaguuccauuacucccucuuucugcagacgcugcuuagcucuagcggagccccugcuuccggccagcuccccagcgccucuaugcggcugaaauuccugcgccuccacgggggaauggagcaagaagagagaacagcgguuuuucaggaguucucccauagccggagaggcguccugcuuugcaccgacguggccgcucgcgggcuggaucucccucaggugaccuggauuguccaguauaaugcccccuccucuccggcugaauacauccaccggaucggcagaacagcccgcauuggaugucauggcagcucccugcugauccuugcgccuucugaagccgaguaugugaacagccucgcuucccacaagauuaacguuucugagaucaaaauggaagacauucugugcgugcugaccagagaugacuguuuuaaggggaaacgguggggagcccaaaagagccacgcugucggcccccaggagauccgcgaaagagccacagugcuccagacgguuuucgaggauuacgugcauuccagcgagcggcgcgucucuugggccaagaaagcucugcaauccuuuauccaggcguacgccaccuauccuagagaacuuaagcacauuuuccaugugcggagccugcaccucgggcacguugcuaaaucuuuuggacugcgcgacgcccccagaaaucuguccgcccuuacacggaagaaacgcaaggcucaugugaaaagaccggaccuccacaagaagacccagagcaaacauucucuggccgagauccugcgguccgaauacagcuccggcauggaggcggauauugcuaaggucaaaaagcagaacgccccuggggaacccggcggaagaccucuccaacacagccugcagcccacacccugcuucggccgcgggaaaacccuuaaguggcggaagacgcagaaaggagugcagagagacucuaagaccagccaaaaaguguga

SEQ ID NO: 68250 - RNA, 1284 nt, Artificial Sequence
  derived and/or modified sequence opt5 from DDX39A__Homo_sapiens__NP_005795
auggccgagcaggacguggaaaacgaucugcucgacuacgaugaggaagaggaaccccaagcuccucaggagagcaccccggcgcccccuaagaaagacaucaagggcuccuaugucucuauucacagcuccggguucagagauuuucugcuuaaacccgagcugcuccgggccaucguugacugcggauucgaacauccuucugaggugcagcacgaauguauuccccaggcuauccugggcauggaugugcuuugccaagccaagagcgggaugggaaaaacagccgucuuugugcuggcuacgcuccagcagauugagccuguuaauggccaggugaccguccuggugaugugucauacacgcgagcuggccuuccaaaucuccaaggaauacgagagauuuucuaaguauaugccgagcguuaaaguguccgucuucuuugggggacucagcaucaagaaagacgaagaggugcugaagaaaaacugcccccacguggucguuggcaccccuggccggauucuugcucuggugcgcaauagaucuuucucccucaagaacgugaagcauuuuguccuggaugaaugugacaaaaugcuugagcagcuggauaugcggcgcgacgugcaggagaucuucagacucacaccccacgaaaagcagugcaugauguuuagcgccacccugucuaaagauauucggccuguuugucgcaaguucaugcaagaccccauggagguguuugucgacgaugaaacaaaacugacccuccacgggcugcagcaguacuaugugaaacuuaaggacuccgagaagaauagaaagcuguucgaucuccuggacguucuugaguucaaccaagugaucauuuuugucaaaagcgugcagcggugcauggcgcuggcccagcuccuggucgaacagaauuucccggcuaucgccauucaucgcggaauggcucaagaggaaagacugucucgguaccagcaguuuaaggauuuccagcgcagaauccucguggccacgaaccuguuuggccgggggauggacaucgagagaguuaauauuguguucaacuaugauaugccugaagacuccgauaccuaccuucaccgcgucgcgcgggccggaagauuuggcacaaaagggcuggcuaucaccuucgugagcgacgagaaugaugccaagauucucaacgacguucaagaccgcuuugaagugaaugucgcugagcugcccgaggaaaucgauauuuccacauacaucgagcagucucgguga

SEQ ID NO: 68251 - RNA, 1287 nt, Artificial Sequence
  derived and/or modified sequence opt5 from DDX39B__Homo_sapiens__NP_542165
auggccgagaacgacguggauaaugaacugcucgacuacgaggaugacgaagucgagaccgcugccggcggggauggagcggaagcucccgccaagaaagacguuaagggcagcuauguguccauccacucuagcggguucagagauuuucugcuuaaaccugagcugcuccgggccauuguggacugcggauucgagcauccguccgaaguccagcacgaguguaucccccaagcuauucugggcauggaugugcuuugccaggccaagucugggaugggaaaaacagcuguuuuugugcuggccacgcuccagcagcuggaaccugucaccggccaagugagcguucuggugaugugucauacacgcgagcucgcguuccagaucuccaaggaguacgaaagauuuucuaaguauaugcccaacgucaaaguggccguguucuuuggcgggcugagcauuaagaaagacgaggaaguccuuaagaaaaauugcccucacaucguugugggaacccccggccggauccuggcucucgcccgcaacaagucccugaaucuuaagcauauuaaacacuucauccuggaugagugugacaagaugcucgaacagcuggauaugagacgggacgugcaggagauuuuucgcaugacaccucacgagaaacaagucaugauguucagcgcuacccugucuaaggaaaucagaccggugugccggaaauuuaugcaggaccccauggagauuuucguugaugacgaaacaaagcucacccugcaugggcuucagcaguacuaugugaaacugaaggauaacgagaagaaucgcaaacucuuugaccugcuugauguccuggaguucaaccaagugguuaucuucgugaaguccguccagagauguauugcccucgcgcagcugcugguggaacaaaauuuuccugccaucgcuauccaccggggaaugccccaggaggaacgccucagcagauaccagcaguucaaagacuuucaacggcgcauucuggucgccacgaaccuuuucggcagagggauggauaucgagcgggugaauauugcuuuuaacuaugacaugccugaagauucugacaccuaccugcauagaguugcccgcgccggacgguucggcacaaagggccucgcuaucaccuuuguguccgaugagaaugacgcgaaaauucugaacgacguccaggauagauucgaagugaauaucagcgagcuucccgacgagaucgauauuucuuccuacaucgaacagacacgcuga

SEQ ID NO: 68252 - RNA, 1986 nt, Artificial Sequence
  derived and/or modified sequence opt5 from DDX3X__Homo_sapiens__NP_001180345
augagccacguggccgucgagaacgcucugggccucgaccagcaauucgccgggcuggaucuuaauuccucugacaaccagagcggaggcuccaccgcgucuaaggggagauacauucccccucaucugcggaaucgcgaagcuacaaaaggauuuuaugauaaggacagcuccggcuggucuagcuccaaagauaaggacgccuacagcucuuucggguccagaagcgauucucggggaaaauccagcuuuuucucugaccgcggcuccggcagcagagggcgguuugaugaccgcggaagauccgauuaugacggcaucgggucucggggagaucgcagcggcuucgggaaguuugagagaggaggcaacucccgguggugcgacaagagcgacgaagaugacuggucuaaaccgcugcccccuuccgagcgccucgaacaggagcuuuucagcggcgggaauacgggaaucaacuuugagaaguacgaugacauucccguugaagccaccggcaauaacuguccuccccacaucgagucuuucagcgauguggaaaugggggagauuaucaugggaaauaucgagcugacaagauauacccggccuacaccggugcagaaacaugcuauucccaucauuaaggaaaaacgcgaccucauggccugcgcucaaaccggcuccgggaagacagccgcguuucugcugccuauccucucucagauuuacagcgauggacccggcgaggcccugagagcuaugaaggaaaacggccgguaugggagacgcaaacaguacccuaucucccuuguccuggcccccacccgggagcucgcugugcagauuuacgaagaggccagaaaguucagcuaucgcucucggguuagaccguguguggucuacggaggcgcggacaucgggcaacagauccgcgaucuggagcggggaugccaccuucugguggccacgccuggcagacucguugacaugauggaacgcgggaaaauuggccuggauuuuuguaaguaucuggugcucgacgaggcugaccggaugcuggauaugggauucgaaccccagaucagacgcauugucgagcaggacaccaugccucccaaaggcgugcggcauacaaugauguucuccgccaccuuucccaaggaaauccaaaugcuugcuagagauuuccuggacgaguacauuuuucucgccguggggcgggucggaagcacaucugagaauaucacccagaaaguuguguggguggaagaguccgauaagcgcagcuuccugcuugaccugcucaacgccacgggcaaggauucccugacacuggucuuuguggaaaccaaaaagggggcugacucucucgaggauuuccuguaucacgaaggauacgcgugcacaagcauccacggcgacagaucccagcgggauagagaggaggcccuucaucaauuucgcucugggaaaagcccuauucugguugcuaccgccguggccgcucggggccucgacaucuccaaugucaagcacgugauuaacuucgaucugccgagcgacaucgaagaguauguucauagaauuggacgcaccggcagaguggggaaucuuggacuggccacaucuuucuuuaacgaacggaacaucaauaucacgaaagaccuccuggaucugcucgucgaggcgaagcaggaggugcccuccuggcuggaaaacauggcuuacgagcaccacuacaagggcagcucucgcgggagauccaaaagccgguuuucuggaggcuucggggcccgcgacuauagacagagcuccggcgccucuagcuccagcuuuuccucuagccgggcuuccucuagccgcuccggaggcgggggacauggcucuagcagaggguucggaggcgggggcuacggaggcuucuauaauuccgauggguacggaggcaacuauaauagccagggggucgacugguggggaaacuga

SEQ ID NO: 68253 - RNA, 1974 nt, Artificial Sequence
  derived and/or modified sequence opt5 from DDX3Y__Homo_sapiens__NP_001289481
auggagaucggcagaccccggaaggacaccuggaaacuggccaaccucgaucugaauagcgaaaagcaguccgggggagcuucuacagccagcaaaggccgcuacauuccuccgcaccuuagaaaccgggaggcguccaagggguuccaugacaaagauucuagcggaugguccugcucuaaggacaaggaugcuuauagcuccuuuggcagccgcgacucuagagggaaacccggauacuucuccgaacggggcagcggcucucgcgggagauuugaugaccggggacgcuccgauuaugacggcaucgggaauagagagcggccuggauucggccgcuuugaaagaagcgggcacucucgguggugugauaaguccguggaggacgauuggagcaaaccccugccucccuccgagcgccucgaacaagagcuguucucuggaggcaacacgggcauuaauuuugaaaaguacgacgacaucccugucgaggccaccgggagcaacugcccgccccauauugagaauuucuccgauaucgacaugggagaaaucauuaugggcaacaucgagcuuacaagauauacccggccuacacccguucagaaacacgccauuccuaucauuaaggggaagagagaucugauggcuugugcccagaccggaagcggcaaaacagcugccuuucuccugcccauccugucucagauuuacaccgacgggccgggagaagcgcucaaggccgugaaagagaauggccgcuauggccggagaaagcaauacccuaucucccuggugcuugcucccacgcgcgaacuggccguccagaucuacgaggaggcucggaaauucagcuauagaucucgcgugcggccuugcguuguguacgggggagccgauauuggccagcagaucagagaccucgaacgcgggugucaucugcuugucgcgacccccggacggcugguggauaugauggagagaggcaagauugggcucgacuuuugcaaauaucugguucuggaugaagccgaccgcaugcucgauaugggcuucgagccccaaauccggagaauuguggaacaggacacaaugccuccgaagggaguccggcacaccaugauguuuagcgcuacauuccccaaggagauccagaugcuggcccgcgacuuccuugaugaguacaucuuucuggcugugggcagagugggguccaccucugaaaacauuacgcagaaagucguuuggguggaggaccucgauaagcggagcuuccugcuugacauccugggagccacaggcuccgauagccucacccugguguuugucgaaaccaaaaagggggccgacucucuggaggauuuccucuaucacgaaggauacgcuuguacauccauucauggcgacagaagccaacgcgaucgggaggaggcgcugcaccaguuuagaucugggaaauccccuauccuuguggccaccgcuguugccgcccgcggccuggacauuagcaaugugagacaugucaucaacuucgaucuccccuccgacaucgaagaguaugugcaccggauuggacgcacaggcagaguugggaaucugggacuugcuacgagcuuuuucaacgaaaagaauaugaacaucaccaaggaucugcucgaccugcugguggaggccaaacaggaggucccuagcuggcucgaaaacauggcguacgagcaccauuacaagggcgggucccggggacgcucuaaaagcaauagauuuuccggcggguucggcgcucgggacuaucgccaaagcucuggauccucuucuuccggcuuuggggccagcagaggaucuagcucccggagcggcgggggaggcuacgggaacucucgcggcuucggaggcgggggauauggcggguuuuacaauuccgauggauauggcggcaacuacaauagccaggggguggacugguggggaaacuga

SEQ ID NO: 68254 - RNA, 1869 nt, Artificial Sequence
  derived and/or modified sequence opt5 from DDX41__Homo_sapiens__NP_057306
auggaggaaagcgagcccgaaagaaagcgggcccgcaccgacgaggugccugcuggcggguccagaucugaagccgaggaugaggacgaugaagacuacgucccguauguuccccugcggcagcgcagacaacuccugcuucagaaacugcuccagcggcgcagaaagggagcggcugaggaagaacagcaagauagcggcuccgagccucgcggggacgaagaugacaucccccugggaccucagucuaacgugagccuucuggaucagcaccagcaucucaaagagaaggccgaagcccggaaagaguccgcuaaggaaaagcaacugaaagaggaggaaaagauucuggagucuguggccgaaggcagagcucucaugagcgucaaagagauggccaaggggaucacauacgacgaucccauuaaaacguccuggaccccuccgcgguaugugcugagcaugucugaggagcgccacgagagaguucggaagaaguaccauauccuuguggaaggagacggcauucccccucccaucaaauccuucaaggagaugaaauuuccugcggccauccugcgcggccucaagaaaaaggggauucaccaucccacaccgauccagauucagggaaucccuaccauucugagcggcagagauaugaucgggauugcuuucacaggaucuggcaaaacccuugucuuuacacugcccgugaucauguucugccucgaacaggagaagcggcugccuuuuuccaagagagaagggcccuauggacugaucauuugucccagccgcgagcucgcccggcaaacccacggcauccuggaguacuauugcagacuucugcaggaagacucuuccccucuccugcgcugugcucuuugcauuggcgggaugagcguuaaagagcagauggaaacgauccggcacggagugcauaugauggucgccaccccgggcagacugauggaccuccugcaaaagaaaauggugucccuggauauuugucgcuaccucgcgcuggacgaggccgaucggaugaucgacaugggguucgagggagauaucagaacaaucuuuucuuacuucaagggccagcgccagacccuucuguuuagcgcuacaaugcccaaaaagauucagaauuucgccaaguccgcucucgugaaaccugucaccauuaacguugggcgggccggagccgcuagccuggacgugauccaagaaguggaguaugucaaggaagaggcgaaaaugguguaccuucuggaaugccuccagaagacgcccccucccguucugauuuuugccgagaaaaaggcugauguggacgccauccacgaguaucugcuccugaagggcgucgaagccguggcuauccauggcgggaaagaucaggaggaaagaacaaaggccauugaggcguuccgcgaaggaaagaaggacguucuuguggcuaccgaugucgccucuaaaggccuggacuuuccggccauccagcacgugauuaauuacgacaugccugaggagaucgaaaacuauguccaccggauugggagaacaggacgguccggcaauaccgggaucgcuaccacauucauuaacaaggccugugaugagagcgugcucauggaccugaaggcucugcuucucgaagccaaacaaaagguucccccugugcugcagguccugcauugcggcgaugagucuaugcucgacaucggaggcgaacgcgggugugcguucugcggaggccuggggcacagaaucacggauugucccaaacuugaggccaugcagaccaaacaggugagcaauauuggacggaaagacuaccuggcucauuccucuauggauuuuuga

SEQ ID NO: 68255 - RNA, 2817 nt, Artificial Sequence
  derived and/or modified sequence opt5 from DDX42__Homo_sapiens__NP_987095
augaacuggaauaagggcgggcccggaaccaaaagaggcuucggguuuggaggcuucgccaucagcgcugggaagaaagaggaaccuaagcugccgcagcaaucccacucugccuuuggagcgacaagcuccucuagcggcuucggcaaauccgcucccccucagcuccccucuuuuuacaagauugggagcaagcgggccaacuucgacgaggaaaaugccuauuuugaggaugaagaggaggacuccagcaacguggaucugccuuacauccccgcugaaaauucuccuacgcgccagcaguuccauuccaaaccggucgacagcgauucugacgaugacccccuugaggccuuuauggcugaaguugaggaucaagccgcgagagacaugaagcggcuggaggaaaaagauaaggagcgcaaaaacgugaagggaauuagagacgauaucgaagaggaagacgaccaggaggccuauuuccgguacauggcugagaauccuaccgccggcgugguccaggaagaggaagaggauaaccucgaauaugacuccgaugggaaucccauugcuccuacaaagaaaaucaucgacccccugccgccuauugaucacagcgagaucgacuaucccccuuuugagaagaacuucuacaaugaacaugaggaaauuaccaaccuuacaccccagcaacugaucgaucuccgccacaaacugaaucugagagugucuggagccgcgcccccucggccgggcuccagcuuugcccauuucggguucgacgagcagcucaugcaccagauucgcaaguccgaauacacccagcccacaccuauccaaugccagggaguucccguggcucugucuggcagagauaugauuggcaucgccaaaaccgggagcggaaagacggcugccuuuaucuggccuaugcuuauucacaucauggaccagaaagagcuggagcccggcgaugggccgauugccgucaucguguguccuacccgggaacucugccaacagauucaugcugaguguaagcgcuucggaaaggcguacaaccugagauccguugccguguauggcgggggaagcaugugggaacaggcuaaagcccuucaggagggcgccgagaucgucgugugcacacccggccggcugaucgaccacgugaagaaaaaggcuaccaaucuccaacgcgucucuuaccugguuuuugacgaagccgauagaauguucgacaugggguuugaguaucaggugcgguccauugcgagccaugugagaccugaucgccagacacugcuguucucugcuaccuuucggaaaaagaucgaaaagcuggccagagacauucuuaucgaucccauucgcgucgugcagggagacaucggcgaggccaacgaagauguuacgcaaaucguggagauucugcacagcgggccuuccaaauggaacuggcucacacggagacuggucgaguucaccucuagcggauccgugcuucuguuuguuacaaagaaagcuaaugccgaggaacucgcuaacaaucugaagcaggaaggccacaaccuggggcuccugcauggcgacauggaucagagcgagcgcaauaaagugaucucugacuucaagaagaaagauauucccguccuuguggccaccgacgucgcggcccggggacuggauaucccguccauuaagaccgugaucaacuacgacguugcuagagacauugauacacacacgcaucgcaucggccggaccgggagagccggagaaaaaggcguggcuuauacacuccugaccccuaaggacagcaauuuugccggggaucuuguccgcaaccuggagggagcgaaucagcacgugucuaaagagcuccuggaccuggccaugcaaaacgcuugguuccggaaguccagauuuaagggcgggaaaggcaagaaacucaauaucggaggcgggggacugggcuaccgggaacgccccgggcuuggaagcgagaacauggauagaggcaauaacaauguuauguccaacuaugaagccuacaagcccucuacaggggcuaugggcgaccggcugaccgccaugaaagccgcuuuccagagccaguacaagucccauuucguggcggccucucucagcaaccagaaagcuggauccagcgccgccggcgcuucuggguggacguccgccggaagccucaauucugucccuacaaacuccgcgcaacagggccacaauagcccggauucucccgugaccagcgcugccaaggggauuccuggauuuggcaacaccgggaauaucuccggcgcccccgugacauauccuagcgcuggagcccagggcguuaacaauaccgcgucugggaacaauuccagagagggaacaggcgggagcaacggaaagcgcgaacgguacacggagaauagaggcuccucucgccacagccauggcgagaccgggaacagacacuccgacucuccccggcauggagauggcgggcgccacggagacggcuauagacacccugaaagcuccucucggcauacagaugggcaccgccauggagagaauagacacggcggcagcgcugggcggcauggagaaaaccgcggcgccaaugacgggagaaacggagagucccggaaagaggccuucaaccgcgaaagcaagauggagcccaaaauggaaccgaaggucgauucuuccaaaauggacaagguggacagcaagaccgauaaaacagcugacggcuuugccgugccugagcccccuaagcggaaaaagucuagaugggauuccuga

SEQ ID NO: 68256 - RNA, 1947 nt, Artificial Sequence
  derived and/or modified sequence opt5 from DDX43__Homo_sapiens__NP_061135
augagccaccauggcggggcccccaaggcuuccaccuggguggucgccucuagacggagcuccacaguuucucgcgcgccugagagacggccggcugaagaacugaaccgcacgggacccgaaggcuacagcguggggagaggaggccgguggcgcgggaccuccagaccucccgaggccguggccgcuggacacgaggagcucccucugugcuucgcccuuaaaucucauuuugucggcgcugugaucggccgcgggggaagcaagauuaaaaauauccaguccacaaccaacacaaccauucaaaucauucaggagcagcccgaaagccugguuaagaucuucggcucuaaagccaugcagacaaaggcgaaggccgugaucgacaauuuugucaaaaagcucgaggaaaacuauaauuccgagugugggauugauaccgcuuuccaaccuagcgugggaaaagacggcucuacggauaacaauguuguggccggggaccggccgcugaucgauugggaccagauuagagaggaaggacuuaaguggcagaaaaccaagugggcugaucugcccccuaucaagaaaaacuuuuacaaggaguccacagccaccagcgcgaugucuaaagucgaagccgacuccuggcggaaggagaauuucaacauuacaugggaugaccucaaagauggcgaaaagcgccccaucccuaauccgaccugcacguuugacgaugcuuuccaguguuaucccgaggugauggagaacauuaaaaaggccggcuuucaaaagccuacacccauccagagccaggcuuggccuaucgugcugcaggggauugaccugaucggagucgcccaaaccggcacagggaaaacccucugcuaccugaugcccggauucauucaccuuguucugcagcccucccucaagggccagagaaaucggccugggaugcuggugcuuaccccgacacgcgaacuggcccuccaaguggagggagaauguugcaaauauucuuacaagggccugagaagcgucuguguguauggcgggggaaaccgggacgagcagaucgaggaacugaaaaagggcguugauauuaucaucgcuacgcccgggagacucaaugaccugcagauguccaacuuugugaaccuuaagaauauuaccuaccugguccucgaugaggcggacaaaaugcuggauaugggauucgaaccucagaucaugaagauucuucuggacgugcgccccgaucggcaaacaguuaugaccagcgccacauggccucauucugugcacagacucgcucaguccuaccugaaagagcccaugaucgucuaugugggcacccuggaccucgucgccgugagcucuguuaagcagaacauuaucgugacgacagaagaggaaaaauggagccacaugcagaccuuucugcaauccaugucuagcaccgauaaggucaucguguucguuucccgcaaggccguggcugaccaucuuagcucugaucugauucucgggaauaucuccgucgagagccugcacggcgaccgggagcagagagaccgcgaaaaagcccuugagaacuucaagacaggaaaagugcggauucugaucgcgaccgaucucgcuucuagaggccuggacgugcaugauguuacacacgucuacaauuuugacuucccgcgcaacauugaagaguaugugcaccggaucgggagaacgggacgcgccggccggaccgggguguccauuacaacccugacaagaaaugauuggcgggucgccagcgagcucaucaacauccuggaacgcgcuaaucaguccauuccugaggaacuugugucuauggccgagagauuuaaggcucaucagcaaaaacgggaaauggagagaaagauggagcgcccccagggacggccuaagaaauuccacuga

SEQ ID NO: 68257 - RNA, 3099 nt, Artificial Sequence
  derived and/or modified sequence opt5 from DDX46__Homo_sapiens__NP_001287789
augggcagagagagccggcacuaccgcaagagauccgccucucgggggcgcagcggauccagaucucggagccgcucccccucugacaaaagaagcaagcggggcgaugaccgcagaucccggagccgcgauagagaccggcgcagagaacggucuagaucccgcgauaaacggagaagccgcucucgggacagaaagcgccugcggagaucccgcagccgggagagagaucgcucucgggaaagacggcgcuccagaagccgggacagacgccgguccagaucucgcagcagagggcggcgcuccagauccucuuccccuggaaacaaaagcaagaagaccgagaaucggucucgcagcaaagaaaagacagauggcggggaguccucuaaagagaagaaaaaggacaaggaugacaaagaagaugagaaggaaaaagacgcuggaaacuucgaccagaauaagcucgaggaggaaaugagaaaacggaaggagcgcguggaaaaauggagagaggaacaacggaagaaggccauggagaacaucggcgagcugaaaaaggaaauugaggaaaugaaacagggcaagaaauggagccuugaggaugacgaugacgaugaagacgauccggcggaggcugagaaggaagggaaugagauggaaggagaggaacuggacccccucgaugccuauauggaggaggucaaggaagagguuaaaaaguuuaacaugcgcuccgugaaaggcgggggaggcaaugaaaagaaaagcgggccuacggugaccaaggucgugacaguugugaccacaaagaaagccgucguggacucugauaagaaaaagggagagcugauggagaacgaccaggacgcuauggaauacuccagcgaggaagaggaaguugaucuucagaccgcccugacaggcuaucaaaccaaacagagaaagcuccuggagcccguggaccauggcaagaucgaguacgaaccuuuccggaaaaauuuuuaugucgaggugcccgaacuggcuaagaugucucaggaggaagugaacgucuucagacucgagauggaggggauuacgguuaaaggaaagggcugcccuaaaccgaucaaguccugggugcagugugggauuagcaugaaaauccugaauagccuuaagaagcacggauacgaaaaacccaccccuauccaaacacaggccauucccgcgaucaugucuggccgcgaucugauugggaucgccaagaccggaagcggcaaaacaauugcuuuucuccugccuauguuccggcauaucauggaccagagaucccuugaggaaggcgaggggcccauugccgugaucaugaccccgacgcgcgaacuggcucuccagaucacaaaggagugcaaaaaguuuucuaagacccugggacugcgggucguguguguuuauggcgggacaggaauuagcgagcaaaucgccgaacucaaaagaggcgcggagauuaucgugugcaccccugggcgcaugauugauaugcuggccgcuaacuccggccgggucaccaaucuuagacgcgugacauacguugugcuggacgaagccgaucggauguucgacaugggauuugagccccaggucaugagaaucguggauaacguccggccugaccgccagacggugauguucagcgcuaccuuucccagagccauggaggcccucgcucggcgcauccugucuaagcccauugaaguucaagugggcgggagauccgucguguguagcgauguugagcaacaggugaucgucauugaagaggaaaagaaguuccuuaaacugcucgagcugcugggacacuaccaggagucuggcuccgugaucauuuuuguggacaagcaggaacaugcggaugggcuccugaaggaccuuaugcgggccagcuauccuugcaugucucugcacggaggcaucgaccaguacgauagagacagcaucauuaaugauuucaaaaacgggacauguaagcuccugguugcuaccuccgucgccgcccgcggccuugacgugaaacaccugauccucguggucaacuauagcugcccgaaucauuacgaggauuaugugcaccgggcuggaagaacaggccgcgccgggaacaagggauacgcguauaccuucauuacggaagaccaggcucgguacgccggcgauaucauuaaagcccuggagcugucugggacagcuguucccccugaccucgaaaagcugugguccgauuuuaaggaccagcaaaaagccgagggaaagaucauuaaaaagagcuccggcuucucugggaaaggcuuuaaguucgaugagaccgaacaggcucuugccaaugagcgcaaaaagcugcagaaggcggcccucggacugcaggacagcgaugacgaagacgcugccguggauaucgacgagcaaaucgaauccauguuuaacucuaaaaagagagucaaagauauggcugcccccggcaccagcuccgugccugcgcccacagccgggaaugcugagaagcuggagauugccaaacggcuugcucucagaaucaacgcccagaagaaucugggaauugaaucucagguugacgugaugcagcaagccaccaacgcuauccugcgcggcgggacaauucucgcgccgacggucagcgccaagaccaucgcugagcagcuggccgagaaaaucaaugccaaacuuaacuacgugccucuggaaaaacaggaggaagagagacaagauggaggccagaaugaauccuucaagcgguaugaggaggaacucgagauuaacgacuuuccccagacagcucgcuggaaaguuaccagcaaggaagcccugcagagaaucucugaguacuccgaagcggcuauuacaauccgggggaccuauuucccucccggcaaggagccuaaagaaggagagcgcaagauuuaccuggccaucgagagcgccaaugaacuugcugugcaaaaagccaaggcggagaucacgagacucauuaaagaggaacugauccggcugcagaacucuuaucagcccaccaauaagggcagauacaagguccucuga

SEQ ID NO: 68258 - RNA, 2073 nt, Artificial Sequence
  derived and/or modified sequence opt5 from DDX4__Homo_sapiens__NP_001136021
augggcgacgaggauugggaagccgagaucaacccccacaugagcuccuacgugccuauuuucgaaaaggacagauauucuggggagaauggagauaacuuuaaucggaccccggcuagcuccucugaaauggacgauggccccagccgcagagaccauuucaugaaauccggguuugccucuggacggaacuucggcaaucgcgaugcgggggagugcaacaagagagacaauacaagcacgaugggaggcuuuggcgucgggaaauccuucggaaaccggggcuuuagcaauucucgcuucgaggauggggacuccagcggauuuuggagagaaucuuccaacgauugugaggacaauccuacccggaaccgcggcuucagcaagagaggggauaaugaccuggaccccgaugaaugcaugcagcggacaggaggccucuuuggcucucgcagaccuguucuguccgggaccggaaacggcgacacaagccaaucccggucugggagcggauccgagcgcggcggguacaaaggacuuaaugaggaagugaucaccggcagcggcaagaacucuuggaaguccgaggcugaagggggagagagcucugauacacagggccccaaagugaccuauauuccuccgcccccucccgaagacgaggauagcaucuucgcccacuaccagacggggauuaacuuugacaaguaugauaccauccuggucgagguguccggacaugacgccccucccgcuauccucacauucgaagaggccaaucugugucagacccuuaacaauaacauugcuaaagccggcuacacaaagcugaccccgguucaaaaauauucuaucccuauuauccucgcggggagagaucugauggccugcgcucagacgggcagcggaaagacagccgcuuuccugcuccccauucuggcccacaugaugcaugacggcaucaccgcgucccgguuuaaggaacuucaggagccugaauguauuaucguggcccccacaagagagcuggucaaucagaucuaccucgaggcucgcaaauucagcuuugggaccugcgugcgggccguugugauuuacggaggcacccaacuggggcacucuaucagacagauuguccagggauguaacauccuuugcgcuacacccggccgccugauggauauuaucgggaaggagaaaaucggccucaagcagauuaaauaucuggugcuggacgaagccgaccggaugcucgauaugggauucggcccugaaaugaagaaacugaucuccuguccggggaugcccagcaaggagcaaagacagacgcuuauguuuucugccaccuucccugaagagauucagcgccuggcugcggaguuucucaaguccaauuaccuguucguggccgucggacaaguuggcggggcuugccgggacgugcagcagacagugcuucaggucggacaauuuagcaaaagagaaaagcugguggagauccuccgcaacauuggcgaugaacggaccaugguuuucguggagaccaaaaagaaagccgacuuuaucgccacauuccugugucaggagaagaucuccacgacaucuauucacggggauagagaacagcgcgagcgggaacaggcucugggcgacuuuagauucggaaagugccccguccucguggccaccagcguugcggcucggggccuggauaucgagaaugugcaacaugucauuaacuucgaccuuccuuccaccaucgaugaauaugugcaccgcauugggagaacaggacggugcggcaauaccgggagagccaucagcuuuuucgaccuggagucugauaaccaucucgcccagccccuggucaaagugcuuacagacgcucagcaggauguuccggccuggcuggaggaaauugcuuuuuccacguacaucccuggauucagcggcucuacccgcgggaauguguuugccuccgucgacacacggaagggcaaaagcacccucaacacagcgggauucucuuccagccaagcccccaauccuguggacgaugagucuugggacuga

SEQ ID NO: 68259 - RNA, 2214 nt, Artificial Sequence
  derived and/or modified sequence opt5 from DDX50__Homo_sapiens__NP_076950
augcccggcaagcugcucuggggagacaucauggagcuggaagccccucuugaggaaagcgagucccagaaaaaggaaagacaaaaaucugaucggcgcaagagcagacaccauuacgacuccgaugagaaaucugagacccgggaaaacggggugacagacgaucuggacgcuccgaaggccaagaaaagcaagaugaaagagaagcucaauggcgauacggaagagggguucaaccgccuguccgacgaguuuucuaaaagccacaaguccagacggaaggaucuucccaauggagacauugaugaauaugagaaaaagagcaaacgcgucucuucccuggacaccagcacacauaagucuuccgauaacaaacucgaagagacccugacaagagaacagaaggagggcgcguucagcaauuuuccuaucucugaggaaaccauuaaacugcucaaggggcggggaguuacauaccuguuccccauccaggugaagaccuuuggcccuguguaugagggcaaagaccuuauugcucaggcccgcacggggaccggaaagacauucuccuuugccaucccccugaucgaaagacuccaacggaaccaggagaccauuaaaaagagccgcuccccuaaaguccuggugcuugcuccgacaagagaacuggccaaucagguugcuaaggacuucaaggauaucacccggaaacucucuguggccugcuuuuacggcgggacgagcuaucagucccaaauuaaccacauccgcaauggaauugacauccuggucggcacacccgggagaauuaaggaucaucugcagagcggacggcucgaccugucuaaacuuagacacgugguucuggaugagguggaccagaugcucgaucugggcuucgcggagcaggucgaagacaucauccacgaguccuacaagaccgauagcgaagacaacccucaaacacuucuguuuucugccaccuguccccaguggguguauaaaguggcuaagaaguacaugaaaagccgcuacgagcaggucgaucucguuggcaagaugacccaaaaagccgcuacaacgguggaacaucuggccauucagugccacuggucccagcggccugcggugaucggggacguccuccagguguauucuggaagcgagggcagagccauuaucuucugugagaccaagaaaaauguuacagaaauggcuaugaacccccauauuaagcaaaaugcccagugccugcacggggacaucgcucagucccagcgcgagaucacccugaagggauuucgggaaggcagcuucaaagugcuugucgccacaaacguggccgcuagagggcuggauauuccggagguugaccucgugauccaaucuuccccuccccaggaugucgagagcuacauucaccgcucuggacggaccggcagagcgggccgcacggggaucuguauuugcuucuaucagccucgggaaagaggacagcugcgcuacguggagcaaaaggccggcaucacauuuaaacgggucggggugcccuccaccauggaccuuguuaagagcaaauccauggaugcuaucagaucucuggccagcguguccuaugccgcugucgacuucuuucggcccucugcccagcgccucauugaagagaagggagcgguggaugcucuggccgccgcucuggcccauaucagcggcgcuuccagcuucgaaccuagaucucucauuaccuccgacaaaggguuuguuacaaugacccuggagagccuugaggaaauccaggaugugucuugugccuggaaggagcugaaucggaagcucuccagcaacgcggucucucagauuacaagaaugugccugcugaaaggcaacaugggaguguguuucgacgugccgacgaccgaaagcgagcgccuucaagccgaauggcacgauuccgacuggauccucagcguucccgcuaagcugccugagauugaggaauacuaugauggcaauacaucuuccaacagccggcagagauccggguggucuagcggacgcuccggcagaucugggcggagcggaggccgcuccgggggcagaucuggacggcagagccgccaaggcuccagaagcgggucucggcaggacggacgcagacgguccggcaaucgcaacagaagccggucugggggacauaaaagauccuuugacuga

SEQ ID NO: 68260 - RNA, 2001 nt, Artificial Sequence
  derived and/or modified sequence opt5 from DDX51__Homo_sapiens__NP_778236
auggcccuguucuacguggcuagauaucccggcccugacgccgcggcugccgccgggccggagggagcugaagccggcgcucacgggcgggcccgcgcgcuccuggagagacuucagagccgggcccgcgaaagacaacagcagcgggagcccgcucagaccgaagccgcugccuccacagagccugcgacgcgcagacggcgcagaccccggcgcagacggcgcgucaacgaugccgagccuggaucucccgaagcuccucaaggcaagagacggaaagccgacggggaggaugcuggagccgaaagcaaugaggaggccccgggcgaacccuccgcuggcucuagcgaggaagcgccuggggagcccuccgccggaucuagcgaagaggcuccuggcgagagauccaccagcgccucugccgaagcugcccccgacgggccggcgcuggaggaagcugccggaccucucguucccggccuggugcuugggggauuuggcaagcgcaaagccccuaaggugcagcccuuccugccccgguggcucgcugagccuaacugcgucagacgcaaugugacagaagaucugguuccgaucgaggacauucccgaugugcauccugaccugcagaaacagcuccgggcccacggcaucuccagcuacuuucccguccaagcugccgugauuccugcgcugcuugagucugccgcuuguggguuccugguuggaagaggcggguaucgccccuccgaucucugcgugagcgccccgaccggaucuggcaagacacuggcuuuugucaucccuguggugcaggcccuucugucccgggucguuugucauauuagagcgcucguggugcugcccaccaaggaacuggcccagcaggucagcaaaguguucaacaucuacacagacgcuaccccucuccgcguuucccuggugacggggcaaaagucucuugccaaagagcaggaaagccugguccagaagaccgcugauggauaucggugccucgccgacaucgugguugccacacccggcagacugguggaucacauugaccaaaccccuggcuuuucccuucagcagcugcgcuuccucaucauugacgaggcugaucggaugaucgacagcaugcaucagucuuggcugcccagagucguggcggccgcuuuucaauccgaagauccggccgacccuugugcccugcuccagcggcgccaggcucaggccgucacagcggcuucuaccugcuguccccaaaugccccugcagaaacuucuguucagcgccacgcucacacagaauccugagaagcugcagcaacuugggcugcaccagccgagacucuuuagcaccggacuggcccaccggggccuggaggauacagacggggauggagacuccggcaaguacgcuuuccccguggggcucacccaucacuauguuccuugcucucugagcuccaaaccccuugugguccugcaucucgugcuggaaaugggcuuuagcagaguucuguguuucaccaacucucgcgaaaauucccaccggcuuuuccuccuggugcaggccuuuggaggcgucgauguggcggaguucagcucuagauacgggccuggacagcgcagaaugauucugaagcaauuugagcagggcaaaauccagcuccugauuuccacagacgcuacggcccgggggaucgaugugcaaggaguugagcuugucgugaacuacgacgcuccccaguaucugcgcaccuacgugcacagagucggccggacagcccgcgccgggaagaccggccaggcuuucacacuccugcugaaagugcaggaaagacgguuucuucgcaugcucaccgaggccggagcgccugaacugcaaagacaugagcugagcuccaagcuccugcagccccuuguuccgcgguaugaagaggcccugucucagcucgaggaaagcgugaaagaggaacgcaagcagagagcugccuga

SEQ ID NO: 68261 - RNA, 1800 nt, Artificial Sequence
  derived and/or modified sequence opt5 from DDX52__Homo_sapiens__NP_008941
auggacgugcacgaucuguucagacggcucggcgccggggcuaaguuugacacccgcagauucagcgccgaugcggcucgguuucagaucggaaaacgcaaguacgacuucgauuccucugagguccugcaaggccuugacuuuuucgggaacaaaaagagcguucccggagugugcggcgccucccagacacaucagaaaccucagaauggggaaaagaaggaggaaucucugacggagagaaaacgggaacaaagcaagaaaaagcgcaaaaccaugacauccgagauugccucucaggaggaaggagcuaccauccaguggaugagcuccguggaggccaagauugaagauaagaaaguccagagagagagcaagcucacaucuggcaaacuggagaaccuucggaaggaaaagaucaauuuucugcgcaacaagcacaaaauucaugugcaaggcaccgaccucccggaucccaucgcuacauuccagcagcuggaccaggaguauaagaucaauuccagacugcuccaaaacauucuggaugccggguuucagaugccuacccccauccagaugcaagcgauuccuguuaugcuucacggacgggaacugcucgccagcgcucccacgggcucugggaagacccuggccuucuccaucccuauucuuaugcagcugaaacagccggcuaauaagggauuucgcgcccucaucauuagccccacaagagagcuggcgucucagauccaucgggaacugaucaaaauuuccgagggcaccggguuccgcauccacaugauucacaaggccgcuguggccgcuaaaaaguuuggaccuaagagcuccaaaaaguucgacauccucgucacaacccccaacagacugauuuaccuucugaaacaagauccucccggcaucgaccucgccucuguggaguggcugguuguggacgaaagcgauaaacuuuucgaggacggcaaaacgggguuucgggaucagcuggccuccaucuuccucgcuuguacaagccauaaggucagacgcgcgauguuuucugccaccuucgcuuaugacguggaacaguggugcaagcugaaucuggauaacgugauuuccgucagcaucggagccagaaauucugccguugagacaguggaacaggagcuccuguuugugggcagcgagaccgggaaacuucuggcuguccgggaacucgugaagaaaggauucaacccgccuguucugguguuuguccaauccauugagcgcgccaaggaacuuuuccacgagcugaucuacgaaggcauuaauguggacguuauccaugcggagcggacccagcagcagagagauaacacagugcacucuuuucgcgcugggaaaaucuggguccucauuuguacggcccugcuggcccggggaaucgacuucaagggcgugaaucucgucauuaacuaugauuuucccaccagcuccguggaguacauccacagaauuggccgcacagggcgggcuggaaacaagggcaaagccaucaccuucuuuacagaagacgauaagccucugcuuagaagcguugcuaaugugauucaacaggccgggugccccguccccgaguauaucaaaggauuccagaagcugcucucuaaacagaagaaaaagaugaucaagaaaccucuggaacgcgaguccauuagcaccacgccgaaguguuuccuggagaaagcgaaggacaaacaaaagaaggugacaggccagaacucuaaaaagaaaguugcccuugaagacaaguccuga

SEQ ID NO: 68262 - RNA, 1896 nt, Artificial Sequence
  derived and/or modified sequence opt5 from DDX53__Homo_sapiens__NP_874358
augagccacugggcccccgaguggaagagagcugaagccaacccucgggaccugggcgcguccugggaugugcgcgggucuagaggaagcggcugguccgggccguucggacaucagggcccccgggcugccgggucucgcgagccuccccucugcuuuaaaaucaagaauaacauggucggaguugugauuggcuacagcggcuccaaaaucaaggaccugcaacacucuaccaauacaaaaauucagaucauuaacggggaaagcgaggccaaggugagaaucuucggaaaucgggaaaugaaggcuaaagccaaggcugccaucgagacgcuuauucgcaaacaggaguccuauaacagcgaaucuuccgucgauaaugcggccagccagaccccuaucggcagaaaccuggggcggaaugacauugugggagaggcugaaccccucucuaacugggaucgcaucagagccgcuguuguggagugugagaagcggaaaugggccgaccugccuccggucaagaagaauuuuuacauugaauccaaagcgacaagcugcaugucugagaugcaagugaucaacuggcgcaaggaaaauuucaacauuaccugugaugaccuuaaauccggcgagaagagacugauccccaaaccuacaugccgguuuaaggaugccuuccagcaguaucccgaccuccugaaaagcaucauucgcguugggaucgugaagccuacccccauucagucccaggcuuggccgaucauucugcaaggaaucgaucucaucgucguggcccagacaggcaccggcaagacgcugucuuaccuuaugccuggguuuauucaucuggacagccagcccaucuccagagaacaacggaauggaccuggcaugcucgugcugacccccacaagagagcuugcucugcacgucgaggccgaauguagcaaauauucuuacaaggggcucaaauccauuugcaucuauggaggccgcaaccggaacgggcagauugaggauaucagcaagggaguugacaucauuaucgccacccccggcagacugaaugaccugcagaugaacaauucugugaaccuccgcagcauuacauaccuggugaucgaugaagcugacaaaaugcuugauauggaguucgaaccucaaauucggaagauccugcucgacgucagaccggaucgccagaccgugaugacguccgcgacauggcccgacaccguucggcagcuggcccuuucuuaccugaaggauccuaugauuguguaugucggcaaucucaaccugguggcuguuaauacagugaaacagaacaucaucgucaccaccgagaaggagaaaagagcccugacacaagaauuuguggagaauaugagccccaacgacaaggucauuauguucgugucccagaaacauaucgccgaugaccucagcucugauuuuaauauucaggggaucuccgcugaaagccugcacggaaacucugagcaguccgaccaagaacgcgccguugaggacuucaagagcggcaauauuaagauccuuaucacgaccgauauugugucccgggggcuggaccucaacgaugucacacacguguacaauuaugacuuuccuagaaacaucgauguuuacgugcaucgcgucggauauauuggccggaccgggaaaacaggcaccucugugacgcugaucacacagagagacagcaagauggcgggagagcuuauuaaaauccuggaucgggcuaaccaguccgugcccgaagaccucguugucauggccgagcaguacaagcugaaucaacagaaacgccacagagaaacccggucuagaaagccgggccagcgccggaaggaguucuauuuccugagcuga

SEQ ID NO: 68263 - RNA, 2649 nt, Artificial Sequence
  derived and/or modified sequence opt5 from DDX54__Homo_sapiens__NP_001104792
auggccgcugacaagggccccgccgcggggccuagaagccgggcugccauggcccaguggcgcaaaaagaaaggacugagaaagcggcgcggcgcugccucccaagcuagagggucugauagcgaggacggagaguucgagauccaggccgaagaugacgcgcgggcccgcaaacucggcccggggagaccccugccuaccuuucccacauccgagugcacgucugauguggaaccugacacccgggagaugguccgcgcucagaacaagaagaaaaagaaaagcggaggcuuccaguccaugggccuuucuuaccccguuuuuaaggggauuaugaaaaagggauauaaggugccuacaccgauccaaagaaaaaccauucccgugauccuggauggcaaggacgucguggccauggcucggacagggagcggaaaaaccgccuguuuccuccugccuauguuugagcgccuuaagacacacuccgcgcagaccggcgccagagcucugauucucagccccacgcgggaacuggcccugcagacccucaaauucacaaaggagcuggggaaauuuaccggacuuaagacagcucugauccucggcggcgaucgcauggaagaccaguucgccgcccugcaugagaauccugauaucauuaucgcuacccccgggagacuuguucacguggcggucgagaugucucugaagcuccaauccguggaauacguuguguuugacgaggccgaucggcuguucgaaaugggauuugcugagcagcugcaggaaauuaucgccagacucccgggcgggcaucagacgguccuguucagcgccacacuuccuaaacugcucguggaguuugcucgcgccggacugaccgagcccgugcuuauucggcuggacgucgacacaaagcucaacgaacaacugaaaaccucuuucuuccugguuagagaggauaccaaggcggcugugcuccugcaccuucugcauaaugugguccgcccucaggaccagacagugguuuuuguggccacgaaacaccacgccgaauaucucaccgagcugcuuacaacccaacgggucuccugcgcucauaucuacagcgcccuggaucccacagcuagaaagauuaaccucgccaaguucacccugggcaaauguucuacgcugaucgugacagaccucgcggcccgcgggcuggauaucccccuucuggacaauguuauuaacuauuccuuuccugcuaagggaaaacucuuccugcaccgggugggcagagucgcccgcgcuggccggagcgggaccgccuacucccugguggcgccggaugaaauccccuaucuucucgaccugcaucuguuucucggaagaucucugacccuugcccgcccucugaaggagcccagcggcgucgcugggguggauggaaugcucggccggguuccucaguccguggucgacgaggaagauagcgggcugcagucuacacuggaggccucccuugaacucagaggccuggcucggguggccgacaaugcccagcaacaguacguucgcagcagacccgcuccgucuccugagagcauuaaacgggcgaaggaaauggaccuggugggacucggccugcacccccuuuucuccucuagauuugaggaggaagaacugcagcgccuccggcuggucgauagcaucaagaacuacagaucccgcgccaccauuuucgaaaucaaugcuagcucuagagaccugugcucccaggugaugcgggccaaacgccaaaaggauagaaaagccaucgcucgguuucagcaggggcagcaaggacgccaggagcagcaggagggcccuguggggcccgccccuagcagacccgcgcuucaagaaaagcagccggagaaagaagaggaagaggaggcuggagaaucuguugaggacauuuucuccgaagucgugggccggaagcgccagagaagcgggccuaaccggggcgccaagcgcagacgggaggaagccagacaacgcgaucaggaguuuuauauccccuaccggcccaaagacuucgauuccgagagaggacucucuauuagcggcgaagggggagcuuuugagcagcaggccgcgggcgcugugcuggaccugaugggggaugaagcccaaaaucucacacgcggacggcagcagcugaagugggaccggaaaaagaaacgcuucgucggccaguccgggcaagaggauaagaaaaagaucaagacggaaucuggccgguauauuagcuccagcuacaaaagagaccuuuaucagaaguggaaacagaagcagaaaaucgaugaccgcgacucugaugaggagggagccuccgaccggagaggcccugaacggcgcgggggaaagagagaucggggccaagcuggggccagccgcccgcacgcucccggaaccccugccggcagagugcggcccgagcugaagacaaaacagcagauccucaagcaaagacgccgggcgcagaaacugcauuuccugcagagagggggccuuaagcagcucucugcccgcaaccggagacgcguucaagaacugcagcagggagcuuuuggcagaggggccagauccaaaaagggaaagaugcgcaaaagaauguga

SEQ ID NO: 68264 - RNA, 1524 nt, Artificial Sequence
  derived and/or modified sequence opt5 from DDX56__Homo_sapiens__NP_001244118
auggaggacagcgaagcccugggcuucgagcacauggggcucgaucccagacugcuucaggcugugaccgaccugggauggucccggccuacacucauccaagaaaaggccauuccgcuggcgcuugagggcaaagaucugcucgcucgcgccagaacggggucuggaaagaccgccgcuuacgccauccccaugcugcagcugcuccugcaucggaaagcuacaggcccugucguugaacaggccgugcgcgggcuugugcugguccccaccaaggagcucgcgagacaggcccaaagcaugauucagcagcuggcuacauauugcgcccgggacgugcgcguugcuaacguguccgccgcggaggauucugucagccagagagccgugcuuauggaaaaaccugacguuguggucggaacccccucccggauccugucucaccuccaacaggauagccugaagcugcgcgacucccucgagcugcuugugguggaugaagcugaccugcucuuuagcuucggcuuugaggaggaacugaagucucuucugugucaucucccuagaauuuaccaggccuuccugauguccgcuacauuuaaugaggauguccaggcccugaaagaacucauccugcacaacccgguuacccuuaagcugcaagagagccagcuccccggcccugaccagcugcaacaguuccagguggugugcgaaacggaggaggauaaauuucuucugcucuaugcccugcugaagcucucucugauccgggggaaaucccuucuguucgucaauacccucgaacgcagcuacagacugcggcuguuucuugagcaguucucuauucccacaugugugcucaacggagaacugccucugcgcuccagagcuagcgaccccgaggcgggcguugcccgggggaucgacuuucaucacguguccgcuguccucaauuucgaucugccgccuacccccgaagccuauauucacagagccggacgcacagcucgggccaacaauccuggcaucgugcuuaccuuuguucugcccacggagcaauuccaucucgggaagauugaggaacugcugucuggagagaacagaggccccauccuucucccuuaccaguuccgcauggaagagauugaaggcuuucgguauagaugccgcgacgcgaugcggagcgugacaaagcaggcuaucagagaggcccgccugaaagagaucaaggaggaacugcuccacuccgaaaaacugaagaccuacuucgaggauaauccgcgggaccuucagcugcucagacaugaucugccccugcacccugccgucgugaaaccccaccuugggcaugucccugacuaccucgugcccccggcucugcgcggacugguucggccucacaagaaaagaaagaagcucucuagcuccugucggaaagccaagcgcgcuaaaagccaaaacccccugagaucuuuuaagcauaaaggcaagaaguuccggccuacagccaaacccagcuga

SEQ ID NO: 68265 - RNA, 2778 nt, Artificial Sequence
  derived and/or modified sequence opt5 from DDX58__Homo_sapiens__NP_055129
augaccacagagcagagacggagccugcaagccuuccaggacuacauccgcaagacgcucgaucccaccuauauucuguccuacauggcuccuugguuuagagaagaggaagugcaguauauccaggccgagaaaaacaauaagggcccgauggaagcggcuacacuuuuccugaaauuucuccuggagcuucaagaggaagggugguuccggggauuucuggacgcccucgaucacgccggcuacucugggcuguaugaggcuauugaaagcugggacuucaagaaaaucgagaagcuggaggaauaccgccuccugcuuaagagacugcagcccgaguuuaaaacccggauuaucccuacagauaucauuuccgaccucucugaaugccugaucaaccaggagugugaagagauucuucagaucugcagcaccaagggaaugauggccggcgcugagaaacuggucgaaugucuccugcgcuccgauaaggagaauuggcccaaaacacugaagcucgcccuggaaaaggagagaaacaaauucucugaacuuuggauuguugagaaggggaucaaagacguggagaccgaagaucuggaggacaagauggaaacgagcgauauucaaaucuuuuaucaggaggacccugaaugccagaaucucuccgagaacagcugucccccuucugagguguccgauaccaaucuguacagcccguucaaaccccggaacuaccagcuugaacuggcgcucccugccaugaaggggaaaaauacaaucauuugcgcucccaccggcuguggcaagacauuugucucucugcugaucugcgagcaucaccucaagaaauucccucaagggcagaagggaaaagugguguuuuucgccaaccagauucccguuuaugaacaacagaaguccgucuucagcaaauacuuugagcgccauggcuauagagugaccgggaucucuggagcuacggccgagaauguuccgguggaacagauugucgagaacaaugacaucaucauucugacaccucagauccuugugaacaaucugaagaagggcaccauucccucccucagcaucuucacacugaugauuuuugacgaaugucacaacaccuccaaacaacauccuuacaacaugaucauguucaauuaucuugaucagaagcugggaggaucuagcggcccccucccccaggugaucggccugaccgcguccgucgggguuggagacgccaaaaacacagaugaggcucuggacuacauuugcaagcucugugccagccuggaugcuucugugaucgccacggugaaacacaaucuugaggaacuggagcaggucguguauaagccucaaaaguuuuuccggaaaguugaaucccgcauuagcgacaaguuuaaauacaucauugcccagcucaugagagauaccgagucucuggcuaagcggaucugcaaagaccuggaaaaccuuagccagauucagaaucgcgaguucggcacacaaaaguacgaacaguggaucgugaccguccagaaggcgugcaugguguuucagaugccggauaaagacgaggaguccagaaucuguaaggcccucuuccuguauacaucucaucugcggaaauacaacgaugcucucauuaucagcgaacacgccagaaugaaggacgcccuggacuaucuuaaagacuuuuucuccaauguucgcgcugccggguuugaugagauugaacaagaucugacccagcgguucgaggaaaagcuccaggagcuggagagcgugucuagagaccccuccaacgaaaauccuaaacuggaggaucuuugcuucauccuccaagaagaguaccaccugaaccccgagacgauuacaauccuguuugucaagacccgcgcgcucguggacgcucugaagaauuggaucgaaggaaacccuaaacuuagcuuccugaagcccggcauucucaccgggcggggaaaaacaaaucagaacaccggcaugacacugccggcccagaaguguauccuggaugccuuuaaggcuucuggcgaccauaauauucuuaucgccacguccgucgcugaugaggggauugacaucgcccagugcaaccucgugauccuguaugaauacguuggaaacgugauuaaaaugauccaaaccagaggccgcgggcgggcgagaggaagcaaguguuuccugcucacauccaaugccggcgucauugagaaagaacagaucaacauguauaaggagaaaaugaugaaugauucuauucugcgccuucagaccugggacgaggcuguguuucgggaaaagauccugcacauccagacacacgagaaauucauuagagauagccaagaaaagccuaagcccguuccugacaaagagaacaagaaacuccugugccgcaaguguaaagcccuggcuugcuacaccgccgacgugcgggucaucgaagagugucauuacacggugcuuggggaugcguuuaaggagugcuucguguccagaccccacccuaagcccaaacaguuuucuagcuucgaaaagcgggccaaaaucuuuugugcucgccagaauugcucccaugacuggggcauucacguuaaguauaaaaccuucgagauuccggucaucaagauugagagcuuugugguggaagauaucgccacaggaguccagacccucuacucuaaauggaaggacuuccauuucgaaaagaucccuuuugaucccgcugagauguccaaauga

SEQ ID NO: 68266 - RNA, 1860 nt, Artificial Sequence
  derived and/or modified sequence opt5 from DDX59__Homo_sapiens__NP_001026895
auguucgugcccagaagccugaagaucaaacggaacgccaaugacgauggcaaguccugcgucgcuaaaauuaucaagccugacccggaggaucuccagcuggacaaaucucgcgauguucccguggacgccguggcgaccgaagcugccacaauugauagacacaucagcgaguccuguccuuuucccucuccugggggacaacuugccgaaguccauagcgugucccccgagcagggcgcuaaggacucucacccuagcgaggaaccgguuaaguccuucagcaaaacgcagcggugggccgagcccggggaaccuauuugcguggucuguggacgcuacggcgaguauaucugcgauaagaccgacgaagauguguguucucuggagugcaaagcuaagcaucuccugcagguuaaagagaaggaagagaaguccaaacuuagcaacccccaaaaggccgacucugaaccugagagcccccugaaugcguccuacguguauaaagaacacccguuuauccucaaccugcaggaggaucagauugagaaucugaagcagcaacucgggauccugguccagggacaggaagugacaagaccuauuaucgacuucgagcauuguucucuucccgaagugcugaaccacaaucucaaaaaguccggcuacgaggucccuacccccauucagaugcaaaugauccccguuggccugcuugggcgggacauucuggccagcgcugauacaggauccggcaaaaccgccgcuuuucuccugccugugaucaugcgcgcccuguucgaaucuaagacaccgagcgcgcucauccugacccccacgagagagcuugccauucagaucgagcggcaggcuaaggaacugauguccgggcucccucgcaugaaaaccgugcugcuugucggaggccugccccucccuccccaacuguauagacugcagcagcacgugaagguuauuaucgccacaccggggcggcuccuggacauuaucaaacagagcucuguggagcuuugcggagucaagaucgugguuguggaugaagcugacaccaugcugaaaaugggcuuucaacagcagguccucgauauucuggagaacaucccuaaugacugucagacaauucuuguguccgccaccauccccacgagcauugaacaacuggccucucagcuccugcauaacccuguccgcaucaucacaggcgagaagaaucugcccugcgcuaacgugagacagauuauccucuggguugaggauccugcgaagaaaaagaaacuguucgaaauucuuaaugacaagaaacuguuuaagcccccggugcucgucuucguggauuguaagcugggggccgaccugcuuagcgaggcuguucagaaaaucaccggacucaaguccauuucuauccacagcgaaaaaucccaaauugagcggaagaacauccugaaaggccugcucgagggggauuacgaaguggucgugagcacaggagugcugggccgcgggcuugaccugaucucuguuagacucgucgugaauuuugacaugccuuccagcauggaugaguaugugcaucagauuggacgggucggcagacugggccagaacgggaccgccaucaccuucauuaacaauaacucuaagcgccuguuuugggacaucgccaagcgggugaaacccacaggauccauucuucccccucagcuccugaauagcccguaccugcacgaucaaaagagaaaagaacagcagaaggacaaacaaacgcagaacgaucucguuaccggcgcuaaucugauggacaucauccgcaagcacgauaaauccaacucucagaaguga

SEQ ID NO: 68267 - RNA, 1845 nt, Artificial Sequence
  derived and/or modified sequence opt5 from DDX5__Homo_sapiens__NP_004387
augagcggcuacuccucugacagagaucgggggcgcgacagaggauucggcgcuccccgguuugggggaagccgcgccggcccucuguccgggaagaaauucggaaacccgggcgagaagcucgugaaaaagaaauggaaucuggaugaacuucccaaguuugagaagaacuucuaucaggaacacccugaccuggccagacggaccgcgcaagaggucgaaacauaccgcagaucuaaagagaucacgguucggggccauaauugccccaagccugugcucaacuuuuaugaggcuaauuuccccgccaacgugauggaugucauugcccgccagaauuuuaccgaaccuacagcuauccaggcccagggguggccgguggcucugagcggacuugacaugguuggcguggcccaaaccggguccggaaaaacacugucuuaccuccugcccgcgauuguccacaucaaccaucagccuuuccuggagagaggcgaugggcccauuugucucgugcuggccccuacccgggaacuugcucagcagguucaacagguggccgcugaguauugccgcgccuguagacuuaagagcacaugcaucuacggaggcgcgcccaaaggcccgcagauccgggaccucgagcgcggggucgaaauuuguaucgccaccccuggaagacugauugauuuucuugagugcggcaagacgaaucugcggagaaccacauaucucgugcuggacgaagcugaucgcaugcuggacaugggguucgagccccagauccggaagauuguggaucaaaucagaccugaccgccagacccucaugugguccgccacauggcccaaagaaguccggcagcuggcugaggacuuucuuaaggauuacauucacaucaacaucggagcccuggagcucagcgccaaucauaacauucugcaaaucguugacgugugucacgauguggaaaaagacgagaagcugauuagacugauggaagagaucaugucugaaaaagagaauaagaccauugucuucguggagacgaaacgccggugcgaugaacucacaagaaagaugcgccgggacggcuggcccgcuauggggauccacggagauaagucccagcaggagagagacuggguucugaacgaauuuaaacauggcaaggcgccuauccugauugccaccgauguggcuagccgcggccucgacgucgaggaugugaaauucguuaucaauuacgacuauccgaacucuuccgaagacuacauucaccggaucgggagaacagcccggagcaccaagaccggaacagccuauacguucuuuacccccaacaauauuaaacaggugucugaucugaucuccguccuucgcgaggcuaaccaagccaucaauccuaagcugcuccagcugguggaggacagaggcagcgggcgguccagaggacgcggcgggaugaaggaugaccggagagaucgcuacucugcgggcaaaagaggaggcuucaacacauuucgggaccgcgaaaauuaugauagaggguacagcucccuucugaagcgggacuucggagcuaaaacccagaacggcgucuauagcgccgccaauuacacaaacgggucuuuuggauccaauuucgugagcgcuggcauucagaccucuuuucgcacggggaaccccacaggcaccuaccaaaauggauaugauagcacccagcaguacggcuccaacguuccuaauaugcauaacgggaugaaucagcaagccuaugcuuaccccgccacagcggccgcuccgaugaucggauauccuaugcccaccggcuacucucaguga

SEQ ID NO: 68268 - RNA, 5139 nt, Artificial Sequence
  derived and/or modified sequence opt5 from DDX60__Homo_sapiens__NP_060101
auggagagaaacgugcugaccacauucagccaggaaaugucccaacucauucugaaugagaugcccaaggccgaauacucuagccuuuuuaacgacuucgucgaguccgaauuuuuccugauugauggcgacucucuccugaucacgugcauuugugagaucagcuuuaagccugggcagaaucuucacuucuuuuaucugguugagcgguaccucguggaucugauuuccaaagggggccaguucaccaucguguuuuucaaggacgcugaauaugccuacuuuaacuuccccgagcugcucucucugcgcacagcgcuuauccugcaccuccagaagaauaccacaauugaugucagaaccacauuuagccggugccuguccaaagaaugggggagcuuccuugaggagucuuaucccuacuuccugaucguggcugacgaaggacucaacgaucugcaaacccagcuguuuaauuuccucauuauccacuccugggcccgcaagguuaacgugguccugagcucuggccaggaguccgacgugcuuugucuguaugccuaccuccugccuagcauguacagacaucagaucuuuucuuggaagaauaaacaaaacaucaaggaugcuuauacgacccuucugaaucagcucgaacgguucaaacuguccgcccuggcuccccucuuugggagccugaaguggaacaauauuacagaggaagcccacaaaaccguuucccuucugacacagguguggccugagggaucugacauccgcagagucuucugcgugaccagcuguucccucagccugcggauguaccaucgcuuucuuggcaacagagagcccucuuccggccaggaaacggagauccaacaggugaauagcaacugccugacacuccaggaaauggaggaucuguguaagcugcacugccucaccgucguuuuccugcuucaucugccucucucucaacgggcgugugcccgcgugauuacaagccauugggcugaagacaugaagccgcugcugcagaugaaaaaguggugcgaguauuuuauccuuagaaacauucacaccuucgaguuuuggaaucucaaccugauccaucuguccgaucucaaugacgaacugcuucugaaaaacauugccuucuacuaugagaaugaaaacgugaaggggcuccaccugaaucugggagacaccaucaugaaagauuacgaguaucuuuggaacacagucucuaagcucgugcgggacuuugaaguuggccagcccuucccucugcgcacgaccaaaguguguuuccuggagaagaagcccagcccuaucaaagauuccagcaaugagaugguccccaaccucggguuuauuccgacaucuuccuucgugguugacaaguuugcuggagauauccugaaagaccuuccuuuccucaagagcgaugaccccauugugaccucucucgucaaacagaaggaauuugaugagcuggugcacuggcauucccacaagccucugagcgacgauuacgacagaucccggugccaauucgacgaaaaaucuagagauccccgcguccuucggagcgugcagaaguaccauguuuuucagagauucuauggcaauucccucgagacagugucuagcaaaaucauugucacccagacgaucaaguccaaaaaggacuuuagcgggcccaagucuaaaaaggcccacgagacaaaagcggaaaucauugcccgcgagaacaagaaacggcuguucgcuagagaagaacaaaaggaggagcagaaguggaaugcccuguccuuuagcaucgaggaacagcucaaagagaaccugcauucuggaauuaagucccuugaagauuuccugaaaagcugcaagucuagcugugugaaacuccagguugagauggugggccugaccgcuugccugaaggccuggaaagaacacugucgcuccgaggagggcaagaccacaaaggaccuuagcaucgccguccaagugaugaaacggauucacucucucauggaaaaguacuccgagcugcugcaggaagaugacagacagcucaucgcucgcugccugaaauaucuuggguuugaugagcuggcgagcucccuccauccugcccaggacgcugaaaaugaugugaagguuaaaaagcggaacaaguacucugucggaauuggcccggccagauuccaacugcaguauauggggcacuaccugauccgcgacgagcggaaagaucccgacccuagagugcaggauuucauccccgacaccuggcaacgggagcuucuggacguggucgauaagaacgaaagcgccgugauuguugcuccuacauccucuggaaaaacguaugccagcuacuacuguauggagaaggugcucaaagaauccgacgauggcgucgugguuuauguggcgcccaccaaggcucuggucaaucagguggccgccacaguucagaaccgcuuuaccaagaaucucccgucuggggaggugcugugcggagucuucacaagagaguaccggcaugacgcucuuaacugucaggugcugaucaccgugccugccugcuuugaaauucuccugcuggcuccccacagacaaaauugggucaaaaagauccgcuauguuauuuucgaugaggugcacugucuuggcggcgaaaucggggccgagaucugggaacaucugcucgugaugauucggugcccuuuucuggcgcucagcgccacgaucuccaaccccgagcaccugaccgaguggcuucagagcgucaaaugguacuggaagcaggaagacaaaauuaucgagaauaacacagcuucuaagagacaugugggacgccaggccggcuucccuaaggauuaucugcaaguuaaacaguccuacaaggugagacucguccuguauggggaacgguacaaugaccuggagaaacacguguguagcauuaagcauggagauauccacuuugaccacuuccaucccugcgcugcccuuaccacagaucacaucgaacgcuacggcuuuccgccugaccugacccucucucccagagaguccauucagcuguaugaugcgauguuccagaucuggaaaagcuggccccgggcccaagagcucugcccugaaaacuuuauucauuucaauaacaagcugguuaucaaaaagauggacgcucgcaaguacgaggaaucucuuaaagccgagcugacguccuggauuaagaaugggaacguggaacaggcuagaaugguccugcagaaucucagcccggaggccgaccugucccccgagaacaugaucacaauguucccucuucugguggaaaaacuccggaagauggagaaacugcccgcccucuuuuuccuguuuaaacuuggcgcuguugaaaacgcggccgagagcgugucuaccuuccugaagaaaaagcaagagacaaaacgcccucccaaggcugauaaagaagcccacgucauggccaauaagcugagaaaggugaaaaagagcaucgagaaacagaagauuaucgacgaaaaaucccagaagaagacccggaacguggaucagucucucauucaugaggcugaacacgacaaucuggucaaaugucuugagaagaaccuggagaucccucaagauugcaccuaugccgaccagaaagcgguugauacagaaacgcuccagaagguguuuggacgcgugaaauucgagagaaagggcgaggaacugaaggcucucgccgaacgggggauuggauaccaccauagcgccauguccuuuaaagagaagcagcuggucgagauccuuuucagaaaaggcuaucugcgcgugguuaccgcuacagggacccuggcccucggagugaauaugcccuguaagucugucguguuugcgcaaaacagcguuuaccuggacgcucuuaauuaucggcagauguccggcagagccgggcgccggggccaggaucugaugggagacguguacuucuuugauauuccguucccuaaaaucggcaagcucaucaaaucuaacguccccgaacugagagggcacuuuccucucagcauuacacuggugcuucgccugaugcugcucgccuccaagggagacgaccccgaggaugcuaaggccaaaguccugagcgugcuuaagcauucucugcucuccuucaaacagccgcggguuauggacaugcugaagcuguacuuccucuuuagccuucaauuccuggugaaagaaggcuaucuggaucaggaggggaauccuaugggauuugcuggccucgucucucaucugcacuaccacgaacccuccaaccuuguguucguuagcuuucuggugaauggacuguuccacgaccugugccagccuaccagaaagggcuccaagcauuuuucucaggaugucauggagaaacuggugcucgugcuugcccaccuguucggacgccgguauuuuccgcccaaguuccaagacgcgcauuuugaguucuaccagagcaaaguuuuucuggaugaccucccugaagauuucuccgacgcccuggaugaguauaacaugaagaucauggaagacuucacgacauuucuuagaauugucagcaaacuggcugauaugaaucaggaguaccaacucccgcugucuaagaucaaguucaccggcaaagagugugaagacucccagcuggugagccaccucaugucuugcaaggaggggcggguggccauuagccccuuugucugucuuuccggaaacuucgacgaugaccugcugcgccucgaaaccccuaaucacgugacacugggcaccaucgggguuaacagaucucaggcucccgugcuucugagccagaaauuugauaaccggggacgcaagaugucccucaaugccuaugcccuggacuucuacaaacauggcucucugaucgggcucguccaagauaacagaaugaaugagggcgacgcuuacuaucuucugaaggauuuugcgcugacaauuaagagcaucuccgugagccuccgggaacugugcgagaacgaggacgauaauguugugcuugccuucgaacagcugucuacgaccuuuugggagaaacucaacaaggucuga

SEQ ID NO: 68269 - RNA, 1452 nt, Artificial Sequence
  derived and/or modified sequence opt5 from DDX6__Homo_sapiens__NP_004388
augagcaccgccagaacagagaaccccgugaucaugggccuguccucucagaaugggcaacuccggggaccugucaagccgacgggcgggcccggaggcgggggaacccagacacagcagcaaaugaaccagcugaaaaauaccaacacaauuaauaacggcacccagcagcaagcucagagcaugacaaccacgaucaagccuggcgacgauuggaaaaagacccuuaaacugcccccuaaggaccuccgcauuaagacauccgauguuaccucuacaaaagggaaugaguucgaggacuacugccugaagagagaacuucugaugggaaucuuugagaugggcugggaaaaacccagcccuauucaggaggaguccaucccgaucgcccucucugggcgggauauucuggcgcgcgcuaagaacggaaccggcaaaagcggggccuaucugaucccccuccuggaaagacuugaccugaagaaggauaauauucaggccauggugaucgugccuacgcgggagcucgcucugcaagucucccagauuuguauccaggugagcaaacacaugggaggcgccaagguuauggcuacaaccggcgggacaaaccuucgcgacgauauuaugagacuggacgauaccgugcaugucgugaucgccacccccggacggauccucgaccugauuaaaaagggcguugcgaaaguggaucacguccaaaugaucgugcuggacgaagccgacaagcuccugucucaggauuucgugcagauuauggaggacaucauucuuacacugccuaaaaaucgccagauccuccuguacuccgcuacguuuccccuuagcguccaaaaguucaugaacucucaucugcagaagccguaugagaucaaucucauggaagaacugacccugaaagggguuacacaguacuaugccuacgugaccgaaagacagaaggugcacugccucaacacacuguuuucccggcuucaaauuaaucagagcaucauuuucuguaacucuucccagcgcgucgagcugcucgcuaaaaagaucagccagcugggauauuccugcuuuuacauucaugccaaaaugagacaagaacaccggaaccgcguguuccacgauuuuagaaauggccuuugucggaaccugguuugcaccgaccucuucacgagagggaucgauauccaggcggugaaugucgugauuaacuuugacuucccuaagcuggccgagacauaccugcaucgcaucggacggucuggcagauuuggccaccucgggcuggcuauuaaucuuaucaccuaugaugaccgcuucaaccucaagagcauugaggaacagcugggaaccgagaucaaacccauuccuuccaauaucgauaagagccuguacguugccgaauaucauucugagcccguggaagacgagaaacccuga

SEQ ID NO: 68270 - RNA, 1473 nt, Artificial Sequence
  derived and/or modified sequence opt5 from DEAF1__Homo_sapiens__NP_001280563
auggaggacagcgauuccgccgcuaagcagcugggccucgccgaagcggcugccguggccgcugccgcugccgucgcggccgcugccgcugccgcggccgggggagaggcugaggaacccguucugucuagagacgaagauagcgaggaggacgccgauuccgaagcugagcgggaaaccccucgcgugacagccguggccgucauggcugcggagccgggccacauggacaugggggccgaggcccuucccggaccugaugaagcugccgcugccgcggcuuucgccgaggugacgaccguuacaguggccaacgucggcgcugccgcugacaauguguuuaccacaucuguugccaacgcggccagcaucuccgggcaugugcugucuggaagaaccgcucuccaaauuggcgauagccugaauacagaaaaagccacccuuaucgucgugcacacggacggcuccauuguggagaccacagggcugaagggacccgcugccccucucacccccggcccucagagcccgcccacaccucuggcgcccgggcaggaaaaaggaggcaccaaguacaacugggauccuucugucuaugacuccgagcugcccguucggugccgcaauaucagcgggacgcucuacaaaaacagacugggaucuggcugggaucuuaagccgucccggugucugcuccaucugugcugucuucugcgcagacacgaccucauuacagugaccccuagcggccagaucacaaccucuggggcccugaccuucgaccgggcuuccacaguggaggccacggcugucaucagcgaaucccccgcccaaggagauguguuugccggcgcuaccguucaggaggcgucugugcagccucccugccgcgccagccaucccgaaccucacuauccgggguaccaggacuccugucaaauugcucccuucccugaggccgcccugcccacaagccacccuaagaucguccucaccucucugcccgcucuugccgugccgccucccacaccuaccaaagcggcucccccugcccugguuaauggacucgaacuguccgagcccagaagcuggcuuuaucuggaggaaauggugaacucucuccugaauacggcccagcagcugaagacacucuuugagcaggcuaaacaugccagcaccuaccgggaagcggcuaccaaccaagccaagauucacgccgaugcugagcgcaaagaagucauccauccgccuagacugcccaaggugcuuggccugcagcaguccugcgucaauugugggcgggaggccaugucugagugcacaggaugucacaaggugaacuauugcagcaccuucugucaacgcaaagacuggaaggaucaccagcauauuugcggccaguccgcugccguuacagugcaggcggacgaaguccacguggccgagagcguuauggaaaaagugacggucuga

SEQ ID NO: 68271 - RNA, 213 nt, Artificial Sequence
  derived and/or modified sequence opt5 from DEC1__Homo_sapiens__XP_011517055
augaccaugaacgugcuggaggccggcaaguggaaaagcaucguccccgcuccuggggaaggacuccuggccguucuucacaugaugguguucacagacgcgcugcauagagagcgguccgugaaguggcaggcuggcgucugcuacaaugggggaaaagauuuugccgugucucucgcccgcccgaaggcugccgaaggcauugcugacuga

SEQ ID NO: 68272 - RNA, 1008 nt, Artificial Sequence
  derived and/or modified sequence opt5 from DECR1__Homo_sapiens__NP_001350
augaagcugcccgccagaguguucuuuacccucggcagccggcugccuugcgggcuugcuccgcgcagauucuuuuccuacggaacaaaaauccuguaucagaacacggaggcccuccaaucuaaguucuuuagcccccugcagaaagcgaugcuuccucccaauuccuuccagggcaaggucgcuuuuauuaccgggggaggcacagggcugggaaaaggcaugaccacacuccugucuagccugggcgcccaguguguuaucgccucccggaagauggacgugcucaaggcuaccgccgaacaaauuucuagccagacagggaacaaagugcacgcuauccagugcgauguccgcgacccugauauggugcagaauaccguuuccgagcugauuaagguggccggacaucccaacaucgucaucaauaacgcggccggcaauuucauuagcccuacggaaagacuuucuccgaacgcuuggaaaaccaucacagacauugugcugaaugggaccgccuuuguuacacucgagaucggaaagcaacugauuaaagcucagaagggcgccgcguuccuuuccaucaccacgauuuacgccgaaacagggagcggauuugugguccccucugcuuccgccaaggcuggcguggaggccaugagcaaaucucuggccgcugaguggggcaaguaugggaugcgguucaacgugauccagccuggacccaucaaaaccaagggcgcguuuucccgccucgauccuacagggaccuucgaaaaagagaugauuggaagaauccccuguggccggcuggggaccgucgaggaacuggccaaucucgcugccuuccugugcagcgacuacgccuccuggauuaacggagcuguuaucaaguuugauggcggcgaggaagugcuuauuucuggggaguucaaugaccugcgcaaagugacaaaggaacagugggauacgaucgaggaacucaucagaaagaccaaaggaagcuga

SEQ ID NO: 68273 - RNA, 957 nt, Artificial Sequence
  derived and/or modified sequence opt5 from DEDD__Homo_sapiens__NP_001034801
auggccggccugaagagacgggcuagccagguguggcccgaggaacacggggagcaagaacauggacucuacucccugcaccgcauguucgacaucgucggcacccaucuuacacacagagauguucgggugcugucuuuucucuucguggacgucauugaugaccaugagcgcgggcugaucagaaacggacgggauuuucuucuggcccucgaacgccagggcagaugcgacgagagcaauuuccgccaggugcugcagcugcuccggauuaucacgagacacgaucugcuuccuuauguuacccugaaacggcgcagagcgguguguccggaccucgucgauaaguaccuggaggaaacauccauucgguaugugacaccccgcgcucuuucugacccugagcccagaccuccccaaccuagcaaaaccguuccgccccacuacccuguggucugcugucccaccuccgggccucagaugugcucuaagcggcccgccagaggacgcgccacacugggcagccagcggaaaagacgcaaguccgugaccccggauccuaaggaaaaacagacgugugacauccggcucagagugcgcgcugaguauugccaacaugagaccgcccugcagggcaacgucuuuagcaauaagcaggauccccuggaacggcaguucgagagauuuaaccaagcuaauacaauccucaaaucucgcgaccugggguccauuaucugugacauuaaguucagcgaacuuaccuaccuggaugccuuuuggcgggacuauaucaacggaucucuccuggaggcgcuuaaaggcguuuucauuacagauucccugaagcaggccguggggcacgaagcuaucaagcuccuggugaaugucgacgaggaggauuacgaacugggaagacagaaacuccugcgcaaccuuaugcugcaagcccucccuuga

SEQ ID NO: 68274 - RNA, 1896 nt, Artificial Sequence
  derived and/or modified sequence opt5 from DEF6__Homo_sapiens__NP_071330
auggcccugagaaaggagcuccugaaaagcaucugguacgcuuucaccgcccuugacguggaaaaguccggcaaagucucuaagagccagcugaaaguucucucccacaaccuguauacagugcuucauauuccccacgauccuguggcgcuggaggaacauuuucgggacgaugacgaugggccggucucuagccaaggauacaugcccuaucucaauaaguacauccuggacaagguggaggaaggcgcuuucguuaaagagcacuuugaugagcugugcuggacgcucaccgccaagaaaaacuaucgcgccgacuccaaugggaacucuaugcugagcaaucaggaugcuuucagacuuuggugucuguuuaacuuccucuccgaagacaaguacccucugauuauggugcccgaugaggucgaauaucuucugaaaaaggugcucagcucuaugucccuggagguuagccugggagagcucgaagaacugcuugcccaggaagcucagguggcccaaacaaccggcgggcugucugucuggcaguuucucgagcuguucaauuccggacggugccuucgcggcgugggcagagacacacugagcauggcgauccaugaaguguaccaggagcucauucaggauguccugaagcaaggguaccuguggaaacggggacaccuccgcagaaacugggccgagcggugguuucagcugcagccuucuugucuuugcuauuucggcuccgaagaguguaaggaaaaacgcgggaucaucccccuggacgcucacugcuguguugaggugcucccugacagagauggaaagcggugcauguuuugugugaaaaccgccaaucgcacauacgaaaugagcgcuuccgacaccagacagcggcaagaguggacggccgcgauucagauggccauccgccugcaggcugagggcaagaccucucuucauaaagaucugaagcaaaagagacgggaacagagagagcagcgcgaacggagacgcgccgcuaaagaggaggagcuccugcggcugcagcaacuccaggaggaaaaggagagaaaacugcaggaacuugagcugcuccaggaggcccaacgccaggccgaacggcugcugcaggaggaagaggaaagacgccggagccagcacagagagcuucaacaggcucucgaggggcagcugcgcgaagcggagcaggcccgggcuuccaugcaagccgaaauggagcugaaggaagaggaggccgcuagacagcggcagcgcauuaaagaacucgaggaaaugcaacagagacugcaggaggcccuucagcuggaagucaaggcgcggagagacgaggagagcgugcgcaucgcucaaacacggcuccuggaagaggaagaggagaagcugaaacagcuuaugcagcucaaggaggaacaggaaagauauauugagcgcgcccaacaggaaaaagaggagcugcagcaggaaauggcccaacagucuagaucccugcagcaagcucagcagcagcucgaggaaguucggcaaaaccgccagagagccgaugaggacguggaagcugcccagcggaagcugcgccaggcgagcaccaaugucaaacauuggaacgugcaaaugaauagacuuaugcacccgaucgagcccggagauaagcggccuguuacaucuagcuccuucucuggcuuucagcccccucugcucgcccaccgcgacagcucccugaagagacugacccgguggggcagccaggggaaccgcacgcccucuccgaauagcaacgagcagcaaaaaucccuuaacggaggcgaugaagcuccugcccccgcuucuacaccucaggaggacaagcucgaucccgcccccgaaaauuga

SEQ ID NO: 68275 - RNA, 285 nt, Artificial Sequence
  derived and/or modified sequence opt5 from DEFA1B__Homo_sapiens__NP_001035965
augagaacccuggccauccucgcugccauucugcuuguggcgcugcaggcucaagccgagccccuccaggcccgggcugacgaagucgccgcugccccugagcagaucgcggccgauauuccggaaguuguggugagccuggcuugggacgagucccuugcccccaagcacccuggcucucgcaaaaacauggcuugcuacuguagaauccccgccugcauugcgggggaacggcgcuauggaacauguaucuaccagggcagacugugggccuucugcuguuga

SEQ ID NO: 68276 - RNA, 285 nt, Artificial Sequence
  derived and/or modified sequence opt5 from DEFA3__Homo_sapiens__NP_005208
augagaacccuggccauccucgcugccauucugcuuguggcgcugcaggcucaagccgagccccuccaggcccgggcugacgaagucgccgcugccccugagcagaucgcggccgauauuccggaaguuguggugagccuggcuugggacgagucccuugcccccaagcacccuggcucucgcaaaaacauggauugcuacuguagaauccccgcuugcauugccggggaacggcgcuauggaacauguaucuaccagggcagacugugggcguucugcuguuga

SEQ ID NO: 68277 - RNA, 294 nt, Artificial Sequence
  derived and/or modified sequence opt5 from DEFA4__Homo_sapiens__NP_001916
augagaaucauugcccugcucgcugccauccugcuuguggcgcugcagguccgggcuggcccccuccaagcccgcggggacgaggccccuggacaggaacagagaggcccggaggaucaggacauuagcaucuccuucgcuugggauaagucuagcgcccugcaaguuuccgggucuacccggggaauggugugcagcugucgccuuguguuuugcagacggacagaacugcgcgucggcaacugucucauugggggaguguccuucacguacugcuguaccagaguugacuga

SEQ ID NO: 68278 - RNA, 285 nt, Artificial Sequence
  derived and/or modified sequence opt5 from DEFA5__Homo_sapiens__NP_066290
augagaaccaucgccauucuggcugccauccuccugguggcgcuucaggcucaagccgagagccugcaggaacgggccgacgaggcuacaacgcagaagcaguccggcgaagauaaccaagaccucgccauuucuuucgcugggaauggacugagcgcccuucgcaccuccggcucucaggcgagagccacaugcuacugucggaccgggcgcugcgcuacaagagagagccuguccggagucugugaaaucucuggccggcucuaucgccugugcuguagauga

SEQ ID NO: 68279 - RNA, 303 nt, Artificial Sequence
  derived and/or modified sequence opt5 from DEFA6__Homo_sapiens__NP_001917
augagaacccugacaauccucacggccgugcugcuugucgcucugcaggccaaggcggagccccuccaagcugaagacgauccucugcaggccaaagccuacgaggcugacgcccaggaacagcggggcgcuaacgaucaagacuucgccguuagcuuugcggaggaugccuccucuagccuucgcgcucugggguccaccagagccuucacaugccacugucggcgcucuugcuauagcaccgaauacuccuauggaacauguaccgugaugggcauuaaucauagauuuugcugucucuga

SEQ ID NO: 68280 - RNA, 204 nt, Artificial Sequence
  derived and/or modified sequence opt5 from DEFB103B__Homo_sapiens__NP_061131
augagaauccacuaccuccuguucgcccugcuuuuucuguuccucgugcccgucccuggccaugggggaauuaucaacacccugcagaaguauuacugccggguucgcggcgggagaugugcugugcuuagcugccugccgaaagaggaacaaauuggaaaguguuccacacggggccgcaaaugcuguagacggaagaaauga

SEQ ID NO: 68281 - RNA, 219 nt, Artificial Sequence
  derived and/or modified sequence opt5 from DEFB104B__Homo_sapiens__NP_001035792
augcagagacuggugcuccugcuugccaucagccugcuccuguaccaagaccuucccguccgguccgaguucgaacuggaucgcauuugcggcuaugggaccgcuagaugucggaagaaaugccgcucucaggaguacagaaucggacgguguccuaacacauaugccugcugucuccgcaagugggacgaaagccugcugaauagaacgaaaccguga

SEQ ID NO: 68282 - RNA, 237 nt, Artificial Sequence
  derived and/or modified sequence opt5 from DEFB105A__Homo_sapiens__NP_689463
auggcccugaucagaaagaccuucuacuuucucuucgcuauguuuuucauucuggugcagcuucccagcggcugccaagccgggcuggacuuuucccagccuuucccgucuggagaguuugcggucugugaaagcugcaaacucggccgggggaagugucgcaaagagugccuggaaaacgagaagcccgauggaaauuguagacuuaacuuccugugcugucggcagcgcaucuga

SEQ ID NO: 68283 - RNA, 198 nt, Artificial Sequence
  derived and/or modified sequence opt5 from DEFB106A__Homo_sapiens__NP_689464
augagaaccuuccuguuucucuucgccgugcuguuuuuccuuacacccgcuaagaacgccuuuuucgacgagaaaugcaauaagcugaaaggcacguguaagaacaauugcgggaaaaacgaggaacucaucgcgcugugucaaaagagccuuaagugcugucggaccauucagccuugcggauccaucauugauuga

SEQ ID NO: 68284 - RNA, 222 nt, Artificial Sequence
  derived and/or modified sequence opt5 from DEFB108B__Homo_sapiens__NP_001002035
augagaaucgccgugcugcuguucgcuaucuuuuucuuuaugagccagguccugcccgcccggggcaaguucaaagagauuugcgaacgcccuaacggguccuguagagacuuuugccuugagaccgaaauucacguuggacggugucucaauucucaaccgugcugucucccccugggccaucagccucgcaucgagagcacaacgcccaagaaagauuga

SEQ ID NO: 68285 - RNA, 342 nt, Artificial Sequence
  derived and/or modified sequence opt5 from DEFB112__Homo_sapiens__NP_001032587
augaagcugcucaccacaaucugcagacugaaacuugagaagauguacagcaaaacgaacaccuccucuacaauuuucgaaaaggcccggcacggcaccgagaaaaucagcacagcucgcuccgaagggcaucacauuaccuuuucuagauggaaaagcuguacagccaucggaggccggugcaagaaucagugugacgauuccgaguuccgcauuucuuauugcgcgagacccaccacgcauuguugcgugaccgaaugugacccuacagauccgaacaauuggauccccaaggacagcgucgggacccaagagugguacccuaaggauucccggcacuga

SEQ ID NO: 68286 - RNA, 471 nt, Artificial Sequence
  derived and/or modified sequence opt5 from DEFB125__Homo_sapiens__NP_697020
augaacauccugaugcucaccuucauuaucugcggccugcuuacaagagugacgaaggggagcuuugagccccagaaauguuggaagaauaacgucggacacugccggcgcagaugucuggacaccgaacgguacauucuccugugccgcaauaaacuuuccuguugcaucucuauuaucagccaugaguauacaagacggccugccuucccgguuauccaccuggaagauauuacccucgacuacuccgauguggacucuuuuacaggcagccccguguccaugcugaacgaucugaucaccuucgacacaaccaaguuuggggagacgaugaccccugaaacaaauacccccgagacaaccaugccucccucugaggcuacgacaccugaaaccacaaugccgcccagcgagaccgccaccuccgaaacaaugccucccccuagccaaacggcgcucacccauaacuga

SEQ ID NO: 68287 - RNA, 336 nt, Artificial Sequence
  derived and/or modified sequence opt5 from DEFB126__Homo_sapiens__NP_112193
augaaaagccuccuguucacccuggccguguuuaugcuucuggcucagcucgucuccggcaacugguacguuaagaagugccugaaugacguggggaucuguaaaaagaaaugcaagcccgaggaaaugcacgugaagaacggaugggccauguguggcaaacaaagagauugcugugucccugcggaccggcgcgcuaauuauccgguguucugcguucagacaaagacgaccagaauuucuacagugaccgccacaaccgccacaaccacgcuuaugaugaccacagcuagcauguccucuauggcccccaccccugucagccccacaggguga

SEQ ID NO: 68288 - RNA, 207 nt, Artificial Sequence
  derived and/or modified sequence opt5 from DEFB1__Homo_sapiens__NP_005209
augagaaccagcuaccugcuccuguucacacuuugccugcuccuguccgagauggccucuggcgggaacuuucuuacgggacugggccaccggagcgaccauuauaauuguguguccucugggggacagugccucuacagcgcuugucccaucuucaccaagauucaaggcacaugcuaucgcgggaaagccaaguguugcaaauga

SEQ ID NO: 68289 - RNA, 195 nt, Artificial Sequence
  derived and/or modified sequence opt5 from DEFB4A__Homo_sapiens__NP_004933
augagagugcuguaccuccuguucagcuuucuuuucaucuuucugaugccccucccuggcgucuucgggggaauuggcgacccgguuaccugccugaaguccggggccaucugucaccccguguuuugcccucggcgcuauaaacagauuggaacauguggccuucccgggacgaagugcuguaaaaagccuuga

SEQ ID NO: 68290 - RNA, 972 nt, Artificial Sequence
  derived and/or modified sequence opt5 from DEGS1__Homo_sapiens__NP_003667
augggcagcagagugucccgggaggacuucgaaugggucuacaccgaucagccccacgccgaccgcagacgggagauccuggcuaaguauccugaaauuaaaucucucaugaagccggaucccaaccugaucuggauuaucauuaugaugguucuuacacaacugggggccuuuuacaucgugaaagaccucgauuggaagugggugaucuucggagcguaugcuuuuggcagcugcauuaaucauuccaugacgcuggccauccacgagauugcccauaacgcugccuucgggaauuguaaagcuauguggaaccgcugguuuggaauguucgccaaucuuccuaucggcauucccuacucuaucagcuuuaagagauaucacauggaccaucaccgguaccugggggcggauggagucgacguggauauuccuaccgacuucgaaggcugguuuuucugcacagccuuucgcaaguucaucuggguuauccuccagccccuguuuuaugcuuucagaccucuguucauuaacccgaaacccaucaccuaccucgaggugauuaauacagucgcccaggugaccuuugauauccugauuuacuauuuccuuggcaucaagucccugguuuacaugcucgcugccucucugcuugggcugggacuccacccuaucagcggccauuuuauugcggagcacuauauguuccugaaagggcaugaaacauacuccuauuacggaccccugaaccuccugaccuuuaaugugggcuaucacaacgagcaccaugacuucccuaauauccccggaaagagccuuccgcugguccggaaaauugccgcugaauacuacgauaaccucccucacuauaauucuuggaucaaggugcuguacgacuuugugauggacgauacgauuucccccuauagccgcaugaagagacaucagaaaggggagaugguccuugaguga

SEQ ID NO: 68291 - RNA, 972 nt, Artificial Sequence
  derived and/or modified sequence opt5 from DEGS2__Homo_sapiens__NP_996801
augggcaacagcgccuccagaucugacuucgaguggguguacaccgaucagccccacacacaacggcgcaaggaaauccuggcuaaauauccugccauuaaggcgcucaugagaccggacccccggcugaaaugggcuguccuuguucuggugcucgugcagaugcuggccugcuggcuuguccgcgggcuggccuggagauggcuccuguuuugggcuuacgccuucggaggcugugugaaucauagccugacgcucgcuauccacgauauuucccauaacgccgcguuugggaccggacgggccgcucgcaauagauggcuggccguuuucgcuaaccuuccugugggcguccccuaugccgcgucuuuuaagaaauaccacguggaccaucaccgguaucuugggggagauggccucgacguugaugugccuacacgccuggagggcugguucuuuugcacccccgccagaaagcugcuguggcucguccugcagccuuucuuuuacagccugcggccgcucugugugcaccccaaggcugugacacgcauggaaguccugaauacccuuguucagcuggccgcugaccucgccaucuucgcccugugggggcuuaaaccugugguguaucugcucgcuuccucuuuucugggacugggccuccaucccauuagcgggcacuucgucgcggagcauuacauguuucugaagggacacgaaacauacuccuauuacggcccucuuaacuggaucaccuucaaugugggguaucacguugagcaucacgauuuccccagcaucccgggauacaaccugccucucgugagaaaaauugcccccgaguauuacgaccaucugccucaacaccauucuugggucaaggugcuuugggauuuuguuuucgaagacucccugggccccuaugcucgggugaaacgcgucuacagacucgccaaggauggccuguga

SEQ ID NO: 68292 - RNA, 1026 nt, Artificial Sequence
  derived and/or modified sequence opt5 from DEK__Homo_sapiens__NP_001128181
augagcgccuccgcucccgccgcggagggcgaagggaccccuacacagccggcuucugagaaggaacccgagaugccuggacccagagaagagagcgaggaagaggaagacgaggaugacgaggaagaggaagaggaagagaaaggcaaggggcaaaaacugugcgagaucgaacggauucacuucuuucucuccaagaaaaagacggaugagcugcgcaaccuucauaagcugcucuacaauagaccuggaaccgugucuagccugaaaaagaacgucggccaguucuccggguuucccuucgaaaaaggaucuguucaguauaagaaaaaggaggaaaugcuuaagaaauuucggaaugccaugcucaagagcaucugugaggugcuggaccuggagcgcuccggcgugaacagcgaacuggucaaacggauucucaauuuccugaugcacccuaagccgucuggcaaaccccuuccuaaguccaaaaagacaugcagcaaggggucuaaaaaggagagaaacuccagcggaauggcccgcaaagcuaagagaaccaaaugucccgaaauccugucugaugaguccagcuccgacgaagaugagaagaagaauaaagaggaaucuagcgacgaugaggacaaggaauccgaggaggaaccucccaaaaagacagccaaacgggagaagccgaagcagaaagcuaccagcaagucuaaaaaguccgugaaaagcgccaacguuaagaaggcggauucuagcacaaccaaaaagaaucaaaacuccucuaaaaaggaaagcgaguccgaagacagcucugaugacgagccucucauuaaaaagcugaaaaagcccccuacggacgaggaacuuaaggagaccaucaaaaagcugcucgccuccgcuaaucuggaagaggugacaaugaaacagaucugcaagaaagucuacgaaaacuaucccaccuacgaucugacagagcgcaaggacuuuauuaagaccacggugaaagagcucaucagcuga

SEQ ID NO: 68293 - RNA, 3030 nt, Artificial Sequence
  derived and/or modified sequence opt5 from DENND1A__Homo_sapiens__NP_065997
augggcagcagaaucaagcagaaccccgagaccacauucgaaguguacgucgagguugccuauccucggaccgggggaacgcuguccgacccggaagugcaacgccaguuucccgaggauuacucugaccaggaagugcuccagacacugaccaaauucugcuuuccuuucuaugucgauagccuuacagugucccaaguuggccagaauuuuaccuucgugcugacagacauugauucuaagcagagauuuggguucugucggcucagcuccggagcuaaaucuugcuuuuguauccugagcuaccuucccugguucgaggucuuuuauaagcugcucaacauucuggccgacuacaccacgaaacgccaggagaaucaauggaacgaacugcucgagacccugcacaaacuuccuauccccgauccuggcguguccguucaucugagcgugcacucuuauuucacagucccggacaccagagaacuccccuccauuccugagaaucggaaccugacagaguacuuuguggcgguggaugucaauaacaugcuucaucuguacgcuagcaugcucuaugaacgcagaauccugaucauuugcucuaagcuguccacccucacggccuguauccacgggagcgccgcuaugcuguaccccauguauuggcagcauguuuacauuccugugcuucccccgcaucugcucgacuauugcugugccccuaugcccuaccugaucggcauucaccuuucucugauggagaaggugcggaauauggcucucgaugacgucgugauccugaacguugauacaaauacccuggaaacaccuuucgacgaccuccagucccugcccaacgaugugauuagcucccuuaagaaucgccugaaaaaggucucuaccaccacaggcgacggcguggccagagcguuccucaaagcccaggcugccuuuuucgggagcuaucggaacgcucugaagaucgagcccgaggaaccuaucacguuuugcgaggaagccuucguuucccacuaccgcagcggagcgaugagacaauuucuucagaaugccacccagcugcaacucuucaagcaguuuauugauggccggcuggaccugcucaacucuggggagggauucuccgauguguuugaagaggaaaucaacaugggcgaguacgcugggagcgacaaacuguaucaccaguggcuuucuacaguccgcaagggaagcggcgccauucugaauaccgugaaaacaaaggcuaacccggccaugaaaaccgucuacaaguucgccaaagaucaugcuaagaugggcaucaaggaggugaaaaauagacucaagcagaaagacauugcggaaaacgggugugcccccacgccugaggaacaacugcccaagacagcuccuucuccccugguugaggccaaagauccgaaacuucgggaagacagacgcccuaucaccgugcacuuuggacagguccggcccccuagaccccacgugguuaagcgcccuaaguccaauaucgccguggagggccggagaaccagcguccccuccccggagcagccucagcccuaucgcacacuccgggaaagcgauucugcugagggggacgaagccgagucccccgagcaacaggugagaaagagcaccggaccugugccggcgcccccugaccgcgcugccucuauugaucugcuggaagacguuuucuccaaccucgauauggaggccgcucugcagccccuuggccaggccaaaagccuggaagaccuccgggcuccuaaggaucugagagagcaacccgggacauuugacuaccagcgccuggaucuuggaggcuccgaacggucuagaggcgucacgguggcccucaaacugacccauccuuauaauaagcuguggagccucgggcaggacgauauggcgauccccuccaagccgccugccgcuucucccgagaaaccuagcgcccugcuuggaaacucccuggcucucccccggcgcccgcagaauagagacagcauucugaacccuucugauaaggaggaagugcccacaccuacccugggcuccaucacaauuccccggccccaagggagaaaaaccccugagcuuggaaucgucccgcccccucccaucccucgccccgccaagcuccaggcggccggcgcugcccugggggacgugagcgaacggcugcagacggauagagaccgcagagcugcccucucuccuggccugcuuccgggaguugugccccaaggcccuaccgagcugcuccagccccuguccccugggcccggagccgcuggcacaagcucugacgcgcugcuugcccuccuggauccgcugagcaccgcuugguccgggagcacacucccuucucggcccgccacccccaaugucgccacgccuuucacaccccaguucuccuuuccuccggcuggaacccccacaccuuucccccagccuccccugaacccguuugugccuagcaugcccgccgcgccucccacccuuccucugguuuccacccccgcuggcccguucggggccccucccgccucucucggccccgcuuuugccagcggacugcugcuuuccucugcgggcuucugcgcuccucaccgcagccaaccgaaucuguccgcccucucuaugcccaaccuguuugggcagaugccuaugggaacacauacgagcccccuccagccucugggacccccugccguggcuccgucccggauuagaacccuuccccuggcccgcagcucugcuagagccgcggaaacaaaacaggggcucgcccugcggccuggagaucccccucugcuucccccgcgcccuccccaaggccuggagcccacccuccagccuuccgcuccccagcaggccagagacccuuucgaggaccugcuccaaaagacaaagcaggaugucagcccgucucccgcucuggccccugcccccgacuccguggaacagcuucggaaacaaugggagaccuuugaauga

SEQ ID NO: 68294 - RNA, 1191 nt, Artificial Sequence
  derived and/or modified sequence opt5 from DENND1B__Homo_sapiens__NP_001287787
auggccgcugcccccagagaggaaaagcgguggccucagccgguguucagcaaccccgucguucuguggaaauuuccugaggacuucggcgaucaagaaauccuccaguccgugcccaaguuuugcuucccuuuugacguggagcgcgucucucagaaucagguggggcaacacuucaccuuuguucugacagauauugaaagcaaacagagauucggauuuugucggcuuacguccggcgggaccaucugccuguguauucucucuuaccugcccugguucgagguguauuacaagcuccugaacacacucgcggacuaucuggcuaaagagcuggaaaaugaucucaacgagacccugcgcagccuuuacaaucauccugucccgaaggccaacacacccgugaaucuguccguucacucuuauuuuaucgccccugacgugaccggacuccccacaauuccugaaagcagaaaccugaccgaguacuucgucgcuguggaugugaauaacaugcuucagcuguaugccuccaugcuccaugagcggcgcaucgucaucauuagcucuaagcuguccacgcugaccgcuugcauccacggcagcgccgcgcuccuguaccccauguacuggcagcauauuuauaucccgguucuuccuccccaccuucucgacuacuguugcgccccuaugcccuaucugauugggauccacucuucccuuauugaaagagugaaaaauaagagccuggaggauguggucaugcucaacguggacacaaauacccuggaaucucccuuuuccgaucugaacaaucucccuagcgacguuguguccgcucugaaaaacaagcugaaaaagcaaucuacagccaccggagauggcgucgcucgggccuuccugcgcgcgcaggccgcucucuucggcagcuacagagacgcccugcgguauaagccgggggagcccaucacguuuugugaagaguccuucgugaaacaucgcagcucuguuaugaagcaguuucuugagacagcuaucaaccugcagcuuuucaaacaauuuauugacggaagacuggccaagcugaaugccggccggggguucuccgauguguuugaagaggaaaucaccagcggaggcuucugcgggggaaaagacaagcuccaguacgauuauccuuuuucucaguga

SEQ ID NO: 68295 - RNA, 3030 nt, Artificial Sequence
  derived and/or modified sequence opt5 from DENND2A__Homo_sapiens__NP_056504
auggacauguucagccuggauaugaucauuuccgaccccgccgcugaggccucuagagcgggcaagaaacagcucagaggggugcaaaacccuugcccgagcgcucgcgccagaccccggcacaagucccugaauaucaaagauaagauuucugaaugggagggcaaaaaggaagucccuacccccgccccuagccgcagagcugacggacaggaggauuaccuucccuccucuacaguugaacggcgcagcuccgacggggugagaacccaggugacggaggccaagaacggaaugcggccuggcacagagagcaccgaaaaagagcgcaauaagggggcugucaacgugggaggccaggauccggaacccggccaagaccugucucagccugagagagagguugaucccuccugggggcggggacgcgaaccuagacucggcaaacugcgguuucagaaugacccccuuagcgugcugaagcaggucaaaaagcucgagcaagcccugaaggaugggucugcgggacuggacccgcagcucccuggcacauguuauagcccccauugcccucccgauaaagccgaagcugggagcacccugcccgagaaccuuggaggcggcucuggguccgaagugagccagcgcguucacccuuccgaccuggagggaagagagccgacacccgaacucguggaggaccggaagggcucuuguagacgcccuugggaucggagccuggaaaaugucuacagaggguccgagggaagccccaccaaaccuuucaucaacccccuuccgaagccucgccggacguuuaaacaugccggcgaaggggacaaggauggaaaacccggcauuggcuucagaaaggagaagcgcaaucugccuccccucccuucucugcccccgccuccccugcccuccagcccuccgcccucuagcgugaaccggagacucuggaccgggcgccagaaauccucugcugaccaccggaaguccuaugaguuugaagaucugcuucaauccagcucugaguccagcagaguggacugguacgcccagacaaaacugggacucacccgcacacugucugaagagaaugucuaugaagauauccuugacccucccaugaaggagaacccuuacgaggauaucgaacugcauggccggugccucgggaaaaaguguguucugaauuuccccgcguccccuaccagcuccauucccgacacgcugacaaagcagucucucagcaaaccggccuuuuucagacaaaacuccgagcggcgcaauuuuaagcugcuugauaccagaaaacugucucgggacggaacaggcagcccuuccaagaucucucccccuucuacccccuccagcccggacgauauuuucuuuaaccucggggacccucagaacggccggaaaaagcgcaagauccccaaacuggugcuucggauuaaugcuaucuaugaagugagacgcggaaagaaaagagucaagcggcugucucaguccauggagagcaacucuggcaaagugaccgaugagaauagcgaauccgacagcgauacagaggaaaagcucaaggcccacucucagcgccugguuaacgugaaauccagacugaagcaagcuccucgguaccccagccucgcccgcgagcugauugaauaccaggagagacagcuuuucgaguauuuugucgugguuucccugcacaaaaagcaggccggggcugcguacgugcccgaacucacgcaacaguucccucugaaacuggagcggucuuucaaguuuaugcgcgaagccgaggaccagcuuaaagcuaucccgcaguucugcuuucccgaugccaaggacugggucccugugcaacaguucaccagcgaaacauuuuccuucguccucaccggagaggauggcucuagacgguuuggguauugucgcagacugcugcccggaggcaaggggaaacggcucccugagguguacugcaucguuagcagacugggcuguuucucccuuuuuagccgcauucuggacgaaguggagaagcggagaggaaucagccccgcccucguccagccucugaugcgcuccgugauggaagcuccguuccccgcccugggcaaaacaauucuuguuaagaauuuucucccugggagcggaaccgaggugaucgaacugugccggccccuggauucuagacucgagcaugucgacuucgagucccuguuuagcucucuuuccgugcgccaccugguguguguuuucgcgagccuccugcuggaacggagagucauuuucaucgcugauaaacuuucuauccucuccaagugcugccaugccaugguggcccugauuuauccuuuugcuuggcagcacacguacauccccgugcugccgccugccauggucgacauuguguguagccccacacccuuccucaucggccugcuuuccagcucucugccucuccugcgcgagcugccccuugaagagguucucguggucgaccuggugaacagccgguuucugagacaaauggaugacgaggauuccauucucccucggaagcugcagguugcucuugaacacauccuggagcagcgcaaugaacucgccugcgagcaagacgaagggccgcuggauggaagacauggccccgagucuagcccucugaacgagguggucuccgaagcguucgugcgguuuuucguugagaucguggggcacuauucucuuuuucugaccagcggcgaacgcgaggaaagaacccuccagcgggaggccuucagaaaagcugucuccucuaagagccugcgccauuuucucgagguguucauggaaacacagauguuucggggauucauucaggagagagaacugcgccggcaagacgccaaaggccuuuuugaggugagagcucaggaauaccuggagacccuccccuccggggagcacagcggagucaauaaguuccugaaaggccuggggaacaagaugaaguuccuucauaaaaaguga

SEQ ID NO: 68296 - RNA, 5721 nt, Artificial Sequence
  derived and/or modified sequence opt5 from DENND4A__Homo_sapiens__NP_001138295
augaucgaggacaagggccccagaguggccgauuacuucgucguugcugggcugaccgacgugagcaaaccucucgaagaggaaauucacuuuaacgaugccugccauaagguggcgaaaccgaaggagcccaucacagacgucuccgugauuaucaaaucucugggagaagagguuccucaggauuauauuuguaucgacgugacgcccaccggccuuagcgcugaucugaauaacgggucccucgucggaccucaaaucuaccugugcuaucggcgcggcagagacaagcccccucuuacagaucugggggugcucuacgacuggaaggagcggcugaaacagggaugugaaauuauccagucuaccccguauggccgccccgccaauauuagcggcuccacaucuagccagagaaucuacauuaccuaucggcgcgccuccgagaacaugacacaaaauacccuggcuguuacggauaucugcauuaucaucccuagcaagggggaaucucccccucacaccuucuguaaaguggacaagaaccucaauaacuccauguggggaagcgccgucuaccugugcuacaaaaagucuguggcuaagacaaauaccguguccuauaaagccggccuuauuuguagauacccccaggaggauuaugagagcuuuucucugccggaauccgucccucucuucugccugcccaugggggcgacaaucgaguguuggccuagcaacuccaaguacccccuucccguuuuuucuaccuucgugcugacgggagccagcgcugaaaaaguguauggcgccgcuauucaguuuuacgagccuuauuccgaagagaaucucacagagaagcagcggcugcugcucgggcugaccagcgccgacggaaaaucugacuccagcaagacaauccauaccaacaaaugcauuugucuucugucucacuggccguucuuugaugcguuccgcaaguuucucaccuuccuguacagauacagcaucuccggcccccauguccuuccuaucgaaaagcacauuucucacuuuaugcauaaagugcccuucccuagcccccaacggccgcgcauccugguucagcucuccccucacgacaaucugauucugagccagcccgugucuuccccucucccccugagcggcgggaaguucucuacacuucugcagaaccucggaccugagaaugccgucacgcugcuuguguuugcuguuaccgaacauaaaauccugauucacucccucagacccagcgugcugacauccgucaccgaggcccuggugucuaugaucuucccguuucacuggccuugccccuaugucccccucugcccucuggcucuugccgaugugcugagcgccccgugucccuucaucguuggcauugacucccgguacuuugaucucuaugacccucccccugaugugucuugcgucgacguggauacaaacaccaucagccaaauuggggacaagaaaaacguugcuuggaagauccugcccaagaaaccuuguaagaaucugaugaacacgcuuaauaaccuccaucagcagcuggcgaaacugcaacagcgccccagagaugacggacucauggaccuggccauuaaugauuacgacuucaacuccggcaagcggcuucacaugaucgaucuggaaauucaggaggcuuuucucuucuuuauggccagcauccugaaaggguauagaucuuaccugcgcccgaucacacaggccccuuccgagaccgcuaccgacgccgcgagccuuuucgcucuccaagccuuucugcggucuagagaucgcucccaucagaaguucuauaauaugaugacaaagacccagauguuuauucgguucaucgaagagugcagcuucgugucugacaaagaugccagccuggcuuuuuucgacgauugugucgacaagguggauauggacaaauccggagaagugagacucauugagcuggaugaaagcuuuaagucugagcacacaguuuucgucacgcccccugagaucccccaucuuccgaacggcgaagagccuccccugcaguacuccuacaauggcuuuccugugcuccgcaacaaucuguucgaacggcccgagggguuucugcaagccaaaaagaacaagcuucccagcaaauccucuagcccuaauuccccgcuccccauguucagacgcaccaagcaggagauuaaaucugcucacaagaucgccaaacgguauagcuccaucccucagauguggucuagaugccugcugcgccacuguuacggacucugguuuauuugccugcccgcguaugugaaggucugucauagcaaagugcgggcccuuaagacagcuuacgacguucugaagaaaaugcaguccaagaaaauggacccucccgaugaagugugcuauagaauccucaugcaacuguguggccaguacgaccagccuguccuggccgugcggguucuuuucgagaugcagaaggcugggauugauccgaacgccaucaccuauggauacuacaauaaagcggugcucgaaagcacauggcccucucgcuccagaagcggcuauuuucuguggaccaagguccggaacgugguucugggggugacgcaauucaagagagcccucaaaaagcacgcucaucugucucagaccacacuuuccgacggcagcgaucuggacgccgucucucacggauccauggauagcggccacgggacccauacaguggagcaggcuccuuuuaacaccggacucauuaaaguguacgccacggacgaucgcuccagcacaggcgggcaaucugaccugggauauaauagccuguccaaggaugaaguccggagaggcgacaccucuacagaggauauccaggaggaaaaagacaagaaggggagcgacugcuccucucuuagcgaguccgaaucuaccaaaggcagcgccgauugccugcccaagcucuccuaccagaacagcucuuccaucguucgccugaccggaacaagcaauaacucugcuggcaaaauuuccggggagagcauggaauccacgccugagcuccugcuuaucucuagccuggaggacaccaaugaaacaagaaacauucagucccgguguuuccgcaagagacacaaaagcgauaaugagaccaaccuccaacagcaggugguguggggaaaucggaaccgcaaucugucuggcgggguccugaugggauucaugcuuaacagaaucaaucaggaagcgacacccggcgacauuguggagaagcugggggccgaugcuaagauccucuccaacguuaucagcaaaucuacccggccgaauacgcuggacauuggcaagccuccccuccgcagcaaaagagauucccuggaaaaggagucuagcgacgaugacacacccuuugauggauccaacuaucuugccgacaaaguggacucuccugucaucuucgaucuggaggaccucgauagcgaaaccgacguguccaaggccggcugcguugcuacccaaaaccccaaacggauucagcgcaugaauagcucuuuuuccgugaagccuuucgagaagacagaugucgccaccggguuugacccgcugagccugcuuguggcggaaacagagcagcagcaaaaagaggaagaggaagaggaugaagacgauuccaagucuaucagcacgcccuccgcuagacgggaccuggccgaggagauuguuauguacaugaacaauaugucuagcccucucaccuccagaacacccagcaucgaucugcagcgcgccugugacgauaaacucaacaagaaaucuccuccccuggugaaggcuugccggagauccagccuuccgccuaauucucccaagccuguccgccugaccaaauccaagagcuauacaaaaucugaagagaagccccgggacagacuguggagcuccccugccuucucucccaccuguccguuucgcgaagagagccaggacacgcucacccauuccagcccuuccuucaaccuggauacacuucuggugcccaaacucgacgugcugcggaauucuauguuuaccgcgggaaagggcgucgcugaaaaggccagcaaaugguacuccagauucacaauguacaccacaucuagcaaggaucaauccucugaccgcaccagccucuccagcguuggggcccaggauucugaguccacgagccugacagacgaggaugugugccacgaacuugagggacccauuucuucccaggaaaccagcgcuaccucuggcacaaaacggaucgaccuguccagaaucagccuggaguccagcgccucucucgaagggagccuguccaaguuugcucuuccuggcaaaucugaggugaccagcuccuucaacgccucuaauacgaacauuuuccagaauuaugcgauggagguccugaucagcuccuguucucggugccgcacaugugauugccucgugcaugacgaagagauuauggccggauggaccgcugaugacagcaaccugaauacaaccuguccguuuugcggcaacaucuuccuccccuuucugaauauugaaaucagagaucuucggcgcccugggagauacuuccugaaguccagccccucuacagagaacaugcacuuuccuuccagcaucucuucccaaacccggcagagcugcauuuccacgucugccagcggacuggacaccuccgcucucagcguucagggcaacuucgaccugaauucuaaguccaaacuucaggagaacuuuuguacaagaagcauccaaauucccgccaaucgcucuaagaccgccaugagcaaaugcccuaucuucccgauggcucgguccauuucuacaagcgggccccuggauaaggaagacaccggaagacagaaacucaucuccacgggcucucugccugcgacacuccagggcgccaccgauagccuggggcuugaguggcaccugcccuccccugaccccgugacagucccguaucugagcccucucgugguuuggaaggaacuggagucucuucuggaaaacgagggagaucaugcuaucaccguggccgacuuugucgaucaccaucccauuguguucuggaaucucgucugguacuuucgccggcuggaccugcccuccaaccucccuggccuuauccugagcuccgagcacuguaauaaguauucuaaaauucccagacauugcaugagcgaagauuccaaguacgugcugauccagaugcucugggacaacaugaaacugcaccaagauccugggcagccgcuuuauauucuguggaaugcccacacccagaaguaccccaugguucaucuccugcagaaaucugacaacagcuucaaucaagagcugcucaaguccauggugaaaagcaucaagaugaacgacgucuacggaccuaugucucagauucuugaaacacugaauaaguguccccacuuuaaacgccagcggucccuguauagagagauccucuuccugagccuuguggcucugggccgcgaaaacaucgauauugacgccuucgauaaggaguacaaaauggcguaugacagacucacgccuucucaaguuaaguccacccauaauugcgaucggcccccgagcacaggggugauggagugucgcaaaaccuuuggagaaccuuaccuguga

SEQ ID NO: 68297 - RNA, 597 nt, Artificial Sequence
  derived and/or modified sequence opt5 from DENR__Homo_sapiens__NP_003668
auggccgcugacaucagcgaguccucuggcgccgauugcaagggggaccccagaaacagcgcgaaacuggaugcugacuacccucuccgggugcuguauuguggagucugcucccuuccgaccgaauacugugaguauaugcccgauguugccaagugccgccaguggcuggagaaaaauuucccuaacgaauuugccaagcucacaguggaaaauucucccaaacaagaggcuggcauuagcgaggggcagggaacggccggcgaagaggaagagaagaagaaacagaagagagggggacggggccagaucaaacaaaagaaaaagaccgugccucagaaggucacaauugcuaaaaucccccgcgccaagaaaaaguacgugaccagaguuuguggccuggcgacauucgagauugaccuuaaagaagcccagcgguuuuucgcucagaaguuuuccugcggggccucugugaccggagaggaugaaaucaucauucaaggcgacuucacagaugacaucauugaugucauccaggagaaauggccugaaguggacgaugacagcauugaggaccugggggagguuaagaaguga

SEQ ID NO: 68298 - RNA, 1404 nt, Artificial Sequence
  derived and/or modified sequence opt5 from DEPDC1B__Homo_sapiens__NP_001138680
auggagcacagaaucgugggccccgggccuuaccgggccacccgccuguggaacgaaacagucgaacucuucagagcuaagaugccgcugcggaaacaucgcugcagauuuaagagcuaugaacacuguuucacggccgcggaggcuguugacuggcuucaugaacugcuccggugcucccagaauuuuggacccgaggugacccgcaaacaaacagugcagcugcuuaagaaauuccugaagaaccacgucauugaggauaucaagggcaaauggggagaagaggacuuugaagauaauagacaucucuaccgguucccucccucuagcccucugaagcccuauccuaaaaagccgcccaaccagaaagacgugauuaaguuuccugaguggaaugaucugcccccugggaccucccaggagaacauccccguucgcccgguggucaugaauagcgaaaugugguacaagagacacagcauugccaucggcgaggugccugccugucggcucguucaccgcagacaacugacagaagcuaacguggaggaaaucuggaaauccaugacccuuucuuaucugcagaagauucucgggcuggacagccuugaggagguccuggaugugaaacucgucaauuccaaguucaucauucauaacguguacagcguuucuaaacagggaguggugauccuggacgauaaguccaaagaacugccccacuggguccucagcgccaugaagugccuggcuaauuggccuaacuguucugaccuuaagcagcccauguaucugggcuuugagaaagauguguucaagacaauugccgacuacuacggccaucucaaagaaccccugcuuaccuuucaccuguucgaugcguuuguuuccgugcucgggcugcugcaaaaggagaaagucgccguggaggcuuuccagaucugcugucuccugcuuccuccggagaaucggcgcaagcugcagcuccugaugagaaugauggcccggauuugccuuaacaaggagaugcccccucugugugacggauucggcacgagaacccucaugguucagacauuuagccgcugcauccuguguucuaaagacgaaguggaucuggacgagcuccuggcugcccggcuugucaccuuccugauggauaauuaucaagaaauccucaaggugccccuggcgcugcagacauccauugaggaaagagucgcccaccuucgccgggugcaguuucaaaaaucuuacccugagguuuaucaggagagauuccccaccccggaauccgcugcccuccuguuuccugagaagcccaaaccuaagccccagcugcucaugugggcucugaagaaaccuuuccagcccuuucaacgcacgcggucuuucagaauguga

SEQ ID NO: 68299 - RNA, 1680 nt, Artificial Sequence
  derived and/or modified sequence opt5 from DEPDC5__Homo_sapiens__NP_001007189
augagaaccacaaagguguacaaacuggucauccacaagaaaggcuucgggggaagcgacgaugagcucguugugaaccccaagguguuuccucauauuaaacugggcgacaucgucgaaauugcccacccgaaugaugaguauucuccccuucugcuccaggugaagucccugaaggaagaccuucaaaaagagacgaucagcguugaucagaccgugacacaggucuuccggcugcgcccuuaccaggacguguauguuaacguggucgaucccaaggacgugacccucgaucugguggaacugacauuuaaagaccaauacauugggagaggagauauguggcggcucaagaaaucccuggucucuaccugcgcuuauaucacacagaagguugaguucgccggcauccgcgcgcaggcuggggagcuuugggugaagaaugaaaaagugauguguggauacauuagcgaggacaccagagucguguuucgguccacgucugccaugguuuauaucuucauucagaugagcugcgaaaugugggauuuugacaucuacggcgaccuguacuucgagaaggccgugaacggcuuucucgcugaucuguucaccaaauggaaggagaaaaauuguucccaugaagucacagugguucuuuuuagccgcaccuucuaugacgccaagucuguggaugaguuuccugaaauuaacagagcuuccauccggcaagaccacaaagggcgcuucuacgaggauuucuauaaggucgugguccagaaugaaagacgggaggaguggacaagccugcucgugaccauuaagaaacuguuuauccaguaccccguucuggugcgccucgaacaggccgagggauucccucaaggcgacaacucuacguccgcgcaggggaauuaucuggaagccaucaaccuuagcuuuaaugucuucgauaagcauuacauuaacagaaauuuugaccggacaggacagaugucugugguuaucaccccgggcgugggggucuucgagguggaucgccugcucaugauucugacaaaacaaagaaugaucgacaacggaauuggcguggaucuuguuugcaugggcgaacagccccugcacgcugucccucucuuuaagcugcacaaucgguccgcccccagagacagccgccugggggacgauuauaacaucccucauuggaucaaccacuccuucuacaccucuaaaagccagcucuuuuguaauuccuucacaccccggauuaagcuggcuggaaagaaaccggccagcgagaaggcgaaaaacggcagagacaccucucuuggguccccuaaggagagcgaaaaugcccugcccauccagguggauuacgacgcuuaugaugcccaaguguuucgccucccuggacccucucgggcucagugccugacgaccuguagaagcguccgcgagcgggaaucccauucuagaaaaagcgccuccagcugcgacgugucuuccagccccucucuuccuucccgcacacugccgaccgaggaaguucggagccaggccuccgaugacucuagccucggcaaguccgcuaacauucugaugaucccccacccucaucugcaccaguacgaggugucuagcucccucggguauacaagcaccagagagcaccugggauga

SEQ ID NO: 68300 - RNA, 1230 nt, Artificial Sequence
  derived and/or modified sequence opt5 from DEPTOR__Homo_sapiens__NP_073620
auggaggaaggcgggagcaccggauccgccggcucugacagcuccacaucugggagcggaggcgcucagcaaagagagcuggaacggauggccgaggugcucgucacgggggaacagcugcgccuuagacugcacgaggagaagguuaucaaagaucggcgccaucaccucaagaccuaccccaacugcuucguggcgaaagaacugauugacuggcuuaucgagcauaaggaggcuuccgauagagagacagccauuaaacugaugcagaagcucgccgaccggggaaucauucaccaugugugugaugagcacaaggaauuuaaagacgucaagcuguucuaucgcuuuagaaaagaugacggcaccuucccucuggauaaugaggugaaggcuuuuaugcggggccagcgccucuacgaaaaacugaugucuccggagaacacacuucugcaacccagagaagaggaggggguuaaguaugaacggaccuucauggccagcgaguuucucgacuggcuggugcaggaaggagaggcuacaacccgcaaggaagccgagcagcuuugccacagacugauggagcauggcaucauccagcacgucuccaauaaacauccuuucguggauagcaaccuccuguaccaauuucggaugaauuuccgcagacggagacgccugauggaacuccugaacgagaagucucccuccagccaggaaacgcacgacucuccuuuuugucuucggaaacagucccacgauaauagaaagagcaccucuuucauguccguuagccccuccaaagagauuaagaucgugucugcgguccgccggagcuccaugagcucuugcggguccagcggauauuuuucuagcuccccuacacugucuagcuccccgcccgugcucuguaacccuaaaagcgugcugaagagacccgucaccucugaagaacuucugacaccuggcgcccccuacgcucgcaagaccuucacgauuguuggggacgccgugggauggggcuucgugguccggggcuccaaaccgugccauauccaggcuguggacccuagcgggcccgccgcggccgcuggaaugaagguuugucaauuuguggucucugugaauggccucaacguucugcacguggauuauagaacagucuccaaucugauucucaccgggccucgcacaaucgugauggaggucauggaggaacuggaaugcuga

SEQ ID NO: 68301 - RNA, 957 nt, Artificial Sequence
  derived and/or modified sequence opt5 from DERA__Homo_sapiens__NP_057038
augagcgcccacaacagaggcaccgagcuggaccucuccuggaucucuaagauucaggugaaucaucccgcuguccugcggcgcgccgaacaaauccaggcgagacggacaguuaaaaaggaguggcaggcugccuggcuucugaaagccgugacguucauugaucucaccacacugagcggggacgauaccuccucuaacauccagcgccuuugcuacaaggcuaaauauccuauuagagaagaccugcucaaggcccugaauaugcacgauaagggaaucacaaccgcugccgugugugucuacccggcgcgggugugcgacgccguuaaagcucugaaggccgcuggcuguaacauccccguggccagcgucgcggccggguuuccugcuggacaaacacaucucaaaacccgccuggaggaaauuagacuugccguggaggauggcgcuacggagaucgacguugugauuaaucggucccugguccucaccgggcagugggaagcccuguaugaugagauccgccaguucagaaaggccugcggagaagcucaccuuaaaacaauucuggcgaccggcgagcucggcacacugaccaacguguacaaggccucuaugaucgcuaugauggccgggagcgacuuuauuaagacguccacaggaaaagagaccgugaaugccacauuccccgucgcuaucguuaugcugcgggccauccgcgacuuuuucuggaagaccggcaacaaaauuggguuuaagccugcgggaggcaucagaagcgcuaaagauucucucgccuggcugucccuugugaaggaggaacugggggaugaauggcucaaacccgagcuguuccggauuggagccagcacccuucugucugacaucgaacgccagauuuaucaucacgugacaggcagauacgcugccuaucacgaccucccuauguccuga

SEQ ID NO: 68302 - RNA, 696 nt, Artificial Sequence
  derived and/or modified sequence opt5 from DERL1__Homo_sapiens__NP_001128143
augagcgacaucggcgauugguucagauccauucccgccaucacccgguacugguuugcugccacaguggcggucccucugguugggaagcucggacugauuucuccggcuuaucuuuuccuguggcccgaggccuuucucuaccgcuuccagaucuggagaccuauuacggccaccuuuuauuuccccgugggcccugggacaggauuucuguaccuugugaaccuguauuuccucuaccaauauagcacccggcuggaaacaggcgcuuuugacgggcgccccgccgauuaccuguucaugcuccuguuuaauuggaucugcaucgucauuaccggacuugcuauggacaugcagcugcucaugaucccucugauuauguccgugcuuuacguuugggcccagcugaacagagauaugaucgugucuuucugguuuggcacacgguucaaagcguguuaucucccgugggucauucugggcuucaauuacaucauugggggaagcuaucccauggaccugggcgggcgcaacuuucucuccaccccucaguuccuguacagauggcuucccucucggcgcggaggcgugagcggguuuggaguuccucccgccuccaugagacgggcugccgaucaaaauggcggcgggggacgccacaacuggggccagggguucagacugggagaccaguga

SEQ ID NO: 68303 - RNA, 720 nt, Artificial Sequence
  derived and/or modified sequence opt5 from DERL2__Homo_sapiens__NP_057125
auggccuaccagagccugagacucgaguaucugcaaauucccccugugucccgggcuuacaccacagccugcguccuuacgaccgcggcuguucagcuggaacucaucacaccguuccagcuguauuuuaaccccgagcuuaucuucaagcacuuucagauuuggcgccugaucaccaauuuccucuuuuucggcccugugggguuuaacuuccuguuuaauaugauuuuccuguacagauauugucggaugcucgaagagggaucuuuucgcggcagaacagccgacuucguguuuauguuccuguucgggggauuucuuaugacccuguucggccucuuugucagccugguguuccuugggcaagccuuuacaaucaugcugguuuacguguggucccggcgcaaccccuaugucagaaugaauuucuuuggacuccugaacuuccaggcuccuuuucugcccugggugcucaugggcuucucucugcuucugggcaauagcaucauuguugaucuccuggggaucgccgugggacauauuuacuuuuuccuugaagacgucuuuccuaaccagccgggcgggauccggauucugaaaacccccuccauccucaaggcuauuuucgauacgccugacgaggaucccaauuacaacccucugcccgaggaacgcccgggaggcuucgccuggggagaggggcagagacugggcggcuga

SEQ ID NO: 68304 - RNA, 708 nt, Artificial Sequence
  derived and/or modified sequence opt5 from DERL3__Homo_sapiens__NP_001002862
auggccuggcagggccuggcugccgaguuccuccaagugcccgcggucaccagagcuuacacagccgccugcguucugacgaccgcugccgugcagcuugaacugcucagcccuuuucagcuguauuucaacccgcaccuuguguuucggaaguuccaggucuggcgccuggugacaaauuuucucuucuuugggccccugggauucuccuuuuucuuuaacaugcuguucguuuuuagauacugucggaugcucgaggaaggcucuuuccgcgggagaaccgcugacuucguguuuauguuccuguuuggaggcguccuuaugacacugcucgggcugcuuggaagccuguucuuucucggccaagcccugauggcgaugcugguguauguuuggucccggcgcucuccuagagugcgggucaauuucuuuggccuccugaccuuccaggcccccuuucuuccuugggcucugaugggguucagccuccugcuuggaaacuccauccugguggaucuccugggcauugccguggggcauaucuacuauuuucuggaggacgucuuccccaaucagccuggaggcaaacgccuccugcagacaccgggguuucuuaagcugcuccuggaugcucccgccgaagacccuaacuaccuuccccugccugaggagcaacccggaccgcaccucccucccccucagcaguga

SEQ ID NO: 68305 - RNA, 1413 nt, Artificial Sequence
  derived and/or modified sequence opt5 from DES__Homo_sapiens__NP_001918
augagccaggccuacuccucuagccaaagaguguccucuuaucggcgcaccuucggcggggcucccggauuuccucugggcagcccgcucuccucucccgucuucccuagagccggguuuggaagcaagggcuccucuagcuccguuacaagccggguguaccaggugucucgcacguccgggggagcgggcggccuggggagccuuagagcuucucggcugggaaccacacgcacccccuccagcuauggcgccggggagcuccuggacuucucccuugccgaugcugucaaccaggaauuucugacaaccagaacaaaugagaaaguggaacuccaggagcugaacgaccgguucgccaauuacaucgaaaagguucgcuuucuggagcaacagaacgcugcccucgcggccgaggugaauagacugaaaggacgggaaccuacccgcgucgcugagcuuuaugaagaggagcugagagaacuccggcgccagguggagguucugacgaaccagagagcccggguggaugucgaaagagacaaucuucuggaugaccuccaacgccugaaggcuaaacugcaggaggaaauucagcucaaggaggaggccgaaaacaaucuggcggccuuccgggcugauguggacgccgcuacccuugccagaaucgaucuggagcgccggauugaaucucucaacgaggaaaucgccuuucugaagaaagugcacgaggaggaaauuagagagcuucaggcucaacugcaggaacagcaaguccagguugagauggacaugagcaagcccgaucucacagcggcccugcgcgacauccgggcucaguacgaaaccaucgccgccaaaaauauuuccgaggcugaggaaugguauaagagcaaagugucugaucugacacaggccgcgaacaagaauaacgacgcucucagacaagccaagcaggagaugauggaauaccgccaucagauccaguccuauaccugcgagauugacgcccugaaaggcacgaaugauagccuuaugcggcaaaugagagagcuggaagaccgcuucgcuucugaggccagcggguaccaggauaacaucgcucggcucgaagaggaaauuagacaccugaaggacgagauggcccggcaucuucgcgaguaccaggaucugcucaacgugaaaauggcgcuggacgucgaaaucgccacauauagaaagcugcucgagggagaagagucccggauuaaucugccuauccagaccuacucugcucuuaacuuuagagaaacaagcccggagcaacgcggcuccgaggugcacaccaaaaagaccguuaugaucaaaacaauugaaacgcgggauggcgagguggucagcgaagccacccagcagcagcaugaggugcuguga

SEQ ID NO: 68306 - RNA, 486 nt, Artificial Sequence
  derived and/or modified sequence opt5 from DESI2__Homo_sapiens__NP_001284675
augggcgccaaccagcuggugguccucaauguuuacgacauguauuggaugaacgaguacaccagcuccaucgggauuggaguguuccacucuggcaucgaaguguaugggagagcugucgugcugggaagcacagauuuucuugaggacgauauugaaaagaucguugaggaacugggcaaagaguacaaggggaaugccuaucaucucaugcacaaaaacugcaaucauuucuccucugcgcugagcgagauucuuuguggaaaggaaaucccccgguggaucaaccgccuggcuuacuuuuccucuugcauuccuuuccuccaaagcugucugccgaaagaguggcugacgcccgccgcccuccaguccagcgugucucaggaacugcaggacgagcuugaggaagcugaggaugccgcugccuccgcgagcgucgccucuaccgcugccggcuccagaccuggccggcacacaaagcuguga

SEQ ID NO: 68307 - RNA, 288 nt, Artificial Sequence
  derived and/or modified sequence opt5 from DEXI__Homo_sapiens__NP_054734
augcugggcgccagaguggcugcccaccucgacgcgcuggggccccuugucccuuacguuccgcccccucugcuccccagcauguucuaugugggacuguuuuucgugaacguccuuauccuguacuaugcuuuucucauggaguacauugugcugaauguuggccugguguuccucccugaagauauggaccaggcccuggucgaucuuggggugcuguccgaccccggaucuggccucuaugaugccgacagcgagcuggauguuuuugacgcuuaccuugaauga

SEQ ID NO: 68308 - RNA, 885 nt, Artificial Sequence
  derived and/or modified sequence opt5 from DFFB__Homo_sapiens__XP_011539165
augcugcagaagcccaaaagcgugaagcucagagcccugcgguccccucgcaaauucggcgucgcugggagaucuugccaagagguucuucggaagggaugucugcgcuuucagcucccggaaagaggcagccggcugugccuuuacgaggacgggaccgaacugacagaggauuauuuccccuccgugccugacaacgccgaacucgugcugcugacgcucggacaggcguggcagggcugugaguggcaagggcuguggcgcaugugccuucugcucgauagacaucugcuuuuugucccccugguggcugacguuucugauauccggcgcuuccucagcgccuuucacgagccucaggugggacugauucaggccgcucagcaacugcucugugacgaacaggcuccccagagacagcggcugcuugccgaucugcuccacaaugucucccaaaacaucgccgcggagacccgcgccgaagacccuccgugguucgagggccuggagucuagauuucagagcaaauccggcuaccuucgguauagcugcgaaucucgcauuagauccuaccugcgggaggugagcucuuaucccuccacaguuggggcugaagcccaggaggaguuccucagagugcugggaagcaugugucaacgccugcggucuaugcaguacaauggcuccuauuuugauagaggggcuaagggaggcagccgccucugcaccccugaagggugguucuccugucagggacccuuugacauggauucuugccugagccggcauuccaucaacccuuacagcaauagagagucucgcauucuuuucuccacauggaaccuggaccacaucgauggcguccuccuguguggccccggguga

SEQ ID NO: 68309 - RNA, 1491 nt, Artificial Sequence
  derived and/or modified sequence opt5 from DFNA5__Homo_sapiens__NP_001120925
auguucgccaaggcuaccagaaacuuucugcgggagguggacgccgauggcgaccucaucgcggucagcaaucugaacgauuccgacaaacuucagcugcucucucugguuacaaagaaaaagcgcuucuggugcuggcaaagacccaaauaccaguuucuuagccugacgcucggggaugugcugauugaagaccaguucccuuccccgguggucguggagucugauuuuguuaaguaugaaggaaaguucgcuaaucacgugagcggcacccuggagacagcccucgggaaagucaagcugaaccuuggaggcuccucucggguggaaagccaguccagcuuugggacccugcgcaaacaagagguugaccuccagcagcugaucagagauucugccgagcggacaauuaaucuucgcaaccccgugcugcagcaaguccucgaaggaagaaaugaggugcugugugugcugacccagaagaucacaaccaugcagaaaugcgucauuuccgaacauaugcagguugaggagaaguguggcggcaucguggggauccaaacgaagaccgugcaggucagcgcuacagaagacggaaacgugaccaaagauucuaauguugugcucgagauuccugccgcuacaaccaucgccuacggcgucauugaacuguaugugaagcucgacgggcaguucgaguuuugccugcuccggggaaaacaaggcggguucgaaaacaagaaacgcaucgauuccguuuaccuggacccccuuguguuuagagaguucgcguuuauugacaugccugaugccgcucacggaaucagcucucaggacggcccccuguccguccucaagcaggccacgcugcugcucgagcggaauuuccauccuuucgcugaacugccggagccccagcaaacagcccuuagcgauauuuuucaggcggugcuguucgacgaugaacuccugaugguccuugagccugugugugacgaucugguuuccggccucucucccaccguggccguccugggggaacugaaaccucgccagcagcaagaccucguggcuuuucugcagcuuguuggaugcagccugcagggcgggugucccggaccggaggaugccggcuccaagcagcuuuucaugacagcuuauuuucuggugagcgcccuggccgagaugccugacucugcugcggcccuucucgggaccugcuguaagcugcaaaucauccccacccugugccaccuccugagagcucuuuccgaugacggagucagcgaccuggaagauccuacacucacgccccugaaagacaccgagcgguucggcauugugcagcgccuguuugccucugccgauaucagccuugaaagacucaaguccucugugaaagcuguuauucugaaggacagcaaagucuucccccugcuccuguguaucacacuuaacggccugugcgcccucgggcgggagcauuccuga

SEQ ID NO: 68310 - RNA, 2724 nt, Artificial Sequence
  derived and/or modified sequence opt5 from DFNB31__Homo_sapiens__NP_056219
augaacgcgccccuggacggccucagcguguccucuagcuccaccgggucucugggaagcgcugccggcgccgggggaggcgggggagcuggccuuagacugcucuccgccaauguccggcagcugcaccaagcccuuacagcucugcucucugaggccgaacgcgagcaguucacgcauugccugaacgcuuaccacgccagacggaauguuuuugaucuggugcgcacccucagagugcugcuugacagcccugucaagcggcgccugcucccgaugcugagacuugugaucccccgguccgaucagcuccuguucgaccaguauacagcggaaggccuguaccugccugccaccacacccuaucgccaaccugcuuggggagggcccgauagcgccggcccuggggagguuagacucgugucucugcggcgcgcuaaagcccaugaaggacuuggcuuuuccauuagagggggaagcgagcacggcgucggcaucuacgugucucugguugagccggggucccucgcggaaaaggagggacugcgggugggcgaccagauucuucgcgucaacgauaaaagccuggccagagugacccaugcugaagccgugaaggcucucaaagggucuaagaagcugguccuguccguuuauagcgccggacggauccccggcggguacgugacaaaucacauuuauaccuggguggacccucagggaagauccaucucucccccuagcggccucccccagccgcacggcggggcccugcgccaacaggagggagaucggagauccacgcuucaucugcuccagggcggggacgagaaaaaggucaaccuggugcuuggagauggccgcagccuggggcucaccauccggggcggagcugaauacggccuggggauuuacaucacaggaguugacccuggcucugaggcggaaggguccggacugaaagugggcgaucagauucucgaggucaaugggagauccuuccugaacauccuucacgacgaagccgugcgccugcucaagucuagccggcaucugauucugaccguuaaagacgugggcagacuuccccacgcucgcacaaccgucgaugagacgaaguggaucgccuccucucggauuagagagacaauggccaauagcgcuggauuucucggcgaccugaccacagaagggaucaacaagccuggauucuauaaaggccccgccgggucccaagugacccugagcucucucggaaaucagacccgcguccugcuugaggaacaggcgcggcaucugcucaacgagcaagaacacgcuacaauggccuacuaucuggaugaguacagaggcggguccgugagcguugaggcccuggugauggcucuuuuuaagcuccugaauacgcacgccaaauucucucugcucuccgaaguccggggcaccaucagcccccaggaccuggagcgcuuugaucaucuugugcugagacgggaaauugaguccaugaaggcuagacagccuccgggacccggcgccggggacacauauucuaugguuagcuacuccgauaccggaucuagcacaggcucccacgggaccagcacgacagugucuuccgcgcgcaacacccucgaccuggaagagaccggagaggccguccagggcaauaucaacgcucugccugaugugagcguggacgauguucggucuacaucccaagggcuuagcucuuucaaaccccucccuagacccccgccucuggcccagggcaacgaccugccccucggacagccucgcaagcugggcagagaagaccuucagcccccuagcuccaugcccagcuguucugggaccgucuuuuccgcuccgcaaaaucggagcccucccgccggaacagcgcccacgccuggcaccuccucugcccaggaucugccgagcucccccauuuaugcuucugugagcccugccaaccccuccucuaaacgcccucucgacgcucaucuggcccuggugaaucagcaccccaucgggccuuuccccagaguccagagcccgccucaccuuaagucccccagcgccgaggcuacaguggcgggaggcugccuccugccucccucuccguccggccauccugaucaaaccgggacaaaccagcacuuuguuaugguggaaguccaucggcccgacagcgagccugaugugaaugagguucgcgcccugccccagaccagaacggcuucuacccucucccagcugagcgacucuggacaaacacuuuccgaagauagcggcguggacgccggggaggccgaagcuagcgcccccggacggggccgccagagcgucucuaccaagagcagauccucuaaagagcugccucggaacgaacgcccgacagauggggcgaauaagcccccuggacuccuggagcccaccagcacgcuggugagaguuaaaaaguccgcugccacacuuggcauugccaucgagggcggggcuaacacccggcagccucugcccagaaucgugacaauucaacgcggaggcucugcccacaauugugggcagcucaaagucggacacgugauccuggaagugaacggccucacccugcgggggaaggagcauagagaagcggcucgcauuaucgccgaggccuucaagaccaaagaccgggauuacauugacuuccuugucacagaauuuaauguuaugcuguga

SEQ ID NO: 68311 - RNA, 1059 nt, Artificial Sequence
  derived and/or modified sequence opt5 from DFNB59__Homo_sapiens__NP_001036167
auguucgccgcugccaccaagagcuuugugaaacaggucggcgacgggggaagacugguucccgugccuucccucucugaggcggauaaguaccaaccgcugagccuuguggucaaaaagaaacggugcuuccuguuuccccgcuauaaguucacauccacgccuuuuacccucaaggacauccugcuuggcgauagagaaauuucugcugggaucagcuccuaccagcugcucaacuaugaggacgaaucugaugugagccuguacggacggcgcggcaaucacauuguuaacgacguggggaucaaugucgccggauccgauagcauugccgugaaggcuucuuucggcaucguuacaaaacaugagguggaagucuccacccugcucaaagagaucacaaccagaaagauuaacuuugaccacagccugauccggcagucucgcuccagcagaaaagccgugcuuuguguggucauggagucuauucggacaacccgccagugcucccugagcguucaugcuggcaucagaggggaagccaugcgguuccacuuuauggaugagcaaaaucccaagggacgcgacaaggcgauuguguucccugcccauacgaccaucgcuuuuuccguguucgaacucuuuauuuaucuggauggcgccuucgaccuuugugucacaucugugagcaaagggggauucgagagagaggaaaccgcuacauuugcccugcucuaccggcugcgcaacauccuguucgagagaaaucggagaguuauggaugugaucucccgcagccagcucuaucuggacgaccuguuuucugauuacuacgacaagccccuuuccaugaccgauauuagccucaaagaaggcacgcacauccgggucaaccugcuuaaucacaacauuccuaaggggccgugcauccuguguggaaugggcaauuucaaaagagagacaguguauggcugcuuucaguguucuguugacgggcagaaguacgugcgccuccaugcgguccccugcuucgauauuuggcacaaacggaugaaguga

SEQ ID NO: 68312 - RNA, 1467 nt, Artificial Sequence
  derived and/or modified sequence opt5 from DGAT1__Homo_sapiens__NP_036211
augggcgacagagggagcucccggcgcagacggaccggaucucgccccagcucccacggcgggggaggcccugccgcugccgaggaagaggugagagaugcggcugccgggccggacgucggagccgcuggcgaugcccccgcuccugcccccaacaaggacggcgaugcggggguuggaucuggccauugggaacugcggugccaccgccuccaggacagccuguucuccucugauagcggguuuuccaauuacagaggaauccuuaacugguguguggugaugcugauucucagcaaugcccggcuguuccuugagaaccugaucaaauauggcauucucgucgacccuauccaagugguuucucuguuucugaaggaucccuacuccuggccugcuccgugccucgugauugccgcuaaugucuucgccguggcggccuuucagguugaaaaacgccuggcugugggggcccuuacagagcaggcuggacugcuccugcaugucgccaaccuugccacgauccuguguuuccccgcugcgguggugcuccuggucgagagcaucaccccuguuggcucucugcucgcccugauggcucacacaauucuuuuucugaagcucuuuuccuauagagacgugaauagcuggugccggcgcgccagagccaaagcugccucugcgggcaagaaggcuuccagcgccgccgcuccccauaccguguccuacccugauaaccugacauaucgggaccuuuacuauuuucuguucgcccccacccucuguuacgaacugaauuuuccgcgcucuccuagaauccggaaaagauuccugcuccgccggauucuggagaugcuuuucuucacacagcugcaagucgggcucauccagcaguggauggugcccaccauucagaacagcaugaagccuuucaaagauauggacuacuccagaaucauugaacgccugcuuaagcuggcuguucccaaucaccucaucuggcugaucuuuuucuauuggcuguuucacagcugccucaacgccguggcggagcugaugcaauucggagaccgggaguuuuacagagauugguggaacucugaauccgucacguauuucuggcagaauuggaauauucccgugcauaaaugguguauccgccacuuuuacaagccuaugcuucggagaggcagcucuaaguggauggcccgcaccgggguuuuccuggcuagcgccuuuuuccaugaguaucucguguccgucccgcugcggauguuuagacugugggcuuucacaggaaugauggcccagauuccccuugcgugguuugugggccgcuucuuccaggggaacuacggaaacgccgcugucuggcucucucugaucauuggccaaccuaucgccgugcugauguauguucacgacuacuacgugcucaauuaugaagcucccgccgccgaggcuuga

SEQ ID NO: 68313 - RNA, 1038 nt, Artificial Sequence
  derived and/or modified sequence opt5 from DGAT2__Homo_sapiens__NP_001240820
augaagacccugaucgccgcuuacagcggcgugcucagaggggagcggcaggccgaagcggaccgcucccaaagaucucacggaggccccgcucugagccgggagggguccggacgcuggggcgucgccugcucugccauucuuauguauaucuucuguacagauugcuggcugauugcuguucucuacuuuacguggcugguguucgacuggaacaccccuaaaaagggagggagacggagccagugggugcgcaauugggccgucuggagauauuuucgggauuacuucccgauccagcuugugaaaacacauaaccugcucaccacacgcaauuauauuuuuggcuaccacccccauggcaucauggggcugggagcuuucuguaacuuuuccaccgaagccacagagguuucuaagaaauucccuggcaucagacccuaucuggcgacccucgccgggaauuuucggaugccugugcugcgcgaauaccuuaugagcggaggcauuugccccgucuccagagacacgaucgauuaccugcucagcaagaacgggucuggaaaugcuauuaucauugugguuggcggcgccgcugagucccugagcucuaugccugggaagaacgccgugacccuucggaaucgcaaaggauucgucaagcuggcgcucagacacggcgccgaccuggugccgaucuauuccuuuggggagaacgaaguguacaaacaggucauuuucgaggaaggaagcuggggccgguggguucaaaagaaauuucagaaguauaucggguucgcucccuguaucuuccauggaagaggccuguuuucuuccgauacauggggccucgugccuuacagcaagcccauuaccacaguggucggggagccuaucaccauucccaaacuggagcacccgacgcagcaggacaucgaucuuuaucacacaauguacauggaagcccuggugaaacucuucgacaagcauaagaccaaauuuggacugccugagacagaaguucuugaggugaauuga

SEQ ID NO: 68314 - RNA, 1530 nt, Artificial Sequence
  derived and/or modified sequence opt5 from DGCR2__Homo_sapiens__NP_001167004
auggugcccaaggccgacagcggcgcuuuccugcuccuguuucuucugguccucaccguuacagagccucugagaccggaagugacgggggaggugcggccccaccauggaaaagaagccgucgauccucgccagggcagagcgcgcgggggagaccccucccacuuccaugcugugaacguugcccaaccugugcgguuuucuagcuuccuuggcaagugccccaccggguggcaccauuacgagggaacagccuccuguuauagagucuaccugucuggcgaaaauuauugggaugcugcccagaccugccagcggcucaacggcagccuggcuacauuuuccaccgaccaggagcugcgcuucgugcucgcccaagagugggaucagccugaaagaucuuuuggguggaaagaccagcggaagcuguggguuggauaccaguaugugaucacaggccgcaauagaagccuugaggggcggugggaagucgcguucaaaggauccagcgagguguuucugccgcccgauccuauuuucgccucugcuauguccgagaacgacaauguguuuugugcccaacuccagugcuuccacuuucccacccugcgccaccaugaucuucacagcuggcaugcugaaucuuguuacgagaaguccagcuuccugugcaagagaucucagacgugugucgacaucaaagauaacguuguggacgaaggcuucuauuuuaccccuaagggggaugaccccugccucuccuguacaugccacggaggcgagccggaaauguguguggccgcgcugugcgagcggccucagggcugccaacaguaccgcaaagaccccaaggaguguugcaaauucaugugucuggauccugacgggaauagccucuuugauuccauggccucuggaaugagacuggucgugagcugcauuuccagcuuccuuauccugucucuccugcuuuuuaugguucaccggcugagacagcgccggagagaacgcauugagucccucaucggcgcuaaccugcaucacuucaaucuggggcggagaauccccggauuugacuacggccccgauggguucggaaccggccucacaccucugcaucuuagcgacgauggcgaagggggaaccuuucacuuccaugacccgcccccucccuauacggccuacaaguauccugauauuggccaacccgacgauccgccucccccuuacgaggcuucuauccaccccgacagcguguuuuaugacccugccgaugacgaugccuucgaacccgucgaggugucccugccggcuccuggggacggaggcucugagggggcgcuccugcgccggcuugaacagccccugcccacagccggcgcuagccucgccgaucuggaggacuccgccgauucuagcuccgcucugcucguuccuccggaccccgcccagagcggaucuaccccugcggcugaagcccugcccggcgggggaagacacucccgcagcucccuuaacacaguggucuga

SEQ ID NO: 68315 - RNA, 663 nt, Artificial Sequence
  derived and/or modified sequence opt5 from DGCR6L__Homo_sapiens__NP_150282
auggagagauacgccgcugcccuggaagagguggcggacggcgcucggcagcaagaacgccacuaucagcuccugagcgcccuucagucccuggucaaggagcuccccucuagcuuccagcaaagacuguccuacaccacacuuucugaucuggcccucgcucugcuggacgggacgguuuuugaaaucgugcagggacuccuggagauucagcaucuuaccgagaaaagccuguauaaccagcggcuccgccugcaaaaugaacacagagugcuucggcaggcccugcgccagaagcaucaggaggcucaacaggccugcagaccucacaaccucccggucgugcaggcggcccaacagcgggaacuggaggcuguugagcaucgcaucagagaggaacagcgggccauggaucagaaaauuauccuggaacucgaccgcaagguggcugaucaacaguccacacuggagaaagccggcgucgcgggguucuacgugaccacaaauccccaggaacuuaugcugcagaugaaccuccuggagcuuauuagaaagcugcaacagcggggaugucgcgccggcaaugcugcccucgggcugggaggcccuuggcagucucccgcugcccagugcgaccaaaagggcagcccuguucccccuuga

SEQ ID NO: 68316 - RNA, 2223 nt, Artificial Sequence
  derived and/or modified sequence opt5 from DGCR8__Homo_sapiens__NP_001177255
auggagaccgacgaaagccccuccccucugccgugcggccccgccggggaggcugugauggaaucuagagcccggccuuuccaggcgcucccccgcgagcaaagcccucccccuccgcugcagacauccucuggagcugaagucauggauguuggcagcgggggagacggccaguccgagcuucccgccgaggauccuuuuaacuucuacggggccucucugcucagcaagggauccuuuagcaaaggcagacugcuuaucgaccccaauuguucuggccacuccccucggacggcucgccaugcccccgcugugagaaaguucagcccggaucugaaacuccugaaggacgugaaaauuucugucuccuuuaccgaaagcugccggucuaaggaucgcaaggugcuguauacaggggccgagagagacguucgggcggaauguggacuccugcuuuccccugugagcggcgauguccacgccugccccuucgggggauccgugggcgacgggguuggaaucggcggcgagucugcugauaaaaaggacgaggaaaacgagcuggaucaggaaaaacgcguggaguacgccguccucgacgaacuggaggacuuuaccgauaaucuugagcuggacgaagagggggcuggaggcuucacagccaaggcgauugugcaaagagaucggguggacgaagaggcccucaacuuuccuuaugaagaugacuucgauaaugacgucgaugcucugcuggaggaggggcucugugcccccaaaaagcgcagaaccgaagagaaguacggaggcgacagcgaucaucccuccgacggggaaacaagcguucagccuaugaugaccaaaaucaagacggugcugaaaucucggggacgcccgcccaccgagccucuucccgacggcuggauuaugacauuucacaacuccggcgugccugucuaucugcauagagaaagccgggugguuaccuggucuagacccuacuuccucgggacaggaagcauccgcaagcacgauccgccucuguccucuauccccugccuucacuauaaaaagaugaaagacaaugaggagcgggaacagagcuccgaucugaccccuagcggcgacgugucucccgucaagccucucuccagaagcgcugagcuggaauuuccccuggaugagccggacucuaugggggccgauccuggaccucccgacgagaaggauccccucggcgccgaagcugcgccgggggcccugggccaggugaaagcuaagguugagguguguaaagacgaauccgucgaucuugaggaguuccgcagcuaccuggagaagcgguucgacuuugagcaagugacggucaaaaaguucagaacaugggccgaacgccggcaguuuaacagagagaugaagcgcaaacaggccgaauccgagcggcccauucucccugcuaaucagaagcugaucacccuuucugugcaagaugcccccacaaagaaggaguucguuauuaacccuaauggaaaaagcgaagugugcauccugcaugaguacaugcagagaguccucaaggugcgccccguuuauaacuuuuucgaaugugcgcgggcuacccuggagauucugaucccugacuuugugaagcagaccuccgaagagaaacccaaggacucugaagaacucgaguacuucaaucacauuagcaucgaagauuccagagucuaugagcugacaagcaaagccggccuucugucuccguaccaaauccuccaugaaugccugaagcggaaccacgggaugggagacacguccauuaaauuugagguggugccuggcaagaaucagaaaagcgaguauguuauggccugugggaaacacaccguccgcggauggugcaagaacaaaagagugggcaagcagcuggcuucucagaaaauccuucaacuccugcauccccacgugaagaacugggggucccugcuccggauguacggcagagaaagcucuaaaauggucaagcaggagacaagcgauaaguccgugauugaacugcagcaguaugccaaaaagaauaaaccuaaccuucauauccugagcaagcuccaagaggaaaugaaacgccuggcugaggagcgggaagagaccagaaagaagcccaaaaugucuauuguugccuccgcgcagccgggaggcgaaccucugugcacaguggacgucuga

SEQ ID NO: 68317 - RNA, 2208 nt, Artificial Sequence
  derived and/or modified sequence opt5 from DGKA__Homo_sapiens__NP_958853
auggccaaggagagaggccugaucagccccuccgacuucgcucagcuccaaaaauacauggaauauucuaccaagaaagugagcgauguccugaaacuuuuugaggacggggaaauggccaaauacguucagggagaugcgauuggcuaugagggguuccagcaguuucugaagaucuaccucgaaguggacaaugugccucggcaccugucccuugcucuguuccaaucuuuugagacaggacauugccucaaugagacgaacgucaccaaggaugugguuugucugaaugacgugagcugcuauuucucccugcucgaaggcgggcgcccggaggauaaacuggaauuuacauucaaacuuuacgacaccgauagaaacggcauucuggacucuagcgaggucgauaagaucauucuccagaugaugcggguggccgaguaucuggacugggauguuuccgaacuucgccccauccugcaggagaugaugaaggaaaucgacuacgacggaagcggcucugugucccaggccgagugggucagagcuggggccacaaccgugccucuccuggugcugcucggacuggaaaugacacuuaaagaugacggccaacacauguggcggcccaagcgcuuuccuagacccgucuacuguaaucugugcgagagcucuauugggcucggaaagcagggccuguccuguaaccuuugcaaauauaccguucaugaucagugugcuaugaaggcccugccuugcgaggugagcacguacgcgaaaucucggaaggacaucggggugcagucccacgucugggugcgcggaggcugugaaagcggcagaugcgaucggugucaaaagaagauucgcaucuaucauucccucaccgggcugcacugcguuuggugccaccuggagauucaugacgauugucuccaggccgugggacacgaaugcgacuguggccugcuuagagaucauauccugccgcccucuagcauuuacccuuccguccucgcuagcgggcccgaccggaaaaauucuaagacaucccagaagaccauggaugaccugaaccuuagcacaucugaggcccugcgcaucgacccugugcccaauacccacccgcuccugguuuucgugaacccuaaaagcggaggcaagcaagggcagagaguccuguggaaauuucaguauauccucaaucccagacagguguucaaccugcuuaaggauggaccugaaauuggccugcggcucuuuaaagacguccccgauucccgcauccuggugugcggcggggacggaacgguuggcuggauucuggagacaaucgauaaggcuaaucuucccgugcucccuccggucgccgugcugccccuggggaccggaaacgaccucgcgcggugucugagauggggcgggggcuacgagggacaaaaucuugccaagauucugaaagaucucgaaaugucuaagguugugcacauggaccgcuggagcgucgaggugaucccucagcagacagaagagaaauccgaucccgugccuuuccagaucauuaacaacuauuucagcaucggcguugacgcuucuauugcccaucgguuucacaucaugagagaaaaguaccccgagaaauucaauucccgcaugaagaacaagcugugguacuuugaguucgcuaccagcgaaucuauuuuuagcacaugcaaaaagcuggaggaaucccuuaccgucgagaucugugggaaaccgcucgaucuguccaaucugucucucgagggaaucgccgugcugaacauuccuagcaugcauggcggguccaaucuuuggggagacacgcggagaccccacggcgauaucuaugggauuaaccaagcccugggcgcuaccgcgaaggugaucacagacccugacauucucaaaaccugcguccccgaucugucugacaagcgccuggaagugguuggacuugagggcgccaucgaaauggggcagauuuacacaaagcucaaaaaugcuggacggagacuggccaaguguagcgagaucaccuuccauacgacaaaaacccugccuaugcagaucgauggcgaacccuggaugcagaccccgugcacaauuaagaucacccacaaaaaccaaaugccuaugcucauggggcccccuccccgcuccacaaacuuuuucggauuucugagcuga

SEQ ID NO: 68318 - RNA, 2415 nt, Artificial Sequence
  derived and/or modified sequence opt5 from DGKB__Homo_sapiens__NP_004071
augaccaaccaggagaagugggcccaccugagccccuccgaguucucucaacuccagaaauacgcugaauauagcacaaagaaacugaaggacgugcuugaagaguuucauggcaaugggguccuggccaaauacaacccugaaggaaagcaggauauccucaaucagacgauugacuucgagggcuuuaagcuguucaugaaaaccuuucuugaggcggaacugccggaugacuucacagcucaccucuuuauguccuucucuaacaaguuuccccauagcuccccuaugguuaaaucuaagcccgcccugcugagcgggggacucagaaugaauaaaggcgccaucaccccuccccggacaaccuccccugcuaacacaugcagcccggaggugauucaccugaaggauaucguguguuaucuuucucugcucgaacgcgggagacccgaggacaagcuggaguucauguuucggcuuuacgauaccgacggaaauggcuuccuggauuccagcgaacucgagaacauuaucucucaaaugaugcaugucgccgaauaucuggagugggacgugacggaacugaauccuauccuccacgagaugauggaggaaauugauuacgaccacgauggcaccguuucccuggaggaauggauccaagggggaaugacaaccauuccccuucuggugcuccugggccuugagaacaaugucaaagacgacgggcagcauguguggcgccugaagcacuuuaacaaaccugcuuauugcaaucucugucugaacaugcugaucggaguuggcaagcaggggcucugcuguagcuucugcaaauacacagugcaugaaagaugugucgcccgggcgcccccgucuugcauuaagaccuacgugaaauccaagcgcaauacggaugugaugcaccacuauugggucgagggaaacuguccuacaaagugcgacaaaugucauaagaccguuaaaugcuaccagggccugacaggccuucacugcguguggugucagaucacccugcauaacaagugcgccagccaccucaaacccgagugugauugcgggccucugaaggaccauauucuuccucccaccacaaucugucccgugguccugcagacgcucccgaccuccggagugucuguucccgaagagagacagagcacagugaagaaagaaaaguccggcagccaacagccuaauaaagucaucgauaagaacaaaaugcagcgggcuaauucugugaccguugacgggcaaggacuccaggugacacccgucccuggcacccacccccugcugguguucgucaacccgaaguccgggggaaagcagggcgagcgcauuuauagaaaauuucaguaccugcuuaauccucggcaaguguauagccugucuggcaacgggcccaugccuggacucaauuucuuucgcgauguucccgacuucagagugcuggccugcggcggggauggaacggucggcugggugcuggacuguaucgaaaaggcuaacguugggaaacacccucccguggccauucuuccgcucggcacaggaaaugaucuggcgcggugccugcgcuggggcgggggauacgagggcgagaaccucaugaagauccugaaagacauugaaaauagcaccgagaucaugcuugacagauggaaguuugaagucaucccuaacgauaaggacgagaaaggggaucccgugcccuauuccauuaucaauaacuacuucucuauuggaguggacgccagcaucgcucaucgguuucacauuaugagagagaagcauccugaaaaauucaauucccgcaugaagaacaaauuuugguacuucgaguuuggcaccagcgaaacauucucugccaccuguaagaaacugcacgaguccguugaaaucgagugcgaugggguccagaucgaccucauuaacaucagccuggagggcauugcuauccugaauauuccgucuaugcacggaggcuccaaccuuuggggagaaagcaagaagcggagaucccaucgccggaucgagaaaaaggggucugauaaaagaacaacggugaccgacgccaaggaacucaaauuugccagccaggaucuguccgaccagcugcucgagguggucggccuggaaggggcuauggagaugggacaaauuuauacaggccuuaagucugcggggcgccggcuggcccaguguagcugcgugguuaucagaaccuccaagagccuccccaugcagaucgauggcgagccuuggaugcagacacccugcaccauuaaaaucacgcacaagaaucaagcuccuaugcugaugggacccccucccaaaaccggccuguucuguucucuugugaagcgcacacggaacagauccaaagaauga

SEQ ID NO: 68319 - RNA, 3513 nt, Artificial Sequence
  derived and/or modified sequence opt5 from DGKD__Homo_sapiens__NP_003639
augaacauguuccuguacuuucagaccaucauuaaggagggcaugcucacaaaacaaaauaacagcuuccagagauccaagcggcgcuauuuuaaacugagagggcggacgcuuuacuaugccaagaccgcuaaaucuaucauuuucgacgaaguggaucugacagacgccagcgucgcggaguccucuaccaagaauguuaacaauagcuuuacagugaucacccccugccgcaagcucauucugugugcugauaacagaaaagaaauggaggacuggaucgccgcccuuaagacagugcagaaucgggaacacuucgagccuacccaguacuccauggaucauuuuucuggaaugcacaacugguaugcuugcagccaugcccgcccgacguacuguaaugucugcagagaggcucuguccggcgugaccagccacgggcucucuugugaaguuugcaaauucaaggcccauaaacggugugcggugcgcgccacaaacaauugcaaguggaccacacuggcuuccaucggaaaggacauuaucgaggaugccgacggcauugcuaugccccaccaauggcuggaagggaaccucccugucagcgccaaauguaccgugugcgauaagacguguggaucuguucugagacuucaggacuggcggugccuguggugcaaagcgauggugcacacauccuguaaggagagccuccugaccaaaugcccccuuggccuguguaaggucucugugaucccucccacagcccucaauuccauugauagcgacggcuuuuggaaagcuagcugcccuccgucuuguaccagcccccugcugguguucgucaacuccaagagcggggauaaucagggaguuaaguuucuccgcagauucaaacagcugcuuaacccugcccaaguguuugaccugaugaacggcgggccccaucucggacugcggcuuuuccagaaguucgacaccuuucgcauccuggugugcggcggggauggaucugucggcugggugcucuccgagauugacagccugaaucugcacaaacagugucagcucggcguucugccucuugggacaggaaacgaucuggcuagagugcucggcugggggucugccugcgacgaugacacgcaacugccccagauccuugaaaagcuggagcgggccagcaccaaaaugcucgauagaugguccgucauggcuuaugaagcgaagcugccgcgccaggccucuagcuccacagugaccgaggacuucagcgaagauucugagguucaacagauccuguuuuacgaggacuccguggcugcccaucucagcaagauucugacaucugaucagcacuccgucgugaucagcuccgccaaaguccuuugugaaaccgugaaggacuucguugcucgggugggaaaagccuacgagaagacgacagaaucuagcgaggaauccgaggucauggcgaaaaagugcucugugcugaaggagaaacucgacagccugcugaagacccuugaugacgaaucccaggcuuccucuucccucccuaaucccccucccaccauugccgaggaagccgaggauggcgacgggagcggaucuaucuguggcuccacaggcgauagacugguugcuagcgccugccccgcucgcccucaaauuuuucggccgagagaacagcugaugcuccgcgccaacucucugaaaaaggcgauccggcagaucauugagcacaccgagaaagccguggacgaacagaaugcucaaacacaggagcaggaaggguucguccuuggacugagcgaguccgaggaaaagauggaucauagagugugucccccucucagccacucugaguccuuuggcgugcccaaggggcgcagccagcggaaaguuuccaagucuccuugcgaaaaacugaucagcaagggaucccugucucuuggcagcuccgccucucugcccccgcaaccugggagcagagacggccugcccgcucugaacacgaaaauucucuauccuaauguccgcgccggaauguccggcagccugcccgggggaucugugaucucccggcuucugauuaacgcggauccuuucaauagcgagcccgaaacccucgaguacuauacagagaagugcgugaugaacaauuacuuuggcaucgggcuggacgccaaaaucucucuggauuucaacaauaagagagacgaacauccggagaagugucggucccgcaccaaaaacaugaugugguauggaguccuuggcacaaaggaacuccugcacagaaccuacaaaaaucuggagcagaaggugcuccuggaaugcgaugggcggccuauuccccuucccagccugcagggcaucgcuguucucaacauuccuucuuaugccggaggcacgaacuuuuggggagggaccaaagaggacgacacauucgcugccccguccuuugaugacaagauccuggagguggucgccguguucggcagcaugcagauggcuguuuccagagugauucgccugcaacaucaccggaucgcgcaguguagaaccgucaagauuagcauccuuggggaugaaggagugcccguucagguggacggcgaggccuggguccaaccucccggguacauccgcauugugcacaaaaauagagcucagacacucacccgggaucgcgccuucgaaucuacgcucaagagcugggaggacaaacagaagugcgaacugccuagacccccuuccuguucucuccaucccgagaugcugagcgaggaagaggccacacagauggaucaauuuggccaggcugccggagugcuuauccacuccauucgggaaaucgcgcagucucaucgcgacauggagcaggagcuggcucacgccgucaacgccagcuccaaaucuauggauagaguuuacggcaagccgcggaccacagaagggcucaauugcagcuucgugcuggagauggugaacaauuuucgcgcucugagauccgaaaccgagcuucugcucagcggaaagauggcccugcaacucgacccuccccagaaagaacagcugggcucugcgcuugcugagauggaucggcagcugcgcagacucgccgacaccccuuggcugugucaauccgccgagcccggggaugaagagagcgucaugcuggaccuugcuaagcggucuagauccggaaaauuccgccuggugacaaaguuuaaaaaggaaaagaacaauaaaaacaaggaggcccacagcucccucggcgcuccgguucaucugugggggacggaagagguggccgcguggcucgagcaccugucucuuugcgaauauaaagacauuuucacccggcaugauaucagaggcagcgagcugcuccaccuggaacgccgggaccugaaggaucuuggagucacaaaagugggccauaugaagagaauccugugugggauuaaagagcucucccgcagcgccccugcuguugaagccuga

SEQ ID NO: 68320 - RNA, 1704 nt, Artificial Sequence
  derived and/or modified sequence opt5 from DGKE__Homo_sapiens__NP_003638
auggaggccgaaagacggcccgcuccuggcagcccguccgaggggcuguucgccgacggacaccucauccuguggacccuuugcucugugcugcuccccgucuuuauuacauucugguguagccugcagcgcuccagacggcaacuucaucgcagagauaucuuucggaagucuaaacacggcuggcgcgacacggaucuguucagccagccuaccuacugcuguguuugcgcgcagcauauucuccagggggcuuuuugugacugcuguggacugagaguggaugaaggcugccugcggaaggccgacaaacgcuuccaauguaaggagaucaugcucaaaaacgauacaaaggugcuggacgccaugccccaccauuggauuagagggaaugucccucuuugcuccuauuguauggugugcaagcagcagugcggaugucagcccaaacugugcgauuaccgguguaucuggugccaaaagaccguucacgacgaauguaugaaaaacucucucaagaaugagaaaugcgauuuuggcgaguucaagaaccugaucauuccuccgagcuaucuuacauccaucaaucagaugcgcaaggacaaaaagaccgauuacgaagugcuggcuagcaaacucggcaagcaguggacaccccugauuauccuggccaacucuagauccgggaccaauaugggagagggccuccugggggaauuucggauucuucugaacccuguccagguguucgacguuacgaaaacacccccuaucaaggcucuccaacuguguacccuucugcccuauuacagcgcccgcgugcucgucugcggaggcgacgggaccgugggaugggugcuggaugcggucgacgauaugaaaauuaagggccaggagaaguauaucccgcagguugccgugcugccucucggcacagggaaugaccugucuaacacccuuggauggggcacgggguacgcuggagagauccccguggcccaaguccugagaaaugugauggaagcugauggcauuaaacucgaccgguggaagguucaggugacaaacaaaggguacuauaaucugagaaagccuaaagaguuuaccaugaacaauuacuucuccgucggacccgaugcccuuauggcgcugaacuuucacgcccaucgcgaaaaggcucccagccucuucucuucccggauccugaacaaggccguguaucuguucuacggcacaaaagacugucucguucaggagugcaaggaucugaauaaaaagguggaacuugagcuggacggcgagagagucgcucucccuagccuggaagggauuaucgugcugaacauuggauauuggggcgggggaugucgccuuugggagggcaugggggaugaaaccuacccgcucgcccggcacgacgacggccugcuggaggucgugggaguuuauggcuccuuucauugcgcccagauccaagugaaacucgcuaaucccuucagaaucgggcaggcgcacaccguccgccugauucuuaagugcucuaugaugccuaugcaaguggauggagaacccugggcccagggcccuuguacaguuacgaucacccacaagacacaugcuaugaugcuguacuuuagcggggagcagaccgacgaugacauuuccagcacaucugaucaggaggacaucaaagccaccgaauga

SEQ ID NO: 68321 - RNA, 2301 nt, Artificial Sequence
  derived and/or modified sequence opt5 from DGKG__Homo_sapiens__NP_001074213
augggcgaggaaagaugggugagccugacccccgaggaguucgaccagcuccaaaaguacuccgaguauucuagcaaaaagaucaaagaugcccugacagaauuuaacgaagggggaucccuuaagcaguacgacccucacgagccgauuucuuaugaugucuucaaacuguuuaugcgggcuuaccucgaaguugaccugccccagccucuuagcacgcaucuguuccucgccuuuucccagaagccccgccacgagaccucugaucauccuacagaaggcgcgagcaauuccgaggcuaacagcgccgacaccaauauccaaaacgccgauaaugcuacaaaggccgacgaggcuugcgcccccgauaccgaaucuaacauggcggagaaacaggccccugcugaagaccagguggccgcuacaccgcuggagcccccugugcccagauccucuagcuccgaaagcccugucguguaucugaaggauguuguguguuaccucucucugcuugagaccgggcggccccaggacaaacuggaguucauguuucgccucuaugauuccgacgaaaauggacugcuugaccaagccgagauggauugcauugucaaccagaugcugcacaucgcgcaguaccucgaaugggacccgacggagcugagaccuauucugaaggaaaugcuccagggcauggauuacgaccgggauggguucgugagccugcaagaguggguucauggaggcaugaccacaaucccccuucuggugcuccugggcauggacgauuccgggucuaaaggagacggccgccacgccuggaccaugaagcacuuuaagaaaccuacauauuguaauuucugccauaucaugcuuaugggggucagaaagcagggacuguguugcaccuacuguaaauauacggugcacgagcggugcgugagccgcaacauucccggcugugucaagacauacuccaaagcuaagagaagcggggaaguuaugcagcaugccuggguggagggaaauucuuccgugaaaugcgaucggugucacaagagcaucaagugcuaucaaucugucaccgcucgccacugcgugugguguagaaugacauuucaucggaaaugcgaacucagcacccugugugacggcggcgagcugcgcgaucacauucuccugcccaccuccaucugcccuauuacaagagaccggccgggggaaaagucugacggauguguuagcgccaaaggcgagcuugugaugcaguacaagaucauucccacgccugggacccauccccugcucguccuggugaacccuaaauccggaggcagacagggggagcgccuuaauuucuuucgggauacacccgacuucagaguucuggccugcggaggcgauggcaccgugggguggauccucgacuguaucgauaaggcuaacuucgcgaagcacccgccugucgccgugcugccccugggaacaggcaaugaccucgcucgcugccugcgguggggagggggcuaugaagggggcagccuuaccaaaauucugaaggauaucgagcagucuccucucgucaugcuggacagauggcaucuggaagugauuccccgcgaggagguugaaaacggagaucaagugccuuacuccaucaugaacaauuacuuuagcauuggcgucgacgccucuaucgcccaccgguuccacgugaugagagagaaacaucccgaaaaguuuaacucccgcaugaaaaauaaacuuugguauuucgaguuugggacgagcgaaacauucgcugccaccuguaagaagcuccacgaucauaucgagcuggagugcgacggaguuggcguggaucuguccaacauuuuucucgaagggaucgcgauucugaauaucccgucuauguacggaggcaccaaccuuuggggcgagaauaagaaaaaccgggcugucauuagagaaagccgcaagggggugacagacccuaaagagcugaaguucugugugcaggaccucuccgaucagcugcuggaaguugucggacuugagggcgccauggagauggggcagaucuauaccggacucaagucugccggccggagacuggcucaaugcgccagcgugacaauccggacgaauaaacugcuccccaugcaaguggacggggaacccuggaugcagccuugcuguaccauuaagaucacacacaaaaaccaggcuccgaugaugaugggacccccucagaaguccagcuuuuucucucugcgcagaaaaucccggagcaaggauuga

SEQ ID NO: 68322 - RNA, 3495 nt, Artificial Sequence
  derived and/or modified sequence opt5 from DGKH__Homo_sapiens__NP_001191433
auggccggcgcugggggacagcaccaucccccuggcgccgcugggggagcggccgccggcgcuggggccgcugugaccagcgccgcggccuccgcuggaccgggcgaggacucuagcgauuccgaagccgagcaagaaggcccccagaagcugaucagaaaagucucuacaagcgggcagauucggacgaagaccuccaucaaagagggacagcuccugaagcaaacaucuagcuuccagcgcuggaaaaagagauacuuuaagcugcggggccgcacccuguauuacgcuaaagacuccaagagccucauuuucgaugaaguugaccugucugaugccuccguggcggaggccagcacaaagaacgcuaauaacucuuuuaccaucauuacaccuuucagacggcuuaugcugugcgccgagaaucgcaaggaaauggaggacuggaucuccagccucaaaucugugcagaccagagaacccuaugaggucgcucaguuuaacguggagcacuucuccgggaugcauaauugguacgccuguagccacgcccggccuacguuuugcaacguuugucgcgaaucccugucuggagugaccagccauggccuguccugcgaggucuguaaguucaaggcucacaaaagaugcgcggugcgggccacaaauaacuguaaguggaccacacucgcuagcaucgggaaagauauuaucgaagacgaggauggaguugccaugccccaccaauggcuggaaggcaaucuuccugugucugccaagugcgcugucugugacaaaaccugcggcuccgugcugcgccuccaggauuggaagugucuguggugcaaaacgauggugcauacagccugcaaggaccuuuaucacccgauuuguccccuggggcagugcaaggucagcaucauuccucccaucgcgcucaacucuaccgauagcgacggauuuuguagagcuacauucuccuuuugcguuucuccucugcugguguucgugaauagcaaauccggcgacaaccagggggucaaguuucuccggcgcuucaaacaacugcuuaaucccgcccagguguucgaucugaugaacggaggcccgcaucucgggcugagacuuuuucagaaguucgacaauuuucggauucugguuuguggaggcgauggcagcgugggguggguccucucugagaucgacaaacugaaccugaacaagcaaugccagcucggagugcugccucuuggcaccgggaaugaucuggccagaguucucggauggggcggguccuacgacgaugacacccagcugccccagauccuugagaagcuggaacgcgcuagcacaaaaaugcucgaucgguggucuauuaugacguaugagcugaagcugccucccaaagccucccuccugcccggcccuccggaagcuagcgaggaguucuacaugaccaucuacgaggacuccguggccacacaccuuaccaagauucugaacucugaugagcacgcggucgugaucagcuccgccaaaacacucugugaaaccgucaaggacuuuguggcuaagguugagaaaacguaugacaagacacuggaaaaugccguggucgcugaugccguggcgucuaaaugcagcguucugaacgagaaacuugaacaacuccugcaggcccugcauaccgacucccaggcugcccccgugcucccuggacugagcccccuuauugucgaggaggaugcuguggaaucuuccagcgaggaaucucugggcgaguccaaagagcagcucggggacgaugugaccaagccuagcucucaaaaggccguuaaacccagagaaaucaugcugcgcgccaauagccugaagaaagcugucagacaggugaucgaggaagcgggaaaggugauggacgauccgacaguccacccuugugagcccgccaaccaguccagcgacuacgauucuaccgaaacagacgaguccaaagaggaagcuaaggaugacggcgccaaagagagcauuacggugaagaccgccccucggucccccgaugcucgcgccucuuaugggcauagccagacagacuccguuccuggacccgcgguggcugccucuaaggaaaaucuuccgguccucaacacccggaucauuugcccuggccugagagccgggcuggcugccagcaucgcgggcuccucuauuaucaauaaaaugcuccuggcuaacaucgaccccuucggagccacacccuuuauugauccugaccuugauagcguggacggcuacuccgagaaguguguuaugaauaacuauuucgggaucggacuggaugccaaaauuagccucgaauuuaauaacaagcgcgaggagcacccggaaaaaugccggucuagaaccaagaaucugaugugguacggcgugcuggggacgcgcgagcuucuccaacgguccuauaagaaccuggaacagagaguccagcuggagugcgacggacaguacaucccccucccuagccugcaaggcauugcugugcuuaacauccccucuuacgccgggggcaccaauuucuggggaggcacaaaagaagaugacauuuuugcugccccuuccuucgaugacaagauccuggagguuguggcgaucuuugauagcaugcagauggccgucucucgggugauuaaacuccagcaucaccgcaucgcucaauguagaaccgugaagauuacaaucuucggggacgagggaguccccguucagguggauggcgaagccugggugcagccucccgggauuaucaaaaucguccacaagaaccgggcucagaugcugaccagagaccgcgccuucgaguccacgcuuaagagcugggaagacaaacaaaagugcgauuccggaaaaccggugcuucggacacaucucuauauucaccaugccaucgaccuggcuaccgaggagguuagccagaugcagcuguguucucaggcggccgaagaacucauuacaagaaucugcgaugcugccaccauucacugucugcuugaacaagagcuggcccacgcugugaaugccugcagccaugcgcucaacaaggcuaauccucgcugucccgaaucccugaccagagacacagccacggagaucgccaucaacgucaaagcucuguacaaugagaccgaaucucuucuggugggccggguuccucuccagcuggagagcccccacgaggaacgcguguccaacgcccuccauucugucgaaguggagcugcagaaacuuacagagauuccguggcuguauuacauccuccacccuaaugaagaugaggaacccccuauggacugcaccaagagaaacaaucggagcacaguuuuucgcauugugcccaaguucaagaaagagaagguccagaaacaaaagaccuccucucagcccgggagcggcgauacggaauccggaagcugugaggcgaacucuccuggcaauuga

SEQ ID NO: 68323 - RNA, 3198 nt, Artificial Sequence
  derived and/or modified sequence opt5 from DGKI__Homo_sapiens__NP_004708
auggacgccgcuggcagagggugccaucugcucccccugccugccgcgcggggaccggcucgcgcccccgccgcugccgcugccgcggccgcuagcccucccggcccuuguuccggggccgcuugcgcccccucugcggccgcuggagccggcgcuaugaacccuagcuccucugccggggaggaaaagggagccaccggcggcagcuccucuagcggguccggagcuggcagcuguugccuuggggcggagggaggcgccgauccgagaggggcuggaucugccgccgcugccggcgcggcugcccuggacgaacccgccgcugccggccagaaagagaaggaugaagcucucgaggagaaacugcggaaucuuacauuccgcaagcaaguguccuacagaaaagccaucagccgggcggggcugcagcaccucgccccugcucacccccugucucugccugucgccaacggacccgcuaaggaaccgcgcgccacgcucgacugguccgagaaugcgguuaacggcgaacaucuguggcuugagaccaaugugagcggggaucuguguuaucucggagaggaaaacugccaggugagauuugccaagucugcucugcggcgcaaaugugccgucugcaagauugugguucacacagcuuguaucgagcagcuugagaaaauuaauuucagaugcaagccuaccuuucgggagggcgggucccgcagccccagagaaaacuucgugcggcaucacuggguccaccgcagacggcaagagggaaaauguaagcagugcggcaagggcuuucagcagaaauucuccuuucauucuaaggagaucguggccauuagcugcuccugguguaaacaagccuuccacaauaagguuacaugcuuuaugcugcaucacaucgaagaaccuuguagccucggggcucacgcggccgugaucgucccucccaccuggauuaucaaagugaagaaaccccagaacucucugaaggcuuccaauagaaagaaaaagcgcaccagcuucaaacggaaggccucuaaaagaggaauggaacaggagaacaagggccgcccguuugugauuaagcccaucagcuccccucugaugaaaccccuccuggucuucguuaauccuaagucugggggaaaccagggcacaaaagugcuucaaauguuuaugugguaccugaaucccagacagguguucgaccucagccaggaagggccgaaggaugcccuggagcuuuaucggaaagucccuaaccugcgcauucucgcuugcggcggagacggcacggugggguggauccuguccauucuggaugagcuccaacugagcccccagccucccguuggagugcuuccucugggcaccgggaacgaccucgcccggacacugaauuggggaggcggguacaccgaugaacccgucucuaagauccuuugucagguggaggacggcacaguugugcagcuggauagauggaaccuccaugucgaacgcaauccggaccugccucccgaggaacuggaggacggagugugcaagcucccccugaacgucuucaauaacuauuuuucccuuggcuucgaugcgcacgugacccuggaguuucaugaaagccgggaggcuaauccugaaaaauucaacucuagauuucgcaauaagauguucuacgccggggccgcuuuuuccgacuuccuccaacggagcuccagagaucugucuaaacacguuaagguggucugugacggaacggaucugacaccgaaaauccaggagcuuaaguuucagugcauuguguuccucaacaucccccgguauugugccggcaccaugccuugggggaaucccggagaccaucacgauuuugagccucagcgccacgacgauggcuacauugaaguuaucggguucacaauggcgagccuggcugcccugcaagugggcggacauggcgagagacuccaccagugccgggaagucaugcugcuuaccuacaaguccauucccaugcaaguggacggggagccuuguagacuggcccccgcuaugauccgcaucucucuccggaaccaggccaauauggugcagaaaagcaagagacgcaccuccaugccgcugcugaacgauccucagagcguucccgacagacuucggauucgcgucaauaaaaucucucuccaggacuaugaaggauuucauuacgauaaggagaaacugagagaggcuuccauuagcgacuggcugcggacaaucgccggcgaacucgugcagucuuucggggcgauuccucugggaauccuugugguccgcggcgauugcgaccuggagacgugcagaauguauaucgaucggcuccaagaagaccugcaguccgugagcucugggagccagcgcguucacuaccaagaucacgagaccuccuuccccagagcccugagcgcucagcggcuuucuccgcgcugguguuuucucgacgauagaucccaggaacaucugcacuucgugauggagauuagccaggacgagaucuuuauucuggauccugacauggucgugucccaacccgccggcacaccucccggaaugcccgaucucguuguggaacaggcuucuggcaucagcgacugguggaacccugcccugcggaagagaaugcuuuccgacucugggcugggaaugauugccccguauuacgaggauagcgaccucaaagaucugucccauucucgcguccugcagagccccguguccagcgaagaccacgcuauccuucaggcgguuauugccggcgaucucaugaagcugaucgagucuuauaagaacgggggaucccugcucauccaaggcccugaccauugcagccugcuucacuacgcugccaaaaccggcaauggggaaauugugaaguacauccuggaucacggacccucugagcuccuggacauggccgauuccgagacaggcgaaaccgcucugcauaaagccgcgugucagcggaacagagcugucugccagcuucugguggacgccggggccagccuccgcaagacggauucuaaaggaaagacaccucaggagcgggcucaacaggccggcgaccccgaucuggcggcuuaucucgaauccagacagaauuacaaggugauugggcacgaggaccuggagaccgccgucuga

SEQ ID NO: 68324 - RNA, 3816 nt, Artificial Sequence
  derived and/or modified sequence opt5 from DGKK__Homo_sapiens__NP_001013764
auggacagaggcgccgcugccgcgcaggggaccgcucccccucaagauggagagcagccggccgaaagccccgagccucccccucccuggccuccgcccccucccccucccgccccgccucccgcuccuccccugcucuccgaagccucucccgagccuaucccggaacccugcccugagcuggcucccggcccuugucccgaggccacaagcgaauccgcgacggagcuuuacaccgaaccgacaccugagcccgccaccgagccugcuucugaacccgccccugagcccgcuacagaaccggccccugagcccgcgaccgaacccgccccugagccggcucccgagccugccacagaaagcgcucccgagccuacccccgaaccugcccuggaguccgugcccgaaccggccccugagcucacgcccgaggucgcuccugaacuggcgcccgagccgaccccugaacccguuacagagcuugccccugaguucugccccgaagcugcccccgaguuucggccuucuccggcccccugucugcuccagugcccuguggacacccgcgaaagagggcugaagacaagccccuccccuagccccucuccuuccccgcggacccccaugagcuggucucgcauuaaaaagauccugaaagagggaccuaugcucaagaacuguaauuccuucaaaagauggaagcugcgguauuuucuugugcagggccaaaagcuguacuucgcucaccaucccgccuuugcgcacuucgaaacgauugaucucagccaggcuacagucgccgagucuuccugccgcaaccugugucauagcuuuugcgugaucaccccucagagaaaaauuacacuugccgcucccaaucggaaggacauggaggaauggaucaacaucauuaaaaccauccagcaaggggagauuuauaagaucccggccgcugaaaauaacccuuuccugguuggaaugcacuguugguacuccucuuauagccaucgcacccagcacugcaauguguguagagaguccauucccgcccucagccgggaugcgaucauuugcgaagucugcaaagugaagucucaccgccugugugcccugagagcuuccaaggacugcaaauggaacacacucagcaucacggaugaccugcuucugcccgccgaugagguuaauaugccucaucaguggguggagggcaacaugcccgucucuagccagugugcugugugccacgaauccuguggcucuuaccaacggcuccaggacuuucgcugccugugguguaauagcaccgugcaugaugacugcagacggagauucuccaaggaguguugcuuucgcagccaccggucuuccgucaucccuccgacagcccuuagcgaucccaaaggggacggacagcugguugugucuuccgacuucuggaaccucgauuggagcuccgcguguucuugcccucugcugauuuuuaucaauagcaaguccggcgaccaccaagggauuguguuccucagaaaauucaagcaguaucugaaccccucucaggucuuugaucuucugaaaggaggcccugaagccgggcucagcauguucaagaauuuugcucgcuuccggauccuggugugcggaggcgacggcuccguuagcugggugcuuucucugauugaugccuuugggcuccaugagaagugucagcuggcugucaucccccugggaaccggcaacgaccucgccagagugcugggguggggagccuucuggaacaaauccaagagcccgcuugauauccugaaucgcguugaacaggcuucugugcggauucucgacagaugguccgucaugauccgcgagacaccucggcaaacgccccugcugaaaggccagguggagauggaugucccuagauuugaagcggccgcuauucagcaccuugagagcgccgccaccgaacucaacaagauccugaaagcuaaguaccccacagagaugauuaucgccacccgcuuccugugcucugcgguggaagacuuuguuguggauaucgucaaggcuugggggcaaauuaaacagaauaacaccgccaucgugagcguuauucucaaguccgaccugauguacgaccggcuuagcgugcugaucgauguccucgccgaggaggcugccgcgacaucugcugaaaaauccgccaccgaguaugccgacagcuccaaggcugauagaaaaccuuucauuccccagaucgaccauauugccaaguguaagcuggaacuggcuacaaaagcccagucucuucaaaagagccucaaacugaucaucuuucagguggagcaggcgcuggaugaggaaucccggcagacgauuucugugaagaauuucagcuccaccuuuuuccucgaggacgauccggaagacaucaaccaaacaucuccucgcagacggagcagacgcggaacccuguccagcauuucuucccuuaaaagcgaggaucuggacaaucucaaccuggaucaucugcacuucacacccgaaucuauccgguuuaaggagaagugcguuaugaauaacuacuucggcauuggccuugacgccaaaaucucccucgauuuuaauaccagacgcgacgagcaccccgggcaguauaacagcagacugaagaauaaaaugugguacggacugcucggcacgaaggaacugcuucagcggucuuaucgcaaacuggaggaaagaguccaccucgagugugacggggaaaccaucucccugccuaaccugcaaggaauuguggugcuuaauaucacaagcuacgcuggcgggauuaacuucuggggcuccaacaccgccacaaccgaguaugaggcuccggccaucgaugacggaaagcucgaagucguggccauuuuuggcagcguucagauggcuaugucucggaucaucaaucugcaucaccaucgcauugcgcagugccacgaggugaugaucacgauugauggggaagagggaauccccguccagguggacggcgaagccuggauucaaagaccugggcugaucaaaauccgguacaagaacgcugcccagaugcucacacgcgauagagacuucgagaauagcaugaagaugugggaguacaaacacaccgaaauucaggccgcuccccagccucaacuggauuuucaggacucccaggagucucuuagcgaugaagaguaugcccagaugcaacaucuggcgcggcucgcugagaaccugaucuccaagcugaaugaccuuucuaaaauucaccagcauguuagcgugcugaugggauccgucaacgccucugccaauauccucaacgauauuuucuacggccaggacagcgggaaugaaaugggcgcugccuccuguauccccauugagacacugagccgcaacgaugcgguggacguuaccuuuucucucaagggacuguaugacgauaccacagcuuuccuugacgaaaaacugcucagauccgccgaggaugaaacggcccugcaaagcgcucuggacgccaugaauaaggaguuuaagaaacuuucugagaucgauuggaugaacccuaucuucgugccggaagagaaguccagcgacaccgauucccggucucugagacucaaaauuaaguuucccaaacugggcaagaagaaagucgaagaggaacgcaagccuaaaagcgggcaguccgugcagagcuucaucggaaaucucuggcaccggagacaucgcgaggacgaggcugaaggcgaugacccccugacaccuucucggucccagcuuuga

SEQ ID NO: 68325 - RNA, 2829 nt, Artificial Sequence
  derived and/or modified sequence opt5 from DGKQ__Homo_sapiens__NP_001338
auggccgcugccgcggagcccggcgcuagagccuggcugggaggaggcagcccucggccggggucccccgccugcucuccugugcucggaagcggcgggcgcgcuagacccggaccuggccccggcccugggccggaacgggccggaguccgcgcucccggcccugccgcggcccccgggcacuccuucagaaagguuacccugacaaaaccuacguuuugucaucuuugcucugacuucaucuggggacuggcuggcuuucucugugaugugugcaacuucaugagccacgagaagugucugaaacaugugcggauucccugcaccuccgucgccccgucucuugugcgcguuccuguggcucacuguuuugggcccagaggacugcauaagcggaaauucugcgccgucugucgcaaggugcucgaagcgccugcccugcacugcgagguuugugaacugcaccuccaucccgacugcgugcccuuugcuugcagcgauuguagacagugccaccaagacggccaucaggaucacgacacacaccaucaccauuggcgggagggcaaucugccuuccggggcccgcugugaggucugcagaaagaccuguggaagcucugaugugcuugcuggcgugcggugcgaauggugugggguccaggcccacucccugugcagcgccgcucucgcgccggaguguggauucggccgccugagaucucuuguucugcccccugccugcgugcggcuccugcccgggggauuuuccaaaacacagagcuucagaaucguggaagcugccgagccuggcgagggcggggacggagccgauggcucugcugccgucgggcccggacgcgaaacccaagcgacaccggaguccggcaagcagacccugaaaauuuuugacggggaugacgcugugcggagaagccaguuccgccucguuacggugucccggcuggccggcgccgaagagguccuugaagcugcccugagagcucaucacaucccugaggaucccggacaccucgagcugugucgccuuccucccucuagccaggccugcgacgcgugggccggcgggaaggcuggauccgccgugauuagcgaagagggccggucuccuggguccggagaagcuacccccgaggccuggguuaucagagcgcugccgcgcgcccaagaagugcucaaaaucuacccuggcuggcugaaggucgggguggcuuaugucagcgugcggguuacacccaagucuaccgccagaagcgugguccuggaggugcucccccugcuuggccgccaggcugaguccccugaaucuuuucagcugguugagguggccaugggaugccggcauguccagagaacaaugcucauggacgaacaaccgcugcuugaucggcugcaggacauucgccagaugagcgugagacaagugucccagacccgguucuacguugccgagagcagagaugucgcuccccacgugucucucuucgugggcgggcugccucccggacuguccccugaagaguauagcucucuccugcaugaggcgggcgccacgaaagcuacagucguguccguuagccacaucuacuccucucagggggccgugguccuugacguggccuguuuugcugaagccgagcgccuguauaugcuccugaaggauauggcgguucggggaagacugcuuaccgcucucgugcugcccgaccugcuccacgccaaacugccucccgauagcugcccgcuucuggucuucgugaacccuaaguccggcgggcucaaaggccgcgaccugcuguguucuuuuagaaaacuucucaauccccaucagguuuucgaucugacaaacggaggcccucugcccgggcuccaccuguuuagccaagugccgugcuuccggguccuuguguguggaggcgacgggaccgugggauggguccugggcgcccucgaagagacccgcuacagacuggcuugcccugagcccuccguugccauucugccucuugggacaggcaaugaucucggacgggugcugcgcuggggcgcgggguauagcggagaagaccccuuuucugugcugcucuccgucgacgaggcugaugccgugcugauggacagauggacgauccuucuggaugcccaugaagcuggcagcgccgagaacgacaccgcugaugccgaacccccuaagauuguucagaugucuaauuacugugggaucggaauugacgcggagcucucccuggauuuccaccaggcccgggaggaggaaccgggcaaguuuacaagccgccugcauaacaagggcguguacgucagaguggggcuucagaaaaucucucacagccggucccuccacaagcaaauccgccugcagguugaaagacaggagguggaacugcccagcauugagggacucaucuucauuaauaucccuucuuggggcuccggggcugaccuguggggaagcgauuccgacacccgguuugagaaacccagaauggaugacggccuucuggaagucguggggguuacaggagugguccauaugggccaggugcaaggcgggcuccgcucugggauucggaucgcccagggcagcuauuucagagugacccugcugaaggcuacgccuguccagguugauggggagcccugggugcaggccccuggacacaugaucauuuccgccgcuggcccgaaagugcauaugcuucgcaaggcgaagcaaaaaccccggagagccgggacaacccgcgacgcucgggccgacgccgcuccugcccccgaaucugauccuagauga

SEQ ID NO: 68326 - RNA, 3354 nt, Artificial Sequence
  derived and/or modified sequence opt5 from DGKZ__Homo_sapiens__NP_001099010
auggagaccuucuuuagacggcacuuccgcggcaaggugcccgggccuggagaaggccagcaaagaccgagcuccgucgggcugcccacaggaaaagcccggcgcagaucuccugcuggccaggccagcuccucucucgcgcagcggcgcagaagcuccgcucagcugcaagggugccuucugucuuguggaguucgggcccagggcagcucccgcagacggagcucuacggugcccccuuccugcaacccccgcuuuaucguggacaagguccucaccccucagccgacaaccgugggcgcccagcugcuuggggcuccccugcuccugacaggacugguuggcaugaaugaggaagagggggugcaagaagaugucguggccgaggcuagcucugccauucagccuggaaccaaaacacccggcccucccccgccuagaggggcgcagccccuccugccucuuccccgguaccugcgcagagccuccagccaucuccugcccgcugacgccguuuaugaucacgcucuuuggggacugcauggcuacuaucggagacucucucagcgccggccuuccggccaacacccggggcccggaggcagacgcgccagcgggaccacggcgggaaccaugcugccuacacgggugagaccccugucccgccggagacaggucgcccuccgccggaaggcugccggcccucaggcuuggucugcccugcuugccaaagcuaucaccaagagcgggcugcaacaucucgcgcccccgccucccacaccuggagcccccuguuccgagagcgaaagacagauucgcucuaccguggacugguccgagagcgcuacguacggcgaacacaucugguucgagacaaacgugucuggcgauuuuugcuaugucggggagcaguacuguguugcccggaugcuuaagagcguguccagacggaaaugcgccgcuuguaagauugugguccacaccccuugcaucgaacagcuggagaaaaucaauuuccgcuguaagcccucuuuuagagaaagcggaucccggaacgugagagagccgacauucguucgccaucacugggugcaucggagacgccaagacggcaaaugcagacacugugggaagggauuucagcagaaguucaccuuucacagcaaagaaauugucgccaucucuugcuccuggugcaagcaggcguaucauagcaaagugucuuguuucaugcugcaacagauugaggagccuugcucccucggcguucacgcugccguggucaucccucccaccuggauucugcgggcccgcagaccccagaauacacugaaggcuagcaaaaagaaaaagcgggccuccuuuaagcgcaaaucuagcaagaaagggccggaagagggcagauggcggcccuucaucauucgcccuacgcccuccccucucaugaagccccugcuuguguucgucaacccuaaaucuggaggcaaucagggggcuaagaucauccagagcuuucugugguaccucaaccccagacagguguucgaucugucccagggaggcccgaaggaagcccuugagauguaccggaaaguucauaaucugcgcauucucgcgugugggggagacggcaccgugggguggauccugagcacacuggaucagcucagacugaagccucccccucccgucgccauucuuccgcugggcaccggaaacgaccucgcucggacacugaauuggggcgggggauauaccgaugaaccugugucuaaaauccugucccacguugaggagggcaacgugguccaacuugacagaugggaucuccaugccgaacccaauccugaggcugggcccgaagaccgcgacgagggagccacggaucggcugccccuggacguguuuaacaauuacuucagccucggcuuugaugcgcacgugacacuggaguuccacgaaucuagagaggccaacccugaaaaguuuaacucccgcuuccggaauaaaauguuuuaugcugggaccgccuucagcgacuuucuuaugggcucuagcaaggaucuggcuaagcauauuagaguugucugcgacggaauggaucucaccccgaaaauccaggaccugaagccccagugugugguguuccugaacaucccucgcuacugcgccggcacaaugcccugggggcacccuggagagcaucacgauuuugaaccccaacggcacgacgauggcuaucuugaggucauuggguucaccaugacaucccucgccgcucugcaagugggaggccauggggagagacugacgcagugucgcgaaguugugcucaccacaagcaaagcgaucccuguccagguggacggcgagccgugcaagcuggccgcuucucggauuagaaucgcccuucggaaucaagccaccaugguucagaaagcuaagcgcagauccgccgcgccccugcacagcgaccagcagccugugcccgaacaacuccggauucaggucucccgcgugucuaugcaugauuacgaggcucugcacuaugacaaggaacagcugaaagaggccagcguuccucuuggaacaguggucgugcccggcgauuccgaccucgagcuguguagagcccauaucgaacggcugcagcaagagccggauggggcuggagccaagucuccuaccugccagaaacucagccccaagugguguuuccuggacgcgacgaccgcuuccagauuuuaccgcaucgaucgggcccaggaacaccuuaacuacgugacagagauugcccaagacgaaaucuauauucuggaucccgagcuccugggcgcuucugccagaccugaccugcccaccccuacaagcccgcuucccaccuccccuugcagccccacgccucgcucucuccagggggaugcugcgcccccgcagggagaggaacugaucgaggccgccaaacggaaugacuucugcaagcugcaggaacuccacagagcuggcggcgaucugaugcaucgcgacgagcaaucccggacacuucugcaccaugccgucagcaccgggucuaaagacguugugagauaccuccuggaucacgcuccucccgaaauucuggacgccguggaggagaacggagaaacaugucuucaucaggccgcugcgcugggccagcgcaccaucugccacuauauugucgaggccggggcuucccucaugaagaccgaucagcaaggagacacaccuagacagcgggccgaaaaggcccaggauacggagcuggcugccuaccucgagaaucgccagcacuaucaaaugauccagagagaagaccaggagaccgcgguguga

SEQ ID NO: 68327 - RNA, 834 nt, Artificial Sequence
  derived and/or modified sequence opt5 from DGUOK__Homo_sapiens__NP_550438
auggccgcuggcagacuguuccucagccggcugcgcgcccccuuuuccucuauggcuaagagcccucuugaggggguguccucuagcagaggacugcacgcgggccgggggccgcgcagacucuccaucgaaggaaacauugccgucggcaaaucuaccuucguuaagcugcuuacaaaaacguaccccgaguggcauguggccaccgaaccuguggcuacauggcagaauauccaagccgcugggacccagaaggccugcacagcgcagagccugggaaaccuccuggacaugauguaucgggagcccgcccgcugguccuacaccuuucagacauucagcuuucugucuagacucaaaguccaacuggaaccuuuccccgagaaacuucugcaggcucggaagccugugcagauuuuugagcgcuccguuuauagcgauagauacaucuucgccaagaaucucuuugaaaacggcucucuguccgacauugaguggcacaucuaucaggauuggcauagcuuccuucugugggaauuugcuucucggaucacccuccacggcuucauuuaccugcaagccuccccgcaagugugucugaagcgccucuaucagagagcgcgggaggaggaaaaagggaucgagcuggccuaccuugaacagcugcauggacagcacgaggcuuggcucauucacaagacgaccaaacugcauuuugaagcccuuaugaauauccccguccuggugcucgacguuaacgaugacuucagcgaggaggugacaaagcaggaagaucugaugcgcgaggucaauaccuucgugaagaaccuguga

SEQ ID NO: 68328 - RNA, 1428 nt, Artificial Sequence
  derived and/or modified sequence opt5 from DHCR7__Homo_sapiens__NP_001157289
auggccgcuaagagccagcccaacaucccuaaagccaagucccuggacggcgugaccaaugauagaacagcgucucaagggcaguggggacgggcuugggaggucgacugguucagccucgccuccguuauuuuucugcuucuguucgccccguuuaucguguacuauuucauuauggcuugcgaucaguacucuugugcccucacgggccccguggucgacaucgugaccgggcacgcucgccugagcgauauuugggccaaaacaccucccaucaccagaaaggcggcccagcuuuauacacuguggguuaccuuucaagugcuccuguacacaucccugccugacuucugccauaaauuucuccccggauaugucggcgggauccaggaaggagcugugaccccugccggcguugugaacaaguaccagauuaauggccugcaggcuuggcuucugacgcaccuccugugguucgccaacgcgcaucuucugucuugguuuagcccgaccaucauuuucgauaauuggaucccccuccuguggugugccaacauucugggguaugcugucuccacauuugccauggugaagggauacuucuuuccuaccagcgcucgggacugcaaauucacaggcaauuucuuuuacaacuauaugauggggaucgaguucaauccccgcauuggaaagugguuugauuucaaacucuuuuucaacggcagaccugggaucguggccuggacccugaucaaucuuucuuuugccgcuaagcaacgggaacugcacucccaugucacgaacgcgaugguucucgugaaugugcugcaggccauuuacgucaucgacuucuuuuggaacgagacaugguaucuuaaaaccauugauaucugucacgaccacuucggaugguaccugggcuggggcgauugcguguggcuccccuaucuguacacacugcaggggcucuaucugguuuaccauccggugcagcuuagcaccccucacgcugucggagugcugcuccugggccuuguuggguacuauauuuuucgcguggccaaucaucaaaaggaccuguucagacggaccgacggacgcugucucaucuggggcagaaagcccaaagucaucgaaugcucuuacacauccgccgaugggcagcggcaccacagcaagcugcuggugucuggauuuuggggcgucgcucgccauuucaacuaugugggcgaccucauggggucccuggccuacugucuugcgugcggaggcgggcaucugcucccuuauuucuacauuaucuauauggcuauucugcugacgcacagaugucuucgggaugagcaccgcugcgccagcaaauacggaagagacugggagcgguacaccgccgcuguucccuauagacuccugcccggcaucuuuuga

SEQ ID NO: 68329 - RNA, 1005 nt, Artificial Sequence
  derived and/or modified sequence opt5 from DHDH__Homo_sapiens__NP_055290
auggcccugagauggggcaucgugagcgucgggcucauuuccucugacuucaccgcuguucugcagacacuuccccggagcgagcaccaagugguggccgucgcggcucgcgaucuguccagagccaaggaauuugcccagaaacaugacaucccuaaggcuuacggaucuuaugaggaacucgccaaagauccgagcguggagguugcuuacauuggcacgcagcacccccagcauaaggccgcggugaugcugugccuugccgcugggaaagccguccugugugaaaagccuaccggagugaacgcugccgagguucgggagaugguggcggaagcccgcuccagagcucucuuccugauggaggccaucuggacacgguuuuuccccgcuucugaagcccugcgcagcguccucgcccaaggcacccugggggaccuuagaguggcucgggcggaguuuggaaagaaucugauucacgugccucgcgccgucgauagagcucaggccggcggcgcccuccuggacaucgggaucuauugcguucaguucacauccaugguguuuggaggccagaaacccgagaagauuagcguggucgggcggcgccaugaaaccggaguggaugacacaguuaccgugcuucugcaauacccuggcgagguccacgggucuuucacguguuccaucaccgugcagcucagcaacacagcuucuguuuccggaaccaaaggcauggugcagcugcugaauccgugcuggugucccacagaacucgucgugaagggcgagcacaaagaauuuccucugcccccuguccccaaggauugcaacuucgacaauggggccggaaugagcuaugaggcgaagcaugugugggagugucuuagaaaaggcaugaaggaaucuccgguuauuccucuguccgagagcgaacuccuggcugauauccuugaggaagugcggaaagccauuggggucaccuuuccccaggacaagcgcuga

SEQ ID NO: 68330 - RNA, 564 nt, Artificial Sequence
  derived and/or modified sequence opt5 from DHFR__Homo_sapiens__NP_000782
auggugggcagccugaacugcaucgucgccguuucccagaauauggggauuggaaagaacggcgaccuccccuggccuccgcugagaaaugaguuccgguacuuucaacgcaugaccacaacgucuagcguggaagggaaacagaaccuugugaucaugggaaagaaaaccugguucuccauucccgagaagaauagaccucugaaaggccggaucaaccucguccugucucgcgaacuuaaggagcccccucagggggcucacuuucugagcagaucccucgaugacgcccugaagcugacagaacagcccgagcucgcgaauaaaguggauaugguuuggauugugggaggcucuagcgucuauaaggaggcuaugaaccauccuggccaccugaaacuuuucgugacccggaucaugcaagacuuugaauccgauacauucuuuccggagaucgaccuggaaaaguacaaacuccugcccgaguauccugggguucuuagcgaugugcaggaggaaaagggaauuaaguacaaauucgaggucuaugaaaagaaugacuga

SEQ ID NO: 68331 - RNA, 564 nt, Artificial Sequence
  derived and/or modified sequence opt5 from DHFRL1__Homo_sapiens__NP_001182572
auguuccugcuccugaacugcaucguggccgucagccagaauaugggcauugggaagaacggagaccuucccagaccuccgcugcggaaugaguuucgcuacuuccaaagaaugaccacaacguccucuguugaaggcaaacagaaccucgugaucauggggcggaagaccugguuuagcauucccgagaaaaaucgcccucugaaggauagaaucaaccuugugcugucccgggaacucaaagagcccccucagggagcucacuuccuggcccgcucucuggacgaugcgcucaagcugacagaaagacccgagcuugcuaauaaggucgacaugauuuggaucgugggcgggagcuccguuuauaaagaggccaugaaccaucugggacaccucaagcuguuugugacccggaucaugcaggauuucgaaucugacacauuuuucagcgagauugaucuugaaaaauacaagcugcucccugaguauccgggcguccuguccgacgugcaagagggcaaacauaucaaguacaaguuugaaguuugugagaaagaugacuga

SEQ ID NO: 68332 - RNA, 1191 nt, Artificial Sequence
  derived and/or modified sequence opt5 from DHH__Homo_sapiens__NP_066382
auggcccugcucaccaaccugcuuccccugugcugucucgcucugcuugcccugccugcgcagagcugcggcccggggagaggacccgugggccggcgcagauacgcucggaagcaacucgucccucugcuguauaaacaguucguucccggggugccugagcgcacacucggagccuccggccccgccgaagggagaguggcucggggaucugagcgcuuuagagaccuggucccuaauuacaacccggauaucauuuucaaggacgaagagaauagcggcgccgaucggcuuaugacggaacgcuguaaagagagagugaacgcucuggccaucgcgguuaugaauauguggcccggcgugcggcuccgcgucaccgaggggugggacgaagauggacaccaugcccaggacucccugcacuaugagggcagagcucuugauauuacaaccucugaccgggaucgcaacaaguacgggcugcucgccagacuggcuguggaagccggauuugacuggguuuauuacgagagccggaaucaugugcacgucuccgugaaagcggauaacucucuggccgugagagcuggcgggugcuucccuggaaaugccacaguccgccucuggagcggcgagcggaagggccugagagaacuucaucgcggggacuggguucuggcugccgaugccuccggacggguggugcccaccccuguccuccuguuucuugacagagaccugcagcgccgggcuagcuucguggcgguugagacagaauggcccccgagaaagcuccugcugaccccuuggcaccucguguuugccgcucgcggccccgccccugcccccggggauuucgcucccgucuuugcccggagacugcgcgcgggagacucugugcuugcuccuggcggggaugcccugcggccggccagaguugcucggguggcccgcgaggaagcugucggaguguucgcgccccucacggcccacggcacccugcuugucaacgacgugcuggccuccuguuaugcuguucucgagagccaucaaugggcccacagagcuuuugccccucugcggcugcuccaugcgcugggcgcccuucugcccgggggagcugugcagccuacaggcaugcacugguacucuagacuccuguaccgccuggccgaggaacuucucggguga

SEQ ID NO: 68333 - RNA, 1188 nt, Artificial Sequence
  derived and/or modified sequence opt5 from DHODH__Homo_sapiens__NP_001352
auggccuggagacaccugaagaaacgggcucaggacgccgugaucauucucggcgggggaggccugcuuuucgcgagcuaccugauggcuaccggggaugagcgcuuuuaugccgaacaucucaugcccacacugcaaggacuucuggacccugaguccgcccacagacucgcuguccgguucacgucucugggccugcucccgcgcgccagauuucaggauagcgacaugcuggaaguucgggugcuugggcauaaguuccgcaaccccgugggaaucgcugccggcuuugauaaacacggcgaggcggucgacgggcuguacaagaugggauucggcuuuguggaaauuggguccguuaccccuaaaccccaggagggaaauccuagaccccggguguuccgccucccugaggaucaggccgucaucaacagauauggcuuuaauucucaugggcugagcgugguugaacaccggcuucgcgcuagacaacagaagcaggccaagcugacagaggacggacucccgcugggcgugaaccugggcaaaaauaagaccuccgucgaugcugccgaagacuacgcggagggggugcgggugcucggaccccuggccgauuaucuugucguuaacgugucuagcccuaauacagcuggccugcgcucccuccaggggaaagccgagcugagacggcuucugaccaaggugcuccaagaaagagacggacugcgccggguccacagacccgcugugcugguuaaaauugccccugaucucacaagccaggacaaggaggacaucgccucuguggucaaggaacugggcaucgaugggcuuauugugaccaacacgaccguuucccgccccgcuggacugcagggcgcgcuccggagcgagacaggcgggcugucuggaaaaccgcuuagagaccuguccacccagacaauccgcgaaauguacgcccucacccaaggccgggugccuauuaucggggucggaggcgugagcucugggcaggaugcucuggagaagauuagagccggcgccucccugguccagcucuauacggcucugacauucuggggacccccugugguuggcaaagugaagcgcgagcuugaagcccugcucaaagagcaaggguuuggaggcgucaccgacgcgaucggggcugaucaucggagauga

SEQ ID NO: 68334 - RNA, 984 nt, Artificial Sequence
  derived and/or modified sequence opt5 from DHPS__Homo_sapiens__NP_001193903
augcccaucauuccugccuucugggaggcugaagccggcgggagcagagaggaagaguuugaaaccucccuggcgaacaugaucgagaagaaacucgagccgcugucucaggacgaagaucaacacgcugaccuuacacagagccggcgcccccugacguccugcaccauuuuccucggauacacaucuaaucugaucagcuccggcauuagagagaccauccgguaucuugugcagcauaacauggucgauguucuggugacaaccgccgggggaguggaagaggaccucaucaagugucuggccccuacauaccugggcgaguuuucucuccgcgggaaagaacugagagagaauggaauuaaccggaucggcaaucuucugguccccaacgaaaauuauugcaaguucgaggauuggcucaugccuauucuggaccagauggugauggaacaaaacaccgagggcguuaaauggacgcccagcaagaugaucgcucgccuugggaaggagauuaauaacccugaauccguguacuauugggcccagaaaaaucacaucccggucuuuagccccgcucugaccgauggaucucucggcgacaugauuuucuuucauuccuacaagaacccugggcuggugcuggauaucguugaggaccucagacugaucaauacacaggccauuuucgcgaaauguaccggaaugaucauucuuggcgggggaguggucaagcaccauaucgccaacgcuaaucugaugcggaacggcgccgauuaugcuguguacauuaacacagcccaggaauuugacggcagcgauucuggggcgcgccccgacgaggccguguccuggggaaaaaucagagucgacgcucaaccuguuaagguguacgccgaugcuagccucguguucccccugcuugucgccgaaaccuuugcccagaagauggacgcuuucaugcacgagaaaaaugaggauuga

SEQ ID NO: 68335 - RNA, 783 nt, Artificial Sequence
  derived and/or modified sequence opt5 from DHRS11__Homo_sapiens__NP_077284
auggccagacccggcauggagcgguggcgcgacagacuggcucucgugaccggggccagcggaggcaucggggcggcugucgcccgggcccugguucagcaaggacuuaagguggugggcugcgcucgcacagucgggaacauugaggagcuggccgcugaauguaaauccgccggauacccuggcacgcucaucccguauagaugcgaucugucuaaugaggaagacauucuuagcauguucuccgcgauccggucucagcacagcggcguggauauuuguaucaacaaugccgggcuggcucgccccgacacccuccuguccggaucuacaagcggcuggaaggauauguuuaacguuaaugugcuggcccucuccaucugcaccagagaggcuuaccagagcaugaaagagcggaacgucgacgaugggcauauuaucaauauuaacucuauguccggacaccgcgugcugccucuuagcguuacacauuucuauucugccaccaaguacgcggugacagcccugaccgaaggccucagacaggagcugcgggaagcucaaacgcacauccgcgccaccuguauuucccccggggucguggagacacaguuugcuuucaaacuucaugacaaggauccugagaaggccgccgcuaccuaugaacagaugaaaugccugaagcccgaggacguggcggaagccgucaucuacguucucagcaccccugcucacauucagaucggagauauccaaaugagaccgacagaacaggugacguga

SEQ ID NO: 68336 - RNA, 843 nt, Artificial Sequence
  derived and/or modified sequence opt5 from DHRS2__Homo_sapiens__NP_005785
augcugagcgccguggcuagaggcuaccaggggugguuccaccccugcgcccggcucuccguccgcaugucuagcaccggaaucgacagaaagggcguucuggcgaaccggguggcuguggucacaggguccacgucuggaauuggcuuugccaucgcccgcagacuugcucgggauggggcccaugugguuauuagcucccgcaaacaacagaauguggacagagcuauggccaagcugcagggagagggccucucugucgcgggcaucgugugucacguugggaaagccgaagaucgggagcagcugguggcuaaggcccuugaacauugcggaggcgucgacuuccugguguguagcgcuggggugaacccucucgucggauccacccugggcacaagcgagcaaauuugggauaaaauccugucuguuaaugugaaguccccggcccuccugcuuagccagcugcuccccuauauggaaaaccgcagaggggcggugauccuggucucuuccauugccgcuuacaauccugugguugcccuuggaguguauaacgucagcaagaccgcucugcucggccugacacggacccuggcccucgagcuggcccccaaagacauccgcgugaauugcguugugccuggcauuaucaagacagauuuuucuaaagucuuccacgggaacgagucccuuuggaagaauuuuaaagaacaucaccagcugcagagaauuggagagagcgaagacugugcuggcaucguguccuuccucugcucucccgaugcgagcuacgucaacggggagaauauugccguggcuggauauuccacccggcuguga

SEQ ID NO: 68337 - RNA, 567 nt, Artificial Sequence
  derived and/or modified sequence opt5 from DHRS4__Homo_sapiens__NP_001269916
augcacaaggccggccugcucgggcugugcgcuagagccuggaacagcgugcggauggcguccucuggaaugacccgcagagacccccuugcuaauaaagucgcccugguuacagccagcacggauggcaucggguucgcuauugcccggcgccucgcucaggacggagcccaugugguggucuccucuagaaagcaacagaacguggaucaggcgguugccacccugcagggcgaggggcuuagcgugacaggaaccgucugucacgugggcaaagcugaagaccgggagcgccugguugccacagcugugaagcuccauggcgggaucgauauucuggucuccaaugccgcggugaacccguuuuucggaucuaucauggacgugaccgaagaggucugggauaaaagacggcugagcggcgaccgcguuuuucacuccagccuccaaucuauuuccagccuggaugggcagggaaagagaggcaagcaugaacggaauccugccgacaaaaaggugcgcagagcucgggggcuuugcuggcaccgcguguuccccguccuguga

SEQ ID NO: 68338 - RNA, 936 nt, Artificial Sequence
  derived and/or modified sequence opt5 from DHRS7C__Homo_sapiens__NP_001099041
augggcgugauggccaugcugaugcucccccugcuucugcucgggaucagcggacugcuuuucauuuaccaggaggucuccagacuguggucuaagagcgcuguucaaaacaaagugguggucaucaccgacgccauuuccggccucgggaaggaaugcgcgcggguguuucacacaggaggcgcucgccugguucugugugggaaaaauugggagagacucgaaaaccuguaugaugcccuuaucucuguggccgacccuagcaagacguucaccccgaaacugguccuccuggaucuuuccgacauuucuugcgugcccgauguugcuaaggaggugcuggacuguuacggaugcgucgauauccucaucaauaacgccagcgugaaggugaaaggcccugcucauaagauuucccuggaacuggacaaaaagaucauggaugccaauuauuuuggccccauuacacucaccaaagcgcugcuuccuaacaugaucagccggcgcacagggcagauuguccugguuaauaacauccagggaaaguucggcauucccuuuagaaccacauacgccgcuucuaagcacgccgcucucggguucuuugacugucugcgggccgagguggaggaauaugauguggucaucuccaccgugagcccuacguucauccgcucuuaccauguuuauccggagcagggaaauugggaagcguccauuuggaaauuuuucuuuagaaaacuuaccuacggcgugcaccccgucgagguggccgaggaaguuaugcggacagugcgcagaaagaagcaagaggucuucauggcuaacccuauccccaaagccgcuguguacguccggaccuuuuucccugaguucuuuuucgccgugguugccugcggggugaaggaaaaacugaauguccccgaagagggauga

SEQ ID NO: 68339 - RNA, 1140 nt, Artificial Sequence
  derived and/or modified sequence opt5 from DHRS9__Homo_sapiens__NP_001276692
augcccgagggcagaagccacugcgccuguuccaucaccucucugacacuccuggugagccuuacgcgggucacccuggacauucuccagaagcuggauccuccgcaacccgcucauuggcgccaccaucuucugguucucuacaaaaaggggguguaucugucccacacaggaggcaaaaugcuguucugggugcucgggcugcuuauccugugcggauuucucuggaccagaaagggcaaacugaagauugaagacaucacagauaaguacauuuucaucaccgggugugacucuggauuuggcaaccuugccgcgcggacauucgauaaaaagggcuuucaugucaucgcugccugccugaccgagagcggguccacggcccucaaagcugaaaccucugagcgccugagaacagugcugcucgacguuaccgauccugaaaaugugaagcggacagcccagugggucaaaaaccaggugggagagaagggccugugggggcuuauuaauaacgcuggaguucccggcgugcuggccccuaccgacuggcucacgcuggaggauuaucgcgaacccaucgaggucaaucuuuucgggcugauuagcgugacacucaacaugcugccucuggugaagaaagcgcagggaagagucaucaauguuuccagcgugggcggccggcucgccauugucgggggaggcuacaccccgucuaaguaugcuguggaaggguuuaacgacucccugcgcagagauaugaaagccuucggagugcacguuagcuguaucgagcccggccuuuuuaagacaaaucuggcugacccugugaaagucauugagaagaaacucgccaucugggaacaacugucucccgauaucaagcagcaguacggggagggauauauugaaaagucccuugacaaacugaagggcaacaaaagcuacgugaauauggaccucucuccuguuguggagugcauggaucacgcgcugaccucccuguuccccaagacccauuacgccgcuggcaaagacgccaagaucuuuuggauuccgcucagccacaugccugcugcccugcaggauuuccuucugcucaagcaaaaagccgaacuggcuaaccccaaggcggucuga

SEQ ID NO: 68340 - RNA, 2760 nt, Artificial Sequence
  derived and/or modified sequence opt5 from DHTKD1__Homo_sapiens__NP_061176
auggccagcgcuaccgccgcggcugccagacggggccuggggcgcgcccucccccugcuuuggagaggauaccagacagagcggggcguguauggguaccgcccuagaaagccggaaucccgggagccccaaggagcucuggaacgcccucccgucgaccacggccucgccagacugguuacgguguauugcgagcaugggcacaaagcugccaagaucaacccucuuuucaccggacaggcgcugcucgaaaaugugcccgagauucaggcccugguccagacacugcaaggcccuuuucauaccgcuggccuccugaacauggggaaagaggaagccucucuugaggaagugcugguuuaccucaaucagaucuauuguggacagauuagcaucgagacaucccagcugcaaucucaggaugagaaggacugguucgcuaaacgguuugaagaacuucagaaggaaaccuucacaaccgaggaacgcaagcaccugagcaaacucaugcuggagucccaggaguuugaucauuuccuggccacgaaguuuucuaccgugaaaagauacggcggggaaggagcggagagcaugaugggcuucuuucacgaacuccugaagauguccgccuauagcgggauuacagacgucaucaucggaaugccgcaccggggccgccuuaaccugcucaccggccugcuucaauuucccccugagcugauguucagaaaaaugcgggggcucucugaguuccccgagaauuuuuccgcuacaggagaugugcugagccaucugaccucuuccguugaccucuacuucggcgcccaccauccucugcacgugacgaugcuucccaacccgagccaccuggaggcugucaauccuguggccguggggaagacacgcggaagacagcagucucggcaagauggcgacuacucccccgauaacagcgcccagccuggggacagagucauuugccuccagguucauggagaugcuuccuucuguggccagggcaucgugcccgaaaccuuuacacugucuaaucuuccccacuuccgcauugggggaagcgugcaucugaucgucaacaaucaacucggcuauaccaccccugcggagcgggggagauccagccuguacugcucugacauuggaaagcuggugggcugugccaucauucacguuaacggggauuccccggaagaggugguccgcgcuacacggcucgccuuugaauaucagagacaguuccgcaaagacgugaucaucgaccugcuuugcuaccggcaguggggccauaaugagcuggaugagcccuuuuauacgaacccuauuauguacaagaucauuagagcccgcaaaagcauccccgacaccuaugcugaacaccucauugccggaggccugaugacacaagaggaaguuucugagaucaagagcuccuacuacgcgaaacugaaugaucaccuuaacaacauggcucauuaucggccucccgcccucaaucugcaggcccacuggcaggggcuggcucagccggaggcccaaaucaccacauggucuaccggagugccucucgaccugcuuagauucgucggcaugaaaagcguggaagucccccgcgagcugcagaugcauucccaccuccugaagacgcacgugcagagccggauggaaaagaugauggaugggauuaagcuggacugggcuacagccgaggcgcuugcccucggaucucugcuggcucagggcuuuaacguuagacucuccgggcaagaugugggccggggaaccuucagccagcgccaugccaucgucgugugucaggaaaccgacgauacauacauuccucugaaucacauggaccccaaccaaaaaggcuuucuugagguuucuaauuccccucugagcgaggaagcugugcucggguucgaguauggaauguccaucgaaucucccaagcugcugccgcuuugggaggcccaguuuggcgauuucuuuaacggggcgcagauuaucuucgacaccuucaucagcggaggcgaagccaaauggcuccugcaguccgggauugucauccugcucccucauggcuacgacggagcuggccccgaucacucuagcugcagaauugagcgguuucugcaaaugugugacuccgccgaggaagggguggauggagacacagugaauauguucguuguccaucccacgaccccugcucaguauuuucaccuucugagacgccagauggugcggaacuucagaaagccgcucaucguggccagccccaaaaugcugcugcgccuuccugccgcugucucuacacuccaggagauggcgcccggcaccacauuuaauccugugauuggggauuccagcguugaccccaagaaggugaaaacccuggucuucugcucuggaaagcacuuuuacucccuggugaaacaaagagaaagccucggcgccaagaaacaugauuucgcuaucauucggguugaggaacuguguccuuuuccccuugacucucugcagcaggagaugagcaaguauaagcacgugaaagaucauaucuggucccaggaggaaccgcaaaacauggggccuuggagcuucgucucuccccgcuuugagaagcagcucgccugcaaacugagacuggugggccggccuccccuuccgguuccugccgugggaaucggcacgguccaucugcaccagcacgaagacauucucgcuaagaccuucgccuga

SEQ ID NO: 68341 - RNA, 2388 nt, Artificial Sequence
  derived and/or modified sequence opt5 from DHX15__Homo_sapiens__NP_001349
augagcaagagacaccggcuggaccucggcgaggauuaccccuccgggaaaaagcgcgccggaaccgacggcaaagauagagaccgggaucgcgacagagaagaucggucuaaggaccgcgauagagagcgggaccgcggggauagagaacgggagcgcgaaaaagagaaggagaaggaacugagagcuagcacaaacgccaugcuuaucuccgcgggacugccuccgcucaaagccucucauagcgcucacuccacgcauucugcccacagcacccauuccacacacagcgcucacucuacccaugccggccacgcugggcauacaucccugccccagugcauuaauccuuucaccaaccuuccccacacaccucgguauuacgacauccugaagaaacgccuccaacugcccgugugggaguauaaggauagauuuaccgacauucugguccggcaccagagcuucguucucgugggagaaacgggcucuggcaaaaccacacagaucccucagugguguguggaguacaugagaucccugccggggcccaagcgcggagucgccugcacccaaccucggagaguggcggccaugagcguugcucagcgcguggccgacgagauggaugucaugcuuggccaggaagugggguauucuauucgguuugaggacuguuccagcgcuaagacaauccugaaauacaugaccgauggaaugcuccugagagaagccaugaaugacccccuucuggagcgcuauggcguuaucauucucgaugaagcgcaugagcggacgcuggccacagacauccugaugggggugcucaaggaggucgugagacagcgcuccgaucugaaagugauugucaugucugcuacccuugacgccggaaaguuccaaaucuacuuugauaacugcccucugcucacaauucccggccggacccacccgguugaaaucuucuacaccccugagcccgaaagagacuaucuggaggcugccauucgcacagugauccagauccauaugugugaagaggaggaaggcgaucuucugcucuuucugacggggcaggaggaaauugacgaggccugcaaacggaucaagagagaaguggacgaucugggaccugaggucggcgacauuaaaaucauuccccucuacagcacccugcccccucagcaacagcagcggaucuucgagccgcccccucccaagaagcaaaauggggcuaucggacgcaaagugguuguguccacaaacauugcggaaaccagccuuacaaucgauggcgucguguuuguuauugacccuggguucgccaagcagaaaguguauaaucccagaauccgggucgagucucugcucgugaccgcuauuuccaaggccagcgcccagcagagagcuggacgcgccggccggacgagaccgggcaaauguuuucgccuguacacagaaaaggcguauaagaccgagaugcaagauaacaccuacccugagauccuuagaucuaaucuggggagcgucgugcuccagcugaaaaagcugggaaucgacgaucucguucacuucgacuuuauggaucccccugcucccgaaacacugaugcgggcccuugagcugcucaacuaucuggccgcucugaaugacgauggcgaccuuaccgaacucggguccaugauggccgaguucccucuggauccccagcuggcuaaaauggugauugccucuugcgacuacaacuguagcaaugaaguccucuccaucacagcgaugcugagcgugccgcagugcuucguucgcccuacggaggccaagaaagcugccgacgaggcuaagaugagauuugcccauauugauggagaccaccuuacccugcucaacguguaccacgcguucaagcaaaaucaugaaucuguccagugguguuaugauaacuuuaucaacuaccggucccugaugagcgccgacaaugugcgccagcagcugucuagaauuauggaucgguucaaccuuccccgcagauccacagacuuuaccagccgggauuauuacaucaauauucgcaaagcucucgugacaggcuauuucaugcaaguugcccaccuggagagaaccgggcauuaccugacggucaaggacaaccagguggugcagcuccaccccuccaccguccuggaucacaaaccugaaugggugcuuuauaaugaguuuguucugacaaccaagaacuacauccggacaugcaccgacaucaaaccggaauggcucgugaagauugcuccccaguacuaugauaugucuaauuucccucaaugcgaggccaagagacagcuggaccgcaucauugccaaacugcagagcaaggaguacucccaauauuga

SEQ ID NO: 68342 - RNA, 2946 nt, Artificial Sequence
  derived and/or modified sequence opt5 from DHX16__Homo_sapiens__NP_001157711
augagcgaggaccccagaggcccuaaggugccgcggaaagccgucguugaaaagcccgcucgcgccgcggagagagaagcucgggcccugcucgagaaaaaccgcuccuacagacugcuugaagauucugaggagagcuccgaagagaccgugucucgggccgggagcucccugcagaagaaacgcaagaagagaaaacaccuccggaagaaacgcgaagaggaggaagaggaagaggcuucugaaaagggcaaaaagaagacaggagggagcaaacaacagacggagaagccugaguccgaagacgagugggaaagaaccgagcgggaacgccugcaggaucuugaggagagagacgccuucgcugaacgggugcgccagagagauaaagaccggacaagaaauguccuggagcgcagcgauaagaaagccuaugaagaggcgcaaaagcggcucaaaauggccgaagaggacagaaaggcuauggugcccgagcugcgcaagaaaucucggagagaauaccuggccaagcgcgagcgggaaaaacucgaggaucuggaggcugaacuugccgacgaggaauuucuguucggagauguugagcucuccagacaugaacgccaggagcugaaguauaaacggagagugcgcgaccuugcgcgggaguacagagccgcuggcgaacaggagaagcuggaagccaccaaccgguaucacaugccuaaggagacacgcgggcagcccgcuagagccgucgaucucguggaagaggagagcggagccccuggcgaggaacaacggagaugggaagaggcucgccugggcgcggccucucugaaauuuggggcucgggacgccgccucccaggaaccgaaguaccagcucguucuggaggaggaagagaccaucgaauuugugagagcuacacagcuucaaggagacgaggagcccagcgccccucccaccucuacgcaggcgcagcaaaaagaauccauucaggcuguccgcagaagccugccuguguuucccuuccgggaggaacuccuggccgccaucgcuaaucaucaggugcuuauuaucgagggcgaaaccggguccggaaagacaacccagauuccgcaauaucuguuugaggagggcuacacaaacaaagggaugaagaucgccugcacccagccucgcagagucgcugccaugucuguugcggcccggguggcucgcgaaaugggagugaagcucggcaaugaggucggcuacagcaucagauucgaagauuguacguccgagcggacagugcugcgcuauaugaccgacgggaugcugcucagagaauuucugagcgagcccgaucuugccucuuacuccguugugauggucgacgaggcucacgaacggacacugcauaccgauauucucuucggacugaucaaagacguggcccgcuuuagaccugagcuuaagguucugguggcgagcgccaccauggauacagcucgguucucuacguuuuucgacgaugcccccgucuuccgcauucccggcagacgguuuccuguggacaucuucuauaccaaagcuccggaagccgauuaccucgaggccugcgucgugagcguucugcagauucacgugacacagcccccuggggacauccuggucuuucucaccggacaagaagagauugaggcugcgugugaaaugcugcaggacagaugccgccggcuuggcuccaagaucagagagcugcucgugcugcccaucuaugccaaccugccuucugauaugcaggcucgcauuuuccagcccacaccgccuggggcccggaaaguuguggucgccaccaauaucgcugaaacgagccuuacaauugagggaaucauuuacgugcucgaccccggcuuuuguaagcaaaaguccuauaacccuagaaccggcauggagagccugaccgugacacccugcucuaaagccuccgcgaaucagcgcgcugggcgggccggaagaguugccgcuggcaaguguuuccggcuguacaccgccugggcguaccagcacgaacucgaggaaacaacggucccugagauccagcgcaccagccuggggaacguggugcuucugcucaaaucucugggaauccaugaucugaugcacuuugacuuccuugaucccccgccuuaugaaacacuccugcuggcucucgagcaacuguacgcccuuggcgcccugaaucaucucggggagcugaccacauccggcagaaagauggcugaacugcccgucgaccccaugcuuagcaaaaugauucucgccuccgagaaguauucuugcagcgaagagauccugaccguggcugccaugcuguccguuaacaauucuauuuucuaccggccuaaagauaaggugguccacgcggacaacgcccgcgugaauuucuuucucccgggaggcgaucaccugguucuucugaacguguauacgcagugggcugaaagcggguacuccagccagugguguuaugagaacuucguccaauuuagaucuaugcggagagcccgcgacgugcgggagcagcucgaaggacugcuggagagaguugaagugggccuuuccagcugccagggggauuacauccgcguccggaaggcuauuaccgccggauacuucuaucauacagccagacucacccgcucuggcuaccggacagugaaacagcaacagaccguguucauccaccccaauuccagccuguuugagcagcagccuagauggcugcucuaucaugaacugguccuuacgacaaaggaguucaugcgccaaguucuggagaucgaaucuagcuggcuccuggagguggcuccccacuacuauaaagcgaaggaacuggaggacccucaugccaaaaagaugcccaagaaaauugggaagaccagagaggaacuuggcuga

SEQ ID NO: 68343 - RNA, 2232 nt, Artificial Sequence
  derived and/or modified sequence opt5 from DHX32__Homo_sapiens__NP_060650
auggaggaagagggccuggaaugccccaacagcuccucugagaagagauacuucccugaaagccucgacuccucugauggggacgaggaggaagugcuggccugugaggaucuugaacugaauccguuugacggacuccccuauagcucccgguacuauaaacugcuuaaggagcgcgaggaucugccuaucuggaaagaaaaguacucuuucauggagaaccuccugcagaaucaaauugucaucguuagcggcgacgcuaaaugcgggaaguccgcccaggugccccaguggugugcggaauauugccugagcauucacuaccagcauggaggcgugaucuguacccaaguccacaagcagacagugguucagcucgcucugagaguggccgaugagauggacgucaacauugggcaugaagugggauauguuaucccuuuugagaauugcuguacgaacgagaccauccuucgguacugcacagaugacaugcugcagcgcgaaaugaugucuaaucccuuccucggcuccuacggcgugauuauccuggaugacauucacgagagaagcaucgccaccgauguccuucuggggcuccugaaagacgugcugcucgcucggccugaacugaaacuuauuaucaacucuuccccgcaucugauuagcaaacucaauucuuauuacggaaacgugcccgucaucgagguuaagaauaaacacccuguggaaguggucuaucuguccgaggcccaaaaggacagcuuugaguccauccuucgccugauuuucgaaauccaccauucuggcgagaagggggauauugugguuuuucucgcuugugaacaggacaucgagaaagugugcgaaacagucuaccagggaagcaaccugaaucccgaucugggcgagcucgugguugugccucuguaucccaaggagaaauguucccuuuucaagccgcuggacgaaaccgagaaaagaugccaggucuaccaacggcgcgugguccucacaaccagcucuggggaauuucugauuugguccaacagcgugagauucguuaucgaugugggagucgagcggcgcaagguguauaauccuagaauccgggccaacucucuuguuaugcagcccauuagccagucccaagcggagauccgcaaacagauucugggcucuagcuccagcggcaaguuuuucugccucuacacggaagaguuugccucuaaggacaugaccccucugaaacccgcugaaaugcaggaggccaaccugacauccaugguccucuucaugaagagaaucgauauugcugggcugggacacugugacuucaugaaucggcccgccccugaaagccuuaugcaggcgcuggaggaucucgacuaccuggccgcucuggauaacgacggcaaucuuucugaguuugggaucaucauguccgaguucccgcucgacccccaacugagcaaauccauucuggccucuugcgaauuugauuguguggacgaagugcucaccaucgcugccauggugacagccccuaacugcuucagccauguuccccacggagcugaggaagcggcccugaccuguuggaagacguuucuucacccugagggcgaucauuucacacugauuuccaucuauaaggcuuaccaggacaccacacucaauucuagcuccgaguauugcgucgaaaagugguguagagauuacuuucugaacugcagcgcccugcgcauggccgacgugauucgggcugagcuucucgaaaucauuaagagaaucgagcugcccuaugccgaaccggcguucgggucuaaagagaauacccugaacaucaagaaagcucuccuguccggauacuuuaugcagauugcccgcgauguggacggcagcggcaauuaucuuaugcugacccacaagcaggucgcccaacuccauccucugucuggguacuccaucacgaaaaagaugcccgagugggugcuguuccacaaguuuagcauuucugaaaacaauuacauccggauuacaagcgagaucuccccugaacuuuucaugcagcucguuccccaguauuacuuuagcaaccugccucccucugaguccaaagauauccugcagcaaguggucgaccaucucagcccgguguccaccaugaauaaggagcagcagaugugugaaacaugcccugagaccgaacagagauguacacugcaauga

SEQ ID NO: 68344 - RNA, 3432 nt, Artificial Sequence
  derived and/or modified sequence opt5 from DHX34__Homo_sapiens__NP_055496
augcccccuccgagaacccgggagggccgcgacagacgggaucaccaucgcgcccccagcgaagaggaagcucuggagaagugggacuggaacugcccugaaacaagacggcuccuggaggaugccuucuuucgcgaggaagacuacaucagacagggguccgaggaaugucaaaaauucuggacguuuuucgagcggcuucagcgcuuucagaaucugaagaccucuagaaaagaggaaaaggaucccggacagccuaaacacagcauucccgcgcucgcugaccugccucggacauaugauccgcgcuacagaaucaaccuuuccgugcugggccccgccacccgggggucucaaggacucggccgccaucugccugccgagagagucgcugaguuccggagagcccugcuccacuaucuggacuuugggcagaagcaggcuuucggacgccuugccaagcugcagcgggaaagagcggcccuccccauugcucaauacggcaaucgcauccugcagacacuuaaagaacaucagguugugguggucgccggcgauaccgggugcggaaagagcacacaggugccucaauaucugcucgcugccggcuuuucccacguugcguguacccagccccggagaauugccugcaucucucuggcuaaacgcgugggguucgagagccugucccaguacggaagccaagucggcuaucagauccgguuugagucuacgagauccgccgcuaccaagauuguguuccucacaguugggcugcuucugcgccagauccagcgggaaccgagccucccucaauacgaggugcugauugucgacgaagugcacgagagacaucuucacaacgauuuucugcucggagugcugcagcgccugcuccccacccggccugaccugaaagucauccuuaugucugccacaauuaauaucucccuguucagcucuuacuucuccaacgcccccguuguccaggugcccggcagacucuuuccuauuaccgugguguaucagccgcaagaagcugagcccacgacaagcaaguccgagaagcuggauccucggcccuuccuucgcguucuggaaucuaucgaccauaaauacccucccgaggaaagaggcgaccuccugguguuucugagcgggauggcggagaucuccgccguccucgaagcugcccagaccuaugccagccacacacagcggugggugguucugccgcuucacucugcucuguccguggccgaucaggacaaggucuucgauguggcgccucccggagucagaaaauguauucucagcaccaauaucgcugagaccucugugacaauugacggcauccgcuuuguuguggauagcgggaaggucaaagagauguccuacgacccucaagccaagcugcagcggcugcaggaguucuggauuucucaggccagcgcugaacaaagaaaaggacgcgccggcagaacggggcccggagugugcuuucggcuuuaugcugaauccgauuacgacgccuucgcgccuuaucccguuccggagauccgcagaguggcccucgauagccugguccugcagaugaagucuauguccgugggcgacccucggaccuuucccuucaucgagcccccuccgcccgcuagccucgaaacagccauucuguaccuucgcgaucagggcgcucuggacucuuccgaggcccucaccccuaucgggagccugcuggcgcaacuucccguggacguugucauuggaaagaugcucauccugggcuccauguuuucucugguggaaccugugcucacaauugccgcugcccugagcguccagucccccuucaccagaucugcucagagcuccccugagugugccgccgcucggcgcccccuugaaagcgaucagggggacccguuuacgcuguucaacguguucaaugcguggguucaagugaaaucugagagaucccggaacagccgcaaguggugcagacggagaggaaucgaggaacaucgccucuacgagauggccaaucugcggagacaguuuaaagaacugcuugaggaucacggccuccuggcuggggcccaggccgcucaggucggcgacucuuauucccgccugcaacagcggagagaacgccgggcccuccaucagcugaagagacagcacgaggagggagcgggccgccggagaaaagugcuucggcugcaagaggaacaggaugggggaagcucugacgaagaucgcgcuggcccugcucccccuggggccagcgacggaguugauauccaggacgugaaguucaagcucagacaugaucuggcccaacugcaggccgcggcuuccagcgcccaggaccuuucucgggagcagcucgcccugcugaaacucguccugggccgcgggcuuuacccccaacuggcugugccggaugccuuuaacuccagcagaaaggacuccgaccagauuuuccacacacaggcuaaacagggcgccguucuccacccuaccuguguguuugcgggaucucccgaaguccugcaugcccaagagcuggaggcuagcaauugcgauggcucccgggacgauaaggacaaaaugucuagcaagcaccagcuucuguccuucgugucucuccuggaaaccaacaagccuuaucucgugaauugugucagaauccccgcccugcagagccuucugcucuuuucccgcagccuggauacaaacggggacugcucucggcugguugcugauggauggcuugagcugcagcucgccgacuccgaaagcgccauuagacugcucgcugcgucucugcgccuucgggccagaugggaguccgcucuggaucgccaacucgcccaucaggcccagcagcaacuggaggaagaggaagaggacacccccgugagcccuaaagaaguggcuacacugucuaaggagcuucugcaguucacggccuccaaaaucccguacagccuccggagacugaccggccucgagguccagaacauguauguggggccccaaacaauuccugcgacaccccaucugccuggacuuuuuggcuccagcacccugucuccccacccuaccaagggcggcuacgcuguuacggauuuccugaccuauaauugccucacaaacgacaccgaucuguacagcgacugucuucgcacauuuuggaccugcccgcacuguggacugcacgcuccccucacgccucuggaaagaaucgcccaugagaauacaugcccccaggccccucaggacgggcccccgggggccgaagaggcggcucucgaaacccugcagaaaacauccgugcuucaacggccuuaccacugugaggccugcggaaaggauuuccuguuuacccccaccgagguccugcgccauagaaagcagcacguguga

SEQ ID NO: 68345 - RNA, 2985 nt, Artificial Sequence
  derived and/or modified sequence opt5 from DHX36__Homo_sapiens__NP_001107869
augagcuacgacuaucaccagaacuggggcagagaugggggaccccgguccucuggcgggggauacggcgggggaccugccggcggccaugggggaaaucgcggcagcgggggaggcgggggaggcggcgggggaggcagagggggacggggccgccacccggggcaucugaagggaagagagaucggcaugugguaugcuaaaaagcaaggccagaaaaacaaggaagccgagcggcaggaacgcgcggugguccacauggacgagagacgggaggaacagauuguucaacuccuuaauuccgugcaggcuaaaaacgauaaggagucugaagcccagaucagcugguucgcccccgaggaccauggguacggaaccgaaguguccacaaagaauacgccuugcucugagaacaaacuugauauucaggagaagaaacugaucaaucaagaaaagaaaauguuccgcauuagaaaccggagcuauaucgaccgcgauuccgaguaccuccugcaggaaaaugagcccgacggcacccuugaucagaagcugcucgaagaccugcagaagaaaaagaacgaucugagauauaucgagaugcaacacuuccgggagaaacucccuagcuacgggaugcagaaggaacuggucaaucuuauugacaaccaccaggugacaguuaucucuggagagaccggcugugggaaaacaacccaagugacacaguuuauucuggauaauuacaucgaacgcggcaagggauccgcuugcagaauugucuguacccagccccggagaaucagcgccauuucuguggcugagcgcguugccgcggaacgggccgaguccugcggcagcgggaacucuacgggauaucagaucagacuccaaucccgccugccucggaaacagggcagcauccuuuacuguaccacagggauuauccugcaguggcuccaguccgacccguaucugucuagcgugucccauauuguccuggacgagauccacgaaagaaaucuccaaagcgaugugcugaugaccguggucaaggaccuucugaacuuccgcucugaucucaagguuauucugauguccgcuacacuuaacgccgagaaauuuagcgaauacuucggaaauugccccaugauccauaucccuggcuuuaccuuccccgugguggaguaucugcucgaagacgucauugagaagauccgguacgugccugagcagaaagaacacagaucucaguuuaagcgcggguucaugcagggccacguuaaccggcaagagaaagaagagaaggaggcuauuuauaaggaaagauggcccgauuacgugcgcgagcugcggagacgguacagcgccuccacggucgacgugaucgaaaugauggaggaugacaaaguugaucugaaucucauuguggcgcugauccgcuauaucguccuugaagaggaggacggagccauucugguguuucucccgggcugggauaacaucucuacacugcaugaccuucugaugagccaggucauguucaaguccgugaaucagacccagguuuuuaaaagaacaccucccggggugcggaagauugucaucgcuaccaacauugccgaaaccagcaucacaauugacgaugugguuuacgugaucgacggaggcaaaaucaaggagacgcacuucgauacccaaaauaacauuucuacaauguccgcugaaugggucagcaaggccaaugccaaacagagaaaggggcgcgcuggacgggugcagccuggccauuguuaucaccucuacaacgggcugagagcgucucugcucgacgauuaucaacugcccgagauccuucgcacaccccuggaggaacucugccugcagauuaaaauccugagacuuggcggaauugccuacuuccucucccggcugauggacccuccgagcaaugaggcugugcugcucuccauccgccaucugauggaacuuaacgcccuggauaagcaggaggaacucacgccccugggcguucaccuggccagacuuccugucgagccccacaucgggaaaaugauucucuuuggagcucuguucuguugccuggacccugugcucaccaucgccgcgucucugagcuuuaaggaucccuucgugauuccgcuuggcaaggagaaaaucgcugacgcccggcgcaaggaacuggccaaagauaccagauccgaccaucucacagucgugaaugcuuuugaggggugggaagaggcccggcgcagaggauuccgguaugaaaaggauuacuguugggaguacuuucugucuagcaacacccugcagaugcuucacaauaugaaaggccaauucgcugagcaucuccugggggccggcuuuguuuccagccgcaacccuaaggaccccgaaucuaacauuaauuccgacaacgagaaaaucaucaaggcggugauuugcgccggacuguauccuaaggucgcuaaaaucagacucaaucugggcaagaaacggaagauggugaaaguuuacaccaagacagaugggcuuguggccguccaccccaagagcgugaacguugaacagaccgacuuccacuauaauuggcugauuuaccaucucaaaaugagaacaucuuccaucuaucuguacgauugcacggaggugagcccuuauugucugcuguuuuucggaggcgacauuucuauccagaaggauaacgaccaggaaaccaucgcugucgaugaguggauuguguuucaaagccccgcccgcaucgcgcaccucgugaaagagcugcggaaggaacuggacauucuccugcaggagaaaaucgaauccccgcauccugucgauuggaaugacacaaagagcagagauugcgccguucuuucugcuauuaucgaccugauuaagacccaggagaaagccacaccccgcaacuuucccccucgguuccaggauggguacuacuccuga

SEQ ID NO: 68346 - RNA, 3684 nt, Artificial Sequence
  derived and/or modified sequence opt5 from DHX38__Homo_sapiens__NP_054722
augggcgacaccagcgaggaugccuccauccacagacuggaagggacagaccucgauugccaggugggaggccugauuuguaagucuaaaagcgcugccuccgagcaacaugucuucaaggcgcccgcuccucggccgucucuucuggggcucgaccugcuugccagccugaaacgcagagaacgggaggaaaaggaugacggagaggauaaaaagaaguccaaaguuucuagcuacaaggacugggaggaauccaaagaugaccagaaggaugccgaggaagagggcggggaccaggcuggacagaacauccgcaaagauagacacuaucggagcgcccgcguggagacgcccucucauccuggcggcguguccgaagaguuuugggaaagaagccggcaacgcgagagagaacggcgcgagcacggggucuacgcuucuuccaaggaggaaaaggacuggaaaaaggagaaaagcagagaccgggauuaugaccgcaagagagaucgggacgaaagagaucgcucucggcauuccagcagauccgagcgcgacggaggcucugaacggagcuccagacgcaaugagcccgagagcccucggcacagacccaaagaugccgcgaccccuucucgcuccacaugggaagaggaagacagcggguacggaucuagccggagaucccagugggagucuccgagccccaccccuuccuaucgcgauagcgaacggucucacagacucuccacacgggaccgcgauagaagcgugcggggcaaguacucugacgacacaccccugccuacccccuccuauaaauacaacgagugggccgaugacagacgccaucuggggagcaccccgcggcucuccagaggacgcggcagacgggaggaaggcgaggaagggauuucuuucgauacggaggaggaacgccagcagugggaggacgaucaaagacaggcugaccgggauugguacaugauggacgaaggauaugaugaguuucacaauccucuggccuacagcuccgaagacuauguucgcagacgggagcagcaucuucacaagcagaagcaaaaacgcaucucugcucagagacggcagauuaacgaggauaaugaacgcugggagaccaacagaaugcugacaagcggcgugguccaccggcucgaaguggacgaggauuucgaagaggacaaugccgcgaagguucaucugauggugcacaaccuugugcccccuuuucuggacgggagaaucgucuucaccaaacaacccgagcccgugaucccugucaaggaugccacauccgaccucgcuauuaucgcccgcaaaggaagccagaccguucggaagcauagagaacagaaggagcgcaaaaaggcucagcacaaacauugggaacuggccggcacgaagcugggggauauuaugggagugaaaaaggaggaagaaccggacaaggccgugacagaggauggcaaagucgacuaccggaccgaacaaaaguuugcugaucacaugaaaagaaagucugaggcguccagcgaguucgccaaaaagaagucuauccucgagcagcgccaguaucugcccauuuuugcugugcagcaagagcuucugacaaucauucgggacaauuccaucguuaucguggucggcgaaaccgggagcggaaaaaccacacagcucacgcaguaccugcacgaggauggcuauaccgacuacgggaugauuggaugcacacagccuagacgcguggccgccaugucuguugcuaagcgggugagcgaagagaugggcgggaaccuuggcgaagaggucggauacgccaucagauucgaggauuguaccuccgaaaauacacugauuaaauauaugaccgacggcauccuccugcgggagagccugcgcgaagcggaucucgaccauuacucugcuauuaucauggacgaggcccacgaaagaucccugaacacggaugugcuuuuugggcugcuccgggaggucguggcccgcagaagcgaccugaaacuuaucguuacauccgcuaccauggaugccgagaaguucgcugccuuuuucggaaaugugcccauuuuccauaucccuggccggaccuuucccgucgacauucuguucucuaagacaccgcaagaagauuauguggaggcggccguuaaacagagccuccaggugcaccuguccggggcuccuggagacauccugauuuuuaugcccggccaggaagauaucgaggucaccucugaccaaaucguggaacaccucgaggagcuggaaaacgccccugcucuugccgugcugcccauuuacagccagcucccuuccgaucugcaggcgaagaucuuccaaaaggcccccgacgggguuagaaaaugcauugucgcuacaaauaucgccgagacgucucugaccguggauggcauuauguuugugaucgacagcggauauuguaaacuuaaggucuucaacccgcgcauuggcauggacgcucuccagaucuacccuaucucccaggccaacgccaaucagcggagcgggagagcuggacgcacaggccccgggcaaugcuuucggcuguauacccagucugcguacaagaacgaacugcucacaaccacggugcccgagauucagagaaccaaucuggccaacguugugcuucugcucaaaucccugggaguccaggaucugcuucaauuccauuuuauggacccuccgcccgaggauaauaugcucaacagcauguaccagcuguggauccugggcgcucucgacaauacagggggccugaccucuacaggacgccuuaugguggaguucccucuggaucccgcccucuccaagaugcugauuguuagcugugacaugggcuguucuuccgaaauccugcuuauugugagcaugcucuccgucccugccaucuuuuaucggcccaaggggagagaagaggaaagcgaucagauccgcgagaaauucgcugugccugagucugaccaccugaccuaccugaacguuuaucuccaguggaagaauaacaauuacagcacgauuuggugcaacgaucauuuuauccacgccaaagcgaugagaaaggugcgggaaguccgcgcucaacugaaagacauuauggugcagcagagaaugucccuugccucuugcggaacagauugggacaucgugcggaaguguauuugcgccgcuuauuuccaucaagccgcgaagcugaaaggcaucggggaguacgucaauauccgcaccggaaugcccugccaccuccacccgacaagcucccuguucggcaugggguauaccccugauuacauuguuuaccaugaacuggugaugaccacaaaggaguauaugcagugugugacggcugucgacggcgaauggcuugccgagcucggacccauguuuuacucugugaaacaggccggcaagagcagacaggagaaccggagacgcgcuaaagaagaggccuccgcuauggaagaggaaauggcccuggcggaggagcaacugcgggccagacgccaggaacaggagaagcggucuccucucgggagcguuagauccaccaagaucuauacacccggacggaaagaacagggcgagccgaugaccccucgcagaacacccgcucgguucgggcuguga

SEQ ID NO: 68347 - RNA, 2109 nt, Artificial Sequence
  derived and/or modified sequence opt5 from DHX40__Homo_sapiens__NP_001159773
augagcagauuccccgccguggcuggccgggccccucgcagacaggaggaaggggagcggucccgcgaccugcaagaagagagacucucugcggucugcaucgcugaucgggaagagaagggauguaccagccaggagggcgggacaacgccgaccuuucccauucagaaacagcgcaagaaaaucauucaagccgaaacagccaucaaguacaugaccgacggaugccugcuuaaacacauucugggcgauccuaaccucacaaaguucuccguuaucauccuggacgaggcucaugaaagaacccuuacaaccgauauucuguuugggcuccugaagaaacuguuccaggagaagucucccaaucggaaagagcaccucaaggugguggucaugagcgccacgauggaacuggcuaaacuuuccgccuuuuucggaaacuguccuaucuuugacauucccggccgccuguauccugugagagagaaguucugcaaucucaucggcccgcgggaucgcgaaaacaccgcguacauucaggccaucguuaaggugacaauggacauucaucugaaugagauggcuggggauauccuugucuuucugaccggacaguucgaaaucgagaaaucuugugagcuccuguuucaaauggccgaaagcguggacuaugauuacgacguucaggauacaacccuggacggccuccugauucuucccugcuauggguccaugacgacagaccagcagagacggaucuuccugccucccccucccggcauucgcaagugugugaucagcaccaacauuucugcuacaucccucaccaucgauggaaucagauacgucguggacgggggauuugugaaacaacugaaucacaacccgcggcuuggccuggauauucucgaggucguuccuaucagcaagucugaagcccugcagagauccggccgcgcggggcggaccagcucuggaaaaugcuucagaauuuauuccaaggacuucuggaaucaguguaugcccgaucaugugaucccugagauuaaacgcacaagccugacguccgugguccucacccugaagugccuugccauccacgacgugauccgguuucccuaccuggaucccccuaacgaaagacucauucuggaggcucuuaagcaacuguaccagugugacgccaucgaucgcucuggccacguuacacggcucgggcugagcaugguggaguucccgcugcccccucaucugaccugcgcugucauuaaagccgccucccucgacugcgaagaucuucugcuccccaucgcugcgaugcugagcguggagaauguuuuuauuagaccuguggaccccgaauaucagaaggaggccgaacagcgccaccgggagcuggcugccaaagccggaggcuucaacgacuuugcuacacuugccgucaucuucgagcaauguaagucuuccggggcgccggcuagcuggugccagaaacauuggauucacuggagaugucucuuuucugccuuccgcguggaagcccagcugcgggagcugaucagaaagcucaagcagcaaagcgauuuuccuaaagaaaccuucgagggacccaagcacgagguccugcggcgcugccuuugugcuggcuacuuuaaaaauguggccagacgguccguuggcagaacguucugcacaauggacgggcgcggaucuccugugcauauccaccccagcuccgcucugcaugaacaggagaccaagcucgaauggauuaucuuucacgagguccuggugaccacaaaaguuuaugcccggauuguguguccuaucagauacgaauggguccgcgaucugcuucccaagcuccaugaguucaacgcgcacgaccugagcucuguggccagacgggaggugcgcgaagaugcuagacggcgcuggaccaauaaggagaacguuaaacagcugaaggacggcauuuccaaagauguccucaagaaaaugcagagacggaacgacgauaagagcaucucugacgcccgcgcuagauuccuggaacggaagcaacagcgcacacaggaucacuccgacacgagaaaagagaccggguga

SEQ ID NO: 68348 - RNA, 2037 nt, Artificial Sequence
  derived and/or modified sequence opt5 from DHX58__Homo_sapiens__NP_077024
auggagcugagaagcuaccagugggaagugaucaugcccgcccucgagggcaagaacauuaucauuuggcugccuaccggggcuggaaaaacacgggccgcggcuuaugucgccaagcgccaccuugaaacgguugacggcgccaaaguggugguccuggugaauagaguucaucucgugacccaacacggggaggaguuccggcgcaugcuggauggaagauggacagucaccacacuuuccggcgacauggggccgcgggcuggauuuggccaucuggcccgcugccacgaucuccugaucuguaccgcugaacugcuccagauggcccugacaucucccgaggaagaggaacauguggagcuuaccguuuucagccugauuguggucgacgagugccaccacacgcauaaggauaccguguacaacgugaucaugucccaguaucucgaacugaaacuucagagagcgcaaccucugccccagguccucggccugacagccucuccugggaccggaggcgcuagcaagcuggacggggccaucaaucacguucuccagcugugugcuaaccuugauacauggugcauuaugucuccccagaauuguugcccucaacugcaggagcauucccagcagccguguaagcaauacaaccucugccaccggcgcagccaggaccccuuuggagaucugcuuaaaaagcugauggaccagauccacgaucaucucgaaaugccugagcuguccagaaaauucggcacccaaauguaugaacaacagguggugaagcugagcgaggccgcggcccucgcugggcugcaggagcagcgggucuacgcccuucaucugcgcagauauaaugacgcucuccugauucacgauacggugcgggccguugacgcccuugcugcgcugcaggacuuuuaccaccgcgaacaugugacaaaaacccagauccucugugccgagagacggcugcuggcucucuucgaugacagaaagaacgaacuggcccaccuugccacacacggacccgagaauccuaagcuggaaaugcucgagaaaauucugcagcgccaauuuucuuccagcaacucuccccggggcaucauuuucaccagaacccgccaguccgcucauagccugcuucucuggcugcagcagcaacagggccugcagacagucgauauccgggcccagcuccugaucggggcgggaaauucuucccaaagcacgcacaugacccagagagaccagcaagaggugauucagaaguuucaggauggcacacuuaaccugcucguugcuaccuccguggccgaagaggggcuggacaucccgcauugcaaugucgugguccgcuacggacugcuuacaaacgaaauuucuauggugcaggcccggggcagagcucgcgccgaucaaagcguuuaugcuuucguggccaccgaggggucccgggaacucaaaagagagcugaucaaugaggcgcuggaaacgcucauggagcaggccgucgcugccgugcagaagauggaccaggcugaauaccaagccaaaauucgcgaucugcagcaggcggcccuuacaaagcgggcugcccaggcugcccaaagagagaaccagcggcagcaauuuccuguugagcacgugcagcugcucuguaucaacugcauggucgccgugggacacggcagcgaccugcgcaaaguggaaggcacccaucacguuaaugucaaccccaauuucucuaacuauuacaauguguccagagauccuguggucaucaacaagguguuuaaggacuggaaacccgggggaguuauuagcugccggaauuguggcgaggugugggggcugcagaugaucuauaagucugucaaacuucccgugcucaagguuagaagcaugcugcuggaaaccccucagggacgcauucaagcuaaaaaguggucccgggugccguucucuguccccgacuucgauuuucuccagcauugcgcggagaaccugagcgaccuuucccuggauuga

SEQ ID NO: 68349 - RNA, 3546 nt, Artificial Sequence
  derived and/or modified sequence opt5 from DHX8__Homo_sapiens__NP_001289552
auggccguggcugucgccauggcgggcgcucugaucgggagcgagcccggaccugccgaagaacucgccaagcuggaauaccuuucccugguuucuaaagugugcaccgagcucgacaaccaccugggcauuaaugauaaggaccuugcugaguucgugaucagccuggccgagaaaaacacaacguuugauaccuucaaggcuucccucgucaaaaauggggccgaguuuacagacucucugauuagcaaccugcucagacugauccagaccaugcggccgcccgcgaagccuuccacaucuaaggaucccgugguuaaaccuaagaccgaaaaagagaagcucaaagaacuguuccccgugcucugucaaccugacaauccgagcguccgcacaaugcuggaugaggacgaugugaagguugccguggacguccuuaaggagcuggaagcucucaugcccuccgccgcuggacaggagaaacagagagaugccgaacaucgggaccgcaccaagaaaaagaaaagaagccggucucgcgauagaaaccgggaccgcgacagagaucgggagcgcaauagagaccgggaucacaagcgcagacaucgguccagaagccgcucucgguccagaacgcgcgaacggaacaaagucaagagcagauaucgcucucgguccagaagccaguccccucccaaggaccgcaaagaucgggacaaguacggcgagagaaaucuggaucgcuggcgggacaaacacguggauagaccucccccggaggaaccuaccauuggggacaucuauaacggaaaggugacaucuaucaugcaauuuggcugcuucguucagcuggagggccuccggaaacgcugggaagggcuggugcauauuagcgagcuuagacgggaaggaagaguggcgaaugucgccgaugugguuuccaagggccagcgcgugaaggucaaagugcugagcuuuaccgggacaaagaccucucucuccaugaaagacguugaccaggagacgggagaggaucugaaccccaaucggagacgcaaccuugugggcgaaacaaaugaggaaaccagcaugagaaacccugaccggcccacacaccugucucucgucagcgcucccgagguggaagaugacucccuggagcgcaagagacugacccggaucucugauccugagaaaugggaaauuaagcaaaugaucgccgcuaacguccucagcaaggaggaguucccggacuuugaugaagagaccgggauucugcccaaaguggacgaugaagaggacgaagaucuugagaucgaacugguugaggaggaaccucccuuccuccgcggacacacaaagcaguccauggacaugagcccuauuaaaaucgugaagaaucccgauggcucucugucccaggccgccaugaugcagagcgcucuugcgaaagagagacgggaacugaagcaagcccagcgcgaggcugaaauggacucuaucccgaugggccucaacaagcauugggucgacccucugcccgaugccgaggggagacagauugccgcuaauaugcggggaaucggcaugaugccuaacgacauucccgaguggaaaaagcacgccuuugggggaaauaaagcguccuacggcaagaaaacgcaaaugagcauccuggaacagcgcgagucccucccuauuuauaagcugaaagaacagcuugugcaggcuguucaugauaaccaaauccugaucgugauuggggagaccggaucuggcaagacaacccagaucacacaguaccucgccgaagccggcuauaccagcagagggaagauuggauguacgcagccccggagagucgcugccauguccguggcuaaacgcgugucugaggaguucggcugcugucuggggcaagaaguuggauacacaauccgguuugaggacugcaccagcccggaaaccgucauuaaguacaugacagauggcaugcugcuuagagagugucucaucgacccugaucugacccaguaugccaucauuaugcuggacgaggcgcacgaacgcacaauccacacggaugugcuuuucgggcugcuuaaaaagaccgugcagaaacggcaggacaugaagcugauugucacauccgccacccucgaugcugugaaguucagccaauacuuuuaugaggcccccaucuucacaauucccggcagaaccuacccuguugaaauccuguauacgaaagagccggaaaccgacuaccuggaugcuucucuuauuacagugaugcagauccaucucaccgagcccccuggagacauccuggucuuucugacaggccaggaggaaauugacaccgccugcgagauccucuaugaacgcaugaagucccuggggcccgaugugccugagcuuauuauccugcccguuuacagcgcgcucccuucugaaaugcagacgcggauuuucgaccccgccccgccuggauccagaaaaguggucaucgcuacaaauaucgccgagaccagccugacaauugauggcaucuacuaugugguugaccccggguuugugaagcaaaaagucuacaacucuaagaccggaauugaucagcugguggugaccccuaucagccaggcucaagccaagcagcgcgccggccgggcugggagaacaggccccggaaaauguuaucggcuuuacacggagcgcgcguauagagacgaaaugcucaccacaaaugucccggagauucagcggaccaaccuggccuccacaguucugagccucaaggcuaugggcaucaaugaucugcuuucuuucgacuuuauggaugccccucccauggaaacccugaucacggccauggagcagcucuacacacugggggcucuggacgaugaaggacuucucacccgccugggcagacggauggccgaguucccucuggagcccaugcucugcaaaaugcugauuauguccgugcaccuuggguguagcgaagagaugcugaccaucguguccaugcucucuguccaaaacguguuuuauagacccaaggacaaacaggcgcuggcugaccagaagaaggccaaauuccaucagacagaaggagaucaccugacccuucuggccguuuacaauagcuggaagaacaauaaauuuuccaacccuuggugcuacgagaacuucauucaagcucgcucucuccggagagcccaggacauccgcaagcagaugcugggcauuauggaucggcauaaacucgacguggucagcugcgggaaguccacagugagaguucagaaagcgaucuguucuggcuuuuuccgcaaugcugccaagaaggauccgcaagagggauaucggacgcugaucgaccaacagguggucuacauucaccccagcuccgcccuuuucaacagacagccugaaugccccaaacacuuucugccugugguugcuguggccgucagccucgagcagugucugucuaaguucgaagaucugaauaaagagcuuggccuggugaccugcuga

SEQ ID NO: 68350 - RNA, 3813 nt, Artificial Sequence
  derived and/or modified sequence opt5 from DHX9__Homo_sapiens__NP_001348
augggcgacgugaagaacuuccuguacgccuggugcgggaaaagaaagaugacccccagcuaugagauccgggcugucggaaauaaaaaccgccagaaguuuaugugugaaguucaaguggagggcuacaauuauacagggaugggaaacuccacgaauaaaaaggaugcccagucuaacgcggcuagagacuucgugaauuaccucguccggauuaacgaaaucaagagcgaggaagugccugccuuuggcguugccuccccgcccccucugaccgauacacccgacaccacagcuaaugccgagggggaucuuccuaccacaaugggaggcccccugccuccgcaccucgcucugaaagccgagaacaauucugaagugggcgcgagcggguauggaguccccggcccuaccugggaccgcggggccaaccuuaaggauuacuauuccagaaaagaggaacaggaggugcaggcuacgcuggagucugaagagguugaccucaaugccggacugcauggcaacuggacccuggaaaaugcuaaggcccggcucaaccaauacuuccagaaagagaagauucagggggaauacaaguauacacaggugggacccgaucacaaccgcagcuuuaucgcggagaugaccauuuacaucaaacaacugggcagacggaucuucgcccgcgagcauggcuccaauaagaaacuugcugcccagagcugcgcucugucucucgucagacagcuguaucaccuuggggugguggaagccuacuccggacugacaaagaaaaaggagggcgaaaccgucgagccuuauaaaguuaaccucagccaggaccuggaacaucaacugcagaauauuauccaggagcucaaccuggagauucuucccccgccugaagaucccucugugccuguggcccugaauaucgggaagcucgcucaauuugagcccucccagcggcagaaccaggucggagugguucccuggagcccuccgcaaucuaauuggaaccccuggacguccagcaauauugacgaaggcccucuggcguucgccacacccgagcagaucuccauggaucuuaagaacgaacugauguaccagcucgagcaggaccacgaccugcaagcuauucugcaggagcgcgaacuccugccugugaaaaaguuugagucugaaauccuugaggccaucagccaaaauuccgucgugauuaucagaggggccaccggauguggcaaaacaacccagguuccccaguucauucuggaugacuuuauccagaacgaucgggcugccgagugcaauauuguggucacccagccgcgcagaaucagcgcggugucugucgcugaacggguggccuucgagagaggcgaagaaccugggaaguccuguggauauagcguucgcuuugaaucuauccucccccggccucacgccagcauuauguucugcacagugggcguccugcuuagaaaacuggaggcugggauccgcggaauuucccaugugaucguugacgagauucacgaacgggauaucaacacggacuuccuccuggugguccugagagauguggugcaggccuaccccgagguucgcaucguccucaugucugcuaccauugacacaagcauguuuugugaauacuucuuuaauugcccuaucauugagguguauggccggaccuaccccgugcaagaauauuuccuggaggauuguauccagaugacacauuuugucccgccucccaaggacaagaaaaagaaagauaaggacgacgaugggggcgaggacgaugacgccaacugcaaccuuauuuguggagaugaauacggccccgagaccagacuguccaugagccagcucaaugaaaaagagacgccuuucgaacugaucgaggcgcugcuuaaguauauugagacacucaacgugccgggggccguucugguguuucugcccggauggaaucucaucuacaccaugcaaaagcaccuggaaaugaacccucacuucggcucucaucgcuaucagauccuuccccugcacucccagauuccucgggaggaacagagaaaagucuuugaccccgugccuguuggggugaccaaggucauccucagcacaaauauugcugagaccucuaucacaauuaacgaugugguuuacgugaucgacuccugcaaacaaaaggucaaacuguucacggcccauaauaacaugaccaauuacgcuacagugugggccagcaagaccaaccuggagcagcgcaagggacgggcgggcagagugcggcccggguuuugcuuccaccuuuguucccgcgccagauuugaacggcucgagacacauaugaccccggaaauguucagaacgccucugcacgagaucgcucugucuauuaaacuccugcgccuuggcggaaucggccaguuccuggccaaggcuauugaacccccuccccucgaugccgucaucgaggccgagcacacccugcgggaacuggacgcucuugaugcgaaugacgagcucacaccgcuggggcggauucuggccaaacucccuaucgaaccccgcuuuggaaagaugaugaucaugggcugcauuuucuauguuggggaugcuaucuguaccauugccgccgcuacaugcuuuccugagcccuucaucaacgaaggaaaaagacugggcuacauucaucggaauuuugccgggaaccgcuucagcgaccacguggcgcuucuguccguguuucaggcuugggacgaugccagaaugggcggagaggaggccgaaauccgguucugugagcauaagcgccucaauauggcuacccugagaaugacgugggaagccaaaguccaacugaaggagauccuuauuaacucuggcuuucccgaagacugccuccugacacagguguucaccaacacagggccugauaauaaccuggacguugugaucagccuccuggcguuuggagucuauccgaauguguguuaccacaaggagaaacggaagauucuuaccaccgagggccgcaacgcucugauccacaaauccagcguuaauugccccuucucuucccaggauaugaaguauccuagccccuuuuucguguucggggagaaaauuagaacacgggccaucucugccaagggaaugacgcucgucaccccucugcagcugcuucuguuugcuuccaagaaagugcaaagcgacggccagauuguucucguggaugacuggaucaagcugcagaucucucaugaggccgcugccuguauuacagggcuccgcgcggccauggaagcucuggucguggaggugaccaaacaacccgccaucauuagccagcuugauccugucaacgagagaaugcugaauaugauccggcagauuuccagaccgagcgcugccggcaucaaccucaugaucggaucuacacgcuacggcgacgggccccggccucccaagauggccagauaugauaauggauccggcuaccgcagagggggaagcuccuacucuggcggcggguauggaggcggguacagcuccggaggcuaugggucuggaggcuacggcgggagcgcuaacuccuucagagcgggauauggcgccgggguuggaggcggguaccgcggagugucucggggcggcuuuagagggaauagcggaggcgacuaucgcgggccuuccggaggcuaccgggggagcggaggcuuccagagaggcgggggacggggcgcuuacgggaccggauauuuuggccaagggcgcggaggcggcggguacuga

SEQ ID NO: 68351 - RNA, 561 nt, Artificial Sequence
  derived and/or modified sequence opt5 from DIABLO__Homo_sapiens__NP_001265233
augaaaagcgacuucuacuuucagaaguccgagccccacucucugagcuccgaagcccucaugagacgggcugugucucuggucaccgauagcacauccacguuccuuucucaaaccacauaugcccugaucgaggcgauuaccgaauacacaaaggcuguuuauacccucacaagccuguaccgccaguauaccucccuucugggcaaaaugaacagcgaggaagaggacgagguguggcaagugaucauuggggccagagccgaaaugacgucuaagcaucaggaguaccucaaacuggaaaccacauggaugaccgcugucggacuguccgagauggccgcugaggccgcguaucagacaggcgccgaucaggcuagcaucaccgcccggaaucacauucagcucgugaagcugcagguugaagaggugcaucaacuuucucgcaaggcugaaacgaaacuggccgaggcgcagaucgaggaacucagacagaagacacaggaggaaggggaggaacgggccgaguccgaacaagaggcuuaccugcgcgaggacuga

SEQ ID NO: 68352 - RNA, 3792 nt, Artificial Sequence
  derived and/or modified sequence opt5 from DIAPH1__Homo_sapiens__NP_001073280
auggagcccccuggcgggagccugggaccgggcagagggacccgggacaagaaaaagggacgcucccccgaugaacucccuucugccggcggggacggaggcaaaagcaagaaauuccuggagagauuuacauccaugcggaucaagaaggaaaaagagaagcccaacucugcucaccgcaauagcuccgccucuuacggcgaugacccuacggcgcagagccuucaagauguguccgacgaacagguccugguucucuucgagcagaugcugcuugauaugaaccugaaugaggaaaaacagcaaccccucagagagaaggacauuaucauuaaacgggaaauggugagccaguaucuguacaccucuaaggcugggaugucccagaaggagagcucuaaauccgccaugauguauauccaggagcugcgcagcggacucagagauaugccucugcuuucuugccuggaaucccuccgggugagccugaacaauaacccggucuccugggugcaaacauuuggcgccgaggggcuugcuucucugcucgacauucugaagcgccugcaugaugaaaaagaggaaaccgccggaagcuacgacuccagaaauaagcacgagaucauccggugucucaaagccuucaugaacaauaaguuuggcauuaaaacaaugcuggagaccgaagaggggauccuucugcucguucgcgccauggaucccgcggugccuaacaugaugauugacgccgcuaagcugcuuagcgcccugugcauccucccccagccugaagacaugaaugagagaguccuggaagcuaugacagagcgggccgagauggaugaaguggagcgcuuccagccccugcucgacggacugaagucuggcaccacgauugcgcuuaaaguuggcugucugcagcucaucaacgcccugauuaccccggcugaggaacuugauuuuagagugcauauccgguccgaacugaugagacucgggcugcaccaaguccugcaggaccuccgcgagaucgagaaugaagauaugcgggugcagcugaacguguucgacgagcaaggagaagaggauagcuaugaccuuaagggcagacuggaugacauucgcauggagauggaugacuuuaaugaagucuuccagauccuccugaacacaguuaaagacucuaaggccgagccucauuuucugagcauucuucagcaccuccugcuggugcggaacgauuacgaagcuagaccccaguauuacaaacucaucgaggaaugcauuucccaaaucgugcugcacaagaauggggccgacccugauuucaagugucgccaucuucagaucgagauugagggacugaucgaccagaugauugauaaaaccaaggucgaaaaaucugaggccaaggcugcggaacucgagaaaaagcuggacagcgaacugacagcccggcacgagcuucagguggagaugaagaaaauggaauccgauuuugagcaaaagcuccaggaccugcagggcgaaaaagaugcucugcauagcgagaagcagcaaaucgccaccgaaaaacaggaccucgaggccgagguuucucagcugacgggggaaguggcuaaacuuacaaaggagcuggaagaugccaaaaaggagauggcgucccucagcgcugccgccauuaccgucccucccucugugcccuccagagcuccgguucccccugcucccccucugcccggagacagcggcacaaucaucccgccucccccugcucccggcgauuccaccaccccucccccgccucccccucccccgcccccucccccuccccugccugggggagugugcauuucuagcccgcccucccuuccuggcgggacagccaucucucccccucccccgcucagcggagacgcgacgauuccucccccuccuccccugcccgagggcgucgggaucccgucccccagcucucugccuggcggaaccgccauucccccucccccuccgcuccccggcuccgcucgcaucccucccccucccccgccucugcccgggagcgccggcauucccccucccccuccgccccuuccuggagaagcugggaugcccccucccccgccuccccugccuggaggccccgggaucccucccccgccucccuuccccggcggaccuggcaucccgcccccucccccugggaugggaaugcccccuccgcccccuuucggcuuuggggugcccgccgcgccuguccuccccuucggacugacaccgaaaaagcuguacaaaccugaggugcagcuucggagacccaacuggucuaagcucguugccgaagaccugucccaagauuguuuuuggaccaaagugaaggaggaccgcuucgaaaauaacgagcuguuugcuaagcucacacugaccuucagcgcccagacgaaaacaucuaaggcuaaaaaggaucaggagggcggggaagagaaaaagagcguccaaaagaaaaaggugaaagaacuuaagguucuggacuccaaaaccgcccagaaucucagcauuuuucugggcucuuuccggaugcccuaucaggagaucaagaacgugauucuggaagucaaugaggccgugcuuaccgaguccaugauccagaaccugauuaagcaaaugccugaacccgagcagcucaaaaugcugagcgaacucaaggaugaguacgacgaucuggcugaauccgagcaguuuggagugguuaugggcacagucccuagacuucggccgcgccugaaugcgauccucuucaaacugcaguuuucugagcaaguggaaaacaucaagcccgagauugugagcgucaccgccgcuugcgaggaacugagaaaauccgagucuuucagcaaucuucuggaaaucacacuccugguggggaacuauaugaaugccggaucccggaacgccggcgcuuuuggguucaauauuucuuuccucuguaagcugagagacaccaagagcacggaucagaaaaugacacuucugcacuuucucgccgagcugugcgaaaacgacuacccugauguucugaaguuccccgacgagcuugcgcacguggaaaaggcuucccgcgucagcgccgagaaccugcagaagaaucucgaucagaugaaaaagcaaaucucugacguggagcgggacguucagaacuuuccugccgcuaccgaugaaaaagacaaguucguggagaagaugacauccuuugucaaagaugcccaggaacaauauaauaagcugagaaugaugcauagcaacauggagacccucuacaaagaacugggagaguauuuccuuuuugaccccaagaaacugucuguggaggaguucuuuauggaucugcacaauuuccgcaacauguuucuccaggcgguuaaggaaaaucagaagagacgggaaacggaggagaaaaugcgcagagcuaagcuggccaaagaaaaggccgagaaagaacggcuugagaagcagcaaaagcgcgaacagcugauugacaugaacgcugagggcgaugagaccggggugauggacucccuccuggaagcccuccagagcggcgcugccuucagacggaaacgcggaccgagacaggcgaaucggaaggccggcugugcugucacaucucugcuugccuccgagcugaccaaagaugacgcuauggccgccgugccugcuaaggugagcaaaaacuccgaaacauuucccaccauccuggaggaagcgaaggagcucgucgggcgcgccagcuga

SEQ ID NO: 68353 - RNA, 3306 nt, Artificial Sequence
  derived and/or modified sequence opt5 from DIAPH2__Homo_sapiens__NP_006720
auggagcagcccggcgccgcugccagcggggcgggaggcggguccgaggaaccuggaggcgggagaucuaacaagcggagcgcuggaaaucgcgccgccaacgaagaggaaaccaaaaauaagccgaaacugaacauccaaauuaagacacucgcugacgaugugagagaccggaucacguccuuccgcaaaucuaccgucaagaaggagaaaccccugauucagcacccuaucgauagccagguugccauguccgaguuucccgcugcccagccucuuuacgacgaaagaucucugaaucucagcgagaaggaagugcuggaucuuuucgagaaaaugauggaggacaugaaccugaaugaagagaagaaagcgccccuccggaacaaggauuuuacaaccaagcgcgaaauggugguccaauauauuuccgccacagcuaaaagcggcggccugaaaaauucuaaacaugagugcacccuguccagccaggaauacgugcacgagcucagaucugggaucuccgacgagaagcugcuuaacugucuggaaagccuccggguuucucugacauccaauccugugagcugggucaacaauuucggacaugagggccuugggcugcuccuggaugaacuggagaaacuccuggacaagaaacagcaggaaaacaucgauaagaagaaucaauauaaacuuauucagugccugaaggccuuuaugaacaacaaauucggacuccagcgcauccugggcgacgagagaucccuucugcuccuggcucgggccauugauccgaagcagcccaauaugaugaccgagaucgugaaaauucugucugcgaucuguauuguuggggaagagaacauccucgacaagcugcuuggagccaucacgaccgcugccgaacgcaauaacagagagcgguuuagcccuauuguggaaggccuggagaaucaagaggcucuccagcugcaggucgccugcaugcaauucaucaacgcccuugugacaucccccuacgaacuggacuuucgcauucaccucagaaaugaguuccugcggagcggccugaagaccaugcucccugaucugaaagaaaaggagaacgacgagcuugauauccagcugaaaguguuugacgaaaauaaggaggaugaccucacagaacugucucauagacugaacgauauucgcgcugagauggacgauaugaaugaagucuaucaccuucucuacaacaugcugaaagacaccgcggccgagaauuauuuccuguccauccuccagcacuuucugcuuauccggaacgauuacuacauuagaccccaguauuacaagaucauugaggaauguguuagccaaaucgugcugcauugcucugggauggacccggacuucaaguaucgccagcggcucgauauugaccugacgcaccugaucgauagcugugugaauaaagcuaaggucgaggaauccgagcagaaagccgccgaguucucuaagaaauuugacgaagaguucacagcuagacaggaagcccaagcggagcuucagaagcgcgaugaaaagaucaaagagcucgaagcugagauucagcagcugcggacccaagcccaggugcugagcuccagcucuggaaucccugggcccccugccgcuccuccccuccccggcguuggaccgcccccucccccucccgccccgccucugcccggcggggcuccucuucccccucccccgccuccccugcccggaaugaugggcauuccuccgcccccucccccuccccuccuguuuggcgggccucccccgccucccccucugggaggcgugcccccgccucccgggaucucccuuaaccucccuuacggaaugaagcagaaaaagauguauaaacccgaggucagcaugaagagaauuaacuggucuaaaaucgaacccacagagcuguccgaaaauugcuucuggcugcgcgugaaggaggacaaguuugagaacccugaucucuucgccaaacuggcgcuuaauuuugccacccagauuaagguucaaaagaacgcugaagcccuggaggaaaagaaaaccggcccgacaaagaagaaagugaaggagcuccggauccuggaccccaaaacggcucagaaucugagcaucuuccuuggguccuacagaaugccuuaugaagauauucgcaacgucauccucgaggugaaugaggacaugcugucugaagcccugauucagaaccucgucaagcaucugcccgagcagaaaauccuuaaugaacuggcggagcucaagaacgaauacgaugaccugugugagccugagcaauuuggcgugguuaugagcuccgugaagaugcugcagccccggcuuucuagcauucuguucaaacucaccuuugaggaacacaucaauaacaucaagccuuccauuaucgccgucacacuggcuugcgaggaacucaaaaagagcgaaucuuucaauagacugcuugagcuggugcuccugguuggaaacuacaugaacuccggcagccggaaugcccagucucugggguuuaaaauuaacuuccuuuguaagauccgcgauaccaaguccgcugaccagaaaacaacccugcuccacuucauugccgacaucugcgaggaaaaguauagagauauccugaaauuuccggaggaacucgagcauguggagagcgccucuaaggucagcgcucaaauucugaaauccaaucuugcgagcauggaacagcagaucgugcaccuggagcgggacauuaagaaauucccccaagccgaaaaccagcaugauaaguuuguggagaagaugacgucuuucacaaaaaccgcuagagaacaguacgagaagcucuccaccaugcacaauaacaugaugaaacuguaugagaaucugggagaauacuuuaucuucgacagcaagacaguuuccauugaggaauuuuucggcgaucuuaacaauuuucgcacccuguuccucgaggccguccgggaaaacaauaaaagacgcgagauggaggaaaagacaagacgggccaagcuggcuaaagagaaggccgaacaggagaaacucgaacgccaaaagaaaaagaagcagcugaucgacaucaacaaagagggggaugagacgggagugauggacaaucuucuggaagcgcugcagucuggcgcugccuuuagagaucggcgcaagcggauuccuagaaaccccgacaaucgcagagugccucucgagcggagccgcuccagacauaacggggccaucucuagcaaauga

SEQ ID NO: 68354 - RNA, 3582 nt, Artificial Sequence
  derived and/or modified sequence opt5 from DIAPH3__Homo_sapiens__NP_001035982
auggagagacaccagccccggcugcaucacccugcccaaggcagcgcugccgggaccccguaccccuccucugcgagccuccgcggaugcagagaauccaagaugccucggcgcaaaggcccccagcauccucccccuccgucugggcccgaggaaccuggagagaagagacccaaauuccaccugaacauccggacacuuacggacgauaugcuggacaaguuugcuagcauucgcaucccuggcuccaaaaaggaaagacccccgcucccuaaucugaagaccgccuucgccucuagcgauuguuccgcugccccucuugagaugauggagaacuuucccaaaccccugagcgaaaaugagcuccuggaacuguucgagaagaugauggaggacaugaaccucaaugaagauaaaaaggcuccccugcgggagaaagacuuuucuauuaagaaggaaauggugaugcaguauaucaacacagccuccaaaaccgggagccuuaagcgcucuagacagauuuccccucaagaguucauccaugaacugaaaaugggaagcgcggaugagcggcucgucacaugccuggagucucuucgcguuucccugaccagcaauccgguguccuggguggaaucuuuuggccacgagggccucgggcugcugcucgacauccuggaaaaacuuauuagcggaaaaauccaggagaaggucgugaaaaagaaccagcacaagguuauucagugucugaaagcccucaugaauacacaauacggccuggaaagaaucauguccgaggagcggagccuuucucugcucgcuaaggccguggauccccgccauccuaacaugaugaccgacgucgugaaacugcuguccgcuguuugcauugugggggaagagagcauccucgaagagguccuggaagcccuuacgucugcgggagaggagaagaaaauugauagauucuuuuguaucguggaaggccugcggcacaauagcgugcagcuccaggucgccugcaugcagcugaucaacgcucuuguuaccucccccgacgaucuggacuucagacuccauauucgcaaugaguuuaugcggugugggcugaaggaaauccugccuaaccucaagugcauuaaaaaugacggacuggauauccaacuuaagguguucgacgagcacaaagaggaagaucuguuugagcucucucacagacuggaagacauucgcgccgagcuggaugaggcuuaugacguguacaacauggucuggagcacagugaaggagacccgggccgagggcuauuucaucuccauccuucagcaucuccugcugauuagaaacgauuacuucauccgccagcaauauuuuaaacucauugacgaauguguuagccagaucgugcugcaccgggauggcauggaccccgauuucacauacagaaagcgccuugaccuggaccucacccaguuugucgauauuugcaucgaccaggccaagcuggaggaguucgaagaaaaggcuucugagcuguacaagaaauuugagaaggaguucacggaucaucaagaaacacaggcggaacuucagaaaaaggaggccaagaucaaugaacuccaggcugagcugcaagccuuuaaaucccaguucggggcccugccggcugacuguaacauuccucugcccccuagcaaggagggaggcaccgggcacucugcccugcccccucccccgccucuucccuccggaggcggggugcccccuccgcccccucccccucccccucccccgcugccuggaaugcggaugcccuuuagcggcccuguucccccgccucccccucucggcuuccucgggggacaaaauucuccuccccugcccauccuuccguuuggccucaaacccaagaaagaguucaagccugaaauuuccaugagacgccugaacuggcugaaaauccggccccaugaaaugacagagaauugcuuuuggauuaaggugaacgagaauaaguaugaaaacgucgaucuccugugcaaacuugagaauaccuucuguugccagcagaaggaaagacgggaggaagaggacaucgaggagaaaaagagcauuaaaaagaagaucaaagaacugaaguuccucgauuccaaaaucgcgcagaaccugucuauuuuucugagcuccuuccgcgugccuuacgaagagaucagaaugaugauucuugaagucgacgagacccggcucgcugagagcaugauccagaaucugauuaagcaucugcccgaucaggaacaacucaacucucugucccaguuuaaaagcgaguauucuaaucuuugugaaccugagcaguucgugguugugauguccaacgucaagagacugcgcccgcggcucagcgccauccuguuuaagcugcaauucgaagaacaggugaauaacaucaaacccgacauuauggccguuucuacagcuugcgaggaaaucaagaaaagcaaguccuuuagcaaacuucuggagcucgugcugcucauggggaacuacaugaaugccggaucuagaaacgcucagacguucggcuuuaaucuguccagccuuuguaagcugaaggauaccaaauccgccgaccagaagacaacccuccugcacuuccuggucgaaauuugcgaggagaaauauccugauauccuuaacuuuguggacgaccuggaaccccucgauaaggcgucuaaagugagcguugagacacuggaaaagaaucuccgccaaauggggagacagcugcagcagcuugagaaagaacuggagaccuucccucccccggaggaccuccacgauaaguuugucacgaagaugucccgguucgugauuucugccaaagaacaauacgagacacugagcaagcugcacgaaaacauggagaaacuuuaucaguccaucaucggcuacuacgcuauugacgugaagaaagucucuguggaagauuuccugaccgaccucaauaacuuucgcaccacauucaugcaggccaucaaggagaauauuaagaaaagagaggcugaagagaaggaaaaacggguucgcaucgccaaggagcuggcggaaagagagcggcucgagcgccagcagaaaaagaagagacugcuugaaaugaaaaccgagggagaugaaacaggcgugauggacaaccugcuggaggcccuccaaagcggggcugccuuucgggaucgcagaaagcggacgccuaugcccaaagacgucagacagucccugagccccaugucucaacgcccugugcuuaagguuuguaaucaugagaaccagaaagugcagcugaccgaaggaucccggagccacuauaauauuaacugcaauucuacaagaacccccgucgcuaaggagcucaacuacaaccuggauacacacaccuccacgggccgcaucaaggccgccgaaaagaaagaggcuuguaauguggaaagcaaccggaaaaaggagaccgagcuccuggggucuuucuccaaaaaugaaagcguuccugagguggaagcgcuucuggccagacugcgcgcucucuga

SEQ ID NO: 68355 - RNA, 5490 nt, Artificial Sequence
  derived and/or modified sequence opt5 from DICER1__Homo_sapiens__NP_001182502
augaaaagccccgcccugcagccucucuccauggcuggccugcagcuuaugaccccggccucuagccccauggggccuuucuuuggacugcccuggcagcaggaggcgauccacgacaacauuuacacaccuagaaaguaucagguggaacuccuggaggcugcccuugaucauaauacgaucgucugccugaacaccggcuccgggaagacauucauugccguucuccugaccaaagaacugucuuaccaaauccggggagacuuuagccgcaauggcaagagaacaguguuccucgugaacuccgcuaaucaggucgcccaacaggugucugcuguucggacccacagcgaucugaaagugggggaguauuccaaccuugaagucaaugccagcuggacaaaggagcgcuggaaccaagaguuuaccaagcaucaggugcugauuaugacguguuacguugcgcucaaugugcugaaaaacggauaucuuucucuguccgacaucaaucuccuggucuucgaugaaugccaccuggccauccucgaccaucccuacagagagauuaugaagcugugugaaaacugcccuagcuguccgcggauccuuggccugaccgcuucuauucucaauggcaaaugcgaucccgaggagcuggaagagaagauccagaaacuugaaaagauucugaaguccaacgccgagacagcuaccgaccucguggugcuggaucgcuauacaagccagccuugugaaaucgucguugacugcgggcccuuuaccgauagaucuggacuguacgagcggcuccugauggagcuugaagaggcccugaauuucauuaacgacuguaacaucuccgugcacagcaaagaacgcgauuccacgcucaucucuaagcaaauucugagcgacugcagagcggugcuugucgugcugggcccuuggugugccgacaaaguugcugggaugauggugcgggagcuccagaaguacaucaaacacgaacaggaggagcugcaucgcaaguuucuccuguucacagauaccuuucugagaaaaauucacgcccuuugcgaggaacauuucucccccgcuagccuggaccucaaguuugucacaccgaaggugaucaaacugcuggaaauucuucggaaguauaaaccuuacgagcgccaacaguucgaaucuguugagugguauaauaacagaaaucaggauaacuacguguccuggagcgacucugaggaugacgaugaagacgaggaaaucgaggagaaggaaaaacccgagaccaauuucccuagccccuuuaccaacauccucugcggaauuaucuucgucgaacggagauauacagccgugguccugaaucgccugauuaaggaggccggcaagcaggaucccgaacucgcuuacaucuccucuaacuuuauuacggggcacggaaucggcaaaaaucaaccucggaacaagcagauggaggcggaguucagaaaacaggaagaggugcugcgcaaguuucgggcccacgaaaccaaucuucugaucgcuacaagcauuguugaggaaggcguggacaucccgaaauguaaccucgucgugagauucgaucugcccaccgaguaucgcuccuacguucagagcaaggggcgggccagagccccuauuucuaauuacaucaugcuggcugacacagacaagauuaaauccuuugaggaagaucuuaagaccuauaaagccaucgagaagauucuccgcaacaaaugcagcaagucuguggacacgggagaaacagauaucgaccccgucauggaugacgaugacguguucccucccuacgugcugcggccggaugacggcgggccuagaguuaccaucaauaccgcgauuggacauaucaaccgcuauugugcucggcugcccuccgauccuuuuacacaccucgcccccaagugcagaacccgggagcugccugacggcacauucuacagcacgcuuuaucugcccauuaacuccccgcuccgcgccucuaucgucgggccucccaugagcugugugagacuggcugaacggguggucgcccugauuugcugugagaaacuucauaagaucggagagcucgaugaccaccugaugcccgugggcaaagaaaccguuaaguacgaggaggaacuggaccuccaugaugaggaagagacauccgugccuggcagaccggggucuaccaaacgccggcaaugcuaucccaaggcuaucccugaaugucugagagacagcuacccccgcccugaucagcccugcuaccuuuaugucauuggaauggugcugacaaccccucuccccgacgagcugaauuuuagacggcgcaaacuguacccgccugaagauacgaccagauguuucggcauccuuacagccaagcccauuccucagaucccccacuuuccgguuuauacccgguccggggaggugacaauuagcaucgagcucaagaaaucuggauucaugcugucccugcagaugcucgaacugaucacccgccuucaccaauacauuuucagccauauccugagacucgagaagccugcgcuggaauuuaaacccacggacgccgauucugcuuauugcguccugccucuuaacgugguuaaugacuccagcacacuggauauugacuucaaguuuauggaggauaucgaaaaaucugaggcccggauuggcauccccagcaccaaguacacaaaggagacccccuucguguuuaaacucgaagacuaucaggaugcugucaucauuccucgcuacagaaacuucgaccagccgcaccgguuuuacguggccgacguguauaccgaucugacaccccucuccaaguucccuagccccgaguacgaaacguuugcggaguauuacaaaaccaaguauaaucuggaccuuacaaaccugaaucagccucuccuggaugucgaccauaccucuucccgccugaaccuucugacacccagacaccucaaucaaaaagggaaggcccugccucucagcuccgcugaaaagcggaaagccaagugggagucucugcagaacaaacagauccuuguuccggagcugugcgcuauucaccccaucccugccagccucuggagaaaggccgugugucugcccuccauucuguaccgccuucauugccugcucaccgcugaggaacugcgggcgcaaacggccucugaugcuggcgugggagucagaagccucccugccgacuuccgcuaucccaaucuggauuuuggcuggaaaaaguccaucgacucuaagagcuucauuuccaucagcaacucuuccagcgccgaaaaugauaacuacuguaaacacucuacaaucgugccggagaaugcugcccaucagggggcgaaccggaccuccagccuugagaaccacgaccagaugucuguuaauugcagaacccugcuguccgaaagcccuggaaagcuccauguggaggucuccgcugaucugacagccauuaacggccuuagcuacaaucagaaccuggccaaugggucuuaugaccucgcuaaccgcgacuuuugucaaggaaaucagcugaacuacuauaaacaggaaauccccgugcagcccaccacaagcuacuccauucaaaaucucuauucuuacgagaaccagccucagcccagcgaugaaugcacgcugcuuuccaauaaguaucuggacggcaacgccaauaaaucuaccagcgauggguccccuguuauggcggugaugccgggcacaaccgacacaauccagguccugaagggacggauggauucugagcaaagccccuccauuggcuacagcucuagaacccucgggccuaaccccggacugauccuucaggcucugacgcucuccaaugccagcgacggcuucaaccuggagcgccucgaaaugcugggggauucuuuccuuaaacacgccaucaccacauaccuguuuuguaccuauccugacgcucacgagggacggcuguccuacaugagaagcaagaagguguccaacugcaaucucuaucggcugggcaaaaagaaagggcuucccucucgcaugguugugagcauuuucgauccgccugucaacuggcugcccccuggcuacguggugaaucaggacaaguccaacacagauaaaugggaaaaggacgagaugaccaaggauuguaugcucgccaauggaaaacuggacgaagacuaugaggaggaagaugaggaagaggaaagccucauguggagagcucccaaggaggaggccgacuacgaagaugacuuucuggaguaugaucaagaacauauccgguucauugacaacaugcuuaugggcucuggggcguuugucaaaaagaucucccugagcccuuucucuacaaccgauagcgccuacgaguggaaaaugcccaagaaguccucucugggaagcaugccguuuuccucugacuucgaggauuuugacuacagcuccugggaugcuaugugcuaucucgacccuagcaaagccguugaagaggaugacuucguggugggcuuuuggaaucccucugaagagaacuguggggucgacacgggaaagcaguccauuagcuacgaucugcacacagaacagugcaucgcugacaaauccaucgccgauugcguggaggcccuucugggcuguuaucucaccucuugcggggagcgcgcugcgcagcuguuccuguguagccucggccuuaagguucugcccgugauuaaaagaaccgaccgggaaaaggcccugugcccuacaagagagaauuucaacucccaacagaagaaucucucugucagcugugcugccgccuccguggcuagcucucgcuccagcguucugaaagauucugaauacggaugccuuaagaucccgccccgguguauguuugaccauccugaugccgacaaaacccugaaccaccucauuuccggcuucgagaauuuugaaaagaaaaucaacuauagauucaagaauaaggcguaccugcugcaggcuuuuacgcaugccagcuaucacuacaacacaauuaccgauugcuaccagcgccucgaguuccuuggggacgccauccuggauuaucugauuacaaaacaccucuacgaggacccccggcaacauucuccuggagugcugaccgaccuuagaagcgcucuggucaauaacacaaucuuugccucccucgcggugaaguaugauuaccacaaauauuucaaggcugucucucccgaacuguuucaugugaucgacgauuucguucaguuucagcuggagaaaaacgaaaugcagggcauggacagcgagaaguccuuccuccaaauguacccugugccgcuuugugaaaauugccugaaauggaaccagaagcugcccaaucucgcccgccugcgggagcuuaccacggggagaagcgagucccuguggaaguga

SEQ ID NO: 68356 - RNA, 1689 nt, Artificial Sequence
  derived and/or modified sequence opt5 from DIDO1__Homo_sapiens__NP_071388
auggacgauaagggcgaccccagcaacgaggaagccccuaaagcuaucaagccgaccuccaaagaguucagaaagacauggggguuucggcgcacgaccauugccaaaagagaaggagcgggcgaugcugaggccgacccccuggaaccucccccuccccagcaacagcucgggcugucucuucggcgcagcggaagacagccuaagcggacagagcgcguggagcaguuccugaccaucgccagacggcgcggcagacgguccaugccggucucucucgaagauagcggggagcccacauccugcccugcuaccgacgccgaaacagcuucugagggaagcguugaguccgccagcgaaacccgcucuggcccccaauccgcgagcacggccgugaaggagagaccugcuucuuccgaaaaagugaagggcggggaugaccacgaugacaccagcgauucugacuccgauggacugacacuuaaagagcugcagaaucggcuccgcagaaagcgggaacaggagcccaccgagagaccgcugaaaggcauucagagccgccugcggaagaagagacgcgaagaggggccugccgaaacagucggauccgaggcuucugacaccguggaaggcguucuccccagcaaacaagagccugagaacgaccaggggguggucucccaggccggaaaggaugaccgggaaagcaaacuggagggcaaggcggcccaggauaucaaagacgaagaacccggcgaucuugggagacccaagccugaaugugagggauacgacccgaaugcucuguauugcauuugucgccaaccccauaacaaucgguuuaugaucugcugugauagaugcgaggaaugguuccacggcgacuguguggggaucucugaggcccgcggacggcuccuggaaagaaacggcgaggauuacauuugcccuaauuguacgauccuucagguucaggacgagacacauuccgaaaccgcugaucaacaggaggccaaauggcgccccggggacgccgacggaacagauugcaccagcauuggcaccaucgaacagaagucuagcgaggaccagggcauuaaggggcggaucgaaaaagcugcgaacccuuccggaaagaaaaagcugaaaauuuuucaacccgugaucgaggccccgggcgcuucuaaguguaucgggccuggaugcugccacgucgcccagcccgauagcguguauuguuccaaugacugcauucucaagcaugccgcugccacaaugaaauuccugagcucuggcaaggagcagaaaccuaagcccaaagaaaagaugaagaugaaaccugagaagcccucccugccgaaauguggggcgcaggcuggcaucaagauuagcucugugcacaaaagaccugcccccgaaaagaaggagacgaccgucaaaaaggccguuguggugcccgcucgguccgaagcccucggaaaagaggcugccugcgagagcuccacaccuucuugggcgagcgaucacaacuacaaugccgucaagccggagaaaaccgcugcccccuccccuucucugcuuuauaaguguauguaccaucugggcguggggcuccuggaccccagccgcuccuuuuggaucgcuauuccuugggccugccccggacuuggcguugcggcccuguguuga

SEQ ID NO: 68357 - RNA, 2271 nt, Artificial Sequence
  derived and/or modified sequence opt5 from DIEXF__Homo_sapiens__NP_055203
augggcaagagagggagccggucccagucucaacugcucaacacccugacgaaaaagcagaaaaagcaccuucgcgacuucggagaggaacaucccuuuuacgauagagugagccggaaagaggccaagccucagaucugccagcuguccgaaucuagcgacuccucugauagcgaguccgacagcgaaucugagccgcaacaggucuccggcuaucaccgccuccuggcuacacuuaagaauguuagcgaggaagaggaagaggaugaggaagaggaagaggaagaggacucuauuguggaugacgccgagaugaacgaugaagacgggggauccgaugugagcgucgaggaagagauggcggcugaaucuaccgagucccccgagaauguggcccugagcgccgacccugaaggcaaagaggauggggaagaacccccuggaacaucccagaccucucccgaagaguucacagacgcuaagcaugagagccucuuuucccuggaaaccaacuuccuggaggaagagagcggcgacaauucuucccucaaagccagccaggauccuuuucugcaacacguuaacaaggagcuuaaagaaaaggcuauccaggccguggcgacaaauccgaagaccacgcaugagcugaaauggcccauucucggccagcuguucuuuucuagcaaguuccagaaacuugaaaccuuuaagccucccaaagacaucgaucugaagucccuccaucugcaaaaaccucuggagucuacauggaccaagacaaacagccaguuccucuccgggccccagaaguccucuuccccguuuaccccucugcaaaaagaacuuuuccugauuaugaauagcuacagagaccucuuuuaucccgagcggacggcccugaagaacggagaggaaauccgccacgucuacugucuucacgugaucaaucacauucugaaagcuaacgcccagguucucggcaauaacucuagacggcgcucccagaaguucggggugggagaugacgaugacuucagagaucagggccugacacggccuaaaguccugaucguggugcccuuucgcgaggcugcccucagagucguucaacuguucauuagccuucuggaaggggacuccaagaagaaaaucauugugucuaauaagaaacgguuucagggagaguauggcagcgaucccgaggagcgcccuccgaaccucaagagacccgaggacuacgaagcgguguucgucggcaacaucgacgaucauuuucggauugggguggccauccugcagagauccauccgccuuuaugcuccuuucuacucuagcgacauucugaucgccagcccccucggacugcggaccauuaucggcggggagggagagaaaaagagagauuuugacuuccugagcucuauugaacuccugaucaucgaucaggcugacauuuaccuuaugcaaaauugggaacacguucugcaccucaugaaccauaugaaucugcugccucuugauucccacggcguggacuuuagccgcguccggauguggucucucaacaauugguccaaguauuacagacagacacugcuguucggggcccuccaggaugcccagaucaacagcguguuuaauaaauauugcguuaacaugcaaggacagguggcuguccgcaaugugcccaugaccggcucuauuagccauguccuggugcagcuuccgcacguuuuccagcggauggaggcggagaaccuggccuccgugaucgacgcuagauuuaauuucuucgucaacaagauucucccucaauaccgcgaugccgugaugagccauacccugaucuauauccccucuuacuuugacuucguucggcugagaaauuauuuuaaaaaggaggaacuuaacuucacacacauuugugaauacacgcagaaauccggcgugagccgcgcccggcacuuuuuccuccagggggagaagcaauuucugcuguucaccgagagauuucauuucuacaagcgguauacaaucaaaggcauucgcaaucucaucuuuuacgaacugccuaccuauccccacuucuacuccgagauuugcaacaugcuuagagcuacaaaccggggagaagaggccaccuggacguguacaguccuguauucuaaguacgaugcgcagagacucgcugccgugguggggguugaacgcgccgcucagaugcugcagagcaauaaaaacguccaucuguuuaucaccggagagaaguga

SEQ ID NO: 68358 - RNA, 2397 nt, Artificial Sequence
  derived and/or modified sequence opt5 from DIP2A__Homo_sapiens__NP_001139587
auggccgacagaggcugcccccuggaggcugccccucucccggcggaagugcgggagagccuggcugaacuugagcuggaacucuccgagggggauaucacccagaagggauacgagaaaaagcgcgccaaacugcuugccagauauauuccccugauccaaggcauugacccuucucuccaggcugaaaaccggauccccgggccuagccagacaacggccgcugcccccaagcagcaaaaaucccgcccuaccgcgucuagagaugagcgguuccgcagcgacguccacacagaagccguucaggcugcccuggcuaaguacaaggagagaaaaaugccgaugcccuccaagcggcgcucugugcuggugcauagcuccgucgagaccuauacaccucccgauaccagcucugccuccgaagacgagggaagccucagacggccuggccgccugacaucuacgccccuucagucccacagcucuguggaaccguggcuggauagaguuauucagggguccagcaccuccucuagcgcguccagcaccucuucccauccuggaggccggcccacaaccgccccuagcgcugccgcuacacccggcgccgccgcuaccacggcgcucgccgggcuggaggcucacacacauaucggagugcccgucaauucucgcgugagcuccaaaauccaacagcuucugaacacccucaagagaccuaaacggccgccccugaaggaauuuuucguugacgauuuugaggagcugcucgaagugcagcagccugaccccaaucaaccuaagcccgagggcucugaaacaagcguccugagaggggagccgcuuaccgccggagugccucggcccccuucccugcucgccacccugcagcgcuggggcacaacgcagcccaaaagcccuugucuuaccgcucuggauacaaccgggaaggccguguacacacucaccuauggaaaacuguggucuagaucccugaagcucgcguacacgcugcuuaacaaacugacaagcaagaaugaaccccuccugaaaccgggcgaccgcgucgcucuuguuuucccuaacucugaucccgugauguuuaugguggccuucuauggcugccugcucgccgagcugguccccgugccuauugagguuccgcugacccggaaggacgcugggucccaacaggugggauuucuccugggcagcuguggggucuuccuugcccugaccacagacgcuugccagaagggacuccccaaagcccagaccggcgaaguggcggccuuuaagggguggccuccccuguccuggcugguuaucgauggaaaacaccuugcuaagccucccaaagacuggcacccucucgcccaagauacaggcacgggcaccgcuuacauugaguacaagacaucuaaggaagggagcaccgugggagucacagugucccaugccucucugcuggcgcaguguagagcccucacccaggcuugcggcuauagcgaggccgaaacgcugaccaauguccuugacuucaaacgcgaugcugggcuguggcacggagugcucacauccguuaugaaccggaugcauguggucagcgugcccuacgcccugaugaaggccaauccgcugucuuggauccagaaaguuuguuuuuauaaggcuagagcggcccuugugaaaucccgcgacaugcacuggagccuccuggcucaacggggccagagagaugucucucuguccagccuccgcaugcugauuguggccgacggggccaacccuuggucuaucagcuccugcgaugcuuuccuuaauguguuucagagccggggccugagacccgagguuauuuguccuugcgccucuucccccgaggcgcucaccgucgcuauccggcgcccgccugaccugggagggcccccucccagaaaggccgugcugagcaugaacggccuuuccuacggagugauccgggucgauacagaagagaagcucucugugcugaccguucaggacgugggccaagucaugcccggggccaauguguguguugugaaacuggaaggaacgccuuaucucugcaagacagacgaggucggcgagauuugcgugagcuccucugcuaccgggacagccuacuauggccugcuuggaaucaccaaaaacguuuucgaagcggugccggucaccacaggcggggcucccauuuucgauagaccuuuuacgcgcaccggacugcucggcuucaucgggcccgacaaucugguguuuauugugggaaagcuggauggccuuauggucacagggguucggagacacaacgccgacgaugugguggccaccgcucucgccgucgagccuaugaaauucguguaccgcggcagauga

SEQ ID NO: 68359 - RNA, 4731 nt, Artificial Sequence
  derived and/or modified sequence opt5 from DIP2B__Homo_sapiens__NP_775873
auggccgagagaggccuggaacccagcccugcugccguggcggcucucccgcccgagguccgggcccagcuggccgaacuugagcuggaacucuccgagggggacaucacccaaaagggauacgagaaaaagcgcucuaaacugcuuagcccuuauagcccccagacacaggaaacggauucugcuguucagaaggagcugagaaaccaaaccccugcccccagcgcugcccagacauccgcgccuucuaaauaccaccggacccgcagcggcggggccagagacgaacgguaucgcuccgauauucacacagaggcugugcaggccgcucucgccaagcacaaggagcagaaaauggcgcugccgaugcccaccaagagacggagcacauucgugcaaucuccugccgacgcuugcacacccccugauacguccagcgccucugaagacgagggaucccugcgcagacaggcugcccucagcgccgcucugcagcagucucuucaaaaugcggaauccuggaucaaccggagcauucagggcuccucuaccagcuccagcgccucuuccacacugagccauggggaggucaaaggaaccucuggcagccucgcugauguguuugccaauacacgcaucgaaaacuucuccgcucccccggacguuaccacgacaaccucuagcuccuccucuuccagcucuauuagaccugcuaauaucgaucugcccccuuccggcaucgugaaggggaugcacaaaggaagcaaccgguccucucuuauggacacagccgauggcguccccgugagcucccgcguuucuaccaagauucagcaacugcucaauacccugaagagacccaaacggccuccgcugaaggaguuuuucguggacgauagcgaggaaaucgucgaggugccccagccugaccccaaccagccuaaacccgaagggagacagaugacaccggugaagggagagccucucggcgucauuuguaauuggcccccugcgcuggaauccgcccuucaacgcugggggacgacccaggccaaaugcagcugucugacagcccucgacaugaccggaaagcccguuuacacacugaccuauggcaaacuuuggucucggucccugaagcucgcuuacacgcugcugaacaagcucggcaccaaaaaugagccugugcugaagcccggggauagaguggcccuugucuauccgaacaaugacccugugauguuuaugguugcuuucuacggaugccugcucgccgaggugauccccguccccauugaagugccucugacccgcaaagaugcgggcgggcagcagaucggauuucuucugggcagcugugggauugcccucgcucugaccucugagguuugccugaagggacucccgaaaacacaaaacggcgaaaucgugcaguucaagggcuggccccggcugaagugggucgugaccgacuccaaauaccuuagcaagccucccaaagauuggcagccucauaucucucccgccgggacagagccugcuuauauugaauacaagacgagcaaagagggauccgucaugggcgugaccguuagcagacuggccaugcucucucacugucaggcgcugucccaagccugcaauuauagcgagggggaaacaaucgugaacguccuggacuuuaagaaggaugcuggacuuuggcacggcauguucgccaacgugaugaauaaaaugcauaccauuuccguucccuacucugugaugaagacauguccgcucagcuggguccagcgcgugcacgcucauaaagccaagguggcccugguuaaaugccgggaccugcacugggcuaugauggcgcacagagaucagcgcgacgucucccucucuagccugcggaugcuuaucgugaccgauggggccaacccuugguccgugucuagcugugacgcuuuucugucccucuuccagagccauggccugaagcccgaggccauuugcccuugcgccacgucugcugaagccaugaccgucgcgaucagacgccccggagugccgggcgcuccucugcccgggcgggccauccuuuccaugaauggacucagcuauggcguuauuagagugaacacagaggacaaaaauucugcccugaccguccaagauguggggcacguuaugccuggaggcaugauguguaucgugaagcccgacgggcccccucagcugugcaagacagaugagauuggcgaaaucugugucuccagccggaccggaggcaugauguacuuugggcucgcuggagugacgaaaaacacauucgagguuauuccggucaauucugccggcucccccgugggggacgugccuuucauccgcagcggacugcuuggcuuuguggggcccggcucccuggucuucguugugggaaagauggauggccuccugauggugagcgggagacggcauaacgcggacgauaucgucgcuaccggacuggccguggaaucuauuaaaacaguuuauagaggccgcaucgccguguuuagcgucuccguguucuacgacgagcggauuguuguggucgcugaacagagaccugaugccucugaggaggacagcuuucaauggaugucccgcgugcuucaggcuaucgauucuauucaccagguugggguguacugccucgcccugguccccgcgaauacccugccuaagaccccgcucggaggcauccauauuagccagacaaaacaacuguuccuugaagggucccugcaccccuguaacauccucaugugcccucacacgugugugaccaaucugcccaagccuagacagaagcagcccggcgugggaccggccucugucaugguuggcaaccugguggcugggaaacggaucgcccaggcugccggacgcgaccuuggccaaauugaggaaaaugaucucgugagaaagcaucaguuucuggccgagauccugcaguggcgggcucaggcgacaccugaccacguccucuucaugcugcuuaacgccaaagggaccacagugugcaccgcuagcugucugcaacuccauaagcgcgccgaaagaauugccuccguucugggagacaaaggccaccugaaugcuggcgauaacgugguccuucuguauccucccgggaucgagcucauugccgcguuuuacggaugccuguaugcuggcuguauccccgugacgguucggcccccucacgcccagaaccucacagccacccugccgaccgugcgcaugaucgucgacgugagcaaggcugccugcauucuuacaucucagacccugaugagacuccugcggucccgcgaggcggcugccgccgucgaugugaagacauggcccacgaucauugacaccgaugaccugccuagaaaacggcuuccccaacuguacaagccucccacaccggaaaugcucgcuuaucuggauuucagcguuucuaccacagggaugcucaccggagugaaaaugucccauagcgccgucaaugcucugugcagagccaucaaacuucagugugagcuguacuccucucgccagauugcgaucugccucgacccuuauuguggccugggguuugcccuguggugccuuuguagcguguacuccggacaccagagcguucugauucccccuauggaacucgagaacaaucuguuccucuggcugucuacggugaaccaauacaagauccgggauaccuuuugcuccuauagcgucauggaacuuuguacaaagggccugggcaaucagguggaggugcugaagaccagagggaucaaccucucuugcguucgcacaugugucgugguggcugaggaacggcccagagucgcccugcagcagagcuucuccaaacuuuucaaggacauuggacugucuccucgcgcugugagcaccacauuuggcucccggguuaauguggccaucugccuccaagggaccucuggacccgauccgacgacagucuacguggaccugaaaagccucagacaugaucgcguucggcugguggagagaggcgccccucagucccuucugcugagcgaaucugggaagauucuccccggagucaaagugguuaucgugaaccccgagaccaagggcccugucggcgacucccaccugggggagaucugggugaauagcccgcauaccgcuuccggauauuacacaauuuaugacucugaaacccuucaggcggaucacuucaacacgcggcugagcuuuggcgacgccgcucagacacucugggcccgcaccggguaccugggauucgugagacggacagagcucaccgccgcuacaggcgaacgccacgaugcccuguaugucguuggggcgcuugacgagacccuggaacugagaggacuccgguaccaucccaucgauauugagacguccgugucuagaauccaccgcagcauugcugagugugccguguuuaccuggacaaaucugcuugucgugguuguggaacugugcggcuccgagcaagaagcccucgaccuggucccucucgugaccaacguugugcuggaggaacauuaccuuaucgucggcguggucgugguuguggaucccggggugauuccuaucaauagccggggagagaagcagagaaugcaucugcgcgacucuuuccuggcugaucagcucgaccccaucuaugucgccuacaacauguga

SEQ ID NO: 68360 - RNA, 4671 nt, Artificial Sequence
  derived and/or modified sequence opt5 from DIP2C__Homo_sapiens__NP_055789
auggccgacagaagccuggagggcauggcucucccccuggaagugcgggcccgccuugcggagcuggaacucgagcuguccgaaggggauaucacccagaagggauacgagaaaaagagaucuaaacuuauuggcgcuuaucugccucaaccgccccgggucgaccaggcccucccucaggagcgcagagcccccguuacaccuagcuccgcuucucgguaccaccgcagacggagcuccgggucucgcgaugaaagauaucggagcgacgugcauacggaggccgugcaggcugcccuggcgaagcacaaagaacgcaagauggccguccccaugccuuccaagagacggagccuggugguucaaaccucuauggaugcuuacacaccgcccgacaccuccagcggaucugaggaugagggcuccgugcagggggacagccagggaacaccuaccucuucccagggcagcaucaacauggaacauuggauuucccaagccauccacggcucuacaaccagcacgaccuccucuagcuccacacagagcgggggaucuggcgcugcccaucgccucgcggaugucauggcccagacccacauugagaaucacagcgcucccccugacgugacaaccuauacguccgaacauucuauccagguugagagaccccaagggagcacaggaucccggaccgccccgaaauacggcaacgcugaacugauggagacaggggauggagugccugucagcucuagaguguccgccaagauccagcagcuugugaauacccugaaacgccccaagcggccuccccucagagaguucuuugucgacgauuucgaagaacugcuugaaguucaacagcccgacccuaaccagccgaaacccgagggcgcccagaugcuggcuaugcgcggcgaacaacucgggguggugaccaauuggccucccagccuggaggcggcccugcagcgguggggaacaauuucuccuaaggcucccugccucacgaccauggacacaaacggcaagccgcuguauauccuuaccuacgggaaacuguggacaagauccaugaaggucgccuacagcauucuccacaaacugggaaccaagcaggagccuauggugcgccccggcgaucggguugcccuuguguuuccuaauaacgaccccgcugccuucauggcggcuuuuuaugggugucugcucgccgaagucgugccuguucccaucgaggugccgcugacgagaaaagaugccggaucccagcaaauuggcuuccugcucggcucuugcggggucacaguggcucugaccagcgacgccugucauaagggacuuccuaaaucccccaccggcgaaaucccccaguuuaagggguggccuaagcugcucugguucgucacagagucuaaacaccugagcaagccgccccgcgauugguuuccucacauuaaagacgcuaauaacgauaccgccuacaucgaauauaagacaugcaaagacggauccgugcuuggcguuacggugacccggacagcgcugcucacccauugucaggcccugacacaggcuugcggguacaccgaggccgagacgaucgucaaugugcuggauuucaagaaggacguuggccucuggcacggcauucugaccagcgugaugaacaugaugcaugucaucucuauucccuauucccuuaugaaagugaauccucugagcuggauccaaaaggugugucaguacaaagcuaagguugccugcgucaaaucuagagauaugcacugggcgcucguggcccaucgcgaccagcgggacauuaaccuguccagccugagaaugcuuaucguggcugauggagccaaucccuggucuaucagcuccugugacgcuuuucucaacgucuuccagagcaaggggcugcggcaagaagugauuugcccuugugccucuucccccgaggcccugacaguugcuauccgcagaccgaccgaugacagcaaccagccucccggacggggcgugcucuccaugcacgggcugacauauggagucauuagaguggauucugaagagaagcucagcguucugaccgugcaggacgucggccucgugaugccuggggcgaucaugugcuccguuaaacccgauggcgugccgcaacugugccgcacggacgagauuggagaacugugugucugcgccguggcuacaggcaccucuuacuacgggcuuagcggaaugacaaagaauaccuuugagguguucccuaugaccuccucuggcgcccccaucagcgaauauccuuucauccggacagggcuccugggauuugucggccccgggggccugguuuucguggugggaaaaauggauggccucauggucguguccgggagacgccacaacgccgacgauauuguugcuacggcccuggcgguggagcccaugaaguuugucuacagaggacggaucgcuguguucagcguuaccgugcuucaugacgaacgcauugucaucguggccgagcagagaccugauucuacagaggaagacuccuuucaguggaugagccggguucugcaggccauugacucuauccaccaagugggcgucuauugucucgcucuggugccggccaauacccugcccaaaacaccucuugggggcauucaucucuccgagaccaagcagcuguuccuggaaggaagccuccaccccugcaacgugcugauguguccucacacgugcgucacaaaucuucccaagccucgccagaaacagccggagaucgggcccgcgucuguuauggugggcaaccugguguccggaaagagaaucgcucaagccagcggccgggaucucgggcagauugaagacaaugaucaggcccgcaaauuucuguuccuguccgagguccuucaguggagagcucaaaccaccccugaccauauccucuacacacugcugaacugucggggagccauugcuaauagccuuaccugcgugcagcugcacaagcgcgccgagaaaaucgcgguuaugcuuauggaaagaggccaucugcaggauggggaccacguggcccucgucuaucccccuggaauugaucugaucgcugccuuuuacggcugucuguaugcuggcugcgugcccaucacaguucggccgccucauccccaaaacauugccacgacccuucccacagugaagaugaucgucgaggugucuagaagcgccugucugaugaccacacagcucauuugcaaacugcuccgcucccgggaagcugcggccgcugucgacgugagaaccuggccucugauccuugauacggacgaucugcccaagaagcgcccugcccagauuugcaaaccguguaaucccgacacccucgccuaccuggauuucucuguuagcacaaccgggaugcuggcuggagugaagaugucccacgccgcgacaucugcuuuuugccggagcaucaaacuucagugugagcuguacccuuccagagaagucgccaucugccucgaccccuauuguggccugggguucgugcucuggugccuguguucuguuuacagcggacaccaauccauucuuaucccucccagcgagcuggagaccaacccggcccucuggcugcuggcugugucucaguauaagguccgcgacacauuuugcuccuacagcgugauggaacuuuguaccaaaggccuggggucucagacggagucccucaaggcccggggacuggaucucagcagagugcgcacaugcguugucguggcggaggagcggccuagaauugcucugacccaguccuucucuaaacuuuucaaggaccugggccugcauccccgggccgugagcaccuccuuuggcugucgcgucaaucucgccaucugccugcaagggacaagcggaccugaucccaccacgguguauguugacaugagagcccuucggcacgaucgcgugagacuggucgagcggggcucuccucauucccucccccugauggaaagcgggaagauucucccgggagugagaaucaucauugcuaacccugagacaaaaggcccccugggggacucucaccuuggagaaaucuggguucauagcgcucacaaugccuccggcuacuucaccauuuauggcgaugagucucugcagagcgaccacuuuaacucccgccugucuuucggggauacacagaccaucugggcgcggacaggauaccucggcuuucugagacgcaccgaacuuacggacgccaacggggagcggcaugaugcucuguacguggucggagcccucgacgaggcuauggaacugagaggcaugcgcuaucaccccauugacaucgagaccagcgugauucgggcccauaaguccguuacagaaugcgccguguucaccuggacaaaucuccuggucgugguggucgagcuugaugggagcgaacaggaggcucuggaccugguuccucucgugaccaacgugguccuggaggaacacuaccuuaucgugggaguuguggucgugguugauaucggcgugauuccgaucaauucuagaggcgagaaacaacgcaugcaccugagagacggguuucucgcggaucagcuggaccccauuuaugucgccuacaacauguga

SEQ ID NO: 68361 - RNA, 597 nt, Artificial Sequence
  derived and/or modified sequence opt5 from DIRAS1__Homo_sapiens__NP_660156
augcccgagcagagcaacgacuacagaguggucguuuucggcgccgggggagugggcaaguccucucuggugcuccgguuugucaaagggaccuuccgcgauacauauaucccuacgauugaagacaccuacagacaagugaucagcugcgauaaguccguuuguacacugcagauuaccgacacaaccggaucucaccaguuuccggcuaugcagcggcuuagcaucuccaaaggccaugccuucauucugguguuuucugucacaagcaagcaaucccucgaggaacuggggcccaucuauaaacuuaucgugcagauuaagggaagcguugaggauaucccugugaugcuggucggcaauaagugcgacgaaacccagcgcgagguggauacgagagaggcgcaggcuguggcccaagaauggaaaugugccuucauggagaccucugcuaagaugaacuacaaugucaaagaacucuuucaggagcugcugacacucgagacccggcgcaacaugucccugaauauugacggcaagagaagcgggaaacagaagcggacagaucgcguuaagggaaaaugcacccuuauguga

SEQ ID NO: 68362 - RNA, 600 nt, Artificial Sequence
  derived and/or modified sequence opt5 from DIRAS2__Homo_sapiens__NP_060064
augcccgagcagagcaacgacuacagaguggccgucuucggcgcugggggaguuggcaaguccucucuggugcuccgguuugugaaagggaccuuccgcgaaagcuauaucccuacagucgaggauacguacagacaagugauuuccugcgacaagucuaucuguacccugcagauuacagauaccacaggaagccaccaguuuccggccaugcagcggcuuuccaucucuaaaggccaugcguucauucugguuuauagcaucaccucccgccaaagccucgaggaacugaagcccaucuacgaacagauuugcgagaucaaaggggacguggagucuauuccuaucaugcuugucggaaauaagugugaugaaucccccagcagagaggugcagucuuccgaagcugaggcccuggcccggacauggaagugcgcuuuuauggagaccagcgccaaacucaaccacaauguuaaggaacuguuccaggagcugcucaaccuggaaaaacgcagaacggugucucuucaaauugacggcaagaaauccaagcagcagaagcggaaagagaagcugaaaggcaagugugucaucauguga

SEQ ID NO: 68363 - RNA, 315 nt, Artificial Sequence
  derived and/or modified sequence opt5 from DIRC1__Homo_sapiens__XP_011508847
augcccgaggcccacaugcagccugcuaagcugcaaaccagccucccgacaacggaccauggcuccaaaaagcccgugucuugcuaccugccuccccuuagcaacgcccacccuauguguaucgaaguccagaaugcgcagaacugcuccucugcugccgccacccuggagcccagcauuaucuccgauacauguuucuauaaaccuauuaccaaggaccagcucucuagcagauccgaacugaauacaguucggcuuaaaugccugaacagccuccgcggguggaagauccugaaucaacugucucucaccuga

SEQ ID NO: 68364 - RNA, 1437 nt, Artificial Sequence
  derived and/or modified sequence opt5 from DIRC2__Homo_sapiens__NP_116228
augggcagcagaugguccucugaggaggaacggcagccccugcucgggccuggacugggcccggggcuuggagccagcuggcgcuccagagaagcugccgcggcugcccugcccgccgcugugccuggccccgggcgggucuacggacgcagauggcucguucugcuucuguucucucuccuggccuuugugcaaggccugguguggaacaccuggggcccuauccagaauagcgcucggcaggccuauggguucuccucuugggacauugcgcuccugguccuuuggggacccaucggcuuucugccuugcuucgccuuuauguggcuccuggauaagcgcgggcuuagaauuacagugcugcucacgagcuuccugaugguucugggaaccggccuccgguguaucccgauuuccgaccugauccuuaaacgcagacugauccacgggggacagaugcucaacggccuggcuggccccacagugaugaaugccgcuccuuuucuuagcaccacaugguucucugccgaugagcgggcgaccgccacagcuauugccuccaugcugagcuaccucgggggagcuugcgccuuucuggucggcccccuggugguuccugcccccaacgggaccucuccgcuccuggcugcggaauccagccgcgcccauaucaaggacagaauugaggcugugcuuuaugccgaguucggagucgugugucugaucuuuucugccacgcucgcuuacuucccuccccggccuccccugcccccuuccguggccgcggcuagccaacgccuuuccuauagacggucugucugcagacugcucagcaauuuucgcuuccugaugauugcccuggccuacgcuaucccgcucggcguuuucgccgggugguccggagugcuggaucuuauucugacccccgcucacgugagccaggucgacgccggcuggaucggcuuuuggucuaucguugggggauguguggugggcauugcgauggcccgguucgcugauuuuaucagagggaugcucaaacugauucugcuucuccuguucuccggagccacacugagcucuaccugguuuacacugaccugccugaacagcaucacgcaucuuccucugacaaccgucacacucuaugcuuccuguauucugcugggcguguuccuuaauucuagcguucccaucuuuuucgaacucuuuguggagaccgucuacccugugcccgaagggauuaccugcggcgucgugacauuccuguccaacauguuuaugggaguucuccucuucuuucugacguucuaccacaccgagcuuagcugguucaauuggugucugccgggcucuugccuccugucccugcuucucauccuguguuuucgcgagagcuaugaccggcuguaccucgauguggucgugucuguuuga

SEQ ID NO: 68365 - RNA, 2787 nt, Artificial Sequence
  derived and/or modified sequence opt5 from DIS3__Homo_sapiens__NP_001121698
augcugaaaagcaaaaccuuccucaagaaaacaagagccggcggggugaugaagaucguccgggagcacuaccugcgcgacgauauuggaugcggcgcucccgggugugccgcgugcggaggcgcucaugaagggccugcccuugagccgcagccccaagacccugccuccucuguuuguccccagccucacuaucugcuccccgauacgaacgugcugcuucaucagaucgugagcgcuuggagaccuggaaccugggccuccgucgcuucuagccugcggcucccgggcucccuggaaacauacguggagcaggaacaaggcgagaaugccaacgaccgcaaugauagagcgauucggguugccgcuaaaugguauaacgagcaccugaagaagaugucugccgacaaucagcuccaggugaucuuuauuaccaacgaucgcagaaauaaagaaaaggcuaucgaggaagggauccccgccuucacaugcgaggaguacgucaaaagccugaccgcgaacccugaacuuauugaccggcuggccugucucuccgaggaaggaaaugagaucgaaagcggcaagauuaucuuuucugagcaucugccccuuuccaaacugcagcaagggauuaagagcggaacauaucuccagggcaccuuccgcgcuucuagagagaacuaccuggaagccacgguguggauccacggggauaaugaggaaaacaaggagauuauccugcagggacucaaacaccugaaucgggcuguucaugaagacaucguggccgucgagcuucugccuaagucccaguggguggcccccagcucugugguccuccacgaugagggccaaaacgaagaggacguugaaaaagaggaagagaccgagcgcaugcugaagacagcuguguccgaaaagaugcuuaagccgaccggcagaguggucgggauuaucaaacggaauuggcgcccuuauugcggaaugcugagcaaguccgauauuaaggagucuagacggcaucucuuuacacccgcggacaaaagaaucccucgcauucggaucgaaaccagacaggccagcacgcuggagggccgccggaucauuguggcuaucgacggguggcccagaaacucccgcuaccccaacggacacuucguucggaaucugggcgaugugggggagaaggaaacagagaccgaaguccuccugcuugagcacgacgugccucaucagccguuuagccaagccguucugucuuuccuccccaaaaugccuugguccauuacagaaaaggauaugaaaaacagagaggaccugcgccaccuuuguaucugcagcguggaucccccuggauguaccgacauugaugacgcccugcauugccgggagcucgaaaauggcaaccuggaggucggcgugcacaucgcugaugucucucauuuuaucagacccgggaaugcccuggaccaggaaagcgcgcgccggggaaccacaguguaccucugugagaagagaauugauaugguuccggaacugcuuuccucuaaccugugcagccucaagugcgacguggaccggcuggcuuucuccuguaucugggagaugaaucacaacgccgagauucugaaaacgaaguuuaccaaaagcgucaucaauucuaaggccucccuuacauaugcugaagcccagcuccgcauugauagcgcuaacaugaaugacgauaucaccacaucucugagaggccugaacaaacucgccaagauucugaagaaacggagaaucgagaagggggcgcuuacccuguccagcccugaagugcgcuuccacauggacuccgagacgcaugaucccaucgaccuccagacaaaagaacugcgggagaccaauucuaugguugaggaauuuaugcugcuugccaacauuagcguggcuaagaaaauccacgaggaguucuccgaacaugcccuccugagaaagcacccugcucccccucccucuaauuacgagauucuggucaaggccgcgcgcagcagaaaccucgaaaucaaaaccgauacagccaagucccuggcugagagccuugaccaagccgaaucuccgaccuucccuuaucugaacacacuccugcggauucuggcuacgcgcugcaugaugcaggccguguacuuuuguuccggaauggauaaugacuuccaccauuauggccuugccagccccaucuacacccacuuuacaucucccaucagacgguaugcugaugugauuguucaucgccuccuggcggucgccaucggggcugacugcaccuacccugagcugacagauaaacacaagcucgccgacauuuguaaaaaccugaauuucagacauaagauggcccaguacgcucagcgggccuccguggcguuucacacccaacuuuucuuuaaaagcaagggcaucgugucugaagaggcuuauauucuguucguccgcaagaacgccaucgugguucucaucccgaaauacggacuggagggcacgguguuuuucgaagagaaggacaaacccaauccucagcugauuuaugaugacgaaauccccagccuuaagauugaggauaccgucuuucacguguucgacaaaguuaaggugaagaucaugcucgauuccagcaaccugcagcaucagaaaauuagaaugucucuggucgaaccucaaauccccgggaucuccauuccuacagacaccagcaauauggaucucaacggacccaagaaaaagaaaaugaagcugggcaaguga

SEQ ID NO: 68366 - RNA, 1812 nt, Artificial Sequence
  derived and/or modified sequence opt5 from DIS3L2__Homo_sapiens__NP_001244210
augagccaccccgacuacagaaugaaccugcggccucucggcaccccgcgcgggguguccgccgucgcuggaccccaugauaucggcgccucuccuggggacaagaaaagcaagaauagauccacacggggcaaaaagaaaucuauuuucgagacguauaugagcaaggaagauguuuccgagggacugaagcgcgggacccuuauccagggagugcugagaauuaaccccaaaaaguuucacgaagcguucaucccuucucccgacggcgaucgggacauuuuuaucgauggcguggucgcucgcaauagagcccucaacggggaccuggugguugugaaacuucugccugaggaacauuggaaggucgugaaaccggagagcaaugauaaggagacagaagccgcuuacgaguccgacauccccgaggagcucugcggacaccaucugccucaacagagccugaagucuuauaacgauucccccgacguuauuguggaggcccaguucgauggcagcgacucugaagacgggcacggaaucacccagaauguccucguggauggcgugaaaaagcuguccgucuguguuagcgagaaagggcgggaagacggagaugcuccugugacaaaggacgagaccacaugcauuucucaagauacccgcgcccuuuccgaaaagagccugcagagauccgcgaagguggucuacauccucgagaaaaagcacucucgggccgcuacgggcuuucugaaacuucuggccgacaaaaacagcgaacucuuccgcaaguaugcucuguuuucccccagcgaucauagagugccgcggauuuacguuccucugaaagacuguccccaggauuucguggcccgcccuaaggacuaugcgaauacccucuuuaucugcagaauugucgauuggaaagaagacuguaacuucgcccugggccagcuugcuaagucucuggggcaagccggagagaucgaacccgagacagaaggcauccucaccgaguacgggguggacuuuuccgauuucagcucugagguucuggaaugccuuccccagggacugccuuggacaauuccgcccgaggaauuuagcaagcggagagaccuccgcaaagauuguaucuucaccauugacccuuccacggcucgggaucuggacgaugcccugucuugcaagccccucgccgacggcaauuucaaaguggggguccacaucgcugaugugagcuacuuugucccugagggauccgaccuggauaagguggcggccgaaagagcuacaagcguuuaucuugugcagaaagucgugcccaugcugccgcgccuccugugugaggagcuuugcucucugaacccuauguccgacaagcucaccuucagcguuauuuggacacugacccccgaaggcaagauccuggaugagugguuuggccggaccaucauuagaucuuguacaaaacucuccuacgaacaugcccagagcaugaucgaguccccuacggagaagauucccgccaaagaacugccucccaucucuccggagcacagcuccgaagaggugcaccaacagaaugcugacaaggacggggccgcgcaucuucaggcuucucacagcccuuccgccgaagaugccgaggcucaacccagcaccgaggaacgccugcccgagacacggggaauuugcgacagagauccugacacccgccucuucuuucugcagcagcagucucggguccuggaagccaaaccgcaaaacacaaucagaguggaggaacagaccacgcagcuucagaucuga

SEQ ID NO: 68367 - RNA, 3165 nt, Artificial Sequence
  derived and/or modified sequence opt5 from DIS3L__Homo_sapiens__NP_001137160
augcugcagaagagagagaaagugcuccugcuucggaccuuccaaggccgcacacugagaaucguccgggaacacuaccuccgccccugcguuccuugucauagcccgcugugcccccagccugccgcuuguucccacgacgggaaacuucugucuagcgaugugacgcauuaugugauucccgacuggaaagucgugcaggauuaccucgagauccuggaauuuccugagcugaagggaauuaucuucaugcagaccgccugccaagcgguucagcaccagagaggccggcgccaguauaacaaacucagaaaucugcuuaaggacgcucggcaugauuguauucuguuugccaacgaguuccaacagugcuguuaccucccccgcgagagaggggaguccauggaaaaguggcagacacggucuaucuauaaugccgcugugugguacuaucaccacugccaggaccgcaugccuaucgucauggugaccgaggaugaagaggccauucaacaguacggaagcgagacagaaggcguuuuugugaucaccuucaaaaacuaccuggacaauuuuuggccggaucuuaaggcugcccaugagcugugugacuccauucuccagucuagacgggaacgcgagaacgaaagccaagagucccacgggaaagaguaucccgaacaucugccucuggagguccucgaagcgggaaucaagagcggcagauacauucagggcauccugaaugugaacaaacaccgggcccagauugaggcuuucgugagacuucagggggccucuuccaaggauagcgaccuggucucugauauccucauccacggaaugaaggcucgcaaucgguccauucauggcgacguugugguggucgaacugcuucccaaaaacgaguggaaggggagaacaguggcccugugcgagaaugacugugaugacaaagcgagcggagaaucuccuuccgagcccaugccgaccggccgcguuguggggauccuccaaaagaacuggcgggauuaugucgugacguuuccuagcaaagaagagguucagucccagggaaagaaugcccagaaaauucuggugacccccugggacuacagaaucccuaagauucgcaucucuacacaacaggcugaaacccugcaggauuuccgggucguggucagaaucgacagcugggaguccacaagcguguaucccaacggccacuuuguucgcgugcucggccggauuggggaucuggagggagaaaucgccaccauucuugucgaaaauucuaucuccgugauucccuucagcgaagcucagaugugcgagaugccuguuaacacgccggagucucccuggaaggugagcccugaagaggaacaaaagagaaaggaccugcgcaaaucccaucucgucuuuucuaucgaucccaagggcugcgaggacguggaugacacacugagcgugcggacccuuaacaaugggaaccuggaacucggaguucacaucgccgacgucacacauuucguggccccuaauuccuacauugauaucgaggcuagaacccgggcgaccacauauuaccuggccgaccgcagauacgauaugcugcccagcgugcucucugcugaccuguguucccuucugggcggggucgaucgguaugccgugagcauuaugugggagcucgacaaagccucuuacgaaaucaagaagguuugguauggaagaacgauuauccgcuccgcuuacaaacuguucuaugaggccgcgcaggaacugcuugauggcaaccucagcguggucgacgauauuccggaguuuaaggaccuggaugaaaaaucccggcaggcuaagcuggaggagcucgugugggccaucggcaaacugaccgacaucgccagacacguucgcgcuaagagagaugggugcggagcccuugaacuggagggcguggaagucugugugcagcucgacgacaagaaaaauauucacgaucugaucccuaagcaaccccuggagguucaugaaacaguggcugagugcaugauucuugccaaccacugggucgcgaaaaagaucugggagucuuucccucaucaggcccuccugcggcagcaucccccuccccaccaagaauuuuucagcgagcugcgcgaaugugcuaaagccaagggguuuuucauugacaccagauccaauaagacacucgcugauucucuggacaacgccaaugauccgcacgacccuaucgugaaccggcuucugcgcagcauggcgacccaggccauguccaaugcucucuacuuuagcacgggaucuugcgccgaggaggaguuccaccauuauggccuggcucuggauaaauacacacacuuuaccucccccaucagacgguacagcgacauugugguccaucgccuucucauggccgccaucucuaaggauaaaaagauggagauuaaagggaaccuguucuccaauaaggaccuggaagaacucuguagacacaucaacaaucggaaccaggcugcgcagcacagccaaaaacagucuaccgaacuguuucagugcauguauuucaaggauaaggaccccgccacagaggagcgcuguauuagcgauggcguuaucuacuccaucagaaccaacggagugcuucuguuuauuccucgguucggcaucaaaggggcugccuaucucaagaauaaagacggacuggugauuagcugcggcccggacucuuguuccgaauggaagcccgggagccugcagagauuccaaaacaaaaucacauccacgaccacagauggagagucugucaccuuucaucuuuucgaccacgugacaguucgcauuagcauccaggccucccggugccauucugauaccaucagacucgaaauuaucagcaauaagccuuacaagauucccaacacggagcugauccaccaguccucuccucugcucaaaagcgaacuggugaaggaggucaccaaauccguggaggaagcucagcuugcccaagagguuaaggugaauauuauccaggaagaguaucaggaauaccgccaaacaaaaggccggagccuguauacccuccuggaggagauuagagaccuggcgcuucuggaugucucuaacaauuacgggaucuga

SEQ ID NO: 68368 - RNA, 2499 nt, Artificial Sequence
  derived and/or modified sequence opt5 from DISC1__Homo_sapiens__NP_001012975
augcccggcgggggaccucagggcgccccggcugccgccgggggaggcggggugagccacagagcuggaucccgggacugccugcccccugccgccuguuuccgcagacggcgccucgcuagacggcccggcuacaugcgcucuagcaccggcccugggaucggauuucugucccccgccgucggcacacuuuucagauuuccugggggaguuucuggcgaggaaagccaucacuccgagucucgggcucgccaaugcgggcuggauagcagaggacuccuggugcgguccccggugagcaagucugccgcggcccccacggucaccuccgugcgcggcacaagcgcucauuucggcauucagcuuagagggggaacccggcugccugaccgccucucuuggcccuguggcccuggguccgccggauggcagcaggaauuugcugccauggauagcucugagacacuggacgcguccugggaagccgcuugcagcgauggcgccagacggguuagagcugccgggucccugcccucugccgagcucagcuccaacagcuguucuccgggaugcggcccugaggugcccccuaccccucccggcucccacagcgcuuucacaucuagcuuuuccuucauccgccugucucuugggagcgcgggagaacggggcgaggccgaagggugucccccguccagagaggcugagagccauugccaaucuccccaggaaaugggagccaaagccgcuucccuggacggcccucacgaggauccccgcugucucagccggccuuuuucucugcuugccaccagagucuccgcggaccuggcucaggccgcccgcaauagcucccggcccgaaagagauaugcacucucucccggacauggauccugggagcuccucuagccuggaccccucccuggcuggcugcggaggcgaugggagcucuggauccggcgacgcccauagcugggacacgcuccugcgcaagugggagccugugcuucgggauugucugcucagaaaccgccggcagauggaaguuauuucucugagacuuaaacugcaaaagcuccaggaggacgcuguggagaaugaugacuaugauaaagccgaaacccugcagcagcggcuggaggaccucgaacaagagaagaucucccugcacuuccagcuucccagccgccagccugcgcugucuagcuuucucgggcaucuggccgcucaaguccaggccgcucuuagacggggagccacacagcaggcguccggcgaugacacccacacaccccugagaauggaaccgcgccuccuggagccuaccgcccaagauagccugcacgugucuauuacgcggagagacuggcuccugcaggagaagcagcagcuucaaaaagaaaucgaggcucugcaggcccgcauguucgugcucgaagcuaaggaucagcagcugagacgggagaucgaggaacaagagcagcagcugcaguggcaagggugcgaccuuacaccccucgucggccagcugucccugggacagcuccaagaaguuagcaaagcccugcaggacacccuugccuccgcuggccagauucccuuucaugcggagccuccggaaacaauccgcucucugcaggagagaauuaagagccucaaccugucccugaaagagaucaccaccaaggugugcaugucugaaaaguucuguagcacacuucggaaaaaggugaaugauauugagacgcaacuccccgcccugcuggaagcuaaaaugcacgccaucuccgggaaccauuucuggaccgccaaggaccucacagaggaaauucgcucucugaccagcgagagagagggacuugaaggccugcucuccaaacugcugguccuuagcucucggaaugugaagaaacucggguccguuaaggaggauuacaaccgccugagacgggaaguggagcaccaggaaacagcuuaugagaccagcgucaaggagaauacgaugaaauacauggaaacacugaagaacaaacucugcucuuguaagugcccucugcuuggaaaagugugggaggccgaccuggaagcgugucgccuccugauccagucccugcagcuucaagaggcuagaggcagccucucuguugaagaugagcggcagauggacgaucuggagggggccgcgcccccuauucccccuagacugcauuccgaagacaagcgcaagacaccccucaaagagagcuauauccuguccgcugaacuuggcgagaagugcgaggauaucggcaaaaagcugcucuaccuggaagaccagcugcacaccgccauucacagccaugaugaggaccuuauccagucucugcggagagaacuccaaauggugaaagagacccugcaggcgaugauucuccagcugcaaccggcuaaggaagccggagagcgcgaggccgcugccagcuguaugaccgcugggguccacgaagcccaggcguga

SEQ ID NO: 68369 - RNA, 4575 nt, Artificial Sequence
  derived and/or modified sequence opt5 from DISP1__Homo_sapiens__NP_116279
auggccaugagcaacggcaauaacgacuucgugguccuguccaauucuagcaucgcuaccuccgccgcgaaccccucuccucucacaccgugcgauggggaccacgcugcccagcaacugacgcccaaggaggccaccagaacaaaaguuagcccuaauggaugucuucagcugaacggcaccgugaaguccucuuuucucccccuggauaaucagcggaugccucagaugcuuccccaaugcugucauccuugcccguaccaccauccccugacaagccacuccagccaucaggaaugucacccugaggcugggcccgccgcuccuucugcccucgcguccugcuguaugcagccccacagcgaauauucugccucccugugcccgaaccauagcccuguguaccagaccacauguugccugcaacccucuccuuccuucugucuccaccaucccuggcccgaccacuuucagcaccagccuguccagcaacauauugcuaauauccgcccgagcagacccuucaaacugccuaaguccuaugccgcucuuauugccgauuggcccgugguugugcugggaaugugcaccauguuuaucgucgugugcgcgcucguuggcgugcuggucccugagcuucccgacuucucugauccgcugcucggguuugaaccucggggaacggccauuggccagcgccuggugaccuggaacaauauggugaaaaacacaggcuacaaggcuacccuggccaauuaucccuucaaguacgcugacgagcaggccaaaagccacagagaugaccggugguccgaugaccauuaugagcgcgaaaagagagaggucgauuggaacuuucacaaagacagcuucuuuugugacguuccuucugaucgguacucccgcgugguguucacaagcucugggggagaaacccucuggaaucugcccgccaucaagagcaugugcaacgucgacaacuccagaauccggucucauccucaauuuggcgaucuuugucagcgcacgacagcugcgagcugcugucccuccuggacccuggggaauuacauugccauccucaacaauagaagcucuugccagaaaauuguggagcgggacguuucccacacacugaagcuccugcgcaccugugcuaagcacuaucagaacggaacccucggcccggauugcugggacauggccgccagacggaaagaucaacugaaguguacaaaugugccuagaaaaugcacgaaguacaacgcugucuaucagauccugcauuaccucguggacaaagauuucaugacccccaagacagccgacuaugcgacccccgcucugaaauacagcaugcuuuucucuccuacagagaagggggaauccaugaugaauauuuaucuggauaacuuugagaauuggaacagcuccgacggaguuaccacgaucacaggcauugaguucggcaucaagcacucucucuuucaggacuaccugcuuauggauaccguguacccggccaucgccauugucaucgugcugcucgucauguguguguauaccaaaagcauguucauuacacugaugaccauguuugcuaucauuuccucucugaucguuagcuacuuccucuaucgcguggucuuucauuucgaguuuuuccccuuuaugaaucugacagcccuuaucauucugguggggaucggagcugacgaugccuucguucucugcgacguguggaacuacacgaaguuugauaaaccucacgcggaaaccuccgagacagucagcauuacccugcagcacgccgcucugucuauguucgugacauccuucaccacggccgcugccuuuuaugcgaauuacgugagcaacaucaccgccauucggugcuucggcguuuaugcugggacagccauccuugucaauuacgugcucauggugaccuggcugcccgcugucgugguucugcaugagagauaccuccugaacaucuuuacauguuucaagaaaccucaacagcagauuuaugacaacaagucuugcuggaccguggccugucagaagugccacaaaguccuuuuugccaucuccgaagcuagccgcauuuucuuugagaaggugcugcccuguaucguuauuaaauuccgguaccucuggcuguuuugguuccuggcgcuuacggugggaggcgccuauaucgucugcauuaauccuaagaugaaacuccccucucuggaacugagcgaguuucaaguguucagauccagccauccguuugaacgcuacgaugcugaguauaagaaacucuucauguucgagcggguucaccauggggaagaacugcacaugccuaucacagugaucuggggagucucucccgaagacaacggcaauccucuuaaccccaaguccaagggcaaacugacccucgauagcuccuuuaauauugccucuccggccagccaggcuuggauccugcacuucugucagaagcugagaaaccagacauuuuucuaccaaaccgacgagcaggauuuuaccuccugcuucauugaaacauuuaaacaguggauggagaaucaagacugugaugagccugcccuuuaucccugcuguucucauuggagcuucccuuacaagcaggaaaucuuugagcucugcauuaagcgcgcgaucauggaacuggagcgguccacgggguaccaccuggacucuaaaacccccggacccagauucgacaucaacgauacaauucgcgcuguggugcucgaguuucagagcaccuaucuguucacacuugccuacgaaaagaugcaucaguucuauaaagaggucgacuccuggaucagcucugaacuguccagcgccccugagggccucucuaaugggugguuuguuuccaaccuggaguucuacgaucugcaagacagccuuucugauggaacccucauugcuaugggccuguccguggccguggcguuuagcgucaugcugcucacgacauggaauaucauuaucucccuguaugcuaucauuagcaucgccgggaccauuuucgugaccguuggcucucuugugcugcucggaugggaacugaacguccuggagagcgugacaaucuccguugccgugggccuuucugucgacuuugcugugcacuacgggguugccuaucggcuggcuccggaucccgacagagaaggaaaggugauuuucagccucucccgggucggcucugccauggcgauggccgcucugaccacauuuguggccggggcuaugaugaugccuagcacggugcucgccuacacccagcugggaacauucaugaugcuuaucaugugcaucuccugggccuuugcuaccuucuuuuuccaguguaugugccgcugucugggcccccaggggacaugcggccaaauuccucuccccaaaaagcugcaguguucugcguuuagccaugcccuguccaccagcccuucugauaaaggacaguccaagacgcacaccaucaaugcuuaccaccuugacccgagaggccccaagagcgagcuggaacaugaguucuaugaacucgagccucuggccucucacuccugcacagcccccgagaaaaccacauacgaagagacccauauuuguagcgaguucuuuaacucccaggcuaagaaucucgggaugccuguccacgccgcguauaacucugaacugagcaaauccacagaaagcgaugcuggaucugcccuucugcaacccccgcucgagcagcacaccguuugccauuucuuuucccugaaccagcgguguagcugcccugacgccuacaagcaccugaauuauggcccccauucuugucaacagaugggggauugccuuugccaccaguguagccccacgacauccucuuucgugcagauccaaaacggaguggcuccucugaaagccacccaucaggcggucgagggcuuugugcaccccauuacccacauccaucacugcccuugucuccaggggagaguuaagccggcuggcaugcagaauagccugccccgcaacuucuuucuccauccugugcaacacauucaggcccaggaaaagaucggaaaaacaaauguccacucccugcagcggucuaucgaggaacaucuucccaagauggccgagccuagcuccuucgugugcagaagcaccggcucucugcugaaaacguguugcgaccccgagaacaagcaacgcgaacucuguaaaaauagagacguuuccaaccuggagagcuccgggggaacagaaaauaaggcuggcgggaagguggagcuuucucugagccagaccgaugccuccgucaacucugaacacuuuaaucagaacgagccgaaagugcuuuucaaucaucugaugggagaggcuggcugccggagcuguccuaacaauucccagagcugcgggcgcauugucagagugaaguguaacucuguugacugccaaaugcccaacauggaagccaaugugccugcgguccucacacacuccgagcugagcggcgaaucucuucugaucaaaacccuguga

SEQ ID NO: 68370 - RNA, 2052 nt, Artificial Sequence
  derived and/or modified sequence opt5 from DIXDC1__Homo_sapiens__NP_001033043
augcuggccugccucaccagaggcaaccugcuugacgugcugcaggagggguucaaugaacaacagcuccaggcuuacgucgccuggguuaacgcgcagcugaagaaacggcccgcugugaagccugugcaagaucuucgccaggaccugagagauggagucauccucgccuaucugauugagaucguggccggcgaaaaacugagcgggguucagcucuccccgggaaaucagcaagagaugaagaacaauguggaaaaaguccugcaguuuguggcuucuaagaagauucggaugcaccagacaagcgccaaagacaucguugauggcaaccuuaaguccauuaugcgccuggugcucgcucuggccgcgcauuucaaacccgggucuagcagaacggucaaucagggacgggacucccgcgccccucuucaaucucacagaccccauugugcuaccgccguggcucagggcgccgcggccgcucuggccgaugugugccacgacaugagccgguccggccgcgaugucuuuagauaccggcagcgcaacagcucuauggacgaggagaucgaaaauccuuauugguccguuagagcucucgugcaacaguacgaggggcagcagcggagccccucugaauccagcuguucuucccugacaagcccuuccccgauccauucugccaagagcgaguccauuaucacccaaagcgaggaaaaagccgauuucgugauuauccccgcugagggaauugaaaaccgcacagagggcaccgacucuccucuguccagagauuggcggcccgggagcccuggaacauaucucgaaaccucuugggaggagcagcugcuugaacagcaggaguaccuggaaaaggagauggaagaggcgaagaaaaugaucagcggccuccaagcccugcuucugaaugggucccuccccgaggacgaacaggagagaccgcuggcucugugcgaaccuggagucaaccccgaggaacagcucauuaucauccagucucgccuggaccaaagcauggaggagaaucaggaucuuaagaaagaacugcucaaguguaaacaggaggcccggaaccugcagggcauuaaggacgcccuucaacagagacugacgcagcaagauaccuccgugcuccagcugaaacaggaacugcuccgcgcuaauauggacaaggaugagcugcacaaccagaacguugaccuucaacggaagcuggaugagagaaaucgccuccugggcgaauauaaaaaggagcuggggcagaaagaccggcuucuccagcagcaccaagccaagcuggaagaggcgcugagaaaacucagcgaugugucuuaccaucaggucgaccuggaacgcgagcuugagcacaaggaugugcugcucgcucauugcaugaagcgggaagccgacgaggccacaaacuacaauucccacaacagccagucuaauggauuucugcugccuaccgcuggcaaaggggccacauccguuagcaacagaggaaccuccgaccuucagcucgugcgcgaugcucugcggucucugagaaauagcuucuccggccacgacccccaacaucacacgaucgauucucucgaacaggggauuagcucccugauggagcggcuucaugucauggaaacacagaagaaacaagagcgcaaggugagagucaaaagcccccggacccaggugggaucugaguauagagaauccuggccuccgaacagcaagcugccccacucucaguccagcccuacaguuucuagcaccuguaccaaggugcucuacuuuacagaccgcucccugacgcccuucauggucaauaucccuaaacggcuggaggaagugacccuuaaggauuuuaaagccgcgauugacagagagggcaaccaucgcuaucacuucaaggcccucgaucccgaauuuggcacaguuaaagaggagaucuuccacgacgaugacgcuaucccggggugggaaggaaagauuguggccugggucgaggaagaucauggcgagaauuga

SEQ ID NO: 68371 - RNA, 1545 nt, Artificial Sequence
  derived and/or modified sequence opt5 from DKC1__Homo_sapiens__NP_001354
auggccgacgcugaggugaucauucugcccaagaaacacaagaaaaagaaagaaagaaagagccucccugaggaagaugucgccgagauccagcaugcggaagaguuccugauuaagccggaguccaaaguugcuaaacuugacaccucucaauggccccugcuccugaagaacuuugauaaacuuaaugugcggacaacgcacuacaccccucuggccugcggcagcaacccccucaagcgcgaaaucggggacuauauuagaacaggauucaucaaucuggauaagccuuccaaccccucuagccaugagguggucgccuggauccggcgcauucugagaguggaaaagaccggccacuccgggacacucgacccuaaaguuaccggaugucugaucgugugcauugagcgggcuacacgccuugucaagucucagcagagcgccggcaaagaguacguggggaucguuagacugcauaaugcuauugaaggaggcacccagcucucccgggcccuggagacgcuuaccggcgcgcuguuucaacgcccgccccucaucgccgcugugaagagacagcugcggguccgcacaauuuaugaaagcaaaaugaucgaguacgauccugaaagacggcuggggaucuucugggugucuugugaggccggaaccuauauucgcacacucugcgugcaccugggccuucugcucggggucggaggccagaugcaggagcugagacggguuagauccggggugaugagcgaaaaggaccacauggugaccaugcaugauguccuugacgcucaauggcuguacgauaaccacaaagacgagucuuaucuccgccgggugguuuacccccuggaaaagcugcucacgucccauaagagacuggugaugaaagauagcgccgucaaugcgaucuguuacggagccaagauuaugcuuccuggcgugcugcgcuaugaggacggcaucgaaguuaaccaggagauuguggucaucacaaccaaaggggaggcuaucugcauggccauugcucucaugacaaccgccgugaucucuaccugugaccacggaauugucgccaagaucaaacgggugauuauggaaagagauacauacccccgcaaguggggccuggggccgaaggcuucccagaaaaagcugaugaucaaacagggacuucucgacaagcacggcaaaccuacggauagcacccccgcgacauggaagcaagaguauguugacuacuccgaaucugccaagaaagagguggucgcugaagugguuaaggccccucagguggucgccgaggcugccaaaaccgcgaagcggaaaagagagagcgaauccgagagcgaugaaacaccucccgcugcuccccagcugaucaagaaggagaaaaagaaaucuaagaaagacaagaaagccaaggccgggcuggaguccggagccgaaccgggcgauggcgacagcgauaccacgaagaaaaagaaaaagaaaaagaaggcuaaagagguggaacucgugucugaguga

SEQ ID NO: 68372 - RNA, 801 nt, Artificial Sequence
  derived and/or modified sequence opt5 from DKK1__Homo_sapiens__NP_036374
augauggcccugggcgcugccggggcgaccagaguguucgucgcuaugguugccgccgcucucggaggccacccccugcuuggggugagcgccacacugaacuccgugcucaauucuaacgcuaucaagaaucugccuccgccccuuggaggcgccgcggggcauccuggaagcgccgucuccgcugcccccggcauucuguacccuggcgggaacaaauaucagacgaucgacaauuaccaacccuauccuugcgcugaggaugaagaguguggaaccgacgaauacugcgccucuccgacacggggcggggaugcgggagugcagauuugucucgccugccgcaagagacggaaacgcuguaugagacacgcuaugugcugucccggcaacuauugcaagaaugggaucuguguuagcuccgaccagaaccauuuucggggagagauugaagagaccaucacagagucuuucggcaaugaucacagcacccuggacggcuacucccgcagaacaacccugagcucuaaaauguaucauacgaaggggcaggaaggauccgugugccuccggagcucugauugugccuccggccugugcugcgcucgccacuuuuggagcaagaucuguaaaccuguccuuaaggaggggcaagugugcaccaaacacagacggaagggaucucauggccuggaaauuuuccagcgcuguuacugcggggagggacucuccuguagaauccagaaagaccaccaucaggccagcaacuccucucggcugcacacaugccaacgccacuga

SEQ ID NO: 68373 - RNA, 780 nt, Artificial Sequence
  derived and/or modified sequence opt5 from DKK2__Homo_sapiens__NP_055236
auggccgcucugaugagaagcaaggacuccucuugcugucuccugcuucuggccgcggugcucauggucgagagcucccaaaucggcucuagccgggcuaaacugaacuccauuaagucuagccuugggggagaaacccccggccaagccgccaaucgcuccgcugggauguaccagggacuggccuucggcgggagcaaaaagggcaaaaaccucggacaggcuuauccuuguucuuccgauaaggagugcgaaguuggcagauacugccacagcccgcaucaggggucuuccgccuguauggugugccggcgcaagaaaaagagaugucaccgggacggaaugugcugucccagcacacgcugcaauaacggcaucuguauuccugugacggagucuauccugacaccccauauuccugcgcuggaugggaccagacaccgggaccgcaaucauggacacuauuccaaccacgaucucggcuggcaaaaucuggggagaccccauaccaaaaugagccacaucaagggacaugaaggcgacccuugccuucgguccucugauugcaucgagggcuuuuguugcgcccgccacuucuggacaaaaauuuguaagccgguccugcaccagggggaggugugcaccaagcagcggaaaaagggaagccauggccucgaaaucuuucagagaugugacugcgcuaaagggcuguccuguaagguuuggaaagaugccacauacagcucuaaggcucgccuucacgugugccagaaaauuuga

SEQ ID NO: 68374 - RNA, 1053 nt, Artificial Sequence
  derived and/or modified sequence opt5 from DKK3__Homo_sapiens__XP_006718241
augcagagacugggcgccacccuccugugccuucugcucgcugccgcggugcccacagcuccugccccggcccccacggcuaccagcgccccugucaagcccgggccugcucuguccuacccccaagaggaagccacacuuaacgagauguuccgggaaguugaggaacugauggaggacacccagcacaaacuccgcucugcgguggaggaaauggaggccgaagaggcugccgcuaaggccagcuccgaggugaaucuggcgaaccugccuccgucuuaucauaaugaaacaaacaccgauacaaaagucggaaauaacaccauccacgugcauagagagauucacaagaucacgaauaaccagaccggccagaugguuuuuagcgaaacagugauuaccuccgucggggacgaggaaggacggcgcucucaugaguguaucauugaugaggacugcggccccagcauguacugucaauucgccuccuuucaguauacaugccagccuuguagagggcagcggaugcucugcacccgcgauagcgaauguugcggagaccaacuguguguguggggccacugcacgaaaauggcuacaagaggcucuaaugggaccaucugugauaaccagcgggacugccagcccggacuuugcugugccuuccagcgcggccugcucuuuccuguuugcacaccccugccgguggagggggaacuuugucacgauccugcuuccagacugcucgaccugaucaccugggagcuggaacccgauggagcccucgaccggugcccuugugccagcggccugcuuugccaaccccauucucacucccuggucuacguguguaagcccaccuucguggggagccgcgaucaggacggagagauucuccugccuagagaggucccggacgaauaugagguuggcucuuuuauggaagaggugcggcaggaacuugaggaucuggagcgcucccucacagaagagauggcucugagagaacccgcggccgcugccgccgcucugcucggcggggaggagaucuga

SEQ ID NO: 68375 - RNA, 675 nt, Artificial Sequence
  derived and/or modified sequence opt5 from DKK4__Homo_sapiens__XP_011542791
augguggccgcuguccugcucggccugagcuggcuuugcucuccccugggggcccucguucuggacuucaacaauaucagauccagcgcggaucuucacggagcucggaagggcucccagugucugucugacaccgauugcaacacacgcaaauuuugucuccaaccuagagacgagaagccguucugcgccacgugucgggggcugcgcagacggugccagcgcgaugccauguguugccccggaacccugugugugaaugacgugugcacaaccauggaagaugcuacaccuauucucgagagacagcuggacgaacaggauggcacccaugccgaggggacaaccggacaccccguccaagaaaaccagccuaaacggaagcccagcaucaaaaagucccagggccgcaagggccaggagggggagucuugucuuagaacguuugacugcggaccuggccugugcugugcucggcauuucuggaccaaaauuugcaagccggugcuccuggaagggcaaguuuguagccgcagaggacacaaagauacagcccaggcgcccgagaucuuucagcggugcgacuguggcccugggcuucugugccgcucccagcucaccagcaauagacaacaugcccggcugagagugugucagaagauugaaaaacuguga

SEQ ID NO: 68376 - RNA, 636 nt, Artificial Sequence
  derived and/or modified sequence opt5 from DKKL1__Homo_sapiens__NP_001184230
augggcgaggccucucccccugcuccggccagacggcaucugcucgugcugcuucugcuccuguccacccuugucauccccucugcggcugccccuauucacgacgccgaugcucaggaaagcucccuggggcucacaggacugcaaucucugcuccagggcuucagccgccuguuucuuaaggggaaccugcucagaggaaucgacucccuguucucugcccccauggauuuucggggccuuccugggaauuaccacaaagaggaaaaccaggagcaucagcugggaaauaacacgcucagcucccaucugcaaauugacaagguuccccgcauggaagagaaagaggcucuggugccuauccagaaggccaccgauagcuuccacacagaacuccacccgagaguggcguuuuggauuaucaaacugccccggcgcagaucucaccaggacgcccuugagggcggccauuggcuguccgaaaagcggcaccgccuccaggcuaucagagaugggcugcggaagggaacccauaaagacguccuugaggagggcacagaaagcagcucccacagccgccugucuccuagaaagacccaccuccuguauauucugcggcccucccgccaacucuga

SEQ ID NO: 68377 - RNA, 1944 nt, Artificial Sequence
  derived and/or modified sequence opt5 from DLAT__Homo_sapiens__NP_001922
auguggagagugugcgcccggcgcgcucagaacgucgcccccugggcgggccuggaggcuagauggaccgcccuccaagaaguuccugggacaccgcgggugacgagccgcuccggacccgccccugcuagacgcaauucugugaccacaggcuacgggggaguccgggcccuguguggcuggacccccagcuccggggcuacaccuagaaaccggcuucugcuccagcugcuuggaucucccggccgcagauauuacagccugccuccgcaccagaaggugccccucccuucccugucucccaccaugcaggccggcacaaucgcgcggugggagaaaaaggaaggggacaaaauuaaugagggagaucugaucgccgaaguugagaccgacaaggcuacggugggcuucgagagccucgaagagugcuauauggccaaaauucuggucgcugaagggacccgcgaugugccuaucggagccauuaucuguaucacaguuggcaagcccgaggacauugaggcguuuaagaacuacacccuugauuccagcgccgcuccgacaccucaagccgcucccgccccuacccccgccgcuacggcgucucccccuacaccguccgcccaggcucccgggagcucuuauccuccccauaugcaagugcugcucccugcccugucccccaccaugacaaugggaaccguccagagaugggagaaaaaggugggcgaaaaacuuagcgaaggcgaccugcucgccgagaucgaaaccgauaaggcuacaauuggguucgaggugcaggaggaaggauaccuggccaaaauccuggucccggagggcacgcgggacguuccucucgggacaccccugugcauuaucguggaaaaggaggcggauauuucugcuuuugccgacuaucgcccuaccgaagugaccgaucuuaagccccaggucccucccccgacaccuccucccguggccgcuguucccccgacgccccagccucuggcccccaccccuuccgcucccuguccugccacacccgcgggaccgaaaggcagaguguucgucagcccucucgccaagaaacuggcuguggagaaggggaucgaccuuacccagguuaaaggaaccggccccgauggccggaucacaaagaaagacauugacuccuuugugccuucuaaggucgcccccgcuccggccgcgguggucccucccaccgggccuggaauggcccccgugcccacaggcguuuucacggauaucccuauuagcaauaucagacgcgugauugcucaacggcugaugcaguccaagcagaccaucccgcacuacuaccucagcaucgacgucaacaugggggaggugcugcugguuagaaaagaacucaauaagauucuggagggacgcucuaaaaucuccgugaacgauuuuauuaucaaggccagcgcucuugccugccugaaaguccccgaagccaauucuagcuggauggacacagugauucggcaaaaccaugugguugaugucuccguggcugugucuaccccugcgggccucaucacacccaucgucuucaaugcccacauuaaggggguggagaccaucgcuaacgacguugugagccuggccacgaaggccagagaaggcaaacuucagccucaugaguuucagggaggcaccuucacaauuuccaaucuggggauguuuggaaucaagaacuucagcgcuauuaucaaucccccucaggccuguauucucgcgaucggcgcuucugaggauaaacuggucccggccgacaacgaaaagggguuugauguggccuccaugaugagcguuacccugucuugcgaccaccgcguggucgauggagcugugggcgcccaauggcucgcggaguuccggaaauaucuggaaaagcccaucacaaugcuucuguga

SEQ ID NO: 68378 - RNA, 3276 nt, Artificial Sequence
  derived and/or modified sequence opt5 from DLC1__Homo_sapiens__NP_006085
augugcagaaagaaacccgacaccaugauccugacacagauugaggccaaggaagccugugauuggcuccgggccacgggcuucccucaguacgcgcagcuguaugaggacuuucuuuucccgaucgauauuagccuggugaaacgcgaacacgacuuucucgauagagacgcuaucgaggcccugugccggcgccuuaacacccugaauaagugugccgucaugaaacucgaaauuucuccccauagaaagcgguccgaugacagcgaugaggacgagccuugcgcuaucuccgggaaguggacauuccagcgcgauucuaaaagauggagccggcuggaagaguuugacguuuucucccccaagcaggaucuggugccuggaucucccgacgacagccacccuaaagauggcccgucccccgggggaacccucauggaccugagcgaacgccaagaggugucuuccgucagaagccuuucuuccacaggcagccugccuucucaugcucccccuuccgaggaugcugccacaccccggaccaacagcgugaucuccguuuguucuagcuccaaucucgcggggaacgacgauagcuuuggaucucugccguccccuaaggaacuuagcucuuucagcuuuuccaugaaaggccacgagaagaccgccaagucuaaaacgcgcagccugcucaagagaauggaaucccugaaacucaagagcucucaucacuccaaacacaaggcucccagcaaacugggccugauuaucucugggccuauucuucaggagggaauggacgaagagaagcugaagcagcucaauugcguggagaucuccgcccugaacggcaaucggauuaacguccccauggugcgcaaaagaagcguuuccaauucuacccagacaagcuccucuagcucccaaagcgaaaccucuuccgcugugagcacacccucuccugucacccggacgagaucccuuagcgccuguaacaagcgcguggggauguaccuggagggauucgauccguuuaaucagucuacauucaacaauguggucgaacagaacuuuaaaaaucgggagagcuaucccgaagacaccguuuucuacaucccugaggaucauaagcccggcacauucccuaaagcgcucaccaacggguccuuuagccccucuggaaacaauggcuccgugaacuggagaaccggcagcuuccacgggccgggacauauuucccugcgccgggaaaauucuagcgacuccccuaaggaacugaagagacgcaacucuagcuccucuaugagcucccggcucagcaucuaugauaaugugcccggcucuauccuguacuccagcucuggggaccuugccgaccuggagaacgaagauauuuuuccugagcucgacgauauccuguaucacgucaaaggaaugcagagaauugugaaucaaugguccgaaaaguucagcgacgagggcgauucugacuccgcucuugauagcguuucccccugcccuagcucucccaaacagauccaccuggacguggauaacgaccgcacaacgccgagcgaucucgacuccaccggaaauucucugaacgagccugaggagcccagcgaaauucccgagcggagagauuccggggucggcgccucucugacacgcagcaaucggcauagacuccgguggcacuccuuucagucuagccaucgcccuucccugaacagcgugucucuucaaaucaauugucaguccguugcucagaugaaccugcuccagaaguacagccugcugaaacuuaccgcccuccuggagaaguacacaccgucuaauaagcacggcuucuccugggccgugcccaaauuuaugaagagaaucaaagucccugacuauaaggaccggagcguguucggggucccccugaccgugaacguucaaagaacgggacagccucucccccaguccauucagcaagcuaugcgcuaccugcggaaccauugccuugaucaggugggccuguuuagaaaaucuggggucaagagccgcauccaggcgcucagacagaugaaugaaggagccauugacugugugaacuaugagggccaauccgcuuacgauguugccgacaugcugaagcaguauuuccgggaucugccugaaccccuuaugacaaauaaacucagcgagaccuuucugcagaucuaccaguaugugccgaaggaccaacgccugcaggccauuaaagcugccaucaugcuccugccugaugaaaacagagagguccuucagacccugcucuacuuccugucugacgugacagcggcugugaaggagaaucaaaugacccccacaaaccuggccguuugccuugccccuucccucuuucaccugaauacgcugaaacgggaaaacagcucuccccgcgucaugcagagaaagcagagccucgggaaaccggaucagaaggaccugaaugagaaccuugcugccacccaaggccuggcucacaugaucgccgaaugcaagaaacucuuccaggugccugaggaaaugucccggugucgcaauucuuacacagagcaggagcugaagccccugacccuugaagcgcucggacaucugggcaacgaugacagcgccgauuaucagcacuuccugcaagacugcguggacgggcucuuuaaagaggucaaggaaaaauucaagggauggguguccuacucuacaagcgagcaggcugaacuguccuauaagaaaguuagcgagggcccuccccuuagacuguggcggucugugauugagguccccgccgugccugaagagauccucaagcgccugcugaaagaacagcaucuuugggauguugaccugcucgauuccaaggugauugagauccuggacagccagaccgagauuuaccaauauguccaaaauuccauggcuccgcaccccgccagagauuacgugguucuccggacguggagaaccaaccugccuaaaggggcgugugcccuucugcucacaucuguggaccacgaucgcgcucccgucgugggagugcgggucaauguucugcugagcagauaucuuaucgaaccuugcggccccgggaaguccaagcugaccuacaugugucgcguggaccuccggggccauaugccugagugguacacaaaaucuuuuggacaccugugcgccgcugaaguggucaagauuagagauagcuucuccaaccagaacaccgagacgaaagacacaaagagccgcuga

SEQ ID NO: 68379 - RNA, 1530 nt, Artificial Sequence
  derived and/or modified sequence opt5 from DLD__Homo_sapiens__NP_000099
augcagagcugguccagaguguacugcucucuggccaagcggggccacuucaaccgcaucagccaugggcuccagggacuguccgcugucccccuuagaaccuaugccgaccagccuauugaugcggacguuacagugaucggcucugggccgggaggcuacguggcugccauuaaagccgcucagcugggguuuaagacggucuguaucgagaaaaaugaaacccucggaggcacaugccugaacgugggcuguauucccagcaaggcccuucugaauaacucccacuauuaccauauggcucacgggaaagauuucgccucucggggaaucgagaugagcgaaguucgccucaaucuggacaagaugauggagcagaaguccaccgcggugaaagcccugacaggcgggaucgcucaucucuuuaagcaaaacaaagucgugcacguuaauggauauggcaagauuaccgggaaaaaccaggugacagccaccaaggcugauggaggcacgcaggucaucgacaccaagaauauucugaucgccacaggcagcgaagugaccccuuuccccgggauuacaaucgaugaggacaccauugugucuuccacgggagcgcuuagccugaaaaaggucccugagaaaaugguugugaucggcgccggggugaucggagucgaacucggcucuguguggcagagacugggggcugauguuacagccguggaguuucuuggacacgucggcggcguggggauugacauggaaaucuccaagaacuuccaacggauucugcagaaacagggauuuaaguucaaacucaauaccaagguuacaggcgcuaccaagaaaagcgaugggaagaucgacgugucuauugaggccgccuccggaggcaaagcugaggucauuaccugcgaugugcugcuggucuguaucgggcgcagacccuuuacaaagaaccucggccuggaagaacuuggaaucgaacuggacccucggggccgcaucccggugaauacgagauuccagaccaaaauucccaacaucuacgcgauuggggacguuguggccggaccuaugcucgcucauaaggccgaggaugaaggcaucaucugcgucgaggggauggccggaggcgcugugcacauugacuauaauuguguucccagcgugaucuacacacauccugaggucgccuggguggggaaguccgaggagcaacugaaagaagagggcauugaauacaaggugggaaaauuucccuucgcggcuaacucucgggccaagaccaacgccgauacagacggcaugguuaaaauccuugggcaaaagagcaccgaucgcguccugggagcucacauucucggcccgggggccggagagauggugaaugaggcugcccuggcgcuggaauauggcgccuccugcgaggacaucgcuagagugugucacgcccauccuacgcucagcgaggcuuuucgggaagccaaccuggcggccucuuucgggaaguccauuaauuucuga

SEQ ID NO: 68380 - RNA, 5268 nt, Artificial Sequence
  derived and/or modified sequence opt5 from DLEC1__Homo_sapiens__NP_031361
auggaaacccgcagcuccaagacacggcgcucucuggccagcagaacgaacgaaugccagggcaccaugugggcucccacauccccuccggccgggucuagcucccccucucaaccuaccuggaaaagcucccucuacagcucucuggcguauuccgaggcuuuccacuacagcuucgccgcccggccccgcagacuuacacagcuggcucucgcccagcggccugaaccccagcugcuucgccugagaccuucuucccuccggacccaagacaucagccaucugcugacaggcguguuccgcaaucucuauucugcugaggucauuggcgaugaaguuuccgccagccugaucaaggcgagaggguccgagaacgagcggcacgaagaguuuguggaccagcuucagcagauucgcgaacuguacaagcaaagacucgaugaguucgagaugcuggaacggcauaucacccaggcccaggcucgcgccauugcugagaaugaaagagugaugucucaggccggaguccaagaccuugagagccuggugcggcucccgcccguuaaguccgugagcagaugguguaucgauucugaacugcugcgcaagcaccaucucaucuccccugaggacuauuacacggauaccguccccuuucacagcgcgccuaagggcauuucucugcccgggugcagcaaacuuacauucuccugugagaaacggucugugcagaagaaagaacugaacaagaaacucgaggacagcugcagaaagaagcuggccgaauuugaggaugaacuugaccacaccguugauucccugacauggaaucucaccccgaaagcuaaggagcgcacgcgggagccucugaaaaaggccagccagcccagaaacaaaaauuggaugaaccaucugcgcgugccucaacgggaacucgacagacugcuucuggcucgcauggagucucggaaucacuuccucaagaaccccagauucuuucccccuaauacacgcuauggaggcaaaucccuggucuuuccgcccaagaagccugcccccaucggcgaguuucagagcaccgagccugaacagucuugugccgauacacccguguuucuugcuaaaccgccuauuggguucuucaccgacuacgagaucggacccguguacgagauggucauugcgcugcagaacaccacaacgaccucccgguaucucagaguucugccucccagcacaccuuacuuugcccugggccucgggauguuccccggaaagggcgggaugguggcuccgggaaugaccugccaauauaucgugcaguuuuucccugacugucugggcgauuuugacgauuucauucuugucgaaacacaguccgcccauacccugcucaucccccugcaggcccggagacccccuccggugcugacgcuuucucccguucucgacugcggcuacugucugaucgggggagugaaaaugacaagauuuauuugcaagaaugucggcuucagcguggggcgguuuuguaucaugccuaaaaccuccuggcccccucugucuuucaaggcuauugccaccguuggauuuguggagcaacccccuuucggcauccuccccagcgucuuugaacuggcgccggggcacgcuauucuuguggagguccuguucuccccuaagagccucggaaaagccgagcagacauucaucaucaugugcgauaacugccagauuaaggaacuggugaccaucggcauuggccagcugaucgcccuugaccucauuuauaucucuggggagaaaucccaacccgauccuggagaacugacagaccugacggcucagcacuuuaucagauucgagcccgaaaaucuccgcagcaccgcccggaagcagcugauuaucagaaacgcuacacauguugagcuugccuuuuacuggcagauuaugaaaccgaaccugcaaccucucaugcccggcgagaccuucucuauggauuccaucaaguguuauccugacaaggaaacagcguuuagcauuaugccccgcaaaggggugcugucuccccacaccgaucaugaguucauccugagcuuuuccccucacgaacuuagagacuuccauagcguccuccagauggugcuggaggaaguuccggagcccgugucuuccgaggccgaaagccugggacacuccucuuacagcgucgacgaugugauugugcucgagaucgaaguuaagggcuccgucgagccuuuucaggugcugcuugaacccuacgcucugaucauuccuggggagaauuauaucggcauuaacgugaaaaaggccuucaaaauguggaauaacucuaagagccccauccgguaccucuggggaaagauuuccgacugccacaucaucgaggucgaaccuggcacgggggugauugagccgucugaaguuggagauuuugagcugaauuucaccggcggggugcccggaccuacaagccaagaccugcuuugugagaucgaagauucccccagcccugucgugcuccauauugaggcuguuuuuaaaggccccgcccugaucauuaacgugucugcgcugcaguucgggcuccugcgccuuggccagaaggccaccaauuccauccagaucagaaacgucagccaacugccggcuacauggcggaugaaagaaucuccugugucccuccaggagcgccccgaagacguuagccccuucgauauugagccuucuuccggacagcugcacagccugggcgagugcagaguggacaucacccuugaagcccugcauugucagcaccucgagacgguccuggaacucgagguggaaaauggggcuugguccuaucugcccguguacgccgagguccaaaagccucacguuuaucuucagagcucucagguggaggugcggaaccuguaccucggagucccgacaaaaaccacaauuacccugaucaauggcacccugcuucccacacaguuucauugggggaagcugcucggacaccaagccgaguucugcauggugacgguuagcccuaaacauggccugcucgggcccuccgaggaaugucagcugaaacuugagcugaccgcucacacacaggaagaacucacccaucuggcgcugccuugccacgugucuggcaugaagaaaccccuuguccugggaauuagcggcaagccgcaagggcuccagguggccaucacaaucuccaaagagucuagcgauuguuccaccgaacaguggccuggacaccccaaggagcugcgccucgacuuuggcucugcuguuccucugagaacgcgggugacacgccagcuuauucugaccaacagaagccccauccggaccagauucucccugaaauuugaauauuucgggagcccucaaaauucucucuccaagaagacaagccugcccaacaugccgccugcccuucugaaaaccguccgcaugcaggagcaucucgccaagcgggagcagcuggauuuuauggaaucuaugcucucccacggaaaaggcgcugccuucuuuccccauuucagccaggggaugcugggccccuaccaacagcuuugcauugacaucacaggaugugcgaauauguggggcgaguacugggauaaccugauuugcacggugggggaccugcucccugaaguuaucccggugcacauggcugccgucggaugccccauuuccucucugagaaccacaagcuauaccaucgaccaggcccagaaggagccugcuaugcgcuuuggcacacaaguguccgggggagauaccgugacgcggacccuuagacugaacaauagcucucccugugacauccgccucgauugggaaacauacgucccugaggacaaagaggaucggcugguugaacuccugguguucuauggacccccuuucccgcuuagagaccaggccggcaacgagcuggugugccccgauaccccugaagggggaugucugcucuggucccccggcccuagcucuagcuccgaguuuucucaugaaacagacagcuccgucgaggggucuagcuccgcgagcaaucgcguggcucagaagcugauuucuguuauccuucaggcccacgagggagugcccuccggccaccuguacugcauuagcccgaagcaagucgugguuccugccgggggauccucuaccaucuauauuagcuucacacccauggugcucucccccgaaauccugcauaaagucgaguguaccggcuacgcucucggcuuuaugucucuggauagcaagguggaacgggagaucccugggaaaagacaccggcuucaggacuucgccgucggaccccugaagcuggaucuccauuccuaugugcgcccugcucagcugagcguugaacuugacuacggcgggucuauggaguuucaaugccaggccuccgaucugauuccggagcagcccuguagcggagugcucucugaacuggucacgacacaccaccugaaacucaccaacaccacagagaucccucauuacuucagacuuauggugucccggcccuuuagcguuucucaggacggcgcgagccaagaccaccgcgccccugggcccggacagaagcaggaaugcgaggaggaaaccgcuuccgccgauaagcagcuggugcugcaagcucaggagaauaugcucgucaacgugucuuucagccugucccuugaacugcucagcuaucagaaacugccggccgaccagacgcugccuggcguggauauucaacaguccgccucuggcgagagagaaaugguuuuuacacagaaucuccuucuggaguacaccaaccaaacaacccaggucgugccccugcgggcuguggucgcggugccugagcuccagcugagcacauccuggguugacuucgggaccuguuuugugucucagcaaagaguccgcgaaguguaucuuaugaaucugagcggaugccgguccuacuggacgaugcucaugggccagcaggagcccgccaaggcugccguugccuucagagugucuccuaacagcgggcugcuggaagcucgcuccgccaaugcgcccccgaccagcaucgcucuccaggucuuuuucacagcccggucuuccgagcuuuaugaaagcaccauggugguugagggagugcugggcgagaaaucuuguacacugagacuccgcgggcaaggauccuacgaugaacgguauaugcugccucaucagcccuga

SEQ ID NO: 68381 - RNA, 483 nt, Artificial Sequence
  derived and/or modified sequence opt5 from DLEU7__Homo_sapiens__NP_945340
auggccagccccgcuccucugguggccuccaucucucaccagauggucgcgcuccaaacccugcagcuucugcagcaggaguggggcuggggagacgggccgguugcucccggcaacccuagagaucccgaccaugugagcacagccccugcccggcgcuccgggcccccuagagcucggccgggacccggccgcgaagagagagggggaggcgugggcacgcggucucgcagaaccgccgcucgggccaauagcccugaagaggaagucgugcgcggggcggagggaggcgccgagcuccugcccuucccuagagaucgggggcccugcacacuugcucaaauggccaugcgcuccgcucuggccagaguuguggacucuaccagcgaacucgucuccguggagcagacacugcugggaccgcuccagcaggaacggagcuuuccuauucaccugaagcugcaacuucucgcgaacgaguga

SEQ ID NO: 68382 - RNA, 2679 nt, Artificial Sequence
  derived and/or modified sequence opt5 from DLG1__Homo_sapiens__NP_001191315
augcccgugagaaagcaggacacccaacgggcccugcaccuccuggaggaauaccgcagcaaacuuucccagacagaggauagacagcugcggucuagcaucgaacgcgucauuaacaucuuccaguccaaucucuuucaagcucugauugacauccaggaguucuaugaaguuacgcuucuggauaacccuaagugcauugacagaucuaaaccgagcgagcccauccagccugugaauaccugggagaucuccucucuccccagcuccacagugaccagcgaaacacugccuucuucccugagccccucugucgagaaguaccgguaucaggaugaagacaccccuccgcaagagcauauuagcccccagaucacaaacgaggugauuggcccugaacucguucacguguccgagaaaaaucugucugaaaucgagaacguccauggguuugugucccacagccauauuucccccaucaaggccaauccucccccgguucuugugaacaccgauucucuggaaacgccuaccuacgucaauggaacagacgcggauuaugaguacgaggaaauuacccucgagcgcggcaacagcgggcugggauucuccaucgcuggcgggacagacaauccccacaucggagaugacagcucuauuuuuaucaccaagauuaucacgggcggcgccgccgcucaggaugggagacuucgggugaacgacuguauucugcgcgugaaugaagucgacguuagagaugugacacacuccaaagccguggaggcucucaaggaagccggaagcaucguccggcuguaugugaaacgcagaaagccuguuucugagaaaaucauggagauuaagcugaucaagggccccaaagggcucggauucagcauugcgggcggggugggaaaccagcauauccccggcgacaauuccauuuacgucaccaagaucaucgaaggcggggccgcucacaaagauggaaagcugcaaauuggcgacaaacuucuggccgugaacaacguuugccucgaggaagugacacaugaggaagcugucaccgcccugaagaauaccucugauuuuguguaccuuaaagucgcgaagccuacaagcauguauaugaacgacggguacgccccgcccgauaucaccaauuccagcucucagccuguggacaaccacguuucccccagcucuuuccugggacagacgccugcuucccccgcccgguauagcccgguguccaaggcuguccucggcgaugacgagauuacacgcgagccuagaaaagugguucugcaccgggggucuaccggacugggcuuuaauaucgugggcggggaagauggagagggcauuuucaucagcuuuauucucgccgggggacccgccgaccuguccggcgaacuuagaaagggggaccgcaucaucucugucaacagcguggaucugcgggcugcgucccaugagcaagccgcugccgcccucaaaaaugcuggccaggccgugacaauuguugcgcaguacagaccugaggaauauagccgcuucgaggcuaagauccacgaccugcgggaacagaugaugaacucuuccauuagcucuggauccggcagccuuagaaccucucaaaaacgcagccuguacguccgggcccucuuugauuaugacaagacgaaggauuccgggcugcccagccagggacugaauuucaaauucggcgacauccuccaugugauuaacgccucugaugacgagugguggcaggcuagacaggugacaccugauggggaauccgacgaggucggagugauccccagcaagcgccggguugagaaaaaggaaagagcccgccugaaaaccgugaaguuuaauuccaagacccgggauaaaggcucuuucaacgacaagagaaagaagaaucuuuuuagccggaaauucccguuuuacaagaacaaggaucaauccgagcaggaaacaucugacgcugaccagcacgucaccagcaaugccuccgauucugagagcuccuaccgcgggcaggaagaguaugugcugagcuacgagccuguuaaccaacaggaagugaacuauacaagacccgucaucauucucggccccaugaaagaccggaucaaugaugaccugauuucugaguucccugauaaguuuggauccugugugccgcauacgaccagacccaaacgcgacuacgaaguugauggccgggacuaucacuucgugacaagcagagagcagauggaaaaggauauccaggagcacaaauuuauugaggcggggcaauacaacaaucaucuguauggaaccucuguccaguccgugcgcgaaguggccgagaagggcaaacacugcauccuugacgucagcgggaacgcuaucaagagacuccagauugcccaacuguacccuaucucuauuuucaucaagcccaaauccauggaaaauauuauggagaugaacaagcggcugacagaggaacaggcucgcaaaaccuuugagagagccaugaagcucgaacaggaguucacggaacauuuuaccgcgaucguucagggagauacacuggaggacaucuacaaucaagugaaacagauuaucgaggaacagagcggcuccuauauuugggugccugccaaggagaaacuuuga

SEQ ID NO: 68383 - RNA, 2250 nt, Artificial Sequence
  derived and/or modified sequence opt5 from DLG2__Homo_sapiens__NP_001136172
augcagagacccagcgugucccgggccgagaacuaccaacugcucugggacaccaucgcuucucugaagcagugcgaacaggccaugcagcacgcguucauuccugucaauggcacagagaucgaauaugaguuugaagagauuacgcuugagcgcgggaacagcggacugggcuucuccaucgcugggggaaccgauaauccgcauauuggcgacgaucccgggaucuuuaucacaaaaauuaucccuggaggcgccgccgcugaagacggcagacuccggguuaacgauuguauucugcgcgugaaugagguggacgucucugaagugagccacuccaaggccguugaggcucuuaaagaggccgggucuaucgugagacuguacguccggcgcagacggcccauucucgaaaccgugguugagaucaagcuguucaaaggaccuaagggccugggguuuagcauugcgggaggcguggggaaccaacauauccccggagauaauuccaucuaugucacaaagauuaucgacggcggcgccgcucagaaagaugggcgccuccaggugggagacagacugcuuauggugaacaauuacagccuggaagaggucacccacgaagaggccguugcuauucucaagaacacaucugaggugguguaucugaaagucggcaagccuaccacgaucuacaugaccgauccguaugggcccccugacauuacacauuccuacucucccccuauggaaaaucaccuucugagcggaaacaauggcacccucgaguacaaaacaucccugcccccgaucagcccugggcgguauucucccaucccuaagcacaugcugguggaugacgacuacaccucccauagccagcacuccacggccacacgccaacccucuaugacccuccagagagcgguuagccuggaaggagagccccggaaggugguccuucauaaaggcuccacaggccugggguucaacauugugggaggcgaagauggggagggaaucuuuguuagcuucauucucgccggcgggccugcugaccugucuggcgagcuucagcgcggagaucagauccuguccgugaauggcauugaccucagaggggccagccacgaacaagcugccgccgcucugaagggagcgggccagaccgucaccaucaucgcccaguaucaaccggaggauuacgcucgguuugaagccaaaauucacgaccugagagagcagaugaugaaccauucuaugagcuccgggucuggaagccuccgcacaaaccagaagcggucccuguaugugagagccauguucgauuacgacaaaagcaaggauucuggccuucccucccaggggcugagcuuuaaauauggcgacauccuccacgucauuaaugcuucugaugacgaaugguggcaagcccgccgggugaugcuggagggagacuccgaggaaaugggcguuaucccuagcaagagacgcguggagcggaaggaaagagcgcgccuuaaaacggucaaguucaacgcuaaacccggggugauugauuccaagggagacaucccuggccugggggaugacggauacggcaccaaaacacuccgggggcaggaggaucugauucugucuuacgagcccguuaccagacaggaaaucaauuauacacgcccggugaucauucucggcccuaugaaggaccggaucaacgaugaccugauuagcgaguuucccgauaaguucggauccugcgucccucauaccacgagacccaaacgggacuacgaaguggauggccgcgacuaucacuucgugaucucuagagagcagauggaaaaggauauucaagagcauaaauuuaucgaggccgggcaguacaaugacaaccuuuauggaacaagcguucaguccguccgguucguggccgaaagaggcaagcacuguauccuggacgugagcgggaaugcuauuaaacgccuccaggucgcccaacuguacccuaucgcuauuuuuaucaagccccggucucuggagccgcuuauggaaaugaacaagagacucaccgaggaacaggccaaaaagaccuaugaucgcgcgauuaaacuggagcaggaguucggagaauacuuuacagccaucgugcagggcgacacccuggaggauaucuacaaucaaugcaagcucguuauugaggaacaguccgggccuuucaucuggauucccagcaaagaaaagcuguga

SEQ ID NO: 68384 - RNA, 1101 nt, Artificial Sequence
  derived and/or modified sequence opt5 from DLG3__Homo_sapiens__NP_001159750
augaugaacagcuccaugucuagcggcuccgggucucugagaaccagcgagaagcggucccucuacgugcgcgcccuguucgacuaugauagaacacgggacucuugccuucccagccagggacuguccuuuagcuacggcgauauccuccacgucauuaaugcuucugacgaugaaugguggcaagcccgccugguuacgccucauggggaguccgaacagaucggagugauuccgagcaaaaagagaguggagaaaaaggaacgggcgcgccuuaaaaccgucaaguuccacgcuagaacaggcaugaucgagucuaaccgguccauuaagaccaaacgcaagaaaucuuuuagacugucucggaaguuccccuuuuauaaauccaaggagaauauggcccaggaaagcuccauccaggagcaaggggugacaucuaacaccagcgacuccgaaagcagcuccaagggacaggaggaugccauccucagcuacgagccuguuacacgccaggaaauucauuaugcuagacccgugaucauucugggcccuaugaaagaccgggucaaugaugaccugaucucugaguucccccacaaguuuggcagcugugugccucauaccacgcgcccgagacgggauaacgaaguugacgggcaggauuaccacuucguggucuccagagagcaaauggaaaaagacauucaggacaauaaguuuaucgaggccggacaguucaacgauaaucucuauggcaccucuauucagagcgugcgcgcuguggccgagcgggggaaacacugcauccuggacgucuccggaaacgcgaucaagagacuucaacaggcccagcuguaccccauugcuaucuuuauuaaaccuaagagcaucgaagcccucauggagaugaaucgccggcaaacauacgaacaggcuaacaagauuuaugauaaagccaugaagcuggagcaggaguucggcgaauacuuuaccgcgaucguucagggggacucucuugaggaaaucuauaauaaaauuaagcaaaucauugaggaucaguccggacauuacaucugggugcccagcccugaaaaacuguga

SEQ ID NO: 68385 - RNA, 2166 nt, Artificial Sequence
  derived and/or modified sequence opt5 from DLG4__Homo_sapiens__NP_001122299
auggacugccuguguaucgugaccacaaagaaauacagauaucaggaugaggacacgcccccucucgaacacagcccggcccaucugcccaaccaagcuaauuccccucccgucauuguuaacaccgauacacuugaggccccuggcuacgugaaugggaccgaaggagagauggaauaugaggagaucacacuggaacggggcaacucugggcucggauucagcauugcgggcgggaccgacaauccccacaucggagaugacccuuccauuuuuaucacaaagaucauuccgggcggcgcugccgcccaggaugggcgccugagagugaacgacucuauccuuuucgucaaugagguggauguucgggaagugacccauagcgcugccgucgaggcucugaaagaggccggauccauugugcgccucuacguuaugagacggaagcccccugcggaaaaagugauggagaucaagcugauuaagggccccaaagggcugggauuuucuaucgccggcggggucggaaaccagcacauuccuggcgacaauagcaucuaugugacgaagaucauugaaggcggggcugcccauaaagauggacgccuccagaucggcgacaagauucuggcugugaacuccgucgggcuugaggauguuaugcacgaagacgccguggcggcccugaaaaauaccuacgacguggucuaucucaagguggcuaagcccagcaacgccuaccugucugauuccuacgcuccgccugacaucacaaccagcuauucucaacaccuugauaaugagauuucccauagcucuuaccugggaacagacuaucccaccgccaugacgccuacaucccccagacgguacagccccguugccaaagaucuccugggcgaggaagacaucccucgcgagccgagacggaucgugauucaccgcggguccaccggacugggcuucaacaucgucggcggggaagauggagagggcauuuuuaucucuuucauucucgcugggggacccgcggaccugagcggcgaacuuagaaagggggaucagauccuguccgugaauggcguugaccuccggaacgccagccaugagcaggcugccaucgcccugaaaaacgcuggacagacagugaccauuaucgcccaauauaagccugaggaauacucucgcuuugaggcgaaaauucacgaucuuagagaacagcugaugaacuccagccucggcucugggaccgcuagccugcgguccaaucccaagagaggauucuauauccgcgcccuguuugacuacgacaaaacaaaggauugcggcuuccucucucaggcccugagcuuucgguucggggacguccuucacgugauugaugcuuccgacgaggaaugguggcaggccagacgcguccauagcgauucugagacggacgauaucggauuuauuccuuccaagcggagaguggagcgccgggaauggagcagacugaaagcuaaggacugggggucuuccagcggcucccaaggccgcgaggauucuguucucagcuacgaaaccgugacacagauggagguccacuaugcccggcccaucaucauucugggaccgaccaaagacagagcgaaugaugaccuucuguccgaguucccugauaaguucggcucuugugugccccauacaacccgcccuaaacgggaauacgagaucgacgggagagacuaucacuuuguuagcucccgggaaaagauggagaaggauauucaggcccauaaauucaucgaagcuggacaauacaacagccaccucuauggcacgucugugcaguccguccgcgagguggccgagcaggggaagcacugcauucuggacgugagcgcuaaugccguuagacggcugcaggcggcccaucuccaccccaucgcuaucuuuauuagaccucgcucucuggaaaacguccuugagaucaauaaacggauuacagaggaacaagccagaaaggcuuucgaucgcgccaccaaacuggaacaggaguuuaccgaguguuucuccgccaucguggaaggagacagcuuugaggaaauuuaccauaaggugaagagagucaucgaggaucucucuggccccuauaucugggugccggcucgggaacgccuguga

SEQ ID NO: 68386 - RNA, 5760 nt, Artificial Sequence
  derived and/or modified sequence opt5 from DLG5__Homo_sapiens__NP_004738
auggaaccccagcggcgggaacugcucgcccaaugccagcagagccuggcucaggccaugaccgaaguggaagcgguccuuggccugcucgaagcugccggggcccuguccccuggagaacgcagacaacuugacgaggaggcuggcggggccaaggcugaacugcuccugaaacugcuccuggccaaggagcgggaucacuuccaggaccuucgcgcggcccuggagaagacccagccgcaucuccugcccauccuuuaccugaacggaguugugggcccuccccagccugcugagggggccggaucuacguauagcgugcucuccaccaugcccucugauagcgaguccucuagcucccugagcucugucggcaccaccggcaaggcuccuuccccgcccccucugcucacagaccaacaggugaaugaaaaaguugagaaccugagcauucagcuuagacugaugacccgggaacgcaaugagcucagaaagcggcuggccuuugcgacccacgggaccgccuucgauaagcgccccuaccauagacuuaacccugacuaugaacggcugaaaauccagugugugcgcgcuaugucugaucuccaaucccugcagaaucagcacacgaacgcccugaagagaugcgaggaggucgcuaaagaaaccgacuuuuaccauacacuccacagccggcugcuuucugaucaaacccgccugaaggacgauguggacaugcucagacgggagaauggacagcugcuuagagaacgcaaccugcuccagcaguccugggaggauaugaaacggcugcacgaagaggaccaaaaggagauuggcgaccugagagcccagcagcagcaaguucucaagcauaaugggagcuccgaaauccugaacaaacuuuaugauacagccauggacaagcuggagguggucaaaaaggauuacgacgcucuccgcaaacgguauucugaaaagguggcgauucacaaugccgaucugagcagacuggagcagcuuggagaagagaaccagcgccuccugaaacagaccgagaugcugacgcaacagcgggacacagcuauccagcuccagcaucaaugugcccugucccuuagacgcuucgaagccauccaccacgagcugaauaaggcuaccgcccagaacaaggaucuccagugggaaauggagcugcugcaaagcgagcuuacagaacuccggaccacccaggugaaaacagcgaaggagucugaaaaauacagagaggaacgcgacgcugucuacuccgaguauaagcugauuaugagcgagcgggaucagguuaucucugaacuggacaaacuccagacggagguggaacuggccgagagcaaacuuaaguccucuaccagcgagaaaaaggccgcuaaugaggagauggaagcccugagacaaauuaaagauacagugaccauggacgcuggccgggccaacaaggaggucgaaauccuccgcaaacagugcaaggcgcugugucaggagcugaaggaagcccuucaggaggcugacguggccaaaugcagacgggauugggcuuuucaagagagagacaagauuguugccgaacgcgauuccauccggacacucugugacaaccugagacgcgagagagaucgggcggugagcgaacuggccgaggcucuccgcucucuggacgauaccagaaaacagaagaaugacgucucccgggagcuuaaagaacugaaggagcagauggaaagccagcucgagaaggaagcccgcuucagacaacugauggcucauucuucccacgauagcgccauugacacggauuccauggagugggagacagaagugguugaguuugaacgggagaccgaagacaucgaucugaaagcccuuggguucgacauggcugagggagugaacgagcccugcuuuccgggcgacuguggcaucuucgucaccaagguggauaaagggucuauugcggacggacgccucagagucaaugauuggcugcugcggaucaacgacguggaucucauuaauaaggacaaaaagcaggccaucaaagcucugcuuaacggcgaaggggccauuaauaugguugugcgcagaagaaagagccugggaggcaaggucgugacaccucuccauaucaaccuguccgggcagaaagauucuggaaucagccuggagaauggcguuuacgccgcugccgugcuucccggcuccccugcggcuaaggaagggagccuggccgucggagaccggauuguggccaucaacggcauugcucucgauaauaaaucucugaacgagugcgaaucccuccugcgcagcugucaagacucucuuacccugucccuccugaagguguuuccccagagcucuagcugguccgggcagaauaucuucgagaacauuaaagauagcgacaagaugcugucuuuucgggcccacggacccgagguucaggcgcauaauaagagaaaccuuauccaacacaacaauuccacacagacggauaucuucuauaccgaccgccuggaagaccggaaagagccuggcccgcccgggggcagcuccucuuuccuccacaagccuuuucccggaggcccucugcaggucugcccccaggcuugcccgagcgccuccgaaagaucucucagcuccuuccgcucugaugccagcggggaccggggauuuggccugguggaugugagagggcgccggccucuucugcccuucgagacagaggucggaccuuguggcgugggggaggcuucccucgacaaagccgauagcgagggcucuaacuccggaggcaccuggcccaaggcuaugcugagcucuacagccguuccugaaaaacuguccguguacaagaagcccaaacaaagaaagagcauuuuugacccgaauaccuucaaacggccucagacgccgcccaagaucgauuaucuucugccugggccgggacccgcgcauucuccucagcccuccaaacgcgccggcccucucacacccccuaagcccccgagacggagcgacuccauuaaguuucagcaccgccuggagacaagcucugaaagcgaggcuacccucgucggguccucuccuagcacaucucccccuagcgcccugcccccggauguggacccuggagagcccaugcaugcuagcccucccagaaaagcccggguuagaaucgccuccucuuacuaucccgaaggcgauggggacagcucccaccuuccugcuaagaaaagcugcgacgaggaucugaccucucaaaagguggacgaacugggccagaaacgccggagaccgaaguccgcgcccagcuuccgcccuaaacucgcccccgucgugauuccugcucaguuucuggaggaacagaaguguguucccgccucuggagagcuuuccccugagcugcaagaaugggccccguacagccccggccacuccucucggcauagcaacccuccccucuacccuuccagacccagcguggggacggucccgcgcucucugacaccuuccaccacagugagcucuauccuccggaaucccauuuauaccgugagaagccaccgcgucggacccugcuccucuccucccgcugccagagaugcgggcccucaggggcugcauccgagcguucagcaccaaggacggcuuucccuggaccugucucaucgcaccuguagcgauuacuccgagaugagagcuacacacggcagcaacucucuccccuccagcgcccggcugggguccucuagcaaucuucaguucaaggccgaacgcaucaaaaucccuuccacgcccagauauccucggucuguggugggcagcgagagaggauccgucagccacucugaaugcuccacaccuccccagagcccccugaacauugacacacucucuuccuguagccagucucaaaccagcgcuuccacacugccccgcaucgccgugaauccugcgucucucggcgagcggagaaaggaucgccccuacguugaggaaccucggcaugugaaaguccagaaggggagcgagccccugggaauuuccaucgugagcggcgaaaaagggggaauuuauguuuccaaggugaccgucggcucuaucgcucaccaggccggccuugaguacggggaccagcugcuggaguuuaacggaaucaaucucagaagcgccacggaacaacaggcucggcugauuaucggccagcagugcgauacaauuaccauccuugcccaauauaacccgcaugugcaccagcuguccucucauagccgcuccucuagccaccucgacccugcugggacccacuccacacugcagggaagcggcaccacaacgcccgagcaucccucuguuauugauccucucauggaacaagacgaggggccguccacacccccugccaagcaguccucuuccagaaucgcgggagaugccaauaaaaagacacuggaaccccggguggucuucaucaaaaagagccagcuugagcugggcgugcaccuguguggcgggaaccuccauggaguguuugucgcugagguugaagacgacucuccugccaaaggccccgaugggcuggugccuggagaccuuauucuggaguacggcucccucgaugugcgcaauaagaccgucgaagagguguacguugaaaugcugaagccgagagacggggugcggcugaaaguccaguaucgccccgaggaguucacaaaggcuaaaggacucccuggcgauagcuucuacaucagagcccuuuaugaccggcuggccgauguggaacaagagcuguccuuuaagaaagacgauauucucuacguugacgauacccugccccagggcacguucgggagcuggauggcuuggcagcuugacgaaaacgcgcagaagauccaacgcggacagauuccuucuaaguaugugauggaucaggaguuuagcagacggcuguccaugucugaagucaaagacgacaacagcgccaccaagacacucuccgcugccgccagacgcucuuucuuucggagaaaacacaagcacaaacgcagcggcuccaaggaugggaaggaccugcuggcucucgaugccuucucuagcgacuccaucccccuuuuugaggauagcgugucucuggcguaccagcggguccaaaaaguggacugcaccgcucugagaccgguucucauccugggaccucuucuggauguggucaaggagaugcucgugaaugaagcccccggcaaauucugucgcugcccccuggagguuaugaaggccucccagcaggcuauugaaagaggggugaaagacugccuguuugucgauuauaagagacgcagcggacauuucgacgugacaaccguggccucuaucaaagagauuacagagaagaaccggcacugucuccuugauaucgcgccucaugccauugaaagacugcaccauaugcacaucuaccccauuguuaucuuuauccacuacaaguccgcuaaacauauuaaggagcagcgcgacccuaucuaucugcgggacaaagucacccaaagacacagcaaggaacaguucgaggccgcucagaaacucgaacaagaguacucccgcuauuuuacgggcgugauucagggcggggcccugucuagcaucugcacacagauucuugcuauggugaaucaggagcaaaacaagguccuguggaucccggccuguccccucuga

SEQ ID NO: 68387 - RNA, 2028 nt, Artificial Sequence
  derived and/or modified sequence opt5 from DLGAP1__Homo_sapiens__NP_001003809
augaaccugaucuuccacaaggacauucucuuuggcauccccgccaauaaagugccucaggaugaguggaccggguacacaccgagaggaaaggacgaugaaauucccugccggcgcaugagaagcggcuccuauaucaaagcuaugggggacgaggauucuggagacagcgauacguccccuaagcccucuccuaaagucgccgcgcggcgcgaaagcuaccugaaggcuacccaacccucccuuacagagcugaccacacucaagauuucuaacgaacauagcccuaaacugcagaucagaucccacagcuaucuucgggccguuucugagguguccaucaaucgcagccuggacucucucgauccggccggccugcugaccucccccaaguucagaagccggaacgagucuuacaugcgcgcuauguccacaauuagccagguguccgaaauggaggucaaugggcaguuugaaucugugugugagagcguuuucuccgagcucgaaagccaagccguggaggcucuggaccuuccuaugcccggaugcuuuagaaugcggucucauuccuauguccgcgccaucgaaaaaggcuguagccaggaugacgagugcgugucucugagaagcuccucuccuccccggaccacgaccacaguucgcaccauucagagcuccacagugagcucuuguaucaccacguacaagaaaacaccgccucccgucccucccagaaccacaaccaagcccuucauuuccaucaccgcgcagagcucuacagaauccgcccaagaugcuuauauggacggccaggggcagcggggagacauuaucagccaguccggccucucuaacagcacggagucccuggauucuaugaaggcccuuaccgcugccaucgaggcggccaaugcucaaauucacgggccugccagccagcauaugggaaacaauacagcuaccgugacaaccacgacaaccaucgccaccgugacaaccgaagaccgcaaaaaggaucacuuuaaaaagaacagaugccuguccauuggcauccaggucgacgaugccgaggaaccggacaaaacaggggagaauaaggcucccagcaaauuccaaucuguuggaguccagguggaagaggagaaguguuuucggagauucacgcgcuccaacagcgugaccacagcggugcaggccgaucucgacuuucacgauaaucuggaaaacucucuggaguccauugaagacaauagcugcccuggccccauggcucggcaguucucuagagaugccagcaccuccacaguuagcauccaaggcucugggaaccauuaccacgccugugcugccgacgacgauuuugacaccgauuucgacccuuccauccugcccccgccugaucccuggauugacagcaucacggaggauccucucgaagcggugcagcgcuccgucugccaucgggacggacacugguuccuuaagcugcuccaggcugagagagaucgcauggagggcuggugucagcaaauggaacgggaggaaagagagaacaaucugcccgaggacauucuugggaaaauccgcaccgccgugggaucugcccagcugcucauggcucagaaguuuuaccaguuccgggaacugugcgaggaaaaccugaauccuaacgcccaccccagaccgacaagccaagaucucgcuggcuuuugggacaugcugcagcuuuccauugagaauaucucuaugaaauucgaugaacugcaucagcucaaggccaacaauuggaaacagauggacccucuggacaagaaggagcggcgcgcgcccccucccguuccgaaaaagcccgccaaagggccugcuccccuuaucagagagcggagccuggaauccucucaaagacaggaggcccgcaagcggcucauggcugccaaaagagcggccagcgugcgccagaacuccgcuaccgaaagcgccgagucuauugaaaucuauauuccugaggcucaaacaagacuguga

SEQ ID NO: 68388 - RNA, 2928 nt, Artificial Sequence
  derived and/or modified sequence opt5 from DLGAP2__Homo_sapiens__XP_011533064
augaagggccugagcggguccagaacccagcccccucucugcucuggacacacauguggccuggccccgcccgaggacugcgaacaucuucaccaugggccugaugcucggcccccuuaccugcucagccccgccgacuccuguccuggaggccgccacagaugcucuccgcggagcuccguccauucugagugugucaugaugcccguugugcugggggaucacgugagcuccagcacguucccucgcaugcacuauucuucccauuacgacaccagagaugacugcgcggucgcucacgccggagccaaaaucaaccggauucccgcuaaucuucuggaucaauuugaaaagcagcucccucugcaucgcgacggcuuccacacacugcaguaucagagaaccagcgccgcugccgagcaacggucugaaucccccggccgcaucagacaccucgugcauagcguucagaaacuguuuacaaagucucacucccuugaggggagcuccaaaucuaacgcgaauggaaccaaggccgauggccgggcugacgaucaucaccaugcccaccacgcuaagcauagcaaacgcuccaagagcaaagagagaaagccggaagggaaaccucggcccggaaugucuuccugguggagcucugacgauaaccuggacagcgacuccacauaccgcaccccuucugugcucaauagacaccaucugggccccgucgcccacuguuaucccgaugcgcuucagagcccuuucggggaccugucccucaagacgagcaagucuaacaaugaugugaaaugcuccgccugugagggacuggcucugaccccggacgccaaguaccucaaacggagcucuugguccacacugaccguuagccaggcuaaggaagccuauagaaaauccucucuuaaccuggauaagccccuccugcaccaagacgccaaaccugcucugcgccccugccauuaccuucaggugccucaggaugaguggggcggcuaccccacagggggaaaggacgaggaaauuccgugucggagaaugcgcagcggcuccuauaucaaggcgaugggggaugaggaaucuggagagagcgacuccagcccuaaaaccucucccaaguccgccauucucccugaaccccugcugaaaagcaucggccagcggccucucggggagcaccaaacgcagacauaccugcaggcugccucugauguccccgugggacauucccuugacccggccgcuaauuauaacagcccuaaguuuagaucucgcaaucaaagcuacaugcgggccguguccacccugagccaggcgucuugcgucucccagguuagcgaggcugaaaucaacggccaguucgaguccgugugcgaaucuguguuuagcgaggucgaaucccaagccauggacgcccucgaucugcccggcuguuucagaacacgcucucacagcuaucuucgggcuauucaggccggguacucccaggacgaugagugcauccccaugaugaccccuucugacauuaccagcacaaucagauccacggcugccgugagcuauaccaauuacaaaaagacaccgcccccuguucccccucgcaccacaucuaagccccugauuuccgugaccgcgcagagcucuacggaguccacacaagaugccuaccaggacagccgggcucagagaaugucuccuuggccccaggauucccggggacucuauaacagcaccgacucccuggauagcaauaaagccaugaaccuggcucucgaaaccgccgcggcccaacgccaucugccggagucucagagcuccucugucagaacaagcgacaaggcuauccuuguguccaaagccgaggaacugcucaagucucgguguagcuccauuggcauccaggauucugaauuuccugagcaccagcccuacccuagaagcgacguugagaccgcuacagauuccgacacggaaagccgcgggcugcgggaguaucacucugugggaguccaaguggaagacgagaaaagacauggccgcuucaagagauccaacagcgucaccgccgccgugcaggcugaucuggagcuugaaggguuucccggccacaucacaaccgaggacaagggacuccaguucggcagcuccuuucaacggcauagcgaaccguccacaccuacccaguacucugcgguucgcacggugagaacccaggggcuguucagcuaucgggaggauuaccgcacacaggucgacaccuccacacugcccccucccgaucccuggcucgaaccugccauugacaccguggagacgggaagaaugagcccgugccggcgcgauggcucuugguuccugaaacuucugcacgcugagacaaagagaauggaagggugguguaaagagauggaacgggaggccgaagagaaugaccucuccgaggaaauccugggaaagauucgcagcgccguuggcucugcucaacugcuuaugagccagaaauuucagcaguucuauuggcucugccaacagaacauggaucccuccgccaugccuagacccaccucucaggaccuggcgggguacugggauaugcugcagcucagcaucgaggacguguccaugaaguuugaugaacugcaacggcuuagacugaaugacuggaagaugauggagucuccugaacgcaaagaggagcggaaggugcccccuccgauucccaaaaagccucccaaaggcaaguucccuaucacaagagaaaaaucucucgaccugcccgaucgccagcggcaggaggcuagacgccggcugauggccgccaagagagcugccuccuuucgccaaaacagcgcgucugaacgggcugacuccaucgagauuuacaucccggaggcccagaccagacuuuga

SEQ ID NO: 68389 - RNA, 2940 nt, Artificial Sequence
  derived and/or modified sequence opt5 from DLGAP3__Homo_sapiens__XP_011540181
augagaggcuaccacggggaccggggaagccauccccgcccugccagauucgcugaucagcaacacauggacgugggcccggccgcgcgggcucccuaucugcucgggucccgcgaggccuuuucuaccgaaccuagauucugcgccccucgggcuggacugggccauaucagcccugaggggccccuuucccugucugaaggaccuagcgucggcccggagggcgggcccgccggagcuggcguugggggaggcuccucuacauuuccucgcauguaccccgggcagggaccuuucgauacgugugaagacugcgugggccacccccagggcaagggggccccgagacucccucccacccugcuugaucaguuugagaaacaacugccugugcagcaggacggauuccauacacuccccuaucagcggggccccgcgggggccggaccuggcccggcucccgggaccggaacagccccugagccccgcagcgaauccccuagcagaauuagacaccugguccacucugugcaaaagcuguuugcuaaaucccauagccucgaggcccccggcaagcgcgauuacaacggcccgaaagcggaagggagaggaggcucugggggagacuccuauccuggccccgggagcggcggaccucacaccucucaucaccaccaucaccaucaccaucaccaccaucaccagucccggcauggcaagcgcagcaaguccaaagauagaaagggggacggacggcaccaggccaaaucuacaggcugguggagcuccgaugacaaucuggauagcgacucuggguuccuugcuggaggcagacccccuggggagcccggcggaccguuuugucuggagggcccugacggguccuaccgcgaucucagcuucaagggacggucuggcgggagcgaaggaagaugccuggccuguaccggcauguccaugucucuugacgggcagagcguuaaacgcuccgcuuggcacacgaugauggugagccaaggccgggauggauaucccggcgccgggcccggaaagggccugcucgggccugagaccaaggccaaagcuagaacauaccauuaccugcaggucccgcaggacgauuggggaggcuaucccaccgggggcaaggacggagaaaucccuugccgccggaugagaucuggcuccuacauuaaagcgaugggggaugaggaaagcggagacucugauggcucccccaagacaagcccuaaagccguggcucgccgguuuaccacgagacgcuccucuagcguugaccaagcccggaucaacuguugcgugcccccucggauucacccccgguccucuaucccgggguauagccgcucccugacaaccggacagcucagcgaugagcugaaucagcagcuugaggccgucuguggcucuguguucggcgaacuggagucccaagcuguggacgcccucgaccugccugggugcuuuagaaugcggagccauucuuaccuuagagcgauccaggcuggauguucccaggaugacgauugccugccccuccuggccacacccgccgcugucagcggccgccccgggucuagcuucaacuuccggaaggccccgccucccauuccucccggaucccaggcucccccuagaaucagcauuaccgcccaaucuuccaccgacagcgcgcacgaauccuuuacagccgcugagggcccggcccgcagaugcucuagcgcugaugggcuggacggacccgccaugggcgcgcggacgcucgaacuggccccuguucccccucgcgcuucccccaaaccuccgacccuuaucauuaagacaauccccggcagagaggagcugcggucucucgcccgccagagaaaguggcggccuagcauuggggugcaaguggaaaccaucuccgauucugacacagagaaucgcagcagacgggaguuccauuccaucggaguccagguggaagaagauaaacgcagagcucgguuuaagagaagcaacucuguuaccgccggcgugcaggccgaccuggagcuugaggggcuggcuggacucgcgacggucgccacagaagauaaagcucugcaguucggccgcuccuuucagcggcacgccagcgagccccagccugggcccagagccccgaccuauucuguguuccgcaccguucacacacaaggacagugggcuuaccgggaaggcuauccucugcccuacgagcccccugccaccgacggcucccccgggccugcgccggcucccacaccuggacccggcgccgggagacgcgauagcuggauugagcggggaucuagaucccucccugacagcggccgcgccucccccuguccgcgggacggggaaugguuuaucaagaugcugagagcugagguggaaaaacuugagcauuggugccagcaaauggaacgggaggccgaggauuacgaacugccugaggaaauucucgagaagauccgcagcgcggucggaucuacgcagcugcugcuuagccagaaggugcagcaauucuuuagacucugucagcaguccauggaccccaccgcuuucccuguccccacauuucaggaucuggccggcuucugggaccugcuccaacugucuauugaagaugugacccuuaaauuucuggagcuccagcagcugaaggccaauagcuggaaacugcuugagccuaaggaagagaaaaagguucccccgccuauccccaagaaaccccuccggggccgcggggugccugucaaggaaagaucccuggacucuguggaucggcagagacaagaggcucgcaaacggcugcucgccgcuaagagagccgcgagcuuccgccacuccucugccacagaaagcgcugacuccaucgagauuuauaucccggaggcccagacccggcuguga

SEQ ID NO: 68390 - RNA, 2529 nt, Artificial Sequence
  derived and/or modified sequence opt5 from DLGAP5__Homo_sapiens__NP_001139487
augagcuccucucacuucgccagcagacaccggaaggacaucuccaccgagaugauucgcacaaaaaucgcucacagaaagucucugagccagaaagaaaaccggcauaaggaguacgaacgcaauagacacuuuggccucaaagaugugaacauucccacgcuggaggggcggauccuugucgaacuggacgagaccucccaaggacucguuccugagaagacaaaugugaagccgcgcgccaugaaaaccauucugggcgaucagagaaagcagaugcuucagaaauauaaggaagagaaacaacugcagaagcucaaggaacagcgggagaaagcgaagcgcgggaucuucaaagugggaagauaccggcccgacaugccuugcuuucugcugucuaaccagaaugcugucaaggccgagcccaaaaaggccaucccuagcuccgugcgcauuacaagaagcaaagcuaaggaucaaauggaacagaccaagaucgacaacgagucugauguucgggccauucgccccggcccuagacagacauccgaaaagaaggugagcgacaaagagaagaaagucgugcagccgguuaugcccaccucucuccggaugacgagauccgcuacccaagccgcgaaacaggugccucgcacagucagcucuaccacagcccggaagcccgugaccagagcugccaaugaaaacgagccugaggggaaagugcccuccaagggacgcccggcuaaaaaugucgaaacgaagccugauaaaggcaucagcuguaagguugacuccgaggaaaacacacuuaauucucagaccaacgccacaagcggcaugaaucccgauggggugcuuuccaagauggagaaccugccugaaauuaauaccgcgaaaaucaagggaaagaacagcuucgcccccaaggacuuuauguuccaaccccucgauggccugaaaaccuaucaggugacaccuaugacgccgcggucugcuaacgccuuucuuacccccuccuacacauggaccccucugaagacagaggucgacgagagccaggcuaccaaggaaauucucgcccagaaaugcaagacguauucuacaaaaaccauccaacaggacagcaauaagcugcccuguccucuggggccccucaccguguggcaugaggaacacguucugaacaaaaaugaggccacaaccaagaaccuuaauggacugccgaucaaagaagugccuucccucgagagaaacgagggccgcauugcucagccccaccauggggucccuuacuuccggaauauccugcagucugaaacagagaagcugacgagccacugcuuugaaugggauagaaagcuggagcucgacauucccgaugacgcgaaagaucugauccgcaccgccgugggacaaacacggcugcucaugaaggagagauucaaacaguuugaaggccugguugacgauugugaguauaagcgcggcauuaaagaaaccacaugcaccgaccuugauggguucugggacaugguguccuuucagaucgaggaugucauccauaaguucaacaaucugauuaagcucgaagagagcggauggcaagugaacaauaacaugaaucacaacaugaauaaaaacgucuuccggaagaaagugguuucuggcaucgcuuccaagccuaaacaggacgacgccgggagaauugccgcucggaaccgccuggccgcgaucaagaaugcuaugagagagcggauuagacaggaagagugugccgaaacggccgugagcgucauccccaaggagguggauaaaaucguuuuugacgcuggauucuuucgcguggaaucuccggucaaacuuuucuccggccugagcguguccucugaggggccuagccagcggcucggaacccccaaauccgugaacaaggccguuucucagagcagaaaugagaugggcauuccccaacagacaaccuccccugaaaacgcuggcccgcagaauacaaaaagcgagcacgucaagaagacccuguuucugucuauccccgaaucccgcagcucuauugaggaugcccaaugcccugggcuccccgaccugaucgaagagaaccauguggugaauaaaacggaucuuaaggucgacugucuguccagcgagagaaugucucucccucugcuggcgggaggcguggccgaugacauuaacacaaauaaaaaggaagggaucagcgauguuguggagggaauggaacuuaacuccagcauuaccucucaggacguccucauguccagccccgagaaaaauacagcuucccagaacucuauccuggaggaaggcgagaccaagaucagccaguccgaacuguucgauaauaaaucucucaccacagagugccaucugcuugacagcgugggguccuguuacguugcccgggcuggccuggaagugcucggaucuagcgauccuacgaccuccgccagccgcgucgcgggcacaaccgccagaucuaagcugcaauga

SEQ ID NO: 68391 - RNA, 1152 nt, Artificial Sequence
  derived and/or modified sequence opt5 from DLK1__Homo_sapiens__NP_003827
augaccgccacagaggcucugcucagagugcugcuucugcuccuggccuucggccacagcacguacggggcggaaugcuuucccgcuuguaacccucagaauggauucugcgaggacgauaacgucugucggugccaaccgggcuggcaggggccccuuugugaccagugcguuaccuccccuggaugucugcauggccucugcggggaacccggacaguguaucugcacagauggcugggacggcgagcugugugaucgcgacgugagagccugcucuagcgccccuugcgcuaauaacgggaccugugugucccuggaugacggacucuaugaaugcucuugugcccccggcuacagcgggaaggauugccagaaaaaggacggaccuugugucauuaauggcuccccgugccagcacgggggaacauguguggaugacgagggccgggcuucucaugccagcugccugugucccccuggcuuuuccgggaacuucugcgagaucguugcgaauagcuguacccccaacccuugcgaaaaugauggagugugcacagacauuggcggggacuuucgcuguagaugccccgccggauucaucgauaaaaccuguucucggccggucacgaacugcgcuuccagcccuugucagaauggcgggaccugccuucagcacacacaagugucuuaugagugucugugcaagcccgaauuuaccggacucacauguguuaaaaagcgcgcccuguccccucaacaggugaccagacuucccagcggcuacggccuggcuuaucggcucacgcccgggguccaugagcugccugugcagcaaccggagcaccgcauucugaaggugucuaugaaagaacucaacaagaaaacaccccugcuuaccgagggacaggccaucugcuucacaauccugggcguccucaccucccugguugugcuugggaccgugggaauugucuuucugaauaagugugaaacaugggugagcaaccucagauacaaucacaugcugcggaaaaagaagaaccugcuccugcaguauaacuccggcgaggaccuugcgguuaauaucauuuucccugagaaaaucgauaugacgaccuuuucuaaggaagccggggacgaggaaauuuga

SEQ ID NO: 68392 - RNA, 2172 nt, Artificial Sequence
  derived and/or modified sequence opt5 from DLL1__Homo_sapiens__XP_011534060
augggcagcagaugcgcccuggcucucgccgugcuguccgcgcuucugugucaggucuggucuagcgggguuuucgagcucaagcugcaagaauuugugaacaaaaagggacuucugggcaaucggaacugcugucgcgggggagcugggcccccuccgugcgccuguagaaccuucuuucgggugugccucaaacacuaccaggccuccgucucucccgagccucccuguacauaugggagcgcugugacgccuguucugggaguggacuccuucucucugcccgauggcggcggggccgacagcgcuuuuuccaauccuauccgcuucccguuuggauucaccuggcccggcacauuuagccucauuaucgaagcccugcauaccgauucuccugacgaucuugcgacagagaaccccgaaagacugauuucccggcucgccacccagcgccaccugacagucggggaggaguggagccaggaccuucauucuuccggaagaaccgaucugaaguacagcuaucgguucgugugcgacgaacacuacuauggcgagggguguucuguguuuugccgcccuagagaugacgcuuucggacauuuuacguguggcgaacggggcgagaaaguuugcaaucccggguggaagggaccguacugcaccgagccuaucugucuccccggcugcgaugaacaacacggguucugugacaagccuggagagugcaaaugucgcgucggcuggcaggggagauauugcgaugaauguauucgguaccccggaugccugcacggcacaugucagcagcccuggcaaugcaacugucaggagggcuggggcggacuguucugcaaucaggaccucaacuacugcacccaucacaagccuuguaaaaauggcgccacaugcaccaacacggggcagggauccuauacauguagcugccgcccgggcuacaccggggcuacaugugaacugggcaucgacgagugcgaucccuccccuuguaagaauggaggcucuugcaccgaccuugagaacagcuauuccuguaccugucccccuggguuuuacggaaaaaucugcgaacugagcgccaugacaugcgcggauggccccugcuucaaugggggaagauguucugacuccccggauggcggguauagcugccgguguccugugggcuacucuggauuuaacugcgagaagaagauugacuauuguagcuccucucccugcagcaauggcgccaaauguguggaucucggggacgcuuaccugugcagaugucaagccggauucuccggccgccauugcgaugacaacgucgaugacugugcuagcucuccuugcgccaacgggggaacgugccgggacggcguuaaugauuuuuccuguaccugucccccuggguacacaggcagaaacugcagcgcccccgugucucgcugcgaacacgcuccgugucacaauggagcgaccugccaugagcggggccacagauaugugugugaaugcgcccgcggguacggaggcccuaacugucaguuccuucugcccgagcugcccccugggccggcugucguggaccucacagagaagcuggaaggacagggcgggcccuuuccuuggguugccgugugcgccggcgucauccucgugcugaugcuucugcucggaugugcugccguuguggucugcgugcggcugagacuucaaaaacaucggcccccugcggaucccugccggggcgagaccgaaacgaugaauaaccuggcuaauugucagagagagaaggacauuuccgucagcaucauuggggccacacagaucaaaaacaccaauaagaaagccgauuuccacggagaccauuccgcugauaagaacggcuuuaaggcccgcuauccugcuguggacuacaaucucguucaggaucugaaaggggacgauaccgccgugcgggacgcgcacucuaagagagauacaaaaugccaaccccagggaagcuccggcgaagagaagggcaccccgacaacgcugcgcgggggagaggccucugaacgcaaaagaccugacagcggcuguuccaccagcaaggacacaaaguaucagucugucuacgugauuuccgaggaaaaagaugagugcguuaucgcuaccgagguguga

SEQ ID NO: 68393 - RNA, 1857 nt, Artificial Sequence
  derived and/or modified sequence opt5 from DLL3__Homo_sapiens__NP_058637
auggugagccccagaauguccggccugcucucucagaccgucauccuggcccuuauuuuccugccucaaacacggccggcugggguuuuugagcuccagauccacagcuucggacccggcccugggcccggagccccucgcucccccugcucugcgagacugccuugucggcuguuuuuccgcgugugccuuaagccgggccucagcgaagaggcugccgaaucccccugugcccugggggcugcccugucugcuagaggaccuguguacacggagcagcccggcgccccugcgcccgaccucccgcugccugauggccuucugcagguccccuuucgggacgccuggccugggaccuucagcuuuauuaucgaaacauggcgcgaggagcucggagaucaaauuggcgggcccgcuuggucccugcuugccagaguggcuggacggcgcagacuggccgcgggcgggcccugggcccgggacauccagcgcgcuggagccugggaacucagauucagcuaucgggcucgcugcgagccuccggccguuggcaccgccuguacaagacugugccggcccagaucugcuccuucccgcuguggccccgggcugcggccuugcgcgccccucgaagaugagugugaggccccgcuggugugcagagcuggauguagcccugaacauggcuuuugcgagcagcccggggaaugccgcugucuugagggauggaccggcccucugugcacaguccccgugucuaccuccagcugucucucuccucgggggcccuccagcgccacgaccggaugccugguuccgggcccuggccccugugacgggaaccccugcgccaauggaggcuccuguucugaaacaccucgcagcuucgagugcaccuguccgagaggguuuuacggacuucggugcgagguguccggcgucacaugugcugaugggcccugcuucaacggcggacugugcgugggcggggccgacccugauagcgcguauaucugucacugucccccuggauuucagggcucuaauugcgagaaaagaguggaccgcugcucccuccaacccugucggaacgggggacugugccuggaucucggccaugcucugagaugucgcugccgggccggguucgccggcccuagaugugaacacgaccuugaugacugcgcuggacgggccugugcuaauggcgggaccugcgucgaaggaggcggggcccaucgcugcagcugugcgcugggauucggcgggagagacugccgggagagagccgaucccugugcugcccgcccgugcgcucacggcggacgguguuacgcccacuuuucuggccucguuugcgcgugugccccuggguauaugggagcuagaugcgaguuccccgugcauccugacggcgccagcgcucugcccgccgccccgccugggcuucgccccggagauccucagagauaccugcucccucccgcucugggccugcucguggcggccggggucgcuggcgccgcccugcuucuggugcacguucggcgcagaggacauucccaggacgcuggcucucggcuccuggccgggacgcccgaaccgagcgugcacgcgcugcccgaugcucuuaacaaucuccgcacacaggagggauccggcgacgggccuucuagcuccgucgauuggaacagacccgaagacguggauccucaaggaauuuauguuaucagcgcccccucuauuuacgcccgggagguggcuaccccucuguuuccgccccugcacacaggccgcgccggccagagacagcaucuccuguucccuuaccccuccagcauccuuuccgucaaguga

SEQ ID NO: 68394 - RNA, 2058 nt, Artificial Sequence
  derived and/or modified sequence opt5 from DLL4__Homo_sapiens__NP_061947
auggccgcugccagcagauccgcgucuggcugggcucugcuccugcuuguggcccuguggcagcaacgggccgcugggagcggagucuuccagcuccagcugcaggaguuuaucaacgaacgcggcguucuugccuccgggagacccugcgagccuggaugucggaccuucuuucgcgugugccugaagcacuuccaagcuguggucucuccgggccccuguacauuugggacggugagcaccccuguucucggaacaaauuccuucgccgugagagacgauucuagcggcggcgggcggaacccccugcagcugccuuuuaauuucaccuggcccggaacauuuucccucauuaucgaagcguggcaugccccuggcgacgaucugcgcccggaggcccuucccccugacgcucugauuagcaaaaucgcuauucaggggucucucgccgucggacagaacuggcugcuugaugaacaaaccuccacacugaccagacuccgguacagcuaucgcgugaucugcucugacaauuacuauggcgauaacuguuccagacugugcaagaaacggaaugaccacuucgggcauuacguuugucagcccgauggaaaccugagcugccucccuggcuggacgggcgaguauugucagcagcccaucugccugucugggugucacgagcaaaauggauacugcuccaagccggcggaaugccuuugucgcccuggcuggcaggggagacugugcaacgaguguauuccccauaauggaugccggcacggcaccuguagcacaccuuggcagugcaccugugacgaaggguggggaggccucuuuugcgaucaagaccugaacuauuguacacaccauucccccugcaaaaauggcgccaccuguucuaacagcgggcagcgcuccuacacgugcacaugcagacccggauacaccggcguggauugugagcuugagcugagcgaaugcgacucuaauccuugucggaacgggggauccugcaaggaccaggaggauggcuaucacugucucugcccgcccggguacuauggccugcauugugaacacagcacacugucuugcgcugacagcccuuguuucaacggaggcuccugcagagagcgcaaucagggggccaacuacgcuugugaaugucccccuaauuuuaccggaucuaacugcgagaagaaagucgaucggugcaccagcaaucccugcgccaacggcgggcaaugucucaauagaggaccgucccgcaugugccgguguagaccuggcuucacagggacguauugcgagcugcacgugagcgacugugcccgcaaccccugcgcucauggcggaaccugucacgaucuugaaaauggccugaugugcacauguccugcgggguucucuggacggagaugcgaggugcgcaccuccaucgacgccugcgcuagcucucccuguuuuaaccgggccacaugcuacaccgaucucuccacggacacauucgucuguaauugcccuuauggcuuuguugggagcagaugugaguuccccgugggacugccgccuuccuuucccuggguggccgucucucuuggcguggggcuggcuguucuccuggugcugcucggcauggucgccguggcgguucgccagcugcggcuuagacggcccgaugacggaagccgcgaggcuaugaacaaucuguccgauuuccagaaggacaaccucauuccugccgcccagcugaaaaauaccaaccaaaagaaagaacuggagguggacugcggccuugauaagucuaacugugggaagcagcagaaucauacccucgacuacaaccuggcuccgggaccccugggcagagggacaaugccuggaaaauuuccccacagcgauaagucccucggcgagaaagccccucugcggcuucauagcgaaaagcccgagugcagaaucucugcuauuuguuccccucgcgacagcauguaccagucugucugccugaucuccgaagaacggaaugaaugugugauugccaccgaggucuga

SEQ ID NO: 68395 - RNA, 1362 nt, Artificial Sequence
  derived and/or modified sequence opt5 from DLST__Homo_sapiens__NP_001924
augcugagcagaucccggugcgugucucgcgccuucagcagaucccucucugcuuuucagaagggcaacuguccccuggggcggcgcagccuuccuggagucucccugugccaaggcccgggguaccccaauucuagaaaaguugugaucaacaauagcguguucuccguccgguuuuuccgcaccacagccguguguaaggacgaucucguuacggugaaaaccccugcguuugcugagagcgucacagaaggagacgugagaugggagaaggccguuggcgauaccguggccgaagacgaggucgugugcgaaauugagacagauaaaaccucugugcagguccccuccccugcuaacgggguuaucgaggcccugcuugugcccgacggaggcaagguggaaggcgggacaccucuguucacccuccggaagacgggagcugccccggcgaaagccaagcccgcugaggccccugcugccgcggcccccaaagcugaaccuaccgccgcugccgugcccccgccugccgcucccauuccuacacagaugccucccguccccagcccgucucagcccccuuccggcaagcccguuagcgcggugaaaccuaccgucgcucccccgcuggcugagccuggggccggaaagggccugcgcucugagcacagagaaaagaugaaucggaugcgccaaagaaucgcccagcggcucaaagaggcucagaacacaugugccaugcugaccacguuuaaugaaauugauauguccaacauccaggagaugcgcgcgagacauaaggaagccuuccuuaaaaagcacaaucugaaacucggguuuaugagcgccuucgugaaggccuccgcuuuugcccugcaagagcagcccguugugaacgcugucaucgacgauacaaccaaagagguggucuaucgggacuacauugauaucucuguggccguugcgacaccuagaggacuugugguccccgugauucgcaauguugaagccaugaacuucgcugacaucgagcggaccauuaccgaacugggcgagaaggccagaaagaaugaacucgcuaucgaggauauggacggcgggacauuuacgauuagcaacggaggcguguucgggucccuguucggaaccccuaucaucaaucccccgcagagcgccauucugggcaugcaugggaucuuugaccgcccugucgcgauuggaggcaaaguggaggugcggcccaugauguauguugcccucacauacgaucacagacugaucgacggccgcgaagcugucaccuuccuucggaagauuaaagccgcuguggaggaucccagagugcugcuccuggaccuuuga

SEQ ID NO: 68396 - RNA, 390 nt, Artificial Sequence
  derived and/or modified sequence opt5 from DLX1__Homo_sapiens__NP_001033582
augaccaugacaacgaugcccgagagccugaacuccccugugucuggcaaggccgucuucauggaauuugggccgcccaaucagcaaaugagcccuucccccaugucucacggacauuacagcaugcacugccuccauuccgcuggccacucucagccugacggggccuauagcuccgcgagcucuuucuccagaccccugggauacccuuauguuaacagcgugucuucccaugcuagcucuccguacaucuccagcgugcaguccuaucccggcucugccagccuugcccagucccggcuggaggauccugggcaagaccucguccccaaacaggcuauucaggugcaggaagccgaugaggcuggauggggcggcagcgggggauga

SEQ ID NO: 68397 - RNA, 987 nt, Artificial Sequence
  derived and/or modified sequence opt5 from DLX2__Homo_sapiens__NP_004396
augaccggcguguucgacagccuggucgccgauaugcacuccacacagaucgcugccucuagcacguaccaucaacaccagcagcccccuuccgggggaggcgcggggccgggaggcaacucuagcuccucuagcucccuccauaagccccaggagagcccuacccugcccguuucuacagcuaccgacuccagcuauuacacaaaucaacagcacccugccgggggaggcggcgggggaggcucucccuaugcccauaugggguccuaccaguaucaggcuagcggacuuaacaaugugccuuacucugccaaauccagcuaugaucugggcuacaccgcugccuacacauccuaugcgccguacgggaccucuagcucccccgccaacaaugaaccugagaaggaagaccucgagcccgaaauuagaaucgugaacggaaaaccuaagaaaguccggaagccccgcacgauuuauagcucuuuucaacuggcugcccuucagagacgguuccagaagacccaguaccuggcucucccggagcgcgccgagcuggcggccucccugggccucacacaaacccaggugaaaaucugguuucagaauagacggagcaaguucaaaaagauguggaaaucuggcgaaauuccuagcgagcaacaccccggggcuuccgccucuccucccugcgcuagcccucccguuuccgccccggccagcugggauuuuggagugccccagcgcauggcuggcgggggaggcccugggucuggaggcuccggcgcggggagcucuggauccagccccuccucugccgcuagcgccuuccugggcaacuauccuugguaccaccagacauccgggucugccagccaucuucaggcuaccgcgccccugcuccacccgacgcaaacaccucagccccaucaccaccaucaccaucacggaggcgggggcgccccugucuccgcuggaaccaucuuuuga

SEQ ID NO: 68398 - RNA, 864 nt, Artificial Sequence
  derived and/or modified sequence opt5 from DLX3__Homo_sapiens__NP_005211
augagcggcuccuucgacagaaagcugucuagcauccucaccgauauuuccucuagccuguccugccacgccgggucuaaagacagccccacacuuccugaguccagcgugacggaucugggauacuauucugcuccgcagcaugacuacuauuccggccaacccuacgggcagaccgucaacccuuauacauaccaccaucaguuuaaucucaacggacuggccggcaccggggcguauagccccaagucugaauacacauacggagcuuccuaucggcaguacggcgccuaucgcgagcaaccucuucccgcccaggauccuguuagcgugaaagaggaaccggaagcugaggugagaauggucaauggcaagcccaaaaaggugcggaagccucgcaccaucuacucuuccuaucagcuggccgcucuccagagacgguuccaaaaagcccaguaccuggcgcugcccgagcgcgccgaacucgcugcccagcuggggcuuacacagacccaaguuaagauuugguuucagaacagacggagcaaauucaagaaacuguauaagaauggagaggugccucucgaacacucccccaacaauucugacagcauggcuuguaacuccccgccuagccccgcccugugggauacgucuucccauagcaccccugcgcccgcccgcucucagcuucccccuccgcugcccuacagcgcuuccccuucuuaccucgacgaucccacaaauagcugguaucacgcccaaaaccuguccggcccucaucugcagcagcagcccccgcaaccugcuacccuccaccacgccagccccgggccucccccuaaucccggagccgucuacuga

SEQ ID NO: 68399 - RNA, 723 nt, Artificial Sequence
  derived and/or modified sequence opt5 from DLX4__Homo_sapiens__NP_612138
augaccagccugcccugcccucucccgggcagagacgccuccaaggcuguguuccccgaucuggccccuguccccucuguugcggcugccuacccucuugggcugagccccacaacggccgcuuccccuaaccucucuuauagccggccguacggacaccuucuuuccuaucccuacaccgagccugccaaucccggcgacucuuaucugagcugucagcaaccugcugcccucucccagccccugugcgggccggcggaacauccucaggagcuggaagccgauagcgagaaaccccgccucucuccugaacccuccgagagacggccccaggcuccugccaagaaacugcgcaagccgagaacaaucuacagcucucuucaacugcagcaccucaaccagcgguuucagcauacccaauaucuggcucugcccgagcgcgcccagcuggcggcccagcucggacugacacagacccaagugaaaauuugguuccagaauaagagauccaaguacaaaaagcugcucaaacagaacagcggcgggcaagaaggagacuuuccuggccggacauucucugugucccccuguagcccuccccugccgucccuuugggaucugccuaaggcuggcacccuccccacgucuggguacggaaauagcuuuggcgccugguaucagcaccauuccagcgacguccuggcuucuccucagaugauguga

SEQ ID NO: 68400 - RNA, 870 nt, Artificial Sequence
  derived and/or modified sequence opt5 from DLX5__Homo_sapiens__NP_005212
augaccggcguguucgacagacggguccccagcauccgcuccggggauuuucaggccccuuuccaaacaucugcugccaugcaccauccgagccaggagucccccacgcugccugagucuagcgcgaccgacuccgauuacuauucucccacaggaggcgcuccucacggguacugcagccccaccuccgccagcuauggaaaggcccucaacccuuaccaguaucaguaccauggcguuaaugggucugcuggauccuauccggccaaggcuuacgccgacuacagcuaugcgucuuccuaccaccaauauggcggcgccuacaacagagugcccagcgcuacaaaucagccugagaaagaagugaccgagcccgaaguccggauggugaacgggaaaccuaagaaaguucgcaagcccagaacaauuuauucuuccuuucagcuggccgcccuucagcggcgcuuccaaaagacccaguaccuggcucucccggagagagcggagcuggccgcuagccuuggacugacgcagacccaggugaaaaucugguuucaaaauaagcgguccaaaauuaagaaaaucaugaagaacggcgaaaugccucccgagcauucuccuagcuccagcgaucccauggccuguaauucuccccaguccccugcugucugggaaccgcaggggagcucucgcagccucucccaccacccccaugcccacccucccacaucuaaccaaagcccugccuccagcuaucuggaaaauucugcuuccugguacaccagcgcggccucuuccauuaacagccaucugcccccgccuggaucccuccagcacccccuggcucuugccucuggcacacuguacuga

SEQ ID NO: 68401 - RNA, 882 nt, Artificial Sequence
  derived and/or modified sequence opt5 from DLX6__Homo_sapiens__NP_005213
augaugaccaugacaacgauggccgacggccuggaggggcaggauagcuccaagucugcuuucauggaauuuggacaacagcagcagcaacagcagcagcaacagcagcagcaacagcagcaacagcagcagcccccuccgcccccucccccucccccucaaccgcacagccagcaguccucucccgccauggcgggcgcucauuacccucuccacugccugcauagcgccgccgcugccgcugccgcggggucccaccaucaccaccaucaccagcaucaccaccauggaucucccuaugccagcggcgggggaaacuccuacaaucacagaagccuugcugccuauccuuacaugucucauucccaacacagccccuaucugcagucuuaccauaacuccagcgcugccgcgcagacccggggcgacgauacagaccagcagaaaaccacagugaucgagaauggcgaaauucgcuucaacgggaagggcaaaaagaucagaaaaccgcggaccauuuauucuucccuccaacugcaggcccuuaaucaccgcuuucagcaaacacaguaccuggcucucccugagagagccgaacuggcugccagccugggacucacccagacgcaagucaagaucugguuccagaacaagcgguccaaauuuaagaaacugcuuaagcaggggucuaauccccacgagagcgauccucugcagggauccgccgcucucagcccccgcucucccgcgcugccuccgguuugggacguguccgccagcgcuaaaggcgugucuaugcccccuaacagcuacaugcccggguauucccauugguacucuagcccucaccaagauaccaugcagagaccccagaugauguga

SEQ ID NO: 68402 - RNA, 5358 nt, Artificial Sequence
  derived and/or modified sequence opt5 from DMBT1__Homo_sapiens__NP_004397
augggcaucagcaccgugauucuggagaugugccuccuguggggacaggugcuuuccaccgggggcuggauccccagaacgaccgacuacgcuucucugauuccuagcgaaguuccgcucgaucccacaguggcugagggguccccuuuccccucugaaagcacccuggaguccaccguggcugaaggaucuccuaucagccuugaguccacccuggagagcacagucgccgaaggcucucucauucccuccgagagcacccuggaaucuacgguggcugagggguccgacagcggacuggcccuccggcugguuaacggcgauggccgcugucaagggagaguggagauccuuuaucggggaucuuggggcaccgucugcgacgauuccugggacacaaaugaugccaacgugguuugucgccagcuggggugcggaugggcuaugagcgccccuggcaaugcuugguuugggcagggauccggcccgaucgcccucgacgaugugagauguucuggccacgaaagcuaccugugguccugcccccauaacggguggcuuagccacaauuguggacauggcgaggacgcgggggucauuugcucugccgcucagccucaauccacccugcggcccgaaagcuggccugugcgcaucucucccccggugccuacagagggaagcgaauccucucucgcccugagacuggucaacggcggggaucggugucgcggaagaguugaggugcucuaucggggcagcuggggcaccgugugcgacgauuacugggacacgaaugacgcuaacgucgugugucgccagcuggggugcggaugggccauguccgcgcccggcaaugcccaguucgggcagggaagcggcccuauuguucuugaugacgugagaugcucugggcacgaguccuaucuguggagcuguccccauaacggcuggcucacacacaauugcggacacucugaagaugcuggcgucaucuguuccgcgccccaaagccggccuaccccgucccccgacacauggccuaccucucaugcuagcaccgccgggcccgaguccucucuggcccuucgccuggugaacggaggcgauagaugccaggggcggguugaagugcucuacagaggaagcuggggcacagucugugacgauuccugggacacgagcgaugcuaauguggucugccgccagcugggguguggcugggcgaccucugccccuggaaacgcucgguuuggccagggguccggacccauugugcuggacgauguuagaugcagcggcuaugagucuuaccucugguccuguccgcacaauggguggcugagccauaacugccaacacucugaagacgccggagugaucuguagcgccgcucacuccuggagcacaccuucucccgacacccuuccuacaauuacccugcccgccuccacggucggcagcgaguccucucucgcgcugcgccuugugaacgggggcgaucggugccagggaagaguugaggugcuguaccagggcagcugggggacagucugcgacgauuccugggacaccaaugaugcuaacguggugugucgccaacucggaugcggcugggccaugucugccccugggaaugcucgguucggacagggcagcgggcccaucguucuggacgaugucagauguuccggccaugaaucuuaucuguggagcugcccgcacaacggauggcucucccauaauuguggccacagcgaggacgccggggugaucugcucugcuucccagagccgcccuacccccucucccgauacauggccuaccucccaugccagcacagcgggaucugaauccagccuggcccuucggcuggugaacggcggggacagaugucagggacgcgucgaggugcucuaccggggcuccuggggcacgguuugcgaugacuauugggauaccaaugacgcuaacguggucuguagacaacuggggugcggaugggccaugagcgcuccgggcaaugcccgguuugggcagggaucuggccccauugugcuggacgauguucgcuguagcgggcacgaauccuaccuuuggucuugcccucacaacggauggcucagccauaauugcggccaccaugaggacgcgggcgugaucuguuccgccucucagagccagcccacaccuucccccgauaccuggccuacaucucacgcuagcaccgccggguccgagagcucucuggcucugagacucgucaacggaggcgaccggugccaagggagaguggaaguucuguaucgcggauccuggggcacggugugugaugacuacugggauaccaaugacgccaacgucgugugccggcagcuuggguguggaugggccacaagcgcucccggcaaugcgagauucggccaggggucuggaccgauugugcuggaugacguccgcugcuccggccacgagagcuaucucugguccuguccucauaacggguggcugucucacaacugcggacaucacgaagaugccggcguuaucuguagcgcuucccagagccaacccaccccuucucccgacacauggccgaccuccagagccagcacggccgggucugagagcacacuggcccuucggcucgugaauggaggcgaucgcugcagaggccggguggagguccuguaccagggguccuggggaaccgugugugacgacuacugggauacaaacgacgccaauguugugugccgccagcugggcugcgggugggcgaugucugcuccuggaaacgcccaguuuggccaagggagcggacccauuguccucgaugacgugagauguuccggccaugaaucuuaucuguggagcugcccucacaauggcuggcuuucccacaacugugggcaucacgaggaugccggaguuaucugcagcgcugcccagucucaguccacaccccggcccgacaccuggcugacaacgaaucucccugcgcugaccgugggcagcgaauccucucuggcccuucgccucgucaacgggggagauagaugucggggccgcguggagguucuguacagagggagcuggggaacagugugcgacgauuccugggacaccaaugaugccaacgucgugugucggcaacugggcugcggcugggccaugucugcuccggggaaugccagauucggacagggcagcgggcccaucgugcucgacgacguccgcuguuccggaaacgaaagcuaucuguggucuugcccucauaagggcuggcuuacacacaauugugggcaucacgaggaugcuggaguuauuugcuccgccacccagaucaacagcacgacaaccgacugguggcaccccaccacaaccacaacggcgcggccuucuuccaauugcggcggcuuucuguucuacgccagcgggaccuuuucuagccccuccuauccugcuuacuauccgaacaacgccaaaugugugugggagauugaagucaauucuggauacagaaucaaccucggcuucagcaaucugaagcuggaggcucaucacaacugcuccuuugauuacgucgaaauuuucgacgggagccuuaauuccucucuccugcugggaaaaaucuguaacgauacacgccagaucuucaccagcuccuauaaucggaugacaauucauuuuagaucugacaucagcuuccaaaacaccggcuuucucgccugguacaauuccuuccccucugaugccacgcugcgccuugugaaccugaauagcuccuaugggcucugcgcuggccggguugagauuuaccacggaggcaccugggggacagugugugacgauagcuggaccauccaggaagcggaggucgugugcagacagcugggauguggccgcgccguuucugcucuggggaacgccuauuuuggauccggcagcgggccuauuacacuugacgauguggagugcucuggcaccgaauccacacuguggcagugucggaauagaggaugguucagccacaacugcaaucaucgggaggacgccggcgucaucuguucugggaaccaccucuccacccccgcuccuuuucugaacauuacgcgccccaauacagauuacagcugcggaggcuuccucucccaaccgagcggggacuuuucuagcccuuucuaucccggaaacuaccccaauaacgccaagugcgugugggacaucgaaguccagaauaacuacagagugaccguuaucuuucgggaugugcagcuggagggcggguguaauuaugacuacauugaagucuucgauggcccuuaucgcuccucuccccuuaucgcgagagugugcgacggagcucggggcagcuuuaccuccucuagcaacuucauguccauuagauucaucucugaucauagcauuacacgccggggguuuagagccgaguacuauuccagcccuucuaaugacuccaccaaccugcucugucugccgaaucacaugcaggccagcguuucucgcuccuaccugcaaagccuuggauucuccgcuucugaucuggugaucagcacguggaacggcuauuacgagugccggccccagaucacaccuaaucucgucauuuuuaccauccccuacuccggguguggaacauucaaacaggccgacaacgauaccauugacuauagcaauuuucugacagcggcugugucuggcggcaucauuaagagacgcaccgaucuccggauccauguguccugcagaaugcugcaaaacacguggguugacaccauguacaucgccaaugauacaauucacgucgccaacaacaccauccagguggaagaggugcaguaugggaauuucgacgucaacauuagcuuuuacacaucuagcuccuuccuuuauccugugaccucucgccccuacuauguugaccugaaucaggaucucuacgugcaagcugaaauccugcacagcgacgccguccugacgcuuuuuguggauacauguguugcuuccccguacucuaacgacuucaccagccugacauaugaucucauuagauccggaugcgugcgggacgauaccuacggcccuuauagcucucccucccugcgcaucgccagauuucgguuccgcgcguuucauuuccucaauagauucccuagcgucuaccugcgguguaagauggugguuugcagagccuaugaccccuccucucgcuguuaccgggggugcgugcuuagaagcaaacgcgaugucggauccuaucaggagaagguggacgugguccugggcccuauccagcugcagacacccccgcggagagaggaggaaccucgguga

SEQ ID NO: 68403 - RNA, 1023 nt, Artificial Sequence
  derived and/or modified sequence opt5 from DMC1__Homo_sapiens__NP_008999
augaaggaggaccagguggucgccgaggaacccggcuuccaagaugaagaggaaagccuguuucaggacaucgaucuccugcagaaacacgggauuaacguugcugacaucaagaaacuuaaguccgugggaauuugcaccaucaaaggcauucagaugacaacgagacgggcccuguguaaugugaaggggcucucugaggcgaaggucgauaaaaucaaggaggcugccaacaaacugaucgaaccuggauuccuuaccgccuuugaguacagcgaaaagcgcaaaaugguguuccauauuacaaccggcucccaagaguuugacaagcugcucgggggaggcaucgagucuauggcuauuacagaagccuucggcgaguuuagaaccgggaagacacagcugagccacacccugugcguuacggcucagcucccgggagccggcggguaucccggaggcaaaaucauuuucaucgauaccgaaaauacauuucggccugaccgccugagagauauugcggaccgguucaacguggaucaugacgccguccuugauaaugugcuguacgcucgcgccuauaccuccgagcaccagauggaacuccuggacuacguugcugccaaguuucaugaggaggcggggaucuucaaacuucugaucauugacucuaucauggcccucuuuagaguggauuucagcggacggggcgaacuggcugagcgccaacagaagcuggcccagaugcucuccagacugcagaaaauuagcgaagaguauaacgucgcuguguucgugacaaaucaaaugaccgccgaccccggcgccacgaugacauuucaggcugauccuaagaaacccaucgggggacacauucuugcgcacgccucuaccacacggaucucccugcgcaagggcagaggggaacuccggaucgcuaagauuuacgacagcccugagaugccggagaacgaagccaccuucgccaucaccgcuggaggcauuggggaugccaaagaguga

SEQ ID NO: 68404 - RNA, 11034 nt, Artificial Sequence
  derived and/or modified sequence opt5 from DMD__Homo_sapiens__NP_000100
auggaggacgagagagaggaugugcagaagaagaccuucacaaagugggucaaugcucaauuuuccaaguucggaaagcagcacaucgaaaaucuguuuuccgaccuccaggaugggcggagacugcuugaccugcucgagggacugacgggccagaaacuucccaaggaaaaggggucuaccagaguucacgcucugaacaaugugaacaaggcccuccgggugcugcaaaauaacaaugucgaucuggugaacauuggaagcacagacaucguugauggcaaucacaagcucacccuggggcuuauuuggaacaucauucugcacuggcaagugaagaaugucaugaagaacaucauggcgggacuccagcagacaaauuccgagaagauccugcuuucuugggugcgccaauccaccagaaacuacccucagguuaaugugauuaacuucacaaccuccuggucugacggccuggcucucaacgcccugauccacagccaucggcccgaucuguuugacuggaacuccgucgugugccagcagagcgccacgcaacgccucgagcacgcuuucaacauugccagauaucagcugggcaucgaaaaacuucuggaucccgaggacguggauaccacauacccugacaagaagucuauucucauguauaucaccucccuguuucagguccuuccccaacagguuagcauugaagcuauccaggagguggagaugcugccucggcccccuaaggugacaaaggaggaacacuuccagcuccaucaccaaaugcauuacucucagcagaucaccgucucccuggcccagggguaugaacgcacgagcucucccaagcccagauuuaaauccuacgccuauacacaagccgcuuacgugaccacaagcgacccuacccggucccccuucccuucucagcaccuggaggcccccgaagauaagagcuuuggauccagccucauggagucugagguuaaucuggaccgcuaccagaccgcucuugaagaggugcuguccuggcuccugagcgccgaagauacacuucaggcgcaaggcgagauuucuaacgacgucgaagugguuaaagaucaguuccacacgcaugagggguauaugauggaccugaccgcccaccagggaagagugggcaauauccuccagcuggggagcaagcugauuggaacaggcaagcucuccgaggaugaagagaccgaaguccaagagcagaugaaccugcuuaauucucggugggaaugucugcgcguggcuagcauggagaaacaguccaaccuccauagaguccugauggaccugcaaaaucagaaacuuaaagagcucaacgauuggcugacaaagaccgaggaacggacgagaaaaauggaagaggagccgcugggcccugaccucgaagaucugaagcgccaggugcagcaacacaagguucuucaggaggaccuggaacaggaacaggugcgggucaauagccucacacauauggugguuguggucgacgaaucuuccggggaucacgccaccgcugcccuggaggagcaacugaaagugcuuggagacagaugggccaacaucugccgcuggaccgaagaucggugggugcuccugcaggacauucugcucaaguggcagagacugacagaggaacagugucuuuuuagcgcuuggcugucugagaaagaagaugcgguuaauaagauccacaccacaggcuucaaagaccaaaacgagaugcucuccagccugcagaagcuggccguccuuaaggcugaucucgagaaaaagaaacaguccauggggaagcuguacucucugaaacaagaccuccugagcacgcuuaagaauaaguccgugacccagaaaacagaagccuggcuggauaacuucgcccgcugcugggacaaccucgugcagaagcuggagaaaucuaccgcucagaucagccaagccgucacaaccacgcagcccucccugacccagacaaccgugauggaaacaguuaccacggugacaacccgggagcagauucuugucaagcaugcgcaagaggaacugccuccgcccccuccgcagaaaaagagacagaucacaguggauagcgagauucgcaaacggcuggacguugauaucaccgaacugcacucuuggauuaccagauccgaggcugugcuccagagccccgaauuugccaucuuccgcaaggagggaaauuuuucugaccugaaggagaaagucaacgccaucgaacgggagaaggcugaaaaauucagaaaacuucaagacgccucccggagcgcucaggcccugguggagcagaugguuaaugaaggcgugaacgcggauucuauuaagcaggccagcgagcaacucaauucccgcuggaucgaguuuugucagcugcugagcgaaagacuuaacuggcuggaguaucagaauaacauuaucgcuuucuacaaucaacuccagcagcuggaacagaugacaacgaccgccgagaacuggcucaagauucaaccuacaacccccucugaaccuacagcuaucaagucccagcugaaaauuugcaaggacgaggucaaucggcuuagcgggcugcagccccagaucgagagacucaaaauccaauccauugcccugaaggaaaaaggacagggcccgauguuucuggaugcggacuucguggccuuuaccaaccauuucaaacagguguuuucugauguccaggcucgcgagaaggaacuucaaacgaucuucgacacacugccucccaugcgguaucaggagaccaugagcgccauuagaaccuggguucagcaauccgaaacaaaacucucuaucccucagcugagcgugaccgauuacgagauuauggagcagcgccucggcgaacugcaggcccuucaguccucucugcaggagcagcagagcgggcucuauuaccuguccacaacggugaaggaaaugagcaaaaaggcccccucugagaucuccagaaaauaccaaagcgaguuugaagagaucgaaggacgguggaagaagcugucuucccagcuugucgagcacugucagaaacuggaggaacagaugaauaagcuccgcaaaauucaaaaccacauccagacccugaagaaauggauggccgagguggacguuuuccucaaggaagaguggccugcucugggcgauagcgaaauucuuaaaaagcagcugaagcagugcagacugcucgugucugacauccaaacaauucagcccucccugaauagcgucaacgaagggggacagaaaaucaagaacgaagcggagccggaguucgccucccggcuugaaaccgagcugaaagaacucaauacacaaugggaucauaugugucaacagguguaugcucgcaaggaggcccugaaaggcgggcucgaaaagaccguuagccugcagaaggaccuuucugagaugcacgaguggaugacgcaagccgaagaggaauaccuggagagagauuuugaguauaaaaccccugacgaacugcagaaggcuguggaggaaaugaaacgggccaaggaggaagcgcagcagaaagaggcuaaggucaagcuccugacagagagcgugaacuccguuaucgcccaagcgccgcccguggcucaggaagcccuuaaaaaggagcuggaaacccucacaaccaauuaccaguggcugugcacacgccucaacggcaaauguaagacccuggaggaagucugggcgugcuggcaugagcuucugucuuaucuggagaaagcuaauaaguggcucaacgaaguggaguucaagcugaaaacgacagaaaauauuccuggaggcgccgaggaaaucagcgaggugcuugacucccuggagaaccucaugagacacucugaagauaauccgaaccagauucggauccuggcccaaacccucaccgacgggggagucauggaugagcugauuaaugaggaacuugagacauuuaacagccgcuggagagaacugcaugaggaagcuguucggagacagaagcugcucgagcaguccauccaaucugcccaggaaaccgagaaaagccugcaccuuauccaggagucccugacguucauugacaagcagcucgcugccuacaucgcggauaaaguggacgccgcucaaaugccccaggaagcccagaagauucagagcgaucugacaucucacgagaucucccuggaagagaugaagaaacauaaucaaggcaaggaagcugcccagcgcgugcucagccagauugacgucgcccagaagaaacuucaagaugugucuaugaaauuucggcuguuccagaagccugcuaacuuugagcagagacugcaagaguccaaaaugauccucgacgaaguuaagaugcaucugcccgcgcuugagaccaagagcguggaacaggaggucgugcagucccagcugaaucauugcguuaaccucuauaaaucucugagcgaagugaaguccgaggucgagauggugauuaaaacagggcgccaaaucguccagaagaaacagaccgaaaacccuaaggagcuggaugaacgggugacagcccucaaacuucacuacaaugagcugggagcuaaaguuaccgagagaaagcagcaacuggaaaaaugucucaagcugagccgcaaaaugcggaaggagaugaacgugcuuacggaauggcuggccgccaccgacauggagcucacaaagagaucugcugucgaaggcaugcccuccaaucuggacagcgagguggccugggggaaagcgacccagaaggagaucgaaaaacagaagguucaucugaaaucuauuacagaggugggcgaagcucucaagaccguccuuggaaagaaagagacgcugguggaagauaagcugagccuccugaacuccaauuggaucgccgugacaucucgcgccgaggaguggcuuaaccugcuccuggaauaccagaaacacauggagaccuucgaccaaaauguugaucacauuacaaaguggaucauucaggcugacacccugcucgaugaaagcgagaaaaagaaaccucagcagaaggaagacguccuuaagcggcugaaagccgagcugaacgauaucagacccaagguggacuccacccgggaucaagcggcuaaucucauggccaaccgcggcgaccauugcagaaaacugguggagccgcagaucucugaacuuaaucaccgguuugccgcuauuagccaucgcaucaagacagggaaagccuccauuccucugaaggagcucgaacaguucaacagcgauauccaaaagcugcuggagccccucgaggcugaaauucagcagggagucaaucuuaaagaggaagacuuuaacaaggauaugaaugaggacaacgaaggcacggugaaagagcugcugcagagaggggacaaucuccaacagcggaucaccgaugagagaaagcgcgaagagaucaaaauuaagcagcagcugcuucaaacaaagcacaacgcccugaaagaccuccggucucagagacgcaagaaagcgcuggaaaucucccaccagugguaucaguacaagcggcaagccgaugaccugcucaaaugucuugaugacauugagaagaagcuggcuagccugccugaacccagagaugagcgcaaaaucaaggagauugaccgggaacuccagaaaaagaaagaggaacugaacgccguuagacgccaggcugagggacuuuccgaagauggcgccgccauggcuguggagccgacccaaauccagcugucuaagagauggcgggagauugaaagcaaauucgcgcaguuucgcagacucaauuucgcccagauccauacaguccgggaggaaaccaugauggugaugacggaggacaugccucuggagaucuccuauguucccucuacauaccugaccgaaauuacccacgugagccaagcucuccuugaggucgaacagcugcugaacgccccugaucucugcgccaaggacuucgaggaucuguuuaagcaggaagagucccuuaaaaauaucaaggacagccugcagcaaucuuccgggcgcauugacaucauucauagcaaaaagacagcugcccuccagucugcgacccccguggagagaguuaaacugcaggaagcucugucccagcucgauuuccaaugggagaaggugaacaagauguauaaagaccggcagggcagauuugaucgcagcgucgaaaaguggcggagauuccacuacgacaucaaaaucuuuaaucaguggcuuacagaggccgaacaguuccugcgcaagacgcaaauucccgagaacugggagcaugccaaauauaagugguaccugaaggaacuccaggauggaaucggccagcggcaaaccguggugagaacacugaaugcuaccggggaggaaauuauccagcagucuagcaaaacagacgccuccauucuucaggagaagcugggaucucucaaccugcgguggcaagaagucuguaaacagcugagcgaucgcaagaaaagacucgaggagcagaagaauauccuuuccgaauuucagcgggaccugaacgaguucguucuguggcucgaagaggcggauaauaucgccagcauuccucuggagccgggcaaggaacaacagcuuaaagagaagcuggaacaggugaaacuccugguggaggaacugccccuccgccaggggauccugaagcaacuuaacgagaccggaggcccuguccugguguccgcucccauuucuccugaggaacaggacaaacucgagaauaagcugaagcagacgaaccuucaauggaucaaaguuagcagagcccugcccgaaaagcagggggagauugaagcucagaucaaagaucucggccagcuggagaagaaacuggaggaccucgaggaacagcugaaucaccuucugcucuggcuguccccuauucggaaccagcuugaaaucuacaaccagccgaaucaggagggacccuuugacgugcaagaaaccgagaucgccguccaggcuaagcagccugauguggaggaaauucugucuaaaggccagcaccucuauaaggagaagcccgccacacaaccuguuaaacgcaagcuggaagaccugagcuccgaguggaaagcggugaacagacuccugcaggagcuucgggccaagcagcccgaucuggcuccggggcucaccacaaucggagccucuccuacccaaacagucacgcuggugacccagcccgucgugacaaaagaaaccgcuauuagcaaacuugagaugcccuccagccugaugcucgaaguuccugcccuggccgacuucaaucgcgcuuggaccgagcugacagauuggcucucucugcuugaccaggugaucaagucccagagagugauggucggcgaucuggaagacauuaacgagaugaucaucaaacaaaaggcgacgaugcaggaucucgagcagcggagaccccagcuggaggagcuuauuaccgccgcucaaaaucugaaaaacaagacaagcaaucaggaagcccgcaccaucauuacagaccggaucgagcgcauucagaaccagugggaugaaguucaagagcaucuccagaaucgccggcagcagcugaacgagaugcugaaagacucuacccaauggcucgaagccaaggaggaagcugaacaggugcuggggcaggccagagcgaaacuugaauccuggaaagagggaccuuacacgguggaugccauccaaaagaaaaucacagagaccaagcagcuggcuaaagaccuccgccaguggcagaccaaugucgacguggccaacgaucuggcucuuaagcugcuccgggacuauagcgccgaugacacaagaaagguucacaugauuaccgaaaauaucaacgcgucuuggcgcuccauucauaaacgggugagcgagagagaagccgcucuggaggagacacaccgccugcuccaacaguuuccgcuggaucuugaaaaguuccuggccuggcucaccgaggcugaaacgacagccaauguccugcaggacgcuacccggaaagagagacuucuggaagauuccaagggcgugaaagagcucaugaagcaguggcaagaccugcagggcgagaucgaagcccacacagaugucuaccauaaccuggacgagaacagccagaaaauucuccgcucucuggaagggagcgaugacgcggugcuucugcagagacggcucgacaauaugaacuucaagugguccgagcugcgcaagaaaucucuuaauaucagaagccaccuggaagccuccucugaucaauggaagcggcuccaucugagccugcaggagcuucugguuuggcuccagcugaaagacgaugagcucuccagacaagcucccauuggaggcgacuuuccugccgugcagaagcagaacgauguccaccgggcuuucaaacgcgaacugaagaccaaggagcccgugaucaugucuacgcuugaaaccguuagaaucuuucugacagagcagccucuggaagggcucgagaaacuguaucaagagccccgggaacuuccgccugaggaacgcgcccagaaugugaccagacugcuccggaagcaggccgaggaggucaacacagaaugggagaaacugaaucuccauagcgcggacuggcagcgcaagauugaugaaacccuggagagacugcaagaacuucaggaggcuacagacgagcuggaucucaaacugcggcaggccgaagugaucaagggauccuggcagcccgugggcgaccuucugauugauagccuccaagaccaccuggagaagguuaaagcucuccgcggggaaaucgccccucugaaggagaacgucucucacgugaaugaucuggccagacagcuuaccacgcugggcauucagcucucccccuacaaccugagcacacuugaagaccugaauacccgguggaaacuccuccagguggcugucgaggaccgcguuagacaacugcaugaggcccaccgggauuucggcccugcgucucagcauuuucucuccaccagcgugcagggccccugggaacgcgccaucuccccgaacaaggugccuuauuacaucaaucacgagacacaaaccacaugcugggaccaccccaaaaugacggaacuguaccagucucuugcugaucugaacaaugucagauucagcgccuaucggaccgcuaugaagcucagacgccugcagaaggcccuuugucuggaccuccugucccugagcgcggccugcgaugcucucgaccagcauaaccugaaacaaaacgaucagcccauggacauucuucagaucauuaauugucugacaaccaucuacgaucggcucgagcaggaacacaacaaucuggugaacguuccucuuugcguggacaugugucugaauuggcuccugaacgucuaugauacagggagaaccggacgcauucgggugcugucuuuuaagacgggcaucaucucccucugcaaagcccaucuggaggacaaguacagauaucuuuucaaacaaguugcuagcucuaccggguuuugcgaucagcgccggcugggacuccugcuucacgacagcauucagaucccgagacagcugggcgagguggccuccuucgggggaucuaauauugaacccagcguccgcuccuguuuucaauucgcuaacaauaagccugagaucgaagccgcgcucuuucuggacuggaugcggcuggagccccagucuaugguguggcucccugugcugcauagagucgccgcugccgagacagcuaaacaccaggccaagugcaacauuuguaaggaaugccccaucauuggcuuccgcuaccggagccuuaaacacuucaauuaugauaucugucaauccugcuuuuucagcggcagaguugccaaggggcauaaaaugcacuacccuaugguggaguacuguaccccgacaaccucuggagaagacgugcgggauuuugcgaagguccugaaaaacaaguucagaacgaagcgcuauuuugcuaaacauccccggaugggcuaccucccugugcagacaguucuggagggggacaauauggaaacccccgugacacuuaucaacuucuggccugucgauuccgcccccgccagcuccccgcagcugucucacgacgauacccauagcagaauugagcacuaugcuucccgccucgccgagauggaaaauucuaacggaagcuaccugaacgacuccaucagcccuaaugagucuauugaugacgaacaucugcucauccagcauuauugccaaucccugaaccaggauagcccccuuucucagcccagauccccugcucagauucugaucagccucgagucugaggagcggggcgagcuggaacgcauccuugccgaccuggaggaagagaauagaaaccuccaagcggaauacgaccggcugaagcagcagcacgagcauaaagggcugagcccccucccuagcccgcccgagaugaugccuaccucuccccagagcccucgcgaugccgaacugauugcugaggccaaacuucugagacaacacaaaggacggcucgaagcucgcaugcagauccuggaggaccacaauaagcagcuggagucccagcuccauagacuucggcaacugcuggaacagccccaggccgaggcgaaggugaacggcacaacgguuagcuccccgucuaccagccuccaacgcuccgauucuagccagccuaugcugcuuagaguggucggcucccagacaucugacagcaugggggaagaggaucugcucucucccccucaggacaccagcacaggacuggaagaggugauggagcaacugaauaacagcuuucccuccagccggggccgcaauaccccugggaaacccaugagagaagauacgauguga

SEQ ID NO: 68405 - RNA, 2601 nt, Artificial Sequence
  derived and/or modified sequence opt5 from DMGDH__Homo_sapiens__NP_037523
augcugagacccggcgcccagcuccugcgggggcuucugcuccgcagcugcccucugcaaggauccccgggcagaccccggucugugugugggcgcgagggagaagagaagccuccccuuagcgcugaaacccaguggaaagacagagccgagacagucaucauuggcgggggaugcguuggcgugucccuggcguaccaccucgcuaaggccggcaugaaagaugugguccugcuggaaaagucugagcucacggccgggagcaccuggcaugcugccggacugacaaccuauuuccacccuggcaucaaccuuaaaaagauucauuacgacuccaucaagcuguaugagaaacucgaagaggaaacaggacaggugguuggguuucaccagcccggcucuauucggcuggcuaccacaccugugcgcgucgaugaguucaaguaccaaaugaccagaacgggguggcaugccaccgagcaguaucuuaucgaaccggagaaaauccaggaaauguuuccccugcucaauaugaacaaggugcuggcgggacuguacaauccuggcgacggccacauugaucccuauagccucacaauggcccuggcugccggggcucggaaauguggagcccuucugaaguacccugcgcccguuaccucccucaaggcccgcagcgacggcacaugggauguggagaccccgcaggggucuaugagagcuaaccggaucgucaaugccgcuggauucugggcccgcgaagugggcaaaaugauugggcuggagcacccucuuauccccgugcaacaucaguacgucguuacguccacaauuagcgaggugaaggcccugaaaagagaacucccugugcugcgggaccuggagggaucuuauuaccuccgccaggaaagagauggccugcuuuuuggccccuaugagucccaggaaaagaugaaaguccaagacagcugggugaccaacgggguucccccuggauucggcaaggagcuguuugagucugaucucgaccggaucauggaacacauuaaagcugcgauggagauggugccgguccugaagaaggccgauaucaucaaugugguuaacgggcccauuacauacuccccugacauccuucccauggugggaccucaucagggcgucagaaauuauuggguggcuauuggguucggcuacggaaucauucacgccggcggggucggaaaauaucugagcgacuggauccuccacggcgaacccccguuugaucugaucgagcuggacccuaaccgcuacgggaaguggaccaccacacaguacacggaagccaaagcucgggaguccuauggauucaauaacauugugggcuaccccaaggaggaaagauuugccgggcgcccuacccaacggguuucuggccucuaucagagacuggagagcaaaugcuccaugggauuccaugcgggcugggaacagccccacugguuuuacaagccugggcaggauacacaauaucgccccagcuuccggagaaccaauugguucgagccggugggaucugaguacaagcaggucaugcagcgcguggcuguuacagaccuuuccccuuuuggcaaauucaacaucaaggggcaggauagcauucggcugcucgaccaucuguuugccaaugugauccccaaagucggauucaccaacauuucucacaugcugacgcccaagggcagaguguaugccgaacuuacagugagccaucaauccccuggggaguuucuccugaucaccggcucuggaagcgaacugcacgaucuccgcuggaucgaggaagaggcuguuaaaggcggguacgacgucgagauuaagaacaucaccgaugaacugggagugcuuggcguggccgggccgcaggcucggaagguccugcagaaacucacauccgaggaccugagcgaugacguguucaaguuucugcagaccaaaucucuuaagguuuccaauauucccgugacagccaucagaauuagcuacacgggagaacucggcugggagcuguaucaccggcgcgaagacucugucgcgcuguacgaugccaucaugaacgcugggcaagaggagggcauugacaauuucggaaccuaugccaugaacgcucucagacuggaaaaagccuuucgggcguggggccuugagaugaauugugauacaaacccucuggaagccgggcucgaguacuucgugaagcugaauaagcccgcugacuuuaucggaaaacaggcccugaagcagaucaaagcuaagggccuuaaaagacgccucguuugccugacccuggccacagaugacguggauccugaagggaacgaguccauuugguauaauggaaaggucgugggcaacaccacgagcggcuccuacucuuauagcauccagaaaucccucgccuucgcuuacguucccgugcaacugucugaggucgggcaacagguggaaguggagcuucugggaaagaauuacccugcggucauuauccaggaaccccucguucugaccgagccgacacggaacagacugcagaagaaaggcgggaaggacaaaaccuga

SEQ ID NO: 68406 - RNA, 273 nt, Artificial Sequence
  derived and/or modified sequence opt5 from DMKN__Homo_sapiens__NP_001030593
augaacaugaagcccgccaccgcuagcgcccugcuccugcuucugcucggccuggcguggacacaggggucccacggauggggcgcugacgccucuagccuucaaaagagagccgggcgggcugaucagaauuacaacuauaaucagcaugccuacccuacggcuuauggaggcaaguacuccgugaaaaccccggccaaagggggagucucucccagcuccucugcgagccgcguucagccuggccugcuccaaugggugaaauucugguga

SEQ ID NO: 68407 - RNA, 1494 nt, Artificial Sequence
  derived and/or modified sequence opt5 from DMP1__Homo_sapiens__NP_001073380
augaagaucagcauucugcucauguuccuguggggccuuuccugcgcccugcccgugaccagauaccagaacaaugagucugaagacagcgaggaauggaaagggcaccucgcucaagccccuacaccgccccuggcgaacgaggauccuuccgacucuacgcagagcgaagagggacuuggcuccgaugaccaucaguauaucuaccggcuggcugggggauuuucucgcagcaccggcaaagggggagaugacaaggaugacgaugaggacgauuccggcgacgauacauucggcgacgacgauagcgggcccggaccuaaggacagacaggaaggcgggaauagccggcucggauccgaugaggacagcgaugacaccauucaagccucugaagaguccgcuccccagggccaggauagcgcccaggacacaaccucugagucccgcgaacuggauaacgaggacagagucgauagcaaaccugaagggggagacuccacacaagagucugaaagcgaggagcacuggguuggcggcggguccgacggagaaagcucucauggcgauggguccgagcuggacgaugaaggaaugcagagcgacgauccggagucuauccggagcgaacgcggcaauuccagaaugaacucugccgggaugaagucuaaggaguccggagagaauagcgaacaggcuaacacccaggacucuggcggcucccaacuccuggagcaccccagccggaaaauuuuucgcaagucuagaaucuccgaagaggaugaccggagcgaacuugaugacaauaacacgauggaggaggugaaauccgauucuaccgaaaauagcaacucccgcgacacagggcugucucagccuagacgggauagcaagggagacucccaggaggacagcaaagaaaaucucucucaagaggagucccagaacguggauggccccagcucugaauccagccaggaggccaaucugucuagccaggaaaacuccagcgagucucaagaagaggucguguccgagagccgcggggacaacccugaucccaccacauccuauguugaagaccaggaggauucugacagcuccgaagaggauucuagccauacccuuucccacucuaagagcgaauccagagaggagcaggcggacagcgaaucuuccgagagccugaauuucucugaagaguccccggaaagcccugaggaugagaacucuuccagccaggaaggacuccaaucccacagcucuagcgccgagucccagucugaagagagccauuccgaggaagacgauucugacagccaggauuccucucggagcaaggaggacuccaauagcacggaaucuaaauccagcucugaggaagacggccagcugaagaacaucgagauugaguccagaaaacugacaguggaugcuuaccacaauaagcccaucggggaccaagaugacaacgauugucaggacggcuauuga

SEQ ID NO: 68408 - RNA, 1875 nt, Artificial Sequence
  derived and/or modified sequence opt5 from DMPK__Homo_sapiens__NP_001075029
augagcgccgaggugagacugcggcgccuccagcaacugguccuugaccccggcuuccuggggcucgaaccucugcuugaucugcuccugggaguucaccaggagcugggcgcuuccgaacucgcccaggacaaguacguggcggauuuucugcagugggcugagccgaucguggucagacuuaaagaagugcggcugcaacgcgacgauuucgagauucucaagguuaucgggagaggagccuuuucugagguggccgucgugaaaaugaagcagaccggccagguuuaugcuaugaaaauuaugaacaagugggacaugcugaagagaggggaagugagcugcuuccgcgaggaaagagauguccuugugaauggagaccggcgcuggaucacacagcugcauuuugccuuccaagaugagaacuaccucuaucuggugauggaguacuaugucggcggcgaccugcucacgcugcuuuccaaauuuggggaacggauucccgcugagauggcccgguucuaccuggcggaaaucguuauggccaucgauucugugcaccgccucggauaugugcauagagacauuaagccugauaauauccugcuugaccgguguggccacauucgccuggcugacuuugggagcugccucaaacugagagccgauggaaccguccggucccugguggcuguuggcacacccgacuaccucucuccugagauccugcaggccgucgggggaggccccggcaccgggagcuacggaccugaaugugauuggugggcgcuuggcguguucgccuaugagauguuuuacgggcagacaccguucuaugcugacuccaccgccgagacauacggaaagauugugcauuauaaagaacaccugagccucccccugguugaugagggcgugccugaagaggcuagagacuuuauccagcgccuucugugcccucccgaaacccggcucgggagaggaggcgccggcgauuuccgcacgcaccccuucuuuuucgggcuggacugggauggacugcgggacucugucccgccuuuuacccccgauuucgagggcgccacagacaccuguaacuuugaccucguggaggaugggcugacagcuauggaaacccuuuccgacauuagagagggagcgccucugggcguccaucuccccuucgugggguacagcuauucuugcauggcccugcgcgauuccgaaguucccggcccuacgccgauggagcuggaagcugagcaacuucucgagccccacgugcaggccccuagccuggaacccucugucuccccucaggacgagacagccgaaguggcuguucccgccgcggugccggcugccgaggccgaggcugaagucacccugcgggagcuccaagaagcccuggaggaagaggugcuuacaagacagagccugucccgcgagauggaagcuauccggaccgauaaucagaacuuugccucucagcucagagaggcggaagcccgcaaucgggaccuggaggcucaugugagacaacugcaggaacggauggagcuucuccaggccgagggagcuaccgccguuacaggcgucccuagcccccgcgcgacggauccucccucccaccuggacgggccucccgccguggcugugggacaguguccgcuggucggcccugggcccaugcacagacggcaucuccugcuucccgccagagugccucgcccgggacugagcgaagcucucucucugcugcuuuucgccguugugcucucccgggccgcugcgcugggcugcaucgggcuggucgcccacgcuggccaacucaccgccguguggagacgccccggagccgcuagagccccuuga

SEQ ID NO: 68409 - RNA, 1122 nt, Artificial Sequence
  derived and/or modified sequence opt5 from DMRT1__Homo_sapiens__NP_068770
augcccaacgacgaggccuucagcaagccuuccaccccgucugaagcuccccacgccccuggcgugcccccucaggggagagcgggaggcuuugggaaagcuagcggagcccuggucggcgccgcuuccgggucuagcgccggaggcuccucucggggcgggggaagcggcuccggggcuagcgaucucggagccggcucuaagaaaagcccccgccugccuaagugcgcgagaugucggaaucauggguacgccuccccgcuuaaaggacacaagcgcuucugcauguggagagacugucaaugcaagaaauguaaccugaucgcugagcggcagcgcguuauggccgcucagguggcccucagacggcagcaagcgcaggaagaggaacugggcauuucucaucccaucccucuucccuccgccgcugagcugcucgugaagcgcgagaauaacggcagcaauccuugccugaugacagaauguucugggacgucccagcccccgccugccagcguccccaccacagcugccuccgagggaagaauggugauucaggauaucccugccguuaccucucggggccacguggaaaacacacccgaccuggucagcgauuccaccuauuacagcucuuuuuaucaacccucccucuucccuuacuauaauaaccuguacaauugcccgcaguauagcauggcucuugcggccgacucugcuagcggggaggugggaaacccccugggcggguccccuguuaaaaauucucuccgcggacugcccggcccuuacgugcccggccagacagggaaccaguggcaaaugaagaauauggagaacagacaugccaugagcucccaguaccggaugcacagcuauuacccgccucccucuuaucuuggacaguccgucccucaauuuuucaccuuugaagaugcccccagcuacccugaggcucgcgccucuguguucuccccgcccagcucccaggacucuggccuggugagccucuccucuagcuccccuauuagcaauaaaucuacgaaggcgguccuggaaugugagcccgcuuccgaacccagcucuuuuaccguuacaccugugaucgaggaggaugaauga

SEQ ID NO: 68410 - RNA, 1164 nt, Artificial Sequence
  derived and/or modified sequence opt5 from DMRT2__Homo_sapiens__XP_006716781
auggacaagaaaggccugagcgggaagcagaacaauuucgagagaaaagccguguaccaacggcagguccgcgcucccucccuccuggccaagucuauccuugaaggauauagaccuauuccggcggagaccuacguuggcgggacauuuccccugccucccccugugagcgaucggaugcgcaaaagacgggcuuucgccgacaaggaacucgagaacaucaugcuggaacgcgaguauaaggagagagaaaugcuugagacgucccaggccgcugcccuguuucuccccaaucggauggugccuggaccggauuacaacucuuauaaaagcgcuuacucccccucuccugucgaacccccuagcaaggacuucugcaauuuucugcccaccugucuggaucucacaaugcaguauuccggcagcgggaacauggagcugauuucuuccaaugugagcguugccaccacauaccgccaauacccgcuuucuuccagauuccugguguggccuaaaugcggacccaucagcgacacccuccuguaucagcagugucuucugaacgcgacaaccucuguccaggcccucaagccuggcgcuuccugggaucugaaaggcgcccgggugcaagacgggcugagcgcugagcaggauaugaugcccuccaagcucgaaggaucucugguucuuccccacacgccugagauucagaccacacgcagcgaccugcagggccaucaagccgugccggaaagauccgcguuuucucccccucggcgcaauuucagccccaucgucgauaccgacucccucgccgcucaggggcacgugcugacaaagaucagcaaagagaacaccagacauccucuuccccugcggcacaauccguuucauucucucuuccagcaaacgcugacagauaagagcggaccugaacugaaaacccccuuugugaaggaggccuucgaggaaacaccuaaaaagcacagagagugccucgucaaagacaaccagaaguacaccuuuaccauugaccgcugugcuaaggaucuguucguugccaaacaggugggcacaaaacuuuccgugaaugaaccccugucuuucagcgucgaguccauccucaagcggccuagcucugccauuacgagagugucccaguga

SEQ ID NO: 68411 - RNA, 1419 nt, Artificial Sequence
  derived and/or modified sequence opt5 from DMRT3__Homo_sapiens__NP_067063
augaacggcuacgggagccccuaucuguacaugggaggcccugugucccagccgcccagagccccucuccaacggacccccaagugcgcucgcuguagaaaucacgggguccugucuuggcuuaaaggacauaagcgguauugccgcuucaaagacuguacaugcgagaaguguauccugauuaucgaaagacagcggguuauggccgcucagguggcucuccgcagacagcaagccaacgagagccuggaaucccuuauuccugauucucugcgggcccuccccggcccuccgcccccuggggacgcuguggccgcuccccagccucccccggccagccagccuucccagccccaaccuccccgccccgcggccgagcuggcugccgcugccgcgcugagauggacggccgaaccucagccgggagcucuccaggcccagcuggcuaaacccgaucuuaccgaggagcggcugggcgacggcaagucugccgauaauacagaagucuuuagcgacaaggauaccgaccaacgcuccagcccugauguggccaaaucuaaggggugcuucacacccgaguccccugaaaucguuagcguggaggagggaggcuacgcuguccagaaaaacgggggaaaucccgaaucuagaccggacuccccuaagugucacgcggagcagaaccaucuccugauugaaggccccagcgggaccgugucucuuccuuuuucccugaaagccaaucggcccccucucgagguucugaagaagaucuuccccaaccaaaaaccgacagugcuggaacucauccugaagggaugcggcggcgaucuugucagcgcuguggaggugcugcucuccucucgcagcuccgucaccggggccgagagaacgagcgccgaaccugagucucuggcgcuucccuccaauggacacauuuuugaacauacccugagcucuuaucccaucagcuccucuaaauggagcguuggcuccgccuuccgggugccugacacacucagauuuagcgcggauucuuccaacguggucccgagcccccuggcugggccucugcagcccccuuucccccagccuccccgcuacccgcucaugcugcggaauacccuugccagaucucaguccagcccuuuucugcccaacgacgugacacucuggaauaccaugacgcugcaacagcaguaucagcuucgcucccaauacguuucuccuuuccccagcaacuccacaucuguguuucggagcuccccgguccugccugccagagcuaccgaggacccccgcauuagcaucccugaugacggaugucccuucgugucuaagcaguccauuuacacagaagaugacuaugaugagcggagcgacucuuccgauagcagaacccucaauaccucuagcuga

SEQ ID NO: 68412 - RNA, 1515 nt, Artificial Sequence
  derived and/or modified sequence opt5 from DMRTA1__Homo_sapiens__NP_071443
auggagagaagccagugcggcucccgggaccgcggggugucuggaagaccccaccuggccccuggccucgucguugcugccccgcccccucccagcccugcgcugcccgugccuuccgggaugcaagugccgcccgcuuuccuucggccucccucucuguuucuccgcgccgccgcugccgcugccgcggccgcugccgcuaccagcggauccggcggguguccucccgccccgggacuggaaucuggcgucggcgcgguggggugcggauacccuagaacacccaagugugcccggugccgcaaccauggcguugugagcgcucuuaaagggcacaagagauucugucgguggcgcgauugcgccugugcuaaaugcacgcugaucgccgagagacagcgggucauggccgcucagguggcgcuccgcagacagcaagcccaggaagaguccgaagcucggggacugcagcgccugcucuguagcggccugucuuggccucccgggggcagagccuccggcggcgggggacgggccgagaauccccagagcaccggcgggccugcugccggagcggcucuuggccugggggcccucagacaagccucuggauccgcuacaccggccuuugagguuuuccagcaggacuaucccgaagagaagcaggaacaaaaagagagcaagugcgagucuugucagaacggccaggaggaacugaucuccaagagccaucaacuuuaccugggcuccucuagccgcuccaauggggugaucggaaaacagagcauuggaucuuccaucagcgaauauucuaacaagccugauagcauucucagcccccacccuggggagcagucuggaggcgaagagagcccccggucccuguccucuuccgaccuggagagcgggaaugaaucugagugggucaaagaucucaccgcuacaaaggccucccugccgaccgugagcuccagaccucgcgacccccuugauauccugacaaaaaucuuuccuaacuaccggagaucucgccucgaaggcauucugcgguucugcaagggagacgugguccaggcgaucgagcaaguucuuaauggcaaggaacauaaacccgauaacagaaaucuggccaacagcgaggagcucgaaaauaccgcuuuucagcgcgccuccucuuucagccuggcugggauuggauuuggcacgcuggggaacaaguccgccuucagcccucuccagaccacaucugcguccuauggaggcgacagcucucuguacggggugaauccccgggugggcaucuccccgcuuagacuggccuauagcucugcuggacgcggccucagcggguuuauguccccuuaccugacccccggacuuguccccacacugccuuuccggccggcccucgauuacgcuuuuagcggcaugauuagagacucuuccuaucugagcuccaaagauucuauuaccugcgggcggcuguacuuccgccccaaccaggacaauccuuga

SEQ ID NO: 68413 - RNA, 2019 nt, Artificial Sequence
  derived and/or modified sequence opt5 from DMTF1__Homo_sapiens__NP_001135798
augaccgccacaacggagguggcugacgaugaagucaccgagggcacaguuacccagauccaaauucugcagaacgaacagcucgacgagaucagcccccuggggaaugaagagguguccgccgugucucaggcgugguucacaaccaaggaggauaaagacagccuuacaaacaagggacacaaauggaagcaaggcaugugguccaaagaagagauugauauccugaugaauaacauugaaagauaccucaaggcucgggggaucaaggacgccaccgagaucauuuuugagaugucuaaagaugaacgcaaggacuucuauagaacgaucgccuggggacugaaucggccucuuuuugcugucuaccgcagagugcugcggauguaugaugaccgcaaccauguuggcaaauacaccccggaggaaauugagaagcucaaagaacugagaaucaagcacgggaaugauugggccacaauuggagcugcccugggccggagcgcguccucugugaaggaccgcugcagacucaugaaagauaccuguaacacaggcaaguggaccgaggaggaagagaaacggcuggccgaagucgugcaugagcuuacgagcacagaacccggggacaucguuacccagggaguguccugggcugccgucgcugagcgcgugggcacaagaagcgagaagcagugccggucuaaauggcugaauuaucucaacuggaagcaguccgggggaaccgaauggaccaaagaggacgaaauuaaucugauccuucgcaucgccgagcuggauguggcggacgaaaacgauauuaauugggaccuccuggccgagggcuggagcucugucagauccccucaauggcugcggagcaagugguggacaaucaagagacagauugcuaaccacaaagauguuucuuuccccgugcucaucaaggggcugaaacagcuucaugagaaucagaagaacaacccuacgcugcucgaaaauaaauccggaagcggcgugcccaacuccaauaccaacucuagcguccaacacgugcagauucgcguugcccggcuggaggacaauacagcuaucuccagcucuccuauggccgcccuucagaucccggugcaaauuacccacgucuccagcgcugauucucccgcgacaguggacagcgaaaccaucacgcugaacuccggcacacuccagaccuuugagauucugccuucuuuccaucugcagcccaccgggacaccuggaaccuaccuccugcagacaagcuccagccaaggccuuccccugacgcucaccgccucuccgacaguuacccugacagcugccgccccugcuucccccgagcagaucauugugcacgcccuuagcccugaacaucugcucaauaccucugauaacgucacggugcagugucacacccccagagucaucauccagacaguggcgaccgaggacauuacauccagcaucucccaagcugaacugaccguugauucugacauucagagcuccgacuuucccgagccuccggaugcccuggaagccgacacguuccccgaugagauccaccauccuaagaugacaguggagcccucuuuuaaugacgcucacgucagcaaguucuccgaucagaacagcaccgaacucaugaacucugugaugguucgcacagaggaagagauuuccgacaccgaucugaaacaggaagagagcccuucugaccuugccuccgcuuaugugaccgaggggcuggaaagccccacaaucgaggaacaagucgaucagacgauugacgaugagaccauccucaucgugccgucuccucauggauuuauucaggccagcgacgugaucgauacagaauccguucugccccugaccacacuuaccgacccuauucuccagcaccaucaagaggagagcaauaucauugggucuucccugggcagccccgucuccgaagacucuaaggauguggaggaccuggugaauugccacuga

SEQ ID NO: 68414 - RNA, 1077 nt, Artificial Sequence
  derived and/or modified sequence opt5 from DMTN__Homo_sapiens__NP_001107611
auggagagacugcagaaggccaaaauggacaaccaagugcucggcuacaaggaucuggcugccauccccaaagacaaggcgauucuugauaucgaacggccugaccugaugauuuaugagccgcacuucaccuacagccuccuggaacaugucgagcuuccccgcuccagagaacggucucugagcccuaaauccacaucucccccucccagcccugagguuugggcugauucccgcucuccggggaucauuagccaggccuccgcccccagaacgaccggaacaccucggaccagccucccccacuuucaucacccugagacaucucgccccgacuccaauaucuauaagaagccgccuaucuacaaacagagagaaagcgugggcgggucuccccagaccaagcaucugauugaggaucugaucauugaauccagcaaauucccugcugcccaaccucccgaccccaaccagccggcuaagaucgagacagauuauuggcccugcccucccucucucgccguggucgagaccgaauggcggaaacgcaaggcguccagacggggagccgaggaagaggaagaggaggaagacgaugacagcggcgaggaaaugaaggcucugcgcgagagacagcgggaggagcuuuccaaagugacgucuaaucuggggaagaugauucucaaagaggaaauggaaaagagccugccuauccgcagaaaaacccggucccuucccgauagaacaccguuucacaccagccugcaccagggaacaucuaaguccagcucucucccugccuacggccgcaccacgcugagccggcugcaauccacagaguucucucccagcggcuccgaaaccgggagcccuggacuccagauuuaucccuacgaaaugcugguugugacaaacaaaggcagaaccaaacuuccucccggggucgaccgcaugcggcuggagagacaucucucugcugaggacuuuucccgcguguucgccaugagcccggaagaguuuggaaagcuggcgcuuuggaagcggaaugaacugaagaaaaaggccucucucuucuga

SEQ ID NO: 68415 - RNA, 2025 nt, Artificial Sequence
  derived and/or modified sequence opt5 from DMWD__Homo_sapiens__NP_004934
auggccgcuggcggggccgagggaggcagcgggcccggagcggcuaugggcgacugcgccgaaaucaagucccaguucagaacccgggagggguuuuacaaacugcucccuggagauggcgccgcucgcagaucuggcccggccagcgcucaaacacccgugccuccccagccuccccagccuccgcccgggccugccuccgcgucuggacccggcgccgcugggccugccagcucucccccgccugcuggacccggcccugggcccgcccugcccgcgguccggcuuucccugguucgccucggagaaccugacagcgccggcgcuggcgagccgcccgccacgccugcugggcugggauccggcggggauagaguguguuucaaccuuggacgggaacuguauuuuuaccccggcugcugucgcagagggagccagcggucuauugaccucaauaagccuaucgauaaacgcauuuauaagggaacccaacccacaugccacgacuucaaccaguuuaccgccgccacagagaccaucucccugcuggugggcuucagcgcuggccagguccaguaccucgaucugauuaaaaaggacacaucuaaacuuuuuaaugaggaaagacugaucgauaagaccaaggugacguaucucaaauggcugccggaguccgaaagccuuuuccuggcgucucaugccuccgggcaccucuaccuguauaacguuagccauccuugugcuuccgcucccccucaauacucucugcucaagcagggagagggcuuuagcguguacgccgccaaauccaaggcgccccggaauccucuggccaagugggcugucggggagggaccccuuaacgaguucgccuuuagcccggacggccgccaccuggccugcgugucucaggaugggugucucagaguuuuccauuuugacuccaugcugcuucggggccugaugaaaagcuauuucggaggccuccugugcguguguuggucuccugaugggcgcuacgucgugaccggaggcgaagacgaccuggugacagucuggagcuucaccgaagggagaguuguggcucggggacacggccacaaguccugggugaaugccgucgcuuuugaucccuauacaaccagagccgaggaagcggccacggcugccggggcugacggcgagcgcucuggagaggaagaggaagaggaacccgaggccgcgggcacagggagcgccggaggcgcuccucucuccccgcugcccaaagccgggagcaucaccuaccgguucggaucugcuggccaggauacacaauuuugccuuugggaccugaccgaggaugugcucuauccucaucccccucuggccagaacccgcacacuucccgggacgccuggcaccacacccccggccgcuuccagcucucggggaggcgaaccugggcccggaccucugcccagaucccucagccgcuccaacucucugccgcacccugcgggcgggggaaaggccggcgggcccggcguugcugccgagccuggaacccccuucagcauuggccgguuugccacacugacccuccaggaaagacgcgacagaggggcugagaaagaacauaagcgguaccacucccugggaaauaucucucgcggcgggagcggaggcuccggcagcgggggagagaaacccucuggcccugugccgcgguccagacuugaucccgccaagguccuggggacggcgcucuguccucggauucacgaggugccccugcuggaaccucuuguuugcaagaaaaucgcucaggagcgccucacagugcugcuguuccucgaagacugcauuaucaccgccugucaagagggacugauuugcaccugggccagacccggcaaggcuuuuacagaugaggaaaccgaggcccagacaggggaaggaagcuggccucggucuccguccaaaagcgucguggagggcaucucuagccagcccggcaacuccccuagcgggacggucguguga

SEQ ID NO: 68416 - RNA, 9147 nt, Artificial Sequence
  derived and/or modified sequence opt5 from DMXL1__Homo_sapiens__NP_001277250
augaaccugcaccaggugcucaccggcgccgucaaucccggggaccauugcuucagcguuggauccaucggcgaucaaagauuuacagcuuacgccucugggugugacauugugauccugggaagcgauuucgagcggcuucagauuaucccuggcgcgaagcacgggaacauucaggugggaugcgucgacuguuccaugcagcaaggcaaaaucgcugccucuuauggcaaugugaucagcauuuuugaaccgguuaaccugcccaagcagaaaaagaaucucgagcuguacucccaguggcagaaaucugggcaauucuuucuugaaagcaucgcccauaacauuacgugggauccuaccggaucccgccugcucacaggcagcucuuaucugcagcugugguccaauaccaaccucgagaagcccacagaagacgagaaucugaacaagaccgaucuuaauuucggggacuggaaaugcaucuggcacuguaagacagcuagccaggugcaucugaugaaauuuucuccugauggagaguucuuugccaccgcuggcaaggacgauugccuccugaaagucugguacaacguggaaaauuggagaacggccguuaccucccccgacgggagcucugagaagcagucccaaggagaaauugauuucagcuuuguguaucuugcgcacccucgggccgucaacggcuucuccuggcgcaagacaucuaaauacaugccgagagcuagcguguguaaugugcugcucaccugcuguaaggacaacgucugccggcuguggguugagacauuucugcccaacgacugucuccuguauggcggggauugcucccacuggaccgagagcaucaaucuuacgaacaauuucaaacgcaacgccucuuccaaggaaagagugcagaaugcucuggaggugaaccuccggcauuuccgcagaggacggcgcagaagccuggcccuugucgcgcacacaggcuaccugccucaucagcaagacccccaccacgugcaucggaauaccccucuccacgccaacgcucugugccauuuucacauugccgcuucuaucaaucccgccacagauaucccgcugcucccuagcauuaccucccugucucuuaacgaaaaugaggaaaaaaccgggcccuucguugugcauuggcugaacaauaaggagcuccacuuuacacugagcauggaggucuuccuucagcagcugcgcaaauccuuugaacagccuagcucugaggccuccguggaagacagcaaccaagcugauguuaagucugacgaggaaacggaugacggaguggaugaccucaagaucaaucccgagaaaaaggagcugggcugugauaaaaugguccccaacuccagcuucaccucccugucuagcgcggccauugaccaccagaucgaagugcuccuguccgaguggucuaagaacgcugacaugcuuuuuagcauucauccuauggaugggucccugcucgucuggcacguggacuggcuggaugaauaccagccgggaauguucagacagguucaagugagcuuugucucucggauccccguggccuucccuacaggcgacgccaauucccugugcaaaagcaucaugauguaugcuuguaccaagaacguugaucuugccauucagcagggcaagcagaaacccucugggcucacaagauccaccagcaugcugaucucuagcggacauaauaaguccagcaacucucugaaacucuccauuuuuacgccuaaugugaugaugaucagcaagcacgcggacggcucccugaaccaauggcuugucucuuucgcugaggaaagcgccuuuuccacagugcugucuauuagccacaaaucccgcuacugcgggcaucgguuccaccucaaugaucuggccugucauucugugcugccccuucuccugaccaccagccaccauaacgcucugagaacaccggacguugauaauccugagcagcccuucgacgcccucaacaucgaggaaugcucccugacccagcagaauaagagcacagucgauguggcuuuucaagacccuucugccguguauuccgagcuuauccuguggcgcgucgaucccgugggaccucucagcuucucuggcgggguuuccgaacuggcgcggauuaacagccugcacgugucugccuuuuccaaugucgcuuggcuucccacgcucaucccgagcuacugucugggcgccuauugcaacuccccuagcgcuuguuucguggccucugacggacaguaccugagacucuaugaggcgguuauugacgccaagaaacugcuuagcgagcuguccaaucccgaaaucucuaaguacgugggcgaggucuuuaacauugugagccagcaauccaccgcucgccccgggugcaucauugcccucgauccuaucacaaaacugcacggacggaagacccagcugcuucauguuuucgaagaggacuuuauccucaacaaucuggaaaaaaagucucugggcaaggauagcauucucuccaacgcugggucuagcccgaauggauucuccgagaaauuuuaccugaucgugauugaguguacacaggacaacagaagccuucugcacauguggaaucuccaucugaagucuauccccgucucccuggaugaaaaaguggacaccaagcuuagcgaggccguguggcagccugaagagcacuauucuuccagccccgaaaaaauucuguccccuuucucucaaaaguaccaggccugccgcgcuaaccuccagagcacgucccggcugacccucuuuagcgagauggucuauucucaggagcugcaucuucccgaaggcguugagaucaucuccauuaaaccuagcgcggggcaccugucuagcuccucuaucuaccccgccugcagcgcuccguaucuccuggccacauccuguucugaugaaaaggugagauucuggcgcugccgggugaccgacggcgagagcgccacauccaagaauggaaaaauugaucuggcuuacaucugggaagaguggccucuucugauugaggacggccuccaaagcaacucuuccaucaccguccccgggagaccuguggaaguuagcugugcccacacgaaucggcuggcgguggcuuauaagcagcccgccuccaacucucgcagcucccaggauuuugucaugcaugugucuaucuucgagugcgaaagcacaggaggcuccuguuggguucucgagcagaccauucaccuggacgagcuuagcacagugcuggauucugggaucuccgucgacagcaaucucguggccuacaacaaacaagacauguaccugucuuccaaggaaaauauuaccagcaacaccaaacaucugguucaccuugauuggaugucuagagaggacggaagccacauccugacagugggcauuggguccaagcucuucauguauggcccgcuggcuggaaagguccaggaucagacgggcaaagaaacccucgccuuuccucugugggagucuacaaagguggugccccuuagcaaauucguccugcugcgguccguugaccucgugagcuccguggaugggucuccucccuuucccgucagccuguccugggugagagacggaauccuuguugugggcauggauugcgaaaugcaugucuacugucaauggcagccuucuagcaagcaggagccggugaucaccgacuccuauucugggagcacacccuccauuaccagccugaucaaacagucuaauuccagcucuggacuccacccucccaagaagacgcugacacgcuccaugaccagccucgcgcaaaaaauuugcggcaagaaaaccgcuuucgauccuucuguugacauggaggauuccgggcuguuugaagccgcccaugugcuuagccccacacugccucaguaccacccgcugcagcuccuggagcuuauggaccugggcaagguccggagagcuaaagccauccucucccaucuggugaaguguauugcuggagaagucguggcccucaacgaggcggaaagcaaccacgagcgcagacugcggucucuuaccaucagcgccuccggcucuacaacgcgcgacccccaggcuuucaauaaggccgagaacaccgauuauacagaaauugacagcguuccuccccugccucuguacgcucuccuggccgccgaugacgauuccugcuauucuagccuugagaaauccucuaaugaaagcacccuguccaagagcaaccaacucucuaaagaguccuacgacgaacuguuucagacacagcuccugaugaccgauacgcacaugcuugagaccgacgaggaaaauacaaagcccagagugaucgaucugagccaguacucuccgaccuauuucgggccugagcaugcucaaguccuguccggacaccuccugcauagcucccuucccggccugucucggauggaacagaugagccucauggcgcuggccgacacaaucgcuaccacauccaccgauauuggggagagccgcgacagaucucagggaggcgagacgcuggaugaauguggccucaaauuucuucuggccgugcggcugcacacauuccucaccaccucccugcccgccuaccgcgcucagcuucugcaccaagggcucagcacaucucauuuugccugggcguuccacagcguugcugaggaagagcugcugaacaugcucccugccaugcagaaggacgaccccaccugguccgaacuuagagccaugggagugggcugguggguccggaauacgcgcauccugagaaaaugcauugagaagguggcuaaggccgcguucuaucggaaaaacgauccucuggacgcugccaucuuuuaccucgccaugaagaaaaaggcugugauuugggggcuguauagagccgagaaaaauacacgcaugacccaguucuuuggacauaacuucgaagaugagcgguggagaaaggcugcccuuaagaaugcguuuucucugcucggcaaacaacgcuucgaacacagcgccgcuuuuuuccugcuggccgggugccuccgggacgcuaucgagguuugucuugaaaagcugaacgauauccagcuggcccucgucauugccagacuguacgaguccgaguuugacacaucugcugcguauaaaagcauccuucgcaagaaagugcugggaauugauuccccggugagcgaacucugcucucugaauaucaacaugcaucacgaccccuuccugcgguccauggccuacuggauucucgaggauuacagcggcgcucuugaaacccugaucaagcagccuaucagagagaaugacgaucagguccuguccgccucuaaccccacaguguuuaauuucuauaacuaccuccgcacccacccucugcuucugcggagacauuuuggcagcuccgacacguucucuacccacaugagccucacagggaaguccggacuggccggcaccauuaaccugagcgaacggcgccucuucuuuacaaccgcuucugcccaucuuaaagcggggugucccaugcuggcucuggagguucucuccaagaugccgaaagugaucaagaaaacgagaccuuucuaucgggccagcucuuuucuggauacauccaaggacugcagccccucuuccccucuuaagcuggacgcccgcgaggauaaaagcucugcugucgacuggagccaaucccucauuaauggauucggcagcuccucugaagggagcuccgagaagcagucuaacagcacccuguccuuugauuggucucagcccagcgugguuuuccaggacgauucccuggaacucaaaugggacagcgauaaugacgaggagaacgaagaugugccuaucucuaugaaggagcuuaaaccccugcaaagaaagacagacaagaaacuggaugacauuuccagcaauuacaccgaaucuuuuuccacccucgacgagaacgaucugcuuaauccgagcgaagacaucauugccguccagcugaaguuccgggcgugucucaaaauccugacaguggagcugagaacgcucucuaccggauaugagaucgauggcggcaagcuucgcuaccagcuguaucacuggcuggaaaaagagguuauugcccuccagcggacaugcgacuuuuguuccgaugcugaagagcugcaaagcgccuucgggagaaacgaagacgaguuuggacuuaaugaggaugcugaagaccugccucaccagaccaaggugaaacagcuccgcgagaacuuccaagaaaagcggcaguggcugcugaaguaccagucucuccuuagaauguuucuguccuacugcauccugcauggcagccacgggggaggccucgccagcguccgcauggagcugauucuucugcuccaggaaucccaacaggagacaucugagccccuguucagcuccccccugucugaacagaccagcgugccucuccuuuucgcuuguacggccaaugcgaaaacaguggucgccaacccgcugcugcaucucuccaaucugacccacgauauccuucaugcuauuaucaacuuugacucucccccucaccccgauauccagagcaauaagguuuaugugaugcacacccuggccgcuucccucagcgccugcauuuaccaaugucugugcgggucucauaacuauuccagcuuccagacaaaccaguuuaccggaaugguguaccagacaguccugcucccucaccggcccucucugaaaacgggcucccuugacgaggcccugaccccuaauacaagcccggcucaauggcccggcaucaccugccucauuagacugcuuaacuccucuggggaagaggcgcagagcggacugacagugcuccugugugagauccugaccgccguuuaucucucccuguucauucauggccuugcuacgcacucuagcaaugaacuguuucgcaucguggcccauccucucaacgagaagaugugguccgccgucuucgggggaggcgcucacgugcccagcaaagaacagacccacucuaagacacugccuguuuccagccuuguggaggaaggggagaagcagaauaaaagauuucggcccucuaagaugagcugccgcgaguccgccccgcugaccccuucuagcgcgcccgucucccaagaaagccucgccgugaaagagaaguucauccccccugaacugucuauuugggauuacuuuaucgcuaaacccuuccugccuuccagccaguccagagccgaguaugacucugaagagagccucggauccgacgaugacgauaacgacgaugacgaugacguccuggcuucugauuuucaucuucaggagcacagcaauuccaacucuuacagcuggucccugaugcggcucgccauggugcaacugguucuuaauaaccugaagacauucuacccguuugcgggccaugaccucgccgaacugcccgugagcucuccucugugucacgcugugcucaagacccugcagugcugggagcagguccuucugcgcagacucgaaauucacggcgggcccccucagaauuauaucgccucccauacagcugaggaaagccugucugccggacccgcuauucuucggcacaaagcccugcucgagccgacgaacaccccuuucaaguccaaacaucaccuggcgcugagcguuaagagacucuggcaauaccuggugaaacaggaggaaauccaggagacauucauuaagaauaucuuuaccaagaaacgcugucuuaacgaaucucuggaggauaauagcgagaccaucaagaacuccaugauggaagagcccaacauuaauaaaaucgaagccgaccucggcuauccugggggaaaggcucggauuauccauaaagagagcgacauuaucacagccuucgcugugaacaaggccaauagaaacugcaucgccauugcguccucucacgauguccaggaacuggacgugagcggcauccuugcuacgcaaguuuacaccuggguggaugacgauauugaggucgagacaaaaggguccgaagacuuucuggugauccacgcccgcgaugaccucaccgcuguccagggaacaacccccuauacgcauucuaauccuggcacacccauuaacaugccguggcugggcagcacccagaccgggcggggagccuccgugaugaucaagaaggccaucaauaacguuagacggaugacaucucacccuacccugcccuacuaucucacaggcgcucaggaugggagcgugcgcauguucgaguggggacauucccaacagauuaccuguuuuagaagcggcgggaauucucgggucacgcgcaugagauucaacuaccagggaaauaaauuuggcaucguggacgccgauggcuaccugucccuuuaucaaacaaacuggaagugcugucccguuaccgggagcaugccuaaaccguaccugacauggcagugccacaauaagaccgcgaacgacuucguguuugucucuuccagcucucucauugccacggcuggacuguccaccgauaaucggaacgugugucuuugggacacacugguggcccccgcuaacagccucguucacgccuucaccugccaugacucuggcgcgacaguccuggccuaugcuccuaaacaccagcugcucaucuccgggggacgcaagggcuuuaccuacguguucgaucugugccagagacaacagcggcagcuuuuucagagccaugacucccccgugaaggccgucgcuguugauccuacagaagaguauuucgugaccgggagcgccgaaggcaauauuaaaaucuggucucugagcacguucggacuccugcacacauuuguguccgagcaugcucgccaaucuauuuucagaaacaucggcaccggggucaugcagaucgagaccggacccgccaaucacauuuuuagcuguggcgcggacgggacaaugaagaugcggauccuuccugaucaguucuccccccugaacgaagugcucaaaaaugacguuaaguuuaugcuguga

SEQ ID NO: 68417 - RNA, 9114 nt, Artificial Sequence
  derived and/or modified sequence opt5 from DMXL2__Homo_sapiens__NP_001167587
augcaucugcaccaggugcucaccggcgccgucaaccccggggacaauugcuacagcguuggguccgugggcgaugugccuuucacagcuuaugggucuggaugugacaucgucauccucgccaacgauuuugaaugcgugcagaucauuccgggcgcgaagcacgggaauauccagguuagcuguguggaaugcuccaaccagcagggacgcauugcugccucuuacggcaaugccgucuguaucuucgagccccuuggcaucaacagccauaagcggaauugccaacugaagugucaguggcucaagacggggcaguuuuuccuguccucugugaccuauaaccuugcuugggacccucaggauaaucgccugcucaccgccaccgacagcauucaacugugggcucccccuggagaugacauccuggaagaggaagaggagauugauaacacaguucccccugugcucaaugacuggaagugcgucuggcaguguaaaaccuccgugagcgugcaccugauggaauggucuccggauggcgaguacuuugccacagcggggaaggacgauugccuucugaaggucugguaucccaugaccggauggaaauccagcaucauuccucaggaccaucacgaaguuaagagacggcagucuuccacgcaauucagcuuuguguaccucgcccacccccgcgcugugaccggcuucucuuggagaaaaacauccaaguauaugccucgggggagcgucuguaacgugcugcuuaccuccugccaugacggaguuugccgccugugggccgagacacuccugcccgaggauugucugcucggcgaacagaucugcgagaccacgacaucuagcauugcuuccagccugucucacgccggcagacauaaagaccggauccagcacgcgcuugaaaccauccaccaucugaagaaucuccgcaaggggcaaagacgguccagcgugcuggucacacacgccgagcuuaugccggaucagaccgcuaugcaugaagugcagcgccacauuucucaucacgccaacgcucugugucacuuucauaucgccgccagcauuaauccugcuaccgacauccccaacguucucgugggaacagcguucaacgucgaugacggcaaugggggauuugugguccacuggcugaacaauaaagaguuccauuuuacguccucuaccgagguguucaugcaccagcugagaaagcucagcgauaaacaaguugaccacgaaaacgaugacgccgaucgggaggacgaagaacauucccaggaagaccgcgagagaggccugcacaugaaacuugaucaugaccugagccucgaucgggagucugaagcugggacaggauccagcgagcacgaagacggcgagagagaaggcucuccucgcaccuacucccggcugagcgugcccaugccccuuccuacaguccugcucgauagaaaaauugagacccugcugacggaguggaauaagaacccggacaugcuguucacaauccaucccguggaugggaccuuucugguuuggcacgugaaauaccuugacgaauauaauccuggaaucuuccgccagguccagguguccuuuucuagccggauucccguggccuucccuuccggcgaugccucuagccuguccaagaacaucaugauguacgcuugcauuaaugccaccaaggacagccaccauacacuccugcaccaagaggggaugucuguuggaagcccccauggcagccagccgcacucuagaucccauagcacccacaugaacauccuggcgccuacagucaugaugauuucuaaacacaucgaugggagccuuaaucagugggcugugacguuugccgacaaguccgccuucaccacagugcucaccgucagccauaaauuucgcuauuguggccaccgguuccaucugaacgaucuggcuugccacucugugcucccccugcuucugacauccagccaccauaaugcccuccugaccccugaacuggacugucagugggacuccgauaacaaacuuucuagacucauggaccccguuaaacacaucaagggaagcuccaagcaaccucugcgcaaugcugccacgcggaccuuucaugaucccaacgcgauuuacucugagcugauccucuggagaguggacccgauuggcccucugagcuauacagggggagucuccgagcuugcccgcaucaacucucugcacaccagcgcuuucuccaauguggccuggcuccccacacugauucccagcuacugccugggcaccuauuguaacucugcuuccgccugcuuuguugcgagcgaugggaaaaaucuucggcucuaccaggccguggucgacgcuagaaagcugcuggaugaacucucugacccugaguccagcaaacugaucggagaaguguucaacauuguuucucagcaguccacggcccggccgggcuguaucaucgagcuugaugcuauuacaaaucaaugcgggagcaacacccagcugcuccauguguuucaggaagacuucaucauuggcuacaagccccacaaagaggauauggagaagaaggaaacagagaucuucuuucaaccuucccagggauauagacccccucccuucagcgaaaaauuuuuccuggucgugauugagaaggacucuaauaacaauagcauccugcacauguggcaucuucaccucaaauccgugcaggccugccuggccaaggcuucugaaggcgcgagcuccgagucucugcucagcgucccugggcagaaaaacguugauuccucucccgagaccagcccguccgugagcccuaugccccauucuuccagcaucgccaaucugcaaaccgcuucuaaacuuauucuguccagcagacucguguacucccagccucuggaccugcccgaaucugucgaggugauccgggccacaccgagcgccggacaccuuuccuccucuuccauuuauccuguuugucuggcucccuaccucguggucacgaccugcagcgacaacaaggugagauuuuggaaauguugcauggaagccaauccugaguguaacaagucugaugaaaaagagaucuaucacuggaagcgcuggccccugaugaaugacgagggcgaagauaacagcuccacaguuucuauuguggggcggcccgucgcggugagcugcuccuacaccggaagacucgcuguugccuauaaacagccuauccaucacaacggcuucgugucuaaggaguuuagcaugcaugucuguaucuucgaaugcgaguccacagggggcagcgagugggugcuggaacagaccauucaccuugacgaucuggugaaagucggaucuguucucgacucccgcgugagcguggauuccaaucuguuugucuacucuaagagcgacgcccugcuuuccaaggauagauaccugaucccgaacauuaaacaucucgugcaccuggacuggguuucuaaggaggauggcagccacauccucacggugggggucggagcuaauauuuucauguauggccggcuguccgggaucgugacagaacaaaccaacagcaaagacggaguugccgugaucacccuuccccugggcgggucuauuaagcagggcgucaaaucccgcugggugcuccugagaagcaucgaccuggucucuuccguggauggaacaccuagccuucccguuucucugagcugggugcgggacggcauucucgucguggggauggauugugagaugcauguuuacgcgcaguggaagcacgcugugaaguuuggagacaccgaagccgauuccucuaaugccgaggaggcugccaugcaggaccauagcacauucaaauccaacaugcuggcucgcaagagcgucguggaaggcacggccaucuccgaugacguguuuugcucuccuaccguuauucaagaugggggacucuucgaggcggcccacguccugagccccacacuuccucaguaucacccgacccagcugcuggaacucauggaccugggcaaagugagacgggcuaaggccauccuuucccaucuggugaaauguauugcuggcgaggucgccaucgugcgcgaucccgacgccggggaaggaacaaagagacaccucucucggaccaucagcguuuccggcucuacggcuaaggagaccgugacagucgggaaagauggaacccgcgacuacacagagauugacagcaucccuccccugccucucuaugcgcugcuugccgcugaucaagacaccuccuacagaauuagcgaagagucuacaaagaucccccaguccuaugaagaucagaccgugagccagccggaggaccaauacucugaacuguuccagauucaggauaucccuacggacgauaucgaccuggagcccgagaaacgggaaaauaaguccaaaguuauuaaccucagccaguacggccccgccuauuuugggcaagagcaugccagagugcugucuucccaccuuaugcauagcucccugccuggacucacacgccuggaacagauguuccucgucgcucuggccgauaccguggcgaccacaagcaccgagcuugacgagucucgggauaagagcugcuccggcagagacacgcuggaugaaugcggccugcgcuaccuccuggcuaugcggcuucacacaugucugcucaccucucugcccccucucuauagaguucagcugcuucaccagggggugagcacaugccauuuugccugggccuuccacuccgaggcugaagaggaacugaucaauaugauuccggccauccaacgcggagacccccaguggucugagcugcgggcgaugggcauuggguggugggucagaaacaucaauacccuccgccgguguaucgagaagguggcuaaagccagcuuucagagaaacaaugacgcccuggaugcugcccuuuucuaccuguccaugaagaaaaaggcuguggucuggggacucuuucggucucagcaugacgagaagaugacaaccuucuuuagccacaacuucaaugaggaucgcuggagaaaggccgcgcugaaaaacgccuuuucccugcucggcaagcaacgguucgaacagagcgcugccuucuuucuucuggcugggucucugaaggacgccauugagguuugccucgagaagauggaggauauccagcuggccauggugauugcucgccuuuaugaguccgaguucgaaacgagcucuaccuacaucuccauucugaaccaaaagauccucggaugucagaaagacggcagcggcuuuuccugcaagagacugcauccugaucccuuccugcggucucucgcguauugggugaugaaagacuacacaagagcccuugauacccugcuggaacagacaccuaaggaggacgaugaacaccaggucauuaucaagagcuguaaucccguggcuuuuuccuucuacaacuaucuccgcacccacccgcugcuuauccggagaaaucuggccagcccugaggggacgcucgccacacugggacugaaaaccgagaagaacuuuguugacaaaauuaaucucaucgaacgcaaacuuuucuuuacaaccgcuaacgcccauuucaaagugggcugccccguccuggcgcuggaggugcucucuaagauuccuaagguuaccaaaacauccgcucugagcgccaagaaagaccaacccgauuuuaucucucaccggauggacgaugugccuagccauuccaaggcccuuucugacgggaauggaagcuccggcauugaauggucuaacgucacgagcucccaguacgauuggagccagcccaucgugaaagucgacgaggagccgcugaaucucgauuggggagaagaccacgauucugcucuggacgaggaagaggaugacgccgugggacugguuaugaaguccaccgaugcgagagaaaaggacaaacagagcgaccaaaaggccuccgauccuaacaugcuccuuacaccccaggaggaggacgaucccgaaggcgacaccgagguggaugugaucgcugaacagcugaaauuccgcgccugucugaagauucucaugacagagcugcggacccuugcuacgggcuaugaagucgacgggggaaaacugagauuucagcucuacaauuggcuggagaaggagaucgccgcucugcacgaaauuugcaaccaugagucuguuaucaaggaauauagcuccaaaacauacucuaagguggagagcgaucuccuugaccaagaagagaugguggauaaaccugacauuggcuccuaugagcgccaccagaucgaaagacggcgccugcaggccaagagagagcaugcggaacggcgcaaaagcuggcugcaaaagaaucaggaucuccugagagucuuccuuucuuacuguucccugcacggggcccagggaggcgggcucgcuagcgugcggauggagcugaaauuccugcuccaggagucucaacaggaaaccaccguuaagcagcuucaguccccgcugccccugccuacaacccucccccugcuuagcgccucuaucgcuuccacaaagacggugauugccaacccuguccuguaccucaauaaccauauccacgacauucuguauaccaucgugcaaaugaaaacacccccucacccgagcauugaggacgucaaggugcauacccugcacucucucgccgcuagccuuuccgcgagcaucuaccaggcccugugcgauucccauucuuauagcucccagacagaaggaaaucaguuuaccggcauggcuuaccaaggccugcuccugucugacagacgccggcuuagaacggagagcauugaagaacacgccacccccaacuccucuccugcccaguggcccgggguuagcucccugaucaaccuccugagcucugcucaggaugaggaccagccuaaacugaauauccuccuuugcgaagccguggucgcgguguaucugucccugcucauucacgcccuggcuacaaacuccucuuccgagcuuuuccgccuggccgcucauccccucaauaaccggaugugggccgcgguuuuuggaggcggggugaagcuggucgugaaaccgagacggcaaagcgaaaauaucucugccccucccgugcuguccgaggauauugacaagcaccgcagacgguucaacaugcgcaugcucguucccggaagaccugucaaggaugcuacacccccuccggugcccgccgaacggccuagcuacaaagagaaguuuauucccccugagcuuucuaugugggacuauuucguggcuaaacccuuucugccgcuguccgauagcggcgucauuuacgacagcgaugaauccauccauucugacgaggaagaugacgccuucuuuagcgacacacagauccaggagcaccaagauccuaauuccuacucuugggcucuccugcaucuuaccaugguuaagcuggcccuccacaacgugaaaaauuucuuucccauugcggggcuggaguucagcgagcugccugugacaagcccccucggaaucgccgucauuaagaaccuggagaauugggaacagauccuucaggagaagauggaccaguuugaaggcccucccccgaacuauauuaauacguacccuaccgaucugucugugggcgcugggcccgccauccuccgcaacaaagcuaugcuggagcccgagaauacaccuuucaagagcagagacuccagcgccuucccgguuaaacggcuuuggcacuuucuggugaagcaagaaguccuccaggagaccuucauccgcuauauuuuuaccaaaaagagaaagcagucugaaguggaggccgaucugggauaccccggcgggaaagcgaagguuauccauaaagaauccgacaugauuauggcuuucagcgugaacaaggccaacuguaaugagaucguccuggcuucuacacacgaugugcaggagcucgacgugacgucccugcuugccugccaaagcuauauuuggaucggagaagaguacgaucgggaauccaaaucuagcgacgaugucgacuauagaggcuccaccacaacccuguaccagccuucugccacaagcuacuccgcuagccagguucaucccccuucuucccuccccuggcuggggaccggacagacgagcacaggcgccucugugcuuaugaagcgcaaccugcacaaugugaaacggaugaccagccauccuguccaccaauauuaccucaccggcgcgcaggauggguccgugagaauguuugaguggacacgcccccagcaacugguuuguuuccggcaggccggaaacgcuagagugacccgccuguauuuuaauucucagggcaacaagugcggggucgccgacggagaaggcuuccucagcauuuggcaagugaaucaaacagcuuccaacccgaagccuuacaugagcuggcagugucacucuaaagccaccuccgacuuugcguucaucacgagcuccucucugguugccacaagcgggcauuccaaugauaaccggaaugugugccuuugggacacccugaucucucccggcaacagccucauucacggauuuacaugucaugaucacggcgcuaccguccugcaguaugccccuaagcagcaacuucugaucuccgggggaagaaaaggccacgugugcauuuucgacauccgccagcggcagcucauucauacguuucaggcucacgauucugccaucaaggcucuggcccuggaccccuacgaggaguauuucaccacagggagcgcggaaggaaauaucaaaguuuggagacucaccggccaugggcugauucacuccuucaagagcgagcaugccaagcaaucuaucuuucgcaacauuggcgcuggagugaugcagaucgauauuauccagggcaaucggcuuuucuccuguggggccgacggaacacugaaaaccagaguccucccgaacgcuuuuaacaucccuaaucgcauucuggauauccuuuga

SEQ ID NO: 68418 - RNA, 3183 nt, Artificial Sequence
  derived and/or modified sequence opt5 from DNA2__Homo_sapiens__NP_001073918
auggagcagcugaacgaacucgagcugcuuauggaaaagagcuucugggaggaagccgagcugcccgcugagcucuuucaaaagaagguggucgccuccuucccuagaaccguucugucuacaggcauggacaaucgguaccuugugcuggcggugaacacgguccagaauaaagaagggaacugcgagaagcgccucgugaucaccgcuagccagucccuggaaaauaaagagcuguguauucucagaaacgauuggugcucuguuccgguggagcccggagacaucauucaccuggaaggcgauuguacaagcgacaccuggaucauugauaaggacuuuggguaccuuauccuguacccugauaugcucaucuccggaacaucuauugccagcuccauccggugcaugcgcagagccguccugagcgagaccuuccggucuuccgaccccgcuacacgccagaugcuuauuggcaccgugcugcaugaaguuuuucaaaaggccaucaauaacagcuucgcuccugagaaacuccaggaacuggccuuucagacgauucaggagaucagacaccugaaggagauguaucggcucaaucugucucaagaugaaauuaaacaggagguggaagacuaccuucccuccuucuguaagugggcgggggauuuuaugcauaaaaacaccagcacagacuucccucagaugcagcugucucucccguccgauaauagcaaggacaacucuaccugcaauaucgaggucgugaagcccauggacaucgaagaguccauuuggagcccucgcuuuggacugaaaggcaagaucgaugugacagucggcguuaaaauucacagaggguauaagaccaaauacaagaucaugccccuugagcugaaaacgggaaaggaauccaacagcauugagcaucggucucaaguggugcucuauacacugcugucccaggaacgcagagccgacccugaggcuggccuccugcuuuaccugaagaccgggcagauguaccccgucccggccaaucaccucgauaaacgggaacugcuuaagcugcgcaaccaaauggcuuucagccucuuucacagaaucucuaaaagcgccacacggcagaagacccagcuggcgucccugccucagaucauugaggaggagaaaaccuguaaguauugcucucaaaucggaaacugugcccucuacagcagagcuguggaacagcagauggacugcuccagcguucccauugugaugcugccuaagaucgaagaggagacacagcaucuuaaacaaacgcaccuggaauauuucucucucuggugucugaugcugacccuugagucccagagcaaggauaauaaaaagaaccaucagaauauuuggcucaugcccgccucugaaauggagaaauccggcagcugcaucgggaaccugauccgcauggaacacgucaagauugugugcgacggacaguaccugcacaauuuccaauguaagcauggcgcuauccccguuacaaaccucauggccggcgaucgggugauugucuccggggaggagagaucucuguuugcccuuagccgcggauaugugaaagaaaucaauaugaccacagugaccugccugcucgaccggaaccuguccguccugccugagucuacgcuuuucagacucgaucaggaagagaagaauugugacauugauacaccgcugggcaaccugagcaaacucauggaaaauaccuuuguuuccaagaaacugcgcgaccuuaucauugacuuccgggagccccaguuuaucagcuaccugucuuccgugcucccucacgaugcuaaggacaccgucgcgugcauccugaaggggcugaacaaaccccagagacaagccaugaagaaagugcuucucagcaaggauuauacacugauuguuggaaugccuggcaccgggaaaacaacgaccaucuguacacuggugcgcauucucuacgcuugcggauucucuguccugcuuaccuccuacacacauagcgccguggacaauauccugcucaagcuggccaaauuuaagauuggcuuccugcggcuuggccagauccagaaggugcaccccgcuauccaacaguuuaccgagcaggaaauuuguagaucuaaaagcaucaagucccucgcccugcuggaggaacucuauaacagccagcugauuguugcgacgaccugcauggggaucaaucauccgauuuucucucgcaaaaucuuugauuucuguaucgucgacgaggcuucccaaauuagccagccuaucugccuuggaccccuguuuuucucccggagauucgugcucgugggcgaucaccagcagcugccuccccugguccuuaaccgggaagcccgcgcccuggggaugucugagagccucuuuaagagacuggagcaaaacaaauccgcugugguucagcucacagugcaguaccggaugaacucuaagauuaugagccuguccaauaaacuuaccuaugaaggaaaacuggaguguggcucugacaaggucgccaaugcugugaucaaccucagacacuucaaagauguuaagcuggaacuggaguuuuacgccgacuauagcgauaauccuuggcuuauggggguguucgagcccaacaauccggucugcuuucugaacacagacaaagugccugcgcccgaacagguugagaagggcggaguguccaaugucaccgaagccaagcucauuguguuccugacgagcaucuuugugaaagcuggcugcucucccuccgauaucgggauuaucgccccuuaccgccaacagcucaagauuaucaacgaccugcuugcucggagcauuggaauggucgagguuaauacaguggacaaauaucagggcagagauaagucuaucgugcuggucuccuucgugcgcagcaacaaagacgggaccguuggagaacuccugaaggauuggagacggcugaauguggccauuacacgcgcgaagcauaaacuuauccugcucggcugugucccgucucugaacugcuaucccccucucgagaagcugcuuaaucaccugaacuccgagaaacugaucauugaccuccccagcagagaacaugagucccugugucacauccuuggggauuuucaacgggaauga

SEQ ID NO: 68419 - RNA, 2178 nt, Artificial Sequence
  derived and/or modified sequence opt5 from DNAAF1__Homo_sapiens__NP_848547
augcaccccgagccuagcgaaccggccaccggcggggcugccgagcuggacugcgcgcaggaacccggaguggaggaauccgcuggcgaucaugggucugccggaagaggcggguguaaggaggagaucaacgacccuaaagaaauuugcgucggaagcuccgauacaucuuaccacagccaacagaagcaguccggcgacaauggcucugggggacauuucgcccacccccgggaggaucgcgaagacagaggcccucggaugacgaaaagcucccuccagaagcuguguaaacaacauaaacuuuauaucacccccgcucugaacgauacacucuaccugcacuuuaagggguucgaccgcauugagaaucuugaggaauauaccggacugagaugccucuggcugcagagcaacggcauccagaaaauugagaaucuggaagcccagacagagcuccggugucuguuucuucaaaugaaccugcuccgcaagaucgaaaaucuggagccucuucagaaacuggaugcucucaaccugucuaauaacuacaucaagaccauugagaaucuguccugccucccgguucugaacacacuucagauggcccacaaucaucuggaaaccguggaggacauccagcaccuccaagaaugucugagacuuugcgugcuggaucucagccauaacaaacugucugaccccgagauucuguccauccucgaaagcaugccugaucugcggguccuuaaucugauggggaaccccgugauucgccagaucccuaacuauagacggacgguuaccgugcgccucaagcaccugacauaccuugacgacagacccgucuucccgaaggaucgggcgugugccgaggcuugggcccgcggaggcuaugcugccgagaaagaagagagacagcaaugggaaucucgggagagaaagaaaauuaccgacuccaucgaagcgcuggccaugaucaagcagcgcgcugaggagcggaaaagacagcgcgaaagccaggagcggggcgaaaugacauccucugaugacggggagaaugugccugccagcgcugagggaaaggaggaacccccuggcgauagagaaacccgccagaaaauggagcucuuuguuaaggaauccuucgaggccaaggacgagcugugccccgaaaaacccagcggggaggaaccuccgguggaggccaagcgggaagauggaggccccgagccugaggggacgcugcccgcugaaacacuccugcuuucuuccccugucgaggugaaaggagaagacggcgauggcgagcccgaagggacccugccggcggaggccccucccccucccccucccguggaggucaagggagaagacggcgaucaagagccggaagggacacucccugcugagacccugcugcuuagcccucccguuaaagugaagggagaggacggcgacagagaacccgaggggacccucccggccgaagcucccccucccccuccccugggcgccgcccgcgaggaaccuacaccccaggcgguggcuacggagggagucuuugugaccgagcuggauggcacacggaccgaagaccucgagacaauuagacuggaaaccaaggagacguucuguaucgaugaccuuccggaucuggaagacgaugacgagacagggaaaucucucgaggaucagaacaugugcuuuccuaagauugaaguuaucagcucccugucugacgauagcgaccccgagcuggauuacaccucccuuccugugcucgaaaaucugcccaccgacacacugagcaacauuuucgccgucucuaaagacaccuccaaggccgcucgcgugccguuuacagauaucuucaaaaaggaggccaagcgggaccucgaaaucagaaaacaagauaccaagagcccucggccccugauucaggagcuuucugacgaggauccuuccggacagcugcucaugcccccuacgugccagcgcgacgcugcgccccugacaagcuccggcgauagagacucugauuuucuggccgccagcuccccgguucccaccgaaucugcugccacaccucccgagaccugugugggggucgcucaaccuagccaggcccuucccacgugggaccucaccgcguucccugccccgaaggcuuccuga

SEQ ID NO: 68420 - RNA, 2370 nt, Artificial Sequence
  derived and/or modified sequence opt5 from DNAAF2__Homo_sapiens__NP_001077377
auggccaaggcugccgcgagcuccucucuggaggaccucgaucugagcggcgaagaggugcagagacuuaccuccgcuuuccaagaccccgaauuucggcgcauguucucucaguacgccgaggaacugacagauccugagaacagacggcgcuaugaggccgaaaucacggcucucgagagagaacgcggggucgagguucgguuugugcacccggagcccggacaugugcugagaaccagccuugacggcgcccggcgcugcuucgucaauguguguuccaacgcucugguuggggccccuucuagcagacccggauccggcggggaucggggagcggccccuggcagccacuggucucuccccuacucccuggcuccuggccgcgaauaugccgggagauccucuucccgguacaugguguaugacgucguguuucauccggaugcucuggcccucgcgcgcagacacgagggauuccggcagaugcuggacgccacagcucuugaagccguugagaaacaguuuggcgugaagcuggauagacgcaaugcuaaaacccucaaggccaaauacaaggggacacccgaagccgcuguccugcggaccccucuucccggagugauuccugcgagacccgacggcgagccgaaggggccucugcccgauuucccuuaucccuaccaauaccccgccgcuccuggaccgcgcgcccccagcccucccgaggccgcucuccagccugcccccacagaaccgcgguauucugugguccagagacaucacguugaccugcaggauuaccgcugcucccgggacagcgcgccuucccccgugccucacgagcuggugaucaccauugaacucccccugcuuagaucugcugagcaagccgcccuggaagucacgcgcaaacuccugugucuugacagccggaagccugauuauagacugcgccucucccugcccuacccgguggacgauggccggggcaaagcucaguuuaacaaggccagacggcagcugguugugacccucccugucgugcugcccgcugcccgcagagagcccgcgguugccguggcugccgcugccccugaggaaagcgcggaccggucugggacagauggacaggccugcgcuuccgccagagagggcgaagcugggccggcccgcagccgggccgaggacggaggccaugauaccugugucgcuggggcggccggaucuggcgugacaacccuuggcgaccccgaagucgcuccucccccugccgccgcuggggaggagagagugcccaaaccuggagaacaagaucugagccgccacgccggcuccccgcccgggucuguugaggaaccuagccccggaggcgagaauagcccugggggcggaggcagccccugccucucuuccagaagccuggcgugggggucuuccgcuggacgggagagcgcccgcggcgacuccucuguggaaacgagagaggaaagcgaggggacaggaggccagcgguccgccugugcuaugggcgggccgggaaccaagucuggcgaaccucuuugucccccucugcucugcaaccaggauaaggagacacugacccugcucauccaagucccccgcauucagccccagagccugcagggggaccuuaauccucugugguauaaacucagauucuccgcccaagaccugguguacagcuuuuuccugcaguuugcgccggagaacaaacuuucuaccacagaacccguuaucuccaucagcucuaauaacgcugugauugagcucgccaaguccccugaaagccauggacacuggcgggagugguauuacggcgucaauaacgauucucuggaacugcaggagugcagcaauuccgaccagcuccaagggaaggaggaacgcgugaacgaggaaagccaccugacggagaaagaauacaucgagcauuguaauacccccacaaccgauucugacuccagcauugccgugaaggcccuucagaucgauuccuucggacugguuacaugcuuccagcaggagucucucgacgucagccaaaugauucugggcaaaucccagcagccugaaucuaagaugcagagcgaguuuaucaaggaaaaauccgcuaccugcucuaacgaggagaaggauaaccugaaugaaagcgugauuacggaggaaaaagagacagacggggaucaccuuuccagccuccugaacaagaccaccgugcauaauauccccggcuucgacucuaucaaagaaacaaacaugcaagauggauccguccaggugauuaaggaccacguuaccaauugugcuuuuagcuuccagaacucucugcucuaugaucuggacuga

SEQ ID NO: 68421 - RNA, 1827 nt, Artificial Sequence
  derived and/or modified sequence opt5 from DNAAF3__Homo_sapiens__NP_001243643
augcugccccuccuggacagcuccaagagagccggcacccuugggucuggaugcggcgugccucggguccacagcgcugcccugucccgcgaggaaggggcgucuagagauaucuggcggauuaaaguuugggcucgcgugaugacaacgccggccggaagcggcuccggguucggaucugugagcugguggggccucucccccgcccuggaccuucaggcugagagagaugccaccgucgacgcucugccuacaaccauggugccccaaccugccguuauccuccccggcccuccgguggaucccgacagccaggcggauacaguccauucuaacccugaacuggacgugcugcuccugggguccguugauggacggcaccuucugcgcacccucagcagagccaaguuuuggccccggcgcagauucaacuuuuucgugcuggagaauaaucuugaagcugucgcccggcauaugcugaucuuuucucucgcucuggaggagccugagaaaaugggccugcaggagcgcuccgaaacauuccucgaggugugggggaacgcccugcuuagacccccgguggcggccuuuguccgggcucaggccgaccugcucgcucaccugguuccugagcccgaucgccuugaagaacaacugccuuggcucagccugagagcccugaaguuccgggaaagagacgcccucgaggcuguguuucgcuucugggcgggaggcgaaaaagggccccaggccuuucccaugucucggcugugggauuccagacuucgccauuaccugggaagccgguaugacgcuagacgcggcguguccgacugggaucuccggaugaagcugcacgacagaggcgcccaggucauucacccucaggaguuccgccgguggagagauaccgggguggccuuugagcuucgcgacucuagcgcuuaccauguuccgaaucggacgcuggccuccggaagacuccugagcuaucggggcgaacgcguggcggcuagaggguacuggggagauauugccaccggccccuucgucgccuucgggaucgaggcugacgaugaaucucugcuccggacauccaacggacaaccugugaagaccgccggcgagaucacacagcacaauguuaccgaacugcuuagagacguggcugccuggggccgcgcgcgggccacagggggagaucuggaggagcagcagcaugcugaaggcagccccgagccugggacgcccgccccgaccccugaaucuuuuacaguccacuuccucccccugaacagcgcucaaacccugcaccauaaauccuguuauaauggaagauuucagcuucucuacguggccugcggcaugguccaucugcugauuccugagcucggggcguguguggcccccggcggaaaccugaucguugaacuugcucgcuaucugguggacgucagacaggagcaacuccagggcuucaauacccgggugcgcgagcuggcccaggcugccggguuugccccucagacaggagcuagacccucugaaacguucgcgcgguuuugcaagagccaagaguccgcccugggcaacaccguuccggcuguggaaccugggacaccuccccuugauauucucgcccagccccuggaggccagcaauccggcucuggagggacucacccagccccugcagggcgggacaccucacugugaacccugccaacuuccuucugagucccccggcagccugucugaaguccucgcccagccucagggagcgcuggcucccccgaacugugaguccgacagcaaaaccggcguguga

SEQ ID NO: 68422 - RNA, 2568 nt, Artificial Sequence
  derived and/or modified sequence opt5 from DNAAF5__Homo_sapiens__NP_060272
auggccgcucugggcguggccgaggcggucgcugcuccccacccugccgaaggggcugagaccgccgaagcuguugagcucagcagagcccugucccggcuucugccgggacucgaagcggacucuaagcccggccgcagacgggcccuggaggcccuucgcagagcccuggaggaaccugggcccgcugccgauccuacagcguuccagggacccugggcccggcuccugcugccucgccuccugagaugccuuagcgacccggcugagggcugucgggcccuggcugugcaucuccuggaucuugggcugcgcagagccgcccggccccgcgacgcucucccuagacugcugcccgcgcucgccgcucggcuggccggaccugugcccgcccgcagaccgccugaagccugcgaggagcuucggcuggcccucguccaacugcuuggccuggcgguggaucucuguggcgcugcccuggcuccccaccuggacgaugcucucagagcccugcgcugcucccuucuggacccuuuugcugccguucggagagaaucuuguagcugcgcggccgcucucgcccaggcuacgcccgaucauuuccacaugcaguccgagucucugaucgggccccuuaugcagaccauuagccaucaacacuggaaagugcgcgucgccgcgaucgaagccacaggagcugugauucacuuuggcaacgggaaguccguugacgaugugcugagccauuucgcccagcggcucuuugacgaugucccucaggugagacgcgcuguggccucugucguuggaggcuggcugcugugucuccgggacagauacuccuucuuucacaaacugaucccgcuucugcucagcucucugaaugacgaggugcccgaagugcgccagcuggccgcuucccuuugggaggaugucgggcuccaauggcagaaggagaacgaagaggaccugaaagauaagcuggacuucgcgccucccaccccuccccauuauccgccucacgaacggagacccgugcucggaugccgcgagcugguuuuucggaaucuuagcaagauucugccugcccucugucacgauaucacagacuggguggucggcaccagagugaaaucugcucagcugcugcccguucuucuccugcaugccgaagaucacgccacacagcaucuggaggugguccuccggacccuguuccaggcuugcacggacgaggaagccgcggugguccaauccuguacccgcagcgcugagcuugugggcacauuuguuuccccugaaguguuccugaagcucauccugucuacccugaaaaagacacccagcgccuccgggcuucucguccuggccagcgcuaugagaggaugcccgcgggaggcccugcagccucaccucgcggcuauugccaccgaacuggcccaagcucauaucugccaggccucugagaacgaucuuuaccuggagagacuccugcugugugugcaggcucuuguuuccgugugccacgaagacuguggcgucgccagccuccagcugcuggaugugcuccugacgauuguggcgcuugccggggcuacaggacugcgcgacaaagcccaagagaccauggacucucucgcuaugguugaaggcgucagcuccugccaggaucuguaucggaagcacaucgggccccugcuugagagagugacagccucucaucuggacuggaccgcccacagccccgagcuccugcaguuuuccgugauugucgcucagagcggaccugcgcucggcgaagcccugccgcaugugguucccacccuucgcgcuugucugcaaccuucucaggauccccagaugagacucaagcuguucuccauccugagcacagugcuucugcgggccacggacaccauuaauucucagggccaauucccuuccuaccucgagacagucaccaaagauauccuggcccccaaccuccaguggcacgcugggcgcacagccgcggcuaucagaaccgccgccgugagcugccugugggcucuuacguccucugaaguucugagcgccgagcagauucgggacgugcaggaaacacucaugccucaaguccugaccacccuggaggaggauuccaagaugacacgccuuaucucuuguagaauuaucaauaccuuucugaaaacaagcggaggcaugacggaccccgaaaagcucauucggaucuauccggagcugcucaaacgccuggaugacguguccaacgauguuagaauggcggcugccagcacccuugugacauggcugcagugcgucaagggggccaaugcuaaaucuuacuaucaguccagcgugcaauaccuguaccgggaacuccuggugcaccuugacgauccugagcgcgccauccaggacgcuauucuggaaguccucaaggagggaucuggccuguuccccgaccuccugguuagagagaccgaagccgugauccauaagcaccgguccgcgacauauugugagcagcuucugcagcaugugcaagccgucccugcuacccaguga

SEQ ID NO: 68423 - RNA, 13551 nt, Artificial Sequence
  derived and/or modified sequence opt5 from DNAH11__Homo_sapiens__NP_001264044
auggccgcucagguggccgccagagaagcucgggacuucagagaagcccccacccugagacucaccucuggagccgggcuggaagcugugggagccguugaacuugaagaagaggaggaaaacgaggaagaggcugccgcccggcgcgccagauccuuugcucaagaugcccgggugcgcuuccugggcgggagacucgcuaugaugcugggauuuacggaggaaaaguggucucaguaccuugagagcgaagacaaucggcaagugcugggcgaguuccucgaauccaccucuccugccugccuggucuuuagcuucgcggccuccgggcgccuggcugccucucaggagaucccgagagaugcuaaccacaagcucguguuuauuagcaagaagaucacagaguccauuggaguuaaugacuucagccaagugguccuguuuggcgaacuucccgcccugucucucggccacguguccgccuuccuggaugagauccuuguuccugugcugagcaacaagaauaaccacaaaucuugguccuguuuuaccagccaggacauggaauaucauauugaggucaugaagaagaaaauguacaucuuccgggggaagaugucucgcagaacacuccugcccaucccuaccguggcuggaaaaauggaucuggaccagaauugcuccgaaaacaagcccccuagcaaugagcggauuauccuccacgcgauugaguccguggucaucgaauggucucaucagauucaagagaucauugaacgcgauagcguucagagacugcuuaacggccugcaccucuccccgcaggccgagcuggacuuuuggaugaugcggagagaaaaucuuagcuguaucuaugaucagcugcaagcucccguggugcucaaaauggucaagauccugacaaccaagcagucuuccuacuucccuacgcugaaagacauuuuccucgccguggagaacgcccugcuugaggcucaggauguugaacuguaucuccgcccccugcggagacacauccaaugccuucaggagaccgaauuuccucagacacgcauucugaucgcgccccuuuuccauaccauuugucugaucuggagccacucuaaguuuuacaauacaccggcgcgggugaucguccugcuccaggaguucugcaaccuguuuauuaaucaagcuaccgccuaucuuagcccugaggaccugcucagaggggaaaucgaggaaucccuggagaaagugcagguugccgugaacauucugaagacguucaaaaacagcuuuuucaauuaccgcaagaaacuugcuagcuacuuuaugggacggaagcucagacccugggacuuccagucccaucuggucuuuugucgcuucgauaaguuucuggaccggcucaucaaaauugaagauaucuucgccacaacccuggaguucgagaaacuugaaagacuggaguuuggcgggacaaaaggagcuauccucaacggccaggugcacgaaaugagcgaggaacugauggagcugugcaaacuuuucaaacaaucuaccuaugacccuuccgauuguaccaauauggaguuugaaagcgacuacgucgccuucaagucuaagacacucgaguuugaucgccggcugggcacgauuaucugcgaagcguucuuuaacuguaaugggcuggaggccgcuuucaaacuccugaccauuuuuggaaacuuccuugaaaagcccgugguuauggagaucuuuucccugcacuauagcacacucgugcauauguucaauaccgagcuggacgucugcaaacagcuguacaacgaacacaugaagcagauugagugcggccaugugguucuuaauaaaaacaugcccuuuacauccgggaauaugaagugggcccagcaagugcuccagagacugcagauguucuggucuaacuucgcuagccugcgguaucucuuucugggaaauccugaucacgcccuugucuaccagaaguauguggaaaugaccacgcugcucgaccaauucgagucccgcaucuacaacgaguggaaaucuaauguggaugaaauuugugaguuuaaccugaaccagccgcugguuaaguucagcgcgaucaauggccuucucugcgucaacuuugaccccaaacugguggccgugcugagagaagucaaguaccuccugaugcuuaaaaagcaggacaucccugauuccgcucuggccauuuucaagaaacggaauacaauccucaaguauauugggaaccuggaccugcuugugcaaggauacaauaaacugaagcagacccuccuggagguugaauauccccucaucgaggaugagcugagagcuauugacgaacagcuuaccgccgccacaaccuggcugacauggcaggaugacuguuggggcuacaucgagcgcgugcgggcugcgacgagcgaacucgagcauagagucgaacgcacccagaagaacgugaagguuauccagcagacaaugagaggcugggcccggugcgugcugccuccccgcagagagcaccggcgcgaggcugccuuuacccuggaagauaaaggggaccuuuucacaaagaaguauaaacugauucagggagauggcuguaagauccacaaucucgucgaggaaaacagaaaacuguuuaaggccaauccgucucucgacaccuggaaaauuuacguggaguucaucgaugacauuguuguggaaggguuuuuccaagcuaucaugcaugaucuggacuucuuucuuaagaacacggagaagcagcugaaaccugcccccuucuuucaggcgcagaugauccuccugccucccgagauugucuucaagccuucccuggaccgggaagcuggagauggcuuuuaugaccuuguggaggaaaugcugugcaauagcuuccgcaugucugcccaaaugaacagaaucgccacccaccucgagauuaaaaauuaccagaacgauauggacaauaugcuggggcucgcugaggugcggcaggaaaucaugaaccgcgucguuaacgugauuaauaaggugcuggauuuuagaaacacacuugagacccauacauaccugugggucgacgaucgggccgaguucaugaaacacuuucugcucuauggccacgcgguguccagcgacgagauggaugcucaugccaaugaagagauccccgagcaaccgccuacccuggaacaguucaaggagcagaucgacauuuacgaagcccuuuauguucagaugucuaaguuugaggauuucagaguguuugacagcugguucaaagucgauaugaagcccuucaaagugucccugcucacgaucauuaagaaauggagcuggauguuucaagaacaccuccuccgcuucguuaucgacucucugaacgagcuucaggaguuuauuaaggaaacagacuccggacugcagcgggagcugaaugaaggcgaucaugacgggcucguggauaucaugguccaucugcuugcugugagaagccgccagcgggccaccgacgagcuguucgaaccccucaaggagacaauuacccugcucgaguccuacggacagaagaugccugaacagguuuauauccagcuggaggaacuuccggagagaugggagaccacaaagaaaaucgcugccacggugcgccaugaagucucuccccugcacaacgcggaggugacccugauucggaagaaauguauccucuuugaugccaagcaggcugaguucagagagcgcuuucggcacuacgccccucugggcuucaaugcugaaaaccccuauacagcccuugacaaagccaaugaggagcuggaagcucucgaggaagagaugcugcaaaugcaggaaagcaccagacucuuugagguggcgcugccugaguacaagcagaugaagcagugccggaaagaaauuaaacuucugaaagggcugugggaugucaucauuuacguucgcagauccaucgacaacuggacaaagacccaauggcggcagauccauguggagcagauggauguggaacuccgcagauucgccaaagagauuuggucucugaauaaggaaguccgggugugggacgcuuauacgggacuugagggcacaguuaaggauaugaccgccagccugagagccaucaccgagcuccaaucccccgcucugcgcgaccggcacuggcaucagcugaugaaagccauuggggugaaguuucucaucaacgaagcgacaacccuugcugaccugcuggcccucagacugcaccgcgucgaggaugacgugcggagaauuguugauaaagccgugaaggaacuuggcacagagaaagucaucacggagaucucucagaccugggcuacaaugaaguucagcuacgaagugcauuaucgcaccggcauuccucugcucaaguccgacgagcagcuguuugaaacacuggagcacaaucaaguccagcuccagacccuucugcagagcaaauacguggaauauuucaucgagcaaguucugucuuggcagaacaagcucaauauugccgaucuggugaucuucacguggauggagguccagcggaccuggucccaccuugaaagcauuuuuguguguucugaggacauccgcauucaacugguuaaagaugcgagaagauucgacggcguggaugcugaauuuaaggagcucauguucaaaacagccaaggucgaaaacgugcuggaggcgaccugccggcccaaccuguacgagaagcucaaagaccuucaaucccgccugagccugugugaaaaggcucucgccgaguaucuggaaacaaaaagaaucgcuuuuccgcgguucuacuuugugucuuccgccgaucuucuggacauccucagcaagggggcgcagccuaaacagguuaccugccaucuggccaagcuguucgauuccauugcugaccuccaauuugaggacaaucaggaugucagcgcccaccgcgcugugggaauguacucuaaggaaaaagaguaugugcccuuccaggccgagugcgaaugugucggccauguggagacauggcuucugcagcuggaacaaaccaugcaggagacgguuagacacagcaucacagaggccauuguggcuuacgaagagaagccucgggaacucuggaucuuugacuuccccgcgcaggucgcccugaccuccucucagauuugguggaccacagauguggggaucgcuuuuagcagacuugaggaaggauaugagaccgcccugaaagacuuccacaagaaacaaaucucccagcucaacacgcugauuacacugcuccuuggcgagcugccgccuggggaucgccagaagaucaugaccauuugcacaaucgacguucaugcccgggauguggucgcuaaacugauuucucagaaggugguuagcccccaagccuucaccuggcucucccagcugagacaccgcugggaagacacacagaagcauuguuuugugaauaucugcgaugcgcaguuccaauacuuuuaugaguaccuuggcaacucuccucggcuggucaucacaccccucacggacagauguuauauuacccugacacagagccugcaccucaccauguccggagcucccgccggcccugccgggacaggaaaaaccgaaacgacaaaggaucuuggccgggcucuggggaugaugguguacguguucaauugcagcgagcagauggacuacaaaucuaucggaaacauuuauaagggccugguccaaaccggggccuggggcuguuuugaugaguucaaucgcaucuccguugaggugcucagcguggucgcggugcagguuaaaaugauucaugacgccaucagaaaccggaagaagcgcuuuguguuccugggagaggcuauuacacuuaaaccgucugucggcaucuuuaucaccaugaaucccggguacgccggaagaaccgaacugccugagaaccucaaggcucuguuccggcccugcgccaugguggcuccugacauugaacugaucugugagauucuccuuguugccgaaggcuuuguggaugcgcgcgcccuggcuagaaaauucaucacacuguauacgcucugcaaggagcugcuuuccaaacaggaccacuacgauugggggcugcgggccauuaagagcguccucguggucgcuggaucccugaagcgcggcgacaaaaauagacccgaggaucaggugcugaugcgggcccucagagacuuuaacaugccuaagaucguuaccgaugacaucccgguguuccuuggccuggugggggaucuguuccccgcccucgacgucccucgccggagaaaacugcacuuugaacaaaugguucgccagucuacacuugagcugcggcuccagcccgaagagagcuucauucugaagguggugcagcuggaggaacuccuugcugucagacauuccguguuuguugugggaaaugcgggcaccgggaaaagcaagauccugcgcacacugaaccggaccuaugucaauaugaagcaaaaaccuguguggaacgaucucaaucccaaggccgucacgacagacgagcuguucggauuuauucaccaugcuaccagagaauggaaagacggcaagaucguguacucuuauuucauugggcucuuuuccagcauccugcgcgagcaggccaaccucaaacacgauggaccgaaguggaucguucuggacggcgauauugacccuauguggaucgaaucucugaacaccgugauggaugacaauaaaguccucacacuggccagcaacgagcggauugcucuuacccccuucaugagacugcucuuugagauccaccaucugcgcuccgccacacccgcgacggugucucgggccggcauucuuuacguuaauccucaggaucugggguggaaccccuacguggcuagcuggaucgacagacgcagacaccaguccgaaaaggccaaucucaccauucuguucgauaaguaugucccugcuugucuggacaaacuccggacaucuuuuaagaccaucacaagcaucccggaguccagccuggugcaaacccuuugcgugcugcucgaaugccugcuuacgcccgagaacguuccuucugauucccccaaagaagucuacgagguguauuucguguuugccuguauuugggcguucggaggcacccugcuccaggaccagaucagcgauuaccaagccgacuucucccgcugguggcagaaggagaugaaagcugucaaguuuccuucucaggggacaauuuucgacuauuacguugaucauaagaccaaaaagcugcugcccugggccgacaaaaucgcucaguuuacaauggauccggacgugccucuccaaaccgugcugguccacacaacggaaaccgccagacuucgguauuucauggagcugcuccuggaaaagggaaaaccccuuaugcuggugggcaaugcugggguuggaaagacaguguuugucggcgauacccucgccagccuguccgaggacuacauugugucuagaguuccuuucaacuacuauaccacaagcacggcgcugcagaagauccucgaaaaaccccuggagaagaaagccggccauaauuacgggccuggaggcaacaagaaacuuaucuauuuuauugaugacaugaauaugcccgagguggaucuguacgggaccguccagccgcacacacucauccggcagcacauugacuauggacauugguacgaucgccaaaaggugaugcugaaggaaauccacaacugccaguauguggcuuguaugaauccuauggucggcuccuucaccauuaaccccagacuucagcggcauuuuacaguuuucgccuuuaauuuccccagccuggacgcucucaacaccaucuacgggcagaucuuuucuuuccacuuccaacagcaggccuuugccccuuccauucugcgcagcggaccgacgcugauccaagcgacaauugcuuuccaccagaccaugaugugcaacuuucuccccaccgccaucaaauuccauuacauuuuuaaucugagagaccuuucuaacguguuccagggcauccuguuugcuuccccugagugucucaagggcccccuggaucuuauucaccuguggcuccaugaaagcgcccggguguauggggacaaacugaucgauaagaaagacugcgaucuguuccagcgcagaaugcucgagacagccuacaaguauuuugagggaaucgacucucacaugcugcuucaacagccucugauuuacugucauuucgcugaucggggcaaagacccccacuauaugccugucaaggauugggaagugcucaagaccauccugacagagacccuugacaauuacaacgaacugaaugccgcgaugcaccucguucuguuugaggaugccaugcagcaugugugccgcauuagcagaauccugcggacgccgcaggggugugcucuccuggucggagugggcggguccggaaaacaaucucuuagccgccuggccgcuuaucucagaggccuggaaguuuuccagauuacacuuaccgagggcuacgggauccaggagcugcggguggaccucgccaaccuguacauccgcacaggagcgaagaauaugcccaccgucuuccugcuuacggaugcccaggugcuggacgaauccuuucucguucugauuaacgaccuccuggcuagcggcgagaucccugaucuuuucuccgacgaagauguggacaaaauuaucucugggauucacaaugagguccaugcccugggaaugguggauagcagagaaaacugcuggaaguuuuucauggcucgggucagacugcaacucaaaaucauccuguguuuuucccccgugggccgcacccuucggguuagagcccgcaaguucccugcuauugugaauugcacagccaucgacugguuucacgcguggccccaggaggcccuggucucugugagccggagauucauugaggaaaccaaggggaucgagccggugcauaaagauuccauuucucucuuuauggcucacguucacacaaccgugaacgaaaugagcacacgcuauuaccagaaugagcggagacauaacuauaccacgccuaaguccuuccuggaacagaucagccucuuuaaaaaucugcugaagaaaaagcaaaacgaggucucugagaagaaagaacgccuugugaacggaauccagaagcugaaaacaaccgccucccagguuggcgaccucaaggcucggcuggccagccaagaggccgaacuucagcugagaaaucacgaugcggaggcucucauuaccaaaaucggccugcagacagagaaggugucucgcgaaaagaccauugccgacgccgaggaacggaaagucacagcuauccagacggagguguuccaaaagcagagagaaugcgaggccgaucuccugaaagcugagcccgcccuggucgcggccaccgcugcccuuaacacacugaaucgggugaaccucuccgaacugaaggcuuuucccaauccucccauugccguuaccaacgugacagcggccgucauggugcuucuggcuccuagagggcgcguuccgaaagaccggagcuggaaggccgcuaagguguucaugggaaaagucgaugacuuccuccaggcccugaucaauuacgacaaggagcauauucccgaaaacugucugaaaguggugaaugagcacuaucucaaggauccugaauuuaaccccaaucugaucagaaccaaaucuuucgcugccgcgggccuuugcgccuggguuaucaacauuaucaaguuuuacgaggucuauugugacguggagccuaaacgccaggcucuggcccaagccaaucucgaacuggcugccgcgacggagaaacuugaagcuauuagaaagaaacugguggaucucgaccggaaccugucccgccugaccgccagcuucgagaaggccacagcugaaaaagucagaugccaggaggaggugaaucagaccaacaagacaaucaaacucgccaaccggcugguuaaggaacuugaggcuaagaaaauucgcugggggcaguccaucaagagcuuugaagcccaagagaaaacccuguguggagaugugcuccugacggcggccuucgucucuuacgugggccccuuuacaagacaguaccggcaggagcuuguucacugcaagugggugccguuccugcaacagaaagucagcaucccucucaccgaagggcuggaccugauuuccaugcucacagaugacgcuaccaucgccgcuuggaauaacgagggacugcccucugaucgcaugagcaccgaaaaugccgcgauucuuacacauugugagagauggccucuggugaucgacccccagcagcaaggcauuaaguggaucaagaacaaauauggcauggaucucaagguuacgcaccuggggcagaaaggauuucuuaaugccaucgaaaccgcucuggccuucggcgacgugauucucaucgagaaccuggaggaaacaauugacccuguccuggauccccuccuggggcggaauaccaucaagaaaggaaaguacauucgcaucggcgacaaggagugcgaauuuaacaaaaauuucagacuuauucugcauacaaagcucgcuaacccgcacuauaaaccugagcugcaggcccagaccacgcuucugaauuuuacagugaccgaagaugggcucgaggcccaacugcuggcugagguggucuccaucgaacggcccgaccucgagaagcugaaacuuguucugaccaagcaucagaacgauuucaaaaucgaacucaaguaccuggaggacgaucuucugcuccgccugucugcggccgaaggcagcuuccuggacgauacaaagcucguggagagacuggaggcuaccaaaacaacgguggccgaaauugagcacaaggucaucgaagccaaagagaaugagcggaagauuaacgaagcuagagaguguuaucgccccguggccgcgcgggcuucccuucuguacuuuguuaucaaugaccuccagaaaauuaacccucuguaucaguucucucugaaggccuuuaacguccucuuccacagagccaucgaacaagcugauaaggucgaggacaugcagggacgcaucagcauucuuauggaauccaucacccaugccguguuucuguacacaagccaggcucuguucgagaaagauaagcucaccuuucugucucagauggccuuccaaauucuucugcggaaaaaggagaucgacccgcucgaacuggacuuucugcuuagauucacaguugagcacacccaucucucccccguggauuuucugacgagccagucuugguccgcgauuaaagccaucgcugucauggaagaguuccgcggcaucgaccgggauguggaagggagcgccaagcaguggagaaagugggucgaguccgagugcccugaaaaagagaagcugccccaagaauggaaaaagaaaucucucauucagaagcugauccuucugcgcgcuaugcggccugacagaaugaccuacgcccuccggaauuuuguggaggaaaagcugggagcgaaauauguugagcgcacaagacuggaucuugugaaggccuucgaggaaagcucccccgcuaccccuauuuucuuuauccucagccccggcgucgacgcccugaaagaucuggagauucucgggaagcggcugggauucacaaucgacucuggcaaauuucacaacgugucccuugggcagggccaggaaaccguugcugagguggcccuggagaaggccagcaaaggaggccacugggucauucuccaaaaugugcaucugguggcuaaguggcuggggacacuugaaaagcuccuggagcgcuucucucagggaagccacagagauuaccggguuuuuauguccgcggaaucugccccgaccccugacgagcauaucaucccccagggccugcucgaaaacagcauuaaaaucacgaaugagccucccacagggaugcuggcuaaccuucacgccgcccuguauaauuucgaucaggacacccucgagauuuguuccaaggaacaagaguuuaaaucuauccuguucagccugugcuacuuucaugcuugcgucgccggaagacuucgcuucggcccgcagggguggucccggagcuauccuuuuaaccccggcgaucucaccauuugugcgucugugcuguacaauuaucuggaagcuaacuccaaggugcccugggaggaccucagauaccuguucggagaaaucauguacggcgggcacaucacagacgauugggaccgcaaacuuugccgggucuaucuggaggaguuuaugaauccuagccucacggaagaugagcugaugcuggcccccggauucgccgcuccuccguaccuugacuaugccggcuaccaccaguauauugaagagaugcugcccccugaaucccccgcucuguacgggcugcauccuaacgccgagaucgaguuccucaccgugacaucuaauacccuguuuagaacacuucuggaaaugcagccccgcaacgcgcucagcggagaugagcugggccaauccaccgaagagaagguuaagaaugugcuggacgauauucuugagaaacucccugaagaguucaacauggccgaaaucaugcagaagaacucuaauagaagcccguauguccugguguguuuucaggagugcgaacggaugaacauucugauccgcgagaucagaauuucccucgagcaacuggaccuuagccugaaaggcgaacucgcucugucucccgccguugaggcucagcaguucgcccuguccuacgauacagugccugacaccuggagcaaacuugcguaccccucuacguaugggcucgcccagugguuuaaugaucugcugcuccggugucgcgaacuggacaccuggacacaagaccuuacccugccugcugucguguggcucuccggauucuuuaacccccagagcuuccugacagccaucaugcagaccauggcucgcaagaaugaguggccgcuggauaagacgcggcuuacagccgacgugaccaagaaaacaaaggaagauuacggccacccuccccgcgagggggccuaucuccauggacuguuuauggagggcgcuagaugggacacccaggcggggacgauuguugaagcccggcugaaagagcucgcuugccccaugccugucaucuucgccaaggccacccccguggauagacaagaaacaaaacagaccuacgaguguccuguguaucgcacaaagcugcggggaccgucuuacauuuggaccuuuagacuuaaguccgaagagaaaacagcuaaguggguccuggccggcguugcgcuccugcuggaggcuuga

SEQ ID NO: 68424 - RNA, 11895 nt, Artificial Sequence
  derived and/or modified sequence opt5 from DNAH12__Homo_sapiens__NP_001278590
augagcgacgcuaacaaggcugccaucgcggcugaaaaagaagcccugaaucucaagcugcccccuauugugcaccuuccggaaaacaucggcgucgauacccccacccaguccaaacugcucaaguacagacggucuaaagaacagcagcagaagauuaaucagcugguuaucgacggggccaagcgcaaccuugauagaacgcugggaaaacggaccccucuccugcccccucccgacuauccucagaccaugaccagcgaaaugaagaaaaagggcuucaauuacauuuauaugaaacagugcguggaauccucuccgcuggugcccauccagcaggaauggcucgaucauaugcugcgccuuaucccugagagccugaaggaagggaaggagagagaagaacugcuggagucccuuauuaacgaagucucuagcgacuuugaaaauuccaugaaacgguaccuggugcagagcguucucgugaagcccccugucaaaucucuggaagaugagggaggcccccugccggaauccccuguggggcucgacuauagcaaccccuggcacucuuccuacguucaggcucgcaaucagaucuucagcaaccugcauauuauccacccuacaaugaagaugcuucuggaucucggauauaccacauuugccgacaccgugcugcuugauuucacgggcauuagagcuaaaggccccaucgacugugagucucugaagaccgaucucuccauucagacacggaaugccgaggagaagauuaugaacaccugguaccccaaggucaucaaucuguuuacaaagaaagaggcgcuggaaggggugaagccugagaaacucgacgccuucuacagcugcguguccacccugaugucuaaccaacuuaaggaccugcuccgcagaacggucgaaggauuuguuaaacuguucgauccgaaggaccagcagcggcuucccauuuuuaagaucgagcugacauucgaugacgauaaaauggaguuuuauccuaccuuccaagaccucgaagauaaugugcugagccugguggagcgcauugcugaagcccuccagaacguccagacaauccccuccuggcugagcggcaccucuaccccugugaaccuugacacagagcugcccgaacauguucuccacugggcuguggauacgcugaaggccgcgguccacagaaaucuggagggggcccggaaacauuacgagaccuauguggaaaaguacaacuggcuucucgacggaacagcuguugagaauauugaaaccuuucagacagaggaucacaccuucgacgaguauacggaguucaucgagaaauuucugucccuggccagcgaaaucaugcuccugccgcaauggauucauuacacaauggugcgccuugacugugaggaucugaagaccggccucaccaacaaggcuaaagccuucgccaauauccugcugaacgacauugcuucuaaguauagaaaagaaaaugagugcaucuguagcgaguuugaagcgauuaaggagcacgcccuuaaagucccugaaacaaccgaggaaaugauggaucucaucuccuacguggagaaggcucggacagucgggaucgaggaacugauucugagaauccaggagucuaagcgccagaugagcuacuuccucgacguguuucuguucccccaggaagaucuugcccugaacgccacgguucucauguggccucggaaaauuaaucccaucuuugacgagaacgaugaacugauugagaaugcuaagcacaaaaaggagaacgaacugauggccaaaagagagaaacuuauccucgaaauugagaaagagucccgccggauggaagaguucaccgaauuugcggagcuggaaagaaugcaacaguaugugacagacguccgccagcugcagaagcggauccaagagagcgaggaagcugugcaguucaucaauaaggaggaagaacuguuuaaaugggaacugaccaaguacccugagcuugauaaacugaagguuaacauugagcccuaucagaaauucuuuaauuucgugcucaaguggcagagaucugaaaagcgcuggauggacggaggcuuccuggaucugaacggcgaguccauggaagccgacgucgaggaauuuagccgggagaucuucaaaacacuuaaguuuuuccaaaccaaacucaagaaagagcugcaggaaaagagaaaggccgcucgcaaacggucucuggaggaagagaagauugaggaggagccgaaagauaacgccacgaucaccaugugcuccacagugauggaacagauuaaggcuuuuaaagaguacaucccuaccgugagcauccucuguaaucccgggaugagagcccggcauuggaagcaaauuuccgaaaucguuggauaugaccugacacccgacucuggcaccacgcuucgcaagguccugaaacucaaccugacaccuuaccuggagcaguucgaggugauuagcgcgggggccuccaaggaauuuucucuugagaaagcuaugaauaccaugaucggaacaugggaagauauugccuuccacaucagccuguauagagacaccggcgugugcauccucuccagcgucgaugagauucaggcuauccuggacgaucagauuaucaagacccaaacaaugcgggggucuccguuuauuaaacccuucgaacaugagaucaaggccugggaggacagacucauccgcauucaggaaacgaucgaugaguggcugaaagugcaggcgcaguggcuuuaccuggaaccuauuuucuguuccgaggacaucaugcaacagaugcccgaagagggacggcaguuccagaccguugauagacacuggcgcgacauuaugaaguuuugcgccaaggauccuaaagugcucgcugccacaagccugaccggccugcuugagaagcugcaaaacuguaaugaacuccuggagaaaaucaugaagggccucaacgcuuaccuggagaaaaagagacuuuucuucccccgguuuuucuuucugucuaaugacgagaugcucgagauucuguccgaaacaaaggauccucugcgcguccagccccaucuuaaaaagugcuucgaggggaucgccaaacuggaauuucucccgaaccuggacaucaaggccauguauagcucugagggagaaagaguggagcucauugcucugaucagcaccuccgcggcccggggcgcuguugagaaauggcuuauucagguggaagaccugaugcugcgcagcguccacgaugugaucgccgccgcuagacucgccuacccugagucugcgcggcgcgacuggguuagagaauggcccgggcaagugguccugugcauuucccagauguucuggacgagcgagacacaggaagugaucuccggaggcaccgaggggcuuaagaaguauuacaaagagcugcagaaucaacucaacgaaaucguggagcugguccggggcaagcucucuaaacagacccgcacaacccugggagcucuuguuacaauugaugugcacgccagagacguggucauggauaugaucaagaugggcgugagccaugacacggauuuucuguggcuggcccagcuccgguauuacugggaaaaugagaacgcuagaguucgcauuaucaauuguaacgugaaauaugccuacgaauaccugggaaauuccccucggcuugucauuacaccccugacagacagaugcuaucgcacccucaucggagcguucuaccugaaccucggcggggcuccggagggaccugccggcacagggaagaccgagacgaccaaggaucuggccaaagcucuugccgugcaguguguuguguuuaacugcucugacggccuggauuaucuggcuaugggaaaguucuuuaaaggccucgccagcuccggggcgugggccuguuucgacgaguucaaucggaucgaacuggaaguccuuucugugguugcucaacagauucugugcauccagagagccauucagcaaaagcucguggucuuuguguucgagggaacagagcugaaacucaaccccaauuguuuuguggcuaucaccaugaacccuggcuacgccgggcgcagcgaacugcccgacaaucuuaagguccuguuccggacaguugccaugauggugcccaacuaugcucugauugcggagaucucccucuacagcuauggauuucugaaugccagaccucuuucugugaagauugucaugaccuaccgccugugcuccgaacagcucagcucucaguuccacuacgauuauggcaugcgggcugugaaagccguucugguggccgcugggaaccugaagcucaaauacccgaaugagaacgaagacauccuucugcugagauccaucaaggaugucaaugagcccaaauuucucagccaugacauuccucuguucaacggcaucacaucugaucuuuuucccggaauuaagcugccugaggccgacuaucacgaguuccucgagugugcgcacgaggcuugcaaugugcauaaccugcagcccguuaaauuuuuccuggagaagaucauucaaaccuacgaaaugaugaucgugcggcacggcuuuaugcucgucggggagccuuucgccgccaagacgaaagugcuucauguccuggcugauacacugacccucaugaaugagcacggauauggcgaagaggaaaaggugaucuaccgcaccguuaacccgaaauccauuacaauggggcagcuguucggacaguuugaccccgugagccaugaguggaccgauggcaucgucgccaacacguucagagaauuugcgcuuuccgagacaccugaccggaagugggugguuuucgaugggcccauugacacccuguggaucgagagcaugaauacagugcucgaugacaacaaaaagcugugucugaugucuggcgaaauuauccaaaugagcccucagaugucccucaucuuugagaccauggaccuuucucaggcuagccccgccacagucucccgcugcggaaugauuuaucuggaaccgucucagcugggcugggagccucucgugagcuccuggcucaauucucuuaaggggccccugugcgagcccgaauaccaagcccuccugagaggacuguucgcuuggcucaucccucccagccuuaaccagcggguggagcuguuucagcugaauuaccucuauaccacgauuguuuccaaaauccugaagauucuuaucaccuucagaauuagcaacuacuuuaaauaugucccucugaagacacaguguaccuucaucaaauuuuuccuccaccaacaggccugcuuuaucuucucucugauuugguccaucggcgggagcugugauacagacggacgccggguguucgauaccuuuauuagacugaucauucucggcaaggacgaugaaaauccggugcccgacucugucggcaagugggagugcccuuucgaugaaaaagggcuuguguacgacuauauguacgagcugaagaacaaaggacgcuggguucacuggaaugagcugaucaagaacacgaaucucggcgauaaacagaucaagauucaggacaucauugugcccacaauggauaccauccgguauacauuucugauggaccuuuccauuaccuacgcuaagccucuccucuucgucgggcccaccggaacaggcaaaagcguguacguuaaggauaaacugaugaaccaucuggaaaaggaccaauauuuuccguucuacaucaaucucuccgccagaacgucugcgaaccaggugcagaauaucauuauggcccgccuugacaaacggagaaagggggucuuuggaccucccaugggcaaaaaguguaucauuuucaucgaugacaugaacaugccugcucuggagaaguauggcgcccaacccccuauugaacugcuccgccaguuuuucgauugcgggcacugguacgaccugaaagauaccagcaagaucacacuuguggacauugagcugaucgcugccaugggacccccgggcgggggaagaaauccuguuacaccccgguguauccgccauuuuaacauuugcuccaucaacagcuucucugaugaaacaauggugagaaucuuuuccagcaucgucgccuucuaucuccggacccacgaguuucccccugaguacuuugugauuggcaaucagaucgugaacgggacgauggaaaucuauaaacagucugucgagaaucugcugccgacacccaccaagagccauuacaccuucaaccuccgcgacuuuuccagaguuauucggggaugucuucugaucgaaagagaugcuguggcgaauaaacacacaaugauucgccuguucgugcacgagguccuccggguguuuuacgacagacugaucaacgaugacgaccgccgguggcuuuuccaacugaccaagacaguuauuaaggaucauuuuaaagaaucuuuccacagcaucuuuucccaucucagaaagcagaaugccccugugacggaggaggaccugcggaaccugauguucggcgauuauaugaaucccgaccucgaaggcgaugaccgcgucuacaucgagauuccuaacauccaccacuuuucugaugugguugaccagugccuugaugaauauaaucagacccauaaaacaagaaugaaccuggugauuuuccgguacguccuggagcaccucagccgcaucuguagagugcugaagcaauccgggggaaaugcccuucuggucggccucgggggaagcggccggcagucucugacccgccuggcuacauccauggccaaaaugcauauuuuucagcccgagaucagcaaguccuaugggaugaacgaauggagagaggacaugaagggacuccuucggaaugugggcaugaaaggccagaagaccguuuuccugauuacggauacccaaaucaaagaagaggcuuuccuggaagacaucgauucugugcucaacacaggggaggugccuaacauuuuugccgcggacgagaagcaggaagucauggagggaguucgcccgguggcucaggccggcaauaaacacgacgaacugagcccccuugcccuguucgccuuuuucgugaacagaugcaaggauaaucuccaugucgugguugccuuuuccccuaucggggacgcguuccggaacagacugcgccaguuucccucucugauuaauugcuguaccaucgauugguuccaaagcuggccugaggacgcccucgaacggguggcugucaaguuucuggagacacuugagcugaccgaaguggagcagcaggaaauuguccccaucugcaaacacuuccacacauccaucauggaucucagcgagagauuucugcaugaacuuggacgccacaacuacgugacggccaccucuuaucuggagcucauuggcuccuuccggcaacugcugacacagaagagacaggcuguuauggaggccaaacagcgcuacaugaaugggcucgacaagcuggcuuuugccgaaagccaagugggagagaugcagauggaacuugucgagcugcagccgaaacucgaggaagcgaagaucgagaacgccaauaugaugcaagugauugaaaucgagucuguucaaguggaagcuaaacggcaguucgucaagcuggaugaggagauugccuccggcaaggcugaagaggcccaggcccuuaaaaacgaaugugagagcgaccuggcugaagcgaucccugcccucgaggcugcccugucugcccuggauacccucaagcccgcugacaucaccauugugaaaagcaugaagaaucccccuuccggcgugaaacugguuauggccgcggucugcgugaugaaggauaucaagcccgagaaaauuucugacccuagcgggacaggaggcaagauccuugacuacugggggccguccaaaaagcugcucggagauaugaacuuccugagagaccuuaaagaauaugauaaggacaauauucccgugacggucaugcagaagauccgcagcgaguaccugaugaacccugaauuugaucccccuaaaguugccaaggcuuccucugccgcugagggccucuguaaauggaucauggccauggaaguguaugaccggguggcgaaggucguggcccccaaaaaggcuagacugagcgaggcccaaaagucccuggcugagaccauggaacuccugaaucagaaacgcgccgagcuugcugaaguugagcaucaccuggagaaccuccagaugacauuccuggaaaagaccgaggaaaaagccgcgcuugaggaucaaguggaacugugcgccaagaaacucgagcgggcuucucagcugauugggggacugggcggcgaaaagagcagaugggcccaggcugccgacgaucuccagaucacauacgaaaaccugaccggggacguccuuguguccgccggaguuauugcguaucugggcgcuuuuacgucuggguuccgccaaacauguaccaaggauuggagcaugcucugcaaaaagaaaaagaucccguguuccgaggaauuucugcuuagcaaaacccugggagacccugugaagauuagagccuggaauaucgcuggccuccccacagauaccuucucuauugacaacggggucaucgugaauaacugccggcgcuggccucugaugaucgacccccagggacaggccaauaaauggauuaagaacuccgagaaggaaaaucagcugagcgugaucaaacucucugauuccgacuacaugagaacacuggagaacuguauucaauuuggcaccccucuucugcucgagaaugucggcgaagaacuggaucccagccuugaaccgcugcuccugcggcagacguucaagcaaggcgggaucgacugcauuagacugggggagguuaucaucgaauauucuuuugauuucaaauuuuacauuacaaccaagcuccggaacccucacuacaugcccgagcuggccacaaaagugucccuucugaauuucaugaucacccccgaggggcucgaagaccagcugcuuggaauuguggucgcuaaggagcgcccugaacuggaggaggaaagaaacgcccucauccugcaaagcgcggccaauaagaaacagcugaaggauauugagaaaaagauccuugaaacgcuguccagcucugagggcaacauccucgaagacgagagcgcuauuaaagugcuggauuccgccaagaugaugucuaaugagaucaccaagaaacagcaaauugcugaaaagacagagcucaaaaucgccgaaagccgggagggguaucgcccgauugcgaagcauuccucuguucuguuuuucagcaucgccgaccuugcuaacauugaucccauguaccaguauucccugaccugguucgugaaccuguacaucaauucuauccacgacagcaacaaauccaagauucucgaaaagagacugcgguaucuuaaugaucauuuuacauacaaccuguauugcaauaucugucgcagccucuucgagaaagacaagcugcucuuuucuuuccugcugugcgccaaccuucugcucgcuagaaaagagauugaauaccaggagcugauguuucuucugaccggcggagucucccucaagagcgccgagaaaaauccugaccccacauggcugcaggauaagucuugggaggaaaucugucgggcuuccgaguucccugccuuucgcggccucagacaacacuucugcgagcauauuuacgaauggcgggagaucuaugacagcaaagaaccccacaacgcgaaguuuccugcccccauggauaagaaucugaacgagcugcagaaaaucauuauccuucgcugucugagaccggacaagauuaccccugcuaucacgaauuacgugacagauaaacucgggaagaaauucguugagcccccucccuuugaccugaccaaguccuaucuugauucuaacugcaccauuccgcugaucuucgugcucagcccuggagccgaccccauggcuucccugcugaaguucgccaaugauaaaagcaugucuggcaacaaguuucaggccaucucccucgggcagggacaaggccccauugcggcuaaaaugaucaaggccgccauugaagaggggacaugggucugucugcagaauugccaccuugcugugagcuggaugccuaugcuggagaaaaucugugaggacuucaccucugaaacaugcaacagcuccuuucggcucuggcugacgucuuaccccagcuccaaguucccuguuaccauucuucagaacggcgugaagaugacaaaugagccgcccaccggacugcgccucaaccugcugcagucuuaucucacagauccugucagcgaccccgaguuuuucaaaggcuguagagggaaggaacuggccugggagaaacuucuguuuggagugugcuucuuucaugcucucguccaagaacggaagaaauucggcccucugggguggaauauccccuacggauuuaacgaguccgaccuuagaauuagcauccgccagcugcaacucuucaucaaugaauaugauaccauuccuuuugaggccaucucuuaccugacgggcgagugcaacuacgggggccgggugaccgacgauugggacagacgccugcuccugacaaugcuugcggauuucuauaaucuguacauuguugaaaacccgcacuauaaguucucccccagcggaaauuacuuugccccucccaagggcaccuaugaggacuacaucgaguucauuaaaaagcucccuuuuacacagcaucccgagaucuucgggcugcacgaaaacguggauaucuccaaagaccuucaacagaccaagacgcuguuugagucucuccugcugacacagggaggcagcaaacaaaccggggcuuccggaucuacagaucagauucuccuggagaucaccaaggacauucuuaauaaacugccgagcgauuucgacaucgaaauggcccuccggaaguauccugucagauacgaggaauccaugaacaccgugcuggugcaggagauggagcgcuuuaauaaccuuauuaucacaauccggaauacgcugagagaucucgaaaaggcuauuaaaggcguuguggucauggacagcgcccuggaggcgcugucuggcucccuccugguggggaagguucccgaaaucugggccaaacgcagcuaccccucucuuaagccucugggauccuauauuaccgacuuccucgcucggcugaacuuucuucaggauugguacaacagcggcaaacccuguguguucuggcugucuggguuuuucuuuacacaagccuuccucaccggagcuaugcagaauuaugccagaaaguacacaaccccuaucgaccugcugggcuaugaguucgaagucauuccguccgauacgagcgacacaucucccgaggaugggguguacauccacggacucuaucuggacggcgcucgcugggaucgggagagcggccuucuggccgaacaguacccuaagcuccuguuugaccugaugcccauuaucuggaucaaaccuacccagaaguccagaauuaucaaaagcgaugcguacgucugcccccucuauaagaccuccgagcggaaagggacacuuucuaccacaggacauagcacgaacuucgugauugccaugcugcugaagaccgaccaaccgacaagacacuggaucaagcgcggcguugcucuccugugucagcuugaugacuga

SEQ ID NO: 68425 - RNA, 13389 nt, Artificial Sequence
  derived and/or modified sequence opt5 from DNAH17__Homo_sapiens__NP_775899
augaccauggcccccgacgugagacuggaauaccucgaagaagucgcuagcaucguucugaaauucaaaccugauaagugguccaaacuuauuggcgccgaagaaaacguggcccuguuuacagaguucuuugaaaagccggacgugcagguccucgugcugacgcuuaaugcugccgggaugaucauucccugccugggguucccucaaucucucaaaagcaagggcguuuauuuuaucaagaccaaauccgaaaacauuaauaaggauaacuaccgggcccgccugcuguauggggacaucucucccacaccuguggaucagcucaucgcugucguggaagaaguucugagcucccuucugaaucagucugaaaacauggccggauggccccagguggucagcgaagacauugugaaacaagugcacagacucaagaaugaaauguucgucauguccggcaaaaucaaggggaagacccugcuuccuauuccggaacaucugggaagccucgauggcacacuggagucuauggaacggauccccuccagccuggacaaccuccugcuucacgcuauugagaccacaaucauugauuggucucaucagauccgcgacguucuguccaaagauagcgcccaggcgcuccuggacggccuucacccucugccccagguggaauuugaguucugggauaccagacuccugaaucugaaguguauccaugagcaacucaaccggccuaaagugaauaagauugucgaaauccuggagaaagccaagucuugcuacuggcccgcccuucaaaacguguauacgaauguuaccgaagggcugaaagaggcuaacgacauugugcucuaccugaagccgcuucgcauccugcucgaagagauggagcaggcugacuuuacaaugcugccuaccuucauugccaagguccuggauacaaucuguuuuaucugggcgaccuccgaauauuacaauacgcccgccagaauuaucgugauucuccaggaguucugcaaccaaaucauugaaaugacacggaccuuucugagcccugaggaaguucuuaaaggacugcagggcgagaucgaggaagugcucuccgggaucucucuggcugucaacgugcugaaggagcuuuaccagacauaugacuucuguugcgucaauaugaaacucuucuuuaaggauaaagaacccgugcccugggaguucccuagcucccuggccuuuagccgcauuaacucuuucuuucaaagaauccagaccauugaggaacuguacaagaccgcuaucgaguuccucaagcuggagaagauugagcuuggaggcguucgggggaaucugcucggaucccuggugacacgcaucuaugacgaagucuuugagcuggugaagguuuucgccgauuguaaauacgacccgcuugaucccggcgacagcaacuuugauagagacuaugccgauuucgagauuaagauccaggaccucgaccggcgccuggcuacgaucuuuugccagggcuucgaugacuguucuugcauuaaaagcuccgcgaagcugcucuacaugugugggggacugauggaaagaccucuuauccuggccgagguggcuccccgguauucugucaugcucgaacuguuugaugccgagcuggacaaugccaagauucuuuacgaugcucaaauggccgcgagcgaagagggcaacaucccucucauucacaaaaauaugcccccgguggcugggcagcugaaguggucccuggagcuccaggaaagacuggaggugagcaugaaacaccuuaagcauguugaacacccugucaugucuggagccgaggccaaacugaccuaccagaaguaugacgaaaugauggagcuccugcgcugccaucgggagaagaucuaccaacaguggguggcuggcguggaucaggacugccacuucaaccuggggcagccccuuauccucagagaugccgcuuccaaucugauucacgucaacuucagcaaagcccugguggcgguucuccgcgaagugaaguaucugaauuuucaacagcagaaagagaucccugacucugccgaaucccuuuucagcgagaacgagacauuucggaaguucgucggaaaucuggaacucauugugggcugguacaacgagaucaaaaccauuguuaaggcuguggaauuucugcugaucaaauccgagcuugaagccaucgaugucaagcugcucucugcugagacaacccuguucuggaauggcgaggggguguuucaguauauucaagaaguuagagagauccuccauaaccugcagaaccgcaugcagaaggccaaacaaaauauugaaggaaucagccaggcgaugaaggacugguccgccaacccccuuuucgagcggaaagauaauaagaaagaagcucugcucgaccuggacggcagaauugccaaccugaauaagcgcuacgcugccgugcgggaugccggggucaagauccaggcuaugguggcggagaacgccgagcuuuuuagagcugacacgcugucucucccuuggaaagauuaugugaucuacauugacgauaugguccuggacgaguucgaucaguuuauccgcaagagccucuccuuccugauggacaauaugguuauugaugagagcaucgcgccccuuuuugaaauucggauggagcuggacgaagauggacucacauucaacccgacccuggaggugggcucugacagaggguuccuggcccuuaucgagggccuggugaaugauauuuacaacgucgcucggcucaucccucgccuggccaaagacagaaugaauuauaagauggaccucgaagauaacaccgaccugaucgagaugcgggaagagguguccagccuuguuauuaaugcgaugaaagaggcugaagaguaccaagauucuuuugaaagauauuccuaccuguggacagacaaccugcaggaguucaugaagaauuuucucaucuauggaugugccgugaccgccgaagaucuggacacauggacggaugacaccauucccaagacacccccuacccuugcucaguuccaggagcaaaucgauagcuacgagaaacuguaugaagaggucucuaagugcgaaaacacaaaaguguuucacggcuggcuccagugugacugccgcccguucaagcaggcccugcucagcaccauucggagauggggguuuauguucaaacgccaucuguccaaccacguuacgaauagccuugcggaucuggaggcuuuuaugaagguggccagaaugggacugaccaagccccucaaagaaggcgacuacgacgggcuggucgaggugaugggacaucuuaugaagguuaaagagcggcaggccgcuacagauaacauguucgaaccucugaagcaaaccaucgagcuccugaaaacauacggcgaagagaugcccgaagagauccaccucaagcugcaggagcuuccugaacacugggccaauaccaaaaagcuggcuauucaggugaagcugacggucgcgccccuccaagcgaacgaggugucuauccugcgcagaaaaugucagcaguuugaacuuaagcagcaugaguuccgggagcgcuucagacgggaagccccuuuuuccuucagcgaccccaauccguauaaaucccugaacaagcaacagaaaucuauuagcgcuauggaggggaucauggaagcccucuccaagucuggcggacuguuugaggugccuguccccgauuacaagcagcucaaggcuugccaccgcgaaguuagacugcuuaaggagcugugggacauggugguggucgugaauacaagcauugaggauuggaaaaccacaaaguggaaagacaucaacguugaacagauggauaucgacuguaagaaguucgccaaagauaugcggucccuggacaaggagaugaaaaccugggaugccuuugugggccucgacaauaccgucaagaacgugauuacaucucugcgcgcuguuagcgaacuucaaaauccugcgaucagagagcggcauuggcagcagcugaugcaggccacgcaagugaaauucaagauguccgaagagaccacacucgcugaucugcugcagcucaaccuucacagcuaugaggacgaagucagaaauauuguggacaaggccgucaaagagucugggauggaaaaggugcugaaagcccuggauuccaccuggagcaugauggaguuucagcacgaaccccauccgcgcacaggaaccaugaugcucaagucuuccgagguucugguggagacgcuugaagacaaccagguccaacugcagaaucucaugaugagcaaauaccuggcucacuuccugaaggaggugacaucuuggcagcaaaagcucuccaccgccgauagcguuaucuccauuugguuugaagugcagcggaccuggagccaucuugagucuaucuucauuggcagcgaggacaucagaacacagcugccuggggauucccagcgcuuugacgauaucaaccaagaguucaaagcgcugauggaggacgcugucaagacccccaacgugguggaagccacaucuaaaccuggacucuauaauaagcuggaggcccuuaaaaagagccuggcuauuugcgaaaaagcccucgcggaguaccuggagacgaagcggcuggcuuuucccagauucuauuucguuuccucugccgaucuccuugacauccugagcaacggcaaugaucccgucgaagugucccgccaccugucuaagcucuuugacagccuguguaaacuuaaguuccggcuggaugccuccgacaaaccucucaagguggggcugggcauguacagcaaagaggacgaauacauggucuuugaucaggagugcgaccugucuggacagguggaaguuuggcucaacagagugcuugaucgcauguguuccacccugcggcaugagauuccggaggcugucgugacauaugaagagaagcccagagaacaguggauccuggacuacccugcccaaguugcucucacaugcacacagauuugguggaccacggaggugggccuggccuucgcgcggcuugaagagggguaugagaaugccauccgcgauuacaacaagaaacagaucagccagcugaauguccucauuacccugcugaugggaaaccucaaugcuggcgacagaaugaagaucaugacaauuugcaccaucgaugugcacgcccgggacguuguggcuaaaaugauugucgccaagguggaaucuucccaagccuuuacauggcaggcucagcuucgccacagaugggaugaggaaaaacggcauuguuucgcgaacaucugcgacgcccaaauccaguauagcuacgaguaucuggggaauacccccagacuggugauuacaccucucaccgaucgcuguuacaucacgcugacacagucccuucaccugauuaugggaggcgcucccgccgggccugccggcaccggaaagaccgagacaaccaaggaccucggccgggcucuggggacgauggucuacguuuuuaacugcucugaacagauggacuauaaaagcuguggaaauaucuacaagggccuggcccaaacaggggcguggggaugcuucgaugaguuuaacagaauuuccguggaagugcucagcgucaucgcugugcagguuaaaugugugcaggacgccauucgcgccaagaaaaaggcuuucaauuuucuuggcgagaucaucggccugauuccgaccgucgggaucuucauuacaaugaaccccggauaugccggccgggcggaacugccugagaaucucaaggcccuguuuagacccugcgcuauggugguuccugauuucgagcuuaucugugaaauuaugcugauggccgagggguuccucgaagcucgccugcuggcccggaaauuuaucacccucuacacacuuugcaaggagcugcugucuaaacaggaccauuaugauuggggacucagagcuaucaaguccgugcuggucguggccggcagccuuaaacgcggggaccccucuagagcggaagaucaaguccugaugcgggcccuccgcgacuucaacauuccgaagaucgugaccgaugaccugccuguuuuuaugggacugauuggcgaucucuuccccgcucuugacgugcccagaaaacgggaucugaacuuugagaagaucauuaagcagagcaucguggagcugaaacuccaggccgaagacuccuucguccugaagguugugcagcuugaggaacugcuccaagugcgccacucugucuuuaucgugggcaaugcugggagcggaaaaucccagguucugaagucucugaacaaaacguaccagaaucucaagagaaagccuguggccgucgaccuugaucccaaagccgugaccugugacgagcuguucggcauuaucaacccugucacacgggaauggaaggaugggcuguuuagcaccauuaugagagaccucgcuaauaucacacaugauggaccgaaauggauuauccuggacggcgauauugaccccauguggaucgagucccuuaacaccgugauggaugacaauaagguucugacgcucgcgagcaacgagcgcaucccucugaaucggacaaugagacugguguucgaaauuucucaccuccgcaccgccacacccgcuaccgucucccgggccgggauccuguauauuaacccugccgaucuuggauggaaucccgugguuagcuccuggaucgagagacggaaagugcagucugaaaaggcuaaccugaugauucucuuugacaaguaccugccgaccugccuugacaaacugcgcuucggcuuuaagaaaaucacaccuguccccgagaucacggugauucaaaccauccucuaccugcuggagugccuccugacagaaaagaccgugccucccgauagcccuagagagcuuuaugaacuguacuucguuuucacauguuuuugggccuucggcggggcgauguuucaggaccagcucgucgauuaucggguggaguucuccaaaugguggauuaaugaauuuaagaccaucaaguuccccucucaaggaacgauuuuugacuacuauaucgauccggacaccaagaaauuccugccuuggaccgauaaagugcccagcuuugagcuugaccccgaugucccucugcaggccucccucguucacaccacagagaccauccgcauuagauacuucauggaccugcugauggagaaaagcuggccggugaugcucgugggcaacgcugggacaggaaaaucuguccugaugggcgauaaacuugaaucccugaauacggacaacuaucucgugcaggccguucccuuuaacuucuacaccacaagcgcuaugcugcagggggugcuugaaaaaccucuggagaagaagucuggacggaauuacggacccccuggcaccaaaaagcucgucuauuuuaucgaugacaugaacaugcccgaaguggacaaauacgggacaguugccccucauacccugauucgccaacacauggaucauagacacugguaugaccggcacaagcugacgcucaaagauauccauaauugccaguacguggcguguaugaacccgaccuccggcuccuucacaauugacucucgccugcagagacacuucugcgucuuugccgugagcuuccccggccaggaggcucuuaccacaaucuauaauaccauucugacacaacaucucgccuuucgguccgugucuauggcuauccagagaaucagcucccagcuggucgccgcugcccuugcgcugcaccagaagauuacggccaccuuccucccuacagcuaucaaguuucauuacguuuucaaccugcgcgaucugagcaauauuuuucaagggcuccuguucuccaccgccgaggugcuuaaaacaccccuggaccucgugcggcuguggcuucacgaaacagagagagucuauggagauaagaugguggacgaaaaagaucaggagacgcugcaccgcguuaccauggcuucuacaaagaaauuuuucgacgaucucggcgacgaacugcuguuugccaagccuaacaucuucugucauuuugcccaggggauuggagaucccaaguacgugccggucaccgacauggcgccucucaauaaacugcuuguggacguucuggauagcuacaacgaggugaaugcugucaugaaccucgugcuguucgaggacgccguugcucacaucugccggaucaaucgcauucuugaaagccccagaggcaacgcccugcucgugggcgucgggggaucuggcaagcaaagccugucccggcuggccgcuuauaucucugggcucgauguguuccagauuacacugaaaaagggauacggcauccccgaccuuaaaauugaucuggccgcgcaguauaucaaggccgcugucaagaaugugccuagcguuuuucucaugaccgacucccagguggccgaggaacaauuccugguccuuaucaacgaucugcucgcuagcggggagauucccggacuguuuauggaggacgaaguggagaacaucauuucuuccaugagaccucaggugaaaagccugggcaugaaugauacgcgcgaaacauguuggaaguucuuuaucgagaaaguucggagacagcuuaaggugauucugugcuucucuccggucggcuccgugcuccgcguucgggccagaaaauuucccgcgguggucaacuguaccgccaucgacugguuccaugaauggccugaggaugcucuggugagcgucucugcccgcuuucucgaggaaaccgaggggauccccugggaagugaaggcuuccauuagcuucuuuauguccuacguucacacaaccgugaaugagaugagcagagucuaucuggccacagaacggcgcuacaacuauaccacgccuaagacauuccuugagcagaucaaacuguaccaaaaucugcucgcuaagaaaagaaccgagcugguggccaagauugaacggcuugagaacggacugaugaaacuccagucuacagcgagccagguugacgaccugaaggccaaacucgcuauccaggaagccgagcugaagcaaaagaaugaauccgcugaucagcugauucagguggucggcaucgaggccgagaaagugucuaaggaaaaagccauugcggaccaagaggaagugaagguugaggucaucaacaaaaaugugaccgagaagcagaaggcuugcgaaacggaucuugccaaagccgagcccgcucugcucgccgcucaggaagcccuggacacccuuaacaagaauaaccugacagagcucaagagcuuuggguccccgccugaugcgguggucaaugugaccgccgcuguuaugauccugacagcccccggaggcaagauuccuaaagacaagucuuggaaggcugccaaaaucaugauggggaagguggauaccuuccucgacagccugaaaaaguucgauaaagaacacauucccgaggcgugucugaaggccuuuaagccuuaccagggaaaccccacauucgacccggaguuuaucagauccaaaucuaccgcugccgcuggccuuugcagcuggugcauuaauaucguccgguucuaugaaguguacugugauguugccccuaagcgccaagcucuggaggaagccaacgcggagcucgccgaagcucaggagaaacuguccagaaucaagaacaaaauugccgagcuuaaugccaaccugagcaaucucacgucugcuuuugaaaaggccacagcggagaaaaucaagugccagcaggaagcugacgccaccaaccgggugauucugcuggccaaucgccucgucggcgggcuggcuuccgagaacaucagaugggccgaaagcguggagaauuuccggucucaaggaguuacccuuuguggcgaugugcugcucauuuccgcuuuugucagcuaugugggguacuucacaaagaaauaucgcaacgagcugauggaaaaguuuuggauccccuacauccauaaucuuaaagugcccauuccuaucaccaacggacuggacccgcucucccugcugacagacgaugccgacgucgcgacguggaauaaccagggccuccccucugauagaaugagcaccgagaaugccacaauucuggggaacaccgaacgguggccucuuaucguugacgcucagcugcagggcauuaaguggaucaaaaauaaguaucgcuccgagcucaaggccauuagacugggacagaaaagcuaccuugaugugaucgagcaggcuaucucugaaggcgacacacugcucauugagaacaucggggaaaccguggaucccguccuggacccucugcucggacggaacacgauuaagaaaggcaaguacaucaaaauuggggauaaggagguggaauaucaccccaaguuccgccugauccuucauaccaaauacuuuaauccucacuauaagcccgagaugcaggcccagugcacacugaucaacuuccucguuaccagagacggacuggaggaucaacuucuggcggccguggucgcuaaagaacggccggaccucgagcagcugaaggccaaucugacaaaaucccagaacgaguucaagauugugcucaaggagcuggaagauagccuucuggcucgccucucugccgccagcggcaauuuucugggggacaccgcucuuguugagaaccuggagacgacaaaacauaccgcguccgaaaucgaggaaaagguggucgaggccaaaauuacagaagugaagaucaaugaggcuagagagaacuaccggccugccgccgaaagagcuucucuccuguauuucauucugaaugaccucaacaaaaucaaucccgucuaccaauuuagccugaaggccuucaacgugguuuuugagaaagcgauccagcgcaccaccccugcuaaugaagugaagcagcgggucauuaaccuuacagaugagaucacguauuccguguacauguacaccgccagaggccuguucgagcgcgacaagcucauuuuucuggcccagguuacauuccaagugcuuucuaugaaaaaggaacugaaucccgucgagcucgauuuucugcugcgguucccguuuaaagcuggaguggugagcccuguugacuuccuccagcaccagggcuggggaggaaucaaggcccuguccgaaauggaugaguuuaaaaaccuugacagcgauauugaaggcucugcuaagagauggaagaaacuggucgaguccgaggcccccgaaaaggagaucuuccccaaagaauggaagaacaaaaccgcgcuccagaagcuguguauggugcgcugccugcggccugacagaaugacauaugccauuaagaauuucguggaggagaaaauggggagcaaguuugucgagggacgcuccguggaguucucuaaaagcuacgaagaguccucucccagcaccuccaucuuuuucauccucagcccuggcguugauccgcuuaaggacguggaagcucuggggaaaaagcugggcuuuacgauugauaacggaaagcuccacaaugucucucugggccaagggcaggaggugguugccgaaaacgcucuugacguggccgcggagaaaggacauugggucauccugcagaauauucaccucguggcccgguggcugggcacacuggacaagaaacuugagcauuauuccaccgggagccacgaagauuacagaguguucaucucugcugagcccgccccuucccccgaaacccacauuaucccucagggaauccucgagaacgcuauuaagaucacaaaugagcccccuaccggcaugcaugccaaccugcacaaagcccuggaccucuuuacacaagauacgcuggaaauguguaccaaggagauggaguucaagugcaugcuuuuugcucuguguuauuuccaugcgguugucgccgagcgccggaaauuuggcgcucagggguggaauagaagcuacccguucaacaauggagaccucacaauuucuaucaacgugcuguauaauuaccuggaagccaaccccaaggugccuugggaugaccuucgguaccucuuuggcgagauuauguaugggggacacaucaccgaugacugggauagacgccugugccggacauaccuggccgaguauaucagaaccgaaaugcucgagggcgacguccugcuugcucccggguuccagauuccucccaaucuggauuacaaaggauaucaugaauacaucgacgagaaccucccgccugaaucccccuaucuguacggccugcaccccaacgccgagauuggcuuccuuacgguuaccagcgagaagcucuuucgcacagugcuggaaaugcaaccuaaagagaccgauucuggggcgggaacaggcgugagcagagaagagaaggucaaagcugugcuggacgacauccucgaaaagauucccgagaccuucaauauggccgagaucauggccaaggcugccgagaaaaccccuuacguuguggucgcuuuucaggagugugaacggaugaacauucugaccaaugagaugcgcagaucccuuaaggagcugaaccucgggcugaaaggagaacugacgaucacaaccgauguggaggaccuuagcaccgcccucuucuaugauacaguuccggacacguggguggcgcgggccuaccccuccaugaugggccuggcugccugguaugcugaucugcuccugcgcaucagagaacuugaggccuggaccacagacuuugcgcugccuaccacagucuggcucgccggguucuuuaauccccagucuuuccugaccgcuauuaugcagagcauggcccggaagaacgaauggccucuggauaaaaugugccuuuccguggaggugacaaagaagaaucgcgaggacaugaccgcucccccgagagaaggaucuuacgucuauggccucuuuauggagggcgcccggugggauacgcaaaccgggguuaucgccgaagcucgccugaaagagcugacacccgccaugccugugauuuucaucaaggccauuccuguggacagaauggaaaccaaaaacaucuacgagugccccgucuacaagacacggauccgcggaccgaccuauguuuggacguuuaaucucaaaacaaaggagaaggcugccaaauggauucuggccgcuguggcccuucugcuccagguguga

SEQ ID NO: 68426 - RNA, 12798 nt, Artificial Sequence
  derived and/or modified sequence opt5 from DNAH1__Homo_sapiens__NP_056327
auggagcagcccaacagcaagggcuacucccuggggagaacaccucaaggaccggaaugcucuagcgcccccgcugugcaggucggcacacaccgggggcucgaguauaauccuggaaaaauucugcccggcuccgacuacgggcuuggaaacccucccgcccuggauccuaagcucccgcaccuuccccuuccucccgcgccucccacgcugucugaccucggccagccgagaaaaagcccucugaccggcacagauaagaaauauccccugaugaagcagagaggguucuacuccgacauucucucuccuggaacccuggaucaacuuggcgaaguuugucgggggccccgcaugagccagaaucugcucagacaggcugaccuggauaaguuuacaccccgggugggauccuucgaggugccugaagacuuucaggagcgcauggagcaacagugcaucggcagcaccacaagacuucuggcccagaccgauuucccgcuccaggccuaugaacccaaaaugcaaguuccuuuucaggugcugcccgggcagcacccucggaagauugagaucgaacgcagaaaacaacaguaccugucucucgacauugagcagcugcuuuucucccagggaaucgauagcaacaagcugaugccccggcaccucgaccaccaacauccgcagacgaucgagcagggccacgauccuauuuuucccaucuaucugccucuuaaaguuuucgacaaugaagacuuugauugucgcacccccagagaguggauuaacaugggccuggaaccugggucucucgaccggaagcccgugccgggaaaggcucugcugccuacagaugacuuccucggccacgaggaucccaaaucccagaagcugaaauacaaguggugcgaagucggggugcuugacuacgaugaggagaaaaagcuguaucucguucauaaaaccgacgaaaagggacuggugcgcgaugagaugggcagacccauccuuaaugccggggucacaaccgaaggacggccuccgcugcaagugugucaguacugggugccccggauccaacuccuguuuugcgcugaggacccuuguauguucgcccagcgcgucguucaagcgaacgcccugcggaagaauacggaagcucuccugcuuuauaaccuguacguggauugcaugcccagcgacggccagcacgugaucucugagcagucccucagcaaaauuaagcagugggcccuguccacaccuagaaugcgcaaaggccccucuguccuggagcaucuuagcucccucgcucgggaagugagccuggacuaugagagaucuaugaauaagaucaacuuugaucacguuguguccagcaaaccugaaaccuucucuuacgucacacugcccaagaaggaggaagaacaagugccggagcgcgggcucguuagcgugccuaaauaucacuucugggaacagaaggaggacuuuaccuucgucucccugcuuacccggcccgaagugaucacagcccugucuaaagucagagcggaguguaauaaggugacggccaugagccucuuucauuccagccugucuaaauacucccaccuggaggaguucgagcagauucaaagccagaccuuuucucagguucagauguuccuuaaggauuccuggaucagcucccucaagguggcuaugcgcucuagccugcgggacauguccaaaggaugguacaaccuguaugaaacaaauugggaggucuaccucaugucuaagcugagaaaacuuauggaacuggugaaguauaugcuccaagauacccugcgcuuucugguucaggacagccuugccuccuucagccaguuuauuucugauacaugcuguuccgugcucaacugcaccgacgauauggucuggggcgacgaucugaucaacagcccuuaccggccccgcaagaauccgcuguucauuauggaccucgugcuggauucuuccggggugcauuauagcacgccucuugagcaguuugaggcuucucugcucaaccuguucgacaagggaauccuggccacacacgccguuccccaacuugaaaagcucgucauggaggacaucuuuauuagcggcgauccucugcuggaauccguggggcuccaugagccccugguggaagaacuucgggcuaccaucgcgagcgccgucucuaaagcuaugauuccccugcaggccuacgccaaggaguaucgcaaauaccucgaacugaauaacaaugacaucgcuuccuuccugaagaccuaccagacacagggccuucuggcccaagaggugagagaaguugugcucacccaucugcgggagaaagaaauucucgauagcucccugccuucuagcaucaucauuggaccguucuauaucaacacagacaaugucaagcagucccuuucuaaaaagagaaaggcgcuggcuacgagcgugcucgauauucuggccaaaaaccugcacaaggagguugacuccaucugcgaggaauuucgcucuauuagccggaaaaucuacgagaagcccaauuccauugaagaacuugccgagcugagagaauggaugaaaggcaucccugagcgccucguggggcuggaagagagaaucgucaaggugauggaugacuaucagguuauggaugaguuccucuacaaccugagcucugacgauuuuaaugacaaguggauugcuuccaacuggcccagcaaaauccuuggacaaauugagcuggugcagcagcagcaugucgaggaugaagagaaguuccggaaaauccaaauuauggaccagaauaacuuucaggaaaagcucgagggccugcagcuggugguggccggguucucuauccacgucgaaaucucccgcgcucaugagauugccaaugagguuagacgggugaaaaagcaacuuaaggacugucagcagcuggcgaugcucuauaacaaccgcgaaagaaucuuuagccugccuauuaccaauuacgauaaacucucucggauggugaaggaguuccagcccuaucuggaccuuuggacaaccgccuccgauuggcugcgcuggagcgaauccuggaugaacgacccucugagcgcuaucgaugccgagcaacucgagaagaaugucguggaggcuuuuaagacaaugcacaaaugcguuaagcaguucaaggacaugccggccugucaggagguggcgcuggauauuagagcccggaucgaagaguuuaaacccuacaucccucuuauucagggacugcgcaaccccggcaugagaauccggcacugggaaacccucucuaaucaaauuaacaucaaugucagaccuaaggcuaaccugacguucgcccgcugccucgagaugaaucugcaggaccauauugagagcaucuccaaaguggcugaaguugccgggaaggaguacgccaucgaacaggcucuugauaaaauggagaaggaauggucuaccauucuguuuaacgugcugcccuauaaagcgacagacaccuacauccucaagagcccggaugaggccucccaacugcuugacgaccacauugucaugacacagaauaugucuuucagcccuuauaagaaacccuucgagcagcggaucaacuccugggaaaauaagcugaaacucacccaggaggugcuggaagaguggcucaacugucaaagaucuuggcuguaccuugaacccauuuuuagcuccgaggauaucaaucagcagcugccuguugagagcaagcgcuaucagacgauggaacggauuuggaaaaagaucaugaagaacgcuuacgagaacagagaagugaucaaugucugcucugaccugcgcaugcucgauucccugcgggacuguaacaaaauucuugaucuggugcaaaagggccucagcgaguaucuggaaacaaaaagaucugccuucccccgcuuuuacuuccucuccgacgaugagcugcuugagauccugagccagaccaaggacccuacagccgugcagccgcaucugcggaaaugcuuugaaaauauugcuagacuccuguuccaggaggaucuugaaaucacccacauguacuccgccgagggagaggaaguccaacuguguuuuucuauuuaucccagcuccaacguugaggacuggcuccgggaaguggagcgcagcaugaaggcgucugugcaugauaucaucgaaaaggcuauuagagccuacccuaccaugccccggacacaguggguccugaauuggccuggccaggugacgaucgccgggugccaaaccuauuggacaauggagguugcugaggcccuggaagcgggaaaccuccgcucccagcuuuucccccagcugugucagcaacugagcgaccucguggcucuggucagaggcaaacuuucucggaugcagagagccgugcugagcgcccucauuguuaucgaggugcacgcuaaggaugucguguccaaacugauucaggaaaaugucgugucuguuaacgacuuucaguggaucagccaacugcgcuacuauuggaccaauaacgaccucuacauccgggccgugaaugcugaguucauuuauggguacgaauaccuuggaaacuccggcagacuggucaucacaccgcugaccgaucgcugcuaucucacgcugacaggggcccuucaccugaaguuuggcggagcgccugccggccccgcugggaccggaaaaaccgagacaaccaaggaccucggcaaggcccuggcuauucagacagugguuuucaauugcucugaucagcuggacuucauggccauggggaaauuuuucaagggacucgccagcgcuggcgcgugggccuguuuugaugaguucaaccggaucgacauugaagugcuuuccgucguggcucagcaaaucacgaccauucagaaagcccagcagcaaagaguggagcgcuuuauguucgaagggguugagaucccucugguccccagcugcgccguguuuaucacaaugaauccuggcuacgcuggacggaccgaacugcccgauaaccucaaggcccuguucagaccgguggcgaugauggucccugacuaugcuaugauuacagagaucucucuuuacuccuuuggcuucaacgaggccagcgugcuggccaaaaagauuaccacgaccuuuaagcucuccucugaacagcugagcucccaggaucauuaugacuucgggaugcgcgcuguuaaaacagugaucucugccgcgggaaaucugaagagagagaaccccagcaugaaugaagaacugauuugucuucgggcuauccgcgaugucaacgugcccaaauuucugcaagaggaccugaagcuguucuccggcaucguuagcgaucuguucccuaccauuaaagaagaggacacagacuacgggauccuugaugaagccauuagagaggccugcagaaauucuaaccugaaggacguggaaggauuucucaccaaauguauccagcuguaugagacaaccgucgugcgccacggccugaugcucguuggcccgacgggguccggaaagagcacaugcuacagagugcuugcugccgcuaugaccucucugaagggccagcccuccauuagcgggggaauguacgaggccgucaauuauuacgugcugaacccuaaaucuaucaccaugggccagcucuauggggaguucgaucugcuuacacaugaguggaccgacggaaucuuuagcuccuucauucgggcgggcgccaucacgucugauacaaauaagaaaugguacauguuugacggccccguggaugcuauuuggaucgaaaacaugaauaccguccuggacgauaacaagaaacucugucugagcuccggggagauuaucaagcugacagaagccaugaccaugauguucgagguucaagaccucgcuguggccagcccugccacaguguccagaugcggaauggucuaucuugagcccucuauucugggccugaugccuuuuaucgaauguuggcuccgcaagcugccgccccuucugaaaccuuacgaggaacacuucaaggcucucuuugugagcuuccuggaggaauccaucucuuuuguucggagcuccgugaaagaggucauugcgucuaccaauugcaaccugacgaugagccuccuuaagcugcuggauuguuucuuuaaacccuuccucccuagagaggggcugaagaagauccccuccgaaaaacuuagccgcauuguggagcugaucgaaccgugguucaucuuuucucucaucugguccguuggagccaccggcgacagcucugggcggacauccuucagccauuggcugagacugaagauggagaaugagcagcucacccuucuguuuccugaagagggacugguguucgacuaucggcucgaagaugcuggcaucucuggcacaaacgacuccgaggaugaagaggaggaauacaaacaggucgccugggugaaguggauggacagcuccgcccccuuuaccaugguccccgauacgaauuacugcaacauuaucgugccuacaauggacaccguucagaugagccaucugcuugauaugcugcucacaaacaaaaagcccgugcugugcauugggccuaccggaaccggcaagacacugacgaucucugacaaacuccuuaagaaucuggcucuggauuauauuagccacuuccucaccuuuuccgcccgcacaucugcgaaccaaacccaggacuucaucgauagcaaacuggacaagagacggaaagggguguuuggaccgccccuuggccgcaauuucaucuuuuucauugaugaccugaacaugccugcucucgagacauacggggcccagcccccuaucgaacugcugagacaguggauggaccauggaggcugguaugaucggaagauuaucggcgccuuuaaaaaucucgucgacauuaacuucguuugugcuauggggcccccgggaggcgggcgcaauaccgugacgccuagacugaugcggcacuucaacuaccuuuccuuugccgagauggaugaagugucuaagaagcgcaucuucagcacaauucugggaaauuggcucgacggccugcuuggggagaaauccuauagagagcggguccccggagcgccucauaucgcccacuuuaccgaaccccugguggaggcuaccaucaugguuuacgccacaauuaccucucaacuccugccuacacccgcuaagagccacuauacguucaaccugagagaucucuccaaaguguuucagggcaugcugauggccgacccggcuaaggucgaagaucaggugcaacuucugcgccucugguaccaugagaauugccgggucuucagagaccgccuggugaacgaagaggaucggagcugguuugaccagcuucugaaaagauguauggagcagugggaaguuaccuucaauaaggugugcccuuuucagcccauccucuacggcgauuucaugucucccggguccgacgucaagagcuaugagcugauuacaucugaauccaaaaugaugcaagugaucgaggaguacauugaagacuauaaccagaucaauaccgccaagcugaaacucguucuguuuauggaugcgaugagccacaucugucgcauuucccggacacuuagacaggcccugggaaacgcucuccugcuuggcgucgggggaucuggccgcagcucccugacccggcucgccagccauauggcugaguacgaaugcuuccagaucgagcugucuaagaacuaugggauguccgaauggagagacgaugugaaaaaggugcugcucaaggccggacugcaaaaucuuccuauuacguuucuguucagcgacacccagaucaaaaacgagucuuuccucgaggauauuaauaacgugcugaauagcggcgacaucccgaaccuuuacacagccgaugaacaggaccagaucguuuccaccaugcgccccuauauucaagagcagggccugcagccuacaaaggcuaaucucauggcggccuacaccgggcgggucagaucuaacauccacauggugcuguguaugagccccauuggagaaguguuucgcgcuagacugcggcaauucccuucccucgucaauugcuguacaaucgauugguuuaacgaguggcccgccgaagcccugaaaucuguugcuacgguguuccuuaaugagauuccugagcuggaaagcucccaggaggaaauccagggccucauucaggugugcgucuacauccaucaaagcgugucuaagaaauguaucgaguaucuggccgaacuuacccgccacaacuacguuacacccaaguccuaucuggagcuccugcacauuuuuagcauccugauugggcagaagaaacucgagcugaagaccgcgaaaaauagaaugaaguccggacuugacaaacugcuccggaccucugaagauguggccaagaugcaggaggaccuggaaagcaugcauccgcuucuggaggaggcugccaaagauacaaugcucacgauggaacagaucaaggucgacaccgcuauugccgaggaaacaagaaacuccgugcaaaccgaggaaaucaaggcgaaugagaaagccaagaaagcucaggccaucgcugacgaugcccagaaggaccuggaugaggcucugccugcccucgacgcggcccuggcuucucuucggaaccugaacaaaaaugauguuacagaagugcgcgccaugcagagacccccucccggcgucaagcucgugauugaggcugugugcaucaugaaggggauuaaaccgaagaaagucccuggagaaaagcccggcaccaaaguugacgauuacugggagcccggcaaggggcugcuucaagacccuggacacuuccuggaaagccucuuuaaguucgauaaagacaacaucggcgauguggugauuaaggccauccagcccuauaucgacaaugaggaguuucagccugccacgauugcgaaagucuccaaggcuugcacaagcaucugucagugggugcgggccaugcauaaauaccacuucguugcuaaggccguggaaccgaagcgccaagcccugcuggaggcucaggaugaccuuggggucacccagcggauucuggacgaagccaaacaacggcuccgcgagguggaagauggaaucgcgaccaugcaggccaaguauagagagugcauuaccaagaaggaggaacuggagcucaaaugugaacagugcgagcagcggcugggccgcgcugggaaacuuaucaacggccugucugacgagaagguuagauggcaagaaaccguggagaaucugcaguacaugcucaacaauaucuccggagauguccugguggccgcuggcuuuguugccuaccuugggcccuucacaggacaguaucggaccgugcuguacgacagcugggucaaacagcuccgcucucacaacgugccucauacguccgaacccacacugauuggcacccucgggaauccugucaagaucagaagcuggcaaauugcgggacugcccaacgauacacugucuguggagaauggcguuaucaaccaguuuucccagcgguggacccacuucauugacccucagagccaagccaauaaauggaucaagaacauggaaaaagauaaugggcuugacguguucaagcugucugaucgcgacuuucucagaagcauggagaacgcuauucgguucggcaaaccgugucugcuugagaacgucggagaggaacuggaucccgcccucgaaccugugcugcucaagcagacguauaagcagcaaggcaauaccgugcugaaacugggggacacaguuauccccuaccaugaggacuuuagaauguauaucaccacaaaacuuccuaacccccacuacaccccggaaauuuccacaaaacugacccucaucaauuucacgcugagcccuuccggacuugaggaucagcugcucggccagguggucgcugaggaacgccccgaccuggaggaagccaagaaccagcugauuaucucuaaugcuaaaaugcggcaagagcucaaggauauugaagaccagauccuguauagacuuagcuccucugaggggaaccccguggaugacauggagcugaucaagguucucgaagccagcaaaaugaaggcggccgagauucaggcuaaagugcgcaucgccgaacagacagagaaggauauugaccugacccggauggaguacaucccugucgcuauuagaacccaaauccucuuuuucugcguguccgaucuggccaaugucgaccccauguaccaguauucucucgaaugguuucugaacaucuuccugagcggaauugccaauuccgagcgcgcggauaaccucaaaaagcggaucagcaauauuaacagauaccugacauauucucuuuacuccaaugugugucgcagccuguuugaaaagcauaaacucauguucgcuuuucugcuuugcguucggaucaugaugaacgagggcaagauuaaucagucugaauggagauaucugcucuccgggggcagcaucucuauuaugaccgagaacccugccccggacuggcuguccgaucgcgccuggcgggacauccuggcucucagcaaccugcccacauucucuuccuuuagcagcgacuucgugaaacaccuuuccgaguucagagucaucuuugauucucuggaaccucaccgggagccccucccuggaauuugggaccaguaccuggaucaauuccagaaacuucuggugcucagaugucugcgcggcgacaaaguuacgaaugccaugcaggauuuuguggcuaccaaccuggaaccccgguucaucgagccgcagacagccaaucucagcgucguguuuaaggacuccaacucuaccacaccucugauuuucgugcuuagccccgggaccgauccugcggccgaccuguauaaguuugcugaagagaugaaauucuccaagaaacucucugccaucagccugggacaaggccaggggcccagagcugaggccaugaugcgcuccagcauugaaagaggaaagugggucuuuuuccagaauugccaucuugcgccgucuuggaugccugcccuggagcggcucaucgaacacaucaaccccgauaaaguccaucgcgacuuuagacuguggcugacgucccuccccagcaauaaguucccugugucuauucugcaaaacggcuccaaaaugaccaucgagcccccucggggcgugcgcgcuaaucuucucaagagcuacuccucucucggggaagauuuccugaacagcugucacaaggucauggaguuuaaaucccuucugcucucucugugccuguuccacggaaaugcccucgagagacggaaguuuggcccgcugggguucaacauucccuacgaauuuacagacggagaucuucgcaucugcauuagccagcugaaaauguuccucgacgaguaugacgauaucccuuacaaggugcugaaauauaccgcuggcgaaaucaauuacgggggaagaguuacagacgauugggaccggcgcuguauuaugaacauccuggaggauuuuuauaaucccgacgugcucuccccugagcauagcuacucugccuccggcauuuaucaccagauucccccuaccuacgaucuucauggcuaccugagcuauauuaagucucugccgcucaacgacaugcccgaaaucuucgggcugcacgauaacgcuaauauuacguuugcccagaacgagacauucgcgcuucugggaaccaucauccaacuccagccuaagagcuccucugccggcagccaggggagagaagagauugucgaagacgugacacagaauauccugcugaaaguucccgagccuauuaaccuucaaugggugauggcuaaguaccccguccucuaugaggaauccaugaauaccgugcugguucaggaggugauccgguacaaccgccugcuccaggucauuacccagacacugcaagaucuucugaaagcccucaagggacugguggugaugagcucucagcuggaacuuauggccgcuucccucuauaauaacacggucccggagcuguggagcgccaaagcguacccuucccugaagccccucucuagcuggguuauggaccugcuucagagacuggacuuucuccaggcuuggauccaggauggcauccccgccguguucuggauuuccggguuuuucuucccucaggccuuucugaccggaacacugcagaauuucgcucggaaguuugugaucucuauugacaccaucagcuucgauuuuaaagucauguucgaagcccccuccgagcuuacacaaagaccucaggugggcugcuacauucauggccucuuucuggagggggcucgcugggacccggaagccuuccagcuggcggagucucagcccaaggaacucuauaccgagauggccguuaucuggcugcuuccuacgcccaaccggaaagcucaagaucaggacuuuuaccuguguccuaucuauaagacacucaccagagccggaacccugagcacaaccggccacuccacaaauuacgugauugcugucgaaauccccacgcaccagccgcagcgccauuggauuaaaagagggguggcccugaucugcgcgcuugauuauuga

SEQ ID NO: 68427 - RNA, 2619 nt, Artificial Sequence
  derived and/or modified sequence opt5 from DNAH2__Homo_sapiens__NP_001290199
augagcuccaaggccgagaaaaagcagagacugucuggccgggggagcucccaggcuucuuggagcggacgcgccaccagagcggcuguggccacacaagaacagggcaacgcccccgcugucuccgagccugaacuccaggccgagcugccgaaagaggaacccgagccucggcuugaagggccccaagcucagucugaggaaagcguugagccugaggccgacgugaagccccuguuccucucccgcgcggcccugacgggacuugcugaugccguguggacccaggaacacgacgcuauccuggagcauuuugcccaggauccuacagaaagcauucucaccaucuucauugacccgugcuuuggccugaaacuggagcucgggaugcccguccaaacacagaaucagcugguguacuucaucagacaggcgccuguucccauuaccugggaaaacuuugaggccacagugcaauucggaaccguccggggcccuuauauccccgcccuucugcgccuccugggcgggguguuugcuccgcagaucuucgcuaauacgggauggccugagucuauuagaaaccacuuugccucccaucuucacaaguuccuggccugucucaccgauacacgguacaagcuggaaggccauaccguucuguauauccccgcugaggcgaugaauaugaaaccugaaauggugauuaaggacaaagagcucguccagcgccuggaaacaagcaugauccacuggaccagacaaauuaaggagaugcuuucugcccaggagacgguggaaacaggggagaaccugggaccccucgaagagaucgaauuuuggcggaaucgcugcauggaucuguccggcauuagcaaacagcuugugaagaagggggucaaacacguugagucuauccugcaucucgcuaaguccagcuaccuggcccccuucaugaaacuggcccagcaaauccaggacggauccagacaggcucagucuaaccucaccuuucugagcauucuuaaggagccuuaucaagaacuggccuucaugaaaccgaaggauaucuccagcaaacuccccaagcugauuucucuuauccggauuaucugggugaacuccccucacuacaacacacgcgagagacugaccagccucuuccggaagaugucuaaugaaaucauuagacuguguugccaugcgaucagccuggaccgcauuuuugagggcuauguguccucuagcaaagaggaucuccagggcuguauccugugcugucacgcuuggaaggaccacuacguccaggccgugcagaugcauauucaauucuccagccggggguggguucuugaucagaccucuaucuuugcccagguggacgcuuucguccagagaugcaaagaccugaucgaagugugugauugccaauaccacuuugcccgcugggaggacggaaagcagggcccccucccuuguuucuuuggggcucagggaccccaaauuacacggaaccugcuggaaaucgaggauauuuuccauaaaaaucuucacacgcucagagccguucgcggcgggauccuggacgugaagaauaccugcuggcaugaagauuauaauaaguuucgggcgggaauuaaagaccuggaggucaugacacagaaccucaucaccuccgccuucgagcuggugagagaugucccgcacggcgugcuucugcucgacacauuucaccgccuggcuagccgggaagccauuaagagaaccuacgauaaaaaggcuguugaccuguauaugcuuuucaacucugagcucgcccuggugaaucgcgaacggaacaaaaaguggccugaucuggagcccuacgucgcgcaguauuccggcaaggccagaugggugcauauccuccggcgcagaaucgaccggguuaugacgugccuggcuggggcccacuuucuuccuagaauuggaacaggcaaagaaagcgugcauaccuaccagcaaaugguccaggcuaucgacgagcuggugcgcaagaccuuccaggaguggacauccucucucgauaaagacuguauucggagacuggauacaccccugcuucgcaucagccaggaaaaggccgggaugcucgacgugaauuucgauaaauauagaucccaccuggccccuuuucccuacaccccgcugcuccaacugucucaggaguuccacagccaucuucugacgccucucuuuauuauccugucccugagccacaccaucugccuucucucuuccuucuacuuuuucuuuagcucuuucauuuuuguuagcccccaucugcccccuuguuaucagcacuucaacuuuacaaccuaccugaagacacagcaaaauaagaccaugaucggacaggcucgguggcucacgccggucauucccgcgcugugggaagccgaggugggcgcuucccuugaaccucgcucucugagaaccgccugggccacauggcagaaccccgugagcgcuaaaaauaccaagaucuccugggccugguggcauaaaccugucgugagcgcgacaugggagggggagguuggcggaucucccgaaccuggccggcaacgccuccaguga

SEQ ID NO: 68428 - RNA, 12351 nt, Artificial Sequence
  derived and/or modified sequence opt5 from DNAH3__Homo_sapiens__NP_060009
augggcgccaccgggagacuggaacucacacuggcugcgcccccucacccgggacccgcguuccagcggagcaaggcucgcgaaacgcaaggcgaggaagagggguccgaaaugcagaucgccaaaucugacagcauucaucacaugucccauucucagggacagccugagcuucccccucugcccgccagcgcuaaugaggaaccuuccggccucuaccaaaccgugaugucucacagcuuuuauccgccccugaugcagagaacauccuggacccuugccgcuccuuucaaggagcagcaucaccaccgggggcccagcgauucuaucgccaauaacuacucccugauggcccaggaccucaagcugaaggaucugcucaagguguaucaaccugccacaauuagcguuccccgcgacagaaccggacagggccugccgucuuccggcaaucgguccucuuccgaaccuaugcgcaagaagacaaaguuuagcuccagaaacaaggaggauucuacccggaucaagcuggcuuucaagacgagcaucuuuucccccaugaagaaggaggugaagaccagccugacauucccugggucucgccccaugucccccgaacagcagcucgacgugaugcugcaacaggagauggaaauggagagcaaggaaaagaagccuucugagagcgaucuugagagauacuauuacuaucugaccaauggaauccggaaggacaugaucgccccggaagagggcgaaguuauggugcgcauuuccaaacucaucucuaacacacugcugaccagccccuuucucgagccucugaugguugugcuuguucaggaaaaggagaaugauuacuacugcucccugaugaaaagcauuguggacuauauccucauggaucccauggagagaaagcggcuguucauugaaucuaucccucgccuuuuuccccaaagaguuauucgggcuccggugccuuggcauuccgucuacagaagcgccaagaaauggaacgaggaacaccuccacacggugaaucccaugaugcuccgccugaaggagcugugguucgcggaauuucgggaccucagauucgugcgcacagccgagauccuggcugggaaacuuccucugcagccccaggaguuuugggaugucauccagaagcacugucucgaagcccaccaaacccugcuuaacaaauggauuccuacaugcgcucagcuguucaccucucggaaggagcauuggauccacuucgcccccaaguccaauuaugacagcuccagaaacauugaagaguacuuugccucuguugcuagcuucaugucccuccagcugcgcgagcuggugaucaaaucucucgaagaccuggugagccuuuuuaugauucauaaggauggaaaugacuucaaagagccguaucaggaaaugaaguuuuucaucccucaacugaucaugauuaaacucgaggucuccgaacccaucauuguguuuaaccccagcuucgauggcuguugggagcugauccgggacucuuuucuggagauuaucaaaaauuccaacgggaucccuaaacuuaaauacauuccgcucaaguucagcuuuaccgcggccgcugccgauagacagugcguuaaagccgcugaacccggagagccuucuaugcacgccgcggcuacagccauggccgaacugaagggcuauaaccugcuccugggcacggugaaugcugaggaaaaacuugucuccgacuuccugauccagaccuuuaagguguuccagaagaaccaaguugggcccuguaaauaccucaauguguacaagaaauaugucgaucugcuggacaacacagccgagcagaauauugcugccuuccuuaaggagaaccaugauaucgacgauuuugugaccaaaauuaaugcgaucaagaaacgccggaacgaaauugccagcaugaauaucacagucccucucgcuauguucugccuggacgccaccgcucugaaccacgaccucugugagagagcccagaaucugaaggaucaccuuauccaguuucaaguggacguuaaccgcgauacgaauacaucuauuugcaaccaguacagccauaucgcggacaagguguccgaaguccccgccaauaccaaagagcuggugagccucauugaguuccugaagaaaucuuccgcuguuaccguguuuaagcugcggagacagcuucgggaugccagcgagcgccucgaguuccugauggacuaugcugaucugccuuaccaaaucgaagacauuuuugauaacuccagaaaccuccugcuucacaaacgggaccaggccgagauggaucugaucaagagauguucugaguucgagcuccgccuggagggauaucaucgggaacuggagagcuuuagaaagcgcgaagucaugacaaccgaggaaaugaaacacaauguggagaaacuuaacgagcucuccaaaaaucugaacagagccuucgcugaauuugagcugaucaauaaggaagaggaacuccuggagaaagagaagucuacauacccccuucugcaggcgaugcucaagaacaaagugccguaugaacagcuguggagcacggccuacgaguucuccauuaagucugaagaguggaugaauggcccucuguuucuucugaacgcugaacaaaucgccgaggagauugggaauauguggcggaccacauacaaacucaucaagacccugagcgacguucccgccccucgcagacucgcugaaaacgucaaaauuaagaucgauaaguucaaacaguauauccccauucuguccaucagcugcaauccgggaaugaaggaccggcacuggcagcagauuucugagaucgugggcuacgaaauuaaaccuacagagaccacgugucuuuccaacaugcuggaguucggguuuggaaaguucguggaaaaacucgagcccaucggcgccgcggcuagcaaggaauauucucuggagaaaaaucuggaccgcaugaaacuugauugggucaacgugaccuuuuccuucguuaaguacagagacacagauaccaauauccugugcgccauugacgauauccaaaugcuccuggacgaucaugugauuaaaacacagaccaugugcggcagcccuuuuaucaagcccauugaagccgagugucggaaaugggaggaaaagcucauccgcauucaggacaaccuggaugcuuggcuuaaaugccaggccacguggcuguaucucgagcccaucuucucuuccgaagacaucauugcgcaaaugccugaggaagggagaaaguuuggaaucgucgauagcuacuggaagucccugaugagccaggcugugaaagacaaccggauucugguugccgccgaucagccgcgcauggcugagaaacuucaagaggccaauuuccugcucgaagacauccagaaaggccugaacgacuaucucgagaagaaaagacuguuuuucccccgguuuuucuuccuuucuaaugaugaacugcuggagauucucagcgaaacaaaggacccucugagagugcagccccaccuuaagaaauguuuugaggggaucgcuaagcuggaguucaccgauaaccucgaaaucgucggaaugauuuccucugagaaagaaacagugccuuuuauccagaagauuuaccccgccaaugcgaaaggcaugguugagaaguggcugcaacagguggagcagaugaugcucgccagcaugcgcgaagucaucgggcugggcauugaggcuuacgugaaggugccucggaaccauuggguccuucaguggccgggacaaguugugaucugcguguccucuaucuucuggacccaggaagucagccaggcccuggcugagaauacccugcucgacuuucugaaaaaguccaacgaucagauugcccaaaucgugcagcuuguuagaggcaaacugucuagcggggcccgccucacacugggagcucucacggugauugacguccacgcgcgggaugugguugccaagcuguccgaagacagagugagcgaucuuaaugacuuccaguggaucucucagcugcgcuauuacugggucgcuaaagaugugcaaguucagauuaucaccacagaggcccuguauggcuacgaguaucucgggaacagcccccggcuggugauuaccccucuuacagacagauguuaccgcacccugaugggagcccucaagcugaaucucggcggggcucccgaaggcccugccggaacgggcaagacagagaccaccaaagaccuggcgaaggcucuugccaaacagugcgucguguuuaacuguagcgaugggcuggacuauaaggccaugggaaaauucuuuaagggccuggcucaagccggggcgugggcuugcuucgaugaauuuaaucggaucgagguggaaguccucucuguuguggcccagcagauccuguccauucagcaagccaucauuagaaaacuuaagacauucaucuuugagggaaccgagcugagccucaaccccacaugugcuguguucauuacgaugaauccgggcuacgccgggcgggcugaacugccugacaaccugaaggcccucuuccgcaccgucgcgaugauggugcccgauuacgcccuuaucggcgagaucucccuguauucuaugggauuucuggacagcagaucccucgcucagaaaauuguugccacauaccggcugugcagcgaacagcuuucuucccagcaucacuaugauuacggcaugcgcgcugucaagagcguccugaccgccgccgggaaccucaaacugaaguaucccgaggaaaaugagucugugcugcuccuuagagcucugcuggacguuaaccucgcgaaauuccuggcccaagaugugccucuuuuucagggaaucauuagcgaccuguuccccggcgucgugcucccuaagccggauuacgaggucuuucugaaggugcugaaugacaacaucaaaaagaugaaacuccagcccguuccuugguucauugggaagaucauccagauuuaugaaaugaugcuugugcggcacggauacaugaucgucggcgaucccaugggaggcaaaacauccgcuuacaaggugcuggccgccgcucugggagaccuccaugccgcgaaucaaauggaggaauuugcuguugaguauaagauuaucaacccuaaagccauuaccaugggccagcuguacggguguuucgaccaggugucucacgaguggauggauggaguccuugccaaugcuuuuagagaacaagccagcucccugucugacgaucgcaaguggaucauuuucgacggccccguggaugcgaucuggaucgagaacaugaauacggugcucgacgauaacaaaaagcugugccugaugagcggggaaauuauccagaugaacuccaaaaugagccucauuuuugagccggccgaccuugaacaggcuucuccugccaccguuucccggugcggaaugaucuauauggagccccaucagcugggcuggaagccucugaaggauagcuacauggacacacuccccuccucucugaccaaagagcacaaggaacuugucaacgauauguucauguggcuggugcaaccuugucucgaguuuggcagacugcauugcaaauucgugguccagacaagccccauucaccuggcuuucuccaugaugcgccucuauucuagccuucuggacgaaauccgggccguggaggaagaggagauggaacugggggagggacucuccagccagcagaucuuucuguggcuucaaggccuguuccucuuuucucugguuuggaccguggcugggacaauuaaugccgauuccagaaagaaauucgacgucuuuuuccgcaaccugaucaugggaauggacgauaaucacccgcggccuaagagcgugaaacucaccaagaacaauauuuuucccgaaagaggcucuaucuacgacuucuauuuuauuaagcaggcguccgggcauugggagacguggacacaguacaucaccaaagaagaggagaagguucccgccggagcuaaagugagcgaacuuaucauuccuaccauggagacagcccgccagucuuucuuucugaagaccuaccuggaucacgaaaucccgaugcuguucgucggccccacgggcacagggaaaagcgcuauuaccaacaacuuucugcuucaucugccuaagaauacauaucuccccaacuguaucaauuucuccgccagaaccucugccaaccaaacacaggacauuaucaugagcaagcuggaucggcgcagaaaaggacuguucggcccucccauugggaagaaagcugugguuuuuguggacgaucucaauaugccugcgaaggaggucuacggagcccagccgcccaucgagcuucugcggcaguggaucgaccacggcuauugguucgauaaaaaggacaccacgcgccuggauauuguggacaugcuccuggugaccgcuauggggccucccggaggcggcagaaacgacaucacagggcgguuuaccagacaccuuaauauuaucuccauuaacgccuucgaagaugacauccugacaaagaucuuuagcuccauugucgauuggcauuucggaaaaggcuuugacguuauguuccuccgcuacgggaagaugcuggugcaagccaccaaaacgaucuaucgggaugcuguggagaauuuucugccuacacccucuaagagccacuacgucuucaaccucagagacuuuucccgcgugauucagggaguucuucugugcccgcauacccaccuucaagauguggaaaaauguauccggcucuggauucaugaggucuauagaguguucuacgaccggcugaucgauaaggaagaccgccaagucuuuuucaauauggugaaggagacaaccucuaacugcuucaaacagaccaucgagaagguccuuauucaccugagcccuacaggcaaaaucguggaugacaauauuagaucccucuuuuucggggauuacuuuaagcccgaaucugaccagaaaaucuaugacgagauuacggaucugaagcagcugaccgucgugauggaacacuaccucgaggaguucaacaauaucagcaaagcccccaugucccuuguuauguuucgguucgcgauugagcauaucagccgcaucuguagagugcugaagcaagacaagggacaucugcuccuggugggcauuggcgggucuggacggcaguccgccgcuaaacuuagcacauuuaugaacgccuaugagcuguaccagaucgaaauuaccaagaacuaugcuggcaaugauuggcgcgaggaccucaaaaagaucauucugcaggucgggguugccacaaaaucuaccguguuccuguuugcggauaaccaaaucaaggacgaauccuucguggaggauaucaauaugcuccugaacacgggagacgucccuaauauuuuucccgccgaugaaaaggcugacaucguggagaaaaugcagacagccgcuagaacccagggcgagaagguugaagugaccccucuuagcauguacaacuucuuuauugagcgggucaucaauaaaauuucuuucucccuggccaugagcccgaucggggaugcuuuccgcaacagacuccggauguuucccucccugaucaauugcuguacaauugacugguuccagagcuggccuaccgacgcccuugaacugguggcgaacaaguuucucgaggaugucgagcuggacgauaauaucagaguggaaguugugucuaugugcaaauauuuccaagagagcgucaagaagcugucccucgacuacuacaacaaacugcgccggcauaauuaugugacacccacgucuuaccuugaacugauucucaccuuuaagacacugcuuaacagcaaaagacaggagguugccaugaugcgcaaucgguaucugaccggacuccagaagcuggauuucgcugccucccaaguggcugucaugcagagagaacugacagcccuccagccucagcugauccuuaccucugaggagacggccaaaaugauggugaagauugaagcggagacccgcgaagcugacggcaagaaacugcucgugcaagccgaugagaaggaagcuaacguugccgccgcuaucgcccagggcaucaaaaacgagugugagggggaccuggcggaagccaugcccgcucuugaggccgcucuggccgcgcucgauacacugaauccggccgacauuagccuggucaaguccaugcagaacccucccggaccugugaaacucgugauggaaucuaucugcauuaugaagggcaugaagcccgagcggaaaccugaucccagcggguccggaaagaugaucgaagacuacuggggcgucagcaaaaagauucugggggaucuuaaauuucuggagucucucaagaccuaugacaaagacaauaucccgccucugacaaugaagcggauucgcgagcgguucaucaaccaccccgaauuucagcccgcuguuaucaagaauguguccagcgccugcgagggacuuuguaaaugggugagagcuauggaagucuacgaucgcguggccaagguuguggcuccuaaacgggagagacugcgcgaggccgaaggcaagcucgcggcccaaaugcagaaacugaaccagaagagagcugagcugaagcucgucguggaccggcugcaggcccuuaaugaugacuucgaagagaugaacaccaaaaagaaagaucuggaagagaauauugagaucugcucucaaaagcucguucgcgcugaaaaacugauuuccggccuugggggagagaaggacagauggacagaagccgcccggcagcugggcaucagauauacgaaccucaccggggaugugcugcugagcuccggaacagucgcguaccucggcgcuuuuaccguggacuaccgggugcagugucaaaaucaguggcuggccgagugcaaggauaaagucauuccgggguucucugacuuuagccuuucccacacccugggagaucccaucaagauccgcgccuggcagauugcuggccucccuguugacagcuucucuaucgauaacggcauuaucguguccaauagcagacggugggcccugaugauugacccccaugggcaggcuaacaaauggaucaagaauauggaaaaagccaacaaacuugcggugaucaaguucucugacagcaacuauaugcgcaugcuggagaaugcccuccaacugggaacaccuguccugauugagaacaucggcgaagaacucgaugcuuccauugaacccauccugcuuaaagccacguuuaagcagcaggggguggaguacaugagacugggagaaaauauuaucgaguauucucgggacuucaaacucuacauuaccacacgccugagaaacccucacuaucuucccgagguugcugugaaggucugucugcucaauuuuaugaucaccccgcugggccugcaggaucaacuucuggggaucguggccgcgaaagaaaagccugagcucgaagagaaaaagaaccagcugauuguugagagcgccaagaauaaaaagcaucucaaagaaaucgaggacaagauucuggaagugcuuuccaugucuaaaggcaacauccuggaggaugaaacagcuauuaagguccugagcuccagcaaggugcucucugaggagaucuccgaaaaacagaagguugccagcaugaccgagacgcagaucgacgaaacacggaugggauacaaacccguggcuguccacuccgccaccauuuucuuuugcaucucugaucuggcuaauauugagccuauguaucaauacagccuuaccugguucaucaaccuguacaugcauucccucacacacucuaccaagagcgaagaacugaaucuccgcauuaaauauaucaucgaccacuuuacacuguccauuuacaacaauguguguagaagccuguucgagaaggauaaacuucuguuuucucuccugcuuaccaucggcauuaugaaacagaagaaagaaaucacggaggaagucugguauuuccugcucacagggggaauugcccuggacaaccccuacccgaauccugcgccccaguggcucuccgagaaggccugggcugaaaucgugcgggccagcgcccugcccaaacugcauggccuuauggagcaccuggagcagaaccucggggaauggaagcugauuuaugauucugcuuggccucaugaggaacaacuucccggauccuggaaguuuagccagggccuggagaaaaugguuauccuccgcugccugagaccugacaagauggugccggccguccgggaguucaucgcggaacacauggggaaacuguacauugaggcucccaccuucgaccuccagggcucuuauaacgauuccagcuguugcgccccucugaucuuugugcuuucucccagcgccgacccuauggcuggacugcucaaguucgccgaugaccugggcaugggcgggacacgcacccaaacgauuucccuugggcaggggcagggacccaucgcugccaaaaugauuaauaacgcgaucaaggauggcaccugggugguucugcagaauugucaccucgccgcuagcuggaugccuacacuggagaagaucugcgaggaagugauugucccggaguccaccaacgccagauuucggcuguggcucacaucuuaccccagcgagaaguucccuguguccauccugcaaaaugggauuaagaugaccaacgaacccccuaaaggccuuagagcuaaucugcuccgcucuuaccugaacgaccccaucagcgauccggucuuuuuccaguccugcgccaaggcggugauguggcagaaaaugcuuuuuggacuguguuucuuucaugccgucgugcaggagcggagaaauuucggcccucucggguggaacauucccuaugaauuuaaugagucugaccugcgcaucagcauguggcaaauccagauguuccugaacgauuacaaggaaguccccuuugacgcucucacauaucugaccggagagugcaauuacggcgggcgggugacggaugacaaagauagacgccuucugcucucccugcuuagcauguucuauuguaaggagauugaagaggacuacuauucucuggccccuggagacacauacuacauucccccucacggcuccuaucagagcuacauugauuaucuccggaaccugccgaucaccgcucaucccgaaguuuucggccugcacgagaaugccgacauuaccaaggauaaccaggaaacaaaccaacucuuugagggggugcugcuuacccugccuagacagucuggaggcuccgggaaaagcccccaggaggucguggaagaacucgcccaagacauccugucuaaacuuccucgcgauuucgaccuggaagagguuaugaaacucuaccccguggucuaugaggaauccaugaauacagugcugcggcaggagcugauuagauuuaaccgccucacgaaggugguucggagaagccugaucaaucuuggacgggcuaucaaaggccagguccugaugucuuccgaacucgaggaaguguucaacagcaugcugguggggaaggucccggcgaugugggccgcuaagagcuacccuucccuuaaaccccugggaggcuauguggccgaucuccuggccagacugaccuuuuuccaggaguggauugacaagggcccucccguuguguuuuggaucucuggguucuacuuuacacagagcuuccucaccggagucucccagaauuacgcucgcaaauauacaauuccgaucgaucauauuggcuuugaguucgaagugaccccucaggagacgguuauggaaaacaaucccgaggacggggccuacaucaagggacuguuucuugaaggcgcgcggugggauagaaaaaccaugcagaucggggagucucugcccaagauucucuaugacccucugcccaucauuuggcugaagccuggagagagcgcuauguuccuccaccaagauaucuacgugugcccggucuauaaaacauccgcccgcagaggcacccuuucuacaaccggccacagcacgaacuacgugcuguccauugaacugcccacagacaugccucagaagcauuggaucaauagagggguugccagccucugucagcuggacaacuga

SEQ ID NO: 68429 - RNA, 13875 nt, Artificial Sequence
  derived and/or modified sequence opt5 from DNAH5__Homo_sapiens__NP_001360
auguucagaaucggccggagacagcuguggaagcacagcgugaccagagugcucacccaacggcugaagggggaaaaggaagcuaagcgcgcccuucuggacgccagacauaacuaccucuuugcgauuguugcuuccugccuggaucuuaauaagacggaaguggaagacgccauccuggaaggaaaccagauugaacggaucgaucaacucuucgccgugggcgggcugcgccaccugauguuuuauuaccaggacgucgaggaggcugaaaccggacaacucggcucucucgggggcgugaaucuuguuagcggcaagauuaagaagcccaagguguucgucaccgagggcaacgauguggcccugaccgggguuuguguguuuuucaucagaacagacccuuccaaggcuaucacccccgauaauauucaucaggaagucucuuuuaacaugcucgacgccgcggauggaggccugcuuaauagcgugcggcgccugcucuccgacaucuucauucccgcccugagagcuacaucucacggguggggagagcuggagggccuccaggaugccgcuaacauccggcaggaauuucugagcucccuugagggguucgugaauguccugagcggagcccaagaaucucucaaagagaagguuaaccugcgcaaaugcgacauucuugaacugaagacccucaaggagccuacggauuaucugacccuggcgaauaaccccgagacacucggcaaaaucgaagacuguaugaagguguggauuaaacagaccgaacaggugcuggccgaaaauaaccagcuucugaaggaggcugacgaugucggcccuagagccgaacucgagcauuggaaaaagcggcuguccaaauuuaauuaccuucuggagcaacucaagagccccgacgugaaggcuguucuggccgugcuggccgcugcgaaaucuaagcuccugaaaacauggcgcgaaauggauaucagaaucaccgacgccacgaacgaggcuaaggauaacgucaaauaucuuuacacacuggaaaagugcugugacccucucuauuccagcgauccgcugucuaugauggacgccauucccacccugaucaaugccauuaagaugaucuacuccauuagccacuacuauaacacauccgagaaaaucaccucucuuuucgugaagguuaccaaucagaucauuagcgcuugcaaagccuacaucacaaacaaugggacggcguccauuuggaaccagccucaagauguggucgaagagaagauccucagcgcuauuaaacugaagcaggaguaucagcuguguuuucacaagaccaaacagaagcucaaacaaaaucccaacgccaagcaguucgacuucucugaaauguacaucuuuggaaaauucgagacauuucaucggagacuggccaagaucauugauaucuucaccacacuuaagaccuauuccgugcugcaggacagcacgauugaaggccucgaggacauggcuacaaaauaccaggggaucgucgccaccauuaagaaaaaggaguauaauuuucuggaucaacgcaaaauggacuucgaucaggacuacgaagaguuuugcaagcagaccaacgaucugcacaaugaacuucggaaauucauggacgugacauuugcuaagauccagaacaccaaucaagcccucagaaugcugaagaaauucgagcgccugaacauuccuaaucucggaaucgaugacaaguaccagcugauccuugaaaacuauggcgcggauauugacaugaucucuaaacuguacacaaagcagaaauaugaucccccgcucgcccggaaccagccucccauugcugggaagauccugugggccagacaacuguuucaucgcauucagcagccuaugcaacuuuuccagcagcaccccgcuguucucagcacggccgaggcgaagcccaucauccgguccuacaauagaauggccaaagugcugcuggaguuugaaguccucuuccaccgcgcuuggcugcggcagauugaggaaauccaugugggacuugaggccucucugcucguuaaggcuccuggcaccggcgaacuguucgugaacuuugacccgcaaauucugauccuuuucagagagacagaguguauggcccagauggggcucgaagucagcccccuggccaccucccuguuucagaaacgcgaucgguauaagagaaauuucagcaacaugaaaaugaugcucgcugaguaccagcgggugaagucuaagauuccugcggccaucgaacaacugaucgugccccaccuugcuaaaguugacgaggcccugcagccuggacucgccgcucugacauggaccucccugaauauugaagccuaucuugagaacacguuugcgaagaucaaagaccuggagcuccugcucgaucgcgucaaugaccugauugaguucagaaucgaugcuauucuugaggaaaugagcucuacaccgcugugccagcucccgcaggaggagccucugacaugugaagaguuucugcaaaugaccaaggaccuuugcgugaacggcgcccagauccugcauuucaaauccagccucguggaagaggccgucaaugaacuggugaacaugcuccuggauguugaggugcuuuccgaggaagagucugaaaagaucagcaaugagaacuccgucaauuacaagaacgaaucuagcgcuaaacgggaggaggggaauuuugacacacugaccuccagcauuaacgccagagcgaacgcucuccugcugacgacagugacccgcaagaaaaaggaaacagagaugcuuggagaagaggcccgggaacugcucucucacuucaaucaucagaacauggaugcccugcucaaaguuaccagaaauacccuggaggcuauccgcaagcgcauucacuccagccacacaaucaacuuucgggacucuaauuccgccagcaacaugaaacaaaauucucuucccauuuuccgcgcuagcgugacgcuggccaucccuaacauugucauggcgcccgcccuggaggaugugcagcagacccucaauaaggcuguugaaugcaucaucuccgugccuaagggcgucagacaguggagcucugagcugcuuuccaaaaagaaaauucaagaacggaagauggccgcucugcagagcaacgaggacuccgauucugacguggagaugggggaaaaugagcuccaggauacacuggaaaucgccagcgugaaccuccccauuccgguccagaccaaaaauuacuauaagaacguuuccgagaauaaggaaaucgugaaacuggugucuguccuuagcacaauuaucaacuccaccaagaaagaggugaucacgucuauggacuguuuuaagcgcuacaaccauauuuggcaaaaaggcaaggaggaagccaucaagacauucauuacccagagcccucugcuguccgaguucgaaagccagauccucuauuuucagaaucuggagcaagaaauuaacgcugagcccgaguacguuugcgugggaucuaucgcgcuuuauaccgccgaccugaaauucgcucucacagccgaaaccaaggccuggauggucgugaucggcagacacuguaauaaaaaguaccgguccgagauggaaaacauuuuuaugcugaucgaggaguucaauaaaaagcucaaccgccccauuaaggaucuggacgauaucagaauugcuauggccgcgcuuaaagagauccgggaggaacagauuagcaucgacuuucagguugggccuaucgaggaaucuuaugcucugcugaaucgcuacggacuccugauugccagagaggagaucgauaagguggacacacuucauuacgccugggaaaaacugcucgcucgggccggcgagguccagaacaagcuggugucccuccaaccgagcuucaaaaaggaacugauuucugcgguugagguguuucuucaggauugccaccaguucuaucuggacuacgaucugaaugggcccauggcuuccggacucaagccucaagaagccagcgacagacugaucauguuucagaaccaguucgauaauauuuaucgcaaauacaucacguauaccggcggggaggagcuuuuuggccugcccgccacacaguacccucaacuccuggaaaucaagaaacagcugaaccuccuucagaagauuuauacccuguacaauuccgucaucgagacagugaacagcuacuaugacauucuguggucugaagugaauaucgagaaaauuaacaaugaacuccuggaguuccagaaccgguguagaaaacuuccccgcgcucugaaagacuggcaagccuuccucgaucugaagaagaucaucgacgauuuuagcgagugcuguccucugcucgaauacauggcuuccaaagccaugauggagcggcacugggaaagaauuaccacgcuuaccggacauucucuggacgucggcaacgagagcuucaagcugcgcaauaucauggaagcgccccuccugaaauauaaggaggagauugaagauaucugcauuuccgccguuaaagagcgggacaucgaacagaaacuuaaacaggugauuaacgagugggauaauaaaacauuuaccuucgggucuuuuaagacaagaggagagcugcuccugcgcggcgacagcaccuccgaaaucaucgcuaacauggaggauucucugaugcuccuugggagccugcuguccaaucgguacaacaugccguucaaagcccagauucaaaagugggugcaguaucucagcaauucuacagacaucauugaauccuggaugaccguccagaaccuguggaucuaccuugaggcuguguuuguuggaggcgauauugccaaacaacugccuaaggaagccaagagauucagcaauaucgacaaaucuugggugaagaucaugacgcgggcucacgagguccccuccgugguucaguguugcgugggggaugagacacucggccagcugcugccucaucuccuugaccagcuggaaauuugucagaagucccugaccggauaucucgagaagaaacgccugugcuuucccagauucuuuuucgucuccgacccggcgcuucuggaaauccucggccaggccucugauagccacaccauucaggcucaucugcugaacguguuugacaauaucaaguccgucaaguuccacgagaaaauuuacgaucggauccucagcaucucuucccaggaaggggagacaauugagcuugacaagccugugauggccgaaggaaacguugagguguggcugaauagccugcucgaagagucucaaagcucccugcaccuugucauccgccaggccgcugccaacauucaggaaaccggcuuccagcugacggaguuucucucuagcuuccccgcgcaaguggggcugcugggaauccagaugauuuggacaagagauuccgaggaagcucuccggaaugccaaauuugacaagaaaaucaugcagaagaccaaccaggccuuccuugagcugcugaacacacucauugauguuaccacaagagaccugucuagcaccgaacgcgugaaauacgagacgcuuaucaccauccauguccaccaacgggauauuuuugacgaucugugccauaugcacaucaaguccccuauggacuucgaguggcucaagcaguguagauuuuauuucaaugaagauagcgacaaaaugaugauucauaucacagacguggcuuuuauuuaccagaacgaguuccugggcugcaccgaucgccuggugaucacaccccucaccgaccgguguuauaucacgcuugcccaagcgcuggggaugucuaugggcggagcccccgcuggcccugccgggacaggaaagaccgaaacaaccaaagauaugggcagaugccuggggaaguacguugucguguuuaauuguuccgaccagauggauuuccgcggacucggccggauuuuuaaaggccuggcucagagcggguccuggggaugcuucgacgaguucaacagaaucgaucuuccggugcugucugucgccgcucagcaaauuagcaucauucucaccuguaagaaggaacacaaaaaguccuuuaucuucacagacggcgauaaugugacgaugaaccccgaguuugggcuguuccugaccaugaauccuggauaugccggccgccaggagcuccccgaaaaccuuaaaaucaauuuuagaucuguugcgaugauggugccugaccggcagauuaucauucgcgucaagcuggccagcugcggguucaucgauaacgugguucuggcuagaaaauuuuucacacucuacaagcugugugaggaacagcuuuccaagcaagugcacuaugacuuuggacugcggaauauucucagcguccugcgcacccugggcgccgcuaaaagagccaaccccauggacacagagucuaccaucgugaugcggguucucagagauaugaaucuuuccaagcugauugacgaagaugagccucuguuccucagccugaucgaggaccuuuuuccgaacauccugcucgauaaagccggcuaccccgaacuggaggcugcgauuucucgccagguggaagaggccgggcugaucaaucauccucccuggaagcucaaagucauucagcuguucgaaacgcagcgggugagacacggaaugaugacacuuggcccuuccggggcuggaaagacaaccugcauccauacacugaugcgcgccaugaccgacuguggcaagccccaccgggagaugagaaugaacccgaaagccauuacagcuccucaaauguuugggcggcucgauguggccacgaacgacuggaccgauggaaucuucagcacacuguggcgcaagacccuuagagcgaaaaagggcgagcacaucuggauuauccuggacggccccgucgaugccauuuggaucgaaaaucucaacucuguucuggacgauaauaaaacacugacccucgcuaacggggaccggauucccauggccccuaauugcaagaucaucuucgagccccauaacauugacaaugcuagcccugccacggugucccgcaacggaaugguguuuaugucuagcuccauccuggauuggagcccgauucuugaaggcuuccugaaaaagagaagcccccaggaggcggagauccuccggcagcuguacaccgaaucuuuuccugaccuuuaucgcuucugcauucaaaaucuggaguacaagauggaaguccucgaggccuuugugaucacacagagcaucaacaugcugcaggggcugauuccccucaaagaacagggaggcgagguuucccaagcucaccuggggagacuuuucguguuugcccugcucuggucugcuggagccgcucuggagcuugauggccggcgcagacuggaacucuggcugcggagcagaccuaccggcacacuggagcucccuccucccgccgggcccggagacaccgcguucgauuauuacgucgcccccgacggcacauggacgcauuggaauacccgcacacaggaauaucuguaccccuccgauaccaccccugaguaugggucuauccuugugcccaacguugacaaugugcggacagauuuucugauucagacgaucgcuaagcagggaaaagccguccuccugauuggcgaacaagggaccgcuaagacagugaucauuaaaggauucaugagcaaguacgacccggagugucacaugaucaagucccuuaacuuuagcucugccaccacaccucugauguuccagagaaccaucgaguccuacgucgauaaacgcaugggcacgacauauggaccgcccgccgggaagaaaaugaccguguuuauugacgacguuaauaugccuaucauuaacgaauggggagaucaggugaccaacgagaucgugcggcagcucauggaacaaaauggcuucuacaaccuggagaagccgggggaguucacaagcauugucgacauccaguuucuggcggcuaugauccaucccggaggcgggagaaaugauauuccucagcgccucaaacggcaauucucuaucuuuaacugcacccugcccuccgaggccagcguugacaagauuuucggagugaucggcgugggccacuauuguacacagagaggguuuucugaggaaguccgcgauuccgugaccaaacuuguuccucugacgcggagacucuggcagaugacaaaaauuaagaugcugcccaccccugcuaaauuccacuacguguuuaaucuucgcgaccugagccgggucuggcagggaaugcucaacacaaccuccgaggugaucaaggaaccgaaugaucugcugaaacucuggaagcaugagugcaagagagucaucgccgaccgcuucacggugagcucugauguuaccugguuugacaaagcccuggugagccuugucgaggaagaguucggcgaagagaagaaacugcucguggauugugggauugacacauauuuuguugauuuccugagagacgcucccgaagccgcgggagagaccuccgaggaagccgacgcugagacaccuaagaucuacgaacccauugagucuuuuagccaccuuaaagaacggcugaacauguuccuccaacuguauaaugaguccauccgcggcgccgggauggauaugguguucuuugcugacgccaugguccaucuggugaagauuucuagagugauccggaccccucagggaaacgcgcuccugguuggcgucggcgggagcggaaagcagucccuuacaagacuggccucuuucauugcuggcuacgugagcuuucagaucacccucacgcgguccuacaauacaagcaaccugauggaggaucuuaaagugcuguaucgcaccgccgggcaacagggaaagggcaucaccuucauuuuuacagacaaugaaaucaaagaugagucuuuccucgaauacaugaacaauguccuguccagcggggagguuucuaaccuguuugcuagagacgaaauugaugagaucaacuccgaccuugccagcgugaugaagaaagaguucccccggugccugccgaccaaugaaaaccuccacgauuauuuuaugucccgcgugagacagaaucugcacauuguccucuguuucucuccugugggcgagaaguuucggaaccgcgcucugaaauuccccgcccuuaucagcggaugcacaaucgacugguuuuccagauggcccaaggaugcgcugguugccgugagcgaacauuuccugacgucuuacgacauugauuguucccucgagaucaagaaagaggucgugcagugcaugggcagcuuccaagacgggguugcugaaaaguguguggacuauuuucagcgguuccgcagaucuacccacgucacaccuaaaagcuaccuguccuuuauucagggauauaaguucaucuacggcgagaaacauguggaagugcggacccuugccaaucgcaugaacacagggcuggagaagcucaaggaggcuucugagagcgucgccgcccuguccaaagagcucgaagcgaaggagaaagaacugcagguugcuaaugauaaggccgacauggugcugaaagaggugaccaugaaggcccaagcugccgaaaaggucaaagcugaggugcagaagguuaaagauagagcccaggcgauuguggacucuaucagcaaggauaaagccaucgcugaggaaaaacuugaggccgcuaagcccgcccuggaagaggcggaagccgcucuccaaacgauucggccuuccgacaucgccaccguccgcacacugggaagaccgccccaccuuauuaugcggaucauggauugcgugcugcuccuguuucagagaaaaguuagcgcugugaagauugaccucgagaaaucuugcaccaugccuuccuggcaggagagccugaagcugaugacagccggcaacuuccuucagaaucugcaacaguuucccaaagauaccaucaacgaagaggucauugaguuccucuccccuuacuuugagaugcccgacuauaauaucgagacggcuaagcgcgugugugggaacguugccggccugugcucuuggacaaaagcgauggccagcuucuuuuccaucaauaaggaagugcuuccgcugaaggcuaaccucgucgugcaggagaaucggcaucugcuggccaugcaggaucuccaaaaagcccaggcugaacuggacgacaagcaggccgagcuugaugucgugcaggcggaauacgagcaagcuaugaccgagaaacagacacugcucgaagacgccgagagaugucgccacaagaugcagaccgccucuacccugauuagcggacuugcuggcgaaaaagagcgguggacagaacaaucccaggaguucgccgcucagacgaagagacugguuggggaugugcuccuggccaccgcguuccugagcuauucuggaccuuuuaaccaggaguuccgcgaccuccugcuuaacgauuggcggaaggaaaugaaagccagaaagauccccuuuggcaaaaaucugaaccucuccgagaugcugauugacgcuccuacaaucagcgaauggaaucuucaagggcugcccaacgaugaccucucuauucagaauggaaucaucgucaccaaggccucccgcuacccucugcugauugauccccagacacagggcaaaaucuggauuaagaacaaggagagccggaaugaacuccaaaucaccucucugaaccacaaauauuucagaaaucaucuugaggacucccugagccucgggcgcccgcugcuuauugaggaugugggcgaagaacuggacccugcucucgauaacgugcuggaacggaauuuuaucaagacgggaucuacauucaaaguuaaggugggcgacaaagaggucgacgugcuggauggguuuagacucuacaucaccaccaagcugcccaaccccgccuauacaccugagauuagcgcgcggaccuccaucauugacuucacaguuacgaugaagggacuugaagaucagcugcucggcagagugauccugaccgagaaacaggaacuugagaaggaacgcacacaccugauggaggacgucaccgccaauaaacggagaaugaaggagcucgaagauaaccugcuguaccgccucacaagcacccaggggucccugguggaggacgaaucucuuauugucgugcugagcaauacgaaaagaaccgcugaggaaguuacacaaaagcucgagaucuccgccgagaccgaagugcagauuaacucugcucgggaggaauaccgcccggucgccacaagaggaagcauccuguauuuucuuaucaccgagaugcggcuggugaacgaaauguaccagacaucccuccgccaguuccugggccuguuugaucucucucuggccagaagcguuaaaucccccauuaccagcaagcggaucgcuaauauuaucgagcauaugacguaugagguguacaaguaugcggcccgcggccuuuacgaagaacacaaauuccuguuuacacuccugcugacccucaagauugacauccaaagaaaccgggucaaacacgaagaguuccuuacccugaucaaagggggagcuucucuggaucucaaagccugcccucccaagccuuccaaguggauucuggacaucacauggcuuaaucugguggagcucagcaaacugcgccaguucucugaugugcuggaccagauuuccagaaacgaaaagauguggaaaaucugguuugauaaggagaaucccgaagaggaaccucuucccaacgccuaugacaaaagccucgacuguuuccggcgccugcugcucauuagaucuuggugcccggaucggacgaucgcucaagccagaaaguacaucguugacuccaugggcgagaaguacgcggagggggucauucuggaucuugagaagaccugggaggaaagcgacccucgcacaccccugaucugucuccugucuaugggauccgauccuaccgacagcauuaucgcucugggcaagcggcuuaaaauugagacaagauaugugagcauggggcagggacaggaagugcaugcccgcaagcuccugcagcaaaccauggccaauggcggcugggcucugcuccagaacugccaccuggggcuugauuuuauggacgagcugauggauaucauuaucgagacagaacucguccaugacgccuuccggcuguggaugaccacggaggcucacaaacaguuucccaucacccugcuucagauguccauuaaguucgccaaugauccgccucaaggacucagagcgggccugaagcgcacauacucuggggugagccaggaccugcucgacguuuccucuggaagccaguggaaacccaugcuguaugccguggcuuuucuucauuccaccguccaggaacggagaaaguucggcgcccugggguggaacauccccuacgaguuuaaucaagcugauuucaacgccacagugcaguuuauucagaaucaccucgacgauauggacguuaaaaagggagugucuuggaccacgauccgcuauaugauuggcgaaauccaauacggcgggcgggucacagaugacuaugauaaaagacugcugaacaccuucgcgaaggugugguuuagcgagaauauguucggaccugacuucuccuuuuaccagggcuacaacauccccaaguguagcacaguugauaacuaucuucaguacauucagucucucccugccuaugacuccccggagguguucgggcugcaccccaaugcugauaucaccuaccaaagcaaacuggccaaggacguccucgauacgauucugggaauccagccuaaagacaccucuggcgggggagacgaaacacgggaggcugugguggcccgccuugccgaugacaugcuggaaaagcugcccccugauuauguccccuuugagguuaaagagagacugcagaagaugggcccuuuccagccgaugaacauuuuucugcggcaagaaaucgaccgcaugcagagagugcuuucccucgugcggagcacccugacagagcugaaacucgcuaucgauggcaccauuaucauguccgaaaaucugagagacgcgcuugauugcauguucgacgcccgcauucccgcuugguggaagaaggccucuuggaucagcuccacacugggguuuugguucaccgagcucauugaacggaacucucaguuuacgagcugggucuucaauggaagaccucauuguuuuuggaugacaggcuucuuuaacccccagggguuccugaccgccaugcgccaagagaucacccgggcuaauaaaggaugggcccuggauaacauggugcuuugcaaugagguuacaaaguggaugaaagacgauaucuccgcgccucccaccgaaggcguguacgucuaugggcucuaccuggagggagcuggcugggacaagagaaacaugaaacugauugaaagcaagccgaagguccucuucgagcugaugccuguuauccgcauuuacgccgaaaauaacacacuuagagauccccgguuuuauucuugccccaucuacaaaaagccugugcgcacggaccugaauuauauugccgcugucgaccucagaaccgcccagacacccgagcacugggugcugcggggcgucgcucugcuuugugaugugaaauga

SEQ ID NO: 68430 - RNA, 12477 nt, Artificial Sequence
  derived and/or modified sequence opt5 from DNAH6__Homo_sapiens__NP_001361
augaccuucagagcuaccgacagcgaguuugaucugacgaacaucgaagaguacgcugaaaauuccgcucucucucggcugaacaauauuaaggcgaagcagagagugagcuaugucaccuccaccgagaacgaaucugacacccagauccuuaccuucagacacauuaccaaggcucaggagaagacacggaagcgccagcagcccaucaaacuggagccucuccccguucugaagguguaccaagaucauaagcagcccgaauauauucacgagcagaauagauuucagcuuaugaccgcuggcaucaucaaacggccugugagcauugccaagaaauccuucgcuacgucuagcacccaauuucuggaacaucaggacgccgucaagaaaaugcagauccaccgccccuacguggagguuuucuccccuucucccccuaagcucccccauacagggauuggaaagagaggccuguuugggacccgguccuccgcuuaucccaaauacacauuccacgaucgcgaggaaguggucaaggccaacaucagagacccucugcagauuaucaaaauuauccgggagaaugaacaccucggauuucuguauaugauccccgcggugccucgcagcucuauugaguacgauaccuacaaccuuaagguuguguccuaugaaaauaucaacaaaaaugacuacuauacgauuagccaaagagccgucacacauaucuacaacgaggauauugaguucaucgaaaucgaccggugggagcaggaauaucuguaccaccgcgagcucaccaagauucccaucuuuucucuguucagaaaauggaaggcuuuuuccguguggcggaagaaugugagaagcaaaaagauuacaggcugccagaaaucccuucaaaagaaccuguucaucgucaauccgcaucuccgcccugcccugcugaaaauuaacgaacucuguuaucaccugucuuucauggggcuuugcuacaucgagaagugucacaccuacacccugcaggaguuuaaggcugcccagguuauccggcucgcggaagugacagagagacugggagaguuccgcaacgaggccaaauaugugguccggagagcuugccgcuuugcccuucgggcugccggcuucgugcccgaugacugugccuuuggcccuuucgaagauuaccauaagguucagagcuccgggagcuuuauuaauacgccccacgagcugcccaccuauggagacucugagaaaaugacauacaccgaacaggcuuccaagagacauuauugcaugcgccucacauguuucauccggcugaacgacuaccugauugagaauaccaugcacauccucacggugaacgcggucaauagccugcuuaaccaucugacagauaaacucaagagaaccccuucugccgacgugauucaaaaguggaucaccgaagagaaaccggagguucccgauaagaaaggcacacugaugguggaaaagcaggaggaagacgagagccuuauuccuauguuucugaccgaacucaugcugacaguccagucccuccuguucgagcccucucuggaggauuuucuugacgggauccugggagcugugaaucacugccaaaacacgguccucagcgugccuaaucugguucccgauuccuauuucgacgccuuuaccagcccguacaucaacaauaaacuggaaggcaagacaugugggaccggaccuucucuugccgcuguguucgaggaugacaagaacuuccacacaauuaucucccagauuaaagaaaccauccaggccgcguuugagagcgcucgcauuuacgccgccacguucgaaaaguuucagaucuucuuuaaagagaaugagucucucgaucugcaagcucugaagcuccaggaacccgacaucaacuucuuuuccgagcagcuggaaaaauaucauaagcagcacaaagacgccgucgcccuucggccuaccagaaaugugggccugcuccugauugauacacggcugcuucgcgagaagcucauccccagcccucugagaugccuggaaguucucaacuucaugcugccccggcaauccaagaaaaagguggacgccauuaucuuugaggcgcaggaugccgaguacaaacuugaguucgucccgaccacaaccacggaguaugugcauucucugcucuuucuggacgaaauucaggagagaaucgagagccuggaagaugagggcaacaucgugacacaaauguacaaacuuauggaacaguaucagguuccuacaccgcccgaggacuucgcugucuuugccacaaugaaaccuuccauuguggcugugcgcaaugccaucgauaagucugucggggaccgggaaagcuccauuaagcaguucugugugcaccucggaagcgaucuggaggagcugaacaaugaaguuaacgaggugaaacuccaagcgcaggacccgcagauccuggauauuucugccgaccaggauaagaucagacuuauccugaauaaccuccaauccguccuggcugaccugcagaaacgcgccuuccaguacaagagcuaucagaaaaauuuuaagguggaaguuucuaaguucgaggcucuugaagagguguccgccgagcucaaacugaagcaacugcucugggacagcuuuucugaaugggauaaacugcagcaggaguggcuuaagagcaaauucgacugccuggaucccgaaguccucaacggccaaguguccaaguacgccaaguuuguuacccagcuggagaaagggcugccucccaauagcguggucccucagcuuaaguacaaaguggaaaagaugaaagagaagcugcccgugauuaucgaccucagaaacccuacccugaaagcucggcacugggcggccauugagcagacagucgaugcuacgcucguugacgccgaaaucccccugacccuugagcgccugucucaacuccauguguucgauuuuggacaggaaauucaggacaucuccggccaggccagcggggaggcugcccuggaggcgauucugaagaagguggaagauuccuggaaaacaaccgaguucgucauccuuccgcacagagacucuaaggauguguuuauccugggaggcacagacgauauucaaguucuccuggacgacagcaccaucaauguggcuacgcucgccuccucucgguaucugggcccucuuaaaacacgcgucgaugaauggcagaagcagcuggcccucuucaaccagacccuggaggaauggcugaccugccaaagaaauuggcuuuaccuggagagcauuuuuaacgcucccgacauccagcggcagcucccugccgaggcgaaaauguuccuccagguggauaaguccuggaaggaaauuaugcgcaaaguuaauagacuccccaacgcucugcgggccgccacacaaccggggcuucuggagaccuuccagaacaauaacgcucugcucgaccagauccaaaagugucuggaagccuaucuugagucuaaacgcgugaucuuuccuagauucuacuuucugagcaaugaugaacuccuggagauucucgcucagacacggaacccccaggccguccagccucaucugagaaagugcuucgacuccaucagcaaacuugaguuugcgcugaugccgcccgccgaaggaaagauuccuggcaucgauggggagccggaaaagguguauacgaaugacauucuggcuaugcucucucccgagggagaacgcguuucccugggcaaagggcuuaaggcccggggcaacguggaggaguggcugggaaaagucgaagaggcuauguucaccagccucagacgccuguguaaggccgccaucgcugauuaccaaggcaaacuccggacagacugggugguggcggggcacccuucucaggucauccugaccguuucccagauuauguggugcagagaucuuacagaaugucuggagaccgagcauagcaaucacauccaggcccugaagaacuuugaaaaggugaauuucgagcgccucaacgcucuggccgccauugugcaaggaucucuucccaaacugcaccggaauauccucacggcucugauuaccaucgacguccaugccagagacauugugacagaacucguucaguccaagguggagaccgucgagagcuuugauuggcagcgccagcugcgguauuacugggacaucgaucuugacaacugcguggcgagaauggcucugucccaauacacauauggcuacgaguaucugggggccuguccucggcucguuaucacaccccugacagaucgcugcuaccuuugucugaugggagcccuccagcuggaccugggcggggcuccugccggcccggcgggaaccggcaaaacggagacaaccaaggaucucgcuaaagcccuugccauucagugcguggucuucaauuguagcgacgggcuggauuauaagaugaugggaagauuuuucucuggccuggcucaaagcggggccuggugcugcuuugacgaguucaaccggaucgauauugaggugcucuccgucaucgcucagcagcugauuaccauccgcaaugccaaggcggccaaacuuucuagauucauguuugaaggacgggagaucaagcuggugaugacaugugcugccuucauuaccaugaaccccggcuacgcugggagaacggaacucccugacaaccugaaagcccuguuucgccccuucgccaugaugguuccuaauuaugcucucaucgcggaggugauucuuuacagcgagggcuuugaauccucuaagauccuggcccggaaaaugacacagauguacaagcugugcagcgagcaacucucccagcaggaucacuaugacuucggaaugagagcugucaaaucugugcugguuauggccggcagccuuaagcgcgaaaaccccgaccugaaugaggaugugguccucauucgggcccugcaggacuccaaccugccgaaguuucucaccgaugacgcccuucuguucagcgggaucaucucugaucuguuuccuggagugcaaauucccgaacaugacuacggcauccuccaguccacaauuguggauguuaugaauagacagaaccugcagcccgagauguguaugguccgcaaagugauccaauucuaugagaccaugcuugugcggcacggggucaugcuggugggaccuacaggcgggggcaagaccacgguuuaccgcauucucgccgaaacccugggaaaucugcagaaacucggcaucgagaacagcuuuuaucaggcggugaagacauacguccuuaaucccaaaucuauuaccaugggggaacuguauggagaggugaacaaucugacacucgaguggaaggacggccugauggcucuuuccguucgcgccgccgugaacgauaccagcgaagaccauaaguggaucaucuccgaugggccugucgacgcucuguggauugagaauaugaacacggugcucgaugacaauaaaaugcugugccuggccaacucugaaagaaucaagcucacaccgcagauucacaugcuuuucgagguucaagaccugcggguggcgagccccgccaccgucucccgcuguggaaugguguuuguggauccugaagaacugaaauggaugcccuacgucaagacauggaugaaaggcaucagcaagaagcucaccgaggaaacccaggaguacauucugaaucuuuuccagagauauguugacgaaggccugcacuucaucaacaaaaagugcucucaagcuaucccucagguggauauuuccaaagugacaacgcucuguugccugcuggagagccucauccuugggaaggacggagucaaccuggccauggaacagaccaaacugaauacaauucucugucagaccuuuguguucugcuaccuguggucucuuggcgggaaccugacagagaauuauuacgauagcuuugacaccuucauccggacgcaauuugaugacaaccccgaugcucgccuccccaauagcggagaccuguggucuauucauauggauuucgacacaaagagacuggacccuugggagcggaucauccccaccuuuaaguauaacagagauguuccuuucuuugaaaugcucgugcccaccacagacaccguccgcuacggcuaucuuauggagaaacugcuggccgugaagcacagcguucucuucacagggauuacgggagugggcaaauccgucaucgcuaagggccugcuuaauaaaauucaggaaucugccggguacgugccugucuaccugaacuuuagcgcgcagaccuccagcgcccggacacaggagaucauugaaucuaagcucgagagaaaacgcaagaauauccugggagcucccggcaacaagcggauugugaucuucguugaugaccugaauaugccgagacucgaucgguaugggucccaaccucccaucgagcuucugcgccaguaccaggacuuuggaggcuucuaugauagaaacaaacuguucuggaaggaaauucaggacgugaccaucauuagcgccugugcucccccugggggaggccggaauccggugacaccccgcuuuaucagacauuucuccaugcucugccugccuaugcccucugagcacagccuuaaacaaauuuuucaggccauccugaacggcuuccucuccgauuuuccucccgccgucaagcagaccgcuucuagcaucguugaagcguccguggagauuuacaauaaaaugagcguggaccugcugccuacgccggccaagucucacuaugucuucaaccuccgggaucuuuccaagugcgugcaagggauccugcagugugaccccggaaccauucgcgaggaaauccagauuuuuagacuguucugccaugagugucagcggguuuuucacgaucgccucaucaacaaugaagacaaacauuacuuccacgugauccugacagagauggcuaacaagcauuuuggcauugccaucgaccuugaauauuuccugaauaaaccuauuaucuuuggggauuucauuaaguucggagccgacaaagcugauagaaucuacgacgauaugcccgacauugagaagaccgccaacguccuccaagauuaccuggacgauuauaaucugacaaacccuaaggaggugaaacucgucuuuuuccaggacgcgaucgaacacgugagccggaucgccagaaugauucgccaggagcggggcaaugcucugcuuguuggggugggaggcaccggcaagcagucucugacaagacucgccgcucacaucugcggguacaaaugucugcaaauugaacuuucccgcggauauaacuacgauagcuuucaugaggaccugcggaagcucuauaaaauggccggcgucgaagacaagaauaugguguuccuguuuacggauacccagaucguuguggaggaguuccuggaagacauuaacaauauccucaacucuggggagguccccaaucuguuugaaaaggaugagcuugaacaggugcuggcggccacaagaccgcgcgcuaaagaggugggaaucagcgagggcaaccgggacgaaguuuuccaguacuuuauuuccaaggucagacaaaaacuccacaucgugcugugcaugucuccugugggggaggccuuccgcagccgguguagaauguuucccucccuugucaauugcuguaccauugauugguucguucaguggccccgcgaagcucugcucagcguguccaagaccuuuuucucucagguggacgccggaaacgaggagcugaaagaaaagcugccucucaugugcgucaacgugcaucugagcguuuccucuauggcugagcgguauuacaaugaacuuagacgcagauacuauacaacgcccaccagcuaccuggagcucaucaaccuguaucuuuccaugcugucugaaaaacggaagcaaauuaucagcgcccgcgauagagugaagaauggccucacaaaacugcuggagaccaacauccucgucgacaagaugaaacuggaucuuuccgcgcuggagccugugcuccuggccaagagcgaagacguugaggcucuuauggaaaaacuggccguggaucaggagucugcugaccagguccggaauacagugcaggaagaugaggccaccgccaaggugaaggcggaggaaacgcaagcuauugccgacgacgcucagagagaucucgacgaggcccugccggcccuggaugcugccaacaaagcgcucgacucccuggauaaggccgacaucagcgaaauucgggucuucacaaaacccccugaucuuguuaugaccgugauggaggcuaucucuauucugcucaaugccaagcccgacuggccuuccgcuaaacagcugcuuggcgauagcaacuuucugaagcgccuccuggaauacgacaaggagaauaucaaaccccagauccuggccaagcuccaaaaauauauuaacaauccggauuucgugccugagaaggucgaaaaagugucuaaggcguguaaguccaugugcauguggguuagagccauggaccuguacagccggguggucaaagugguugagcccaagcgccagaaacuuagagcugcccaggcugaacuggauaucaccauggccacacuccgggagaagcaggcucugcuucgccaaguggaggaccagauucaggcccugcaggacgaauaugauaaaggggucaacgagaaggaaucccucgcgaagaccauggcccugacaaaagcuagacuggugcgggccggaaagcucaccgcugcccuggaggacgaacaaguucgcugggaggagagcauccagaaauuugaagaggaaauuucuaauaucacgggcaacguguucauugccgcggcuugcgucgccuacuacggggccuuuacagcucaguauagacaaagccuuaucgaguguuggauccaggauugccagucccuggaaauuccuaucgaccccucuuucagccucauuaauauccugggagauccuuacgagauucggcaguggaacaccgacggccuuccccgcgaucugaucuccacagagaacgggauccucgugacccaaggaagacgguggccgcugaugauugacccucaggaucaggccaaucgcuggaucagaaacaaggaaucuaaaagcggccugaagauuaucaaacuuacggacuccaauuuucugcggauucucgagaacucuaucagacugggccuccccguccugcuugaagaacugaaggaaacccuggaucccgcucucgagccuauccugcuuaagcagauuuucaucagcgggggacgccugcucauucggcugggcgacuccgacaucgauuaugacaaaaauuuuagauucuacaugacaaccaagaugccgaacccccacuaucucccugagguguguauuaaaguuacaaucauuaauuuuaccgugacaaagagcgggcuggaagaucaacugcuuucugacgucgugcgccuggagaaaccccggcucgaagaacagagaaucaagcugaucgugcgcauuaacaccgauaagaaucagcuuaaaacgaucgaggaaaagauucugcggaugcuguucacauccgagggaaacauccuggacaaugaagaacucauugauacccugcaggacagcaaaaucaccucuggcgccaucaagacaagacuggaagaggcggaguccaccgaacaaaugauuaacguugcccgcgagaaauaccggccuguggcuacacaggggagcgucauguauuuugugaucgccucccuuucugaaauugaucccauguaccaguacagccugaaguauuucaagcaacucuucaauacgaccaucgagacauccguuaaaaccgaaaaccugcagcagagacuugacgugcugcucgagcagacacugcugaccgcuuacgucaaugugagccgcggacucuuugagcaacacaagcugauuuauucuuucaugcuuugcgucgaaaugaugcggcagcagggcacgcuguccgaugccgaguggaacuuuuuccucagaggcagcgcggggcuggaaaaagagcggccucccaagccggaagccccuuggcuucccaccgcuacaugguuugccuguugcgaccuggaggagucuuucccuguguuucauggacucacccagaacauccugagccaccccaucuccauuagacugggcucuuucgaaacauacaucaauccgcaaaaaugggagggguauagcaagaugaagcaugaagauaaacacaugcgccaggagaaggaggcugcccaucaggacccuugguccgcuggacucucuagcuuucacaaacugauucuuaucaaguguugcaaagaagagaagguuguguucgcccugaccgacuuugucauugaaaaccucggcaaacaguucaucgagacgccgcccguggaucugccuacacuuuaccaagacauguccuguaauacaccccugguuuucauucucagcacagggucugauccuaugggcgcguuucagcgguucgccagagaauccggauauagcgagcgcgugcaguccaucucucugggccaggggcaaggaccgaucgcugagaagauggucaaggacgccaugaaaagcggcaacuggguguuucugcagaauugccaccucgccguguccuggaugcuggcuauggaagaacuuauuaagaccuucaccgaucccgacucugccaucaaagauacauuuagacuguuccucagcuccaugccuagcaacacguuucccguuaccguccugcaaaauucugugaaggugacaaacgaaccucccaaagggcuucgggcgaauauucgcagagcuuucaccgagaugacaccuuccuuuuucgaagagaacauccugggaaagaaguggcggcaaauuaucuuuggcaucuguuucuuucaugccauuauccaggagcgcaaaaaguucgggccgcucggcuggaauauuugcuacgaguucaacgacagcgauagagagugcgcccugcugaaucucaaacuguacuguaaggaaggaaaaauccccugggacgcucuuauuuauaucaccggcgagaucacguacgggggacgggucacagauucuugggaccagcgcugccugagaaccauucucaagcgguuuuucuccccugaaacccuggaggaggauuauaaguacagcgaaucuggcaucuauuuugcccccauggcugacucccuucaggaguucaaagacuacauugaaaaccugccucucaucgaugaccccgagauuuuugggaugcacgagaaugccaaccugguguuccaauauaaggaaacaagcacccugaucaacacaauucucgagguucagccgcgcucuagcacgggaggcgaagggaaauccaaugaugagaucgugcaggaacuggucgcgagcgugcagaccagaguuccugagaaacuugagauggaaggcgccuccgagucucuguuugugaaagaccuccaaggacggcugaacagccuuacaaccguccugggccaggaaguggaucgcuucaauaaccuccugaagcugauccauacaucccucgagacccugaauaaggcuauugccggguuuguugugaugucugaagagauggagaaagucuacaacagcuuccuuaauaaccaggugcccgcucugugguccaauacggccuaccccucucucaagccucugggaagcugggugaaagaccugauccucagaaccuccuuugucgaucuuuggcugaagcggggccagcccaaaagcuauuggauuucuggguucuuuuucccucaaggauuccugacaggcacccuccagaaccacgcgagaaaguacaaucugccgaucgacgaacuuuccuuuaaauauagcguuauucccacauaccgcgaucaggccgcugugaucgaggccgcuaagaccgugcaauucggccaggaacugccuauggacauggagcuccccucuccugaagaugggguccuggugcacggaauguuuauggacgccucccggugggacgauaaggagaugguuaucgaggacgcccugcccggccagaugaacccggugcuuccugucgugcauuucgaaccccagcaaaauuauaaaccuagccccacacucuaccacuguccgcuguacaagaccggggcuagagcgggaacgcugucuacaaccggccauuccaccaacuuuguugugacaguccuccugccuagcaaacgcucuaaggauuauuggauugccaaaggguccgcccuucugugccagcucagcgaguga

SEQ ID NO: 68431 - RNA, 12075 nt, Artificial Sequence
  derived and/or modified sequence opt5 from DNAH7__Homo_sapiens__NP_061720
augagcuccgaacaagacaagucugccagcaaagaaaaguccaaaaagcccgugagauuccugccucaacucucuauggaaaaacuggcuagcaaggaaaaguuuaaagccccggcgcgggcccuuccccagcuguccauggucucuaccaagccucacuggcagcaggccgcccccagcuuccaucucuccguuaaacaagaugacgaaagcccugaacccuuuucugugaagaacgagcagucccacgcugaguacauggaaagauucggcaaaaaggggaagcugccucaucagguggaugacagcuaugucggaccgucuacauccaaaagcaagggcaaaucuccccacaaggagagagaaaauuuucgguccacgcuugugaacguuauuaugcagcaagaugccgaccuggauagcgcugugccugacggguccaccauucccaaaccuacagccucugcgaucgagaaggauauucucagauacuauuacuauauccaucacggaauugacaccgaucacgucgcccccauggaggacagcuggcuggaacaugugcuggaucucguuccgcagcaccugaaaguguucacagacuccaucgucacccuuagcgacgagaugagagaagauuaccugcucucugugcggaaguccaucguggacuuuguccugaaggauccucgcgagaaaggcgacgauaagaaaacagacgaacuucccgcucauagagccgagauggagauucugccuaagcccuggcggaagucuuuccucgcugccucuagcuauauccgcgaucaccugaaugcgaugaaccccaccaugcuggccguucucgaccuguggcacacgaauuuuaagaaacuuagacugguggauauuaaagaguuccauaacugucaggacgcucucgagcuguccucuuuucagaauaucauuaugcggcacauggauagcgccaaggaaacccuucugaaaaugugguucccugaggugcaaaacaucuacuaccaggggaauaagaaaaagcagcucccgacaggagacuccagcgcuaagcuggagagcuuuuucaacugugccgccgcucugaugacccuccaacugcaggaccuuacacuggucuccaugcaggauuucaccgaccucauugcgcagcccccugauagcgugcgcgccuuugaacaucccggcuucaucaugagacugauccuugacaaugauacgauuaaauuugagccugaacugucugacuauaucgauauuuuccucaacguuuacgacgugaugaucaaggcugucuccuuugugccccggguugagacaaaacuguauagcaagugggaauccaaaucuaagccgaccacacugaagccuauuauccucaaugagaucguggaugcccacaaagaaaagauuaaagaggucaucaugaaggagagcguggcccccaccgaacaucugcgccuuuacgacaaauaugauuuccugauuaccagaaaggcugagcgggacgucgauaacuuucucgccgaaaaucacuccuacgagaaaaucauugacgagaucugcaaguaucaaaagcugaucgaagagauucaguacacaucuaucaaaacgauuagacugggcauguucgaaaugcacugugaggaacuuauccgcgcgcucgugaagcgggcugacauuaucugcgggaaacugcuggccaagauguuuagagaucaucaggagguuaacacccgccucugugacgaguucgaacggauugccgagaaagcucugagcacaccucccaacaccgccgaacuuauggagaugaaggcuuacauccagaagguggaagucacagauaugaucgagcuggagcaaagacucguggacuccaaaaauugccuggccuuucugauugaauauguuaacuucagcccugcggauaugcgccuuaauaacucuguguuucagugguacggacggaugggcgagaucuucgaagaacacagaaagauuaucaaagaaaagauugagcaguaucaggaggggcucaaacugcgcugugaacgguucgucgaggaacuggaguccuacgccaagcaaagcgaggaauuuuauucuuucggagaccuccaggaugugcagagauaccugaagaaagcucagauccuuaauggcaagcuggaccucgccgcugauaaaaucgagcaauuuaacgccgaagaggaagcguucggguggcugcccuccguguauccgcagcgcaagaaaauucaggacggacugaauccuuaccuucggcucuacgagaccgccguugaguuuagcucuaacuauagagcuuggacggaaggccccuaccauaaggucaaucccgaucaaguggaggccgacaucggcaacuauuggcgggggcuguacaagcuggagaagacauuccacgauagcccuuaugcucucgccaugaccaagaaagugcgcuccaaggucgaggacuuuaaacagcacauuccgcugauccaggugauuugcaaucccggacuuagaccucggcauugggaagccaugagcgcuaucguuggcuacccccugcagccuucugacgauuccaccgugagcuccuuccucgacaugaaccuggagcccuauaucgauagauuugaggggauuucugaagcggccagcaaggaguacucccuggaaaaagcuauggagaagaugaucacagaaugggacgccgucgaguucgugauucacucuuaccgcgagaccggaacauuuauccuugccagcguugaugaaauucaaaugcuccuggacgaucauaucaucaagacgcagaccaugcggggcuccccuuucauuaaacccuaugagaagcagaugagagaaugggaggggaaacugcuccugcuucaggagauccuggacgaauggcucaaggugcaagcuacauggcuguaccuggagccgaucuuuucuagcccugauaucaugucccagaugcccgaagagggacgcagauucaccgccgucgacaaaacauggcgggauauuaugcgcagcgugaugcaggacaagcacguucuuaccguggucacgaucgacagaaugcuggaacggcucaagaaaucuaaugagcugcucgagcugauucuuaagggccugaacgaauaucucgagaaaaagcgccuguucuuuccuagauucuuuuuccuguccaaugaugaacuucuggagauccucagcgaaaccaaagaccccacacgggugcagccgcaucugaagaaguguuuugagggcaucgcgaaaguggaguucaccgaaacacucgauauuacccacaugaagucuuccgagggggaagucguugagcugaucgaaauuaucagcacggcuaaagcccgcggacaaguggagaaguggcuuguggagcuggaaagagucaugauuaacucuauccacaaagugacaggcgacgccaccuuugcuuacacaaaguaugagcggaucaacuggguucgcgauuggccugggcagaccgugcucugcgucucccagauuuucuggaccaaggaagugcaaacagccauccccaugggaauuaaagcgcuggagcaguaccugaagacguguaauagacagaucgacgauauuguuacccuugugcggggcaaacugagcaugcagaacagagucacacucggggcucuggugguucucgacgugcaugcccgcgauguccuguccagccuugugaagaaaaauaucucugacgauagcgacuuugaguggcugucccaacugcgguauuacuggcaggaaaaccaccucgagaccaagaugaucaaugccggccugagauacggauaugaauaccuuggcaacucuccucgccuggugauuacaccccucaccgaucggugcuauagaacgcuguucggggcucuccaucugcaccuuggaggcgcccccgaggggccugcuggaacaggcaagaccgaaaccacaaaagaccuggccaaggcggucgccaaacagugcguuguguuuaauuguagcgacgggcuggauuaccucgcucugggcaaguucuucaaaggacuucuguccugcggcgccugggcuuguuuugacgaguucaaccgcaucgaucucgaggugcugucugucguggcccagcaaauucucaccauccagcgggggauuaaugccggagcugacauccugauguuugaaggcacagagcuuaagcuggauccgacgugcgcgguuuucauuaccaugaaccccggguaugccggaagaagcgaacugccugacaaucucaaagcucuguuucgcacaguggccaugaugguccccgauuacgccaugaucgcugagaucgugcuuuauuccuguggcuucguuaccgcccggccucugucugugaagauugucgcgacauacagacucugcagcgaacagcuguccagccagcaucacuacgacuaugggaugcgggcugugaagucuguccucaccgccgccggcaaccugaaacuuaaguaccccaaugagaacgaggaaauccugcugcuccgcuccauuaucgaugugaaucugccuaaauuucuuagccacgaccugccccucuucgagggaauuacgucugaucuguuucccggcguuaagcugccuaaacccgacuauaacgaucuccuugcugccaucaaggacaacugugcguccaugaaucugcaaaugaccgcuuucuuuagcgaaaagauccugcaggucuacgagaugaugauugucagacauggguucaugaucgugggagaaccuuuuggcgggaaaacauccgccuaucggguucucgccggagcucugaacgacauuugcgagaagggccuuauggaggaaaauaaagugcagaucaccguccugaaccccaagucugugacaauggggcagcucuacggccaauucgauagcgugucccacgaguggagcgacggaguucuggccgucucuuuccgcgcuuuugccuccagcgugaccccggauagaaaauggcugauuuucgacggcccuguggaugcggucuggaucgaaaauaugaacacagugcucgacgauaauaagaaacuuugucugaugucuggggagaucauucagaugagcccccagaugaaccugaucuuugagcccauggaccucgaaguugccuccccugcuaccgugucucggugcggaaugauuuauauggagccccauaugcugggcuggagaccucuuaugcugagcugggucaaucuccugccggccuccgugucuguuauccaaaaagaguucauuauggggcuguuugaucgcauggugcccgucagcguggaguucauccggaagcacacgaaagaacucuccccuacaagcgacaccaaccuuguuagaucucugaugaaucugauugauuguuuuauggacgacuucgcugaugaggugaagcucaaagagcgcaacgaccgggaaaccuacucccugcuugagggaaucuuucuguucagccucaucugguccgucggcgccucuugcacagaugacgauagacugaaguuuaauaagauucugcgcgaacucauggagagccccaucuccgaccggaccagaaacacguucaaacuucagucuggcacagaacagaccagcuccaaggcccugacagugccuuuucccgagaaagggaccauuuacgauuaucaguucgugacagagggaaucggcaagugggaaccguggauuaaaaagcugaaagaggcuccucccaucccuaaggacgucauguucaaugaaaucauuguucccacccucgauacgauccgcuacagcgcgcugauggagcuucugaccacacaccaaaagccuucuauuuuuguggggcccaccggaacaggcaaauccguguauaucaccaacuuccuccugaaccagcugaauaaggaaauuuacaaaccgcuccuuaucaacuuuagcgcccagacgacagcugcccagacccaaaauaucgucaugucuaagcuggacaaaagacggaaggggguguucggaccuccccugggcaagcgcaugguuguguuugucgaugacgugaacaugcccgccagagagguuuauggcgcucagccuccgauugagcuccugcggcaguggcuugaucauuggaauugguacgaccugaaagacugcuccaugaucaagcucguggauauucagaucaugugugccauggggcccccuggaggcgggcgcaaccccgucacaccuagauauaugcggcacuucaauauuaucaccauuaacgaauuuagcgacaaaucuauguacaccaucuucagcagaauccugacauggcaucuggagauuugcuacaaguuucccgaugaguuccucgaccuuacgacccaaaucgugaauggaacaaugacccuguauaaagaggcgaugaagaaccugcucccuacaccggcuaagucccacuaccuguuuaaucuucgcgauuucucucgggucauucagggcgugugucugagcagacccgagaccacggaaacaaccgagguuaucaaacgccucugggugcaugaagugcugcgggucuauuacgacagacugcucgauaacaccgaccgguccuggcuuauuaauuauauccaggagauccugcgcaacuacauguaugaagauuuucacgagcuguuccaaagacucgacuucgauaaugacgggaugguugaggccgacgaucugcggagccuuauguuuugcgacuuccacgauccuaagcgcgaagacacaaacuacagagagauugccgauguggacaaucugcggaugaucguggaaauucaucucgaggaauacaacaacaucuccaaaaagcccaugaaucugguccuguuucgcuucgcuauugagcacaucucuagaaucagccggauucucaaacagccucgcucccaugcccuucuggugggaguuggcggcucugggagacagagcgugacccggcuggcggcccacauggcugauuauuccgucuuucagguggagaucucuaagggauacgacacaacggaauggcacgaggaucucaaggucauucugagaaaaugugccgaaggcgagaugcaagggguguuccuuuuuaccgacacacagaucaaggaagagagcuuccuggaggauguuuccaaccuccugaaugcuggagaaauucccaaccuguuugcccucgacgagaaacaggaaaucugcgauaagaugcgccagcuugaccggcaaagagacaaaaccaagcagacagauggcagcccgauugcucuguucaauauguuuaucgaccauugucgcucucagcugcacgugguccucgccauguccccuaucggggaugcguuccggaacagacugcgcaaauuucccgcccuugugaauugcuguaccauugacugguuccagagcuggcccgaggaugcucugcaagccguugcuucucgguuccucgaggaaaucgagauguccgaagagauuagagacggaugcaucgauauguguaagagcuuucauacgucuaccauugaccuguccaagagcuucuuuguggaacugcagcgcuauaacuacgucacaccuaccuccuaucucgagcugaucagcacauucaaacuucugcucgagaagaaacggucugaagugaugaagaugaaaaagagauacgaggugggccuggaaaaacuugauagcgccuccucucagguugccaccaugcagauggagcuggaagcucuccacccccaacugaaagucgcgagcaaggagguggacgagaugaugaucaugauugaaaaagaguccguggaagucgccaagacagagaaaaucguuaaggcugaugaaacgauugccaaugagcaggccauggcuucuaaggccaucaaagacgagugcgaugcggaccuggccggcgcucucccuauucuggaaagcgcccuugcugcccuggacacccucacagcgcaggauaucaccguggugaaguccaugaaaucuccgcccgccggggucaagcuggugauggaggcuaucugcauucuuaaaggaaucaaggccgacaagauuccugaucccaccggcagcgggaaaaagaucgaagacuuuuggggaccugcuaaacgccugcucggcgauaugcgguuccugcaaucccugcaugaguaugacaaggauaacauucccccggccuacaugaauaucauccgcaagaacuacauuccuaaucccgacuuuguuccugagaagauccgcaacgcuagcacagccgcggaagggcucuguaagugggugauugccauggauucuuaugacaaagucgcuaagaucguggcccccaaaaagauuaaacuggcugccgccgagggagaacuuaagaucgcgauggauggccugcgcaagaaacaggcugcccucaaagagguucaggacaaacuggcucggcuucaggacacgcuggaacucaauaagcagaaaaaggccgaucuggagaaccagguggaccugugcuccaaaaagcucgagcgcgccgaacagcugauuggcgggcuuggaggcgagaagaccagauggagccacacagcucuggaacucgggcagcuguacaucaaccuuaccggagauauccugauuucuuccggcgucguggccuaucucggggcguucacaagcaccuaccggcaaaaucagacgaaagaguggacaacccuguguaagggaagagacaucccuugcuccgaugacuguucucugaugggcacccucggcgaagccgugacaauucggaccuggaacaucgcugggcugcccagcgauuccuuuagcauugacaauggaaucaucauuaugaacgcccgcagauggccgcuuaugaucgauccucagucucaggcuaauaaauggauuaagaacauggagaaagccaauucccuguaugucaucaagcucagcgagcccgacuacguucggacacuggaaaacugcauucaauucggcacccccgugcuucuggagaaugugggggaagaacucgauccuauccuggaaccgcugcuccugaagcagacguuuaaacagggaggcucuacauguauccgccuuggggacagcaccauugaguaugcgcccgauuucagauuuuacaucacaaccaagcugcggaacccucacuaccuccccgagacguccgucaaagugacccugcuuaauuucaugauuacaccugaaggaaugcaagaccagcugcucggcaucguuguggcccaggagcgccccgaccuggaagaggagaagcaggcucugauucuccaaggcgccgaaaacaaaagacagcugaaggagaucgaagauaagauucuugagguccugucuagcuccgaagggaauauccucgaggacgagaccgcuaucaaaauucugucuagcuccaaggcccuugcuaacgaaaucagccagaaacaggagguggccgaagagacagaaaagaaaauugauaccacacggaugggauaucgcccuaucgcgauucauucuuccauccuguucuuuagccucgccgaccuggcuaauaucgagcccauguaccaauauucccugaccugguucauuaaccuuuuuauccugucuauugagaacagcgaaaaguccgagauccucgccaaaagacugcagauucucaaggaucacuucacguacucucuguauguuaaugugugccggagccuuuuugaaaaggacaaacugcuguucuccuuuugucucacaaucaaccugcuucugcaugagcgcgcuaucaauaaggccgaauggagauuccuccugaccggcgggauuggacucgauaacccguacgccaaucugugcaccuggcugccucagaaaagcugggacgagaucugucggcuugaugaccugcccgcguuuaagacaauucgcagagaguucaugcggcucaaagauggcuggaagaaggucuaugacucucuggaaccucaccacgagguguuucccgaagagugggaggauaaagcuaacgaguuccagagaaugcuuaucauucgcugccugcggccggacaagguuaucccuaugcuccaagaguuuauuaucaauagacuggggcgcgccuucaucgaaccgcccccuuucgaccucgccaaggcuuuuggcgauuccaacugcugugcgccccugauuuucgugcugagcccuggagcugacccgauggccgcgcuucugaaguuugccgaugaccagggcuacgggggaucuaaacucuccagccugucucuuggccaggggcaaggacccaucgcuaugaagaugcuggagaaggccgucaaagaaggcaccugggugguccuccagaauugccaucuggcuacauccuggaugccuacgcuggagaaggugugugaggaacucagccccgagucuacccacccugauuuccggauguggcugacaagcuaccccuccccuaacuuuccgguuagcgugcuucagaauggggucaaaaugaccaacgaagcccccaagggccugagagcgaauauuauccgcuccuaucucauggacccuauuucugaucccgaguucuuuggaagcugcaaaaagccugaagaguucaagaaacugcuuuacggccugugcuuuuuccaugcccucgugcaggagcggagaaaguuugggccccugggauggaacaucccguaugaguucaaugagacagaccugcgcaucuccgugcaacagcuccacauguuccugaaccaguacgaagaacuuccuuaugaagcucugcgguacaugaccggcgagugcaacuaugggggaagaguuacggaugacugggaucgccggacccucagaucuauucugaauaaauuuuucaaccccgagcuuguggaaaauagcgacuacaaguuugacuccucuggcaucuacuucgugcccccuagcggggaucauaaauccuauauugaguacacaaagacccugccccucacacccgcuccggaaaucuuuggcaugaacgcuaaugccgacauuaccaaagaucagagcgagacgcaacugcuguucgacaacauccuccugacacagucucgguccgcuggagccggcgccaagagcucugaugaggugguuaaugaaguggccuccgacauccuugggaagcugcccaacaauuuugauauugaggcugccaugagacgcuauccuaccacauacacccagagcaugaacaccguccucgugcaggaaaugggacgguucaauaaacugcuuaagacaaucagagacucuugugucaacauucaaaaagccaucaagggccuggcugugauguccacggaucucgaggaaguugugagcucuauucugaaugucaaaauccccgagauguggauggggaaguccuauccuagccugaagccccucggaagcuacgugaacgacuuucuggcccgccuuaaauuccugcagcagugguaugagguuggcccgccucccguguuuuggcucuccggcuucuuuuucacccaggcguuccugacaggggcucaacagaauuacgccagaaaguacaccauuccuaucgaucuucugggauuugacuaugaagucauggaggauaaagaauacaagcacccuccggaggacggcguguucauccacgggcucuuucuggacggagccucuuggaaccggaaaauuaagaagcuggcugaaagccauccuaaaauccucuaugauacagugcccguuauguggcugaagcccugcaaacgcgccgacauuccuaagagacccuccuacgucgcuccucuuuauaaaaccucugagcggcgcggcgugcugagcacgacagggcacuccaccaacuucgugaucgccaugacccucccgucugaucagcccaaggagcauuggauuggaagaggcgucgcgcugcuuugucaacugaauagcuga

SEQ ID NO: 68432 - RNA, 14124 nt, Artificial Sequence
  derived and/or modified sequence opt5 from DNAH8__Homo_sapiens__NP_001193856
auggaaaaggacgcugaagacggcgcucccagcgaaggggccgaagccccuccguccaccgaagaagcugcgcccccuagaucugaggaggaagaggcgccccggccucccacaguggaagcuccugccgaggacggauucagcccguccgcugaggaugccgucucuagcguuguggacuaccgcgaucugauccccuccgaagagggcauugugcucccugacgaucacgaagccgaccugaacagaguccggcagcgccuugcccccagaccugugcaaucuguuaucagcgaggugcugucccuccccagcucucggcgcuccagcagauaucggcgcucuauguccgggcugccgaaucuucaggaaacgcugaaggagagacaggcucgguuucgcgaggccagagaaagccggcgccucaagauugauccuucuuacaaguauaucuucgagauucuggcugaaaaccugggacucgacaucgucaccguggaggaacugauccuugauugccccucccuggaggccuuuacaaauuucuuugcgaaggacggcuguaagacccucaaguuccuguaccaggagggggauguuccuggaauugaaugcggcagaacaaucgccggcgcuaccaagggggccaaaaugaugaaacuuuauauugacaacgcugcccccgacaaacugaagggacucuguaucuuuuucgugcggugcagaaaugaugucgccauuaacgugaaaacaauccaggaggaagcucuguuuaccgugcuggacgcgagcaagggccuccugaaugggauucgcgauaugcuugccaacaucuuccugcccgcuguccucgccacgaauaacuggggagcccugaaucaguccaagcagggcgagucugaaaaacacaucuuuaccgagacaauuaaccgguaccuuagcuuccuggacggggcuagaaucuccauugagggaaccguuaagcucaaaacaaucgauaaugugaacuuuagcaagcugcacaccuucgaagaggugacggccgcggcuucuaauuccgaaacaguccaucagcuggaggaggugcucaugguuugguauaaacaaauugaacaggugcugaucgagagcgaacagaugcgcaaggaggccggcgacucuggcccucuuaccgaacuggagcacuggaaacggaugagcgccaaguucaacuacaucauugagcagaucaaggggccguccuguaaagcugucauuaacgugcucaauguugcccauucuaagcugcuuaaaaacuggagagaucuggacgcucgcaucacagauaccgccaaugaaagcaaggacaacgugcgguaccucuauacccuggagaaagucugccaaccccuguacaaucacgaucucguguccauggcgcacgggauucagaaccugaucaaugccaucagaaugauucauggcgucagccgcuauuacaacacaucugaacggaugacgucccuuuuuaucaaggugaccaaucagaugguuacagcuuguaaggccuauauuaccgacgggggacugaaccacgugugggaccaagagacaccugucgugcucaaaaagauccaggauugcauuuuccuguuuaaagaauaccaggcuagcuuccauaagaccagaaaacugaucucugaguccagcggcgagaaguccuuugaaguuucugagauguauauuuucgggaaguuugaagccuucuguaaacgccuugagaagaucacggaaaugaucacagugguccagaccuacagcacccucuccaauucuacaauugagggaaucgacauuauggcgaucaaauuucggaacauuuaccaaggcgugaagaaaaagcaguaugauauccuggaccccagacggaccgaguucgauacagacuuucuggauuucaugacgaagaucaauggccucgaagugcagauucaggccuuuaugaacagcuccuucgggaaaauccugagcucucaacaggcccuucagcugcuccagcgcuuccaaaagcugaauauuccuugccugggacuugagaucaaccacaccauugaaagaauccuccaguacuauguugccgagcuggacgcuaccaagaagcuguaccacucccagaaagaugaucccccgcucgcccggaacaugccucccaucgccggcaagauucugugggucagacagcuuuaucgccggaucagcgagccuauuaauuacuuuuucaaaaacucugauauccuguccagccccgacgggaaggcugugauuagacaauauaauaagaucucuuacgugcucgucgaauuugaggugguuuaccauaccgcguggauccgcgaaauuagccagcugcacuaugcccugcaggcuacacuuuucgugagacauccugagaccggaaaacuccuggucaacuuugaucccaagauccuggaagugguucgggagacgaaauguaugauuaagaugaaacucgacgugccggagcaagccaagcgccugcuuaagcuggaauccaaacucaaggccgacaaacuguaccugcagggccuucuccaguauuacgaugagcugugccaggaagucccuagcguguucguuaaucugaugacccccaagaugaaaaagguggagucuguccucagacaagggcugacagugcuuaccugguccagccugacacucgaauccuuuuuccaggagguggagcugguccuggacauguuuaaccagcuucugaagaaaaucucugaucucugcgaaaugcacauugacaccguucugaaggagaucgcuaaaacggugcucauuagccugcccgaauccggcgccacaaagguggaggauaugcuuacccugaaugaaacauauaccaaagagugggcggacauccucaaccauaagucuaagcacgucgaggaagcugugcgggagcugaucagcauuuucgaacagaucuacgagguuaaauauaccggaaaggugggcaaacaauccgagcagcgcaagcacgucguguuugggucugaaacaggagagggcgaaaauaacgauuacgaggccaauauuguuaacgaguucgacacgcaugauaaagaggacgaguuuaagaaagaauguaaggagguguucgccuucuuuagccaccagcugcuugauucccugcagaaggcuaccagacucagccuggacacaaugaaacggcgcaucuucgucgccucucucuacgggagaaagcaauccgaagauauuaucagcuuuaucaaaucugaggugcaucuggcgauuccuaauguugugaugaucccgucccuugacgacauucagcaggcuaucaaccggaugauucaacugacccucgaagucagccgcggaguggcccacuggggccagcagcagaucagacccaucaagucugugauuccuucccccacaaccacggaugucacacaccaaaauaccgggaaacugcugaagaaggaggagcggagcuucgaagaggccaucccugcuagaaaacuuaagaacuuuuaucccggcguugccgaacauaaagacauuuccaagcuggugcuccugcucagcucuagcgugaacucccugcgcaaagcugcccacgaggcgcuucaggauuuccagaaguacaagacccuguggacagaagaccgggaugucaaagugaaggaguuucuggccaauaacccuucucucaccgagaucagaagcgaaauucugcauuaugcuacauucgagcaggaaaucgacgagcuuaaacccauuaucguugugggagcccuggagcuccacacggaaccgaugaagcuggcucucuccaucgaggccaaagccuggaagaugcugcuuugccgcuaccugaaugaagaguauaagaaaaagaugucuuacaugauugcuuuuaucaacgaauaucugaaaaagcucagccggccuauuagagaucuggacgauguccgcuucgcgauggaggcccuuuccuguauccgggacaaugagauucaaauggauaugacccugggccccaucgaagaggcuuacgccauccucaacagauuugaaguggagguuacaaaagaagagucugaggccguggacacccugcgcuacagcuucaauaagcuccaguccaaggcugucagcgugcaggaagaccugguccaggugcaaccuaaauucaagucuaaccuucuggaguccguugaaguguuucgggaggaugucauuaauuucgccgaagcguaugagcuggaggggcccauggugccgaacaucccuccccaggaagcuagcaauagacuccagauuuuucaggccucuuucgacgaucuguggcggaaauuuguuacauacuccagcggagagcaacuuuucggccugccugugaccgacuaugaaguccuccauaagacgcgcaaagagcugaaccuccugcagaaacuuuacgggcuguaugauaccgugauguccucuaucagcggauacuaugagauucuguggggcgacguggauaucgagaagaucaaugccgagcuccuggaauuucagaacagaugccggaaacuucccaaggggcugaaagacuggcaggcuuuccucgaucugaagaaacgcauugacgauuuuuccgagagcuguccccugcucgaaaugaugacaaauaaggccaugaaacagagacacugggaccggaucucugagcuuaccggcacaccuuucgauguugaguccgacagcuuuugccugagaaacauuauggaagcgccgcugcucaagcacaaggacgauaucgaggacauuuguaucucugcuauuaaagaaaaggauaucgaggccaaacugacccaggucaucgaaaacuggacaaaucagaaccuuagcuucgccgcuuuuaagggaaaaggcgagcugcuccugaaggggaccgaguccggagaaauuaucacgcugauggaggacucucucauggugcuuggcagccugcuguccaaucgcuacaacgcccccuucaagaaaaauauucaaaacuggguguacaagcucucuacaagcuccgauaucauugaagaguggcuggucgugcagaaucuuuggguuuaucuggaagcuguguucgucgggggagacaucgccaaacagcucccucaggaggcgaagcgguuucaaaacaucgauaaaagcuggauuaagaucaugcagagagcccaugagaaucccaacgugauuaauugcuguguuggcgacgaaaccauggggcagcugcugccucaccuccaugagcagcuugaagugugccaaaagucucugaccggcuaccuggagaaaaagcgccuccuguucccccgguuuuucuuugucuccgauccugugcuucuggagauccucggacaggcuagcgacucccacacaauucagccgcaucugcccgccguuucugauaacaucaaugaagugaccuuccacgcuaaagacuaugauagaaucauggccgucauuagccgcgagggcgaaaagaucgugcuggacaacuccgugauggccaaagggccugucgagauuuggcuccuugaccugcugaagaugcaaaugucuagccuccacaauaucauucgguccgcuuuuuaccagaucagcgauucuggauuccagcugcuucccuuucugucccauuucccugcgcagguuggccuccuggggauucaaaugcuguggacgcacgacagcgaagaggcccucagaaacgcuaaagaugaccgcaagaucaugcaagugacaaaucagaaguuucuugauauccugaacacccugauuucucagacaacccaugaccucuccaaauucgauagagugaaguuugagacacugaucaccauucacguccaccaacgggacaucuucgaugaccuugugaaaaugcauauuaagagccccacggauuucgaauggcugaaacagucucgcuuuuauuucaaggaggaccucgaccagaccguugugagcaucacagaugucgacuuuaucuaccagaacgaguuccugggauguaccgauagacuggugauuacaccgcucaccgaccggugcuauaucacgcuugcccaagcccugggcaugaauaugggcggggcuccugccggacccgcgggcacagggaagaccgagacaaccaaagauaugggacgcugccugggcaaguacguuguggucuuuaacuguuccgaccagauggauuucagagggcucggacggauuuuuaaaggccuggcucagucuggcagcugggggugcuucgacgaauuuaauagaaucgagcuucccgugcuguccgucgccgcccagcaaauuuacaucgugcucaccgcucgcaaggagcggaaaaagcaguucaucuuuagcgauggagacuguguugaucugaacccugaguucggcauuuuucugacaaugaaucccggguaugccggaagacaggaacucccugaaaaccuuaagauccaauuccgcacgguggcgaugauggugccggaccggcagauuaucaugagagucaaacuggccuccugcggcuuccuggagaauguuauucucgcucagaaguuuuacgugcuguauaaacuuugugaagaacagcugaccaagcaagugcacuacgauuucgggcuccggaacauccugucuguccugcgcacacucggaagccagaaaagagcccggcccgaggacuccgaacuuucuauugugaugcgcggccugagagacaugaaucugagcaagcucguugaugaggacgaaccucuguuucuuucccugaucaacgaucucuuccccggccugcagcuggacucuaauaccuaugcugagcuccagaacgccguggcucaucaaguccagaucgaggggcuuauuaaucacccucccuggaaccugaagcuggugcagcucuacgaaacaagccugguccggcauggacuuaugacccugggcccguccgggagcggaaaaacgacagugaucaccauucucaugaaggcccagaccgagugcggccgcccucacagagaaaugcggaugaaucccaaagcgaucacagccccucaaauguuugggcgccuggauaccgcuacaaacgacuggacggauggaauuuucucuacccuguggagaaagacacucaaagccaagaaaggcgagaacaucuuucugauccuugacggccccguugaugcuauuuggaucgaaaaucugaacuccgugcucgacgauaauaagacccugacacuugccaacggggaccggauuccuauggcccccagcuguaagcuccuguucgagguccacaauaucgagaacgcuucuccggcgaccguguccagaaugggaaugguuuauauuuccucuagcgcccugagcuggcgcccuauccugcaggcuuggcucaaaaagcggacggcccaggaagccgcuguguuucugacccuuuacgagaaagucuucgaagacacauacaccuauaugaagcugaaucucaaccccaaaaugcaacugcuugagugcaauuacaucgugcagucccugaaccuccuggaaggccugauucccagcaaggaggaagggggagugucuuguguugaacaucuccacaagcuguuugucuucggccuuauguggagccugggggcccuccuggagcuugaauccagagagaaacuggaagcguuucuccgccagcaugagucuaagcuggaucugccugagaucccgaaaggaagcaaucagacaauguaugaguucuacgugaccgacuauggcgauugggagcacuggaacaagaaacuccaacccuacuauuacccuacagacuccauucccgaauacucuagcauccuggugccuaaugucgauaacauucggacgaauuuccuuaucgacaccaucgccaagcagcacaaggcuguucugcucacaggcgagcaggggaccgccaaaaccgugauggugaaggcuuaucugaaaaaguacgaucccgagguccagcuuuccaaaucucugaacuuuagcuccgccacagaaccuaugauguuccaaagaacgauugagagcuauguggacaagcgcaucggaucuaccuacggcccgcccgggggacggaagaugacaguuuuuauugaugacaucaacaugccugugauuaaugaauggggcgaucagaucaccaacgagauugucagacagaugauggaaauggaggggauguauucccucgacaaacccggagauuucacaaccaucguggacguucagcugaucgcggccaugauucauccuggcggcgggcgcaaugacaucccccaacggcugaagagacaguuuacgguguucaacugcacacucccgagcaaugcuucuauugauaaaaucuuuggaauuaucggcuguggguacuucgacccuugccgcuccuuuaagccccagaucugcgagaugauugucaaccuggugagcgugggacggguccuuuggcaauggaccaaaguuaagaugcugcccaccccuuccaaguuccacuauaucuuuaaucucagagaucugucucgcauuuggcagggcaugcuuacaaucaaagccgaagagugugcuagcauucccacccugcucucccuguucaagcaugaaugcagcagagugaucgccgaccgguuuaucacaccugaggaugaacagugguucaacgcucaccugacccgcgccguggaggagaauauugggucugacgcggccuccuguauccucccggaacccuacuucgucgauuuucugagagagaugccugaacccacgggagacgagccugaagauagcguguucgagguucccaaaauuuacgagcuuaugccgucuuuugacuuccuggcugaaaagcuccaguuuuaucaacggcaguucaacgagaucauuagaggcacaagccuggaucuuguguuuuucaaagacgccaugacccaucugaucaagauuucccggaucauccgcacaucuugcggcaaugcucuccuggucggggugggaggcagcgggaaacagucccugucuagacucgccagcuuuauugccggauaccagaucuuccaaauuacccugacgcgguccuauaacguuaccaaucuuacagaugaccugaaggcgcucuacaagguggcuggcgccgacgggaaaggcaucaccuuuauuuucacagauagcgaaaucaaggacgaggcuuuucuggaguaucuuaacaaucugcucucuuccggagaaaucagcaaccuguucgcccgcgaugagauggacgaaauuacccagggccugaucuccgucaugaaaagagagcuuccucggcaucccccuacauucgauaaccuguacgaauauuuuauuucucgcagcagaaagaaucuccacgugguucuguguuucucccccgugggggagaaauuucgggcccgcucucucaaguucccuggacugaucagcggcugcaccauggacugguuuuccagauggccccgggaggcucuuauugccgucgcgagcuacuuccugucugauuacaacaucguguguuccagcgaaaucaagcgccaggucguggagacgauggggcuguuucaugacaugguuucugaauccugcgagagcuauuuccagagauaccggcgcagagcccacgugacaccgaaaucuuaucucuccuuuauuaauggauacaagaacaucuaugcugaaaaagucaaguucauuaaugagcaagccgagcggaugaacaucggccuggauaaacuuauggaagcuagcgagucuguggccaagcugagccaggaccucgcggugaaggaaaaagagcuggccguugcuuccauuaaggccgaugaagugcucgcugaggucaccgugagcgcccaggcuuccgccaaaaucaagaaugagguucaggaagugaaagacaaggcgcaaaagauugucgacgagaucgauucugaaaaagugaaggccgagagcaaacuggaggcugccaagccugcucuggaagaggccgaagccgcgcuuaacaccaucaaacccaaugacauugcuacagucagaaagcuggccaaacccccucaucucaucaugcgcauuauggauugugugcugcuucuguuucagaagaagaucgacccgguuaccauggaucccgagaaauccugcuguaagccuucuuggggagaaagccucaaacugauguccgccacaggcuuccucuggucucugcagcaauuccccaaggacacgauuaacgaggagaccguggaacugcuucagccuuacuuuaauauggaugacuauacauucgagagcgcuaaaaaggucugcggaaacguggccggccugcucuccuggacccuggcuauggccaucuuuuacgggaucaaucgggaaguucuuccccugaaggcgaaccucgccaaacaggagggaagacuggcuguggccaaugcugaacugggcaaggcccaggcgcuccuggaugagaaacaagccgagcuugacaagguccaggcuaaauucgaugccgcuaugaacgaaaagauggaccugcucaacgaugccgacacaugccgcaagaaaaugcaggcugccagcacccugauugacgggcuuucuggagagaagauccgguggacgcagcaauccaaagaauuuaaggcgcagauuaauagacuggugggcgauauccuccuguguaccggguuccugagcuaccucggcccuuuuaaccagauuuuccgcaauuaucugcuuaaagaccagugggagauggaacugcgggccagaaagauccccuuuacagagaaccucaaucugaucucuaugcuuguggauccgccuaccauuggagaguggggccugcaagggcuccccggagacgaucuguccauccagaacggcauuaucguuacaaaggcuacccgcuacccucugcucauugacccccagacgcaagggaaaacauggaucaagagcaaagaaaaggagaaugaucugcaggucaccucucuuaaccacaaauauuuccggacacaccuggaagacucccucagccugggaagaccgcuucugauugaggauauccaugaggaacucgacccugcccuggauaaugugcuggagaagaacuuuaucaaaucuggcaccaccuucaaggugaaggucggcgacaaagaaugcgauauuauggacacauuuaagcucuacaucacgaccaaacugcccaaucccgccuucacaccugagauuaacgcuaagaccuccgugaucgacuucacaguuaccaugaaagggcuugaaaaucagcugcuccgccgggugauucugacggagaagcaggagcuugaagccgagagagucaagcugcucgaagaugugacauuuaacaaacggaagaugaaagagcuggaagacaaucugcucuauaagcugagcgcgaccaaaggaagccuuguugaugacgagucccugaucggcgugcucagaaccacaaagcaaaccgcugccgaggucucugaaaagcugcacguggccgcugagacagaaaucaaaauuaacgccgcucaggaggaguuccgccccgccgcgacgcgggggagcauccuuuacuuucugauuaccgagauguccaugguuaacaucauguaucagacaucucucgcccaguuccugaagcuguuugaucaaagcauggcuagauccgagaaaucuccucucccgcagaagcgcauuaccaauaucaucgaauaccugacauacgagguguucaccuauagcgucagaggacuuuacgaaaaccauaaauuucuguucgugcuccugaugacgcugaagauugaccuccagcggggcaccgugaagcaccgcgaguuucaggcccuuaucaaagggggagcugcccuggaucugaaggcgugucccccuaaacccuauagauggauucucgacaugacauggcugaaucuugucgagcuguccaagcucccucaauucgccgaaaucaugaaccagauuagccggaaugagaaaggcuggaagucuugguuugauaaggacgcucccgaagaggaaaucauuccugauggcuacaacgacucccuggacacaugccauaaacugcuucucauccgcagcugguguccggauagaacaguuuuccaggcccggaaguauaucgcugacucucuggaggagaaauacaccgaacccgugauucugaaucucgagaagacaugggaagaguccgauacccgcacgccucugaucugcuuucuuagcaugggguccgaccccacaaaccagauugaugcccuggccaaaaagcucaaacuggaauguagaaccaucucuaugggacaaggccaggaggugcacgcucggaagcugauucagaugagcaugcaacaagggggauggguccuucuccagaauugccaccugggccuggaguucauggaagaacuccuggaaacccuuaucacaacggaggcguccgacgauucuuuccgcguguggaucaccacagaaccucaugacagauuucccauuacccugcuccagacaagccugaaguucaccaacgagccgccucaagggguucgggccggacugaaacgcacauuugcuggcaucaaucaggaucuucucgacauuuccaaccugcccauguggaagcccaugcuguauaccguggccuuccuccacagcacgguccaggagagacggaaauuuggcccucugggguggaauauccccuacgaguucaacucugccgauuuuuccgcuagcgugcaguucauucaaaaucaucuugacgagugugauaucaagaaaggaguuucuuggaacaccgugagauacaugaucggcgaaguccaguaugggggacgcgugacagacgacuuugauaagcggcugcucaacugcuucgccagagucugguuuagcgagaagauguucgagccuuccuuuuguuucuacaccggcuauaaaauuccgcugugcaagacacuggaccaguacuucgaauauauccagucucuucccagccucgauaauccugagguguuugggcugcaccccaacgcggacauuaccuaccaauccaauacggcuagcgccguucuggaaacaaucaccaacauucagccuaaagagucuggaggcggcgugggggaaacacgcgaggccaucgucuaccggcucuccgaggauaugcugagcaaacuucccccggacuauaucccucaugaagugaaauccagacugauuaagaugggacaccucaauucuaugaacaucuuccugcgccaggagauugaucggaugcaaagaguuaucagcauucugcgcuccucucuuagcgaccucaagcuggcuaucgaaggcaccauuaucauguccgagaaucugcgggaugcccucgacaacauguacgaugcuagaaucccccagcuguggaaacgggugucuugggacagcuccacgcuuggguuuugguucaccgaacugcucgagcgcaaugcccaguuuagcacauggauuuucgagggaagaccuaacgucuuuuggaugaccggcuucuuuaauccccagggguuccugacagcgaugcggcaagaagugacccgcgcccacaagggaugggcucuggauacagugaccauccauaacgagguucuuagacagacgaaagaagagauuacaucuccgccuggcgaaggcgucuauaucuacgggcucuauauggacggagccgcuugggaccggagaaauggcaagcugauggaguccacccccaaagugcuguuuacccagcuccccgugcugcacauuuucgccaucaacagcacagcgccuaaggaucccaaacuuuacgucugcccuaucuauaaaaagccgcgccggaccgaccugacauuuauuacggugguuuaccucagaaccgugcugucucccgaucauuggauccugcgcggggucgcccuucucugugacauuaaauga

SEQ ID NO: 68433 - RNA, 13461 nt, Artificial Sequence
  derived and/or modified sequence opt5 from DNAH9__Homo_sapiens__NP_001363
augagacuggccgaagaacgggcugcccuugcggcugaaaacgccgacggagaacccggggccgaucgcagacugcggcuucugggaaccuacguggcuaugagccuccgcccugccgcuggagccugggaaagaugcgcgggguccgccgaagcugaacagcugcuucaagccuuccugggacgggacgcugccgaaggcccgcgcccccuccuggugguuagaccugggccccggggacuggcgauccgcccuggccucgaagugggccccgaaucugggcuggccggagcuaaggcccucuuuuuccugagaacaggcccugaaccgcccgggccugauagcuuucggggagcugugguguguggcgaccuccccgccgccccucuggagcaccuugcugcgcuguucuccgaggugguucuccccgugcuggccaaugagaagaaccgccugaauuggccgcauaugauuugcgaggaugucagacggcacgcucauucucuccagugugaccugagcgugauccuugaacagguuaaggggaagacgcugcucccucugcccgccggauccgagaagauggaauuugccgauucuaagagcgagaccgugcuugacuccauugauaagagcgucaucuaugcuauugagucugccgugaucaagugguccuaccaggugcaagucguucugaagcgcgaaagcucucagccucuccugcagggcgagaaccccacacccaagguggaacuggaguucuggaaauccagauaugaagaccucaaguacaucuauaaucagcugcggaccauuacagugagaggcauggcgaaacuucuggauaagcuccaaagcucuuacuuuccugcuuucaaggccauguaucgcgacgucguggccgcucuggccgaggcucaggauauccacguucaucuuauuccgcugcagcggcaccucgaggcccuggaaaacgcggaguuucccgaagugaaaccucagcugagaccccuccugcacgucgugugccuuaucugggccaccuguaaguccuaccgcagcccugggcggcugacaguucuccugcaagagauuugcaaucugcuuauccagcaggcuuccaacuaccucucucccgaagaccugcugagaagcgagguggaggaaucccaacgcaaacuccaggucgugagcgacacccugucuuucuuuaagcaggaguuccaggaucggagagaaaaucuucauacguauuuuaaagagaaccaagaggucaaggaaugggacuuccaguccagccugguguucguucgccucgauggauuucugggccagcugcacguggucgaggggcuucucaaaaccgcccuggacuuccauaagcugggaaagguggaauuuucuggcguucgggggaaugcucucagccagcaagugcagcagaugcacgaggaguuccaggagauguacagacugcuuuccggaucuagcuccgauugucuguaucuccaaagcacagacuuugagaacgaugucucugaguucaaucagaaaguggaggaccuggaucgccggcugggcaccauuuuuauccaggccuucgacgaugcgccgggccuugaacacgccuuuaagcuccuggacaucgcugggaaccugcucgagagaccucugguggcccgggacacauccgauaaauaccuuguucugauucagauguucaauaaggaccucgaugcuguccgcaugaucuauagccaacaugugcaggaagaggccgagcugggauuuucucccgugcacaaaaacaugccuaccgucgccggcgggcugagaugggcucaggaacuucggcaacggauucaaggacccuucuccaacuuuggccgcaucacgcauccuugcauggagagcgcggaagggaagcggaugcagcagaaguacgaggacaugcucucccugcuggaaaaauaugagacaagacucuacgaggauuggugucgcaccgugucugaaaagagccaauacaaucugucccagccccuucugaaaagagacccggagacaaaggaaauuaccaucaacuucaauccucagcucaucucuguucugaaagagaugagcuaucuggagccccgggaaaugaagcacaugcccgagaccgccgcugccauguucuccagccgcgauuuuuacagacagcuuguggccaaccuggaacucauggcuaauugguauaacaaggucaugaaaacacugcucgagguggaguucccucugguugaggaggaacuucaaaauauugaccugcggcuccgcgccgcggaggaaacgcugaacuggaagaccgagggcaucugcgauuacgugacagaaauuaccucuuccauccaugaccuggagcagcggauucagaaaacaaaggauaaugucgaggaaauccagaacaucaugaaaaccugggugacgccgauuuuuaagacaaaggacggaaaaagagagagccuucugucucucgaugaccgccacgacagaauggaaaaguauuacaaucugaucaaagaguccggccucaagauucacgcucugguucaagaaaaccuugggcuguucagcgccgaucccaccucuaauaucuggaaaaccuaugugaacagcauugacaaucuccugcugaacggauuuuuccuugccaucgaguguucccugaaguaccuccuggagaacacagaaugcaaagcuggccucaccccuauuuuugaggcccagcugagccuugcgauccccgaacuggucuucuacccuucucuggaguccggggugaagggaggcuuuugcgauaucguggaggggcucauuacaagcaucuuccggauucccucccuggucccucgccuuucuccccagaauggcagcccgcauuaucaaguugaccuggauggaaucccugaccucgcuaacaugagacggacgcugauggaaagagugcagcgcaugaugggccucuguugcggguaccaguccaccuuuucucaguauagcuaccuguauguggaggaucggaaggaaguccuuggacaauuccugcuguacggccacauucucacacccgaggaaaucgaggaccauguggaggaugggaucccugaaaaucccccgcugcuuucccaguuuaaaguucagauugacucuuaugagacccuguacgaagagguguguagacucgaaccuaucaaggucuucgauggauggaugaaaauugacauccgccccuucaaggccagccugcucaacauuaucaaacgguggucccugcuuuuuaagcagcaccugguggaucacguuacacauagccuggccaaucucgacgcuuucaucaagaaaucugaguccggccugcuuaagaaaguggagaagggggacuuucaaggccuggucgaaauuaugggacaccucauggccgugaaagagagacagagcaacaccgaugaaauguucgagccucugaagcagacgaucgaacuccugaagaccuacgagcaggagcuucccgaaacaguuuuuaaacaacuggaggaacugcccgagaaguggaauaacauuaaaaagguggcuaucaccgucaaacaacagguggccccucuccaggcgaaugaggugacacugcuucgccaacggugcaccgccuucgacgcugaacagcagcaauuuugggagcaguuccauaaggaagccccguuuagauucgauucuauucacccccaucagaugcuggacgcucgccacaucgagauccagcaaauggaauccacgauggccagcauuucugaguccgccagccucuuugaggucaacguuccugauuauaagcagcugcggcaguguagaaaagaagugugccagcugaaggagcucugggacacaaucggcauggugaccuccagcauucacgcuugggaaacaacccccuggcggaauaucaacgucgaggcgauggaacuugaguguaaacaauucgcccgccauauuagaaaucuggauaaggaggugcgggcuugggacgccuucaccgggcuggaaucuacaguuuggaacacgcucagcucccugcgcgccguggcugagcuucagaauccugccaucagagaacggcacuggagacagcugaugcaggcgaccggagucucuuuuacaauggaucaagacaccacacucgcucaucugcugcagcuccagcuucaccauuacgaggaugaagugcgcggcauuguugacaaagccgccaaggagauggggauggagaaaacccugaaggaacugcaaacgacaugggcuggaauggaguuccaguaugaaccccacccucggaccaacgugccgcuccugugcagcgacgaggaucuuaucgagguccuggaagacaaccaggugcagcuccaaaaucuggucauguccaaguacguggccuuuuuccuggaggaaguuucuggcuggcagaaaaagcucagcaccguggaugcggucaucuccauuugguuugaggugcagagaacauggacccaccuugaaucuaucuucacagggagcgaggacauucgcgcucagcugccccaagauuccaaacgguuugagggcaucgacauugauuucaaggaacuggccuaugacgcccagaaaaucccuaacguugugcagacgaccaauaagcccggacucuacgagaagcuggaagauauccagggcagacuuugucugugcgagaaagcucucgccgaauaucuggacacaaagcgccuggcuuuuccucgguucuacuuucucuccucuagcgaucuucuggacauucugagcaacgggaccgcgccccagcagguccagagacaucucucuaaacuguucgauaauauggcgaagaugcgcuuucagcuugacgccuccggagagccgacaaaaaccagccugggcauguacuccaaggaggaagaguauguggcuuucucugaaccuugugacugcagcgggcaaguggagaucuggcucaaccacguucugggacauaugaaggccacggucagacacgaaaugaccgagggcgugacagcuuacgaggaaaaaccccgggagcaguggcuguucgaucaccccgcccagguggcccugaccugcacacaaauuugguggaccacagaagucggcauggcuuuugcgcgccuugaggagggguaugaauccgccaugaaggacuacuauaagaaacagguggcucagcugaaaacccugaucacgaugcucauuggacagcugagcaaaggcgauagacaaaagaucaugacaaucuguaccauugacguucaugcccgggauguggucgccaaaaugaucgcucagaagguggacaaugcccaggcguuccuuuggcugucucagcuccgccacagaugggaugacgagguuaaacauugcuuugcuaacauuugugaugcccaauuccuguacuccuaugaauaccuggggaauaccccucggcucgugaucacaccccuuaccgacagaugcuacauuacgcugacacagagccugcaccucaccaugucuggagccccugcuggcccggccgggacaggaaagaccgagacaaccaaagaucugggccgcgcgcuuggcauccuggucuauguguuuaacuguagcgaacagauggacuacaaguccugcgggaauauuuauaagggacucgcccagacgggcgcuuggggguguuucgaugaguuuaaccggaucucuguugaggugcugagcgucguggccgugcaagucaaauccauccaggacgcuauuagagacaagaaacagugguucucuuuucugggagaagagaucagccucaaucccuccguuggcauuuucaucaccaugaacccuggguacgccggacgcacagaacuucccgagaaucucaagagccuguuucggccuugcgcuaugguggugcccgauuucgaacucauuugugagaucaugcuggucgccgagggcuuuaucgaagcgcaaucucuugccagaaaauucauuacccuguaucagcucugcaaggagcugcuguccaaacaggaccauuacgauuggggccuccgggcuaucaagagcgugcuuguuguggccgggucccugaagcgcggagacccggauagaccugaagaccagguccugaugcggucucuccgcgauuucaacauucccaaaaucgugacagacgauaugccuauuuuuaugggccugaucggggaccuuuuccccgcucuggauguuccuagacggcgcgaccccaacuuugaggcccucgugagaaaggccaucgucgaccugaaacugcaagcugaagauaauuucgugcucaaggucgugcagcuugaggagcugcuggcgguucggcacagcguguuuguggucggaggcgccgggaccggaaaaucccagguucuccgcucucugcacaagacguaucagauuaugaagagacggccgguguggacagaccuuaacccuaaagcugugaccaaugaugaacuguucggcaucauuaaccccgccacaggcgaguggaaggacgggcucuuuagcuccaucaugagagaacuggccaauauuacccaugauggacccaaauggauccugcucgacggcgauauugacccuauguggaucgagagccugaacaccgucauggaugacaauaaggugcuuacacuggcuucuaacgagcgcaucccgcucaaucccacgaugaaacugcuuuucgaaauuucccaccugagaaccgccaccccugccacaguuagcagagccgggauccucuacauuaaccccgcugaucugggauggaauccucccgugucuuccuggaucgagaagcgcgaaauucaaacagagcgggccaaccugaccauccucuuugacaaguaccugccuacgugucuugauacacugagaacccgcuucaaaaagaucauuccgauccccgaacagagcaugguccagauggugugccaucuccuggagugccuucugaccacagaggacauuccugcugacugucccaaagaaaucuaugagcacuacuuugucuucgccgcgauuugggccuuuggcggggcuauggugcaggaucaacucguugacuaucgggccgaguucucuaagugguggcugaccgaguucaaaacagugaaguuuccuagccagggaacgaucuucgauuacuauaucgaccccgaaaccaagaaauuugagccgugguccaagcuggucccucaguucgaguuugaucccgaaaugccccuccaggcuugccuggugcacacaucugagaccauuagaguuuguuacuucauggaacgccuuauggcccggcagagaccugugaugcuggucggcacagcuggcaccgggaaaagcgugcucgugggagccaagcuggcgucccuugaccccgaggccuaucugguuaaaaaugucccuuuuaacuacuacacgaccagcgcuaugcuccaggccgugcuggaaaagccgcuggagaaaaaggcuggccgcaauuaugggcccccuggaaacaagaaacucaucuacuucauugaugacaugaauaugcccgagguggaugccuauggcacaguccagccucauaccaucauucggcaacaccuggacuacgggcauugguaugauagauccaaacuuucucugaaagaaaucacaaacguucaguacgugagcugcaugaaccccaccgccggauccuuuacaauuaauccgcgccuccagagacacuucucuguguuuguccugagcuucccuggcgcggacgcucuuuccucuaucuauagcaucauucugacgcagcaucucaagcugggcaacuuucccgccucccugcaaaagagcaucccuccccucauugaccuggcucuugccuuccaccagaagaucgccaccacauuccugccuaccgggauuaaguuucacuacaucuucaaucuccgggauuuugcuaacaucuuccagggcauucuguuuucuuccguggaguguguuaaaagcaccugggaccuuauccgccuguaccuccaugaaucuaauagaguguaucgggauaagauggucgaggagaaagacuucgaucuguuugacaagauucagacagaagugcugaaaaagacguucgaugacaucgaggaucccguugaacaaacccaguccccgaaccucuacugccacuuugccaauggcauuggggagccuaaguauaugcccgugcagagcugggaacugcuuacacagacccuggucgaggcgcucgagaaccauaaugaagugaacacagugauggaccugguccuuuucgaggaugccaugagacacguuugucacaucaaucggauccuggaaucuccccgcggaaacgcucuccuggugggcgucgggggauccggcaaacaaagccugaccagacucgccgcuuuuauuuccagcauggacgucuuccagaucacgcugcggaagggcuaccagauucaagauuuuaaaauggaccuugccucucugugccucaaggcgggggugaaaaaucugaacacaguuuuccuuaugaccgacgcccagguggcugaugagcgcuuccugguccucaucaaugaccugcuggccagcggagaaauuccugaucuuuauuccgacgaugagguggagaacaucauuucuaacguuagaaaugaagucaagagccagggccuggucgacaaccgggagaauuguuggaaguuuuucaucgaucgcaucagacggcagcucaaagugacccugugcuuuuccccgguugggaacaagcuccgcgugagaucucggaaauuccccgcuauugucaauuguacagccauccauugguuucacgaauggccucaacaggcucuggagagcgugucccuucgcuuccugcagaacaccgaaggaauugagcccacagucaagcagucuaucagcaaauuuauggccuucgugcauaccuccguuaaucaaacgagccagucuuaccuguccaacgagcagagauauaauuacacaaccccuaagagcuuucucgaguucauucggcuguaccagucucuucugcaccgccauagaaaagagcucaagugcaagacagaacggcuggagaacggccuccugaaacugcacuccaccagcgcgcaaguggacgaucuuaaggccaaacuggcugcccaggaggucgaacucaagcagaaaaaugaggacgcugauaagcugauccaagugguggggguugaaacggacaagguguccagagagaaagccauggccgaugaagaggagcagaaggucgcggugaucaugcuugaaguuaaacagaagcagaaagacugcgaggaagaccuggcuaaggccgagcccgcccucaccgcugcccaagcugcccugaacacacucaauaagaccaaccugacagaacugaaaucuuuuggcagcccuccccuugcgguguccaaugucagcgccgcugugaugguccugauggccccgcgcggacgggugccuaaggauagaucuuggaaagcugccaagguuaccauggcgaaaguggacggcuuccucgauucccugauuaacuuuaacaaggagaauauccacgagaacugucuuaaggccauucgccccuaucugcaggacccugaguucaaucccgaguucgucgcuacaaaaagcuacgccgcugccgggcucugcucuugggugaucaacauuguucgguuuuaugaaguguucugugaugucgagccgaagagacaggcucugaauaaagccaccgcggaccugacggccgcucaggaaaagcucgccgccaucaaagcuaagaucgcccaucugaacgagaaucuugcgaagcugacagcucgcuuugagaaagccaccgccgauaagcucaaaugccaacaggaagcugaggugaccgccgugacaauuagccuggcuaaccggcuuguuggaggccuggccuccgaaaaugucagaugggcggacgccgugcagaacuucaagcagcaagagcgcacccucuguggggauauccugcugauuacagcuuuuaucucuuaccucggauucuuuacgaaaaaguaucggcagagccugcuugacagaaccuggcgcccuuaccugucccagcucaaaacacccauucccgugaccccugcccuggauccccuucggaugcugauggacgacgcugaugucgccgcguggcagaaugagggccucccugccgacagaaugucuguggaaaacgcuacaauccugaucaauugcgagcgguggccgcugaugguugauccccaacuccaggggauuaaguggaucaagaacaaauauggcgaagaccugagagugacccagauuggacaaaagggcuaccuucagaucauugagcaggcccuggaagcuggggccgucgugcucaucgagaaucuggaggaaagcauugauccuguucuuggaccccugcucggccgcgaggugaucaaaaaggggcgguucaucaaaauuggagacaaggaaugugaguacaacccuaaguuuagacugauccugcacacgaaacucgccaacccccauuaucagccugaacugcaagcucaggcgacccuuauuaauuucacagucacccgcgauggccuggaggaccagcuccuggccgcugugguuuccauggagagaccggaucuugaacagcucaagagcgaccucacaaaacaacagaacggguuuaagaucacccugaaaacgcuggaggauucucuccugucccggcuuagcuccgccucuggcaauuuccugggagaaacagugcucgucgagaaccuggaaauuaccaagcagacagccgcugagguggagaagaaagugcaggaagccaaggucaccgagguuaaaaucaaugaagcgcgcgagcacuacagacccgcugccgcccgggcuagccuucuguauuucaucaugaacgaccucuccaagauucauccuauguaccaauuuucucugaaagccuucagcaucguguuucagaaggcuguggagcgcgccgcgcccgaugaaucccugagagagcgggucgccaaucucauugacagcaucaccuucucuguguaucaguacacaauucgcggccuguuugaaugcgacaaacuuacguaucuggcucaacucaccuuccagauccugcugaugaacagagagguuaaugccguggaacucgauuuucuucugcgguccccuguccagacagggaccgcuagccccguggaguuccugucucaccaggccuggggagcgguuaaagugcucuccagcauggaggaauuuucuaaccuggaccgcgauaucgagggcuccgccaagagcuggaaaaaguucgucgaaucugaguguccggaaaaagagaaacuuccucaagaguggaaaaauaagacagcucugcagagacucugcaugcugcgggccaugcgccccgacagaaugaccuacgcucugcgggauuuuguggaagagaaacuugggagcaaauacgucgugggcagagcccucgacuucgccacguccuuugaagagagcggccccgcuacaccuauguucuucauucugucccccggcguugauccucugaaggacguggaaucucaggggcgcaaacucggauauaccuuuaacaaucagaacuuccacaaugucagccugggccaagggcaggaggugguugcggaggccgcucuugaucuggccgccaagaaaggacauugggugauccuccagaacauucaccuggucgcuaaguggcuguccacccuugaaaagaaacucgaggaacauucugagaacagccacccggaguuucggguguucauguccgccgaacccgcgccuucucccgagggccacaucauuccucaggggauccuggaaaauagcauuaagaucacaaacgagcccccgaccggaaugcaugcuaaucugcacaaagcccucgacaacuuuacacaagauacgcuggaaauguguuccagagagaccgaguucaagagcauccuuuuugcccugugcuacuuccaugcugugguugccgaacgccggaaauuuggcccucagggcuggaauagaucuuaucccuucaacacaggggaccucaccauuuccgucaaugugcuguacaacuuucuggaggcuaaugccaaggugccuuaugaugaccuucgcuaccucuucggagaaaucauguauggcgggcacauuacagacgauugggaccggagacugugccgcaccuaccugggagaguuuauccggcccgaaaugcucgagggcgagcugagccuugcgccgggguucccucugcccggaaacauggauuacaauggcuaucaucaguacauugacgccgaacugcccccugagucucccuaucuguacggccugcacccuaacgcugaaaucggguuccuuacgcaaaccuccgagaagcucuuuagaacaguccuggaacugcagccgcgggauagccaggcccgcgacggagcuggcgccaccagagaggagaaagugaaggcgcuccuggaagagauccuugaacggguuacagaugaguucaauauucccgagcugauggccaaaguggaagaacgcaccccuuauaucgucguggcuuuucaggaaugugggagaaugaacauucucacacgggagauccaaagaucucugcgcgaacuggagcuuggacucaagggcgagcugaccaugacgucccacauggaaaaucugcagaacgcccucuacuucgacaugguucccgagagcugggcucggagagccuauccuucuacagccgggcuggcugcgugguuucccgaucuucugaaccgcauuaaagaacucgaggccuggaccggagacuucaccaugccuuccacaguguggcugacgggcuuuuucaauccgcagagcuuucugaccgcuaucaugcagagcacagcccggaagaacgaauggccccuugaucaaauggcccuccagugcgacaugaccaagaaaaauagagaggaguuccgcuccccucccagagaaggcgcuuacauccaugggcuguuuauggagggagccuguugggacacacaggcgggcauuaucaccgaagcuaagcugaaagaucucacaccucccaugccggucauguucauuaaggccaucccugccgacaaacaggauugccggucuguguacagcugucccguguauaagaccucccaacgcgggcccacguacguuuggaccuuuaaccugaaaacaaaggagaauccuucuaaguggguccuugcuggaguggcccugcuccugcagauuuga

SEQ ID NO: 68434 - RNA, 2100 nt, Artificial Sequence
  derived and/or modified sequence opt5 from DNAI1__Homo_sapiens__NP_036276
augauccccgccagcgcuaaggccccucacaaacagccgcauaagcaauccauuucuaucggcagagggacccggaaacgcgacgaggauagcggaacagaagugggcgaggggacggacgaaugggcgcaguccaaggcuaccgucagacccccugaucagcuggagcucacagacgccgaacugaaagaggaguucacccggauucuuacagccaacaauccccacgcuccucagaacaucguucgcuacucuuuuaaggaaggaaccuauaagcccauuggcuucgugaaucaacuggccgugcauuacacacaggucgggaaccucaucccuaaagauagcgacgagggaagacggcagcacuaucgcgaugaacugguggcuggcucccaggagucuguuaaggugaucagcgagaccggcaaucuugaagaggacgaagaaccgaaagaacuggagacggagcccgggucccaaaccgaugucccugccgcgggagccgcugaaaaggugacagaggaggagcucaugacccccaaacagccuaaggaaagaaagcugacaaaccaguuuaauuucagcgagcgggccucucagaccuacaacaaucccguucgcgacagagagugccaaacggaaccgccuccccggacaaacuuuuccgcuaccgccaaucagugggagauuuaugaugcguacguggaggaacuggaaaaacaggagaagacaaaagagaaggaaaaagccaagaccccugucgcuaaaaagagcggcaagauggccaugcgcaaacucaccucuauggagucccaaacagacgaucugaucaaacuuagccaggcugccaaaauuauggaaagaauggugaaccagaauacguaugacgacaucgcccaggauuucaaguacuacgacgaugcugcggacgaguaucgggaucaaguggggacccugcucccccuguggaaauuucagaacgacaaggccaagcgccuuucugucacagcucuguguuggaaucccaaauacagagaucucuucgccguuggauauggcuccuacgacuuuaugaagcagagccgggggaugcugcugcucuauucccugaaaaacccuucuuucccggaguacauguuuagcuccaacagcggagugaugugccuugauauucauguggaccaccccuaucuggucgccgugggccacuacgauggcaauguugcuaucuacaaccucaagaaaccucauucucagcccuccuucuguagcucugccaagagcgggaagcacuccgacccuguguggcaagucaaauggcagaaggacgauauggaccagaaucugaacuuuuucucugugagcuccgauggaagaauuguuagcuggacccuugugaaacgcaagcugguccauaucgacgugaucaaacucaaggucgaaggcucuacaaccgaggugcccgaagggcugcagcugcacccgguuggaugcggcacggcguucgauuuucacaaggagauugacuauauguuccucguggggacagaagagggaaaaaucuacaaguguuccaaaagcuauucuucccaauuucuggauaccuacgacgcucauaauaugagcgucgauaccguguccuggaacccuuaucacacaaagguuuucaugucuugcagcuccgacuggaccgugaaaauuugggaucauacaaucaagacgcccauguuuauuuacgaccuuaauucugccgucggcgauguggccugggcuccuuauagcuccaccguguucgccgcuguuacaaccgacggcaaagcccacaucuuugaccuggcgaucaacaaguacgaggccauuuguaaucagcccgucgcugccaagaaaaaccggcucacacaugugcaguucaaucugauccacccuauuaucauugugggggaugacagaggacacaucaucagccuuaagcugucucccaaccuccgcaaaaugccgaaggaaaagaagggccaggagguccaaaaggggccugcuguggaaauugccaaacuggauaagcugcucaaucugguucgggaggugaaaaucaagaccuga

SEQ ID NO: 68435 - RNA, 1782 nt, Artificial Sequence
  derived and/or modified sequence opt5 from DNAI2__Homo_sapiens__NP_001166281
auggagaucguguacgucuauguuaagaaaagaagcgaguucggcaagcagugcaacuuuuccgaccggcaagccgagcugaauauugauaucaugcccaacccugaacucgcugagcaguucguggaacgcaauccgguggacaccgggauucaguguucuaucagcauguccgagcacgaggccaacucugaaagauuugagauggaaacacggggagucaaucauguggagggcggguggcccaaagauguuaacccucuggagcuugaacagacgauucgcuucagaaagaaaguggagaaggacgaaaauuacgucaacgcgaucaugcaacugggaagcaucauggagcacugcauuaagcagaauaacgcuaucgauauuuaugaagaguacuuuaaugacgaggaagccauggaggugauggaagaggaucccuccgccaaaaccaucaacguuuuccgggacccucaggaaauuaagcgcgcugccacacaucucucuuggcaccccgauggcaauagaaaacuggcuguggccuauagcugucuugacuuucagcgggcgccugucgggauguccagcgauucuuacaucugggaccuggagaacccgaauaagcccgagcucgcccugaaaccuuccagcccccuggugacccucgaguucaacccuaaggauucucaugugcugcuuggaggcugcuauaacggccaaauugcuuguugggacacacgcaaggggucccuggucgccgaacucagcaccaucgaaucuucccacagagaccccguuuacggaacaaucuggcugcagagcaaaaccggcacggagugcuuuuccgcuucuaccgauggacaggugauguggugggacauucggaagaugagcgaaccgacagagguggucauccuugauauuaccaaaaaggagcagcuggaaaaugcccucggggcgaucucccuggaguucgaaagcacacugccuaccaaauuuauggugggcacggagcaagggauuguuaucucuuguaaccgcaaggccaaaacauccgcugagaagaucgugugcaccuuccccggacaccauggcccuauuuacgcccuccagagaaaucccuuuuaucccaagaacuuccugacagucggcgacuggaccgcucggaucuggagcgaagauucucgcgagagcuccauuauguggaccaaauaccacauggccuaucuuacagacgccgcuuggucuccugugagaccgacgguuuucuuuaccacacggauggaugggacccuggacaucugggauuucauguuugaacagugugaccccacacucagccugaaggauaauggaugccuuauugcguguggcucccaacuggggaccacgacacuccuggaggugagcccuggacugucuacccuccagagaaacgagaaaaaugucgccuccagcauguucgaacgcgagacccggagagaaaagauccuggaggcucgccaucgggaaaugagacuuaaagagaagggcaaggccgaagggcgcgacgaggagcagacagacgaagaacuggccguggaucucgaagcucuggucucuaaagccgaggaagaguuuuucgacaucauuuuugcggagcuuaagaaaaaggaagcugaugccaucaaacugacccccgugccucagcaacccuccccggaggaagaccagguuguggaggagggagaagaggccgcuggcgaagagggcgaugaagaggucgaggaagaccucgccuga

SEQ ID NO: 68436 - RNA, 1194 nt, Artificial Sequence
  derived and/or modified sequence opt5 from DNAJA1__Homo_sapiens__NP_001530
auggugaaggagaccacauacuaugacguccugggcguuaaacccaacgccacgcaggaggaacucaagaaggcuuacagaaaacuggcccuuaaauaucacccugauaagaauccgaacgaaggggagaaguucaaacaaaucagccaggcguacgaagugcuguccgacgcuaagaaacgggagcucuaugauaagggaggcgagcaggccauuaaagaagggggagccggcgggggauuuggcucucccauggacaucuucgauauguuuuucggcgggggaggccgcaugcagagagagcggcgcgggaagaaugugguccaucaacugagcgugacccuugaagaccuguacaacggagcuacaagaaagcucgcccugcagaaaaauguuauuugcgauaagugugagggcagagggggcaaaaagggagcuguggagugcuguccuaacugccgcggcaccgggaugcagauccggauucaccagaucggacccggcaugguccaacagauccaguccguguguauggaaugccaggggcauggagagcggauuucuccuaaagaccgcuguaagagcugcaauggcagaaaaaucguucgggaaaagaagauucuggaggugcacaucgauaaagggaugaaggacggacagaaaauuacauuucauggcgaaggcgaucaagagcccgggcucgagccuggagacaucauuaucguccuggaucagaaggaccacgccguguucacccgcagaggcgaagaccuuuuuauguguauggauauccaacugguggaggcgcucugcggguuccagaaaccgauuuccacacuggacaaccggaccaucgucauuacgucucaccccggacagaucguuaagcauggcgauauuaagugugugcuuaaugaagggaugccuaucuaucgcagacccuacgagaaaggccggcugaucauugaauuuaaggugaacuucccugagaauggauuucucagccccgacaaacugucccugcucgagaagcugcuuccggaaagaaaagaggucgaagagaccgaugaaauggaccagguggagcugguugauuucgacccuaaccaagagcgccggagacacuacaauggcgaagccuaugaggaugacgaacaucacccccgcgggggagugcagugccagacaagcuga

SEQ ID NO: 68437 - RNA, 1239 nt, Artificial Sequence
  derived and/or modified sequence opt5 from DNAJA2__Homo_sapiens__NP_005871
auggccaacguggcugacaccaagcuguacgauauccucggcguucccccuggggccagcgagaaugaacugaaaaaggcguauagaaaacuugcuaaggaguaccacccggacaaaaaccccaaugccggagauaaguucaaggaaauuuccuuugccuaugagguccugucuaacccugaaaaacgggagcucuacgaccgcuauggcgagcaggggcugagagaaggaagcggcgggggaggcggcauggaugacaucuucucccauauuuuugggggaggccuuuucggguuuaugggaaaucaaucucggagccgcaacggcagacggcgcggggaggauaugaugcacccccugaaggugucccucgaagaccuguacaauggaaaaacaacgaagcugcagcucucuaaaaacgugcugugcagcgcuuguuccggccagggcggaaagagcggggccguccagaagugcucugcuuguagaggccgcggggugcggaucaugauuagacaacuugccccuggaaugguucagcagaugcaguccgugugcagcgauuguaauggcgagggggaggucaucaacgaaaaagaccggugcaagaaaugugagggaaagaaagugaucaaggaaguuaaaauucuggaggugcaugucgauaagggcaugaagcacggccaacgcaucaccuucacaggggaagcggaccaggcccccggaguggagccuggcgauauugugcuccugcuucaggagaaagaacaugaggucuuucagagagacgggaaugaccugcacaugaccuauaagaucggacucguugaagcucugugcggcuuccaauuuacauucaaacaccuggaugggcggcagauuguggugaaguacccgcccggcaaagucaucgagccuggaugugugcgcguugugagaggcgaagggaugccccaguaccggaacccuuuugagaagggagaccucuauauuaaguucgauguccaauuucccgagaauaacuggaucaauccggacaaacugucugaacuugaggaucugcucccuuccagacccgaagugccuaacaucauuggcgagaccgaagagguugagcugcaggaguucgacagcacacgcgggucuggaggcgggcagcggagagaagccuacaacgauuccagcgacgaagaguccucuagccaucacggccccggagugcagugcgcucaucaauga

SEQ ID NO: 68438 - RNA, 1362 nt, Artificial Sequence
  derived and/or modified sequence opt5 from DNAJA3__Homo_sapiens__NP_001128582
auggccgcuagaugcagcacccgguggcugcucguggucguuggcacaccccgccugccugccaucuccgggagaggagcgcggccgccccgcgagggcguggugggggcuuggcuuucuagaaagcugagcgucccugccuucgccuccucucucacgagcuguggaccccgggcucugcuuacccugcgcccuggcgugucccucacagggaccaaacacaaccccuuuauuugcacagccucuuuccauaccagcgcuccucuggccaaggaagacuacuaucagauccugggaguuccgagaaaugcgucccaaaaagagauuaagaaagccuacuaucagcucgcuaagaaguaccaccccgauacaaacaaagacgauccuaaggccaaagaaaaguuuagccagcuggcugaggccuaugaagugcuuucugacgaggucaaacggaagcaguacgaugcguauggcuccgccggcuucgaccccggggcuagcggaucucaacauuccuacuggaagggcgggccuaccguggaucccgaggaacuguuucgcaaaaucuucggagaguuuucuagcuccagcuucggcgacuuucagacgguuuucgaucagccgcaggaauacuuuauggagcucaccuucaaucaagccgcuaagggggugaacaaagaguuuacagucaauauuauggacaccugugaaagaugcaacggaaagggcaaugagccuggcacaaaagugcagcacugucauuauugcgggggauccggcauggaaaccaucaacacggggcccuucgugaugcggucuacaugucgcagaugcggaggccgggggagcaucauuaucuccccuugugucguuugccgcggagccggccaggccaagcagaaaaagagagugaugauucccgugcccgcuggcgucgaggaugggcaaaccgugcggaugccuguuggaaagagagaaaucuucauuacauuucgcgugcagaaaagcccggucuuccggagagacggcgcggauauccacucugaccuguuuauuuccaucgcccaggcucugcuugggggaaccgcccgcgcccaaggccucuacgagaccaucaaugugacaauucccccugggacgcagaccgaccagaagauccggaugggcggaaaaggcauucccagaaucaacagcuauggguacggagaucacuauauucauaucaagauccgcguuccuaaacggcugacaucuagacagcaaagccugauucucuccuacgcugaggacgaaaccgauguggagggcacagucaauggggugacccugacgucuagcggaaagcgcuccacaggcaacuga

SEQ ID NO: 68439 - RNA, 1077 nt, Artificial Sequence
  derived and/or modified sequence opt5 from DNAJB11__Homo_sapiens__NP_057390
auggcuccccagaaccugagcaccuucugccuccugcuucuguaccucaucggcgccgugauugccgggagagacuuuuauaagauccugggagucccucgguccgcgucuauuaaagauaucaagaaggcuuaccgcaaacuugcccugcaacuccacccggacagaaaucccgaugacccucaggcccaggagaaauuccaggaucugggcgcugccuaugaaguucugagcgacuccgagaagcggaagcaauacgauacauauggggaagagggacucaaagacggccaucagucuagccacggggauaucuuuucccauuucuuuggagacuucggcuuuauguucggcgggacgccccgccagcaggauagaaacauuccucggggaucugacaucauuguggaucuggaagugacccuugaggaggucuacgcuggcaauuuuguggaaguugugcgcaacaagcccgucgccagacaagcgccugggaaacggaaguguaauugccgccaggagaugagaacaacccagcugggaccgggccgguuccagaugacacaagaagugguuugugacgagugccccaacgugaaacucgucaaugaggaacgcacccuggagguggaaaucgagccuggggugagagacggaauggaauaucccuuuauuggcgagggcgagccucacgucgauggggaacccggagaccuucgguuccgcaucaagguugugaagcauccgauuuuugagagacggggcgaugaccuguacacaaacgugaccaucagccucgucgaaucccuggugggguucgagauggauauuacgcaccuggacggacacaaaguucauaucagcagagauaagaucacccgcccuggcgccaaacucuggaagaaaggggaaggacugcccaauuucgacaacaauaacauuaagggcucucuuaucauuacauuugauguggacuucccuaaagagcagcugaccgaggaagcucgggagggcaucaagcagcuccugaagcaaggguccguccagaaaguguacaauggacuucagggcuauuga

SEQ ID NO: 68440 - RNA, 951 nt, Artificial Sequence
  derived and/or modified sequence opt5 from DNAJB13__Homo_sapiens__NP_705842
augggccaggacuacuauagcgugcuggggaucaccagaaacuccgaggaugcccaaauuaagcaggcuuaccggcgccucgcccugaaacaccauccccuuaagucuaaugaaccuagcuccgcggagaucuucagacagauugcugaagccuaugacguccugucugauccgaugaaacggggaaucuacgacaaguuuggcgaggaagggcucaaaggaggcauuccccuggaguucgggagccagacaccuuggacgaccggauauguuuuucacggcaagcccgagaagguguuccaugaauuuuucggcgggaacaauccuuuuuccgaguucuuugaugccgaaggaucugagguggaccuuaacuucggcgggcugcaaggacgcggcgucaaaaagcaggauccccagguggagagagaccucuaccugagccuggaagaucucuuuuucgggugcaccaaaaagaucaaaaucucccggcgcguucugaaugaggacggauauagcucuacaauuaaggauaagauccuuacaauugacgugaaaccuggcuggagacagggcacccggaucacauuugaaaaggagggggaucaaggaccgaacauuauccccgcugacauuaucuucaucgucaaagaaaagcugcacccucgcuucagacgggagaaugacaaccucuuuuucgugaaucccauuccucugggcaaagcccuuaccuguugcacgguugaggugcgcacccuggaugacagacuccugaacauccccauuaaugauaucauucauccgaaguacuuuaaaaaggucccuggggaaggaaugccccugccugaggaccccacaaagaaaggcgaucucuucaucuuuuucgacauccaguuucccacccggcugacaccucagaagaaacagaugcuucgccaagcucugcucaccuga

SEQ ID NO: 68441 - RNA, 723 nt, Artificial Sequence
  derived and/or modified sequence opt5 from DNAJB1__Homo_sapiens__NP_001287843
auguucgccgaguuuuucggcgggagaaaccccuuugacaccuucuuuggacagcggaauggcgaagaggggauggauaucgacgauccuuucagcggauuuccgaugggcaugggaggguucacaaacgugaauuuuggccgcuccagaucugcucaagaacccgcccggaagaaacaggacccucccgucacgcacgaucugcgcguuagccucgaggaaauuuacuccggcugcaccaagaaaaugaagaucucucauaaaagacugaacccugacggaaagagcauucggaaugaggauaagauccuuacaauugaggugaaaaagggguggaaagaaggcaccaagaucacauuccccaaagagggggaccagaccuccaacaauaucccugcggauauuguguuuguccugaaggacaagccgcacaacaucuucaaacgcgauggaucugacgugauuuaucccgcuagaaucagccuccgggaagcccuguguggcugcacaguuaaugugccuacccuugaugggcgcacgauucccgucguguuuaaggacguuaucagaccuggaaugcggcgcaaagugcccggcgagggccugccgcucccuaagacccccgagaaaagaggggaccugauuaucgaguucgaagucaucuucccugaacggauuccccagacaucccgcaccgugcuggagcaagugcuccccaucuga

SEQ ID NO: 68442 - RNA, 834 nt, Artificial Sequence
  derived and/or modified sequence opt5 from DNAJB2__Homo_sapiens__NP_001034639
auggccagcuacuaugagauccuggacgugcccagauccgcuucugccgaugacauuaagaaagcguaccggcgcaaggcucuccaguggcacccugauaaaaacccggacaauaaggaauuugccgagaaaaaguuuaaggaagucgccgaggcuuaugaaguucugagcgauaaacauaagagagagaucuacgaccgguauggccgcgaggggcuuacaggaacaggcacggggcccuccagagccgaagcuggaucuggcgggccuggauucaccuuuacauuccggagccccgaggaaguguuucgcgaguucuuuggcuccggcgauccuuucgccgagcuguuugacgaucucgggcccuucucugaacugcaaaacagaggaagccggcacuccggcccuuucuucaccuuuucuagcuccuucccggggcauagcgacuucucuuccagcucuuuuuccuucagccccggagcgggcgccuuucgcuccgugucuacaagcaccacauucguccaggggagacggauuaccacgcgcagaaucauggagaauggacaggaacggguggagguugaagaggauggccagcuuaaauccgugaccauuaacggcgucccugacgaucuggcucucgggcuggagcugagccgcagagaacaacagcccucugugacaucccggagcggaggcacccagguucagcaaaccccugccucuugcccccucgacagcgaccuguccgaggaugaagaccuucagcuggcuauggccuacucucucagcgagauggaagcggccgggaagaaaccggcugauguguuuuga

SEQ ID NO: 68443 - RNA, 1389 nt, Artificial Sequence
  derived and/or modified sequence opt5 from DNAJB5__Homo_sapiens__NP_001128476
augggcggggccgaggcugaacccugggggagagccccuggcccggcgaucgggggacggcgcgcuggcgacagcugccccggguggagacggcgcuccagaucucggggacgcggccagagacugagccacggcccucggcgcagaccccaacuccugaccgccgccccuccccuucaggcucggggagccuuccgcuccuuuccucacucuuggggagaggauuuccuggcuagccucauguuuaagauucagcuggaaccgcuuaaacugagagccuggacacucaacggcuucgugaaguuucggaauaaagagacguccgcggggcccgucgccguuaugggaaaggacuacuauaaaauccugggcauuccuucuggggcuaacgaagaugagaucaagaaggccuaccgcaaaauggcucugaaguaucaccccgacaaaaauaaggagccuaacgccgaagagaaauucaaggaaauugcggaggccuacgaugugcucagcgaccccaagaaaagaggacuguaugaucaguacggcgaggaaggccuuaagaccgggggaggcacauccgggggaagcucuggcuccuuucauuauaccuuccacggggacccgcaugcuacauuugccagcuucuuuggaggcucuaauccuuucgauaucuuuuucgcuuccagccggucuaccagacccuucuccggcuuugacccugaugacauggauguggacgaggacgaagaucccuucggggccuuuggacgcuucggcuuuaacgggcugagccggggacccagacgcgccccugagccgcucuacccccggagaaaaguccaagacccucccgugguucacgaacugcgcgugucccuugaggagaucuaccacggcucuacaaagcggaugaaaauuaccagacgccggcugaauccugaugggagaacgguccgcaccgaagacaagauccuccauauugugaucaaacggggcuggaaggagggaacaaagauuaccuuccccaaagaaggcgaugcuacaccggacaacaucccugcggauauuguuuuugugcugaaggacaaaccccacgcccauuucagacgggaugggaccaauguccuguauagcgcucucaucucccugaaggaggcccuuuguggaugcacggugaacaucccuacaauugacggccgcgugaucccccugccuuguaaugaugucauuaaacccgggaccguuaagagacuccggggagaaggccugccguuuccuaaggugcccacacagagaggggaccuuaucguggaguucaaaguccgcuuucccgaccggcugaccccucagaccagacagauucucaagcaacaucugccgugcagcuga

SEQ ID NO: 68444 - RNA, 726 nt, Artificial Sequence
  derived and/or modified sequence opt5 from DNAJB6__Homo_sapiens__NP_005485
augguggacuacuaugagguccugggcguucagagacacgccagccccgaagauaucaagaaggcuuaccggaaacucgcccugaaauggcauccugacaagaacccggagaauaaagaagaggcggaacgcaaguucaagcaaguggcugaggccuaugaggugcuuuccgaugccaaaaagagagacauuuacgauaaauaugggaaggaaggacugaacggcgggggaggcgggggaucucacuuugacagccccuucgaguuuggcuucaccuuucggaauccugaugacgucuuccgcgaauuuuucggcgggagagaucccuuuuccuucgacuuuuucgaggauccuuuugaggacuucuucggaaaccggcgcggccccagagggucucggagccgcggaacaggcuccuuuuucucugcuuuuagcggguucccuuccuuuggaagcggcuucucuuccuuugauacgggcuucaccagcuuugggucucucggacauggcgggcugacauccuucagcucuaccuccuuuggaggcagcgggaugggaaauuucaaauccaucucuacaagcaccaagauggugaacggcagaaagauuacaaccaaacggaucguugaaaauggccaggagcgcguggaagucgaggaagacgggcagcuuaagucccugacgauuaacggaaaagagcagcuccugagacuggacaauaaguga

SEQ ID NO: 68445 - RNA, 930 nt, Artificial Sequence
  derived and/or modified sequence opt5 from DNAJB7__Homo_sapiens__NP_660157
augguggacuacuaugagguccugggccuccagagauacgccagccccgaagauaucaagaaggcuuaucacaaaguugcccugaaauggcauccugacaagaacccggagaauaaagaagaggcggaacggaaguucaaggagguggcugaggccuacgaagugcuuuccaacgaugagaaacgcgacauuuaugauaaguacgggaccgaaggacugaauggcgggggaucucacuuugacgaugagugcgaguauggcuucacauuucauaaacccgacgaugucuucaaggaaaucuuucacgagagagacccuuucagcuuucauuucuuugaagauucccucgaggaccugcuuaaccggcccgggucuagcuacggaaaucgcaacagagaugccggcuacuucuuuuccacggcuucugaauauccuauuuucgagaaauuuagcuccuacgacaccggcuauacaagccaagggucucugggacacgagggccucaccuccuucagcucucuggccuucgacaauuccgggauggauaacuacaucagcgugacaaccucugacaagauuguuaauggacggaacaucaauacaaagaaaaucauugaauccgaucaggagcgcgaagcugaggacaacggcgaacugaccuuuuuccucgugaauagcgucgccaacgaggagggguuugcgaaggaauguuccuggagaacgcagucuuucaauaacuauagccccaacucccacagcucuaaacaugugucccaguacaccuuuguugauaaugacgagggaggcaucagcugggugacaucuaaccgggauccuccgauuuucagcgccggcgucaaggaagggggaaaacgcaagaaaaagaagagaaaagaggugcaaaagaaauccaccaagcggaauugcuga

SEQ ID NO: 68446 - RNA, 699 nt, Artificial Sequence
  derived and/or modified sequence opt5 from DNAJB8__Homo_sapiens__NP_699161
auggccaacuacuaugaggugcugggcguccaggcuagcgccucccccgaagacaucaagaaagcguacagaaagcucgcucugcgguggcacccugauaaaaauccggacaacaaggaggaagccgagaaaaaguucaaacuuguuucugaagccuaugaggugcugagcgauuccaagaagcgcucucucuacgacagagcugggugcgauagcuggcgggccggaggcggggcuuccacccccuaucauucuccuuuugacacaggauacacguuccgcaaucccgaggauauuuuuagagaauuuuucggcgggcuggacccuuucagcuuugaguucugggauucccccuuuaacagcgaccggggaggccgcggccacgggcuuagaggagccuucucugcgggcuuuggggaauuuccugccuucauggaggcuuucuccagcuucaauaugcugggauguucuggcgggucccauaccacauuuagcucuaccuccuucggaggcagcuccucuggcagcuccggguuuaaaagcgugaugucuuccacagagaugaucaacggacacaaggucaccacaaaacggauuguggaaaauggccaagagcgcguugaaguggaggaagaugggcagcucaagagcgucaccgugaacggaaaggagcagcugaaauggauggacucuaaguga

SEQ ID NO: 68447 - RNA, 672 nt, Artificial Sequence
  derived and/or modified sequence opt5 from DNAJB9__Homo_sapiens__NP_036460
auggccacaccccagagcaucuucauuuuugcuaucugcauucugaugaucaccgagcucauucuggccuccaagucuuacuaugacauccuuggcgugccuaaaagcgcguccgaaagacaaaucaagaaggcuuuccacaaacuggccaugaaauaccauccggauaagaacaagucucccgacgccgaggcuaaauuucgggaaauugccgaggcuuaugaaacgcucagcgaugccaaucgcagaaaggaguacgacacccuggggcacuccgcguucacaucuggaaaaggccagcgggggagcggauccagcuuugagcagucuuucaacuuuaauuucgaugaccuuuuuaaggauuucggcuuuuucgggcagaaccaaaauaccggauccaaaaagcgcuuugaaaaccauuuccagacaagacaggacggcggcagcucucggcagcgccaccauuuccaagaguuuuccuucgggggaggccuguuugaugacauguucgaagauauggagaagauguuuagcuucucuggguuugacuccaccaaucagcacacaguccagaccgagaacagauuccacggaagcuccaaacauugucggacgguuacccagcgcagaggcaauauggugacaaccuauacagauugcucugggcaauga

SEQ ID NO: 68448 - RNA, 2244 nt, Artificial Sequence
  derived and/or modified sequence opt5 from DNAJC10__Homo_sapiens__NP_001258510
augggcguguggcugaacaaggacgauuacaucagagaccucaaacggauuauccugugcuuccuuauugucuauauggccauccugguugggaccgaucaggacuuuuacagccuccugggaguguccaagacagcuucuagccgcgagauuagacaagccuucaaaaagcucgcgcugaaacuccaccccgauaagaauccuaacaauccgaacgcucauggcgacuuucugaagaucaaucgggccuaugaagugcugaaagaugaggaccuccgcaagaaauacgauaaguauggggaaaaaggacuggaggacaaccagggcgggcaguacgaauccuggaauuauuacagauacgauuucggaaucuaugacgaugaccccgagauuaucacgcuugagcggcgcgaauuugacgccgcugucaacucuggcgagcugugguucgugaauuuuuacagcccuggcuguucccacugccaugaucucgcccccaccuggagagacuucgcuaaggaaguugaugggcugcuucggauuggagccgugaacuguggcgacgaucgcaugcugugcagaaugaagggggucaauucuuauccuagccucuuuaucuuccgguccggaauggcgcccgugaaauaccacggcgaccgcagcaaggagucucugguuuccuuugccaugcagcaugugagaagcacagucaccgagcuguggacagggaacuucgucaauucuauucaaaccgcuuuugccgcuggaaucggcuggcucauuacauucuguuccaaaggcggggauugccugaccagccagacgcggcuucgccugucuggaaugcuuuuccugaacucccuugacgccaaggaaaucuaucuggaggugauccacaaucucccugauuuugaacugcugagcgcgaacacccucgaggacagacuggcccaccaucgguggcuucuguucuuucacuucggcaaaaacgaaaauuccaacgauccggagcucaagaaacugaagacacuucugaagaaugaccauauucagguggggagauuugacuguucuagcgcucccgauaucugcuccaaccucuacguuuuccagccuagccuggccguguuuaaaggacaaggcaccaaggaguaugaaauucaccacgggaaaaagauccuguacgacauucucgcuuucgccaaagagucugucaauucccaugugacaacccugggaccccagaacuuuccugccaaugauaaggaacccuggcuuguggacuucuuugcuccgugguguccucccugccgcgcgcugcucccugagcugcggagagccagcaaccugcuuuacggccagcucaaguucggcacgcuggauuguacaguucacgaagggcugugcaauauguauaacauccaggcuuaccccaccacaguggucuuuaaucaaucuaacauccaugaguaugagggacaccauagcgccgaacagauucucgaguucaucgaagaccugaugaaucccuccgugguuucucuuaccccuaccacauucaacgagcuggugacgcagcgcaaacacaaugaagucuggaugguggauuuuuacagcccguggugccaccccugucaaguccucaugccugaguggaagcggauggccagaacccugacaggccugauuaacgugggguccaucgacugccagcaguaucauagcuucugugcucaggagaacguucaacgcuaccccgaaauucgguuuuucccucccaaaucuaauaaggccuaucacuaccauuccuacaacggauggaauagagaugcguauagccuucgcaucuggggccucggguuucugccucaggugucuaccgaccugacaccgcagaccuucuccgagaaaguccuccagggcaagaaccacugggugaucgauuuuuacgcucccuggugcggaccuugucaaaauuucgcccccgaauuugagcugcuugcccggaugauuaagggcaaaguuaaggcugggaaaguggacugccaggccuaugcucagacgugucagaaggccggaaucagagcguacccuacagucaaauucuauuuuuacgagcgcgccaagcggaacuuccaagaggaacagauuaauaccagagaugcuaaggccaucgcugcccugauuagcgaaaaacucgagacccugcggaaccagggcaagcgcaauaaagacgaacuguga

SEQ ID NO: 68449 - RNA, 597 nt, Artificial Sequence
  derived and/or modified sequence opt5 from DNAJC12__Homo_sapiens__NP_068572
auggacgccauccugaacuacagaagcgaggauaccgaagacuauuacacacuccugggcugcgaugagcuuuccucuguggaacagauucuggcugaguucaagguccgggcccucgaaugucaccccgacaaacauccugagaauccgaaggcgguugagacguuucaaaaacugcagaaggcuaaagaaauccuuaccaacgaggaaagccgcgccagauaugaucacuggcggcgcucccagaugucuaugcccuuccagcaaugggaggcccugaaugacagcgugaagacauccaugcauuggguggucagagggaagaaagaucucaugcuggaggaaucugacaagacccacacaaccaaaauggagaacgaagagugcaaugaacagcgggagcgcaagaaagaggaacuggcuagcacagccgagaagaccgaacagaaggagccuaaaccccucgaaaaguccgugagcccucagaacucugauuccagcggauuugcugacguuaauggcuggcaucugagauuccgguggucuaaagaugcccccuccgagcuucugcgcaaguuuagaaacuacgagauuuga

SEQ ID NO: 68450 - RNA, 6732 nt, Artificial Sequence
  derived and/or modified sequence opt5 from DNAJC13__Homo_sapiens__NP_056083
augaacaucauucgggagaauaaggaccuggccugcuucuacaccacaaagcacagcuggcggggcaaguauaagcgcguguuuuccgucgggacgcacgcuaucaccacauacaaccccaauacccucgaaguuacaaaccaguggccuuauggggauauuuguucuaucagccccgugggcaaggggcaaggaaccgaguucaaucugacauuuagaaaaggcuccgggaagaagucugaaacccuuaaauucagcacggagcaccggaccgaacugcucacagaggcccugcgcuuuagaaccgacuucuccgagggaaagauuacaggccggcgcuacaacugcuauaaacaucacuggucugauagcagaaagcccgugauccuugaagucaccccuggcggguuugaccagaucaaucccgcgacgaaccgggugcuguguuccuacgauuaucgcaauauugagggauucguugaccucagcgauuaccagggcggguuuugcauccuguacggaggcuucucuagacugcaucucuuugcuuccgaacagcgggaggagauuaucaaaagcgccauugaccacgccgggaacuauaucggaauuucucugcgcaucagaaaggaaccucuugaguucgaacaauaccugaaucuccgguuuggcaaguauuccacagaugagagcaucaccucucuggcugaguucgugguccagaaaauuagccccagacacagcgagccugugaagagaguucuugcccugacagagaccugucucguggaacgggacccggcuaccuacaacaucgccacacugaaaccccugggcgaggucuucgcgcucgugugcgauuccgaaaauccucagcuguuuacgauugaguucaucaagggacaggugagaaaauauucuagcaccgaacgcgacucccuucuggccagccuccuggauggaguccgggcuucuggcaacagagacguuugugugaagaugacacccacccauaaagggcaacgcuggggacuucuguccaugccuguggacgaggaggucgaaagccuccaucugcgguuucuggccacacccccgaauggcaacuucgcugaugccguguuuagauucaacgcgaauauuucuuacagcgggguucuccaugccgugacccaggacggacuguuuuccgagaacaaggaaaaacuuaucaauaacgcuaucacggcccugcucucucaggagggcgaugucguggcuagcaaugccgaacuggagucccaguuccaagccguucgccggcuuguggcuagcaaagcgggcuuucuggccuucacacagcucccuaaguuuagagagcgccugggggucaaaguggucaaggcucugaaacggucuaacaauggaauuauccacgccgccguggacaugcucugcgcucugaugugucccaugcacgaugacuaugaucuuagacaggaacaacugaacaaggccucccuccugagcucuaagaaauuccuggagaaucuucucgaaaaguuuaacucccauguugaccacggcaccggggcgcuggugauuagcucccugcucgauuuccugaccuucgcucuuugcgccccuuacucugagacaaccgagggacagcaguuugacaugcugcucgaaauggucgccagcaauggccgcacacuguucaaacuguuucagcaucccuccauggcuaucauuaagggggccggccuugugaugaaagcuaucaucgaggaaggagauaaggagauugccacgaagaugcaagaacucgcgcugucugagggcgcccugccccggcaccuccauaccgcuauguucacaaucagcuccgaccagagaaugcugaccaaccggcagcuuagccgccaccugguugggcucuggacagccgacaaugcuaccgccacgaaccugcugaaacgcauucuuccuccgggacuccuggcguaccuggagucuuccgaucucgugcccgaaaaggacgccgaucggaugcacgucagagacaaugugaaaaucgcuauggaucaguauggcaaguuuaacaaagugccugaguggcaacgccuggccgggaaggcugccaaggaaguugagaaauucgccaaggaaaaagucgaccuugugcugaugcauuggcgggauagaaugggaauugcucagaaggagaacaucaaucagaaacccgugguccuccgcaagagacggcagcgcauuaaaaucgaggcgaacugggaccuguuuuacuauagauucggccaagaucacgcccggagcaaucugaucuggaacuuuaagacccgcgaagaacuuaaggacacacucgaaucugagaugagagcuuucaauauugaucgggaacugggguccgccaacgugaucagcuggaaucaucacgaguuugagguuaaauacgaaugucuggccgaggaaauuaagaucggcgacuauuaccuccgccugcuucuggaggaggaugaaaacgaggaaucuggaagcauuaaaagauccuaugaguucuuuaaugaacucuaccaccgguuccugcugaccccuaaggugaacaugaaaugccuuugccugcaggcucucgccaucgucuacggccgcugucaugaggagaucgggcccuucacagacaccagauauauuaucggaaugcuggaacggugcacggacaagcucgagagagaucgccugauucuuuuucugaauaagcucauccugaacaaaaagaaugugaaagaccugauggauagcaacggcauucggauccuuguugaccugcucacacuggcgcaccuccaugugucuagagcuaccgucccgcugcaguccaaugugaucgaagccgccccugauaugaagcgcgagagcgaaaaagagugguacuucgggaacgcugacaaggagcgguccggacccuauggcuuucacgaaaugcaggagcuuuggacaaaggggaugcugaacgccaaaaccagauguugggcgcaaggcauggauggauggcgcccucuccagucuauuccccagcugaaguggugccugcuugcuagcggccaagccguucugaaugaaaccgaccucgccacacugauccucaacaugcugauuacgauguguggguacuucccuucccgggaucaggacaaugcuaucauuagaccccuuccgaaagugaagcgccugcugucugauucuaccugccucccucauaucauccagcugcuucugacauuugaccccauucucgucgagaaaguggccauccugcucuaucacauuaugcaggauaacccccaacugccucggcuuuaccuguccggaguguucuuuuucaucaugauguauaccggcuccaauguccugccgguugcuagauuucucaaguacacacacaccaagcaggccuucaaaagcgaagagacgaaggggcaggacauuuuucagcgguccauccugggacauauucuucccgaggcgaugguguguuaccuggaaaacuaugagccugaaaaauucagcgagaucuuccucggcgaguuugacacacccgaagccaucuggucuuccgagaugcgcagacugaugauugaaaagaucgcugcccaccucgcugauuucaccccucggcugcaaagcaauacccgcgcccuuuaccaguauugccccauuccuaucauuaacuacccccagcuggagaaugaacuguuuuguaacaucuauuaccucaaacagcugugcgacacacuuagauucccggauuggccuaucaaggaccccgugaaacugcucaaggauacccuggacgccuggaagaaagaggucgagaagaaaccucccaugaugucuauugaugacgcuuaugaagugcucaaucugccgcaagggcagggcccucaugaugaguccaagauccggaaagcguacuuuagacuugcccagaaguaccaccccgacaagaacccugaaggacgcgauauguucgagaaaguuaauaaggcuuaugaauuucuguguacaaaaagcgccaagauuguggacggccccgaccccgagaacaucauucugauccucaaaacgcaaucuauccuguucaaucggcauaaggaggaucuucagccuuacaaguaugccggguacccgaugcugauuagaaccaucacaauggaaaccuccgacgaucuccuguuuagcaaagagagcccccugcucccugcugccacagaacuugcguuccacaccgucaacugcagcgcucugaacgccgaggaacugcgccgggagaauggacucgaggugcugcaggaagccuuuucuagaugcguugcugugcuuacgcgcgccagcaagcccuccgacaugucuguccagguguguggcuauauuagcaaaugcuacuccguugcggcucaauucgaggaaugucgggagaagaucaccgagaugccuucuauuaucaaagaucugugcagagugcucuauuuugggaaguccauuccccgcgucgccgcccugggaguggaauguguguccucuuucgcugucgacuucuggcugcagacacaccucuuucaggccggcauccuuugguaccugcugggcuuccucuuuaacuacgauuauacccuggaggaaagcgggauccagaaguccgaggaaacaaaucaacaggagguugcuaacagccuugccaaacugucugugcaugcgcucuccagacugggaggcuaccuggccgaggaacaggcuaccccugagaauccgacaauuagaaagagccucgccgggaugcuuacccccuauguggcucgcaaacuggccgucgccucugugacggaaauccugaagaugcucaacuccaauacagagagcccuuaccugauuuggaacaauuccaccagagcugaacuucuggaguuccucgagucucagcaagaaaacaugaucaaaaagggagacugcgauaagaccuauggcagcgaguuuguuuacuccgaccacgcgaaagaacugauugugggggagaucuucguccggguguauaaugaaguucccacauuucagcuggaggugccuaaggccuucgcugccagccuccuugauuacaucggaucucaggcccaguaccugcauaccuuuauggcuauuacgcacgccgcgaaagucgaguccgaacaacacggcgaccgccugcccagaguggagauggcucucgaagcccugcggaacgucaucaaguauaauccgggcagcgagucugaguguauugggcauuucaaacuuaucuuuagccugcucagagugcacggagccggccagguucagcaacuggcucuggaaguggucaacauugugacauccaaucaggauugcguuaacaauaucgccgagucuauggugcucagcucccuucuggcgcugcuccauucucugccuagcucccgccagcuuguccuggaaacccucuacgcccugacaagcucuaccaagaucauuaaagaggcuauggccaagggggcucugaucuaucuccuugacauguucuguaacuccacacacccccaggugcgggcccaaaccgcugaacuguuugccaagaugacggcggacaaacugauuggacccaaggugagaaucacccucaugaaauuccugccuagcguuuucauggaugccaugcgcgacaaccccgaggcugccguccauauuuuugagggcacacacgaaaauccugagcuuaucuggaacgauaauucccgggacaaggugucuaccacagugagagaaaugaugcuggagcacuucaaaaaccagcaggauaauccggaagcuaacuggaagcuccccgaggacuuugccgucguguucggggaggccgaaggagagcuggcuguuggcggcguguuucugcggauuuucaucgcgcagccugccuggguccuccgcaagcccagagaauuucuuaucgcucugcuggagaaacucaccgaacugcuugagaagaauaacccucauggggagacgcuggaaacacucaccauggccacagugugccuguucagcgcccaaccccagcuggcugaucagguuccgccucucggacaccuucccaaagugauucaggccaugaaucaucggaacaaugcgaucccuaaguccgccauucgcgucauccacgcucugucugagaacgaacugugugugagagccauggcuagccucgagaccauuggcccccugaugaaugggaugaaaaagcgggccgacaccguuggacuugcgugcgaggccaucaaccgcauguuucaaaaggaacaguccgagcugguggcucaggcccucaaagcugaucuggucccuuaccugcucaaacuucuggaaggcaucgggcuggagaaucucgacagccccgccgcuacaaaagcccaaauugugaaggcgcugaaagccaugacgagaucucuucaguauggagaacaggugaacgagauccugugccgguccagcgucuggucugcuuucaaggaucagaagcacgaccucuuuauuuccgagagccaaaccgccggcuaccugacaggcccggggguugcuggauaucugaccgccggcacaucuaccagcgugauguccaaccucccuccgcccguggaucaugaagccggggaccugggauaccagacguga

SEQ ID NO: 68451 - RNA, 2109 nt, Artificial Sequence
  derived and/or modified sequence opt5 from DNAJC14__Homo_sapiens__NP_115740
auggcccagaagcaccccggcgagagagggcuguacggagcucaucacagcggcggggccucccuccggacccugggaccuucuguggacccggaaauccccagcuucuccggccuucgcgauucugcggggacagcuccuaacggaacgagaugccugaccgagcauagcggccccaaacacacacaacauccuaaucccgcccacuggcucgacccuucccacggcccgcccgggggaccugggcccccucgggaugccgaagaccccgaucagucugagaccagcuccgaagaggagagcggggucgaccaggaacugucuaaggagaacgaaacaggaaaucagaaagauggcaacuccuuucuuagcauuccgucugcuuguaauugccaagggaccccuggaauccccgagggcccuuauuccgagggcgggaacggaucuagcuccaauuucugucaucacugcacaagccccgcccugggcgaagacgagcucgaagaggaauacgaugacgaggagucccugaaguuucccucugauuucagccgcguuuccagcgggaaaaagccuccgucuagacggcagcgccauagauuucccaccaaggaagacacgcgggagggaggccgcagagauccucggucccccgggcgccacagacugggacggaaacgcagccaggcugacaagagaaaaggccucggccuguggggcgccgaggaacuuugucagcugggacaagcgggcuucugguggcucauugaacugcuugugcuggugggggaguaugucgagaccugcggacaccucaucuacgccugucggcagcugaagucuagcgaccuggaucucuuuagaguguggaugggcguuuggacagggcgccugggcggaugggcucaggugauguuccaguuucuuucccaaggcuucuauugcggggucggacuguuuacccgguuccucaaacugcuuggcgcccugcuccugcuggcucucgcccuguuucuuggguuccugcagcucggauggagauuccuggugggccuuggggaccgccugggcuggcgggauaaggcgacauggcucuuuucuuggcuggacagcccugcccugcagagaugucucacccugcuucgcgauucccggcccuggcaaagacugguucgcauugugcaguggggauggcucgaacugccgugggucaagcagaacaucaaucggcagggcaacgcuccuguggccagcgggagauacugccaacccgaggaagagguggcucgccugcuuacgauggccggagucccugaagacgagcucaaucccuuccauguucugggcguggaggccacagcuucugauguggaacugaaaaaggcguaucggcagcucgccgucauggugcacccugacaaaaaccaucaccccagagcugaggaagccuuuaagguucugcgggccgcuugggauaucguguccaaugccgagaaacgcaaggaguacgaaaugaaaagaauggcggagaacgaacuuagccggucugucaaugaguuccuguccaagcuccaggacgaucugaaggaagcuaugaacaccaugauguguagcagaugccaggggaaacaucgccgguuugagauggacagagagccgaaguccgcccgcuacugcgccgaauguaacagacugcacccugcugaggaaggagacuucugggccgagucuagcaugcuuggccucaaaauuacauauuuugcucugauggaugggaagguguacgacaucaccgaaugggccggcugccaacggguuggaauuucccccgauacccaccgcgugcccuaucauaucucuuucggcagccggauuccugggacaagaggacgccagagagcgacgccggacgcucccccugccgaucugcaggacuuucucucccggaucuuccaggugcccccuggccaaaugcccaaugggaacuuuuucgccgcuccucagcccgccccgggagcggccgcugccagcaaaccuaauucuaccguccccaagggcgaggcuaagccuaaacgcagaaagaaaguccggcgccccuuucagagauga

SEQ ID NO: 68452 - RNA, 453 nt, Artificial Sequence
  derived and/or modified sequence opt5 from DNAJC15__Homo_sapiens__NP_037370
auggccgcuagaggcgugaucgcccccgucggggagagccugcgguacgcggaauaucuccagccuuccgcuaagcgcccggacgccgauguugaccaacagagacuggugcggucucuuauugccgugggacugggcgucgcugcccucgcuuucgccgggcgcuacgcguuuagaaucuggaaaccccuggaacaggugauuaccgagacagccaagaaaaucagcacgccuuccuucucuagcuauuacaagggaggcuuugagcagaaaaugucccggcgcgaagcugggcuuauucugggaguuucucccagcgccggcaaggcuaagaucagaaccgcccaccggcgcgugaugauccucaaccauccugauaaaggcgggucccccuaugucgcggccaagauuaaugaggcuaaagaccugcuggagacaaccacaaagcacuga

SEQ ID NO: 68453 - RNA, 1077 nt, Artificial Sequence
  derived and/or modified sequence opt5 from DNAJC18__Homo_sapiens__NP_689899
auggccgcuacccugggcagcggggagagauggacagaagccuacaucgacgcggugcggcgcaacaaguaucccgaggauacgccuccggaaucccacgaccccugcggauguugcaauuguaugaaagcucagaaggagaaaaagucugaaaacgaguggacccaaacaagacagggcgaggggaauagcaccuacuccgaggaacagcuccugggaguccagcggauuaaaaagugccgcaacuauuacgaaauccuuggcguuucuagagaugccagcgacgaggagcugaagaaagccuaucggaagcucgcucugaaauuccauccugauaagaauugugcccccggggcuacagacgccuuuaaagcgauuggaaacgccuucgcugugcuuuccaauccugauaagcgccugagauacgacgaauauggcgaugagcaagugaccuuuacagcuccccgggcccgcccuuacaacuacuauagagacuucgaagccgauaucaccccggaggaacucuuuaaugucuucuuuggcgggcacuuccccacgggaaacauucauauguuuucuaaugugaccgacgauacauacuauuaccggcgcagacaccggcaugagcgcacccagacacagaaggaggaagaggaagagaaaccucagaccacguauagcgcguucauccaacugcugcccguucucgugaucgucauuaucuccgugauuacacagcugcuugccaccaacccucccuacagccuguuuuauaagucuacacucggcuacaccaucuccagagaaacccagaaucugcagguuccguacuucguggacaaaaacuuugacaaggcuuauagaggggccagccuucacgaucuggagaaaacaauugagaaggacuacaucgauuauauucaaacgucuugcuggaaagaaaagcagcagaaguccgagcucaccaaucuggcuggacuguaccgggacgaacgccucaaacaaaaggccgagagccugaaacuugaaaacugugagaagcugucuaaacucaucggccugcggagagggggauga

SEQ ID NO: 68454 - RNA, 351 nt, Artificial Sequence
  derived and/or modified sequence opt5 from DNAJC19__Homo_sapiens__NP_660304
auggccagcaccguggucgcuguuggccugacaaucgccgcggcuggguucgccggaagauacgugcuccaggccaugaagcacauggagccccaagugaaacaggucuuucagucccugccuaagucugcuuucagcggcggguauuaccggggaggcuuugaaccgaaaaugacgaagcgcgaggccgcucuuauucugggggugucccccaccgccaacaaaggaaagaucagagacgcgcaucggcgcauuaugcuccugaaucacccugauaagggcggcucucccuauaucgccgcuaaaauuaacgaagccaaggaccuucuggaggggcaggcuaaaaaguga

SEQ ID NO: 68455 - RNA, 1665 nt, Artificial Sequence
  derived and/or modified sequence opt5 from DNAJC1__Homo_sapiens__NP_071760
augaccgcccccugcagccagccugcucaacugccgggcagacggcagcucgggcuggugcccuucccucccccucccccucgcacaccgcuucuguggcuccugcuucugcuccuggccgcggucgcucccgccagaggaugggaguccggcgaccuggaacucuuugaucugguugaggaagugcagcuuaacuucuaccaguuucugggggugcaacaggacgccucuagcgcugauauccggaaggccuaucgcaaacucucccugacgcuucacccugacaagaauaaagaugagaacgcugaaacccaguucagacagcuggucgccauuuacgaggugcucaaggacgaugagcggcgccaaagauaugacgauauccugauuaauggacugcccgacuggcggcagccuguguuuuacuaucgcagaguucggaaaaugucuaacgcggaacucgcccugcuucuguucaucauucucacagucggccauuacgcugugguuuggagcaucuaucuggagaagcagcuugaugaacugcucucccgcaagaaaagagagaagaaaaagaaaaccgggucuaagagcguggacgucuccaagcugggagccagcgagaaaaaugaacggcugcucaugaagccccaguggcacgaucugcuuccguguaaacugggcaucugguuuugccucacacugaaggcccuuccucaucugauucaagacgcuggccaguucuacgcgaaauacaaggagacccgccucaaagaaaaggaggacgcccugacaagaaccgaacuggagacgcuccagaagcaaaagaaggugaaaaagcccaaaccugaguuucccguguauacaccccuggaaaccaccuacauccagucuuaugaucacgggacauccauugaggaaaucgaggaacagauggacgauuggcuugagaaccggaauagaacccagaagaagcaagcuccugaguggacggaagaggaccugagccagcucacacgcucuauggucaaauucccgggaggcacccccgggcggugggaaaagauugcccaugagcugggaagauccguuacagaugugaccaccaaagcuaagcagcugaaagacagcgugacauguucuccuggcaugguccgccuuuccgaacucaagagcacggugcagaacucccggcccaucaagaccgccacaacccugccugaugacaugauuacacaaagagaggaugccgaggggguugcugcggaagaggaacaggagggagacucuggcgagcaggaaaccggcgccacggaugcucgcccccggagacgcaaaccggcccggcugcucgaggccacagcuaagccugaacccgaggagaaaagcagagccaagcgccagaaagacuuugacaucgcggaacaaaaugaguccagcgaugaagagucucugcggaaggaaagagcucgguccgccgaggaaccuuggacccagaaccagcagaaacuucuggagcucgcccugcaacaguacccccgcgggagcucugacagaugggauaaaaucgcucggugcgugccuagcaaguccaaagaggacuguauugccagauauaagcugcuugucgaacucgugcagaaaaagaaacaagcuaagucuuga

SEQ ID NO: 68456 - RNA, 822 nt, Artificial Sequence
  derived and/or modified sequence opt5 from DNAJC27__Homo_sapiens__NP_057628
auggaggccaacaugcccaagagaaaagaaccuggccggagccugcgcaucaaggugauuuccauggggaaugcugaggucggaaaaucuugcaucauuaagagauacugugaaaaacgguucguuagcaaguaucucgccaccaucggcauugacuacggggugacaaaggugcacguccgcgauagagagaucaaagugaacaucuuugacauggcgggacauccguucuuuuaugaaguucggaaugaguucuacaaggauacgcagggcgugauucuggucuaugacguggggcaaaaagauuccuuugacgcucuugaugccuggcuggccgagaugaagcaggaacucggaccccacggcaacauggagaauaucauuuucguugugugcgcuaacaaaaucgacuguaccaagcaucgcugcgucgaugaaucugagggcagacugugggccgagagcaagggguuucuuuacuucgaaacauccgcucagaccggagagggcauuaaugaaauguuucagacauucuauaucucuauuguggaccugugugagaacgggggaaaacggccuaccacaaauagcuccgccagcuuuaccaaggaacaagcggaugccauccgcagaauccggaacucuaaagacuccugggauaugcucggcgugaagcccggggcuagccgcgacgaggucaauaaagccuacagaaagcuggcuguucugcuccacccugacaaaugcguggcccccggaucugaggaugcguucaaggccguggucaacgcucggacggcccugcuuaagaauauuaaauga

SEQ ID NO: 68457 - RNA, 1167 nt, Artificial Sequence
  derived and/or modified sequence opt5 from DNAJC28__Homo_sapiens__NP_060303
augaacaccauguacgugaugauggcccagauccugagaagccaccucauuaaggcuacagucauccccaaucggguuaaaaugcugccuuauuucggcauuauccgcaacagaaugauguccacgcauaagucuaaaaagaaaauucgggaguacuaucgccuucugaauguggaagaggggugcagcgccgacgaagugagagaguccuuucacaagcucgcgaagcaauaccauccggauucuggaagcaacaccgcugacuccgccacauucauccggaucgaaaaagccuaucgcaagguccugucucacgugauugagcagaccaaugcuagccaguccaaaggcgaggaagaggaagauguugagaaguuuaaauacaagacaccccagcauagacacuaucuuagcuucgaggggaucggauuuggcaccccuacacaacgggaaaagcacuaccgccaguucagagccgaccgggcugccgaacaggugauggaguaccagaaacaaaagcugcagucucaguauuuucccgauuccgucauugugaaaaacauccgccagagcaagcaacagaaaauuacccaggcgaucgagagacucguugaagaccugauucaagagucuauggccaagggggauuucgacaaucuguccggaaaaggcaagccucucaagaaauuuagcgauuguucuuacaucgaccccaugacgcauaaccugaaucggauccuuauugauaacggcuaucagccugaguggauccugaagcagaaagaaauuuccgacaccaucgagcagcuccgcgaagcuauucuggugagcagaaagaaacuugggaauccgaugacacccaccgagaagaagcaauggaaccacgucugcgaacaguuccaggagaauauccggaaacugaacaagagaaucaaugauuuuaaccucauugugccuauccugacacgccagaaagugcauuucgacgcccaaaaggagauuguccgggcucagaaaaucuacgaaacccugauuaagacgaaggagguuacagacagaaaccccaauaaccucgaucagggagaaggcgagaaaaccccugaaaucaagaaaggguuucugaauuggaugaaccuuuggaaguucaucaaaauucgcuccuucuga

SEQ ID NO: 68458 - RNA, 1707 nt, Artificial Sequence
  derived and/or modified sequence opt5 from DNAJC2__Homo_sapiens__NP_001123359
augcugcuccugcccagcgccgcugacggcagagggaccgccaucacacacgcgcuuacguccgcuucuacccugugccagguggagccugucggacggugguucgaagccuuuguuaagcgcagaaaccggaaugccagcgcuuccuuccaagagcucgaagauaaaaaggagcugucugaagagagcgaggacgaagaacuucagcuggaagaguuuccgaugcucaaaacacuggaucccaaggacuggaaaaaccaggaucauuacgccgugcugggccucgggcacgugcgcuauaaggcuacccagagacaaauuaaggccgcgcauaaagccaugguccugaagcaccauccugacaaacggaaggcugccggagagcccaucaaagaaggcgauaaugacuacuucacauguauuaccaaggcuuaugagaugcuuuccgauccugugaagcgcagagccuuuaacucuguugaccccacauucgauaauagcgugccuuccaaaagcgaagcgaaggacaacuuuuucgaggucuuuaccccgguguucgaacgcaauucucggugguccaacaaaaagaauguucccaaacugggggauaugaacagcucuuuugaggacguggacaucuucuacuccuuuugguauaauuucgauagcuggagagaguucucuuaccucgacgaagaggaaaaggagaaagccgaaugccgggaugagcgcagauggauugagaagcagaaccgggcuacgcgcgcccagagaaagaaagaagagaugaaucggaucagaacccuggucgacaacgcuuauuccugugauccucgcaucaagaaauuuaaggaagaggaaaaagccaagaaggaggccgagaaaaaggcuaaagcggaagccaagcggaaagagcaggaagcuaaggagaagcaaagacaggccgagcuugaagccgcucgccuggccaaagagaaggaagaggaagaggugcggcagcaggcgcuccuggcuaaaaaggagaaagacauucaaaagaaggccaucaaaaaggaaagacagaaacugcgcaauagcugcaagauugaggaaaucaacgagcagauucggaaagaaaaggaggaggccgaagcuagaaugcgccaagccuccaaaaacacagagaagucuaccggaggcggcgggaauggaagcaagaacugguccgaagaugaccuccagcugcuuaucaaagcugugaaucuguuccccgccggcacaaacagccggugggaggucauugcgaauuacaugaacauccacucuuccagcgggguuaagagaaccgccaaagaugugaucggaaaggcuaaaucucuccagaagcuggacccucaccagaaggaugacauuaauaaaaaggccuuugacaaauucaagaaagaacauggcguggucccccaagcugauaacgccacgccgagcgagcgcuuugaggggccuuacacagacuucacccccuggacaaccgaggagcagaaacuucuggaacaggcgcucaagaccuauccugugaauacacccgagcggugggagaagaucgccgaagcuguucccggaagaacgaagaaagauuguaugaagcgguacaaagagcugguggaaauggucaaggccaagaaagcugcccaggagcaagugcugaacgccucccgcgcuaagaaauga

SEQ ID NO: 68459 - RNA, 1515 nt, Artificial Sequence
  derived and/or modified sequence opt5 from DNAJC3__Homo_sapiens__NP_006251
augguggcccccggcagcgucaccuccagacuggggucuguuuucccuuuucuccuggugcuuguggaccugcaguacgagggagcugaaugcggcgucaacgccgauguggagaagcaccucgaacuggggaaaaagcugcuugcggcuggacaacucgccgacgcccugagccaguuccaugcugccguugauggcgacccggauaauuauaucgcuuacuaucggcgcgccacaguguuucuggcgauggggaaauccaaggccgcucuccccgaccugacgaaagucauucagcuuaagauggauuucaccgccgcuagacugcagcggggacaccuccugcuuaagcaaggcaaacuggacgaggccgaagaugacuuuaagaaagugcucaagucuaacccuagcgagaaugaggaaaaagaggcgcagucccagcugaucaagucugaugaaaugcagcgccugagaagccaagcccucaacgcuuucggcuccggggacuacacagccgcuauugccuuucuggauaagauccuugagguuugugugugggacgccgagcugcgggaacuccgcgcugagugcuucauuaaagaaggagagcccagaaaggcgaucagcgaccugaaagccgcuucuaaacuuaaaaaugauaacaccgaagccuuuuauaagaucuccacacuguacuaucagcucggcgaccaugagcugagccugucugagguccgggaaugucucaaacuggaucaggaccacaagcgcugcuucgcccauuacaaacaggugaagaaacuuaauaagcugauugaguccgcugaggaacucaucagagaugggcgguacaccgacgccacaagcaaguaugaaucugugaugaaaaccgagccuuccauugcggaguacacgguccgcagcaaggaaagaaucugucacugcuuuuccaaggaugagaaacccguugaagcuauucggguguguucugaggugcugcaaauggaaccugacaacgucaaugcccuuaaggaucgcgccgaggcuuaucugaucgaggaaauguacgacgaggccauucaggauuaugaaaccgcucaggagcacaacgagaaugaccaacagaucagagaaggacucgagaaagcccagcggcugcugaagcagagccaaaagagagacuacuauaagauccucggcgugaagcgcaacgcgaaaaagcaggaaauuaucaaagccuaccggaagcuggcccuucaguggcauccggauaauuuccagaacgaggaagagaaaaagaaggcugagaaaaaguuuauugacaucgcugccgcgaaagaaguucuguccgaucccgagaugagaaagaaauucgacgauggggaagacccucucgaugccgagagccaacagggaggcggcgggaaucccuuccaccgcucuuggaacuccuggcagggauuuaacccuuucagcucuggcgggcccuuucgguucaaguuucauuucaauuga

SEQ ID NO: 68460 - RNA, 597 nt, Artificial Sequence
  derived and/or modified sequence opt5 from DNAJC5__Homo_sapiens__NP_079495
auggccgaccagagacaacggagccuguccaccucuggcgagagccucuaccacgugcuggggcuugauaagaacgcuacauccgacgauaucaaaaagucuuaucgcaaacuggcccucaaguaccaucccgacaaaaauccugauaacccggaagcggcugacaaguucaaggagauuaauaacgcccacgccauccugacggaugcuaccaaaagaaauauuuaugacaaguacggaagccuuggccuguaugucgccgaacaguuuggggaggaaaacguuaauacauacuucgugcucuccucuuggugggcuaaagcccuguuuguguucugcggacugcucaccuguugcuauuguugcuguugccuguguugcuguuuuaacugcuguugcggcaagugcaaacccaaggcgccugagggggaggaaacagaguucuacgucagccccgaagaucuugaggcccagcugcaguccgacgagcgggaagcuaccgauacaccuaucgugauucaacccgccagcgcuaccgagacgacccagcucacagccgacucucauccuuccuaccacaccgauggauuuaauuga

SEQ ID NO: 68461 - RNA, 1317 nt, Artificial Sequence
  derived and/or modified sequence opt5 from DNAJC7__Homo_sapiens__NP_001138238
augugccccaagaacgccagcuacuauggcaauagagcugccacccugaugaugcucgggcgguuccgcgaggcgcugggagacgcucagcaauccgugagacuugaugacucuuuuguccggggccaccuucgcgaagggaaaugucaucucagccugggaaacgccauggccgcuugcagauccuuccagcgggcccuugagcuggaucacaagaaugcucaggcccagcaagaauuuaaaaacgcgaaugccguuauggaguacgaaaagaucgcugagacagacuucgagaaacgcgauuuuagaaaggugguguucuguauggaccgggcccucgaauuugcuccugccugccaucgcuucaagauucugaaagcggagugucuggccaugcucggcagauauccggaagcucagucugucgccagcgauauccugcggauggacuccacgaacgcugaugcccuuuacgugcgcgggcugugccucuauuacgaggacuguauugagaaggccguucaguuuuucgugcaggcucugagaauggcgcccgaucacgaaaaagccugcaucgcuugucggaaugccaaggcccuuaaagcuaagaaggaggacggaaacaaagccuuuaaggaaggcaauuauaaacuggcguacgagcucuacaccgaagcucugggcauugauccuaacaauaucaagacaaacgccaaacuguauugcaaucgcgggaccgucaacucuaagcucagaaaacuggacgacgccaucgaggauuguacaaaugcugugaagcuggacgauaccuacauuaaggccuaucugcggagagcucaaugcuacauggacacagagcaguaugaagaggccguucgcgauuacgaaaaaguguaucagaccgagaagacgaaagaacauaagcagcuccugaaaaacgcgcaacuugagcugaagaaguccaaacggaaggacuacuacaaaauccucggagucgauaagaacgccuccgaggacgaaauuaaaaaggcuuauagaaagcgcgcccugaugcaccaccccgaucggcauagcggcgcuucugccgaggugcagaaagaagaggaaaagaaauucaaggaggugggggaggcguuuaccauccuguccgacccuaaaaagaagacaagauacgauagcggacaggaccucgacgaagagggcaugaauaugggggauuucgaccccaacaauauuuucaaagccuuuuucggaggcccuggcggguuuucuuucgaagcuagcggaccgggcaacuuuuucuuucaauucggguga

SEQ ID NO: 68462 - RNA, 573 nt, Artificial Sequence
  derived and/or modified sequence opt5 from DNAL1__Homo_sapiens__NP_113615
auggccaaggcuaccacaaucaaagaggcccuggcgagaugggaagagaagacgggccagcggcccagcgaagcuaaagagauuaagcucuacgcccaaaucccuccgauugagaaaauggacgccucccugucuaugcuugcuaacugcgaaaagcugagccucuccaccaauuguaucgagaagauugccaaccugaaugggcuuaaaaaccugcgcauccucucucugggaagaaauaacaucaagaaucugaacggccucgaagcugugggggauacacuggaggaacuuuggauuagcuauaauuucaucgagaaacugaagggcauucacaucaugaaaaagcucaagauucuguacauguccaacaaucuugucaaagacugggccgaguuuguuaagcuggcggaacuccccugccuggaggaucugguguucgugggaaacccucucgaagagaaacauucugccgaaaauaacuggaucgaggaggcuaccaagcggguccccaaacugaagaaacuugacgggacaccugugauuaagggagaugaagaggaagacaauuga

SEQ ID NO: 68463 - RNA, 849 nt, Artificial Sequence
  derived and/or modified sequence opt5 from DNASE1__Homo_sapiens__XP_011520696
augagaggcaugaagcugcucggggcccugcuugcucuggccgcgcuccugcagggagcugugagccuuaaaaucgccgccuucaacauucaaaccuuuggcgagacaaagauguccaaugcuacgcuggucucuuacaucguucagauucucagccgguaugacaucgcccuggugcaggaagugcgcgauucccaccugaccgcugucgggaaacuccuggacaaccuuaaucaggaugcccccgacacauaccauuaugugguuucugagccucugggaagaaacagcuacaaggaacgguaucucuucguguaccgcccggaucaagucuccgcgguggacucuuauuacuacgaugacggcugcgagcccugugggaaugauaccuuuaacagagaaccugccauuguucgguucuuuagccgcuucacagaggugagagaguuugcuaucgucccccugcacgccgcuccuggagacgccguggcggaaaucgaugcccuuuaugacguguaccuggauguccaggagaaauggggccucgaagacguuaugcugaugggcgacuucaaugcugggugcuccuaugugcggcccagccaguggucuuccauucgccuguggaccagcccuacauuucaguggcucaucccggauucugccgacaccacggcuacccccacacauugugccuacgauagaauuguggucgccggaaugcugcuucggggcgcugugguuccugacuccgcgcugcccuucaacuuucaagccgcuuaugggcucagcgaucagcuggcccaggccaucucugaccacuacccuguggaggucaugcuuaaguga

SEQ ID NO: 68464 - RNA, 900 nt, Artificial Sequence
  derived and/or modified sequence opt5 from DNASE1L2__Homo_sapiens__NP_001288609
augggcgggcccagagcccugcucgcugcccugugggcgcuugaggcugccggaaccgccgcucugcggaucggcgccuucaacauucagagcuuuggggacuccaaggugucugauccugcuugcggaagcaucauugccaaaauccucgcgggcuacgaccuggcccuuguccaagaaguucgcgauccggaccuguccgcugugucugcccucauggagcagauuaauagcguguccgaacacgaguauucuuucgucagcucccagccccuggggagagaucaguacaaggaaauguaucuguuuguguaccggaaagacgcuguuagcguggucgauacauaucucuacccugaccccgaggauguguucucucgcgagccuuuuguugugaaguucuccgcccccggaacgggcgaaagagcgccuccgcugcccagccggcgcgcccuuaccccucccccucugcccgcugccgcucaaaaccucguccugaucccgcuucaugccgccccucaccaggcuguggcggagaucgacgcccuguaugauguguaccucgacgucauugauaaauggggcacagacgacaugcuguuucugggggauuucaaugcugacuguucuuacguuagagcccaggauugggccgcuauccggcuccgcuccagcgaaguguuuaaguggcugauucccgacucugccgauaccacagugggaaacuccgacugcgcguaugauagaaucgucgcuuguggcgcccggcuucgcagaagccugaagccucaguccgccaccgugcaugacuuccaagaggaguuugggcucgaucagacacaggcucuggccauuucugaccacuuccccguugaagugacccuuaaauuucaucgguga

SEQ ID NO: 68465 - RNA, 828 nt, Artificial Sequence
  derived and/or modified sequence opt5 from DNASE1L3__Homo_sapiens__NP_001243489
augagcagagagcuggcuccccuccugcuucugcuccuguccauccacucugcccuugccaugcggauuugcagcuucaacgugcgcuccuuuggcgaaucuaagcaggaggacaaaaaugcgauggaugucaucguuaaggugauuaaaagaugugacaucauucuggugauggaaaucaaggauagcaacaaucggaucugcccuauucucauggagaaacugaaccgcgaaaagcuggucuccgugaagagaucuuaccauuaucacgacuaccaagauggggacgcugauguuuucagccgggagccguuuguggucugguuccagagcccccauaccgccgugaaagacuuuguuaucauuccucuccacacaacgcccgagaccuccgugaaggaaaucgaugagcuggucgaaguguauacagacgugaaacaucgcuggaaggccgagaauuucauuuuuaugggagauuucaacgcuggcuguucuuacgucccuaaaaaggccuggaagaauaucagacuucggaccgacccccgcuuuguuuggcugauuggggaucaggaggacacaaccgugaaaaaguccacaaacugcgcuuaugacagaaucgugcuccggggacaggaaaucgucagcucugugguuccuaaauccaauagcguguucgauuuucaaaaggccuacaaacugaccgaggaagaggcgcuugacgucucugaucacuucccgguggaauuuaagcugcaguccagccgcgccuucacgaacuccaaaaagucuguuacccucagaaagaaaacaaagagcaaacgguccuga

SEQ ID NO: 68466 - RNA, 462 nt, Artificial Sequence
  derived and/or modified sequence opt5 from DNASE2B__Homo_sapiens__XP_011540180
augccccagcugugcaccagagccagcuccucugagaucccuggccggcuccugacaacgcuucaaagcgcucaggggcagaaguuccugcacuuugccaaauccgacucuuuccucgaugacauuuuugcggcuuggauggcccagcgccugaagacccaucuucugacagaaaccuggcaaagaaaacggcaggagcucccgagcaacuguucccugcccuaccacguguauaauaucaaggccauuaaacugucucgccauagcuacuucuccagcuaucaggaucacgcuaaguggugcaucucucagaagggaaccaaaaacagauggacauguauuggcgaccucaaucgguccccucaucaagccuuucgcagcgggggauucaucugcacacagaacuggcagaucuaccaggcuuuucaaggccugguccuuuauuacgaaucuuguaaguga

SEQ ID NO: 68467 - RNA, 1083 nt, Artificial Sequence
  derived and/or modified sequence opt5 from DNASE2__Homo_sapiens__NP_001366
augaucccccugcuccuggccgcccuucugugcgugccugcuggcgcgcucaccuguuacggggacagcggacagccggucgauugguucguuguguauaagcugcccgcucuuagaggcuccggggaggccgcccaacggggacugcaguacaaauaucucgacgaaucuagcggcggguggcgcgauggcagagcucugauuaacuccccugagggagccgugggccggucucugcagccccucuaccgcagcaauacaucccagcuggcuuuucuucuguauaacgaccaaccuccccagccuucuaaggcccaggauagcuccaugagagggcacacgaaaggaguccuccugcuugaccaugauggcggguucuggcuggugcacagcguuccgaauuuucccccucccgcgucuuccgccgcuuacagcuggccucauucugccugcaccuauggacagacacuccuguguguguccuuccccuuugcucaauucagcaagaugggcaaacagcugaccuacacauacccgugggucuauaacuaccagcucgaagggaucuuugcccaggaguucccugaccuggaaaaugugguuaagggacaccaugugucucaagagcccuggaacuccagcauuacccuuacaucccaggcgggcgccgucuuucagucuuucgcuaaguuuagcaaauucggcgaugaccuguauuccggguggcucgccgcugcccugggaaccaaucuucaagugcaguuuuggcacaagacggugggcauccugccuagcaacugcucugauauuuggcagguccucaauguuaaccagaucgccuuccccgggcccgcuggaccuuccuucaauagcaccgaggaccacucuaaauggugugugagcccgaagggccccuggacaugcgugggggauaugaaccggaaucaaggagaggaacagcgcggcggcgggacccugugugcgcagcugccugcccucuggaaggcuuuucagccccuggucaaaaacuaccaaccuugcaauggaauggccagaaagcccucccgggccuauaaaaucuga

SEQ ID NO: 68468 - RNA, 1062 nt, Artificial Sequence
  derived and/or modified sequence opt5 from DND1__Homo_sapiens__NP_919225
augcagagcaagagagacugcgagcuguggugugaacgggugaaccccgagaauaaagccgcucucgaagccuggguccgcgagaccggcaucagacugguucaagugaacgggcagcggaaguacggaggcccuccgcccgggugggugggauccccucccccugcgggcucugaagucuucauugggcgccuuccccaggauguguaugagcaccagcugaucccucucuuucaaagaguuggacggcuguacgaguuccgccuuaugaugacauuuagcggccugaauagaggcuucgcuuaugcccgguacuccucucgcagaggggcccaggcugccauugcuacgcuccauaaccacccgcugcggcccagcugcccucugcucgugugucgcuccaccgaaaaaugcgagcugucugucgacggacuucccccuaaucugacaagaagcgcccuccugcuugcgcugcagccccucggcccggggcugcaggaagcccggcugcucccuucccccggaccugcucccggccaaaucgcccugcuuaaguuuagcucucaucgcgcugccgcgauggccaaaaaggcucugguggaggggcagucccaccucuguggagagcagguugccguggaauggcugaagcccgaucuuaaacagagacugcggcaacagcucgucggcccuuuccugagaagcccgcagcccgagggcucucaacuggcucucgcccgcgacaagcugggguuucagggagcccgggcuacccuucagcugcucugccagagaaugaaacugggcuccccuguguuccuuacaaagugucuggggauuggacccgcgggcuggcaucgcuuuugguaucaaguggucaucccugggcaccccguuccguucagcggacucaucuggguggugcugacccuggauggccgggacggccacgaagucgccaaagaugcugugucuguuagacuccugcaggcccuuuccgagagcggggccaaccugcucugguccgcuggagccgaagcgggcacaauggugaagcaguga

SEQ ID NO: 68469 - RNA, 2214 nt, Artificial Sequence
  derived and/or modified sequence opt5 from DNER__Homo_sapiens__NP_620711
augcagcccagacgggcccaagcuccuggcgcccagcugcucccggcgcuggcccuucugcuccugcuucugggggccggaccccgcggcagcucccucgccaacccugugcccgcugccccucugucugcucccgggccuugcgccgcgcagccguguagaaauggaggcgucugcaccagccggcccgagccugacccccagcacccugcccccgcuggggaaccgggauacuccuguacaugcccugccggcaucucuggcgcuaacugucaacugguugccgaucccugcgcgagcaauccuugucaucacgggaacugcuccucuagcuccucuagcuccagcgacggauaucucuguauuugcaaugagggcuacgaagggcccaacugugagcaggcccugcccucucuuccugcuacgggauggaccgaauccauggccccgcgccagcugcagcccgugccugcuacacaagagcccgauaagauccucccuagaagccaggccaccgugacacugcccaccuggcagccgaaaacaggccagaaggucguggagaugaaaugggaccaaguugaagugauuccugauaucgccugcgggaaugcuucuuccaacagcuccgcgggaggccggcuugucucuuucgaggugccccagaauaccagcguuaagauucgccaggacgccacggcuucccugauccuccuguggaaagugaccgccacaggcuuucaacagugcagccugaucgaugggagaucugucaccccucuccaggccuccggaggccuggugcuucuggaagagaugcucgcucuggggaacaaucauuucauuggauuugugaacgacagcgucacaaagucuaucguugcccuucggcugacccucguggugaaggucagcacgugugugcccggcgagucccacgcgaaugaucuggaaugcucugggaaaggaaaguguacaaccaaaccuagcgaggcuacauucuccugcaccugugaagaacaguauguuggcaccuuuugcgaagaguacgacgccugucaacgcaagcccugccagaacaaugccagcuguauugaugcuaacgagaaacaggacggcucuaacuucacaugcgugugucugccgggguauacgggagaacucugccaguccaagaucgauuacugcauucuggacccuuguagaaauggcgcuaccugcaucagcucucuuuccggguuuacaugucaaugccccgagggauauuucggcagcgcuugugaagagaaggucgaccccugcgccuccucuccuugucagaacaaugggaccugcuacguggauggcguucauuuuacauguaacugcagcccgggauucaccggccccacgugugcgcagcugauugacuuuugcgcccucuccccuugcgcucacgggacaugucggucugugggaaccagcuacaaaugccugugugaucccggcuaucacgggcuuuacugcgaagaggaguauaaugaaugucuguccgccccuugccucaacgcugccaccugucgcgaccuggucaauggauacgagugcgugugucuggcggaauauaagggcacacauugcgagcucuacaaagaucccugugccaacgucagcugccugaauggggcuaccugcgacucugauggccuuaacggaacauguaucugcgccccuggcuucacgggggaagagugugacaucgauauuaaugagugcgacuccaaccccugucaccauggaggcagcugccuggaucagccgaauggguauaacugucacugcccucacggaugggugggcgcuaauugugaaauccaucuccaauggaagucugggcacauggccgagucccugaccaacaugcccagacauagccuguacauuaucauuggcgcccuuugcguugcuuuuauccucaugcugaucauucugaucgugggaauuugucggaucucucgcauugaauaccagggcagcuccagaccugcguaugaggaguucuacaacugccggagcaucgacucugaguucuccaaugccaucgcuagcauuagacacgcccgcuuugggaaaaagucccggcccgccauguaugacgucucuccgaucgcuuacgaggauuauagcccugacgauaaaccccucgugacacugauuaagaccaaggaccuuuga

SEQ ID NO: 68470 - RNA, 14262 nt, Artificial Sequence
  derived and/or modified sequence opt5 from DNHD1__Homo_sapiens__NP_653267
auggugcccgaggaaagacgggucggccugagcuccgacgagaccucuagcgauucccucaagucuuggcacagcaucugcguucuggacuccaaggaacagccucuugccugucaacagaagcagcgccaguucgugaaaccggugacagagucugaacaacccacgguccuggagcuccugcuugcugagcugagaacccucuuuagcgccgugcugcaggauuccagcccugcggcuuggcgguaccugcacgccguucucgggcugcuucccccuuaucgcgaacugcucgugggacaccuggaccuucugcccuuccucgagcagcuguacugcugggccccuuggguccagacacaucugcaccucgaucugcuuggcgcuauugugcaagccuuuccgcccgacucuucccugcucgauagcgcuucucacgccgacuguugcccucagaagagacggcugcaccacagacccccuugucccgcgugcccguucguucaggcccagugguccagacaacaggugaaagaagaacuugcuaccuggcugcggccucucacacugcccgagcugcagcgcugucucgggaucgucggagcccaaguggcucuggaagaggccguguggcuugauggccugagccuccugccucuugcgcuggccgcugacauucccgucagauaugaaucuuccgauaccgacaacgccgagguugaacccguggggcggaaggagacacgcagccagcucgauuacgaggugccuagagaaaaggcuuuucagaaauccucuaccggauucagcccggagacguccuuucuggacagccaggucaugaccgcccugaagauggaacgguaucucaaaaagauccacuuccuguaccuuaauguggcccccucucgcuauuuuagaccuuacucccugaugguugugcccccugacaaagucaaccccgagcacuacauuuucagcccguuuggcauccuccaugugcacccuguugaaggcucugagacaaugacccuggggacauggcaccaucacugcgugcuguggcaacagcuucaguucauccccuuuuucaaguauugucuccugcggaaguccuuuaccugcuggaaaaagaaugucagacugcagggacuccaucgccugcaaaaauuucuugagaaccaucugcugcuggcugugccucacuucggcgcggggcugcuucacauuucccggcuccugcaggaacugcacucugucagcuggcucccccaggagcuggauagauguuacgaacuucuggaccuccagacggcccuggcugaggaaaagcauaaagcccugcgccuucuccaccggugccugaaucugugcacauccauccucagacuggugcaugaggauaccuaucacaugcaacagugucuucaggagcgcguucagaacugcgaccggauuagaacaggacaaggcagcaucuaccugcagcgcgugcagcacaagcaacucgaacagaaacugaagcaggccgaggcuugguggcugcagcuugggaaguuugcccggcucgucgauuauaugauuugucaaucucugaucuccgugcuggaggaacagauuaccagcuucguugcgaauauccuccaggcuccuagacagaaacccuuucugucuucccaacuuguguucgacgaucauggacagcugagccacgucccgugcguggagaacaugauccagacccucacaggcggccugcaguccgugaagacgucugcccugcaaguuguccagagcgccgaccuuaaaaccuccucugauagccuguacuccgaagaggaagacgaggaagaggauagcaaggacgaguuucucaugccuaaauuccaggggcaacccucugacgcuguguccaucuucuguggacccaaugugggccuggucuggccuuggaagucucauccgaucgccgggauucucgaagugcgcggaugccggcugagaggccaguauuucccccacaacuacaagcagcuugaggaagaucuggacaauaacccuaaaauccagcaagcucucaauauucagcagguucugcuggagggggugcuuuguaagguccaggaauuuugccgggagcaucacuggaucacaggaaucuacgaguuccugcaaucuuggggcccccagaaacucgaagauaugcgcggcgggccuauuaagaacuaugugacccugguuuccagacucaauguguggcaggcccgggucagcucuaugcccaucgagcugcuuacaaaaggaggccugcuccugcugagcugucacgacgugcaggcggaaauggaguccaaacuuaacagcauuagaaaggauauccuggcccauguucaaaacgaaugcuggaaucucucucagcagcugaugaccgagcucacggacuuuaugcacauuuuccgcacaaucaacuccgauauccaugcuauugcccaguguacccaaaaacugaaugaggcuaacgaacaguacguggagcuugaagaacggauggaguaugucagagcccugcacgaacugauccgcaaucauuucagccucuuuuccgcggagaacgaagcccuggacauuucugugagacggcaguucggggagagcccuauuccgcccugcccucccccuccccaaccgcaccuucugcacugcccucuccuggcuccccagcuccuggauaugugggaagccuuucaguucgagaagucccaggcuucugaguuucuucugagcaaacgccaugccauuaugccuaagcugcaacagcucauggccgcugcgcuggccgaacuugagggacugcucgcuaaagcccuguccggccccuucauggaccccacccaggaucagagaucuacagaacaccaacucgugagccuggagcggcaguuucagaauaccgucuccgaccuuagcgaacugcaucacgccuacgcuaucuucacagaggaugagacgccuguuccgcugcccauuugugggacccgcccuaucgugcagcaacagagaaucuggcaccucuaucgggugauuucugaaaacaucuccgaguggaagugcauggccuuugcgaaguucagccccgcuauggcccaggagaagacagagggcuggcugaccgaagccgcucgcaugucuacaacccuugagcugcauuccccuguccuccaacacuguaugcgcauccugggagaguuucggagcuaccucccccugcuuacgaagcugggcucucugcauccucagucccucaauugccagugucugcuucgcgcccuggggcucggaagccugcagaccaucgaacugcucacacuuggccaacugcugaccuauccgcuccuggaguucgcggacagaauuaaccagguguggcagaaugaaaacgagcggauccacgcucaggagacaaucagacgccuucaacgguacugggaagccagacagcugcgccuccugaauuuuauucugcauguucccuacgagccucccgccuccgaacggagcaaaagacaggugcuccgcucuccucagugggaggucguggacaaggauagcgggaccuucauccuuuccgacuauucuaaccugcaagauagcauucaggaaucccugcagguucucucuaaaauccuggcuauugaaaaguccggagaccuuaauaaaaucgcccuggaguggguggcuaucaugcacggccucggggcccugcuggaagucuggcucacguuccagcaaaaguggauuuuucuuaacaaggugcugcacgagaugaaaauccaguuccccaacgcggaucucaauucccgguuuaagguuauggacgaucaguacagaacacucaugcgcauuucuguggccgacccgaugguccugagccuuguggugccuuccgcugaacggagccccuauuuccaaggccagcagcugcagcaacuccugcaggccggaucugucgagcuggaaggcaucauuaugucccucgagagcguucuuuacggggugugcgcucauuuucccagacuguucuuucugucugauuccgagcucguggcccugcuugccgcucggcuggaaagcugugaggcgcagcucuggguccgcagaugcuucccucacgugcaugccguuuccuuucggucuugucccaccggagagaagaacacagacgauugggagagcuccccuaauacccagacccaaguggaagcucuggccguccugggcgccgggggagaggaggugaagcuccagggcccgcuuccccugcacccugaccugcccaaauggcucgcuagccuggaaaagugccuucgccuggcccucguucacaugcugcagggguguguggcggcuagacuggcccggggcccuucucucggagaggcccuuaagcagcugcccaaacaaaacaagcuguaucuccagcuguacguccagcauuggaucgaucuugugcaggcuuucccguggcagugcguccugguggccgaagagguuguguggagagcggagauggaagaggcucuccuggaauggggcacacuggccauggucuccaugcacaugcgcaaacucgaggugcuuguuaauuuuaugcgggcccagagagcuagccaagggggacaaucucugccuagcgugcgccagacgucccugcucucugcccugcuugucauggcugugacccaucgggacaucgcccagcugcucgaacagcaccaagugagcgaccugacagauuuccauuggguuagacagcugaaguaucaccucggcuccccucacauuauccccaaaucuccccuucagagccugaagaccauugcguccagcgagccuucucugucccccgccgcuugcuggaucgacguccucgggcgcagcuuccuguacaacuacgaguaucuuggaccgcggcugggcccucuccccucccugcugcccgaaagaccugcccucgugcuucugcuggcucucgaggaaguggccugugggacaguccugggcccgaauggagugggcaagcgcgccauuguuaacucucuugcucaggcgcuggggagacaacucgugaugcugcccugcagcccucagaucgaggcccagugucuguccaauuaccucaacggagcucugcaaggcggggccuggcuucugcucgaaaaaguccaucagcugcccccuggacuucugucugcccucggccagcggcugggcgagcugcaccaucucuaugcuccccuguaccaggaggccagccgcaauaccuccacgauugauccuacacaaccgcagcuucuggggagcagcuucuucgaaaagcaccacguguccguuagacucggauauggcugccugcuugugcugcgggcgcucagcucugcuguccccgccaaccugcaucugcuccugcgcccuguggcccuugcucugcccgaccucagacagguugccgagcugacccuucugggggcgggaaugcgggaugccuuucagauggcuaccagacucuccaaauucuuuagccuggaacgcgagcuggugucuggcccucuccccugucggcugccgcuucugaagcaaauccucgaagacacaaucagaacccugaaugucacaaaagaggagccuaagugccagaagccccgcagccuugccgcuauugaagaggccgcucugcuccggucuccccuguucuccauccugaacgggcuccaucugcacaaucuuagaggacugcucugugcccuguuuccuagcgcgucccaggugcuugccgaacccaugacguacaaacugaugaagccucucguggucgaggagcugcagcaaguuggccuggauccgagccccgacauucucggcucccuggaacagcuuucucaggcucugagccgggccuccgggauccuccugcuuggaccugcuggcucugggaaaaccacaugcuggcacagccuguucaagauucagaaccgccucgccgccauggaggauaccuccacacaaggaugucagcccguggaaaucacccaucuguauccuucuggccugagcccccaggaguuucucggguggcuggaaggauccugcuggcaccacggcaucuucccgaaagugcuuagagcugcgggccaauguaacaauauggggcagaagcggcagacggaggagagcauuggaauccagcauuggauuaucugcgacggcgccucuaacggggcuuggcuggauuccauuaccugccuccugagcgaacuuccucaacugucucuccccuccggacagcagaucgcccgcccucccggcacauuucugcugauggaggucgccgacaccacagggaucagcccuaccgugguuggauguugcgcucuugugugguguggcggcgaacagacauggcaaugcauucugucugcccucauggcgucccugcccuacgaguacagacuccagcaccggaccgucgccgaacugaaucauauggcugaggugcuuguuccggccacgcugcgcuuccugacaugucagggggugagcucccuccugcagguccacggacaacaggcugugugcgccggcgucgcggaggugaccagcauggccagaauccuucauucucugcucgaccugcaccuccggcugaaagaagagaaggcuccugggcccgaagaucugagcuauuccgaccccguugcccagucuuuucgcagcuccaagucuagcuuccuuaacagaucccaaguggauucugacgaugugccugacaaaugucgggagcaucugcucgcugucagcuccuuccuguuugcccuuauuuggggauucggcgcucaucugccgagcagauuuuggcccaucuucgauaccuuuauucgcgacucuaucucccggcucagcaauuacccugaacccccucccucugcccugguuuucgaucuccacguguccccugaggacgggacacuggugcccuuuaccggacaguaucugagcucccauauuaagggcacgcuuggcacauuccacccgucuauccagaccgagagacugcucuacgucguggaucugcuucugagcgggggacagccuguucuccuggcgggcgaagccgcuacagggaaauccgccuuuguggagguccugguggaaccccaccauccuuauaucuacagccccauucacccggcuuucucuuccagccaucuccgccugcuucugucucggggaauccaaggccagacccaggccagcccucagcccgggcaccaucaagacuccaagcccucucuccuguuucuucuggaggaucuccaccuggccacaagcgacccugagaaauccugccagcccguccuggaaacccucagacaggcgauggacggaacgguguaugcucacucuacccuggagcuucagacacugcaaccuaccguuaacuuccucgccacagugaccgucccgggcuacugugaacgcccccugugcccucggcuuuuuagacuguucacggugcucgcucuggagagcaugacacaggccacccugcucgaacgccauguucccauuauccaggccuggcuggagcgguucccuuccguggagagagaacgcgcucuugcccggggccuggucagagcgagcguggaggccugggaagcuguguguaauugcuuuaugcccucuccucuccacccgcauuaccacuucucccugcacagcguuucccaucuucugucuagccuccagcugcugcccaaccgcacaggguccagaggauuugucgauuauccuaaucaccaagagcaucuccggcgcgugucuggccugagagggaccugccuuaccgugaugauggccacacggaacgucguuagacuguggcuccacgaagcucagcggacguucugugaccgccuggauagccccagagagcgguccuacugcgccaaacuucugcucgugguggcgcagagcgucuuuuguugcggaccuggcccccaacaucuggggaaggaccaccaggagucugaagaggaagaggaagaggagcgcgugccggaaguugaguccgaaggagagcuggcccagugggaggauuucagcaauucuaacuccgaaaccgaggaagaggaggaaccuuauggccuccagguggcuagagucagcaauucucgggaccccucccugacacccagcauuggcccugugucucgcgggaugaaagagagcaucucccacaagaucagacaagaaaaaggaacccgggccagcaacuaccgccuucagguuagacgguccuuuaagacaugguggcagaaaaagccccagauggaucugauuucuccucuccugcuuccggugcugcuccugcauccccaagagaagccuagcgaccuggucuucucccaggaacucauccugggccccaauucugagaccccuaaccuuuaucuggaacgccagugggagaaacucgaggaacagcuggcuacgagcgccgcucaacugaagcucagcccccaccuugccagaugucauucuauggcgcagcacguggcccggcuggugcgcguccuggcuagaccgcggcagcaugggcuccugcuuagcggagcccugggcacagggagacacaccgcuauuacccucgccuccagcaucugccaagcccacuuuuuccaucugccuucuggcuccgaggaagcgauucugcagugucuucgcgaugcuagcuggcacgccggaaugcucucucagcccguugcccugcuggugccuuccggcguggaccucacaacccugcaucggcuucuggcucucgccacaagcgggucuuuucccggacaguacacggaggcugaucuggacagaaucggcgaacaucugccgcgcgagaaccuuggggucaaacaaaauaucaagaaagagauggugcuccagcgguuccaccagcagguuugcucccaucugcaccuguuuuuccucauuggagauaagcaagcccauaagcagcugccuagcacccuuuuccugagacuccugcagcuggcgacagccucuaucgaccgcuaugaacccugggaccaggcugcccuugcuaaaguggcccaacaccaucucgagggcgcgcaguccgucccccuggaugacgggagcuggaaguacccugaucugcaggccagcauucccuccguggcuaaagccauggcucucauccaccugucugccacccacuaccaugaacaccuuuguccugcucugccgcucguuacacccaagaccuuucuggacuuccuggauacguuucuuaugcuccaacagcagaccauucugaaaaucaagaacaaggcccagcgggugcaaaaugcgcuggagaaccucagaaugcugauuaaagagcauggcacacacgccaaucuuaucuucgaccuggaacagcagcucaaggauagcggaaaaucccugucuauguuucagcaacagcuggagcagagcaaacuucucuauaaacagcaacuggaagagugccgccaccaggaaaaccugaucgagaaucucgcucggcagagagacgcccugcaggcccaacgcgaggcuuuccuugaacagauguccaaggccuuucuggagccucucucucagcugcaagucgcggauuucgaagagauucggagcuacagagcucccccugaauccgugguucgggugaccgacgccaugugugaucuguuucaucacgagacaggcugggccagcgcuaaacagcuucucugcaccgaggacuucuaucaggaacuggucuuuuuccccaaggagaagaucacagacucugaacugauuaaacuccaucugauccuuaaggccccugggauggaugacgcugcccugagagcggugucccgcccggccgcuagccucgccgcuuggcugugggccguccugcacuacggacuugcgcauugccggggccuccccacggaucugcugcuccagcaaguggaggccacccugacaagagaacaggcucgccuuggguauuaccaguuucaggcccaagagacccuggagcacaaccucgcucuggccaaaaugguugaagacgcccaggcuucucacaauuguguggcgaagacccugucccaggcccagugcggacaauaucauaaauggccuaugaaggcugcccuucucacacccaugagagccuggacgacccagcugcagaagcugaaaggccgguguaugacagucuucggggauacccuccugugcagcgcugccauuaucuaccuuggcccuuuucccccgcugcgcagacaagagcuccuggacgaauggcuggcgcuuugucggggauuucaggaggcucucggcccugaugacguggcccaggcccugaagcgcaaacagaaguccgugucuauuccgcccaaaaacccucugcucgcuacacacagccccuucuccauucugucucuucugagcuccgagagcgaacaauaccagugggaugggaaucucaagccucaggccaagucugcucaucuggccggacugcuucucagauccccgacccacuauagcucuugccgguggccccugcugcucgacccuagcaacgaggcgcugaucuggcuugauccccugccucucgaagagaaucgcuccuuugcccccgcucugacggaaggcagagggaaaggacugaugcggaaccagaagcgcgagucuaaaacagacaugaaggaggaagaugacgagagcgaagaguccaaugaagccgaggaccaaaccaaagagcagaaggcugaagagagaaagaacgaacaggagaaagaacaggaggagaaugaagagaaggaagaggagaaaaccgaaagccaaggcucuaagccggccuacgagacacagcuuccuucccuccccuaucugagcguucuguccggcgcggauccugaacucgggucucagcugcaggaggccgcugccuguggacuucccgugcugcucaccaacgucgaacugggccuggggugcgaggagcuucaauggcugcuccagcgggaacagcugagcccuccccaagugcagccgggauucugucucuaccuguccacaacccuuucucugugcgcuauggagaaaguucucggcugugaacugcugaaggggcuuaacgugcuggaccucggacugaauauggagauucucgaggaacaaaugcugcacgagauccuuugccgcgaauaucccgagcuggaaacgagauggcaggaucucaaaauucgggcccuggacacauguaaggccgucgaggcugcggaagagagacugcuuaccaugcugcucuuucaaaacccuaagcgccagaaacccgccaaguuccugcggaauaucgugagagcucagggcaaacucugccagcugcgcgcccauugcgaggaacuugagggccaaaagcugcaggaaaugguccugugggccccuuaccggccggugguuuggcacgggauggcuauggugaaagcccucagccagcugcagaaccuucugccccucuuuuguauguccccugagaauuggcuggcggucacaaagcaagcucucgauucuaugaagcccagagagaucaaccauggagaagaccuggccagccaccuucugcagcugcgcgcccaucucacccggcagcugcuuggcuccacggugaccgcucuggggcucacacaaguuccucuggugggagcccucggcgcucuggcccuucugcaggcgaccgggaaagccagcgagcuggaaagacucgcucuguggcccggacuugccgcuucuccuuccacaguccacagcaagcccgugucugauguggcccgcccggcguggcugggcccuaaagccuggcacgagugcgaaaugcucgagcugcugcccccuuucguuggccucugugcuucccuugccgggcauagcucugcuuggcaggccuaucugagccuguccagcaccguccucggacccgccccgggcccugggcccgagccccugucccuucugcagaagcucauucuguggcgggugcugagaccugaaugccucgcuggagcgcuugccgacuuuacaaccucucugcugggccggccccucgaugagaauacguacgcuccuacaaugccguucaaacacagccaagccacccagcccaugcugauccuucugccucccccugggcaucccuccgccacccuccacccgcugacagugauucagaagcuggcugccaaguaccagcaaggacagaaacagcuccaggucaucgcgcuuggcucugaggcuugggacccugugagcguuguggucuccacccugucucaagccauguaugagggccauuggcuggugcucgauaacugucaccugaugccccacuggccuaaggaacuucugcagcuccugcuggagcuccuggggcgcgccaaaguuguggcugaccuugagagcgaacagcugcucgaccagcccgaguccagaaaugucagcacagugcaucgggauuuucgccuguggcuuauuguuccugccgaaucuuccgcuagccugcccgccgugcucacgcaacacucuaugccggucuucuggaaccagucccuggagcugggacaugugcucaucgacagcguggaacuggcgcagcaaguccuuuacaugcagcccccuacccaggcccugccccuccugcuucugcacggccuccugcugcacagacagcucuaugggacacggcugcaagcucauagaggacgcuggucucagguuacccuuacacaggugcugcagacccaagaucagcucugggccucccugagcaauccucgggcugccaugcaggagcuugcggccucuguguuuuacggcgggccccugggagacacggaggauagagaagcucucauuucccugacccaggccugccugagcccuuccagcggcucuuggguccaaccgcacacaccccagagccuccuggcuacccuuaugccucugcccgagcuccgcgaacuggacgccauggcggaguguaaggcccagaugcaucuucugccuagcccucccgagccccggcucugcggccugucugaagggccccaggcuuggcugcucagacgccagagcagagcccugcuuuccgcucugcagcggucuagcccuguguggguucccgagucccgcagaggagcccagcucgccgaacggcgccugagacaacggcuugugcaggucaaccgcagacuggagagccuccaggaucugcugacacacgugauccggcaggacgaaucugaugcuccgugguccguucucggcccuaaugccagacgcccccuggagggggugcuugagaccgaagcgcuggagcucagccaacuggucggaacgcuucagcgggaccuggauugucuccugcagcagcugaaaggcgcucccccuugccccucuagacgcugugccgccguggcucaugcccucuggacagggcggcugccucuuccguggagaccccacgcgccugcuggaccccaaccucccuggcacuggcugcgccagcucucccggagaggccagcugcuuguccgguaucugggcgugggggccgacgccagcucugauguuccugaacgcguguuccaucucuccgcuuucagacacccgcggcgccugcugcucgcccugagaggagaggcugcccuugaccaaaacguccccagcuccaauuuuccuggcucucgggggagcguguccagccagcugcaguacaagcgccucgaaaugaacucuaacccccugcauuucagaguugagaauggaccuaaccccaccgugccggagcggggccugcuucucaucgggcugcagguccugcacgcggaaugggaccccauugccggagcucuccaagauuccccuagcucucagcccagcccucugcccccuguguccaucucuacacaggccccgggcaccagcgaccuucccgcuccugccgaucugaccguguauuccugccccguuuacaugggcgggccucucggaacagcgaagcugcagagcagaaauauugucaugcaucugccccuuccgacgaaacucaccccuaacacaugcgugcaacgccgggugcaugucuguucucccccucuguccuga

SEQ ID NO: 68471 - RNA, 537 nt, Artificial Sequence
  derived and/or modified sequence opt5 from DNLZ__Homo_sapiens__NP_001074318
augcugagaaccgcccuccggggcgcuccccgccugcuuagcagagugcagccucgggccccgugccugcgcagacucugggggcggggagcgcgccccgaggucgcuggcagacggcgcgccugggccuggggguggagacgguccucuagcgaacaaggaccuggccccgcugccgcucuggggcgcguugaggccgcgcacuaccagcuuguguauacauguaaggugugcggaacgagauccucuaaacggaucagcaagcuggccuaccaucagggcgucgugauuguuaccuguccuggcugccagaaccaccauaucauugcugacaaucucgggugguucuccgaucugaacggaaaacgcaauaucgaagagauucugacagccagaggcgaacaagugcaccgggucgcuggggagggagcccucgagcuggugcuugaagcggccggcgcucccaccucuacagccgcuccugaggccggggaagacgagggaccgcccagcccuggcaagaccgagcccuccuga

SEQ ID NO: 68472 - RNA, 2556 nt, Artificial Sequence
  derived and/or modified sequence opt5 from DNM1__Homo_sapiens__NP_001005336
augggcaacagagggauggaggaccugaucccccucgugaaucggcugcaggaugccuucagcgcuauuggacaaaacgccgaccuugaucugccucagaucgcggucguuggcgggcaguccgcuggaaagucuagcgugcucgaaaauuuugugggccgcgacuuccugccgagaggguccggaauugucacccggcgcccccuugugcugcagcucguuaacgccacaacggaguacgccgaauuucugcacugcaaaggcaagaaauucaccgauuuugaggaagugagacuggagaucgaggcugaaacagaccgggucaccggcacaaauaaggggauuucuccugugcccaucaaccuccgcguuuauagcccucaugugcugaaucuuacccuggucgaucuccccggaaugacaaaagugccugugggcgaccaaccgcccgauaucgaguuccagauuagagacaugcugaugcaguuugucaccaaggaaaacugucuuauccuggccguuuccccugcuaauucugaucucgccaacagcgacgcgcugaagguggccaaagagguggauccccaggggcaacggacgauuggagucaucaccaagcuggaccucauggacgagggcacagaugcucgcgacgugcuggaaaauaaacuucugccucucagacggggguacauuggaguugugaaccgcucccagaaggauaucgacggcaaaaaggauauuaccgccgcucuggccgcggagagaaaguucuuucuuagccaccccucuuaucggcaucuggccgaccgcaugggcacaccguaccuccagaaaguccugaaucagcaacugaccaaccacaucagagauacgcucccugggcugcggaauaaacuucagucccagcugcucagcaucgaaaaagagguggaagaguauaagaacuucagacccgacgauccugcucgcaaaacaaaggcccugcuucaaaugguucagcaguuugcuguggacuucgagaaacggauugaaggaucuggcgaucagaucgacaccuacgagcuguccgggggagccagaauuaaccgcaucuuucaugaacgguuccccuucgagcucgucaagauggaauuugacgagaaggagcugagacgcgaaauuagcuaugccaucaaaaauauccacggcauucggacagggcuguucacccccgauauggcuuuugagaccaucgugaagaaacaagucaagaaaauuagagaaccuugccucaaguguguggacaugguuaucucugagcugauuuccacagugcgccagugcacgaagaaacuucagcaguacccgcggcugagagaagagauggagcgcaucgucaccacacacauccgggaaagagagggacggaccaaggaacaagugaugcuccugauugauaucgagcuggcguacaugaacacaaaucaugaggacuucauuggcuuugccaacgcucagcagcgcagcaaucagaugaacaaaaagaaaaccuccggcaaucaagaugaaauccuuguuauuagaaagggguggcucacgaucaacaauauuggaaucaugaagggcgggucuaaagaguauugguucgugcugacagccgaaaaccugagcugguacaaggacgaugaggaaaaagagaagaaauauaugcucuccgucgacaaucugaaacuucgggauguggagaagggauuuaugagcucuaagcacaucuucgcccuguuuaacaccgaacagagaaauguguacaaggacuaucgccagcucgagcuggcuugugaaacccaggaggaaguugauuccuggaaagccagcuuccugcgggcgggcgucuaccccgagagagugggggacaaggagaaggcuucugaaacagaggaaaacggcagcgauuccuuuaugcauucuauggacccucaacuugagcgccagguggaaaccauuagaaaucucgucgacagcuauauggccaucgugaacaagacaguucgggaucugaugcccaaaacgauuaugcaccugaugaucaacaauaccaaggaguucaucuuuuccgagcuccuggccaaccuuuacagcugcggagaccagaauacacugauggaagagucugcugaacaagcccagcgcagagaugagaugcuccggauguaccacgcucugaaggaggcccuguccauuaucggcgacauuaacaccacaaccgugagcacgccuaugcccccgccugucgaugacucuuggcuucaggugcaguccguucccgcggggcgcagaagcccuaccuccucucccacaccucaacggcgcgcccccgcugugccgccugccagacccggaagccggggccccgcuccugggccgcccccugccggauccgcgcucggcggggcucccccuguccccucucgcccuggcgccagccccgauccguucggaccucccccucaggugcccuccagaccgaaucgggccccucccggcguuccuagaaucaccauuagcgaccccuga

SEQ ID NO: 68473 - RNA, 2178 nt, Artificial Sequence
  derived and/or modified sequence opt5 from DNM1L__Homo_sapiens__NP_001265392
auggaggcccugauccccgugauuaacaagcuccaggacgucuucaauaccguuggcgcugauaucauucaacugccucagaucgugguggucgggacacagagcuccggaaaaucuagcgugcuugaaucccugguuggcagagaccuccugccgcgggggacgggaauugugacccgcagaccccuuauccugcagcucguccacgugucucaagaggauaagcggaaaacaaccggcgaagagaacgggguugaagccgaggaguggggaaaguuucugcauacaaagaauaagcuguacaccgacuucgaugaaauccgccaggagauugaaaacgagacagagagaaucagcggcaauaacaagggcguguccccugaacccauucaccucaaaaucuuuucuccuaaugucgugaaccugacccuuguggaccugcccgggaugacgaaggucccuguuggagaucagccgaaagacauugagcuccagauccgggaacugauucuucgcuucaucagcaaucccaacuccaucauucuggcggugaccgcugccaauacagauauggccaccagcgaggcucucaagaucucuagagaaguggacccugauggccggcgcacacuggccgucauuaccaaacuggaccucauggaugcugggacggacgccauggacgugcugaugggaagaguuauccccgugaagcugggcauuaucggggucgugaaccggucccaacuggauaucaauaacaagaaaagcguuacagacucuauucgcgaugaguaugcguuucuccagaagaaauacccuucccuggccaauagaaacggaaccaaguaucuugcucggacacugaaccgccuccugaugcaucacaucagagacugccugcccgagcucaaaacccggauuaaugugcuggccgcucaguaccagagccuucugaacucuuauggcgaaccggucgaugacaaguccgccacccuccugcaacuuaucacaaaauucgcgacggaguacuguaauaccauugaaggcacagccaaguauaucgagaccagcgaacugugcgggggagcuagaaucuguuacauuuuucaugagacauucggccgcacccucgaguccguggauccucuugggggacugaacacgaucgacauucucacagccauccggaaugcuaccggccccagaccugcccuguuuguccccgaagugucuuucgagcuucugguuaagcgccagauuaaacggcucgaggaacccagccugagaugcguggaacugguccacgaggagaugcagcgcaucauucaacacuguuccaacuacagcacccaggaacuucuccgguuuccuaagcugcaugaugccaucguggagguugugacaugccugcucagaaaacgccugccggucaccaaugaaauggugcacaaccuuguggcuaucgagcuggcguauauuaauacaaagcaucccgacuucgccgaugcuugugggcucaugaacaauaacaucgaggaacagcggagaaaucgccuggcccgggagcugccuucugccguuuccagagacaaaagcucuaagguccccagcgcucuugccccugcgucccaggaacccucuccggcugccagcgccgaggcugacggaaagguggccuccggcggcgggggagugggcgaugggguccaagaaccuacgaccggaaacuggcggggcaugcucaaaacaagcaaggcugaggagcugcuggccgaagagaaaucuaagcccauuccuaucaugcccgcguccccucagaaagggcacgccgugaaucuccuggacguucccgugccggucgcucgcaaacuuagcgccagagaacagcgggauugcgaggugauugaaagacugaucaagucuuacuuucucaucguucgcaaaaacauucaggacuccgugccuaaggcugucaugcacuuccuggugaaccauguuaaagauacccugcaaagcgagcuugugggccagcucuauaaguccucucugcuggacgaucuccugacagagagcgaagacauggcccagcggagaaaagaggcggccgauaugcuuaaggcucugcagggagccucccaaaucauugcugaaauccgcgagacccaccucugguga

SEQ ID NO: 68474 - RNA, 2613 nt, Artificial Sequence
  derived and/or modified sequence opt5 from DNM2__Homo_sapiens__NP_001005360
augggcaacagagggauggaggaacugaucccccucgugaauaagcugcaggacgccuucagcuccauuggacaaucuugccaccuugaucugccucagaucgcugucguuggcgggcagagcgccggaaaauccucugugcucgagaacuuugugggccgggacuuccugccgcgcgggagcggaauugucaccagacggccccuuauccugcagcucaucuuuuccaagacagaacaugcggaguuccugcacuguaaaucuaagaaauuuacggauuucgacgaagugcgccaagagaucgaggcugaaaccgauagaguuacaggcaccaauaagggcaucagcccugugcccauuaaccugcgggucuacuccccucaugugcucaaucugacacuuaucgaccugcccgggauuaccaagguuccugugggagaucagccgcccgacaucgaguaucagauuaaagauaugauccuccaguuuauuagccgcgaaucuucccugauccuugccgucaccccugccaacauggaccuggcuaauagcgaugcccucaagcuggcuaaagagguggacccccaaggccugagaacaaucggggugauuacgaagcucgaucugauggacgagggaaccgacgcccgggauguccuugaaaacaaacugcucccucugcgcagaggcuacaucgggguugugaaucggucucagaaggacauugagggaaagaaagauauccgcgcggcccuugcugccgaaagaaaguucuuucugucccaccccgcuuaucggcauauggccgaccgcaugggcacaccgcaccuccagaaaacccugaaccagcaacugacaaaucacauuagagagagccucccugcgcugcggucuaaacuucagucccagcugcucagccuggaaaaggagguggaggaauacaagaacuucagacccgaugacccuacccgcaaaacgaaggcccuucugcaaaugguccagcaguuuggcguggauuucgagaagcggaucgaaggguccggagaccagguugauacacucgagcugucuggcggggcuagaaucaaucgcauuuuucaugaacgguuccccuucgagcuggugaaaauggaguuugacgaaaaggaucucagacgcgagaucagcuaugccauuaaaaacauccacggaguccggaccggccuguucacacccgaccuugcuuuugaagccauugugaagaaacaaguugugaagcugaaggagccuugccucaaaugugucgaccuggugauccaggaacugaucaauaccgucagacagugcaccuccaaacuuagcucuuacccgcgccuccgggaggagacagaaagaauugugacgaccuauauccgcgagcgggaagggagaacaaaggaucagauucugcugcucaucgacauugagcaauccuacaucaacaccaaccaugaggauuucauuggauuugccaaugcucagcagcggagcacacagcugaacaagaaacgcgcgauccccaaucaaggcgaaauccuuguuauuagacggggcuggcugaccaucaacaauauuucucucaugaagggaggaagcaaggaguacugguucgugcugacggccgaaucccugucuugguauaaagacgaggaagagaaggagaaaaaguacaugcuuccucucgauaaccugaaaaucagagacgucgaaaagggcuuuaugagcaauaagcacguguucgcuauuuuuaacacagagcagcgcaauguuuauaaagaucugcggcagaucgaacucgccugugacucccaggaggauguggacagcuggaaggccucuuuccugagagcuggggucuaccccgaaaaagaucaagccgagaacgaggacggagcgcaggaaaauaccuuuuccauggauccucagcuugagcgccaaguggaaaccaucagaaaccugguggacagcuauguugcuauuaucaauaagucuauucgggaccucaugcccaaaacaaucaugcaccugaugauuaacaauaccaaggccuucauccaucacgagcugcuugccuaccucuauuccagcgcugaucaguccucucugauggaagagagcgccgaccaggcucagcgcagagaugacaugcugcggauguaccaugcccucaaagaggcgcugaacaucauuggcgauaucuccacaucuacggucagcaccccggugccucccccuguggacgauacauggcuucaauccgccagcucucacucccccaccccucagcgcagacccgucagcucuauucauccgccugggcggccucccgcugugcgcggccccacaccgggacccccucugauccccguuccugugggcgccgcugccuccuuuagcgcgcccccuauucccucuagaccggggccucagagcgucuucgccaacuccgaccucuuccccgcuccuccccagaucccgagccggccugugcgcauucccccugggauuccucccggcguucccucuagacggccgcccgccgcuccuuccagacccaccaucauucgcccugccgaacccagccugcuggauuga

SEQ ID NO: 68475 - RNA, 2580 nt, Artificial Sequence
  derived and/or modified sequence opt5 from DNM3__Homo_sapiens__NP_001129599
augggcaacagagagauggaggaacugaucccccucgugaaucggcugcaggacgccuucagcgcucuugggcaauccugccugcucgaacugccucagauugccgucguuggaggccagucugcgggaaagagcuccgugcuugagaacuuugugggacgcgauuuccugccgagaggcucugggaucgucacccggcgcccccucgugcugcagcugguuacaagcaaagcugaauacgccgaguuucuccacuguaagggaaagaaguucacggacuuugaugaggugagacuggaaauugaggccgaaaccgaccgggucacaggcaugaauaaaggcaucuccucuauuccuaucaaccuucgcguguauagcccccauguucugaaucucacccugaucgaucuuccugggauuacaaaggugcccgucggagaccaaccuccggauaucgaguaccagauuagagagaugaucaugcaguucauuacccgggaaaacugccugauccucgcugugacacccgccaauaccgaccuggcuaacuccgaugcccugaagcucgcgaaagagguggacccucagggccugcgcacgauuggggucaucaccaaacuugaucugauggacgaaggaacagaugccagagacguucucgagaauaaacugcuuccccugcggcgcggcuauguggggguggucaacagaagccaaaaggacaucgaugggaaaaaggacauuaaggcugccaugcucgcugaacggaaauuuuuccugucucacccugccuaccgccauaucgcggauagaaugggcacaccccaucugcagaaggugcucaaucagcagcugaccaaccacauucgggacacccuuccgaauuuuagaaacaaacugcaaggccagcuccuguccaucgagcacgagguugaagccuauaagaauuucaaaccugaggaucccacgcgcaagacaaaagcccuucugcagauggugcaacaguuugcugucgacuucgaaaagcggauugaggggagcggagaucagguggacacccucgaacugucuggcggggcuaagaucaacagaaucuuucacgagcgcuucccuuucgagauuguuaaaauggaauuuaacgagaaggaacugcggagagagaucuccuacgccauuaaaaauauccauggcauucgcacaggacucuucacccccgauauggccuuugaagcuaucgugaagaaacagaucgucaagcugaaggggcccagccuuaaaucuguggaccuggucauucaagagcucaucaacaccgugaagaaauguacaaagaaacuggcgaauuucccucggcugugcgaggaaacggagagaauuguugccaaccacauccgcgaacgggagggaaagaccaaggaucaggugcuucuccugauugacauccaggucuccuauauuaauacaaaccaugaggacuuuaucggcuucgcuaaugcccagcaaagaagcucccaggugcacaaaaagaccacaguuggcaaccaggugauccgcaaaggguggcugaccauuucuaauaucggaauuaugaagggcgggagcaaaggauacugguuuguccucacggccgaaucccugagcugguacaaggaugacgaggaaaaggagaaaaaguauaugcuuccgcuggauaaccucaaagugcgggacguggaaaagucuuucauguccagcaaacacaucuuugcucuguucaauacagagcagagaaacguuuacaaggauuaucgguuucuggagcuugccugugacucucaagaagaugucgacagcuggaaagcgucccuccugcgcgcuggcguguaccccgauaagucuguggccgagaaugacgaaaacgggcaggccgagaauuucagcauggauccucagcuggaaagacaggucgagaccauucggaaccucguggacuccuauaugagcaucaucaacaagugcauuagagaucugauccccaaaaccauuaugcaucuuaugaucaauaacguuaaggacuuuauuaauucugagcugcucgcucaacuguacuccagcgaagaccagaacacacugauggaggaaucugccgagcaggcucaacgccgggaugaaaugcuuagaauguaucaggcccucaaagaggcgcugggcaucaucggagacauuuccaccgccacagugagcacgccugcucccccgccugucgaugacuccuggauccagcacucucgcagaagcccuccucccuccccuaccacacagcggcgccccacccugucugccccgcucgcuagaccuacaagcggccgggggcccgcccccgcgauuccuuccccgggaccccauagcggcgccccucccgugccuuuccgccccgggccucugcccccguucccuucuuccagcgauucuuuuggagcucccccucaaguucccuccagaccgacccgggccccucccagcgugccuucucgcagacccccgcccagccccacgcggcccaccaucauucgcccucuugaguccagccugcucgacuga

SEQ ID NO: 68476 - RNA, 4734 nt, Artificial Sequence
  derived and/or modified sequence opt5 from DNMBP__Homo_sapiens__NP_056036
auggaggccggcagcguggucagagcuaucuucgacuuuugccccuccguuucugaggaacugccucucuucgugggggauauuaucgaagugcuggccgucguggacgaguuuuggcuucugggaaagaaagaagauguuaccggccaguucccgagcuccuuuguggagauugucacaauccccucucucaaggagggggaacggcuguucguguguauuugcgaguuuacgagccaagaacuugacaaccugccucuccaccgcggagaucugguuauccuggacggcauccccaccgcgggguggcuccagggaagauccuguuggggcgcucggggcuucuuuccuucuagcugcgugcgcgagcugugucuuuccagccagucuagacaguggcauucccaaagcgcccuguuccagauucccgaguacucuauggggcaggcccgggcucucaugggacuguccgcccagcuugaugaggaacuggacuuucgcgaaggcgaugucaucacaauuaucggggugccugagccgggaugguucgaaggcgagcucgaggggagacggggaauuuuucccgaaggcuucguggagcugcugggcccucuccgcaccgucgacgaaagcguuucuuccgggaaucaagaugacugcaucgugaacggagagguggauacacccgucggcgaagaggagauugggccugacgaagacgaggaggaacccggaaccuauggcguggcucuguacagauuccaggcccuugaaccgaaugagcuggauuuugagguuggggacaaaauccggauccucgcgacacuggaagauggauggcuugagggcagccugaagggccgcaccgggauuuucccuuauagauuugugaaacucugucccgacacgcgggucgaagagaccauggcccugccucaggagggaucccuggcucgcauccccgaaacaucucucgauugccuggagaacacccuuggcguggaggaacagagacacgaaacaagcgaccaugaggccgaggaacccgauuguauuaucuccgaggcuccuaccagcccgcuggggcaccucacgucugaauacgacacagauagaaauuccuaucaagacgaggauaccgccggagggcccccucggagccccggcguugaaugggagaugccucuggcgacagacucucccaccagcgacccgaccgagguggucaacggcauuuccucucagccucaggugcccuuccauccuaaucuucaaaagagccaguacuauuccacagucggaggcagccacccccacucugaacaguacccugaucugcucccccuggaggcccgcacgcgggacuacgcuucccugccgccuaagagaauguauagccagcucaaaacccugcaaaagcccgugcuuccccuguaccgcgggucuuccguuagcgccucccggguggucaaaccuagacagucuagcccgcagcuccauaaccuggcuuccuauacaaagaaacaccauaccucuagcguguacuccaucagcgaacgccuggagaugaagcccggaccucaggcccaaggccuuguuauggaagccgcuacacacucucagggggauggauccaccgaccucgauagcaagcugacgcagcagcugaucgaguuugagaaaucucucgcgggccccgggacagaaccugacaagauucugcggcacuucuccaucauggauuuuaauagcgagaaagacauugugagaggcucuagcaaacuuaucaccgaacaagagcugcccgagcgccggaaagcccucagaccucccccgccucgccccugcaccccugucuccacaagcccccaucugcugguggaucagaaccuuaagccggcuccuccccucgugguucggccuucuagacccgcuccccugccuccguccgcccagcagcggaccaaugccgucagccccaaacugcucucccgccacagaccuacaugugaaacgcuggagaaggaaggacccggccauauggggcggucucuugaccaaaccagcccuugcccccuggugcucgugagaauugaggaaauggagcgcgaucuggacauguauucccgggcccaggaggaacugaaccuuaugcucgaggaaaagcaggaugagucuagcagagcggaaacacuggaggaccugaaauucugcgaguccaauaucgaaucucucaacauggagcugcaacagcuucgcgaaaugacccugcucagcucccagucuagcucccuggucgcuccuagcggaucuguguccgccgagaauccggaacagagaaugcuggagaagcgggccaaaguuaucgaggaacuucuccaaacagagcgcgacuacauuagagaucuggaaauguguaucgagcggauuauggugcccaugcagcaggcucaggucccuaacaucgacuuugagggccuguucgggaacaugcaaauggugauuaagguuagcaaacagcuccuggccgcucuugaaaucucugaugccgugggacccgucuuucugggccaccgcgacgagcucgaagggaccuauaagauuuacugccagaaucaugaugaggcgaucgcccugcuggaaaucuacgagaaggacgagaaaauucagaagcaccuucaagauucccuggcugaccucaaaagccuguauaacgaauggggcuguacgaauuacaucaaccucggauccuuccugauuaagccugugcagagaguuaugcgguauccccuucugcucauggagcugcugaauagcaccccggaaucucacccugauaaagugccccuuacaaacgccguccuggcugugaaggagaucaaugugaacauuaaugaauacaagcgcagaaaagaccucguccugaaguaucggaaaggcgaugaggacagccucauggagaagaucuccaaacugaacauccauucuauuaucaaaaagagcaaucgcguuuccucucaccuuaagcaucugaccggguuugcgccccagauuaaggaugaaguguucgaggaaacagagaaaaacuucagaaugcaagaacggcucaucaagagcuuuauuagagaccugucccuguaccuucagcacauccgcgagucugccugcgugaaagucguggccgcuguuagcaugugggacguguguauggagcggggacacagagaucuggaacaguucgagcgcguccaucgguauaucuccgaccagcucuuuaccaauuucaaggaaagaacggagcgccuggugauuagcccucucaaccaacugcuuucuauguuuacaggcccccacaaacugguucagaagcgguucgauaagcugcucgacuuuuacaauugcaccgagagagccgaaaaacugaaggauaaaaagacacuugaggaacugcaguccgcucgcaacaacuacgaggcccucaaugcccagcugcucgacgaacugccuaaauuccaucaauaugcucaggggcuuuuuaccaacugugugcacggauacgcggaggcccauugcgauuucguccaccaggcucuggagcagcugaagccgcuccugagccuucugaagguggccggccgggaagggaaucucaucgccauuuuucacgaggaacauucuagaguucugcaacagcuccagguguucaccuuuuuccccgagucccugccugcuacaaagaagcccuucgaacggaaaacgaucgaccgccagagcgccagaaagccucuucugggccugcccuccuauaugcuccaaucugaggagcugcgggcgagccuucuggcucgcuacccgccugaaaaacucuuucaggccgagagaaacuucaaugccgcucaggaucuggacgucucccuccuggaaggagaucuugugggcgugauuaagaagaaagaccccauggggagccaaaaccgguggcugaucgacaauggagucaccaagggcuuuguuuauucuuccuuccugaaaccuuacaaccccagacgcagccacucugaugccagcguggggucccauucuagcacagaguccgaacacggaucuagcuccccucgguuucccagacagaauagcggcucuacccucacauucaacccguccagcauggcgguguccuuuaccucuggcagcugucagaagcagccucaagacgcuuccccuccgcccaaagagugcgaucaggggacgcugucugccagccuuaaucccuccaacagcgagucuucccccagccgcuguccuucugaccccgauuccacaagccagccucggucuggagacagcgccgaugucgcuagagacgugaagcagcccaccgccaccccucgcuccuaucggaauuucagacauccggaaaucguuggcuacucugugcccgggcgcaacggacaaagccaggaucuggucaagggcugcgcuagaacagcccaggcgccugaggaccgguccaccgaacccgaugggagcgaggccgagggaaaucagguguacuuugcuguuuauacauucaaagcccgcaacccuaacgaacucuccgugucugcuaaucaaaagcugaaaauucuggaguuuaaggacgucacgggcaacaccgaaugguggcucgccgaggugaauggcaaaaagggguacguccccagcaacuauaucagaaaaacagaauacaccuga

SEQ ID NO: 68477 - RNA, 4899 nt, Artificial Sequence
  derived and/or modified sequence opt5 from DNMT1__Homo_sapiens__NP_001124295
augcccgccagaaccgcuccugcccgggugccgacacuggcgguccccgcuaucagccucccugacgauguucgcagacggcugaaggaccuugagcgcgauucccugacggaaaaagagugcgugaaggaaaaacucaaccugcuucacgaguuccugcagaccgaaauuaagaaucaacucugugaccuggagacaaaacugagaaaggaggaacucucugaggaaggcuaccuggccaaggugaaaagccuucugaacaaggaucucucccuggagaauggggcccaugcuuauaaccgggaggucaauggacgccuugaaaacggcaaucaggccagaucugaggcucggcgcguggggauggccgacgcgaacagcccucccaaaccccuguccaagccuagaaccccgcggcgcucuaaaagcgauggagaagccaagagaucccgggaucccccugcuagcgccucucagguuacaggcauccgcgcugagcccuccccuagccccagaauuacccggaagucuacaagacagaccacgaucaccucccacuuugccaaagggccggcgaagcgcaaaccucaagaagagagcgagcgggccaagucugacgaauccauuaaagaggaagacaaggaucaggacgagaaaagacgccgggugacaagcagagaacgcgucgcucggccccucccugccgaggagcccgaaagagcuaaguccggaacccgcacagagaaggaagaggaacgggaugagaaagaggaaaagagacugcgcucucagaccaaagagcccacgccuaagcagaaacugaaggaggagccggaccgggaggccagagccggcgugcaagcugacgaagaugaggacggcgaugaaaaggacgagaaaaagcaucggagccagcccaaagaucucgcggccaagcgcagaccugaagagaaagagcccgaaaagguuaauccucagaucuccgacgagaaggaugaagacgagaaagaagagaagcggagaaaaacaacccccaaggagccgacagaaaagaagauggcucgcgccaagaccgugaugaacagcaaaacccacccucccaagugcauccagugugggcaauaccuggaugacccugaucuuaaauauggacagcaucccccugacgccgucgacgagccccagaugcugacaaaugaaaagcucucuauuuucgaugcuaacgaguccggcuuugaaagcuacgaggcccugccgcaacacaaacuuacgugcuucucuguguauuguaagcacgggcaucugugcccuaucgacaccggacucauugagaaaaauaucgaacuguuuuucagcggcuccgcgaagcccauuuacgaugacgaucccucucuggaagggggagugaacggcaagaaucucggcccuaucaacgaaugguggauuacaggguuugacggaggcgagaaagcucugaucggguucagcaccuccuuugccgaguauauccuuauggauccgagccccgaauacgccccuauuuucggacugaugcaggagaagaucuacauuucuaaaaucgucguugaauuucuccaguccaacagcgacucuacauaugaggaucugauuaauaagaucgaaaccacggugcccccuuccggccuuaaccugaaucgguucacagaggacagccuccugagacacgcucaguuuguggucgagcaaguggaauccuacgaugaggccggggacucugaugaacagcccaucuuccugaccccuuguaugcgcgaccucauuaaacuggcuggaguuacccuuggccagagacgggcccaggcgcgcagacaaacaauccggcauagcacccgcgagaaggacagaggccccacaaaggccacgaccacaaaacugguguaucagauuuucgauaccuuuuucgcugaacagaucgagaaggacgaucgggaggacaaagaaaacgccuuuaagcgcagacggugcggggucugugaggugugccagcaaccggaauguggaaaaugcaaggcuugcaaggauaugguuaaauucggcggguccggacgcucuaagcaggccugucaggagagacggugcccuaauauggcgaugaaagaagccgacgaugacgaggagguggaugacaacauucccgaaaugccuagccccaagaaaaugcaccagggcaagaagaaaaagcaaaauaaaaacagaaucuccugggucggggaggcugugaagacagauggcaaaaagagcuacuauaaaaaggucuguaucgacgccgaaacccucgaggugggagauugcguuucugugauuccggacgacuccagcaagccucuguaccuggcucgcgucacggcccuuugggaggauucuuccaauggccagauguuucacgcccauugguucugugcugggaccgacacagugcucggagcgaccagcgauccccuggaacuguuucucguugacgagugcgaagauaugcagcugucuuauauccacagcaaagugaaggucauuuacaaagccccuuccgagaacugggcuauggaaggcgggauggaccccgagagccuucuggagggagaugacggcaagacauacuucuaucaacucugguacgaucaggacuaugcccgguuugaaucucccccuaaaacccagccgacggaggauaauaaguucaaguuuuguguguccugcgccagacuggcugaaaugcgccagaaagagaucccccgggugcuggaacaacuugaggaccucgacagcagaguucuguacuauuccgccacaaagaacgggauucuguaccgcgucggcgauggaguguaucucccucccgaggcguucaccuuuaauaucaaacugucuagcccugugaagcggcccagaaaagaaccugucgacgaggaucuuuacccggaacauuaccgcaaguauuccgacuacauuaagggcucuaaccuggaugcucccgagccuuaucggaucgggagaaucaaagaaauuuucugucccaagaaaagcaauggacggccuaacgagacagacaucaagauucgcgugaacaaauucuacagacccgagaauacccacaaguccaccccggccucuuaucaugccgauaucaaccuccuguacuggagcgacgaagaggcuguuguggauuuuaaggccguccagggccggugcacaguggaauauggggaggaccugccugaguguguucagguguacuccaugggaggccccaaucgcuucuacuuucuugaagcguauaacgcuaaaagcaagucuuucgaggaucccccuaaucacgccagaucccccgggaacaaaggcaagggaaaaggcaaggggaagggaaaaccuaagagccaggccugcgaaccgucugagcccgaaauugagaucaaacucccuaagcugcggacgcuggacgucuuuuccggcugcgggggacucagcgagggcuuccaccaagcugggaucucugauacccugugggccauugaaaugugggaccccgcugcccaggcguuuagacuuaauaacccuggcuccacaguguucaccgaggacuguaauauccugcucaaacugguuauggccggagaaacaaccaacagccgcggccagcggcugccccagaagggggauguggagaugcuuugcggaggcccgccuugucaaggguuuuccggaaugaauagauucaacagccgcacguacucuaaauuuaagaauagccucgucguguccuuccugucuuauugcgacuacuaucggcccagauuuuuccugcucgaaaacgugcgcaauuucgucagcuuuaagcgguccaugguucugaaacuuacacugagaugucucgugcgcaugggcuaccagugcaccuucggcgugcugcaggcugggcaauauggagucgcccagaccagacggcgcgcuauuauccuggccgccgcuccuggcgagaaacuuccccuguuuccugagccccuccauguguucgcgccgagagccugucagcugucuguuguggucgaugacaaaaaguuugugagcaacauuacacggcucuccucugggccuuuccgcaccaucacaguuagagauacgaugagcgaccugcccgaagugcggaacggagcuuccgcccuugagaucagcuacaauggcgaaccccagucuugguuucaaagacagcugcgcggggcccaguaccagccuauucuccgggaucacaucugcaaagacauguccgcucuggucgccgcgagaaugcgccauauuccgcuggcucccggaagcgauuggcgggaccuuccuaacaucgaggugagacugucugauggcaccauggcccggaagcuccgcuauacacaccacgacagaaagaauggccgguccagcuccggggcccugcgcggaguuuguucuugcguggaagcuggcaaagccugugaucccgcggcuagacaauucaacacccucauuccuuggugccugccccauacagggaaucggcacaaccauugggccggacuuuacggccgccuggagugggacggguuuuucagcaccacggucaccaauccugagccgaugggaaagcagggcagagugcuccaccccgaacagcaucggguggucuccguucgcgagugcgccagaagccagggcuuuccugacacauaucggcuguucgggaacauccuggauaaacacagacaagugggaaaugcugugcccccuccccuugccaaggcuaucggccuggaaauuaaacucuguaugcuggccaaggcgcgcgagucugccuccgcuaagaucaaagaggaagaggccgcuaaggacuga

SEQ ID NO: 68478 - RNA, 2172 nt, Artificial Sequence
  derived and/or modified sequence opt5 from DNMT3A__Homo_sapiens__NP_715640
augggcauccuggagagagugguccggcgcaacgggagaguugaccggagccucaaggaugaaugcgacaccgccgagaaaaaggcuaaagugauugccggaaugaaugcgguggaagagaaccagggccccggggaaucccaaaaggucgaggaggcuucuccuccggccgugcagcagcccacagauccugccagccccacgguugcuaccacaccugaacccgugggauccgacgccggcgauaaaaaugcuaccaaggccggggacgaugagccugaauacgaggacggacgcggcuucggcaucggggagcuggucuggggaaaacuuagaggcuuuucuugguggccggggcggauugugagcugguggaugacaggacgcuccagagcggccgaaggcacccgguggguuaugugguucggggauggaaaguuuucuguggucuguguggagaagcugaugccccucagcuccuucugcagcgcuuuucaccaggccacauauaacaaacaaccuauguaccgcaaggcuaucuaugaagugcugcaggucgccucuuccagagcgggcaaacuuuuccccguuugucaugacagcgaugagucugacaccgccaaggcuguggaagugcagaauaagccuaugauugagugggcccugggcggguuucagcccuccggaccgaaaggccucgagccucccgaagaggaaaagaacccuuacaaagaggucuauacggauauguggguggaacccgaggcugccgccuacgcucccccuccgcccgcgaagaaaccucgcaagagcaccgccgagaaacccaagguuaaggaaaucaucgacgagcggacaagagaacggcugguguaugagguccgccaaaaaugcagaaauauugaagacaucuguauuucuugcgggucccugaacgugacccucgagcacccucuguucguuggaggcaugugucagaauugcaagaacuguuuucuugagugcgcuuaccaguacgaugacgauggguaucagagcuacuguacaaucugcugcggaggccgggaagugcugauguguggcaauaacaauugcuguagaugcuucugugucgagugcguggaccuccuggucgggcccggagccgcccaagcugccauuaaagaagauccguggaacuguuauaugugcggccauaaggggaccuacggacuucugcgccggagagaggacuggccuucccgccuccagauguuuuucgcgaauaaccacgaucaggaguuugaucccccuaaaguguaucccccuguucccgcugaaaagcggaagccgaucagagugcugucucuguucgacggcauugccacggggcuccugguccuuaaagaccugggcauccaaguggaucgcuacaucgccagcgagguuugugaagacuccauuacagugggaaugguccggcaucagggcaagaucauguaugugggggacgugagaagcguuacccagaaacacauucaggaguggggaccuuucgaucucgucaucggcgggucucccugcaacgaccuguccauugugaaucccgcucgcaagggacuuuacgaaggcacagggcggcuguuuuucgaguuuuacagacuccugcacgaugcccgcccuaaagagggcgacgaucggccguucuuuuggcuguucgaaaacguggucgcuaugggagugagcgacaagagagauaucucucgguuucucgagagcaaucccguuaugaucgacgccaaggaaguguccgcggcccaucgcgcuagauauuucuggggcaaccugccugggaugaaucggccccuugccucuaccgucaacgauaaacuggagcuccaagaaugucuggagcacggaagaauugcuaaguuuagcaaagugcgcaccaucacaacgcgguccaauagcauuaagcagggcaaagaccagcauuucccuguuuuuaugaacgagaaggaagauauccuuuggugcaccgagauggaaagaguguucggguuucccguccacuacacagacgugucuaauaugucccgccuggccagacagcggcuccugggacgcagcuggucuguuccugugauuagacaccuguucgcgccccucaaggaguauuucgccugcgucuga

SEQ ID NO: 68479 - RNA, 2187 nt, Artificial Sequence
  derived and/or modified sequence opt5 from DNMT3B__Homo_sapiens__NP_001193984
augaagggcgacaccagacaccugaacggggaggaagaugccggaggccgggaggacagcauccucgugaauggggcuugcuccgaucagucuagcgacucucccccuauucuggaagccauccgcacaccggagauuagaggacggcgcuccagcuccagacuuucuaaacgggaagucagcucccugcucagcuacacgcaagaucugaccggcgacggggauggagaggacggcgauggcucugacacacccguuaugccuaaacuuuuccgcgagaccagaacacgguccgaaagccccgcgucucugcgcagacgggcuaccgccuccgccgggacaccuuggcccagcccuccgucuuccuaucucaccaucgaucugacggacgauaccgaggacacacauggaacaccccagagcuccucuacaccuuacgcucgccuggcccaggacagccagcaaggcgggauggaaagcccccagguggaggcugauuccggagacggcgauucuuccgaguaucaggacgggaaggaauuuggaauuggcgaucucguguggggcaagaucaaaggguucagcugguggccugccauggucgugucuuggaaggcgaccagcaagagacaggccauguccggaaugcgguggguucaaugguuuggcgacgggaaauucucugaggugagcgcugauaagcuggucgcccuuggacuguuuucccagcacuucaaccucgcuacguuuaauaaacuggugagcuaccgcaaggccauguaucaugcgcuugaaaaagccagaguucgggcuggcaagacauuccccucuuccccgggggacagccuggaggaucagcucaagccuaugcuggaaugggcccacggaggcuuuaaacccaccggcaucgaggggcugaagccuaacaauacacagcccgagaacaaaaccagacgccggaccgcugacgauucugccacauccgacuacugucccgccccuaagagacucaaaacgaauugcuauaacaauggaaaggaccgcggcgaugaagaccaaagccgggagcagauggcuuccgauguggcgaacaauaaaucuagccuggaagacgggugucuuuccugcggaagaaagaacccggucucuuuccauccccuguuugagggcgggcucugucagaccugccgcgaucgguuccuggaacuguuuuacauguacgacgaugacggcuaucaaagcuacuguacagugugcugugagggaagagagcuucuccugugcuccaauaccagcuguugccgcugcuucuguguggaaugccuggagguccucguuggcacagggaccgccgcugaagccaagcugcaggagccuuggucuuguuauaugugccuuccccagcggugucacggagugcugagacgccggaaagauuggaacgugagacuccaggccuucuuuacguccgacacaggccuggaauacgaggcuccuaaacuuuaucccgccauuccggcggcucggcgcagaccuauccggguccugagccucuucgaugggauugccaccggauaccuggugcugaaggagcucggcaucaagguugggaaauauguggccucugaagucugcgaggaauccauugcugugggcaccguuaagcacgagggaaauaucaaguacgugaacgacgucagaaacauuaccaaaaagaauaucgaggaauggggccccuuugaucuggugaucgggggaagcccuuguaacgaccuuucuaaugucaaccccgcccgcaaaggccuguacgaggggaccggaagacucuucuuugaguucuaucaucugcugaauuacagccggccuaaggaaggcgacgaucgccccuuuuucuggauguuugaaaacgugguugcuaugaaagugggggacaagagagauauuucccgguuccuugagugcaauccggucaugaucgacgccauuaaggugagcgcggcccaccgcgcuagauauuuuuggggcaaccucccuggaaugaaucggaucuucggcuuucccguucauuacacagaugugucuaacauggggcgcggagccagacaaaaacugcugggccgguccuggagcguccccgugauucgccaccucuucgcuccucugaaggacuauuucgccugugaguga

SEQ ID NO: 68480 - RNA, 1161 nt, Artificial Sequence
  derived and/or modified sequence opt5 from DNMT3L__Homo_sapiens__NP_787063
auggccgcuauccccgcccuggacccugaggcggaaccgagcauggaugugauucucgucggcuccucugagcugagcuccucuguuagccccgggaccggaagagaccuuaucgcuuacgaagugaaggccaaccagcggaauauugaggauaucugcauuuguugcggcucccugcaagugcacacacagcauccucucuucgaagggggaaucugugcccccugcaaagacaaguuucuggaugcucuuuuccuguaugacgaugacggcuaccagucuuauuguagcaucugcuguuccggggagacgcuccugauuugcggaaacccugauuguacccgcugcuacuguuuugagugcgucgacagccuggugggccccggcacaucugggaaaguucacgccauguccaauugggugugcuaucucugucugccuagcucuagauccggacuucugcagcggcgcagaaaguggcggagccaacucaaggcuuucuacgaucgcgaaucugagaacccgcuggaaauguuugagaccguccccguguggagacggcagccuguucgcgugcuuucccuguucgaggacaucaaaaaggaacucacaagccugggcuuucuggaguccgggucugaucccggacagcucaaacaugucguggacgugaccgacacagucagaaaggauguugaagaguggggcccuuucgaccugguguauggggccaccccuccgcuuggacacacgugcgaucggccucccagcugguaccuguuucaguuccaucgccuccugcaauacgcgagaccuaaacccggcagcccccggcccuuuuucuggauguuuguggacaaucuuguccugaacaaggaagaucucgacguggccucccgcuuccuggagauggagccgguuaccauucccgaugugcacggcgggucucugcagaaugcugucagagugugguccaacaucccugccauucggagcagacacugggcucucguuucugaagaggaacugagccuucuggcccagaauaaacaguccucuaagcucgcggccaaguggcccacaaaacuggugaagaacuguuuccuuccucugcgcgaguauuuuaaauacuucagcaccgaacucacauccagccuguga

SEQ ID NO: 68481 - RNA, 1458 nt, Artificial Sequence
  derived and/or modified sequence opt5 from DNPEP__Homo_sapiens__NP_036232
augagcggccacucccccaccagaggggccaugcaaguggcuaugaacggaaaggcccggaaagaggcgguccagacagcugccaaggaacugcucaaauucguuaaucgcucuccuagcccguuucaugccguggcugagugcagaaaccggcugcuucaggccggcuucuccgaacugaaggagacggaaaaauggaauaucaagcccgagucuaaguacuuuaugacccgcaacagcuccacaauuaucgcuuucgccgucgggggacaguaugugccuggcaauggguuuucucucauuggagcgcacaccgacagccccugucugagagugaaacggcgcuccagacggagccagguuggcuuccaacaggugggcgucgagacauacgggggaggcaucuggucuaccugguuugaucgcgaccuuacacuggccgggagagugauuguuaagugcccuaccuccggacggcucgaacagcagcuggugcaugucgagcgccccauccugagaaucccucaccucgcuauucaucugcaacggaacaucaaugaaaacuucggcccgaauacggagaugcaccuugugcccauucuggccaccgcuauccaggaggaacucgagaaagggacaccugaacccggaccucugaacgccguggaugagcgccaccauagcguccuuaugucucugcucugugcgcaccugggccugucccccaaggacauuguugaaauggagcucugccuggccgauacccagccggcugugcuuggcggggccuaugacgaguuuaucuucgcuccuagacuggauaaucuccauagcuguuuuugcgcccugcaggcccuuauugacucuugugcuggacccggcucccuggcgacagaaccucacgugcggauggucacccucuacgauaacgaggaaguggggagcgaguccgcccaaggagcucagucucugcugacggaacucguucugagacgcaucagcgccuccugccagcaccccacagccuucgaggaggcuauccccaaauccuuuaugauuucugccgacauggcgcaugcugugcacccuaauuaucuugauaagcaugaagagaaccaccggccgcuguuccauaagggccccgucaucaaaguuaauuccaagcaaagauacgccagcaacgccgugucugaagcucucauucgcgagguggccaacaaagucaaggugccucugcaggaccuuaugguccggaaugauacccccugugggacaaccaucggaccuauucuggcuagcagacucggccugcgcgugcuggaccucggcagcccccagcuggccaugcacucuauccgggaaauggcgugcaccacagggguucuucagacgcugacccucuucaaaggauuuuucgagcuguuuccgagccugucccacaaccuucucguggacuga

SEQ ID NO: 68482 - RNA, 1527 nt, Artificial Sequence
  derived and/or modified sequence opt5 from DNTT__Homo_sapiens__NP_001017520
auggaucccccuagagccagccaccuguccccgcggaagaaacgccccagacagaccggcgcucucauggccucuagcccucaagacaucaaguuccaggaccugguggucuuuauucuugagaaaaagauggggacaacgcggcgcgcguuccugauggaacucgcuagacggaaaggauuucgcguugagaacgaacuguccgauucugugacccauaucguggccgagaauaacagcggcuccgacguccuugaauggcugcaggcccagaaggugcaaguuucuagccagcccgagcuccuggauguguccuggcugauugagugcaucagagcugggaagccugucgaaaugacaggaaaacaccagcucgugguucggcgcgacuacagcgauucuaccaaucccggcccuccgaagacacccccuauugccgugcagaaaaucucccaauaugcuugucagagacggaccacacugaacaauugcaaccagaucuucaccgacgccuuugauauucuugcggagaauugugaguuccgcgaaaacgaggacagcugcgucacguuuaugagagccgcuucugugcugaagucccuccccuucaccaucauuagcaugaaagauacagaagggaucccuugucugggaucuaaggugaagggcauuaucgaggaaauuaucgaggacggcgaauccagcgaggucaaagccguucuuaaugaugagcgguaccaguccuuuaagcuguucaccucuguguuuggggugggacucaaaacaagcgaaaagugguuccgcaugggcuuuagaacccuguccaaaguccggagcgacaagucucugaaauucacgagaaugcaaaaggcuggguuccucuauuacgaggaccugguguccugcguuacacgcgccgaagcggaggccgugagcguccuugugaaggaagcuguuugggccuuucugcccgaugcuuucgugaccaugacaggaggcuuucggagagggaaaaagaugggacaugacgucgauuuccucaucaccucuccgggcagcaccgaggacgaggaacagcugcuucagaaagugaugaaccugugggagaagaaaggccuccugcuguauuacgaucucgucgaauccacauuugagaagcugcgccuuccuucucggaagguggacgcccuggaucacuuccaaaaauguuuucucauuuucaagcugcccagacagcgcguugacagcgaucaguccagcuggcaggaagggaaaacguggaaggccauccggguggaccuuguccugugcccuuaugagagacgcgcuuuugcgcuccugggauggaccggcucucgguucgagagagaucugcgccgguacgccacacaugaaagaaaaaugauucucgacaaucacgcucuguacgacaagaccaagcggaucuuucuuaaagccgaguccgaagaggagauuuucgcccaccuggggcucgauuauaucgaacccugggagcgcaacgcuuga

SEQ ID NO: 68483 - RNA, 1203 nt, Artificial Sequence
  derived and/or modified sequence opt5 from DOC2A__Homo_sapiens__XP_011544277
augagaggccggcgcggggacagaaugaccaucaacauucaggagcacauggccaucaaugugugccccggaccuauucggccgauccgccaaauuagcgauuacuuccccagaggcccugggcccgaaggaggcgggggaggcggcggggaggcuccugcccaucuggucccccucgcgcuggcuccuccggccgcccuucugggagcuacaacgcccgaagacggcgccgagguugauuccuaugacucugaugacgcuaccgcccucgggacacuggaauuugaucuucuguacgaccgggcgagcuguacccuccacugcuccauccugcgcgccaagggacugaaaccuauggauuucaacggccucgcugaccccuaugugaagcugcaucuucugccuggggccuguaaagcuaauaagcucaaaacaaagacccagagaaacacacugaaucccguguggaacgaggaucuuaccuacucuggaaucacggacgaugacauuacccacaagguccugcggaucgccgugugcgacgaggauaaacucagccauaaugaauuuauuggcgagauccgcguuccgcugagacggcugaagccuucccagaaaaagcacuucaacauuugucucgaacgccaggugccccuggcgucuccuagcuccaugagcgccgcucuuagaggcaucucuugcuaucugaaagagcucgagcaagccgaacaggggcagggacugcuugaggaacggggccgcauucugcucucccugagcuacucuuccagacggagagggcugcucgucggaauccugcgcugugcucaccuugccgccauggacgugaauggcuauagcgaucccuacguuaagacauaccugcggcccgacguggauaagaaaucuaagcauaaaaccugcgucaagaaaaagacacucaacccugaguuuaaugaagaguucuuuuaugagaucgaacuguccacccuugcuacgaaaacacuggaggugaccgugugggacuacgauauuggaaagagcaacgacuucaucgggggcgucucccucggcccgggggcgagaggagaagcccgcaagcacuggucugauugucugcagcaacccgacgcugcccuggagcgguggcauacacucaccagcgaacugccucccgccgcuggcgcccuuuccagcgcguga

SEQ ID NO: 68484 - RNA, 1239 nt, Artificial Sequence
  derived and/or modified sequence opt5 from DOC2B__Homo_sapiens__NP_003576
augacccugagacggcgcggcgagaaggccacaaucagcauucaggaacacauggcuaucgacgugugccccgggccuauuagaccgaucaaacaaauuuccgauuacuucccccgguuuccucgcggacucccucccgacgccggccccagagcggcugccccuccggaugcccccgcucggccugccgucgcuggggccggacgcagaucucccagcgacggcgcgcgggaggaugacgaagauguugaccagcuguucggggccuauggauccucuccuggccccagcccgggcccuucccccgcucgcccucccgccaagcccccugaggaugaaccggacgcugauggguacgagucugacgauuguacggcccuuggaacccuggacuuuagccuccuguaugaccaggagaacaaugcgcuucauugcacaaucaccaaagccaagggccugaaacccauggaucacaacgggcucgcugacccuuacgugaagcugcaucugcuccccggagccuccaaggcuaauaaacugagaacaaagacccuucggaacacacugaauccuaccuggaacgaaacgcucaccuauuacggcaucacagaugaggacaugauucgcaaaacccugagaaucagcgugugugaugaagacaaguuccggcacaaugaguuuauuggggagacacgcgucccccuuaaaaagcugaagccgaaccauaccaaaacguucucuaucugccucgaaaagcagcugccuguggauaaaacagaggacaagucccuggaagagagaggacggauucucaucagccugaaauauucuucccaaaagcagggccuucugguuggcauugugagaugugcccaccucgccgcuauggaugcgaauggguacagcgaccccuacgucaaaaccuaucugcgcccugauguggacaagaagucuaaacacaagacagccguuaaaaagaaaacccuuaaccccgaauuuaaugaggaguucugcuacgaaaucaagcauggagaccuggcuaagaaaucccucgaggugaccgucugggauuaugacaucggcaagagcaacgauuuuauugggggaguggugcugggcauccacgccaaaggggaacggcugaagcauugguucgacugucucaaaaauaaggauaagagaauugagcgcuggcacacacugacguccgaacuuccuggagccguccugucugacuga

SEQ ID NO: 68485 - RNA, 6543 nt, Artificial Sequence
  derived and/or modified sequence opt5 from DOCK10__Homo_sapiens__NP_001277192
augagcuucagaggcaagguguuuaaacgggagcccuccgaauucuggaagaaacgcagaaccguccggcgcguuaaccaggaggaaauccacagauuuucuagccaagagaagccucggcugcucgaaccgcuggacuacgagacagugauugaggaacuugagaaaacguaucgcaaugauccccugcaggaccuccuguucuuuccuuccgaugacuucucugccgcuaccgugagcugggauaucagaacacuuuacuccaccguccccgaagacgccgagcauaaggcggagaaccugcucgugaaggaagcuugcaaauuuuauucuagccaguggcacguugugaauuacaaguaugagcaguacuccggggauauucggcaacugccucgcgccgaauauaaacccgagaagcugccuagccauucuuucgaaaucgaccacgaggaugccgacaaagaugaggacacaaccucccauagcucuuccaagggaggcgggggagcuggcgggacaggagucuuuaagagcggcuggcucuacaaaggcaacuucaauucuaccgugaacaauacgguuaccgugagauccuuuaagaaacgguacuuccagcugacacagcuuccggauaacagcuauauuaugaauuuuuacaaggacgaaaaaaucuccaaggagcccaaaggguguaucuuccuggacucuugcaccggagucgugcagaacaaucgccucagaaaguaugccuucgaacugaagaugaacgaucuuacauacuuugugcuggcugccgagaccgaaagcgacauggaugaguggauucacacgcucaaucggauccugcaaauuuccccugagggcccccugcaggggcgcagaagcacagaacucaccgaccugggacuugauucucuggacaacuccgucacaugugagugcaccccugaagagaccgauagcucugaaaauaaccuccacgcggacuucgccaaauaucugacagagacggaggauaccguuaagacaacccggaacauggaaagacuuaaucuguuuagccucgaccccgauaucgacacacugaaacugcagaagaaagaccuccuggagccggaauccgugauuaagccuuucgaggagaaggcugccaaacgcaucaugauuaucuguaaggcucuuaacucuaaucugcagggcugcgugaccgaaaacgagaaugaucccaucacgaacauugaaccuuuuuucgucagcguggcccucuacgaccugcgggauuccagaaaaaucagcgcggacuuucauguugaucuuaaucacgccgcugugcgccaaaugcugcucggggccucugucgcucuggagaacggaaauauugacacaaucaccccccggcaguccgaagagccccauauuaagggccugccugaggaauggcucaaauucccgaagcaggccguguuuagcguuucuaacccccacuccgagaucgugcuggucgccaagaucgaaaaagugcuuaugggcaauauugcuagcggggcggagccuuauaucaagaaccccgauuccaauaaauacgcccaaaagauucugaaaucuaacagacaguucuguagcaagcucggaaaguaccgcaugccuuuugcuugggccguccgguccguguucaaagacaaucagggcaacguugauagagacucucgcuuuagcccccuguuccggcaggaauccagcaagaucucuaccgaggaucuggugaaacuugucuccgacuauagacgcgccgaucggauuagcaagaugcaaacaaucccggggucucucgacaucgcuguggacaacguuccucuggagcaccccaauugcgugaccuccagcuucauuccugucaaacccuuuaacaugauggcccagacagaaccuacgguggagguggaagaguucguuuacgauucuaccaaguauuguagacccuaccgggucuauaaaaaucagaucuacauuuauccgaagcaucugaaguacgacagccagaaaugcuuuaacaaggcgcgcaauaucacaguguguauugaauucaaaaacuccgaugaggagagcgcuaagccucucaaaugcaucuacggaaagcccggcgggccccuguuuaccucugccgccuauacagcugugcuucaccauucccaaaauccugacuucagcgaugaagucaagauugagcugccgacccagcuccacgaaaaacaucacauccuguuuuccuucuaccacgugacgugcgacaucaacgccaaggcuaaugccaaaaagaaagaggcgcuggagaccucuguuggauaugccuggcuuccccucaugaagcaugaucagauugcuagccaggaauacaacaucccuauugccacaucccugcccccuaauuaucugucuuuucaagacagcgcuuccggcaagcacggcgggucugauaucaaauggguggacggaggcaagccccucuucaaagucagcaccuuugugguuuccacagugaacacccaggauccucaugucaaugccuucuuucaggagugucagaagagagaaaaagacaugagccaaucucccacguccaacuucauucggagcugcaagaaucugcuuaacguggagaagauccacgcgaucaugucuuuccugccgauuauccucaaccagcuguuuaaaguucuggugcagaaugaagaggaugagauuacaaccacagucaccagagugcuuaccgacaucguggccaagugucacgaagagcaacucgaccauuccguccagagcuacauuaaauucguuuuuaagacacgcgcuugcaaagaacggacggugcacgaggaacuggccaagaacgugaccgggcugcucaaaucuaaugauuccacaaccgucaagcaugugcugaagcacagcugguucuuuuucgcuaucauccuuaaauccauggcccagcaucugauugacacaaacaagauccagcucccuagaccccaacgcuuuccugagagcuaucagaaugagcuggauaaccugguuauggugcuuucugaccacgucauuuggaaauacaaggaugcccucgaagagaccagacgggcuaaucacagcguggcgcgcuuccugaaaagauguuuuacguucauggaccggggauacguuuuuaagauggugaacaauuauaucuccauguucucuagcggcgaucugaagacacucugccaguacaaauucgacuuucugcaggaagucugucaacaugagcacuucauuccccuuugccugccgauccgcuccgccaacaucccugauccccucaccccuucugaaagcacccaggagcugcaugcuuccgacaugcccgaguauucugugacaaaugaauuuuguagaaagcacuuccugauugggauccuucugcgggagguuggcuuugcccuccaggaagaucaggacgugcgccaucuggcccucgcuguccugaaaaaccuuauggccaagcacagcuucgacgauagauaccgggagccccgcaaacaagcgcagauugcuucccuguauaugccucucuacggaaugcugcuggacaauaugccgagaaucuaucuuaaggaucuguaccccuuuaccgugaacacaagcaaucagggcucucgggacgaucucuccacgaacgggggauuccaaagccagaccgccauuaagcacgccaacucuguggacacauccuuuagcaaagauguccugaauuccaucgcugccuucucuagcauugcgaucuccaccguuaaccaugcugacagcagagccucucucgccucccuggauagcaauccuucuacaaacgagaagagcuccgaaaaaaccgacaauugcgagaagaucccccgcccucuuucucugauuggcagcacgcuccgguuugauaaacuggaccaggcugaaaccagaucccugcuuauguguuuccugcacaucaugaagacaauuucuuacgagacccucaucgccuauuggcagcgcgcucccagcccugaaguguccgauuuuuucagcauucuggacgugugccuccaaaacuuccgguaccuggggaagagaaauaucauccgcaaaauugccgcggccuuuaaguucguccagucuacacagaacaauggaacccuuaaaggcuccaacccgagcugccagacauccgggcugcugucucaauggaugcauagcaccuccucucacgagggccacaagcagcaucggagccagacgcuccccaucauuagaggaaaaaaugcucuguccaacccuaagcuucugcagaugcucgacaauacaaugaccagcaacucuaaugagaucgauauugugcaccauguugacaccgaagccaacaucgcuacagaggugugucugaccauccucgaucugcuuucccuguuuacgcaaacacaccagcgccagcugcagcaaugcgacugucagaauagccucaugaagcgggucuucgauaccuauaugcuguuuuuccaggugaaccaaucugccacagcccuuaaacauguuuuugcuucccugagacucuucgugugcaaguuucccagcgcguucuuucagggcccugccgaccugugugggucuuucugcuacgaaguccucaaauguugcaaccaccggagccgcuccacccagacagaggcuucugcccugcuuuauuuuuucaugagaaagaauuucgaauuuaacaaacagaagagcauugugcggucccaccugcaacugaucaaagccgucagccagcucauugcugaugccggaaucggcgggucccgcuuccagcauucucuggcgauuaccaauaacuuugcuaauggagacaagcagaugaagaacagcaauuuccccgccgaggugaaagaucuuacgaagagaauccggaccguucugauggccacagcucaaaugaaagagcacgaaaaggacccggagaugcucguggaucugcaguacucccucgccaacucuuaugcgagcaccccugaacugagacgcacauggcuugaguccauggcuaaaauucaugcccggaauggcgaccugucugaagccgcuauguguuacauccacaucgccgcucugauugccgaguaccucaagagaaagggguauuggaaagucgagaagaucugcaccgcgagccugcuuuccgaagauacgcaccccugugacagcaacucucugcucacaacccccuccggcggaagcauguuuucuaugggcuggccugccuuccuguccauuacacccaauaucaaagaggaaggggcuaugaaggaggacagcggaaugcaggauaccccuuacaacgagaauauucugguggaacagcucuauaugugcguugaguuucuuuggaaaucugaacgcuacgagcugaucgccgacgugaacaagccgaucauugcugucuucgaaaagcaacgggauuuuaaaaagcuguccgaccucuauuacgauauccauagaagcuaucugaaaguggccgaggugguuaauuccgagaagcgccuuuucggccgguacuacagagucgccuuuuaugggcagggauucuuugaagaggaagagggcaaagaauacauuuauaaggagcccaagcugaccgggcucagcgagaucucucagcgccugcugaaacucuacgcugacaaguucggcgcggauaacgugaaaauuauccaagacagcaacaaggugaauccuaaagaucuugaccccaaguaugccuacauccaggucacauaugugacgccuuucuuugaagagaaagaaauugaggauagaaagaccgacuucgaaaugcaccauaacaucaaucgguuuguuuucgagacacccuuuacccuguccggaaagaaacacggcgggguggcugagcagugcaagcgcagaacaauucugaccacgucucaucucuucccguacgucaaaaagcggauccaggugauuagccaauccucuacagaacugaacccuaucgagguugccauugacgaaaugagcaaaaagguguccgagcuuaaucagcuguguaccauggaggaagucgauaugauccgccuccagcugaagcugcagggaucugugagcguuaaagugaacgccggccccauggcuuacgccagagcguuucucgaggaaaccaaugcuaagaaauauccugacaaccaagucaagcuucugaaagagaucuuccggcaguuugccgaugccugcgggcaggcucuggacgugaaugaaagacucauuaaggaggaucagcuggaguaccaagaagagcuucgcucccacuauaaggacaugcugagcgaacucucuacagugaugaacgagcagaucaccggacgggaugaccuguccaaaagaggcgucgaucagacauguacgcgcguuauuagcaaggccacccccgcgcugccuacagugucuaucuccagcuccgccgaaguguga

SEQ ID NO: 68486 - RNA, 6222 nt, Artificial Sequence
  derived and/or modified sequence opt5 from DOCK11__Homo_sapiens__NP_653259
auggccgaggugagaaaguucaccaaacggcugagcaagcccggcacagcugccgaacuccgccaguccgucucugaggcgguuagagggagcguggugcuggaaaaagcuaaggucguggagccucuugacuacgaaaacguuaucgcccaacggaaaacgcagauuuauuccgauccgcugcgcgaccuccugauguuucccauggaggauaucucuauuagcgugaucggaagacagcggcgcaccguccaguccacagugccugaggacgccgaaaagagagcucaaucucuuuucguuaaggagugcauuaaaaccuacagcacagauuggcacguggucaauuauaaguacgaagacuuuuccggcgauuuccggaugcugcccuguaaaagccuccgcccugagaagauccccaaccauguguuugagaucgacgaagauugcgagaaagacgaagauucuuccagccuguguucucagaaggggggagugauuaagcagggcuggcugcacaaagccaaugucaacuccaccaucacaguuaccaugaagguguucaaaagacgguauuuuuaccucacgcagcugccugacgggagcuauauucuuaauucuuacaaggaugagaaaaacuccaaggaaagcaaaggaugcaucuaccuggacgcuuguauugacgugguccaaugcccgaagaugcgcagacaugccuucgagcucaagaugcuggauaaauauucccacuaccuugcggccgagaccgaacaggagauggaagaguggcugaucacacucaagaaaauuauccagaucaauaccgacucucuggugcaggaaaagaaagagacaguugagaccgcucaagaugacgaaacgagcucccagggcaaggccgagaacauuauggcuagccuggaacggucuaugcaucccgagcucaugaaguauggccgcgaaacagagcagcugaauaaacuuuccagaggggauggacggcaaaaccuguuuagcuucgacucugaggugcagagacucgauuuuagcggcaucgaaccugacauuaagcccuucgaggaaaaauguaauaagcgcuuucuggucaacugccacgaucuuaccuucaauauccuggggcagauuggagacaacgccaaaggcccucccacaaauguggagccguucuuuaucaaccucgcgcuguucgauguuaagaacaauuguaagaucuccgccgacuuucacguggaccugaacccucccucuguccgggagaugcucugggggagcuccacccagcuggcuagcgauggaucuccuaaaggcuccagccccgaaucuuacauucauggcaucgccgagucccaacuuagauauauucagcaggggaucuucagcgugaccaauccccacccugaaauuuuucuggucgcucgcaucgagaaggugcuccagggaaacaucacacauugcgccgaaccguacauuaaaaauuccgaccccguuaagacggcccaaaaagugcaccggaccgcuaagcaggucuguucuagacugggccaguaucgcaugccuuucgcgugggccgcucggcccaucuuuaaggauacacaggggagccuugaccuggauggaagauucuccccucucuacaaacaagacucuagcaagcuguccagcgaggauauucugaaacuccugucugaguacaagaaacccgaaaagaccaaacuucagaucauuccgggccagcugaacaucacaguggagugcguuccuguggaccucuccaauugcauuaccagcucuuaugucccccugaagccuuuugaaaagaacugucagaauaucacgguggagguggaagaguucguucccgagaugacaaaauacugcuauccuuuuaccaucuacaagaaccaccuguaugucuacccccuucaacucaaauaugauucccagaagaccuucgccaaagcccgcaauauugcuguguguguggaauuucgggacagcgaugagucugacgccagcgcgcugaagugcaucuacgggaagccggcuggauccgucuucacaaccaacgccuacgccgugguuagccaucacaaucagaacccugaauucuaugaugagauuaaaaucgaacugcccauucaucuccaccaaaagcaucaccugcuuuuuacauucuaccacgugucuugugagaucaauacgaaaggcaccacaaagaaacaggacaccgucgagacacccgugggcuuugcuuggguuccucugcucaaggacgggagaaucauuaccuucgaacagcagcugccgguguccgccaaccugcccccuggauaucuuaaccucaaugaugcugagagccgccggcaaugcaacgucgacaucaaguggguggauggcgccaaaccccugcugaagauuaaaucccaucucgaaucuacgaucuacacccaggaccugcacguucauaaguuuuuccaccacugucagcuuauucagagcggguccaaagaggugccuggagagcugaucaaguaucucaagugccugcaugcgauggaaauccaagucaugauucaguuucugcccgugauccuuaugcagcucuucagagugcugacaaauaugacccacgaggaugacgucccuauuaacuguacaaugguucugcuccauaucgugucuaaaugccacgaagagggccuggauagcuaccuucgguccuuuauuaaguauucuuuccgccccgaaaaaccgagcgccccucaggcucaacugauccaugagacccucgccacgacaaugaucgcuauucugaagcaguccgccgacuuucugagcaucaauaaacuucucaaguacucuugguucuuuuucgagauuaucgcgaaauccauggccaccuaccugcuggaagagaacaagauuaagcuccccagagggcagcgguucccugaaacauaucaccacgugcugcauagccuucugcucgcuaucauuccccacgucaccaucagauacgccgagaucccggaugaaucucgcaaugugaacuauucccuggcuagcuuucugaaacggugucuuacccugauggacagaggcuucauuuuuaaucucaucaacgauuacauuucuggauucuccccuaaggaccccaaaguucuggccgaguauaaguuugaguuccuccaaacaaucugcaaucaugaacacuacauuccucugaaccuucccauggccuuugcuaaacccaagcugcagcgcgugcaggauagcaaucucgaguauucccugagcgacgaauacugcaagcaucacuuccuggucggccuucugcucagagagacgucuaucgcgcugcaggacaacuacgaaauccgguauaccgccauuagcgugaucaaaaaucuccugauuaagcacgcuuuugauacacgcuaccaacauaaaaaccagcaggccaagaucgcccagcuuuaucugccuuucguugggcuccugcuggagaacauucaaagacuugcuggacgggacacccuguacuccugugccgcgaugccgaauucugcuagccgcgaugaguuucccugcggcuucacauccccugccaacagagggucucucagcaccgacaaagauacggccuauggauccuuccagaauggccacgggaucaagcgggaagacucucgcggcagccugauccccgagggagcuacaggcuuuccugaucaggggaacaccggagaaaauaccagacaguccagcacacggucuuccgugagccaauacaaccgccucgaccaguaugagauuagaucucugcuuauguguuaccuguacaucgucaagaugauuuccgaggauacccugcucacauauuggaauaaagugagcccccaggaacugaucaacauucuuauccugcucgagguuugccuguuccauuuucgguacaugggcaagagaaauauugcccgcgugcacgacgcguggcucuccaaacacuucgggaucgaucggaagucucagacgaugccugcucugagaaaccgcagcggagucaugcaagcccggcuucagcaucuguccagccuggaaucuuccuuuacccucaaucacagcucuacaaccacagaggccgacaucuuccaucaggcucugcuugaaggcaacaccgccacggaggugagccugaccgugcucgacacaauuuccuuuuucacccaauguuuuaaaacacagcugcucaauaacgaugggcacaauccgcugaugaagaaggucuucgacauccaucuugcuuuucugaaaaacggccagucugagguuagccugaagcacguguucgccucccucagagcguuuauuucuaaauuccccagcgccuucuuuaagggacgcgugaacaugugcgcugccuucuguuaugaaguccugaaaugcuguaccuccaagaucagcucuacacggaaugaggcuuccgcccuucuguaccuccugaugagaaacaauuuugaauauaccaagcgcaaaacguuccuccggacacaccugcagauuaucaucgccgugagccaacuuauugcugauguugcgcuguccggcgggucuagauuucaggagagccuguucaucauuaacaauuuugccaacuccgaccggccuaugaaggcuaccgccuuccccgccgaagugaaagaucucaccaagcgcaucagaacaguccugauggcuaccgcccagaugaaagagcaugagaaggacccugaaaugcuuauugaucugcaguacucucucgcgaaaagcuaugcuuccacgcccgagcugcggaagacauggcuggacagcauggccaagauccacgugaaaaauggagauuuuucugaagccgcuaugugcuacguucauguggccgcgcucgucgcugaguuccuucaccgcaagaaacuguuuccgaacggcuguuccgccuucaagaaaaucaccccuaauauugacgaagagggggccaugaaggaggaugcuggaaugauggacgugcacuacagcgaagagguccugcucgaacugcuugagcaaugcguggauggccuguggaaggccgagagauaugaaaucauuucugagaucuccaaacucauuguucccaucuacgaaaagcggagagaguuugaaaaacugacacagguguaucgcacccugcauggggcuuacacaaagauucucgaggucaugcacaccaaaaagcggcuucugggcacguucuucagaguggccuuuuauggacagagcuucuuugaggaagaggacggcaaggaauacaucuauaaagagcccaagcugaccgggcucucugaaaucagccugcgccuuguuaaacuguacggagagaaguucggcacagagaacgugaaaauuauccaggacuccgauaaggucaaugcgaaggaacucgacccuaaauacgcccauauucaagugaccuaugugaagcccuacuuugaugacaaagagcugacagaacggaagaccgaguucgaaagaaaccacaauaucucucgcuuuguuuucgaggcuccuuauacgcugagcgggaaaaagcagggaugcauugaggaacaguguaaacggagaacaauccucaccacauccaacagcuuuccguacgucaagaagcgcauccccauuaauugcgagcaacagaucaaccuuaaaccuauugauguggccaccgacgaaaucaaggauaaaaccgcugagcugcagaagcuguguuccucuacagacguggauaugauucagcuccaacugaaacuucagggcugcgucagcgugcagguuaaugccggcccccuggccuaugcuagagcguuccucaacgacucccaggccucuaaguacccucccaagaaagugagcgagcugaaggauauguuucggaaauucauccaagcuuguuccaucgcccuggaacucaacgagcgccuuauuaaggaagaccaggucgaguaucaugaagggcugaaaucuaauuuuagagauauggugaaggagcugagcgacaucauucacgagcagauccuccaggaagacacgaugcacuccccguggaugagcaacacccugcauguuuucugcgccauuucuggaacauccagcgaucggggcuacgggucuccucgcuacgcugagguguga

SEQ ID NO: 68487 - RNA, 5598 nt, Artificial Sequence
  derived and/or modified sequence opt5 from DOCK1__Homo_sapiens__NP_001371
augaccagaugggugcccacaaagcgggaggaaaaauacggcgucgccuucuauaacuacgacgcucgcggggccgaugagcugagccuccagaucggagacacgguucacauucuggaaaccuaugagggcugguacagaggguauacacuucggaagaaauccaagaaaggaaucuuuccugcgucuuacauucaucugaaggaagcuaucguggagggcaaggggcaacacgagaccgugauuccgggagaucucccccugauccaggaagucacaaccacacuucgcgaguggagcaccaucuggagacagcuguaugugcaggacaaucgggaaauguuccgcuccguuagacauaugauuuacgaucucaucgaguggcggucucaaauucugagcggcacgcugccucaggacgagcucaaagaacugaagaaaaaggugaccgccaaaaucgauuacggcaaccgcauucuugaccuggaucucgucgugagagacgaggaugggaauauccuggaccccgaacuuacauccaccauuucucuguuucgggcccacgagaucgcuagcaagcagguugaagagcgccuccaggaggaaaagucccaaaaacagaacaucgauauuaauagacaggccaaguucgcugccacaccuagccuggcgcuguuugugaaccucaaaaaugucgugugcaagaucggagaggacgccgaagugcugaugucucuuuaugaccccgucgaguccaaauucauuagcgaaaacuaccugguucgguggucuuccagcggccucccuaaggauaucgaccgccugcauaaucuuagagcuguguuuaccgaucuggggucuaaagaccucaagcgggagaagauuuccuucgugugucagaucgucagagugggacgcauggagcugcgggauaacaauacgagaaaacugacaagcggccuccgccggccguuugggguugccgugauggacgucaccgauaucauuaacggaaagguggacgaugaagacaaacaacacuucauccccuuucagccuguugcuggcgagaaugauuuccugcagacagugauuaacaaggucaucgccgcgaaagaagugaaucacaagggccaagggcuuugggucacccugaagcuccugcccggagacauucaucagaucagaaaagaguuuccucaccuuguggaccgcaccacagccguugcucggaagacgggcuuccccgaaaucauuaugccgggggaugugagaaacgacaucuaugucacccuggugcagggagauuucgacaaaggcuccaagacaaccgccaaaaacguugaggugacagucucuguguacgaugaggacgggaagcgccucgaacaugugauuuuuccuggagcuggcgaugaggccaucagcgaauauaaguccguuauuuacuaucaggucaaacaaccccggugguucgagaccgugaagguggccaucccuauugaggacgucaauagaagccaccugcgcuuuacguuccggcacagaucuucccaggauagcaaagacaagucugaaaaaaucuuugcucuggcguucgugaagcucaugcgguacgauggcacaacccugcgcgacggggagcaugaucuuaucguuuacaaggccgaagcuaaaaagcuggaggacgccgccaccuaucucagccugcccuccacaaaagcugaacuggaggagaagggacacucugccaccggcaaaagcaugcagucccuugggagcugcacaauuucuaaggacuccuuucagaucagcacgcucguguguucuaccaaacugacacaaaacgucgaucugcucggacugcuuaaguggagauccaauaccagccugcuccagcagaaccugcggcagcugaugaagguggacggcggggaaguugugaaauuccuucaagauacacucgacgcgcuguuuaauauuaugauggagaacuccgaaucugagaccuucgauacgcuggucuuugacgcucucguguucaucauuggccugaucgccgauagaaaguuucagcauuucaaucccguucuugaaaccuacaucaaaaagcacuucagcgccacacuggcuuauaccaaacucacaaaggugcugaagaacuacgucgacggagccgagaaaccuggcgugaaugagcagcuguauaaggcuaugaaagcccuugaauccauuuuuaaguucaucgugcgcucucggauucucuuuaaccagcuguacgagaauaaaggggaagcggauuucgucgagagccugcuccaacuguuuagauccaucaacgacaugaugagcucuauguccgaucagaccguucgcgugaagggagccgcucuuaaguaucugccgacgauugugaaugacgucaaacucguguucgaucccaaggaacugagcaaaauguuuacagaguucauccugaacguuccuaugggccuucucaccauccagaagcuguacugccugauugagaucgugcauucugaccucuuuacacaacacgacuguagagaaauucugcuucccaugaugaccgaucagcugaaauaccaccucgagcggcaggaagaccuggaggccugcugucagcugcuuucccauauccuggagguccucuaucgcaaggauguggggccuacccaaagacacguucagauuaucauggaaaagcugcuccggacagugaaucgcacggucaucagcaugggaagagacucugagcugauuggcaacuucguggcuugcaugaccgccauccuucggcagauggaagauuaccauuaugcgcaccugauuaaaacauuugggaagaugcgcaccgacguuguggauuuccucauggagacauuuaucauguucaaaaaccugauuggcaagaaugucuaccccuucgacugggugaucaugaacauggugcagaauaaagucuuucugagagccauuaaccaauaugcugauaugcuuaauaagaaauuccuggaccaggccaacuuugaacuccagcuguggaauaacuacuuccaccucgcuguugccuuucugacccaggagagccuucaacuggagaauuucuccagcgccaagcgggcuaagauccucaacaaauauggagauaugcgcagacagaucggcuuugaaauucgggacaugugguacaaucuggggcagcauaagaucaaauucauuccggagauggugggaccuauccuggaaaugacgcuuauucccgagacagaacugagaaaggcgaccaucccuaucuuuuucgacaugaugcaaugugaguuucacucuacccgcuccuuccagauguucgagaacgaaauuaucacaaaacucgaucaugagguggaaggcgggcggggagacgagcaguacaagguccuguuugauaagauucuccuggaacacugcagaaaacauaaguaucuugccaaaaccggcgagacauucgugaagcugguugugcgccugauggagcggcuccuggacuacagaacgaucaugcacgaugaaaauaaagagaaccgcaugagcuguaccgucaaugugcuuaacuuuuauaaggaaauugagcgggaggaaauguacaucagauaucuguacaagcucugcgaccugcacaaagagugcgauaacuauacagaagcugccuacacccuccugcuucaugccaagcugcugaaaugguccgaggacguuuguguggcucaccucacacagcgcgauggguaccaagccaccacgcagggccagcugaaggaacagcuuuaucaagagaucauucauuacuucgacaaaggaaagaugugggaggaagcgaucgcucugggcaaggagcucgccgaacaguaugagaaugaaauguuugauuacgagcagcugucugagcuccugaaaaagcaggcccaauucuaugaaaacauugucaaagugauccggcccaagccugacuacuuugcugucggguauuacggacagggcuuccccaccuuucuuagagggaaaguguucauuuaccggggaaaggaguaugaacgcagagaggauuuugaagcccggcugcugacacaguucccgaaugcggagaagaugaaaaccacaagcccucccggcgacgacaucaagaacucccccgggcaguacauucaaugcuuuaccguuaaaccuaagcucgaucugccgcccaaauuccaccgcccugugucugagcagaucgucagcuucuauagagugaaugaaguucagcgguuugaguacuccagacccauccgcaagggcgaaaaaaacccugacaaugaguucgcuaacauguggauugagcggacaaucuauaccacggccuacaagcuucccggaauucugagaugguuugaagugaagucugucuucaugguggagaucagcccucucgaaaaugccauugagacaaugcaacugaccaacgauaaaaucaauuccauggugcagcagcaucucgacgaucccagccugccgaucaacccucuuucuaugcugcugaauggcauuguugaccccgcugucauggggggauuugccaacuaugaaaaggcuuucuuuaccgaucgcuaccuccaggagcacccugaggcccacgaaaaaaucgagaagcugaaagaccuuauugcguggcaaauccccuuccuggccgaaggcauucggauccauggggauaaggugacagaggcucucagaccguuucacgaacgcauggaggccuguuucaagcagcugaaagagaagguggaaaaagaguacggaguccggaucaugccuuccagccuggacgauagacgcggcucuagaccccgguccauggugcgcagcuuuaccaugccuucuuccagcagaccccucuccguugcuagcgugucuagccuuuccucugacagcacgcccucccggccuggcucugauggguucgcccuggaaccgcugcuccccaagaaaaugcauagccgcucccaggacaagcuggacaaggaugaccuugagaaagaaaagaaagauaagaaaaaggagaagagaaauucuaaacaccaggagauuuuugaaaaggaguucaaaccuacagacaucagccugcaacaguccgaagccgucauucucagcgagaccaucucuccccugcggccucagagacccaagucccaggugaugaacguuauuggaagcgagcgccgguucucuguguccccuagcuccccgucuagccaacagacacccccucccgucaccccuagagcuaaacuguccuuuagcaugcagucuucccucgaacuuaacggcaugacaggggcggauguggccgacguucccccgccucugccccugaagggaagcguggcugauuauggcaaucucauggagaaccaagaccugcuugggucucccaccccucccccuccgcccccucaccagcgccaucugcccccuccccucccgagcaaaacgccucccccucccccucccaagaccacacggaagcagaccuccgucgauucuggaaucgugcaguga

SEQ ID NO: 68488 - RNA, 5493 nt, Artificial Sequence
  derived and/or modified sequence opt5 from DOCK2__Homo_sapiens__NP_004937
auggcccccuggagaaaggcugacaaagagcggcacggcguggccaucuacaacuuccaggggagcggagcgccucaacugucccuccagauuggcgaugugguucgcauucaggaaaccugcggggacugguauagaggauaccugauuaagcauaaaaugcuucagggcaucuuuccgaagucuuucauucacaucaaagaggugacaguggaaaagcggcgcaauacggagaacaucauucccgcugaaaucccucuggcccaagaggucaccacaacccucugggagugggggagcauuuggaagcagcuguauguggccuccaaaaaggaaagauuucuucagguucagucuaugauguacgaucugauggaguggcggagccaacuccuguccggaacacugcccaaagacgaacucaaggagcugaaacagaaggugaccucuaagaucgauuauggcaauaaaauucuugagcuggaccucaucguccgcgaugaagacggcaacauucuggauccugacaauacaagcgugaucucccuuuuccaugcucacgaggaagccaccgauaagaucacggagagaauuaaagaagagaugagcaaggaccagcccgauuacgcuauguauucucggaucuccagcucuccuacccauucccuguacguuuuugugcgcaacuucgucuguagaauuggggaggacgccgaacucuuuaugagccuguacgacccgaauaaacagacagugaucucugagaacuaucuggugcgguggggaucccgcggcuuccccaaggaaauugagaugcucaauaaccugaaagucguuuuuaccgaucuugggaauaaggaccugaacagagauaagaucuaccucaucugccaaauugugcgggugggaaaaauggaccugaaggauacaggcgcgaaaaaguguacccaggggcuucgcagaccuuucggagucgccgugauggacaucacggauauuaucaaaggcaaggcugaaagcgacgaggagaagcagcacuuuauucccuuccacccuguuacagccgaaaaugauuuucugcauucccuccugggcaaagugaucgcuucuaagggggacagcggaggccaagggcugugggucaccaugaaaaugcucgugggagauaucauucagauccggaaggacuauccccaccugguugacagaacaaccguggucgcccgcaaacuuggcuucccggagauuaucaugccuggggaugugcggaacgacauuuacaucacccugcuccagggagauuucgacaaguauaauaagacaacgcagagaaacgucgaagugauuaugugcguuugugcggaggauggcaaaacccugcccaacgccaucugcgugggcgcuggggacaagccuaugaaugaauaccgcuccgucguguauuaccaaguuaaacagccccgguggauggagacagugaaggucgccgugcccaucgaggauaugcagagaauccaucuucgcuuuauguuccggcacagaagcucucuggaauccaaagacaagggagagaagaacuuugcuaugagcuacgugaaacucaugaaggaagauggcaccacacugcacgacggguuccaugaucugguuguccucaaaggagacucuaagaaaauggaggaugccagcgccuaucugacccuuccuuccuaccgccaccauguggagaauaagggcgcuacgcugucucggagcuccagcucugucgggggccucuccgucagcucuagagacguguuuuccaucagcacacugguuuguuccaccaaacugacccagaacgugggacuucucggccugcugaaguggcgcaugaagccgcaacuccugcaggaaaaucuugagaaacugaagauugucgacggggaagaggugguuaaauuccuccaggauacacuggacgcgcuguuuaacaucaugauggaacacucucagagcgaugaguaugacauucuuguguucgaugcccucaucuacaucauuggacugaucgcugaccggaaguuucaacauuucaauaccguccuggaggccuauauucagcagcacuuuuccgccacacucgcuuacaaaaagcugaugacggugcuuaagaccuaucuggauacaucuagcagaggcgaacagugcgagcccauccuccggacccugaaagcccuggaauacguuuucaaguuuauugugcgcuccagaacacuuuucagccaacucuacgaggggaaagaacagauggaguucgaggaaucuaugcggagacuguuugaguccaucaacaaucugaugaaaagccaguauaaaaccacgauccuccugcaagucgcggcucuuaaguacauuccuucugugcugcacgacguggaaauggucuucgaugccaagcuccugucccagcugcuuuaugaguuuuacaccuguauucccccuguuaaacuccagaagcagaaagugcaaagcaugaacgaaauugugcagucuaaucuguucaagaaacaggagugccgcgacauccugcuccccgucauuacaaaggagcugaaggaacuucuggagcagaaagaugacaugcaacaucaggugcucgaacggaaguauuguguugagcugcugaacagcauccuugaggugcuguccuaccaggaugccgcuuuuaccuaucaccauauccaggaaauuaugguccaacuccugagaacagugaaucgcaccguuaucacgaugggaagagaccacauucucaucagccacuucguggccugcaugacagcuauucugaaccagaugggcgaccagcauuacucuuuuuacaucgagaccuuccaaacauccagcgaacuugucgauuuucugauggagaccuucauuauguuuaaagaccucaucgggaagaauguguauccgggcgauuggauggccauguccaugguucagaaccggguguuccugcgcgcgaucaacaaauuugccgaaaccaugaaucagaaguuccuggagcacacaaacuucgaguuucagcuuuggaauaacuacuuccaucuggcugucgccuuuauuacgcaagacucucuccagcuggaacaguucagccacgcuaaauauaauaagauccucaacaaguacggagauaugagacggcugauuggcuuuuccauccgcgacaugugguauaaacuugggcagaauaagauuugcuucaucccuggaauggugggccccauccuggagaugacccucauuccugaagccgagcugagaaaagcgacaauccccaucuuuuucgauaugaugcugugugaauaccaacggucuggggacuuuaagaaauucgagaacgagaucauucuuaagcuggaucaugaaguggagggaggccgcggggacgaacaguauaugcagcuccuggagagcauccucauggaaugcgccgcugagcacccuaccaucgccaaguccgucgagaauuuuguuaaccuggugaaaggccuucuggaaaagcugcucgauuacagaggagugaugacagacgagucuaaagacaaucggaugagcuguaccgucaaccugcuuaauuucuacaaggauaacaaucgcgaagagauguauauuagauaccuguauaaacuccgggaccugcaccucgauugcgacaacuacacggaggcugccuauacacugcuucugcauaccuggcugcucaagugguccgaugaacagugugccagccaagugaugcagaccggccagcagcacccccaaacacauagacagcugaaggagacccuuuacgaaacaaucauuggguauuucgacaaaggaaagaugugggaggaagcuaucucucugugcaaagagcucgcggagcaguacgaaauggagauuuuugauuacgaacugcucucccaaaaccugauccagcaggccaaguucuaugagagcauuaugaaaauccuucgcccgaagccugacuacuuugcuguuggcuauuacgggcagggauuccccucuuuucugcggaauaagguguucaucuauagaggcaaagaauacgagcgccgggaggauuuucaaaugcagcugaugacgcaguuccccaacgccgaaaagaugaauaccacauccgccccuggggacgaugucaaaaacgcuccgggccaguauauucaauguuuuaccgugcagcccguucucgacgagcacccuagauucaagaauaaacccgugccugaucagaucauuaacuuuuacaagagcaauuacguccagcgcuuccauuauucucggcccgugagacgcggaacagucgacccugaaaacgaguuugccuccauguggaucgaacggaccagcuucgugacggcguacaagcugcccggcauucuuagaugguucgagguugugcacaugucccaaaccacaaucagcccgcuggagaaugcuaucgaaaccaugucuacagccaacgagaaaauucucaugaugaucaaucaguaucagagcgacgaaacccugccuauuaacccccucuccaugcugcuuaaugggaucgucgauccugccgugaugggaggcuuugcuaaguacgagaaagccuucuuuacagaggaauauguucgggaccaccccgaggaucaagacaagcugacccaucugaaagaucucauugcguggcagaucccguuccugggggcuggaaucaagauucacgaaaaacgcgugucugacaaccuuagaccuuuucaugaucggauggaggaaugcuucaagaaucugaagaugaaagucgagaaggaguacggcgugcgcgaaaugcccgacuuugaugacagacgggugggcagaccucgcagcaugcuccgguccuauagacagaugucuaucauuagccuggccuccaugaacucugauuguagcacgcccuccaaacccacaagcgagucuuucgaccuggaacucgccuccccuaagaccccgcgcguugagcaggaagaacccaucagcccugggucuacccuucccgaggucaaacugcggagauccaagaagcgcacaaaacggagcuccgugguguuugcugaugaaaaggccgcugccgagucugaccugaaaagacucagccgcaagcacgaguucauguccgacaccaaccugagcgagcacgcggccauuccucuuaaggcuucuguccugucccaaaugagcuuugccucucagagcaugcccacgaucccugcucucgcccuguccguggccggcauuccgggacuggaugaagcuaauacaucucccagacucagccagaccuuccuucagcuguccgacggggauaagaagacacugacccggaaaaagguuaaccaauuuuucaaaacaaugcucgcgucuaagagcgccgaggagggaaaacagaucccugacucccugagcaccgaucuuuga

SEQ ID NO: 68489 - RNA, 6093 nt, Artificial Sequence
  derived and/or modified sequence opt5 from DOCK3__Homo_sapiens__NP_004938
auguggacccccacagaggaagagaaguacggcguggucaucugcagcuucagaggguccguuccucagggacuggugcucgaaauuggcgagacggugcaaauccuggaaaaaugugaggggugguaucggggagucucuaccaagaaaccgaacgugaagggcauuuuucccgccaauuacauccaccuuaaaaaggcuauuguuagcaaccgcgggcaguaugagacaguggucccucuggaagacuccaucgugaccgagguuacagccacccuccaggaaugggcgucucuguggaagcagcuuuacgugaaacauaaggucgaucuguucuauaaacucagacacgugaugaaugagcugaucgaccugcggcgccaacuccugagcggacaucuuacacaggaucaggugagagaggucaagcggcacauuaccguucgccuggacuggggcaacgaacaucucggccuggaucuugugcccagaaaagacuuugagguggucgauuccgaccagaucucugugagcgaucuguacaagaugcaccucuccagccggcaaucuguucagcaguccacgagccagguggacaccaugcgcccuagacacggggaaacaugccggaugcccgucccucaucacuucuuucugucucugaaguccuucaccuauaauacaauuggagaggauaccgacguguuuuucagccucuacgauaugcgcgaaggcaaacaaaucucugagagauuucugguucggcuuaacaagaaugggggaccgcgcaaccccgagaaaauugaaagaaugugugcucuguucacggaccucuccagcaaggacaugaaacgggaucuguacaucguggcccaugucauuagaaucggccgcaugcuucugaaugacuccaagaaagggccuccccaccuccacuaucggagaccuuacggaugcgccgugcugucuauccuggauguccuccagagccugacagaggugaaggaagagaaggacuuuguucuuaaaguguauaccuguaacaaugaauccgaguggagccagauucaugagaacaucauucgcaagucuuccgcuaaauacagcgcccccucugcuagccacggccugaucauuucccuccaacugcuucggggcgauauggaacagaucagacgcgagaauccgaugaucuucaaccgggggcuggccauuacaagaaagcucggauuuccugacgucaucaugcccggcgauauucgcaaugaccuguaucugacccucgaaaaaggggauuucgagcggggaggcaagucugugcagaagaacaucgaaguuaccauguacgugcuguaugcggacggggagauucuuaaagauugcaucagccugggauccggcgagccuaacagaagcucuuaccauuccuucguccucuaccacagcaauucuccccgcuggggcgaaaucauuaagcugcccaucccuauugaccgguuuagagggucccaucugcgguucgaguuucgccacuguagcacaaaagacaagggagaaaaaaagcuuuucggcuuugccuucuccacgcucaugagagaugacgggaccacacugucugaugacauccacgagcuguauguguacaagugcgaugagaacagcaccuuuaauaaccaugcucucuaucugggacuuccguguugcaaagaagacuacaauggcugucccaacauuccuuccucucugaucuuccagcggagcacaaaggaguccuuuuucauuagcacccaacucucuuccacgaaacugacacagaauguggaucugcuugcccuccugaaguggaaagcuuuucccgacagaaucauggauguucuggggcgccuccggcacgucagcggcgaagagaucgugaaguuccugcaggacauucuugauacccuguuugugauccucgacgauaacaccgaaaaguauggacugcuggucuuccagucucuuguguucauuaucaaucuccugagagacauuaaauacuuucauuuccgcccuguuauggacacauauauccaaaagcacuuugccggcgcgcuggccuacaaagagcucaucagaugccugaagugguacauggauugcuccgcugagcuuauucggcaggaccacauccaggaagccaugcgcgcucuggaguaucucuucaaauuuauugugcagagcagaauccuguacucucgggccaccugugggauggaagaggaacaauuccgcagcuccauucaggagcuguuucagagcaucagauucguccuuucucucgauucccggaacagcgagacacugcuguuuacgcaggccgcucuccugaauuccuuccccaccaucuuugacgaacuucugcaaauguucacagugcaggagguugcggaauuugugcgcggaacccucggcucuaugccgagcacaguccauauugggcaguccauggaugugguuaagcugcaaucuaucgccagaaccguggacagccggcuguucuccuucucugagagccgcagaauucuucugccugucgugcuccaccauauccaccugcaucuccggcagcagaaagaacugcuuauuugcuccggaauccugggcagcaucuuuucuauugugaagacguccagccucgaggcugaugucauggaggaaguugagaugaugguggaaucucugcuggacgugcuucugcagacccuccugacaaucauguccaagagccacgcccaagaggccgucagagggcagcgcuguccccagugcaccgcugagauuacaggcgaauaugugucuugucuccugucccuucugcggcagaugugcgauacccacuuccaacaucuccuggacaacuuucagagcaaagaugagcugaaggaauuccuucugaaaaucuuuuguguuuucagaaaucucaugaagauguccguguuuccucgcgacuggauggucaugcggcugcucacgagcaacauuaucgugacaaccguucaguaccugucuagcgcccuucacaaaaauuucacagagaccgauuuugacuucaagguguggaacuccuauuuuucucuggcgguccuguucauuaaccagcccagccuccaacuggaaaucaucaccuccgcuaagagaaaaaagauucuugacaaauacggagauaugcgcgugaugauggccuaugagcuguucucuauguggcagaaucucggcgagcauaagauccacuuuauuccugggaugaucggacccuuccugggcguuacacucgugccgcagccugaaguccggaacauuaugauccccaucuuucaugacaugauggauugggagcaaagaaaaaaugggaacuucaagcagguggaagccgagcugauugacaagcuugauagcaugguguccgaaggaaaaggcgacgagucuuaccgcgagcuguuuagccugcucacgcagcuguucgggcccuacccuucccuucuggaaaaggucgagcaggaaaccuggcgggagacaggcaucagcuuuguuaccucugugacaagacucauggaacggcugcucgauuaucgcgacugcaugaaaggagaggagaccgaaaauaagaaaauuggcuguacggugaaccugaugaauuucuacaaguccgagaucaacaaggaagagauguauauuagauacauccacaaacuuugcgauaugcaccugcaagcugagaauuauacagaagccgcuuuuacccugcuccuguacugugagcuucugcagugggaagaccggccgcuccgcgaguuccugcauuaucccagccagaccgaauggcagagaaaggaggggcucugccggaaaaucauucacuacuuuaacaagggaaaaucuugggaguucggcaucccucugugcagagaacuugccugucaauacgagucccuguaugauuaccagagccuguccuggauucgcaagauggaagcgucuuauuacgacaauaucauggagcagcagcggcucgaacccgaguuuuucagagucggguucuauggacgcaaauuuccuuucuuucugcggaacaaggaguacgugugcagaggccaugacuaugaacgccuugaggccuuccaacagcggaugcugagcgaauuuccccaggcuguugccaugcagcacccuaaucaccccgaugacgcuauucuccaaugugaugcccaguaccugcagaucuacgcggugacaccgauuccugacuaugucgaugugcugcaaauggacagaguucccgaucgcgugaaguccuucuacagagucaacaaugugcggaaauuucgcuaugacagaccuuuccauaaggggcccaaagauaaggagaacgaauuuaaaagccucuggaucgagcggaccacacuuacgcugacccacucucugccgggcaucucccgcugguucgaggucgaaagacgggagcucguggaaguuagcccucuggagaacgccauucagguggucgagaauaagaaccaggaacuuagaucucugaucagccaguaccaacauaagcaggugcacggaaauauuaaccuccuguccaugugccugaauggcguuaucgacgcugccgugaacgggggaauugcucgcuaucaggaggccuuuuucgauaaagacuacaucaauaagcaucccggcgaugccgaaaaaaucacacagcucaaggagcuuaugcaagaacagguccacgugcugggggugggacuggcuguucacgagaaauuuguccauccugagaugcggccccuccacaagaagcugauugaccaguuccagaugaugagagcgucucuuuaucaugaauuccccggccuggacaaacucagcccugccuguuccggcaccucuacaccgcgcgggaacgugcuggcuagccacucccccaugagcccugagucuaucaagaugacccaccggcauucccccaugaaucugaugggaacgggcagacacagcuccucuagccucuccucucaugccagcuccgaagccgggaacauggugaugcuuggagauggcagcaugggggacgcuccugaggaucuguaccaccauaugcaacuggccuaccccaauccucgguaucagggaucugucaccaacguguccguucucagcucuucccaggcgagcccgucuagcuccucucugagcuccacacacagcgcucccucccaaaugauuaccucugccccuagcuccgcccgcggcucucccagccuuccugacaaauacagacacgcucgggaaaugaugcugcuccugcccacauaucgcgauagaccguccucugccauguacccugcggcuauccuggagaauggccagccccccaacuuucagcgggcccucuuccagcaaguggucggggccugcaagccuuguagcgaccccaaucuuuccguggcugagaaaggacauuauagccugcacuuugaugccuuccaucacccucugggcgacaccccgcccgcucucccugcccgcacacugagaaagucuccccuucacccuauucccgcguccccgaccagcccucagucugggcuggauggauccaacagcacgcucucuggcuccgccagcuccgggguuagcucucugagcgaauccaacuuuggacauucuagcgaggcucccccucggacagacaccauggauuccaugcccucucaggccuggaaugcugacgaagaucuggagccucccuaccucccggugcacuauagccuuuccgaaucugccguccuggacagcaucaaggcccagccuugccgcucccauagcgcucccggcugugugaucccccaagacccuauggauccgcccgcgcugccucccaaaccuuaccaccccagacucccugcccuggagcaugacgagggcguucuucugcgggaagagaccgaaagaccgcgcgggcuccaccggaaggcuccccugccucccggaucugccaaagaggagcaggccagaauggcuugggaacacggccgcggggagcaguga

SEQ ID NO: 68490 - RNA, 5901 nt, Artificial Sequence
  derived and/or modified sequence opt5 from DOCK4__Homo_sapiens__NP_055520
auguggauccccaccgagcacgaaaaguacggcguggucauugccagcuucagagggacaguuccuuauggacugucccucgagaucggcgacacggugcagauucuggaaaaaugcgaugggugguaccggggauuugcucuuaagaacccgaauaucaaaggcauuuuccccucuagcuaugugcaucugaagaacgccugugucaaaaauaaggggcaauuugagauggugaucccuaccgaagacuccguuaucacagagaugaccucuacacuccgcgauuggggaaccauguggaagcagcuguacgugagaaacgagggcgaccuuuuccaccggcuguggcauauuaugaaugaaauccucgaucugcgcagacagguccuggugggccaccucacacaugaccggaugaaagauguuaagcgccacauuaccgcgagacuggacugggggaacgagcagcuuggacuggaucucgugccccggaaagaauaugcuauggucgacccugaggauaucagcauuacggagcuguaccgccuuauggaacacagacaucggaagaaagacacccccgugcaagccuccucucaccaucuguuugugcagaugaagagccucaugugcuccaaucugggcgaggaacuggaggucaucuucagccucuuugauucuaaggaaaaccgcccuauuuccgagagauucuuucugcggcuuaaucgcaacgggcugccgaaagcccccgacaagccugagagacacuguagccucuucguugaccugggaucuuccgaacuucggaaagauaucuauaucacagugcacauuaucagaauuggccgcaugggggcuggagagaagaaaaaugccugcagcgugcaguaccggagacccuuuggcugugcuguccugucuaucgccgaccuccugaccggcgaaacaaaggaugaccugauucucaaaguguacaugugcaacaccgaguccgaaugguaucagauccaugagaauaucauuaagaagcugaacgcgcgcuacaaucuuacggggagcaacgccggacuggcuguuucccuccaacugcuucacggcgauaucgagcagauucggagagaauauucuagcguguucucccauggggucagcaucacacgcaaacugggauuuucuaacauuaucaugccuggcgagaugcggaaugaccucuacaucaccauugaaagaggggaguucgaaaagggaggcaaauccguggcccgcaacguugaggugacaauguucaucgucgauagcucuggccagacccugaaggacuuuauuagcuucggguccggagagcccccggcuucugaauaucacagcuuugugcuguaccauaauaacuccccucgguggagcgagcuccugaaacuucccaucccugucgauaaguucagaggcgcccacauucgcuuugaauuccggcacuguucuaccaaggagaaaggggagaagaaacuguuuggauucuccuuugugccccucaugcaggaagacggcagaacacugcccgaugggacgcaugagcugaucguucacaagugcgaagagaauaccaaccuucaagacacaacccgguaucucaaacugccuuucagcaagggcauuuuucugggaaauaacaaucaggcgaugaaggccacaaaagaaucuuucuguaucaccuccuuucucugcagcacgaagcugacacagaacggcgacaugcuugaucugcucaaauggcgcacccauccggacaagaucaccgggugucuguccaaacugaaggagauugauggaucugagaucgugaaguuccuucaagacacacucgauacccuguucggcauucuggacgaaaauagccagaaauacggguccaaggucuuugauucucucgugcacaucauuaaccugcuucaggacagcaaauuccaccauuuuaagcccguuauggauacauacaucgagucccacuucgcuggagcccuggcuuauagagaccucaucaaagugcugaagugguacgucgaucggauuacggaagccgagagacaggaacauauccaagaggugcugaaagcccaggaguauauuuuuaaguacaucgugcagagccgccggcuuuucucucucgcuaccggcgggcagaaugaagaggaauuuagaugcugcauucaagagcugcugauguccguucgcuucuuucucagccaggaaucuaagggcuccggagcgcugagccagucucaggccgucuuccuuagcuccuuuccugcuguguauagcgagcugcucaaacuguucgacgugagagaggucgccaaccuggugcaagauacacuuggcucucuccccaccauccugcacguugacgacucccugcaggccaucaagcuccaguguauugggaaaacaguggaaagccagcuguacaccaauccugauucccgguauauccuucugcccgucgugcuccaucaccugcacauucaucugcaagagcagaaggaccuuaucaugugcgcucgcauucugucuaacguuuuuugucucaucaaaaagaacagcuccgaaaagucugugcuggaggagaucgaugucauuguggccagccuccuggacauccuucugagaacgauucucgaaaucaccucccggccgcagccuucuagcuccgcgaugcgcuuccaauuccaggauguuacaggagaguuuguggcuugccugcugagccuucugagacagaugaccgaccggcacuaccagcaacuccuggauucuuucaauacaaaagaagagcuccgcgacuuucugcuucagauuuucaccgucuuuagaauccugauucggcccgaaauguucccuaaggauuggacggugaugcgccucguggccaacaaugucaucaucacaaccguucuguaccuguccgacgcccuuagaaaaaacuuucugaaugagaacuucgauuauaagauuugggacagcuacuuuuaucucgcugugaucuucauuaaucagcugugucuccagcuggagauguuuacacccucuaaaaagaagaaagugcuugaaaaguacggcgauaugcgggucaccauggggugcgagaucuucuccauguggcaaaaccugggagaacauaaacugcacuucauuccugcccucaucggccccuuucuggaggugacccuuaucccgcagccugaccugagaaauguuaugauucccaucuuccaugacaugauggauugggaacagcgccggagcgggaacuuuaagcagguggaggcuaaacucauugacaagcuggauucucucauguccgagggcaagggagacgaaacauauagagagcuguucaauagcauccuucugaaaaagauugaacgcgagacguggcgggaauccggcgucagccugaucgccaccgugacaagacucauggagcgccugcuugauuaccgggacuguaugaaaaugggggagguugauggaaagaaaaucggcugcaccgugucucugcucaacuuuuauaagacagaacugaauaaagaggaaauguacauuagauacauccacaagcucuaugaccugcaccuuaaggcgcaaaacuucaccgaggccgcuuacacgcugcugcucuaugaugagcugcuugaauggagcgaccgcccccugcgggaguuucucacauacccuaugcagaccgaauggcagagaaaagagcaucugcaccucaccauuauccaaaauuucgaucgggggaaguguugggaaaacggaauuauccugugccgcaaaauugccgagcaguaugaguccuacuaugacuacagaaaccuuucuaagaugcggaugauggaagcuagccuguacgacaaaaucauggaucagcagcgccuggagccggaauuuuucagagucggcuuuuaugggaagaaguuccccuuuuuccuccggaauaaagaguucguguguagaggccaugacuacgaacgccuggaggccuuucaacagcggaugcuuaacgaguucccucacgcgaucgccaugcagcacgcuaaucagcccgaugaaacaauuuuucaagccgaggcucaguaucugcagaucuacgccguuaccccuauucccgaaucccaggaggugcuccaaagagaaggagucccugacaacaucaagucuuucuauaaagugaaucauauuuggaaguuucgcuacgaucggcccuuccacaaaggcacaaaggacaaggagaacgaguuuaaaagccuguggguggaaagaacgucccuguaucucguccagucucuuccggggaucagccgcugguucgagguugaaaagcgggaggugguggagauguccccucuggaaaaugccaucgagguccuggaaaacaaaaaucagcagcucaagacccugauuagccaaugccagacaagacagaugcaaaacaucaauccccuuaccaugugccugaacggagugauugaugcugcgguuaauggcggggugucucgcuaccaggaggccuuuuucgucaaagaauacauccucucccauccugaggacggagagaagauugcuagacugcgggaacugaugcucgagcaggcccagauccuugaauuuggccuggccgugcacgagaaguucguuccccaagauaugcgcccgcugcauaaaaagcucguggaccaguuuuucgucaugaaaagcucucugggcauccaggaauucuccgcuuguaugcaggccagcccugugcacuuucccaacggguccccuagagucugccggaauucugcgcccgcuagcgugucccccgauggaacacgcguuauuccuagacggagcccgcuuucuuaucccgccgugaacagauacuccagcucuagccuguccucucaagccagcgcugaggucuccaacaucaccggccagucugagagcuccgacgaaguguucaauaugcagccuagccccucuacguccagccucuccucuacccacagcgccuccccuaacguuacaucuagcgcgcccuccagcgcucgcgccucuccucugcuguccgauaagcauaaacacagccgggagaauucuugucucuccccgagagaacgccccugcagcgccauuuauccuacccccguggagccuucucagcggaugcuuuuuaaccauaucggggacggagcucugcccagaagcgacccgaaucuguccgccccugaaaaggcugucaaccccacacccucuagcuggucccucgauagcggcaaggaggccaaaaauauguccgacucugggaagcugauuagcccucccgugccuccgcggcccacccaaacagcguccccugcccgccacaccacgucugugagccccuccccugcuggaagaucuccccuuaaaggcagcguucaguccuucacaccgagcccugucgaguaccacucucccggccugaucuccaacagcccugugcucucuggguccuauagcucuggaauuuccagccugucccgguguagcaccucugaaaccagcggcuuugagaaucaggugaacgaacaauccgccccccugccuguccccgugccgguuccugugcccucuuacgggggagaggagcccguccgcaaggaaagcaaaacaccuccgcccuauuccguguacgagagaacccuccggcgcccuguuccccuuccucauucucugagcauccccgugacguccgaaccuccggcucugcccccuaagccccucgccgccagaucuagccaccuggagaauggcgcucggcgcacagauccugggcccagaccgcggccucuucccagaaaagucucccagcuguga

SEQ ID NO: 68491 - RNA, 5613 nt, Artificial Sequence
  derived and/or modified sequence opt5 from DOCK5__Homo_sapiens__NP_079216
auggccagauggauccccaccaagcggcagaaauacggcguggcuauuuauaacuacaaugccagccaagacgucgagcugucccuccagaucggggauacaguucacauucuggaaauguaugagggaugguaccgcggcuauacgcuucagaacaagucuaaaaaggggaucuucccugaaaccuacauucaucugaaagaggcgacaguggaagaccucggacagcacgagaccgugaucccgggcgagcugccccuuguccaagaacugacaagcacccucagagagugggcugugaucuggcggaagcuguauguuaauaacaagcugacacucuuucgccagcugcagcagaugaccuacucccuuauugaauggagaucucaaauccugagcgggacgcucccuaaagaugagcuggccgagcuuaagaaaaaggugaccgccaaaauugaccauggaaaucggaugcugggccucgaucuggucgugcgcgacgauaacggcaauauccuggaccccgaugaaacauccaccauugcucucuucaaggcccacgagguugcuucuaagagaaucgaagagaaaauucaggaagagaagagcauccugcagaaccuugaccugcgggggcaguccaucuuuagcacaauucauaccuacggacucuaugugaauuucaaaaacuuugucugcaauaucggcgaggaugccgaacuguucauggcgcuuuacgacccugaucaaucuacguuuauuuccgagaacuaucugauccgcugggggagcaauggaaugcccaaggaaauugagaaacucaacaaucugcaggccguguucacagaccugucuuccauggaccucaucagaccucgggugagccuggucugucagaucguucgcgugggccacauggaacuuaaggaggggaaaaagcacaccugcggacugagacggccguuuggcguggcugucauggauauuacagacaucauucauggcaagguggaugacgaggaaaaacaacacuucauccccuuucagcagauugccauggagaccuacauccgccagagacaacucaucaugucuccucugauuaccucccauguuaucggggaaaacgagccccuuacaagcgugcugaacaaggucauugcugccaaagaagugaaucacaagggacagggccucuggguuucccugaaacugcucccuggggaucugacgcaggugcagaagaacuucucucaccuugucgaccggagcaccgcgaucgccagaaagaugggauuucccgagauuauccugccgggcgaugugcgcaaugacauuuaugucacacucauccauggggaguucgauaaaggaaagaaaaagaccccuaaaaacguggaaguuacaauguccgugcacgacgaggaaggcaagcugcuggagaaggcuauccaucccggcgccggguacgagggaauuagcgaauauaaaucugucguguacuaccaaguuaagcagccuuguugguaugagaccgugaaagucuccaucgcuauugaagaggugacgcggugccacaucagauucacauuucgccaucggagcucucaggaaaccagagauaagagcgagcgcgccuucggcguggccuuuguuaaacuuaugaaucccgacgggaccacacuccaggacggacggcacgaucuggucguguacaagggcgacaacaagaaaauggaggaugcuaaguucuaucugacccuccccgggacaaaaauggaaauggaggaaaaggagcugcaagcguccaaaaaucuugugacguuuaccccuucuaaggacagcacaaaagauuccuuccagauugccacccugaucuguagcacaaagcucacccagaacgucgaccugcugggccuucucaauuggagaucuaacucccagaauaucaagcacaaccugaaaaagcugauggaaguggauggaggcgagauuguuaaauuucuccaagacacgcuggaugcucuuuucaauaucaugauggagaugagcgacucugaaaccuacgauuuucugguguucgacgcccucgucuuuauuaucucccugauuggggauaucaaguuccagcauuuuaacccggugcuggagacauauaucuacaaacacuucagcgccacccuugcuuauguuaagcucuccaaggugcugaauuucuacgucgccaacgcggacgacucuagcaaaacagaacugcucuuugcugcccugaaggcccuuaaauaccuguuccgcuuuauuauccagucccgggugcucuaucugagauucuacggacaaucuaaggauggcgacgaguuuaacaauagcauucgccagcuguuccuugcuuuuaacaugcucauggaucggccccuggaagaggccguuaaaaucaagggggcugcccugaaguaucucccuuccauuaucaaugacgugaaacuggucuucgaucccguggagcuuagcgugcuguuuugcaaguucauccagucuauuccugacaaccagcucgucagacaaaaacugaauuguaugaccaagaucguugaauccacgcuguuucggcagagcgagugccgcgaagugcuucugccccuccugacagaucagcucucuggacagcuggacgauaacuccaauaaaccggaccaugaggcgagcucucaacuucugagcaacauucucgaggugcuggauagaaaggacgucggcgccaccgcugugcacauccagcugauuauggaacggcuucugagacgcaucaaucggacaguuauugggaugaacagacaguccccucacaucggcagcuucguggccuguaugaucgcucuccugcagcaaauggaugacucucauuacucccacuauauuagcaccuuuaagacccgccaggacaucauugauuuccucauggagacauucaucauguuuaaagaccugauuggaaagaaugucuacgccaaagauuggauggugaugaacaugacgcagaauagaguuuuccuucgggcgaucaaccaauuugccgaagugcugacccgcuucuuuauggaccaggcuuccuucgagcuccagcuguggaauaacuauuuucaucuggccgucgcuuuccuuacacacgaaucucugcagcucgagaccuuuagccaagccaagagaaacaaaaucgugaagaaauacggcgauaugcggaaggagauuggguuccgcaucagagacaugugguacaaucugggaccccauaagauuaaauuuaucccuuccaugguuggccccauucucgaagugacacugaccccugaggucgaacuucggaaggccacgauccccaucuucuucgauaugaugcagugcgaguuuaacuucucugggaauggaaacuuucacauguucgaaaaugagcugauuacaaaacuggaccaggagguggaaggcgggcgcggcgaugagcaguauaaggugcuccuggaaaaacuucugcucgagcacuguagaaagcauaaguaccugagcuccucuggagaagucuuugcucuccugguuagcucccuucuggagaaccugcucgacuaucggaccaucauuaugcaagaugagagcaaagaaaaucgcaugucuugcaccgugaacgugcugaauuucuacaaggagaaaaagagagaagacaucuauauucgguaccuuuauaaacugagagaccuccaccgcgauugcgagaacuacacagaggcggccuacacccugcuccugcaugcugaacuucugcagugguccgacaagccgugugucccucaccugcuccagaaggauagcuauuacguguauacacagcaagagcugaaagaaaagcuuuaccaggagaucauuucuuauuuugacaaaggcaagaugugggaaaaagccaucaagcuguccaaggagcucgccgagacguacgaaagcaaaguuuucgauuaugaggggcugggaaaucuccugaagaaacgggcuucuuuuuacgaaaacaucauuaaggccaugagaccccagcccgaguacuucgcggugggcuauuacgggcagggauuuccuuccuuccuucgcaauaaaaucuuuauuuaucggggcaaggaauacgagagacgcgaggacuucagccugcggcugcucacccaauucccgaacgcugaaaagaugacauccaccacacccccuggggaggauaucaaaagcucucccaagcaguauaugcagugcuuuaccgucaaaccugugaugagccugcccccuuccuacaaggacaaacccguuccggaacaaauucuuaauuauuacagagccaacgaggugcagcaguuccgcuacucucggccuuuuagaaagggcgaaaaagaucccgacaacgaguucgccacgauguggaucgagcggaccacauauaccacagcuuacaccuuuccuggaauccugaagugguucgaagucaagcagauuagcacagaggaaaucuccccccucgagaaugccauugagaccauggaacugacgaacgagcgcaucucuaauugugugcaacagcaugcgugggauagaagccuguccguccacccgcucucuaugcuucugagcggcauuguggacccugcuguuauggggggauuuuccaacuaugaaaaagccuucuuuacagagaaguaccugcaggaacaccccgaggaucaggagaaaguggaacuccugaagcggcuuaucgcccugcaaaugccucuccugaccgagggcauccgcauucauggggaaaaacugaccgagcagcucaagccccuucacgaaagacugagcucuugcuuccgggagcugaaggagaaagucgaaaagcauuauggagugaucacacuccccccuaaucugaccgagagaaaacagucccgcacgggcagcauuguucuuccguacaucaugucuuccacacugcggagacucagcauuaccuccgugacaucuagcgucguguccaccagcucuaacuccagcgacaaugcucccucucgcccuggcagcgacggguccauccuggaaccccugcucgagcggagagccucuagcggagcucgcguggaagaucuuucccugcgggaggagaacucugaaaauagaauuagcaaguuuaaacgcaaggacuggucccugagcaagucucagguuaucgccgagaaagcgccugaacccgaucucauguccccuacaagaaaggcccaacggccgaaaagccugcagcuuauggacaaccgccugucccccuuccacggcucuagcccuccccaguccaccccucucucucccccgccucugacgcccaaggcuaccagaacacugagcucccccagccuccaaaccgaugggaucgccgcuacaccuguccccccuccgcccccucccaaaucuaagccuuaugagggaucccagcggaauagcaccgagcuugcccccccgcugccugugcgcagagaagccaaggcucccccucccccucccccgaaagcgcggaagucuggcauuccuacguccgagcccgggagccaguga

SEQ ID NO: 68492 - RNA, 6144 nt, Artificial Sequence
  derived and/or modified sequence opt5 from DOCK6__Homo_sapiens__NP_065863
auggcugcuagcgaacggcgggccuucgcccacaagaucaacagaaccguggcugccgaagucagaaaacagguuucccgggagcgcucuggcagcccccauuccucuagacggugcagcuccucucugggggugccucucacagaaguggucgagccgcuggacuuugaagaugugcuucugagcagacccccugacgccgagcccggaccucucagagaucugguugaguuccccgcugacgaucuugaacugcuccugcaaccucgggagugucgcacgaccgaaccgggcauucccaaggacgagaaacuggaugcccaggugagagcugccgucgagauguacaucgaagacugggugauuguucaccggcgcuaucaguaccucuccgcggccuauagcccugugaccaccgauacacagagagagcggcaaaaggggcugccccgccaggucuuugaacaggacgcuucuggagaugagagauccggcccugaagacagcaaugauucucggagaggguccggaagccccgaggacaccccgcggucuuccggcgccagcuccaucuucgaccuucgcaaccuggcugccgauucucuccugccuagccuucuggagagagcggcccccgaagacguggaucgccggaaugagacacucagacgccagcaucggccucccgcucugcugacccucuaccccgccccugacgaagaugaggcuguggaaagaugcucccgcccggagcccccucgggagcacuuuggccaacgcauucuggucaaaugucuuagccugaaguucgaaaucgagaucgaacccauuuuugggauccucgcccuguaugacguucgcgagaagaaaaagauuucugaaaacuucuacuuugaucuuaauuccgacagcaugaaaggacugcuccgggcccauggcacgcacccugcuaucucuacccuggcgagaagcgccauuuucuccgugacauaucccucuccggauaucuuucuggugauuaagcucgagaaaguccugcagcagggggacaucagcgagugcugugaaccuuacauggugcuuaaggagguugauaccgcuaagaacaaagaaaagcuggagaaacuccggcuggccgccgagcaguucugcacacgccuuggaagauaccggaugcccuuugcuuggaccgccgugcaccuggcgaauaucgucuccagcgcuggccaacucgacagagacucugauuccgaaggggagcgccggccugccuggacggacagacgcagacggggaccccaggaucgcgccagcucuggcgacgaugcuuguuccuucagcggcuucagaccugccacacugaccgugacaaacuuuuucaagcaggaagcugagcggcuguccgacgaagaucucuuuaaauuccuggccgacaugcgcagacccucuagccuucugcggcgccucagaccgguuaccgcgcaacugaagauugauaucuccccugcccccgagaauccccauuuuugccugucuccugagcuucuccacauuaaaccguaucccgacccucgggggcgccccaccaaggaaauccuggaguucccugcuagagaaguguacgcgccccauacaagcuaucggaaccugcucuacgucuauccucacucccugaauuuuagcucuagacagggauccgugcgcaaccuugcuguccgggugcaguacaugacgggcgaggaucccagccaggcccugccgguuauuuucgggaagucuuccuguagcgaauuuaccagagaggcguucacaccuguggucuaucacaauaaaucucccgaguuuuacgaagaguucaagcuccaucugccugccugcgugaccgaaaaccaccaucugcuuuuuacauucuaccacguuagcugucaaccccgcccgggaaccgcucucgagacgccugugggcuucacauggaucccccugcugcagcaugggcggcucagaaccggaccuuuuugccugcccgucuccguggaccagcccccuccgagcuauucugugcuuacccccgauguugcccugccuggcaugcgcugggucgacggccacaaagggguguucuccguggaacucacagcugucagcuccgugcacccccaggacccuuaccuggauaaguuuuucacccugguucaugugcuugaggagggagccuuucccuuccggcucaaagacacaguccugucugaaggcaauguggagcaagaacugagagccagccucgcugcgcugcgccuugccuccccugagccgcugguugcuuuuucucaccaugugcucgauaagcugguccggcuggugaucagacccccuauuaucagcgggcagauuguuaaccuuggacggggcgccuucgaggccauggcucacguggucucccucgugcaccgcucucuggaagccgcgcaggacgcuagagggcauugcccccagcuggccgccuaugugcacuacgcuuuucggcucccuggcacggagcccagccugccggauggagccccucccgucaccguucaagcggcuacacuugcccgcggcuccgggagacccgccagccuguaucucgcucggucuaaguccaucuccucuagcaacccugaccuggccguggcucccggaagcguggaugacgaagucucucgcauucuggccuccaaacuucugcaugaggaacucgcgcugcagugggugguuagcuccagcgccgugcgcgaggcuauccuccagcacgccugguucuuuuuccagcugauggucaagucuauggcccuucaucugcuccugggccaacggcuggauaccccuagaaaacuucgcuuuccggggcgguuccuggacgauaucacagcccucgugggaagcguuggccuggaggugauuaccagaguccacaaggacguggaacucgccgagcaccugaaugcuucccuugcguucuuucugucugaucuccugagccugguugaccgcggguucguguuuucccuuguccgggcccauuacaaacagguggcuacgagacugcagucuagccccaacccugccgcccuccugacccuccgcauggaguucacaagaauccuguguucccacgagcauuaugugacccuuaaucugcccugcuguccucugucucccccggcuagcccuucccccagcgucucuuccacaaccagccaaucuuccacguuuagcucccaggccccugaccccaagguuacaucuauguucgaacucagcggcccuuuucggcagcagcacuuccuggcgggacuucugcucaccgagcuggcucucgcccuggagcccgaagccgagggcgcuuuucuucugcauaagaaagccauuuccgcggugcacagccugcucugcgggcacgauacagacccgcgcuacgcugaagccaccgugaaggccagagucgcugagcuguaccuuccucugcucucuaucgcccgggauacccugccccgccuccaugacuucgcugaaggacccggccaaagaucccggcuggccagcaugcuugauucugacacagagggggagggagauauugcgggcacgaucaacccuagcguggccauggcuauugccgggggcccgcuggcucccggauccagagccucuaucagccagggcccucccaccgccucccgcgcugggugugcgcugucugccgaaagcucccggacacuccuggcuugcguucuuugggugcugaaaaauaccgagccugcccuccugcagagaugggccacagaccucacccugccccagcuuggacgccugcuggaucuccuguaucuuugucuggcugccuuugaauacaagggcaaaaaggcguucgagcggaucaacagccucacguucaagaaaucucuggacaugaaggcuagacuggaggaagccauucucgggacaaucggagcccggcaagagaugguccgcagaucccgggaacgcagcccuuuuggcaauccggagaacgugagauggcggaaauccguuacccacuggaagcagaccucugaucgcguggacaaaacaaaggacgaaauggagcaugaggcucuugucgaagggaaucuggccaccgaggcgagccuggugguccucgauacacuggaaauuaucgugcagacgguuaugcuuuccgaggccagagaaucugugcugggcgcuguccucaaagugguucuguauagccugggauccgcccagagcgcucucuuccuucaacacggccuggccacccagcgggcucuggugucuaaguuucccgagcuccuguucgaggaagacacagagcuuugcgccgaucugugucuccgccugcugagacacugcgggucccggauuagcaccaucagaacacaugcgucugccucccucuaccuucugaugcgccagaacuuugaaaucggacacaauuucgcucgggucaagaugcaagugaccaugagccugucuagccucgugggcacgacccagaacuuuuccgaggaacaucugagacgcucucuuaaaacaauucugaccuaugccgaggaggacauggggcuccgggauagcacauucgcugaacagguucaggaccugauguuuaaucugcacaugauccucaccgauacagucaagaugaaagagcaucaagaagacccugagaugcuuauugaucugauguacagaaucgcccgcggauaucagggcucccccgaccugcggcucaccuggcugcagaacauggccggcaagcacgcugagcuugggaaucacgcggaagccgcucaguguauggugcaugccgccgcucugguggccgaguaccucgcgcugcuggaagaucacagacaucucccugucggaugcgugagcuuccaaaacauuuccucuaacguucuugaggaaagcgccaucuccgacgauauccugucucccgacgaggagggcuuuugcagcgggaaacacuucacggaacugggacucgugggccugcuugagcaggcugccggguacuuuacaaugggaggccuguaugaagcugucaaugagguguacaagaaccucauuccgauccuggaagcccaccgcgacuauaagaaacuggcggccguucauggcaagcuccaggaggcuuucaccaaaauuaugcaccaguccucugggugggagcggguguucggaaccuacuuuagagucggcuucuauggggcccauuuuggagaucuugacgaacaagaguucguguacaaggaaccuagcaucacaaaacuggcugagauuucccaccgccuggaagaguuuuauaccgagcgguucggcgaugacguuguggaaaucaucaaggauagcaaucccgucgacaagucuaaacucgauucccagaaggccuacauucagaucacguacguggagcccuauuuugacacauacgaacugaaagauagagugaccuauuucgaccgcaacuacgggcuuagaacauuucuguucuguaccccuuuuacacccgauggacgggcucauggcgagcucccugagcagcacaagcgcaaaacccugcugagcacggaccacgccuucccguauauuaagaccagaauccgggucugccauagagaagagacaguucucacccccguggaaguggcgauugaggauaugcaaaagaaaacacgggaacuugccuuugcuaccgagcaggacccucccgacgccaagaugcugcagaugguccugcaaggcucuguggggccuacgguuaaucagggaccccucgagguggcucaggucuuccuggccgaaaucccggaggauccuaaacuuuuccgccaccauaacaagcugagacucuguuuuaaagacuucugcaagaaaugugaagaugcccugcggaagaauaaggcgcugauuggccccgaccagaaagaguaccaccgcgaacucgagagaaacuauugccggcuucgcgaggcucugcaaccucugcucacacagagacugccccagcuuauggccccuacacccccggggcugagaaauucccucaaccgcgcuagcuuuagaaaggccgaucuguga

SEQ ID NO: 68493 - RNA, 6423 nt, Artificial Sequence
  derived and/or modified sequence opt5 from DOCK7__Homo_sapiens__XP_011540628
auggcugaacgccgggcuuucgcccagaagaucagccgcacaguggcggcugaaguccggaaacaaauuuccggccaauacucugggagcccccagcugcucaagaaccugaauaucguuggaaacauuucccaccauacaacggugccucuuaccgaggccguggaccccgucgaucuggaagacuaucucaucacacacccccuggccguggauucuggcccucuucgggaccugauugaguuucccccugaugacaucgaaguuguguacagcccccgcgauugcagaacccucgucuccgcugugccugaggagucugaaauggacccgcauguucgggauuguauccgcagcuauacagaggacugggccauugugaucagaaaauaccacaagcuggggaccggauucaaucccaacacacuggauaaacagaaggaacggcaaaagggccucccuaaacaggucuuugaguccgacgaggcucccgaugggaauagcuaucaggacgaccaggaugaccugaagcgcagaucuauguccauugaugacaccccucggggaagcugggccugcucuaucuucgaucuuaaaaacucccugcccgacgcgcuccugccgaaucuucuggaucgcacgccuaacgaagagauugacagacaaaaugaugaccagcgcaagagcaaccggcauaaagaacucuuugcccugcaccccucuccugaugaggaagaacccaucgagagacuguccgugcccgacauuccuaaggaacacuucggccagcggcuccuggugaagugucuuagccugaaauuugagaucgaaaucgagccgauuuucgcuucccucgcccuguacgacgucaaggagaagaagaaaaucucugagaauuuuuauuucgaucuuaacagcgagcagaugaagggccugcucagaccccauguuccucccgcugccauuaccacacuggcgcgcuccgccaucuuuagcauuaccuacccuucucaagacguguuccuggugaucaaacucgaaaagguccugcagcagggggauaucggagagugcgcugaacccuacaugauuuuuaaggaggccgacgcuaccaaaaauaaggaaaaacuugagaagcugaaaucccaagccgaucaguucugucagcggcucggcaaguauagaaugccguucgccuggaccgcuauccaccugaugaacauugugagcucugcggggagccuugagcgcgacuccacggaaguugagaucucuacaggagaacggaagggcagcugguccgagagacgcaauagcucuauuguggggcggagaucccuggagcgcaccacaagcggagaugacgccugcaaccucaccucuuuucggccugcuacccugacagucacgaacuucuuuaaacaggaaggcgauagacuguccgacgaggaucucuacaaguuccuggccgacaugcgccggcccagcuccgugcuuagacggcugcgcccuaucaccgcccaacucaaaaucgauauuucucccgcuccugaaaauccccauuauugucugacaccggagcugcuucagguuaagcucuacccugacagcagagugcggcccaccagagaaauccuggaguuucccgcccgcgacgucuaugugccuaacacaaccuaccggaaucugcucuauauuuacccgcagucccugaacuucgcgaauagacagggcucugcucgcaacaucacggucaaagugcaauuuauguacggggaggaucccagcaaugccaugccuguuauuuucggaaaguccagcugcucugaauuuuccaaggaggccuauacagcuguggucuaccacaacagaagccccgacuuccacgaagagaucaaagugaaacuuccugccacccugaccgaucaucaccaucuccuguuuacauucuaucacguuucuugucagcagaaacagaauacaccccuggaaacaccugugggcuacacguggauucccaugcuucaaaacgggcggcucaagaccggacaguuuugccugccggucucccuggagaaaccuccccaggcuuauagcgugcucucuccugaggugccccugccgggcaugaaguggguugacaaucauaagggggucuucaacguggaaguggucgccgugagcuccauccacacacaggauccuuaccuugacaaauucuuugcgcugguuaaugcccucgaugagcaccuguuccccgugcgcaucggagacaugagaauuauggaaaacaaucuggagaacgaacuuaagagcucuaucuccgcucucaacagcucccaacuggagccugucgugcgguuucugcaucuccugcuugauaaacugauucuccugguuaucagaccgcccgugauugccggccagaucgucaaucugggccaggcuucuuucgaggccauggcgagcaucauuaacagacuucacaagaaucucgaagggaaccaugaccaacacggaagaaauagccugcuggccucuuauauccacuacguguuucgccucccuaacaccuacccgaauagcuccucucccggcccugggggacugggcgggagcguucauuaugcuacaauggccagauccgcugugcggcccgccagccuuaaccugaaucgcucuagaucccucagcaacucuaauccugauauuuccggcacccccacgagcccugacgaugagguccggucuaucauuggauccaaaggccuggacagaagcaacuccugggugaauaccgggggaccgaaggccgcucccuggggcagcaacccuucucccagcgcggaauccacacaggccauggaccgcucuuguaaucggaugagcucccacaccgagacaucuagcuuccugcagacccuuacggggagacugccuaccaaaaagcucuuucaugaggaacuggcucuccaguggguggucugcuccggaucuguucgcgagagcgcccugcaacaggccugguucuuuuucgaacuuauggugaaguccauggugcaccaucuguacuuuaacgauaaacucgaggcuccccggaaguccagauucccggaacgcuuuauggacgauaucgccgcgcuggucucuaccaucgcuuccgacauugugagccgguuccagaaagauacagagaugguugagagacugaacaccucucuugccuucuuucugaaugaccuccuguccgugauggaucgcggcuucgucuuuagccucaucaaguccugcuauaaacaggugucuagcaagcuguacucccuuccuaaccccagcguucuggugucucuccggcuggacuuccugagaauuaucuguucccacgaacacuaugucacccuuaaucugcccugcagccuccugacaccucccgccucuccuagcccguccgugucuagcgcuacgucccaaucuagcggguuuuccaccaacguucaggaucagaagauugccaauauguucgagcucagcgugcccuuucggcagcaacauuaccuggcgggccuuguccugacagaacuggcugugauccucgacccugaugccgagggacuguucggccuucacaaaaaggugaucaacaugguccauaaucugcucucuucccacgacagcgacccccgcuauuccgauccucagauuaaagccagaguugcuaugcuguaccucccccugaucgggauuaucauggaaaccgugccgcagcuuuacgacuuuacagagacccauaaccaacggggacgcccuauuuguaucgccacggaugacuaugagucugaaagcggcuccaugauuucucagacaguggcuauggccaucgcggggaccagcgucccccagcugaccagaccuggauccuuccugcucacaagcaccucuggccggcagcacacaacguuuuccgccgagagcucuagaucccugcuuaucugccugcucugggugcugaagaaugcugaugaaaccguucuccaaaaaugguucacagaccugagcgugcuucagcugaaccgccugcucgaucugcuuuaccugugugucucuugcuucgaguauaaggggaagaaaguguuugaacggaugaauagccucaccuucaagaaauccaaggacaugagagccaaacuggaggaggcuauucucggcucuaucggagcccgccaggaaaugguucggagaagccgcggccagcuggggacauacaccauugccagcccucccgagcggagccccuccggaucugcuuuuggcagccaagaaaaccuuagauggcgcaaggauaugacgcacuggagacagaauaccgagaagcuggacaaaucccgggcggagaucgaacaugaggcccugauugaugggaaccucgcuacagaagccaaucugaucauccuugacacccuggagauugugguccagacagugucugucaccgaaagcaaggaguccauccucggaggcgugcugaaaguucugcuccacucuauggccuguaaccagagcgcuguguaucuucaacauugcuucgccacacagcgcgcgcuggucuccaaguuuccggagcuccuguucgaagaggaaaccgagcagugugcugaucugugccuuagacugcuccggcacuguuccucuuccauugggacgauccgcagccacgccucugccucccuguaccugcucaugagacagaacuuugaaauuggcaauaacuucgcucgggugaaaaugcaaguuacaaugagccuuucuucccuggugggaaccagccagaauuuuaacgaggaguuccugagacgcucccucaagaccauccugacauaugccgaagaggaccuugaacugcgggagaccacguuuccugaccagguccaagaucucguguucaaucugcauaugauccugagcgacacagugaaaaugaaggaacaccaggaggaucccgagaugcucauugaccuuauguacagaaucgcgaagggcuaccagaccucucccgaucugcgccugacauggcuccagaacauggcugggaaacauagcgaacgguccaaucacgccgaggccgcucaaugccugguucauucugccgcucuugucgccgaauaucugagcaugcucgaggacagaaaguaccugccugugggaugcgugaccuuucagaacauuuccucuaauguccuggaggaaagcgcgguguccgaugacguugugucuccggaugaggaaggcaucuguagcgggaaauauuucacagaguccggacucgucggccuucuggaacaggccgcugccagcuucucuauggcuggcauguacgaggccgugaacgagguuuauaaggugcugauucccauccacgaagccaaucgggacgcuaaaaagcucuccaccauucacgggaagcugcaggaggcguuuagcaaaaucguccaucaaucuacgggaugggaacgcauguucggcaccuacuuuagagugggguucuauggaacaaaguuuggcgaucuugacgagcaggaguucguuuacaaagagccugccaucaccaagcuggcugagauuucccaccggcucgaaggguuuuacggagagcgcuucggcgaagauguggucgaggugaucaaagacagcaaccccguggacaagugcaagcuggauccuaauaaagccuauauucagaucacauacgucgaacccuauuuugacaccuacgagaugaaggauagaauuacguauuucgacaaaaacuacaaucugcggcgcuuuauguauuguacaccuuucacccucgauggcagagcccauggggagcuucacgaacaguuuaagcggaaaacaauccugaccaccucccacgcuuucccguacaucaagacacgcguuaacgugacgcauaaggaggaaauuauccugacccccauugagguggccaucgaggacaugcagaaaaagacacaggaacucgcguucgcuacccaccaggauccugccgaccccaaaaugcugcaaaugguccuucagggaucugugggcacaaccguuaaucaggggccucuggagguggcccaggucuuucucagcgaaauucccuccgauccgaagcuguucagacaucacaacaaacugcggcucugcuuuaaggacuucacgaagagaugugaggaugcccuucgcaaaaacaagagccugaucggaccugaccaaaaagaauaccagcgggagcuggagagaaauuaucaucgccucaaggaagcccugcagccccuuaucaaccggaaaauuccccagcuguacaaggcggugcucccuguuacaugccacagagacucuuuuucccgcaugagccugcggaaaauggaucuguga

SEQ ID NO: 68494 - RNA, 6300 nt, Artificial Sequence
  derived and/or modified sequence opt5 from DOCK8__Homo_sapiens__NP_982272
auggccacccugcccagcgcugaaagacgggccuucgcccucaagaucaacagauacuccucugcugaaauuagaaagcaguuuacacugccuccgaaucuuggccaauaucaccggcagagcaucuccacgucuggguuccccagccugcagcucccucaguuuuacgaccccguggaaccuguggauuucgaaggacugcuuaugacccaucugaacucccucgacguucaacuggcccaggagcugggcgauuuuacagacgaugaccucgaugugguguucacccccaaggaaugccgcacacugcagccuucucuuccggaggaggggguggaacuggacccccacgugagagauuguguucagaccuauauucgggaguggcucaucgugaaucgcaaaaaccaaggaagcccugaaauuugcggcuuuaagaaaacaggguccagaaaggacuuccauaagacccugcccaaacagacguuugagagcgagacccuugaauguucugagccugccgcucaggccggaccccggcaccugaauguccucugcgauguguccggcaagggcccgguuacagcuugugacuucgaucugcgcagccugcagccugacaaaagacucgaaaaccugcuucaacaggugucugccgaggacuuugaaaagcagaaugaggaggcgcggcgcaccaacagacaagccgaacuguucgcucucuaccccuccgucgaugaggaagacgccguggagauccggccugugcccgaaugccccaaagagcaucuggggaaucgcauccuugucaagcugcucacacugaaguuugagauugaaaucgagccucuguucgcuagcauugcccucuaugauguuaaagaaagaaagaaaaucucugagaacuuccacugugaccucaauuccgaucaguuuaagggauuccuucgggcgcacaccccgagcguggccgcuuccucucaggccagaagcgcuguguuuuccgucacguaccccagcucugacauuuaucuggugguuaaaaucgaaaaggugcuccagcaaggcgagauuggggauugcgccgagccuuacacagucaucaaagaauccgacggaggcaagagcaaggagaaaaucgaaaagcugaaacuucaggccgagucuuucugucagcgccuggggaaguaccggaugcccuuugcuugggcgccuauuagccucuccucuuucuuuaacgugagcacccuggagagagaaguuacagauguggacuccgucgugggacgcagcucugucggcgagcggagaacccuggcccagucccgccggcucagcgaaagagcucugucucuugaggaaaauggcgugggguccaacuucaaaaccagcacacuguccguuucuagcuuuuucaagcaagagggagaucgccucuccgacgaggaccuguuuaaguuccuggccgauuauaaacggucuagcucccuucagagacgcgucaagagcauccccggccuccugcggcuggaaauuucuacggccccggagaucauuaauugcugucucaccccugaaaugcugcccgucaaaccuuuucccgagaacagaacacggccucauaaggaaauccuugaguuccccacccgcgagguguacguuccgcacacaguguauagaaaccugcucuacgucuauccucagcggcugaauuucgugaacaaacuggcuuccgccagaaauaucaccauuaagauccaguuuaugugcggggaagacgcgagcaacgcuaugcccgugauuuucggaaagucuuccggccccgaguuucuucaagaaguuuacacggccgucacauaucauaauaaaagcccugauuucuacgaggaagugaagaucaaacucccggccaagcugaccgugaaccaccaucugcuguuuaccuucuaccacauuucuugccagcagaaacagggggcuagcgucgagacacugcuuggauauuccuggcugcccauccuccugaaugagcgccugcaaaccggcagcuacugucuuccuguggcccucgaaaagcugcccccuaacuauucuaugcacuccgcugagaagguuccccugcagaauccucccaucaaaugggccgaaggccauaaggggguguuuaacauugagguccaggcggugagcuccguucacacacaagacaaucaucucgagaaauucuuuacgcugugccacucucuugaaagccaggugaccuucccgauccggguccuggaucagaagauuuccgagauggcccucgaacacgagcugaaacugucuaucauuugucuuaacagcuccagacucgaaccucuggugcuguuucuccaucugguucuugacaagcuguuccagcucucugugcaacccauggucaucgcuggacagacagccaauuuuagccaguucgcuuucgaguccgugguggccauugcgaacagccugcacaauucuaaagaucuguccaaggaccagcauggccgcaacugccuucuggccagcuacguccacuauguuuuuagacucccugaggugcaacgggaugugcccaagucuggggcuccgaccgcccugcucgacccucgcuccuaccacacauauggaagaaccagcgcugccgccgucucuuccaaacugcuucaggcucgggugaugagcuccagcaaccccgaucuggcgggcacgcauucugccgcugacgaagagguuaagaauaucaugagcuccaaaaucgccgaucgcaacuguucuagaaugagcuacuacugcuccgggucuagcgacgccccuuccucucccgcugcgccccggccugcgagcaagaaacacuuccaugaagaacucgcucugcagaugguggucuccaccggcauggugcgcgaaacaguuuuuaaguaugccugguucuuuuucgagcugcuugucaagagcauggcccagcacguccauaauauggacaaaagagauucuuuucggcgcaccagauucuccgaccgguuuauggaugacauuacaaccaucgugaacguugugacgagcgagauugcugcccugcucgucaagccgcaaaaagaaaaugagcaggcggaaaagaugaacaucucucuggcuuucuuucucuacgaucugcuuucccugauggacagaggauucguguucaaucucauucgccacuauuguagccagcuguccgccaaacugucuaaccuucccacacugaucagcaugcggcucgaguuucugagaauccucugcucccacgaacauuaccugaaucuuaaccuguucuuuaugaaugccgauaccgcuccuacaagccccuguccuucuauuuccagccaaaacucuagcuccugcucuagcuuccaggaccagaagaucgccuccauguuugaucugaccucugaguaucgccagcaacacuuccucaccggccugcuuuuuacagagcuggcugccgcgcucgacgccgaaggggagggaauuagcaaggugcagcggaaagcugucuccgccauccauagccugcucucuucccacgaucuggaccccagauguguuaagccugaagugaaagugaagauugcugcccuuuaccugccgcuggucggcaucauccucgaugcccugccccagcuuugcgacuucacgguggcugacacccgccgguauagaacaagcggguccgaugaggagcaggaaggagcgggcgccauuaaucaaaacguugcucuggccaucgccgggaauaacuuuaaccucaaaaccucuggcauugugcugagcucccucccuuacaagcaguacaauaugcugaacgcugacacaacccgcaaucuuaugaucugcuuccuguggauuaugaagaacgccgaucagucucugauccggaaauggaucgcggaccuccccagcacgcagcugaaucgcauucuugaucugcucuuuaucuguguccugugcuucgaguauaagggaaaacaauccagcgacaaggugucuacacagguucuccagaaaucccgggaugugaaggcucgccuggaagaggcccuucugagaggcgaaggggcccggggagagaugaugcgcagacgggcuccuggcaacgacagauuucccgggcugaaugagaaccuccgcuggaaaaaggaacagacccauuggcggcaagccaaugagaagcuggauaaaaccaaggcggaacuugaccaggaggcucugauuagcggaaaccucgccacagaagcccaccugaucauucuggauaugcaggagaauaucauucaggcuucuuccgcccucgacuguaaagacagccuucugggcgggguccugagagugcucgucaacucucugaauugcgaucagagcaccacauaccuuacgcacuguuucgcuacccugcgcgcccucaucgcgaaguucggcgaccugcuguuugaggaagagguggaacagugcuucgaucucugucaucagguucuucaccauugcuccucuagcauggacgugacacggucccaagccugugcuacccuguaucugcucaugagauuuagcuucggagccacauccaacuuugcucgcgucaaaaugcaagugaccaugucucuggccagccuuguuggccgggccccggauuucaaugaggaacaccugagacgcucccucagaacgauccuggcuuacucugaggaggacaccgcgaugcagaugacaccuuuucccacccagguggaagaacugcucugcaaccuuaacagcauucuguaugauacagucaagaugcgggaguuccaagaggaccccgagaugcugauggaucucauguaccgcaucgccaaguccuaucaggcuucuccugaccugagacuuaccuggcugcagaauauggccgaaaaacacacaaagaaaaaguguuacaccgaggccgcuaugugccucgugcaugccgcggcucugguggccgaauaccugagcaugcucgaggaucacuccuaucuucccguugggagcgucucuuuucagaacauuuccagcaaugugcuggaagagucuguggucuccgaggacacgcugagcccugaugaagacggagugugcgccggccaauacuucacagagucugggcucguuggacugcuugaacaggcugccgagcuguuuuccaccggcgggcucuaugaaaccgugaacgaggucuacaaacuggugaucccgauucuggaggcgcaucgggaguuccgcaagcucacacuuacccacagcaagcugcagagagccuuugacuccaucguuaauaaagaucauaagcggauguucggcacguauuucagagugggauuuuucggcagcaaauuuggggaccuggaugagcaagaguucgucuacaaggagcccgcuaucacaaaacucccugaaauuucucaccgccuggaggccuuuuauggacaguguuucggcgcugaguuuguggaaguuaucaaggacagcacccccguggauaagacaaaacuugacccuaacaaggccuacauucagaucaccuucgucgagcccuacuuugaugaauaugagaugaaagaccgggugacauacuucgagaagaauuuuaaccugagacgcuucauguauaccacgccguuuacccucgaagggcggccuagaggagagcugcacgaacaguaccggcgcaauacagugcugaccacaaugcaugcuuuccccuauauuaaaaccagaaucuccgucauccaaaaggaggaguucguucucacgccuauugagguggccaucgaggauaugaagaaaaagacacuucagcuggcgguggccauuaaccaggaacccccugacgcuaaaaugcugcagaugguccuccaaggcucugugggcgccaccguuaaucaggggccccuggagguggcucaggucuuucuugccgaaaucccggccgauccuaagcuguaccggcaccauaacaaacuccgccugugcuucaaggaguuuauuaugagauguggagaagcuguggagaaaaauaagcggcugaucacagcggaccagcgcgaguaucaacaggaacucaagaaaaacuacaauaaacuuaaagagaaccugagacccaugauugaacggaagauccccgagcuguacaaaccuaucuuccgcguugaaagccagaagagagauuccuuucaccggucuagcuucagaaagugcgagacccagcucucccaaggcucuuga

SEQ ID NO: 68495 - RNA, 6207 nt, Artificial Sequence
  derived and/or modified sequence opt5 from DOCK9__Homo_sapiens__NP_001123520
augcaggccgacaagugcagaaccagcucccggucugugaaaaaggagcuggucaucgaaagcccccuccaauacaaagaugcugcccagggcgagguugaagcggaguccccugggccggugcccgcuaagccuaaacugauugaaccccuugacuaugagaacgugaucguccagaagaagacacagauucugaaugauugucuccgcgagaugcugcuuuucccuuacgacgauuuucaaacggccauccugagacggcagggacgcuauauuugcucuaccgugcccgccaaagcugaagaggaagcccagagccucuucguuacagaguguaucaagaccuacaacuccgacuggcaccuggugaauuauaaauacgaggauuauucuggcgaauuuagacagcugccuaacaaggucgugaaacucgacaagcugccgguucauguguacgaggucgaugaagagguggacaaggaugaagacgcugccagccuugggucccaaaaaggaggcaucacaaagcacggguggcuguacaaaggaaauaugaacagcgcgauuucugugaccaugcgguccuucaagcgcagauuuuuccaucucauccagcugggcgauggcagcuauaaucuuaacuuuuacaaagacgagaagauuucuaaagagcccaagggguccaucuuccuggacagcugcaugggagucguucagaauaacaaggugcggcgcuuugccuucgaacucaaaaugcaggauaagucuuccuaucugcuggcugccgacagcgagguggaaauggaggaauggauuacaauccucaauaaaauucugcaacuuaacuuugaggcugccaugcaggagaagagaaauggcgauucccacgaagacgaugagcagucuaaacuggaagggagcggauccggccucgacagcuaccugccugagcuugcgaagucugcccgggaagcugagaucaagcugaaauccgagagccgcgucaagcucuucuaucuggaucccgacgcccaaaaacuggauuuuucuagcgcugaaccugaggugaaguccuucgaagagaaauucgggaagagaauccucguuaaguguaacgaccugucuuuuaaucuucagugcuguguggccgagaacgaagagggacccaccacgaacgucgaaccguucuuugugacccugagccucuucgauauuaaauacaaucggaagaucuccgccgacuuucauguugaccugaaccacuucagcgugcgccagaugcuugcuacaaccucuccugcgcugaugaauggcuccggccagagccccucuguccucaaagggauucugcacgaggccgcuaugcaauauccuaagcagggaaucuuuuccgugacaugcccccaucccgauauuuuccuggucgccagaaucgaaaaagugcuccagggcagcaucacccacugugccgagccuuacaugaaguccucugacagcuccaagguugcucagaaagugcugaagaacgccaaacaagcgugccagcggcuugggcaguacagaaugccguuugcuugggccgcccgcacgcuguucaaggaugcuucuggaaaucucgacaaaaacgcccgguuuagcgcuauuuauagacaggauuccaauaagcugagcaacgacgauaugcugaaacuucucgccgacuuccgcaagcccgagaagauggcgaaacugccugucauccugggcaaucucgauauuacaaucgacaacgugucuuccgauuuucccaauuacguuaacagcucuuauauuccuaccaagcaauucgaaacauguuccaaaacccccaucaccuucgagguggaagaguuugucccgugcaucccuaagcauacacagcccuacacgauuuauaccaaucaccuguacguguauccuaaauaccuuaaguacgacagccagaagucuuucgccaaagcucggaacaucgccauuugcaucgaauuuaaggauagcgacgaggaggacucccagccccugaaauguauuuaugggagaccuggaggccccguguucacacgcagcgcuuuugccgcgguucuccaccaucaccaaaauccggaauucuacgaugagaucaagauugaacugccuacccagcugcaugagaaacaccaucuucuccugacauuuuuccacgucucuugcgacaacuccagcaagggcuccaccaagaaacgggaugugguggaaacgcaggucggguauucuuggcugccccuccugaaggacggaagagugguuacaagcgagcaacacauccccguguccgccaaccuuccuucuggcuaccugggguaucaggagcucggaaugggccgccauuacgggccggaaaucaaaugggucgauggcggaaagccccugcugaaaauuagcacccaccuuguguccaccguuuauacacaggaccagcaucuccacaauuuuuuccaauacugucagaagaccgagucuggcgcucaggcccuggggaacgaacuggugaaguaccucaaaagccugcacgcuauggagggacaugucaugaucgccuuucuuccuacaauucugaaucagcucuuccgggugcugacgagagccacccaagaggaaguugcugugaacgucacacgcgugaucauucacguggucgcgcagugccaugaggaaggccuggagucccaccuucggagcuauguuaaguacgccuauaaagcugaacccuacguggccucugaguauaagaccgugcaugaggaacucacaaaauccaugaccacgauccugaagccuagcgccgauuuucugaccucuaauaaacuccugaaguacuccugguucuucuuugacguccuuaucaagagcauggcucagcaccugauugagaacucuaaagugaagcuccugagaaaucagcgguuccccgccuccuaucaccaugcgguugaaacaguggucaacaugcugaugccucacaucacccaaaaauuucgcgauaaucccgaggcuagcaagaacgccaaucauucccuugccguguucauuaaaagauguuuuacauucauggaccggggguuuguuuucaagcagaucaacaauuacauuagcugcuuugcuccgggagauccuaagacccuguucgaauacaaauuugaguuccucagaguggucuguaaccacgagcauuauaucccccugaaucucccuaugcccuucggcaaggggcgcauccagcgguaccaagaccugcagcuugauuauucucugacggacgaauuuugcagaaaccacuuccucgugggccugcugcuucgcgagguuggaacagcccugcaggaauuuagagaggugcggcucauugcgaucagcguccugaaaaaccuccugauuaagcacuccuucgacgaucgcuacgcuucuagaagccaucaggcccggaucgccacccuuuaucugccgcucuuuggccugcugauugaaaaugugcaacgcaucaacgugagagacgucuccccuuuccccguuaaugcugggaugacagugaaagaugagucucuugcccugccugcugugaacccccucgucaccccccagaagggaagcacccuggacaauucccuccacaaggaucugcuuggcgccaucucugggauugcgagcccuuacacaacguccaccccgaacaucaauagcgugcggaacgccgacucucgcggaucccugauuagcacagauucuggcaauucccugcccgagagaaacagcgaaaaauccaauucucucgacaagcaucagcagagcuccacccuggggaacagcguugugcggugugauaaacuugaccaaucugagaucaagucccugcucaugugcuuucuguauauucucaaaagcaugucugaugacgcucuguucacauacuggaauaaggccagcaccuccgaacuuauggacuuuuucacgaucucugaggucugucugcaccaguuucaguacaugggcaagcgcuauauugcuagaacaggaaugaugcacgcccggcugcagcaacucggcagccuggauaacucccuuaccuucaaucauucuuacgggcacagcgacgccgaugugcugcaucagucccuccuggaggcuaacaucgcgaccgaaguuugccucacagcccuggacacccuuagccuguuuacacuggcuuucaaaaaccagcuccuggccgaucacggacauaauccucuuaugaagaaaguguucgacgucuaucugugcuuucuccagaagcaccaaucugagacggcccugaaaaacguguucaccgcucucagaucccugaucuacaaguuucccagcacauucuaugaaggccgcgccgauaugugugcggcucuuugcuacgagauucugaaguguugcaauuccaaacugucuagcauccggaccgaagccucccagcuccuguauuuucuuaugagaaacaauuucgacuacacagggaagaaaucuuuuguccgcacccaccugcaggugauuaucagcguuucccaacucauugccgauguggucggaaucggcgggacgcgguuccagcagagccugucuaucauuaacaauugugcuaacuccgacagacugaucaagcauaccagcuuuucuuccgaugugaaagaccucacaaagcgcauucggaccguucuuauggccacagcgcagaugaaagagcacgagaaugauccugaaaugcugguggaccugcaauacagccucgcuaagucuuaugccagcacccccgagcugagaaagacauggcuugacuccauggcccgcauccaugucaaaaacggcgaucugucugaagcugccaugugcuacgugcacgugaccgcucucguugccgaguaucugacgcggaaggaagcgguccagugggagccuccgcugcucccccacagccauuccgccugucuuagacggagccgcggaggcguguucagacaggggugcacagcuuuucgggugauuaccccuaauaucgacgaggaagccuccaugauggaggaugucggaaugcaggacgugcacuucaacgaagauguucugauggagcugcucgaacaaugugcugacggccuguggaaagccgagcgcuacgagcuuaucgccgauauuuauaagcugaucauucccaucuacgaaaaaagacgggacuuugagagacucgcucaucuguaugauacccugcaccgcgcguacucuaaggugacagaagucaugcauagcgggcggagacuccuuggaaccuacuuccgcguggccuucuuuggccaggcugcccaguaucaguucacggacuccgagacagauguugagggcuuuuucgaagacgaggaugggaaggaauacauuuauaaagagccuaagcugaccccccugucugaaaucagccaacggcuccugaaacuuuacuccgacaaguuuggaucugagaaugugaaaaugauucaggacagcggcaaggucaacccgaaggaucuggacuccaaauaugccuacauccaggugacacacguuaucccuuucuuugaugagaaggaacuccaagagagaaaaaccgaauucgagcgcagccacaauauucggagauuuauguucgaaaugcccuuuacacagaccgggaagcgccagggaggcguggaggagcagugcaaaagacggacgauccugaccgcuauucauuguuuccccuaugucaagaagcgcaucccugugauguaccaacaccauacagaccugaaccccauugaaguggccaucgaugagaugucuaaaaaggucgcggaacucagacagcuuugcuccagcgcugagguugacaugaucaaacugcagcugaagcuccaggggucuguguccgugcaagucaaugccggaccucuggccuacgcucgggccuuucuugaugacaccaacacaaaacgcuauccggauaacaaggugaaacugcucaaggaaguuuucagacaguucguggaggcgugcggccaggcccuggcugucaaugagcggcugauuaaggaagaccagcucgaguaccaagaagagaugaaagccaacuauagagagauggcuaaggaacuuagcgagaucaugcacgaacagcugggcuga

SEQ ID NO: 68496 - RNA, 909 nt, Artificial Sequence
  derived and/or modified sequence opt5 from DOHH__Homo_sapiens__XP_011526642
auggugaccgagcaggaagucgacgccaucggccaaacacugguugaucccaagcagccucuccaggcuagauuccgggcccuguuuacgcuucgcgggcugggaggcccgggggcgauugcuuggaucagccaggccuucgacgaugacuccgcccuccugaaacacgagcuugcuuacugccugggacaaaugcaggaugccagagcuauucccaugcucguggacgugcugcaggauacccggcaggaaccuaugguccgccaugaggccggcgaagcgcugggggccaucggagaccccgaggugcucgagauucugaagcaauauucuagcgauccuguuaucgaaguggcugagacaugucagcuugccgucagacggcuggaauggcuccagcagcacggcggcgagcccgcugccgggccuuaccuguccguggacccggcgcccccugccgaggaacgcgauguuggaagacuucgggaggcucugcucgacgaaucucgcccccuguuugagagauaucgggccauguucgcucugcgcaacgccggcggggaagaggccgcucucgcgcuggccgagggacuucauugcggcagcgcucuguuuagacacgaagugggguacguccucggacaacugcagcaugaggccgccgugccucagcuugcugccgcgcuggcucgguguaccgaaaaucccauggugcgccacgagugcgccgaagcccucggcgcuaucgccagaccggcuugucuggccgcgcugcaagcccacgcugaugacccugagcgggucguuagagaguccugcgaaguggcccucgacauguaugagcaugaaacaggccgcgcuuuccaguacgccgaugggcuggagcagcuucggggagcgcccucuuga

SEQ ID NO: 68497 - RNA, 1029 nt, Artificial Sequence
  derived and/or modified sequence opt5 from DOK1__Homo_sapiens__NP_001184189
augcuggagaacagccucuacucccccaccugggaaggcucucaguucugggugacaguccaaagaacggaggccgcugaacggugcgggcugcacggaagcuauguucuucgcguggaggccgaaagacugacccuccugacagugggcgcgcagucccagauccuugagccucugcucucuuggccguacacccugcugcggcgcuaugggagagacaaggucauguuuagcuucgaggcuggacggcgcugucccuccggcccugggacauuuaccuuccagacagcccaaggaaaugauauuuuucaggccguggaaaccgcuauccauagacagaaagcccagggcaaggcuggccaagggcacgacguucuccgggccgauucucaugagggagaaguggcggagggcaaacugcccagcccucccgggccucaggagcuucuggacuccccgcccgcccucuacgcugaaccucuggauagccuucgcauugcccccugcccuucucaggacucccuguauagcgauccccucgacucuacguccgcucaggccggagagggcguccaaagaaagaaaccgcuguacugggaucuguaugaacacgcgcagcagcaacuccugaaggccaaacuuaccgacccuaaggaggaucccaucuacgacgaaccugaggggcuggcucccgugcccccucagggacucuacgaucugccgcgggagcccaaggacgccugguggugucaggcucgcguuaaagaagagggcuaugaacuuccuuacaaccccgccacagacgauuaugccgugccucccccgagaagcaccaagccucugcucgcucccaaaccucagggccccgcguucccugagcccgggacagccaccggaucuggcauuaagucccauaauagcgcucuguacucccaaguccagaagucuggggccagcggauccugggacugcggccugagccggguggggacggauaaaacaggagugaagucugaaggcuccaccuga

SEQ ID NO: 68498 - RNA, 1239 nt, Artificial Sequence
  derived and/or modified sequence opt5 from DOK2__Homo_sapiens__NP_003965
augggcgacggggccgugaagcagggauuccuguaccuccaacagcagcagaccuuuggcaaaaaguggagacgguucggggcuagccuguauggaggcuccgauugcgcccuugcgcgccuggagcuccaagaagggcccgagaaaccuagacggugugaagcugcccgcaaggucaucagacugucugacugccuucggguugccgaggcuggaggcgaagccagcuccccgcgcgauacaucugcuuucuuccuggagacgaaagagagacucuaccugcuggccgcgcccgccgcugaacggggcgacugggugcaggccauuugucuccuggcuuuuccugggcagcgcaaggagcuuagcggacccgaaggcaagcaguccagaccuugcauggaggagaacgaacuguauucuagcgccgugaccgucgggccccacaaagaguucgcggugacaaugcggccuaccgaagccuccgagcgcugucaucucagaggaagcuacacacugcgggcuggcgaaucugcccuugagcuguggggaggaccggagcccggcacccaacucuaugauuggccuuaccgcuuucugagacgguucggcagagacaagguuacauuuuccuucgaagcugggcgccggugcgugagcggagagggcaauuuugaauuugagaccagacaggggaacgaaaucuuucuggcccucgaggaggccauuucugcucagaaaaaugcggcccccgcuacgccucagccccaaccggccaccaucccugccucccugccccgcccugauagccccuauucucggccccacgacucccuuccuccgcccagcccuacaacccccgucccugcucccagaccgcgcggacaggaaggcgaguacgccgugccuuucgaugcgguugcucggucccuggggaagaacuucagagggauucucgccgugcccccucagcugcuugccgacccccuguacgauucuaucgaagagacacucccuccccgcccggaccauaucuaugaugaaccugagggcgucgcugcccugagccuguacgacagcccccaagagccccggggcgaggcuuggagacgccaggccaccgcggaccgggauccugccgggcuccagcacgugcagccggcuggacaagacuuuuccgccucuggcuggcagcccgggacggaauaugauaaugugguccugaaaaagggaccuaaguga

SEQ ID NO: 68499 - RNA, 993 nt, Artificial Sequence
  derived and/or modified sequence opt5 from DOK3__Homo_sapiens__NP_001138347
auggacccccuggagaccccuaucaaggauggcauucucuaccagcaacacgugaaauucgggaagaaaugcuggagaaaggucugggcccugcuuuaugcuggaggcccgagcgggguugcccggcuggaauccugggaggugcgcgacggaggccucggggcggcuggagauagaucugccggccccggccggcgcggggaaagacgggugauccgccuggccgacugugucagcgugcuuccugcugauggagaguccugccccagagacacaggcgccuuucugcucacgaccacagaacggucucaucugcuggcugcccagcaccgccaggcguggauggggccuauuugucagcucgccuuccccggaaccggcgaggcuagcuccgggucuacagaugcccaaagcccuaaaagaggacugguuccgauggaggaaaacuccaucuacagcucuuggcaggaggugggcgaauuucccgucgugguucagcggaccgaggcugccacacgcugccagcuuaagggcccugcgcugcucgugcuggggcccgacgccauucaacuuagagaggcuaagggaacccaggcccuguauuccuggccuuaccauuuccuccggaaauuuggcagcgauaagauccugcuggggacgcccggagucucucuccugaucuguaaaggcgaacgcaccgacgauguguccgggauuauccuugacgagagccugcucagagcuuauucugugccgggagccggcggccacucccggguccaggauagccuggggccuguucuuagagaacccacauuccagggagagcgcuccuuucugaagaccucuaugcuccggagccugcugugcuccuguagcuggagacauccucgcucucaaccccggacacaggccuccugccuccagggcagcgacugucccgcuccucacagaaauucuaccagcgcggcccacacgcuggggacauccuga

SEQ ID NO: 68500 - RNA, 981 nt, Artificial Sequence
  derived and/or modified sequence opt5 from DOK4__Homo_sapiens__NP_060580
auggccaccaacuucagcgacaucgugaagcagggcuacgucaaaaugaaguccagaaaacuggggauuuaucggcgcugcuggcucguuuuuagaaagucuagcuccaaaggaccccaacggcuggagaaguacccugaugaaaagucugugugucuucgcggcugcccgaaagugacagagaucagcaaugucaagugugugacgagacugcccaaagaaaccaagcggcaggcuguugccauuaucuucacagacgauuccgcgcgcaccuuuacaugcgacucugagcucgaagcugaggagugguauaaaacccugagcguggaaugucuuggguccagacugaacgauauuagccucggagagccugaccugcuggcccccggcguccagugcgaacagacagaucgguucaauguguuucuccugccuugucccaaccuugacguuuacggggagugcaagcugcaaaucacccacgagaauaucuaucucugggauauucauaacccucgcgugaagcuggucucuuggccgcuuuguucccugagacgguacggacgcgacgccacgagauucaccuuugaagcuggccggaugugcgaugccggcgaggggcucuauacauuccagacccaggaaggagagcagaucuaccaacgcgugcacagcgcuacacuggccauugcggaacagcauaaaagagugcugcucgagauggagaagaauguccggcugcuuaacaaaggcaccgaacacuacucuuaucccuguacgccuacaaccaugcugcccagauccgccuacuggcaucacaucacagggagccagaauauugcugaggccucuuccuaugcuggagaaggcuacggggccgcgcaggccagcuccgagaccgaccuccugaaccgcuuuauccuucugaagccuaaacccucucaaggagauagcuccgaagcuaagaccccgagccaguga

SEQ ID NO: 68501 - RNA, 921 nt, Artificial Sequence
  derived and/or modified sequence opt5 from DOK5__Homo_sapiens__NP_060901
auggccagcaacuucaaugacaucgugaagcagggcuacguccggauuagaucccgcagacuggggaucuaucaacggugcuggcucguuuuuaaaaaggcuucuagcaaaggacccaagcgccuggagaaauucuccgaugaaagagccgcguacuuucgguguuaucacaaggugaccgagcuuaacaaugugaagaacgucgcucgccugccuaaaucuacaaagaaacaugccauuggcaucuacuucaaugacgauacgagcaagaccuuugccugcgaauccgaccucgaggcugaugaaugguguaaagugcugcagauggagugcguugggacaagaauuaacgacaucucucuuggagagccggaucugcucgccaccggcguggaacgggagcagagcgaacgcuucaaugucuaucugaugcccuccccuaaccuggacgugcacggggagugugcucuccagaucacauacgaguauauuugccugugggauguucaaaaucccagagugaaacuuaucagcuggccucugucugcccuccggcgcuacggaagagacaccacaugguuuaccuucgaagcgggccggaugugugagacgggcgaagggcuguuuauuuuccagacccgcgauggagaggccaucuaccagaagguccauuccgcugcccuugcuauugccgaacagcacgagagacugcuccaaagcgugaagaacucuaugcugcagaugaagauguccgagcgggcggccagccugucuacaauggugccccucccuagauccgcuuauuggcagcauaucacccgccagcacagcacaggccaacuguaccggcuucaggacgucuccucuccgcugaaacuccacagaaccgaaacguuucccgccuaucgcagcgagcauuga

SEQ ID NO: 68502 - RNA, 996 nt, Artificial Sequence
  derived and/or modified sequence opt5 from DOK6__Homo_sapiens__NP_689934
auggccagcaacuucaaugacaucgugaagcagggcuacgucaaaauuagaucccggaagcuggggaucuuucgcagaugcuggcucguuuucaaaaaggcuucuagcaaaggaccccggcgccuggagaaguuuccugaugaaaaggccgcguauuucagaaacuuucacaaagugaccgagcuucauaauauuaagaacaucacacggcugccgcgcgaaacgaaaaagcacgcuguggccauuaucuuccaugacgagaccuccaaaacauuugccugugaaucugagcucgaggcugaagaguggugcaagcaccuguguauggaaugccuuggcaccagacugaaugauaucagccucggggagcccgaccugcuggccgcuggaguccaacgggagcagaacgaacgcuucaauguguaccucaugccuacacccaaccuggauauuuauggcgaguguaccaugcagaucacacaugaaaauauuuaccuuugggacauccacaacgccaagguuaaacuggugauguggccucucuccucucugagacgguaugggcgcgauagcaccugguuuacguucgaguccggaagaaugugcgacaccggcgaaggccuuuuuacauuccagacccgggagggggagaugauuuaccaaaagguccacagcgcgacacuggccaucgcugaacagcaugagcgccucaugcuggaaauggagcagaaagccagacugcagaccucucucacggaacccaugacacuguccaagagcauuucucuuccucgguccgcuuauuggcaccauaucaccagacaaaauagcgugggagagaucuacucucugcagggccacggguuuggauccagcaaaaugucccgcgcccagacauucccgucuuacgcgcccgagcagagcgaagaggcccaacagccucucucccggucuagcuccuauggcuucagcuacucuagcucccugauucaguga

SEQ ID NO: 68503 - RNA, 768 nt, Artificial Sequence
  derived and/or modified sequence opt5 from DOK7__Homo_sapiens__NP_001158145
augaccgaggccgcucugguggaaggccaggucaagcucagagacgggaaaaaguggaaaagccgguggcugguucuucgcaagcccucccccguggccgauugccugcucaugcugguguacaaagacaagucugagagaaucaagggacuucgggaacgcagcucccugacacucgaggauauuuguggccuggaaccggggcugcccuaugagggacucguccacacgcuggcgaucgugugccuuucucaagcuauuaugcugggcuucgacagccaugaggccaugugugccugggaugcuagaauccgguacgcccucggggaaguucaccgcuuucaugugaccgucgcuccuggaacaaaacuggaguccggccccgccacccuucaccugugcaacgacgugcucguucuggcgagagauauuccucccgccgugacaggccaguggaagcugucugaccuccggcgcuauggggcugucccuagcggauucaucuuugaaggcgggaccagaggauggcggcugcuuccggugcugggccgcgggggagccgaucagcuccccgugagacugcaucggccucgccaccuuccccaccagggcccucugugggcugccgcgggcuccacaagacccaaaagcccggggacccucgacuguggaggcgccugcgggccuggaucucccggcaauccuacggcuggggaggccgcugagccuccccugaccuguggacaagccggccaguggcggggcuga

SEQ ID NO: 68504 - RNA, 1617 nt, Artificial Sequence
  derived and/or modified sequence opt5 from DOLK__Homo_sapiens__NP_055723
augaccagagagugccccagcccugccccgggccccggggcuccucuguccggaucugugcucgccgaagcggcugucguuuucgccguggugcugagcauccacgccacagucugggaccgguacuccuggugugcuguggcccuugcuguucaggccuuuuaugugcaauacaagugggaucgccugcuccagcagggcucugcggucuuccaguuuagaaugagcgccaacuccgggcugcuucccgcuucuauggugaugccucugcucggacugguuaugaaagagcggugccaaacggccggcaaucccuucuuugaacgcuucgggauuguggucgcugccaccggaauggcgguggcccuguuuagcuccgugcucgcucugggcaucacaagaccugucccgaccaacacauguguuauucuuggccuggccgggggagugaucauuuauaucaugaagcauagccucucugugggcgaggucaucgaagugcuggagguucuucugauuuucguguaccucaauaugauccugcuguaucuccugccccggugcuuuaccccuggggaggcccuucugguccucggaggcauuuccuucgugcugaaccagcuuaucaaacgcagccugacacucguugaaucucagggggaccccguggacuuuuuccugcuggucguggucgugggaaugguucucaugggcaucuuuuucuccacccuguucguguuuauggauagcggcacgugggcuucuuccauuuucuuucaccuuaugaccuguguccugagccucggggugguucugccuuggcuucauagacugauucggcgcaauccccuccuguggcugcuccaguuccuguuucaaacagauaccagaaucuaccuucuggccuauuggucccuccuggcuacacuggcgugccuugugguccucuaccagaacgccaagcggucuagcuccgagagcaaaaagcaccaggcuccgaccaucgcccgcaaguacuuccaucugauugugguggccacguauaucccuggaauuaucuuugacagaccccugcucuacguugcugccacagucugucuggcgguguucauuuuucuugaauaugugcgguacuuccgcaucaaaccucugggccacacccucagaucuuuucugucccuguuccuugaugagcgggacagcgggccccucauccugacacacauuuaucugcuccugggaaugucucuucccaucuggcugauuccuagaccgugcacccagaagggcagccucgggggagcucgcgcccugguccccuacgccggcgugcuggcuguuggcgugggggauaccgucgccuccaucuuuggaucuacaaugggcgagauucgguggccugggacgaaaaagaccuucgaaggaacaaugaccagcaucuucgcucaaaucauuuccguggcccuuauccucauuuuugacagcggcguugaucugaauuauucuuacgcguggauccugggguccauuagcacagugucucuccuggaggccuacaccacgcagaucgacaaccuucugcucccccuguaucugcuuauucuccugauggcuuga

SEQ ID NO: 68505 - RNA, 1701 nt, Artificial Sequence
  derived and/or modified sequence opt5 from DONSON__Homo_sapiens__NP_060083
auggcccugagcgugcccggcuacuccccuggguucagaaagccgcccgaggucguucggcuccgcagaaaacgggcucgcucuagaggagccgcggcuagcccuccccgggaacugaccgagccugccgcccgcagagcugcccuuguggcuggccugccccuccggccuuuuccggccgccgggggacgcggcgggggauccggcggcgggcccgcggcugccagacggaacccuuucgcucgccuggacaauagaccccggguggccgcggaaccucccgauggaccggcccgcgagcagccugaagcucccgucccuuuucuugacucuaaccaagagaaugaucugcucugggaggaaaaguuccccgagagaacaacggugaccgaacugccccagacaagccacguuuccuuuucugagccugacaucccgagcuccaaaagcaccgagcugcccguggauuggucuauuaagacacggcuccuguucaccuccagccagccuuuuacaugggccgaccaucuuaaagcucaggaagaggcccaaggccugguccagcacugcagagccaccgaagugacgcuccccaagucuauccaggauccuaagcuguccagcgagcuucgcuguaccuuccagcaaucucugauuuauuggcuccaucccgcucuguccuggcugccgcucuuuccucggaucggggcggacagaaaaauggccggaaagacaagccccugguccaacgaugcuacccugcagcacguucuuaugucugacuggagcguguccuucacaagccuguacaaucuccugaaaaccaaacuuugcccuuauuuuuacgucuguacguaucaguucacagugcuguuucgcgccgccggccucgcugggucugaucugauuaccgcccugaucucccccacaacccggggacucagagaagcgaugcgcaacgagggcaucgaguucagccugccucuuauuaaggaaucuggccauaagaaggagaccgcuagcgggacaucccugggauacggcgaagaacaggccaucucugacgaagaugaggaggagagcuucuccuggcucgaggaaaugggggugcaagacaaaauuaagaaacccgacauccugagcauuaaacuucggaaggagaagcacgaaguccagauggaucacagaccggagucuguugugcuggugaaaggaaucaauacguuuacccuccugaacuuccugauuaauuccaagagccucgucgccacaucuggcccucaggcugggcugccucccacccuucugucccccguggccuuucgcggagcuacaaugcaaaugcucaaggcccggagcguuaacgugaaaacccaggcgcuguccggcuauagagaccaguucucucuggagaucacgggcccgaucaugccccauagccuucacucccucacaaugcugcugaagucuagccaguccgggagcuuuucugccguccucuacccucaugaacccaccgcuguguucaauauuugccugcaaauggauaaaguucuugacauggaggugguccacaaggaacugaccaacuguggacuccacccuaauacacuggagcagcugucccagaucccccuucucggcaaaagcucucugcgcaacgugguccugcgggauuacauuuauaauuggagauccuga

SEQ ID NO: 68506 - RNA, 6897 nt, Artificial Sequence
  derived and/or modified sequence opt5 from DOPEY2__Homo_sapiens__NP_001307643
auggaccccgaggaacaggagcugcucaacgauuacagauaucgguccuacuccucugugaucgaaaaggcucugcgcaauuucgagagcuccucugaaugggcugaccuuauuagcucccugggcaaacucaacaaggcccugcaaucuaaucuuagauauagccugcucccucggcgccugcugaucuccaaaagacucgcccagugccugcacccggcccuucccagcgggguccaccugaaggcccucgagaccuacgagauuaucuuuaaaauuguuggaacaaaguggcuggccaaggaucuuuuccuguauucuuguggccucuuuccucugcuggcucacgccgcuguguccgugcggcccguccuccugacgcuuuacgaaaaauauuuccugccucuccagaagcugcuucugcccagccuccaggccuuuaucguggggcugcugccuggacucgaggaaggcucugagaucuccgaccgcaccgaugcgcugcuucugagacucagccugguuguggggaaagaggucuucuacacagcccuuuggggaucugugcuggcuuccccgagcauucggcuccccgccuccguuuuuguggucggccauaucaaccgcgacgcuccuggcagagaacaaaaguacaugcuggggaccaaucaccagcugacagugaaaucucuccgggccagccugcuugauuccaacgugcugguccagcgcaauaaccucgagauuguucuguucuuuuuccccuuuuauaccugccuggacagcaaugaaagagcgaucccucuucuccggucugauauugugcgcauccuguccgccgcuacacagacccugcucagacgggacaugagccugaacagacgccuuuacgccuggcugcucggaucugauauuaagggcaauacggugguccccgagagcgaaaucuccaacucuuaugaggaccaaagcuccuacuucuuugagaaguauagcaaagaucugcugguggaagggcuugcugagauccuccaucagaaguucauugacgccgacguugaggaacggcaccacgccuaccugaaaccguucagagugcugaucucucuccuggauaagccugaaauuggaccccaggucgugggcaaucuuuuucuggagguuauccgcgcuuucuauuccuacugucgggacgcgcucgggagcgaucugaaacugucuuacacccaguccggaaacagccuuauuuccgccaucaaggagaauagaaacgcuucugaaaucgugaaaacagucaaccuccugauuaccagccuguccacagacuuucucugggauuauaugacccgcugcuucgaggaauguuuucggccugugaagcaaagauacucuguccgcaauagcgugagcccgcccccuacgguuagcgagcugugcgcccuucugguguuccuccuggacgucaucccgcuggaacuuuauucugaggugcagacacaguaccucccccaaguucugggcugucuggugcagccucucgccgaggauauggaagcucugucccuucccgagcugacccaugcccucaagacaugcuuuaaaguccugagcaaggugcagaugccucccucuuaucuggacaccgaauccaccagcggcacaucuagcccggugaaaggggagaacggaaagauuauccuugagacgaaagcgguuauuccuggcgaugaagacgcuuccuuucccccucugaaguccgaggauucugggaucggacucuccgccagcucccccgaacugucugagcaccuccgggucccuagagugagccuggaacgcgacgacguguggaagaaaggcggguccaugcagcggaccuuucuuuguauccaagagcugauugccaauuucgcuucuaagaacaucuuuggaguccagcucacagccagcggcgaggaauccaaaucugaggaacccgcuggcaagagagaucgggacgggacccagagccuggccgcgaaugauuccagccgcaaaaacucuugggagccgaagccuauuacagugccccaguucaagcaaaugcuguccgaccuuuuuaccgccagaggaagccccuucaaaacgaagucuuccgaaagcccuucuuccagcccguccagccccgcucggaaaaauggcggggagugggauguugagaagguggucaucgaccugggaggcucuagagaggaacgccgggaagccuucgcugccgcgugccaucuccugcucgauugugccacauuuccuguguaccugagcgaggaagagaccgagcagcuuugcgcuacccuguuccagcuccccggggccggcgacuccucuuuuccuagcuggcugaaaucccugaugacaauuugcuguugcguuaccgauuguuaucuucagaacguggcuaucucuacacugcucgaagucauuaaucacagccaaucccuggcccucgugaucgaggacaagaugaagagauacaaaucuagcggacacaaccccuucuuuggcaagcugcagaugguuacggugccucccaucgccccggggauucuuaaagucaucgcugaaaagaccgauuucuaccagcgcguggcgagagugcuguggaaucagcugaacaaagagacacgggagcaucacgugaccugcguugaacucuuuuaucgccugcauugucuugccccuacagcuaauauuugcgaggacaucauuugucacgcccugcucgaucccgacaagggaaccagacuggaagcccucuuccgguuuuccgugaucuggcaucugacgcgcgagauccaaggcagcagagugaccucucacaaccgguccuucgaccgcagccuuuuugucgugcuggauucucuggcuugcacagacggggccauuggagcggcugcccagggcuggcucguuagagcccugucccuuggggauguggcucggauccuggaaccuguccuccugcuccugcuucagcccaaaacccaacgcacaagcauucacugucugaagcaggaaaauuccgccgacgaucugcauagaugguucaaccggaagaaaaccucuuuuagagaggcgugcgcugugccggaaccucaggagagcggcuccgaggaacaccucccccugagccaguucacgacaguugaccgcgaagccaucugggccgagguggagaaggaaccugagaaauacccccuucggggagaacugucugaggaggaacuccccuauuacgucgagcugccugauagaaccgcucauggcgccccggacuccagcgaacacacagagucugcugauaccagcuccugucacaccgacucugaaaacacaagcuccuucucuagccccucccaugaucuccaagagcugagcaaugaggaaaacugcugcgccccuauucccaugggagggcgcgcguauccuaagcggucugcccuucuggcugccuuucaguccgagagcuucaaagcuggcgccaagcugucccucgugagaguugacucugauaagacgcaggccagcgaauccuuuucuagcgacgaggaagcugaccuggagcuucaggcgcugaccacaucccgccuccugaaacaacagcgggagagacaggaagccguggaggcucuguucaagcacauccuccuuuaccugcagcccuaugauagccgccggguccuguacgccuuuucugugcucgaagccgugcugaaaaccaauccuaaggaguucaucgaagcugucuccagaacaagcauggacaccucuuccacggcccaucuuaaccugauuagcaaucuccuggcgcggcaccaagaggcucugaucgggcagucuuuuuacggaaaacuccagacacaaguuccgaacguguguccccauagccuucugcuggagcuccugaccuaucuuugccuguccuuccuccgcucuuacuauccuuguuaccugaaggugagccacagagauauucugggcaaucgggacguccaggugaaguccguugaagugcucauccgcauuaugaugcagcuugucagcguggccaaauccucugaggggaagaacguugaauuuauccacagccugcugcagagaugcaaagugcaagaguucguccuccugucccuuucugccagcauguauaccucccagaagcgguacggccuggcuacagcccaucacggcagagcgcuccccgaagauucucuguuugaggagagccugaucaaucucggacaggaccagauuugguccgaacauccucuucaaaucgagcugcugaaacuccugcagguccuuauuguccuggaacaccaucucgggcgcgcucacgaggaggccgaaaaccagcccgaucugagccgggaguggcagagagcccugaauuuccaacaggcuaucucugcccuccaguaugugcagccgcacccucuuaccucccaaggacugcugguuagcgcugugguccgcggccuccagcccgccuacggguacggaaugcaucccgcgugggugucucugguuacacacucccuuccuuauuucggcaagagccugggguggacggugacccccuuugucgugcagauuuguaagaaccucgacgaucuggugaaacaauacgaaucugaguccguuaagcugagcgucuccacaaccagcaaacgggaaaauaucucuccugacuauccgcucacacuucuggagggccugaccacgauuagccauuucugccuccuggagcaggccaaccagaauaagaaaaccauggcugccggagaucccgcuaaccuuagaaacgcccgcaaugccauccuggaggagcucccucggacagugaacaccauggcucugcuguggaaugugcucagaaaggaagagacacagaaacgccccgucgaccuucugggcgcgaccaagggguccucuagcguguacuuuaagacaaccaaaacgaucagacaaaagauucuggacuuccucaacccucugacagcccaccuuggaguucagcugaccgcugccguggccgcugucuggucccggaaaaaggcccagcgccacucuaaaaugaagaucauucccaccgcgagcgcuucccagcucacacugguggaucugguuugugcccucucuacccuucaaacggacacacugcugcaucucgugaaggaagucgugaaaagaccgccucagguuaagggcggggaugagaaaagcccccugguggacaucccuguccuucaguuuugcuaugccuuccugcagcggcuccccgugccugcucugcaagagaauuuuuccagccugcucggagugcuuaaggaaucuguccagcugaaccuggcgccucccggcuacuuccuccugcuuuccaugcugaaugauuuuguuacccgcacacccaaccucgagaauaaaaaggaccagaaggaucugcaagaaauuacccagaaaauccuggaggcggugggcaacaucgccgggagcucucucgaacagacauccuggcugagcagaaaucuugaggugaaggcucagccccaagccucccuggaggaaucugacgcugaggaagaucucuaugacgccgcugccgcgagcgccauggucuccagcucugcucccuccguguacagcguucaggcccugucucuucuggcugaggugcucgccagccugcuggauauggucuaccgguccgacgagaaagaaaaggccgugccucucauuucuagacugcuuuauuacguuuucccguaucugcgcaaccacagcgcuuacaaugcgcccuccuuucgggccggagcucagcuccugucuagccuuuccggcuaugccuacaccaaaagagccuggcgcaaggaggugcuggaacucuuccuggauccugcuuucuuccagauggacacgagcuguguccauuggaagucuaucauugaccaucugcucacccaugagaaaacaauguucaaggaucugaugaacaugcaauccagcucccuuaaacuguuuucuagcuucgaacagaaggccaugcuccugaaacggcaggcguuugccguguucuccggggagcuugaccaguaucaccuguaccucccccugauccaagagagacugaccgauaaucuccgggucggacagacaucuauuguggcugcccagauguuucuguucuuucgcguucuucugcucagaaucagcccucagcaccugaccucccuuuggcccaucauggugagcgaacugauucaaacguucacacagcucgaggaagaccugaaggaugaggacgaaucucugcgguccaccaacaaggugaaccgcacaaaagucagcguuccugaugcuaauggcccgucugugggggagaucccccaguccgagcucauucuguaccuuagcgccugcaaguuucuggacaccgcgcucucuuucccucccgauaaaaugccucuguuucaaaucuauagaugggccuucauucccgaaguggacaccgagggaccggcuuuucuuuccgaugucgaagagaaccaucaggaauguaagccucacacagugcggauccuggagcuccugaaacugaaguucggcgagauuagcucuagcgacgaaaucacgaugaaauccgaguucccccuccugcgccagcauagcguuuccucuaucagacagcuuaugcccuuuuucaugacccugaauggcgccuuuaagacacaacggcagcucccugcugauagccccgggaccccuuuccuggacuuuccggugacagacagcccccgcauucuuaagcagcuggaagagugcaucgaguacgauuuccucgaacacccugagugcuga

SEQ ID NO: 68507 - RNA, 4614 nt, Artificial Sequence
  derived and/or modified sequence opt5 from DOT1L__Homo_sapiens__NP_115871
augggcgagaagcuggaacucagacugaaaagccccgugggggccgagccugcugucuacccguggccccuuccuguuuaugacaagcaccaugaugccgcgcacgaaaucauugagaccauccggugggugugcgaagagauucccgaccugaaacucgcuauggagaacuacgugcugaucgauuaugacacaaaguccuucgaaucuaugcagcgccuuugugauaaauacaauagagccauugacagcauccaucaacuguggaagggaacgacccagccuaugaagcucaacacacggcccuccaccggccugcugcgccacauccuccagcaggucuauaaucauucugugacagauccugagaaacugaacaauuacgaaccguuuagccccgagguuuauggggagaccuccuucgaccuuguggcccaaaugauugaugaaaucaagaugacagacgaugaccuguuugucgaucucggaucuggcguggggcagguugugcugcaggucgcugccgcuaccaacugcaaacaccacuacggaguggagaaggccgacauuccugcgaaauacgccgaaacgauggacagagaguuccggaaguggaugaagugguauggcaaaaagcaugcugaauacacccuugagcgcggcgauuuucugagcgaggaauggagagagcggaucgccaauacauccgugauuuucgucaacaauuuugcuuucgggcccgaaguugaccaccagcucaaagagcgcuuugccaacaugaaggaaggaggcagaaucgugagcucuaaaccuuucgcgccccugaauuuucggauuaacucccgcaaucugagcgauaucgggaccaucaugagaguggucgagcucucuccgcugaagggauccgugagcuggacaggcaaaccuguuucuuauuaccuucauaccauugaccggacgauccuggagaacuauuucuccagccucaagaaucccaagcugcgcgaagaacaagaagccgcuagacggagacagcagcgcgaguccaaaucuaacgccgcuacaccuaccaaggggcccgaaggaaaaguggccggccccgccgaugcuccuauggacagcggcgcggaggaggaaaaggccggggcugccacagucaaaaagccgucccccagcaaggcccggaaaaagaaacuuaacaagaaaggaagaaagauggcuggccgcaagcgggggagaccuaaaaagaugaauaccgccaaccccgagcgcaaaccuaagaaaaaucagaccgcgcuggaugcucuccacgcccaaacagugucucagacggccgcuuccagcccccaggacgccuaccggucuccgcacagcccuuuuuaucaacugcccccuuccguucagagacauucucccaacccucugcucguggcucccaccccgccugcccugcagaagcugcuggaauccuucaagauucaguaccuccaauuccuggcguacacaaaaacaccccaguauaaggccucccuucaggagcugcucggacaggagaaagaaaagaaugcucaacugcugggcgccgcucagcagcuccugagccacugucaggcccaaaaagaggaaauccgccggcuuuuucagcagaagcuggaugagcucggggucaaagcgcugaccuacaacgaccugauucaggcccaaaaggaaaucucugcucauaaucagcagcuuagagagcaauccgagcagcucgaacaggauaaccgcgcccugcggggacagagccugcaacuccugaaggcuagaugcgaggaacuucagcuggacugggccacccucucucuggagaaacugcuuaaggaaaaacaggcccucaagucccagaucagcgagaaacaacggcacugucuggagcugcagauuuccaucguggaacucgagaagucucagcgccagcaagaacugcuucagcuuaagagcugcgugcccccugacgaugcucucucccugcaucugagaggcaaaggcgcgcuugggcgggagcucgaaccggacgccucuagacugcaccuggagcucgauuguacgaaguucagccugccccaccuuuccagcaugucuccugagcuguccaugaauggacaggcugccggcuaugaacucugcgggguccugagccgccccucuuccaaacaaaacacaccucaguaccuggccagcccccuugaccaggagguugugccuuguacccccucucaugucggacggccgagacucgaaaagcugagcggccuggcugccccugauuauacccgccucucccccgcgaaaauugugcugagacggcaccuuagccaggaccauacaguuccugggcgccccgcugccucugagcugcacuccagagccgagcacaccaaggaaaauggccucccguaccaaagcccuuccgugcccggaucuaugaagcugagcccucaggauccccggccccuguccccuggcgcccuucagcuggcuggggagaaaucuagcgaaaagggacuccgcgagagagcguauggcuccucuggggaacugaucacaagccucccgauuuccaucccccugagcacgguccagccuaacaaacuucccgugucuaucccucuggcuuccgugguucuccccagccgggccgagcgcgccagaucuaccccuuccccgguccugcaaccccgggacccuagcucuacacuggagaagcagauuggagcuaaugcccauggcgcugggucccgcagccuugcccuggcgcccgccggcuuuuccuacgcuggaagcguggccaucucuggcgcucucgccgggagcccugccucccugacccccggagcugaaccggcgacacucgaugagucuagcuccucuggcagccuguucgccaccgugggguccagaucuagcacgccucagcacccccuucugcucgcucagccccggaacucccugccugccagccccgcccaucaacugucuuccagcccuagacuuggaggcgcugcccaggggccgcugcccgaagcgucuaaaggcgaccucccuuccgauagcggauuuuccgaccccgagucugaagcuaagcgccggauugucuucaccaucacaaccggcgccgggagcgccaagcaguccccuagcucuaaacacagcccccugacagcuagcgccagaggagauugcgugccgucucauggccaggacagccgccggagagggcgccggaagagagcguccgcuggaaccccuucucucagcgccggcguuucccccaaacgccgggcccugccuucuguggcugggcuuuuuacgcaacccagcggcuccccucugaaucugaacagcauggucucuaacauuaaucagccccucgagaucacagccauuuccagcccggagaccucccugaagucuagcccugugcccuaccaggaccacgaucaacccccuguucuuaaaaaggaaagaccgcugucccagacaaacggagcucacuauucuccccucaccagcgacgaggaaccuggcuccgaggaugaacccagcucugcccggaucgagcgcaaaaucgcgaccauuucccuggagagcaagucuccucccaagacacucgaaaaugggggaggccuggccgggagaaaaccugcuccggccggagagcccgugaacuccagcaaguggaaaucuacguucagcccuaucuccgacauuggccuugcuaagucugccgauagcccccugcaggccuccagcgcucugucccaaaauucucucuuuaccuuccggccugcgcuggaggagcccagcgccgacgcuaaacuugccgcccauccgcgcaagggcuuuccugggucccugucuggagcugauggccucagccccgggacaaaccccgccaauggauguaccuucggcgggggacuggcggcugaccucucccugcacucuuuuagcgauggcgccucccuuccucauaagggccccgaggccgcugggcugagcucuccucuguccuucccgagccagagaggaaaagaaggcucugacgccaaccccuuccucuccaagcggcagcuggaugggcuugcgggacugaaaggcgaggggagcagaggaaaggaagccggcgagggcgggcucccucugugcggacccacagacaaaaccccucuccugucuggcaaggcugccaaggcucgcgaucgggaagucgaccuuaaaaaugggcacaaccuguuuaucuccgccgcugccgugcccccgggaagccugcucuccggcccugggcuggcgcccgccgcuagcucugccggaggcgcugccagcuccgcccagacgcauagaucuuuccuuggcccuuuucccccugggccccaguucgcucugggaccgaugagccuccaagcgaaucugggcuccguugccgggucuagcgugcugcagucccucuuuucuagcgucccugcugccgccggacuugugcacguguccagcgcugccacacgccugaccaacucucacgcgaugggcuccuucagcggggucgccggaggcaccguuggcgggaauuga

SEQ ID NO: 68508 - RNA, 1227 nt, Artificial Sequence
  derived and/or modified sequence opt5 from DPAGT1__Homo_sapiens__NP_001373
augugggccuucagcgagcugcccaugccucuccugaucaaccuuauugugucccugcucggcuuugucgcuaccguuacacugaucccggccuucagagggcacuuuauugcggcucggcuuugcggacaggaccugaauaagacgucucgccaacagauccccgaaagccagggcgugauuuccggggccguguuccucaucauccuguuuuguuucauuccuuuucccuuccugaacugcuuugucaaagagcaguguaaggccuucccucaucacgaauuuguggcucucaucggagcccugcuugcuauuugcuguaugaucuuccugggcuuugccgaugacguucucaaucugagauggcggcauaaacuucugcuccccaccgcggccucucugccucugcucaugguguacuucacaaacuucgggaauaccacaauugucgugccgaagcccuuucgcccuauccugggacuucaccuggaucucggcauucuguauuacguuuauaugggccuucuggcuguguucugcaccaacgccaucaauauccucgcugggauuaacggacuggaggccggccaaagccuggucaucuccgcgucuauuaucguguuuaaucucguggaacuggagggggacuguagagaugaccaugucuucagccuuuacuuuaugauucccuucuuuuucacaacccugggacuccuguaucacaacugguacccuucccggguuuuugugggcgauacguucugcuauuuugccgggaugaccuucgcuguggucggaauccuuggccacuuuagcaaaacaaugcuccuguucuucaugccccagguguuuaauuuccuguacucucugccgcagcuccugcauaucauuccuuguccccgccacagaaucccucggcuuaacauuaagaccggcaagcuggagauguccuacagcaaauuuaagacaaaaucucucuccuuccuggggaccuuuauccugaagguugccgaaagccuucagcucgugacgguccaucaaucugagacagaagacggagaguucaccgagugcaauaacaugacacugauuaaucugcuccugaaagugcuuggccccauccacgaacgcaaccugacccuccugcugcuucuccugcagauccugggguccgcuauuaccuuuagcaucagauaucagcucguucggcuguucuacgauguguga

SEQ ID NO: 68509 - RNA, 612 nt, Artificial Sequence
  derived and/or modified sequence opt5 from DPCD__Homo_sapiens__NP_056263
auggccgugaccggcuggcuggagagccucagaacagcucagaagacggcccugcuucaagacgggcggcgcaaaguccacuaccuguuccccgauggaaaggaaauggcggaggaauaugacgagaaaaccuccgaacuccugguuagaaaguggcgggugaaaucugcucuuggcgccauggggcaguggcagcuggaggugggagauccugccccgcucggcgcugggaaccugggacccgagcugaucaaggaaagcaaugccaacccuauuuuuaugcgcaaggacacaaaaauguccuuccaguggagaauccggaaucuccccuacccuaaggaugucuauucugugagcguugaccaaaaagagcgcugcauuaucgugagaaccacaaacaagaaauacuauaagaaguuuuccauucccgaucuggaccggcaucagcuuccucuggaugacgcucuccugucuuucgcccacgcgaauuguacccuuaucaucagcuaccagaaaccgaaggaagucgugguugccgaguccgagcugcagaaagaacucaagaaagugaagacagcucauagcaacgauggcgacugcaaaacccaauga

SEQ ID NO: 68510 - RNA, 4182 nt, Artificial Sequence
  derived and/or modified sequence opt5 from DPCR1__Homo_sapiens__NP_543146
auggcccagcccgugcacagccugugcuccgcuuucggccuccaauguugccugcuuuuucugcucgccucuuggggagcgggggcuaccacauuccaggaguaccagaagacgggcgaacugagcaccuccgaccauaucuuuccucuuacaccggggcuggucuauucuauucccuucgaucacaucguucuccauagcggacagagaccucccgagcugccuaaauccaccgaaauucacgagcaaaagcggcauuguaacacaacccgccacucuaaacccacagacaagccuaccggcaauagcaaaacgaucgaucacaaguccagcaccgacaaccaugaagccccgcccacaucugaggaaaauuccagcaaccaggggaaggauccuaugauuagaaaucagcggucuguggaccccgccgauuccaccacaacccacaaagaaagcgcuggaaagaaacauaucacgccugcccccaagucuaaaaucaacugccgcaaguccacaaccggcaagagcacagugaccagaaaauccgacaagaccggccggccgcuggagaaaucuaugagcacacucgauaagacguccaccagcucucacaaaacaaccacauccuuucacaauagcgggaacucucagaccaagcagaaaagcacguccuucccugaaaagauuacagcugccucuaagaccaccuacaaaacaaccggaacacccgaggagagcgaaaagacggaggacucccgcaccacagucgcgagcgauaaacugcuuaccaagacaaccaaaaauauccaagaaacgauuucugccaacgagcugacccagucccucgcugaaccuacagagcauggcgggagaaccgccaaugagaacaauacacccagccccgcugaaccuaccgagaaccgggaacgcacggccaaugagaacacaacccugucuccggcggaacccaucgagaacagagagcggacagccaaugaaaacaccgcuccuuuucccgccggaccuaccgagaaucgcgaaaugacagcuaacgagaauacgacccuuuuccccgccgaaccgacagagcacggcgagagaaccgccaacgaaaauacaaccccuucccccgcugagccuacggaacauggggagcggacagcgaacgagaauaccacccccagcccugccgaacccacagagcacggagaacgcaccccguuugcuaacgacaagacaacguccucuagcgccgaguccaccgaacauggcgagagaacaccucuggccaaugagaacaccacacccucucccgcugaaccuaccgagaaucgggaaagaacggccaacgagaauaccacaccgagccccgcgggcccuaccgaaaaccgcgagacaaccgcuaacgagaagacaacccucucccccguggaaccuacggagaaucgggaaacaaccgccaacgagaaaaccacacccagcccugccgaacccaccgagaaugggcagagaacgccguucgcuaacgagaagacaaccucuuccagcgccgaaccuacagagcacggagaacgcacaccccuggcuaaugagaacaccaccccuucucccgccgagccgacggaaaaucgggagagaaccgcgaacgagaaaacaaccccuucccccgccgagccuacagaaaauggcgaucgcacgccccuggcuaacgagaagaccacacccagccucgccgagccuaccgaaaaugggcaacggacaccguuugcuaacgagaaaaccaccucuagcuccgccgaacccacagagcacgaagagagaacgccucuggcgaaugagaacaccacacccagcccugccgaacccaccgagaaucgcgaacggacagcuaacgagaacaccacgccuucuccggccggacccacagaaaauagagagaugaccgcuaacgagaagaccacacuuuucccugccgaacccaccgagaaucgcgaacggacagccaacgagaagacgaccuccagcccugcugagcccacagaaaauggccagagaaccccguuugcgaacgagaaaacaaccuccucuagcgccgaaccuacggagcauggggaacggacaccccuggcuaaugagaacaccacccucucccccgccgagccuacagaaaaucgcgagagaaccgccaacgaaaagacaacgcccuucccugcugagccgaccgaaaaucgggagagaacagccaacgagaauaccacccccucuccugcgcagcccacagaaaacggagaccgcacgccucuggcuaaugagaaaaccacacccagccuugccgaaccgaccgagaacggcaagcggacaccuuucgccaacgagaaaaccacguccucuagcgcugaacccacagagcacgccgaaagaaccccucuggcgaaugagaacaccacauccagccccgcugaaccuaccgagaaucgcgagagaacagccaacgaaaagaccacgcaauuucccgccgagccgacagaaaaucgggagucuaccgcuaacgaaaagacaaccccuuuccccgccgagcccacggagaaucgcgaauggaccgcuaacgagaauacaacccucuccccugccgaaccgacagagcaugaagagaugacaccccuggcgaacgagaaaaccacccugagcccugccgaacccacggagaauggcgaaagaacaccuuuuaccaacgagaagaccacacccucuuccgcugaaccuaccgagcacggggagcggacaccgcucgccaaugaaauuacgacccccagccgcgcugagccuacagaacacggagagagaaucgccaacgagaaagccacccccucuccugcuaagcccacagaacauggcgagaccacgguuaaugaagacaccacaccguccagcgcggagccuaccgaaaacggggagcggacaccccuggccaaugagaacaccacgacaucccccaccgaaagcacagagcacggagaacgcaccgcuaacgagaaaaccacaccuucucccgccgaaccuacggagcauggcgagagaaccccgagcgccaaugaaaagacaauucccuccccugcuaaacccaccgagcacgaagagaugacaccuucugccaacgaaaauaccacgcccagcccggugaagccuacagagcauggggagaagaccacccuugcgaacgagaaaaucacacugucccccgaaggcccuaccgaacacggagcuaagacaacgucugccaaugagaaaaucacccccagccucgccaagccuacagagcacggcgaacggaccacaucccccaacgauaaaauuaccucuagcgcugccgaguccacggaacaucgcgacagagcgaccagcgcuaaugucaucacaccggccccugccgagcccauuaagcacgcuaagcggaccacacuggcccaugagaaaaugacccaggugacagaaaagucuaccgagcaccccgagaaaacgacauccaccaccgaaaagacaacgagaaccccugaaaaaccgacacuuuauagcgagaagaccaucuguacaaaggggaaaaacacccccguuccugaaaagcccacagagaaucugggaaacaccacgcucaccacagagaccauuaaagcuccugugaagucuacagaaaaucccgagaaaaccgccgcggucacgaagacaaucaagccuuccgugaaagugaccggcgauaagagccugacaaccacguccucucaucugaacaaaaccgaagucacacaccagguucccaccgggagcuucacacucaucaccucccgcacaaagcugagcucuauuaccuccgaggccacgggaaaugaaagccacccguaccuuaacaaagacggcucucagaaggggauccaugcuggccaaaugggagagaaugauagcuuuccugccugggcuauugugaucgugguccugguggccguuauucuccugcugguguuccuuggccucaucuuucuggucuccuauaugaugcggacaagacgcacccugacccagaacacacaguacaacgacgccgaggaugaagggggacccaauucuuauccuguguaccucauggagcagcaaaaccugggcauggggcagauccccagcccgcgguga

SEQ ID NO: 68511 - RNA, 1236 nt, Artificial Sequence
  derived and/or modified sequence opt5 from DPEP1__Homo_sapiens__NP_001121613
auguggagcggcugguggcuguggccccucguggccgucugcaccgcugacuucuuuagagaugaggccgaacggaucaugcgcgacuccccuguuauugaugggcacaacgaccugccguggcagcuucuggauauguucaauaacagacuccaagacgagcgggcgaaucugacaacgcuugcuggaacccauacaaacauccccaagcugcgcgccggcuuugucgggggacaguucuggucuguguacaccccuugugauacacagaauaaagacgccgugagacggacccucgaacagauggaugugguucaccgcaugugcagaauguaucccgagacauuucuguacgugaccagcuccgcuggcauucggcaagccuuccgcgaagggaaggucgcuucucugaucggaguggagggcggccauagcauugacuccucucucgggguucugagagcccuuuaucagcugggaaugcgguaccucacgcugacccacagcuguaacacaccuugggcggauaauuggcuuguggacaccggcgauuccgagccccagagccaggggcugucuccuuuuggacaacgcgucgugaaagaacucaacagacugggcgugcugaucgaccucgcccaugucuccguugcuacaaugaaggccacccugcagcuuagccgggcuccggugaucuucucucacuccagcgccuauucugugugcgcgucccgcagaaauguccccgacgaugugcugcggcucguuaaacagacggacagccuggugauggucaacuuuuacaauaacuauauuuccuguacaaauaaggccaaccuuucucagguggcugaucaccuggaccauaucaaggagguugccggggcuagagccgugggauucggcggcgauuuugacggggucccucgcgugcccgaaggacucgaggaugucagcaaauacccugaccugauugccgagcugcuccggagaaauuggaccgaagcugaggugaagggcgcgcuggccgauaaccuucugcgcguuuucgaagcuguggagcaagccuccaaccucacacaggcccccgaagaggagccgaucccucuggaccagcuugggggaagcugccggacccacuacggcuauucuuccggggcuagcucucugcauagacacuggggacuccugcuggccagccucgcgccccugguccuuugucugucccuccuguga

SEQ ID NO: 68512 - RNA, 1461 nt, Artificial Sequence
  derived and/or modified sequence opt5 from DPEP2__Homo_sapiens__NP_071750
augcagcccagcggccuggaggggccuggaaccuucggcagauggccgcuccugucccuucugcuccugcuucugcuccugcaacccgugacaugcgccuacacgaccccugggcccccucgggcucugacaacccucggagcuccccgcgcgcacacaaugccuggcaccuaugcuccgucuacaacccugagcucccccucuacgcaggggcuucaggaacaggccagagcccugaugcgggacuuuccucucgucgauggacauaacgaccugccccuuguucugcgccaaguguaccagaagggccuccaggaugugaaucugagaaacuucagcuauggccagaccucccuggaccggcuccgcgaugggcuggucggagcucaauuuuggucugccuacgugccuugucagacacaggacagagaugcccuucggcugacccucgagcagaucgaccugauucgcagaaugugcgccagcuauuccgaacuugagcugguuacaagcgcgaaagcccucaaugauacccaaaagcuggcuugucugaucggcguggaagggggacacucucucgacaacucccugagcauucuucggacguucuacaugcugggcguccgcuaucucacacugacccauacaugcaauacccccugggccgagucuuccgcuaaaggggugcacagcuuuuacaacaauaucucuggacuuaccgauuucggcgagaagguuguggccgaaaugaacagacugggcaugauggucgaccucucccaugugagcgaugcgguggcccggcgcgcucuggaggucucccaggccccgguuaucuuuucucacagcgcugccagagggguguguaauuccgcccggaacgugccugacgacauucugcagcuccugaaaaagaauggaggcgucgugaugguuagccuuucuaugggggugauccaaugcaaccccuccgcuaaugucagcacaguggcggaucacuucgaccauauuaaggccguuaucggaucuaaauuuauuggcaucgggggagauuacgacggcgcuggcaaguucccucaggggcuggaagaugugagcacguaucccguccucauugaggagcugcuguccagaggauggucugaagaggaacuucagggcgugcuccgcgggaaccugcugcgggucuuuagacagguggagaaaguucaagaagagaauaaguggcagagcccccucgaggacaaauucccugaugaacagcuguccagcucuugucacuccgaccuuagccgccugcggcagagacaaucucucaccuccggacaggagcugacagaaaucccgauucauuggaccgccaagcugcccgccaaguggagcguguccgagucuagcccucacauggcucccguccuugccgugguugcgacauuuccugugcucauccuguggcuguga

SEQ ID NO: 68513 - RNA, 1542 nt, Artificial Sequence
  derived and/or modified sequence opt5 from DPEP3__Homo_sapiens__NP_071752
augaucagaaccccgcugagcgccuccgcucaccggcuccugcuuccuggcucucgcgggagaccgccccggaacaugcagccuacaggacgcgagggcagcagagcccugucccggcgcuaccucagacggcugcuucugcuccugcugcuccugcuucugcgccaacccgugacgagagcggaaaccacaccuggggcuccccgggcccucucuacccugggaagcccuucccuuuucacaaccccgggcguccccucugcccugacaaccccugggcucacgacccccggaacaccuaagacccuggaccugcgcggcagagcucaggcccucaugcggagcuuuccccugguugauggccauaaugaccuuccccaggugcugcgccagagauauaaaaacgugcuccaagaugucaaucugcggaacuucucccacgggcagacaagccuugacagacugcgcgauggacucgugggcgcucaguuuuggucugccuccguuagcugccagucucaagaccagaccgcggugcggcuggcccuggagcagauugaucucauccauagaaugugugcuuccuacagcgaacuggagcuugucacgucugccgaagggcucaauuccagccagaagcuggcuugccugauuggaguggagggcgggcacucccuugacucuagccuguccguucuccgcagcuucuaugugcugggaguccgguaccugacacucaccuuuacauguucuaccccuugggccgaguccagcaccaaauucagacaucacauguauacaaacgugucuggccugacgagcuuuggcgaaaagguggucgaggaacuuaaucgccuggggaugaugaucgaucucuccuacgcgucugacacccugauucggagaguucuggaggugagccaagcccccgugaucuucucccacagcgcugcccgcgcugucugcgauaaccuucucaaugugccugacgauauccugcagcugcucaaaaagaacggaggcauuguuauggugacacugucuauggggguccuucaguguaaucugcucgccaacguguccaccguugccgaccauuuugaccacauccgggcugugauuggaagcgaguucaucggcauugggggaaauuaugauggcacaggcagauuuccccaagggcuggaagacgucucuaccuaccccgugcugaucgaggaacuucucucccgcagcugguccgaggaggaacugcagggaguccugcggggcaaccuccugagaguguuccggcagguugagaaggugcgcgaagagucuagagcgcagagcccugucgaagccgaguuuccguacgggcaacuuuccacgucuugccauagccaccuggugccccagaauggacaccaggcuacacaucucgaaguuaccaaacagccuaccaaccgggugcccuggagauccagcaacgccucuccuuaucugguccccggccugguggccgcugccacaauuccgaccuucacacaauggcuuuguuga

SEQ ID NO: 68514 - RNA, 1245 nt, Artificial Sequence
  derived and/or modified sequence opt5 from DPF1__Homo_sapiens__NP_001128627
augggcgggcugagcgccagacccaccgcuggacggacagacccugccggcacgugcugggggcaggauccgggauccaaaauggcgaccgugauccccggcccucucucucugggggaggacuucuaccgcgaagcuauugagcacuguagaagcuauaacgcccggcuuugcgccgaacgcucccugagacuccccuuucuggauucucaaacaggagucgcucagaauaacuguuacaucuggauggagaaaacccaucggggcccuggccuugcccccgggcagauuuauacauacccugcucgcugcuggagaaagaaacggcgccugaauauccucgaagacccgagacugcggcccugugaguauaagauugauugcgaggccccucugaaaaaggaaggaggccuccccgaggggccuguucuggaagcgcuucugugugccgagaccggagagaagaaaaucgaacucaaggaggaagagacaaucauggacugccagaaacaacagcugcuugaguucccccacgaucuggaaguggaggaccucgaagaugacauuccgcgcagaaagaaccgggcuaaaggcaaggccuacgggaucggaggccugcgcaagagacaggauaccgcuagccuggaggaccgggauaaaccuuaugugugugacauuugcggcaagagauacaaaaaucgccccgggcucuccuaccauuauacgcacacccaucuggccgaagaggaaggagaggagaacgcggaacggcacgcccuuccuuuucacagaaagaauaaccauaaacaguucuacaaggagcuggcuuggguccccgaagcccaacgcaaacacacagcuaagaaggcccccgacggcaccgugaucccuaauggguauugugauuuuugccucggaggcucuaaaaagacagggugcccggaggaccugauuagcugugccgauugcggacgguccggccaucccagcugucuucaguucaccguuaacaugacggcugcggugagaacauaccgcuggcagugcaucgaauguaaaucuugcucccuguguggcaccagcgagaaugacgaucagcuccuguuuugcgacgauugugaccggggguaucacauguacugccugucuccucccauggccgagccucccgaaggauccuggagcugucaccucugccugagacaucuuaaggagaaggcuucugccuauauuacacugaccuga

SEQ ID NO: 68515 - RNA, 1137 nt, Artificial Sequence
  derived and/or modified sequence opt5 from DPF3__Homo_sapiens__NP_001267471
auggccaccgugauccacaacccccugaaggcucucggcgaccaauucuacaaagaggccauugaacauugcagaagcuauaauucccggcugugugcggagcgcucugucagacuuccuuuucuggauagccaaacagggguugcucagaacaauugcuacaucuggauggaaaagcggcaccgcggaccgggccucgcccccgggcagcuguauacguacccugccagauguuggcggaaaaagcgcagacuucaucccccugaggaccccaaacugcggcuccuggaaauuaagccugagguggagcugccgcucaagaaagauggauucaccuccgaaucuacaacccuggaggcccuucugcgcggcgaagggguggagaagaaagucgacgcuagagaggaagagagcauccaggaaauucaacgggugcucgagaacgaugaaaauguugaggagggaaacgaagaggaagaccuggaggaagauauccccaagcgcaaaaauagaacacggggccgcgcuagaggcuccgccgggggacggagacgccacgacgcggccucucaggaggaucaugacaagccuuaugugugcgauaucuguggcaagcgguacaaaaacagacccgggcuuagcuaucacuacgcucacacccaucuggccuccgaggaaggagacgaggcucaggaucaggaaacacgcagcccucccaaucaccggaacgagaaucauagaccgcaaaagggcccugacgggaccgucauucccaacaauuacugcgacuuuugucucggaggcucuaacaugaauaaaaaguccggccgcccugaggaacuggugagcugcgccgauugugggcggucuggacaccccacgugccugcaguucacccucaacaugacagaggcgguuaaaaccuauaaguggcaguguaucgaaugcaaauccugcauucuguguggcacaagcgagaacgacgaucagcuucuguuuugcgacgauugugacagaggguaccacauguauugccucaaucccccuguggccgaaccgcccgagggaucuugguccugucaucugugcugggagcuucugaaggaaaaggcuagcgccuucggcugucaggcuuga

SEQ ID NO: 68516 - RNA, 1332 nt, Artificial Sequence
  derived and/or modified sequence opt5 from DPH1__Homo_sapiens__NP_001374
augagacgccaggugauggccgcucuggucguuagcggcgccgcggagcaagggggacgggacggccccgggagaggacgggcuccucgcggcagaguggccaaccagaucccgcccgaaauucucaagaauccucagcugcaggccgcuauccgggugcuucccuccaacuacaauuucgagauuccuaaaaccaucuggcgcauucaacaggcccaggcuaagaaagucgcccugcagaugcccgaagggcuccugcuuuuugcgugcacaaucguggauauccuggagagauucacggaagccgagguuauggugaugggagacgucaccuauggcgcuuguugcguggaugacuuuacagcccgggcucucggcgccgauuuccugguucacuacgggcauucuugucugauuccuauggacaccagcgcgcaagauuuucgcgugcucuaugucuucguggacaucagaauugauacaacccaucugcuugacucccugcggcucacauuuccgcccgccaccgcucuggcccuugugucuacgauccaguucgucagcacccugcaggcugccgcccaggagcucaaggcugaauaccgcguuuccgugccucaaugcaaaccccugucuccuggagagauucugggcuguacaagccccagacucuccaaggaaguggaggcggucguguaucugggggauggacgguuucaccuugagagcguuaugaucgccaacccgaaugugccugcuuaccgcuaugaccccuacucuaagguccuguccagagaacacuacgaucaucagcggaugcaggccgccagacaagaggcuauugccaccgcgcgcagcgcuaaaucuuggggccucauccuggggacacuuggacggcagggcuccccuaagauccuggaacaccucgagagcagacugcgcgcccugggccucucuuucgugcggcugcuucuguccgaaauuuuucccagcaaacucucccugcuucccgagguugacguguggguccagguggccugcccuagacugucuaucgacugggggaccgcuuucccgaagccccuccugacgccuuaugaggccgcugucgcccugcgcgauauuagcuggcagcaacccuacccuauggacuuuuaugcgggauccagccucggccccuggacagugaaccacgggcaggaucggagaccgcaugccccuggacgccccgcucggggcaaaguucaggaagggucugccagaccucccuccgcuguggccugugaggacugcagcugucgcgaugaaaaggucgcgccucuggcccccuga

SEQ ID NO: 68517 - RNA, 174 nt, Artificial Sequence
  derived and/or modified sequence opt5 from DPH3__Homo_sapiens__NP_001040899
auggccguguuccacgacgaggucgaaaucgaggauuuucaguacgacgaagauagcgagaccuauuucuaccccugcccuuguggcgacaacuuuuccauuacaaaggaucaauucguuugcggggaaacggugccggcucccucugccaauaaagagcuggugaaguguuga

SEQ ID NO: 68518 - RNA, 498 nt, Artificial Sequence
  derived and/or modified sequence opt5 from DPH6__Homo_sapiens__NP_001135444
augagaguggccgcucugaucagcggcgggaaggacuccugcuacaacaugaugcaguguauugccgcgggacaccaaaucgucgcucucgccaaucugcggcccgccgagaaccagguuggcucugaugaacuugacagcuauauguaccagaccguggggcaucacgcuauugaucuguaugccgaggcuauggcccucccucuguaccgcagaacaauccggggacgcucccuugacacgagacagguguauaccaaaugcgaaggcgaugaggucgaagaccuguacgagcuccugaagcuggugaaagggauuacacggaugacccuccuggcggaguaugaugcccuuaaucugcaagacuuccauaugcaccucaagguuggaucucaggcuaucguguaccgcacaccgaacgaacuguguacccauagcaaauuugauaagcacacauuucccccuuucaucuccgagauugccaagugcgaagucuga

SEQ ID NO: 68519 - RNA, 1359 nt, Artificial Sequence
  derived and/or modified sequence opt5 from DPH7__Homo_sapiens__NP_620133
augaugggcugcuucgcccugcagaccguggacacagagcucacggcugauagcgucgaaugguguccccugcaagggugcagacaccuucuggccuguggaaccuaccagcuccggcgcccugaggacagaccggcgggcccccagaacaaagggggaauggaaguuaaggagccucaggugcggcugggccgccuuuuucuguauuccuucaaugauaacaauucuauccauccccucguggaaguccaaagaaaggacacaagcgcuauucuggauaugaaauggugccacaucccuguggccgggcaugcccugcucggacuggcugacgccuccggcucuauucagcuucugcggcucguugagagcgagaagucccacgugcuggaaccccuuucuagccuggcucucgaggaacagugucuggcccugucccucgauuggagcaccggcaaaacagggcgcgcgggagaccagccucugaagaucauuucuuccgauagcaccggccaacuucaucugcucauggucaacgagacaagaccgcggcugcagaagguggccucuuggcaggcucaccaguuugaggccuggaucgcugccuucaauuacuggcaccccgaaaucguuuauuccgggggagacgauggccuucugcgcgggugggacaccagagugccuggaaaauuucucuucacgagcaagcggcauaccaugggcgucugcucuauucaauccagcccccaccgcgagcauauccuggcgacaggcuccuacgaugaacacauucugcucugggacaccagaaacaugaaacagccucuggccgacacacccgugcaagggggaguguggcggaucaaguggcacccguuucaucaccaucuucugcucgcugccuguaugcacucuggcuucaaaauucugaauugccagaaggcuauggaggaacgccaggaggccaccguccuuacgagccauacacugccugauucccucguuuauggggccgacuggagcuggcugcuguuuagaucucuccagcgggcucccuccuggagcuucccuucuaaccugggaaccaagacagcggaucuuaaaggcgccagcgagcugcccacccccugucacgaaugcagagaggacaaugauggggaaggacacgcucgcccucaguccggcaugaagccgcucaccgagggcaugcggaaaaacgggacauggcugcaagccacggccgcuaccacaagagacuguggagugaaucccgaagaggccgauucugcguuuagccugcuugcuaccugcuccuucuacgaccaugcccuccaccugugggagugggaaggcaacuga

SEQ ID NO: 68520 - RNA, 783 nt, Artificial Sequence
  derived and/or modified sequence opt5 from DPM1__Homo_sapiens__NP_003850
auggccagccuggagguguccagaucuccccggcgcagcagacgggaacucgagguccgcuccccuagacagaacaaguacucuguucugcuuccgaccuauaaugaacgggagaaccugccccucaucguguggcugcuugugaaauccuucagcgaaucuggcauuaauuacgagaucauuaucauugacgaugggagcccugacggaacacgcgaugucgcugagcaacuggaaaagaucuauggcuccgacagaauccuccugcggccccgcgagaaaaagcuggggcucggaacggccuacauucacggcaugaaacaugcgaccgggaacuauaucauuaucauggaugcugaccugagccaccauccuaaguuuauucccgaguucaucagaaagcagaaagaaggaaauuuugauauugugucuggcacacgguacaagggcaacgggggaguuuauggcugggaccuuaaacgcaagaucaucuccagaggggccaauuuccugacccagauucuccugcggccuggagccagcgaucuuacaggcucuuuucgccuguacagaaaagaggugcucgaaaagcugaucgagaagugcgucuccaaaggguacguguuccagauggaaaugauuguucgggcuagacaacugaacuauaccaucggagaggugccgauuagcuuugucgaccgcguguacggcgaaucuaagcucggcgggaaugagaucguguccuuccugaaaggacuucugacacucuuugccaccacguga

SEQ ID NO: 68521 - RNA, 255 nt, Artificial Sequence
  derived and/or modified sequence opt5 from DPM2__Homo_sapiens__NP_003854
auggccaccgggacagaccagguggucgggcugggacucguugcugugagccugaucauuuucacguacuauaccgccugggugauccuucugcccuuuauugauucccaacacgucauccauaaguacuuccucccuagagcguaugcuguggccauuccgcuggccgcuggccuucugcuccugcuguuuguuggccucuucaucucuuacgugaugcugaaaacaaagcgggucaccaaaaaggcccaguga

SEQ ID NO: 68522 - RNA, 369 nt, Artificial Sequence
  derived and/or modified sequence opt5 from DPM3__Homo_sapiens__NP_061846
augcugagcgugggcgggcucagacugucccuuguccgguucucuuuucugcuccugcgcggagcccuucugcccagccucgcuguuaccaugacaaagcuggcccaguggcuguggggccucgcgauccugggguccacguggguggcucuuaccacaggagcccugggccucgagcugccucuuucuugccaagaagugcuguggccgcuccccgccuaccugcuggucagcgcuggguguuaugcccucggaaccgugggcuacagaguugcuacauuccacgacugcgaggaugccgcgcgggaacugcagucccagauucaggaggcccgcgcugaccuugccagacggggccugcgcuuuuga

SEQ ID NO: 68523 - RNA, 2403 nt, Artificial Sequence
  derived and/or modified sequence opt5 from DPP10__Homo_sapiens__NP_001171505
augaccgccgcuaagcaggagccccagccuacaccgggcgccagagcgagccaggcucagcccgccgaccaggaacugggguccaacucuccuccccaacggaauuggaaaggaaucgccauugcucuccuggugauccuugucguuugcagccugauuacgauguccgugauccuccugaccccugaugagcuuacaaacucuagcgaaacccgccugucccucgaggaccuguucagaaaggauuuugugcugcacgaccccgaagcccgguggauuaaugauacagacgucguguacaaaucugagaacggccauguuaucaagcucaauaucgagaccaacgcuacaacccugcuucuggaaaauacgaccuucgugacauuuaaagccagccgccacuccgucagcccugaucucaaguaugugcugcuugcguacgacguuaagcagauuuuccauuauucuuacaccgccuccuaugugaucuacaacauucacacaagagaggucugggaacugaauccgcccgagguggaggauagcgugcuccaguaugcugccuggggaguccaggggcaacagcugaucuacauuuuugaaaacaauaucuacuaucagccugacauuaaaucuuccagccugcggcucaccucuuccggcaaggaggaaaucaucuucaacgggauugcugauuggcuguacgaggaagaacuucugcauagccacaucgcccacugguggucccccgacggagagcgccucgcguuucugaugauuaaugauucucuuguuccuacgauggugauccccagauucacaggcgcccuguauccgaaaggcaagcaguacccuuaucccaaagcugggcaagugaacccuaccauuaagcucuacgucgugaaucuguauggacccacacauacccuggaacucaugcccccugacagcuuuaagucccgggaguacuacaucaccaugguuaaaugggugagcaacacaaagacggucgugcgcuggcugaacagagcccagaauaucucuauucuuaccguuugugaaacaaccacaggcgcuugcuccaaaaaguaugagaugaccagcgacacguggcugucucagcaaaacgaggagccgguguucagccgggauggguccaaauuuuucaugacaguccccgugaagcagggaggccgcggggaguuucaccauaucgccauguuccucauucagucuaaaagcgaacagaucaccgucagacaccugaccuccggaaauugggaggugauuaagauccuugccuacgacgaaacaacccaaaagaucuauuuccugagcacagagucuuccccucggggccgccagcucuacagcgcuucuacggaaggccugcugaacagacaguguauuuccugcaauuuuaugaaagagcaguguaccuauuucgaugcgagcuuuucccccaugaaccaacacuuccuccuguuuugcgaggggccucggguucccguggucucucuucauagcacagacaauccggccaaguacuucauccuggaauccaacucuaugcucaaagaggcuauucugaagaaaaagaucggaaagccugaaauuaaaauccugcacauugaugacuaugagcuuccccuccagcugagccugccuaaggauuuuauggacagaaaucaguacgcccuccugcuuaucauggaugaggaacccggcgggcagcuggugaccgacaaauuccauaucgauugggacuccguucucauugacauggauaacgugaucgucgcccgcuuugacggacggggcagcggguuccaaggacugaagauucugcaggagauccacagacgccuuggcucuguggaagugaaagaucagauuacagcuguuaaguuucuccugaagcugccuuacaucgacuccaaacggcucagcaucuucggcaagggguauggaggcuacauugccucuaugauccugaaauccgaugagaaacuuuuuaagugugggagcgucguggcgcccauuaccgaccugaagcucuaugcuucugccuucagcgaaagauaccugggaaugccguccaaggaggagagcacguaucaggccgcuucugugcugcauaauguccacggccuuaaagaagagaacauccucauuauccacgggaccgccgauacaaaggugcauuuccaacacuccgcugaacugaucaaacaucugauuaaggccggcguuaauuacaccaugcaaguguauccugacgagggacacaacgucagcgaaaaauccaaguaccaccucuacucuacaauccugaaauuuuucagcgauugccuuaaggaggagauuuccgugcugccccaggaacccgaggaagacgaguga

SEQ ID NO: 68524 - RNA, 2124 nt, Artificial Sequence
  derived and/or modified sequence opt5 from DPP3__Homo_sapiens__NP_001243599
auggccgacacccaguacauccugcccaacgauauuggcgugagcucccucgacugcagagaggcuuuccggcugcuuucuccuacagaacgccuguaugccuaccaccucagcagagcggcuugguaugggggacuggccguccuucugcaaacguccccggaggcccccuacaucuaugcucuccugucucggcuguuucgcgcccaggauccugaccagcucagacagcaugcucuggccgaaggccuuaccgaggaagaguaccaagagaagcuggaacggguuauucucgggagcgaggcggcccagcagcaccccgaagaggugcgcggacuguggcagacauguggcgagcuuauguucucccuggaaccuagacuccggcaucuggggcugggaaaagagggcaucaccacauauuuuucuggcaauugcaccauggaagaugcuaagcucgcccaagacuuccuggauagccagaaccuuuccgcuuacaauacacgccuguuuaaagagguggacggggaaggaaagcccuacuaugaggucagacucgccagcgugcugggcucugagccuucccuugauagcgaaguuaccucuaaacugaaguccuacgaguuccgggggagcccguuucaggugacgcgcggagacuaugcgcccauucuccagaaggucguggaacaacuggagaaagccaaggcuuacgccgcuaacucucaccagggccagaugcuggcccaauauaucgaauccuucacccaggggagcaucgaggcccauaaaagaggaucccgguuuuggauucaggauaagggcccuaucguugagucuuacauuggcuucaucgaaagcuaucgcgaccccuuuggguccagaggagaguucgaaggcuuuguggcugucgugaauaaagcgaugagcgccaaguucgagcggcucguggcuucugccgaacagcugcuuaaggagcugccuuggcccccgacauucgagaaagauaaguuucucaccccugacuucacaucccuggacguccuuaccuuugccgggagcggcauucccgcuggaaucaacauuccuaauuacgaugaccugagacaaacggaaggguucaaaaacguuucucucggaaaugugcuggccguggcguacgcuacacagcgcgagaagcugaccuuucucgaagaggaugacaaagaucuguauauccuuuggaagggccccagcuucgacguccaggugggccugcacgagcuccuggggcacggauccggcaaacuguuuguucaggaugaaaagggggccuucaacuuugaccaagagacagugaucaaucccgaaaccggagagcagauucagucuugguaccggagcggcgaaaccugggauuccaaguucagcacaaucgccucuuccuaugaggaguguagagcugaaagcgucgggcuuuaccucugccugcauccucaggugcuggagauuuuuggcuucgaaggagccgacgcugaggauguuaucuaugugaacuggcucaauaugguccgcgccggccugcuugcgcuggaauuuuacacgccggaggccuucaacuggcggcaagcucacaugcaggccagauucgugauucuccgcguccugcuggaggcuggggaaggacuugugaccaucacacccaccacaggcucugacgggcggccugacgccagaguucgccucgaucgguccaaaaucagaagcgugggaaagcccgcgcuggagcgcuuucugcggagacuccagguccugaaauccaccggcgacguggccgggggccgggcucuuuaugaaggauacgccacgguuacagaugcuccucccgaguguuuccugacccuccgcgacaccgugcugcugagaaaggaaucucggaaacuuauuguccagccgaauacaagacucgagggcagcgaugugcaacugcuggaguacgaagccuccgccgcugggcucauccgcucuuuuagcgagcgguucccugaagacggacccgagcuggaggaaauucuuacccagcuggcgacagccgaugcuagauuuuggaagggcccuuccgaggcccccagcgggcaggccuga

SEQ ID NO: 68525 - RNA, 2301 nt, Artificial Sequence
  derived and/or modified sequence opt5 from DPP4__Homo_sapiens__NP_001926
augaagacccccuggaaagugcugcucggccugcuuggggccgcugcccuggucacaaucauuacgguuccuguggugcuccugaacaagggaaccgacgaugcgacagcugacagcagaaaaaccuacacacuuaccgauuaucugaagaauacauaccggcucaaacuguauucccugcgcuggaucucugaccacgaguaccucuauaagcaggaaaacaauauucuggucuucaacgccgaguacggcaauagcuccguguuucuugaaaacucuaccuucgaugaguuugggcauagcaucaaugacuauuccauuucuccggauggacaauucauccugcucgaauacaacuacguuaagcaguggagacacagcuauacggccuccuacgacaucuaugaucugaauaaacggcagcuuauuaccgaggagcgcauccccaacaauacacagugggugaccuggagcccugucggccauaagcuggcuuacguguggaacaaugacauuuauguuaaaaucgaacccaaccucccuucuuacagaauuacauggaccgggaaggaggauaucauuuauaauggaaucacggacuggguguacgaagaggaggucuuuuccgccuacagcgcucugugguggucucccaacggcacauuccuggccuaugcgcaauuuaacgauaccgaagugccucucaucgaguacuccuucuauagcgacgaaucucugcaguacccgaaaacagugcggguccccuauccuaaggccggcgcuguuaaucccaccgugaaguuuuucguggucaacaccgacucccuuagcuccgugacaaaugccacgucuauucagaucaccgcuccugccagcaugcugauuggggaucacuaccucugcgacguuacaugggcgacccaggagcgcaucucccugcaauggcuuagacggauucagaacuauagcgugauggauaucugugacuacgaugaaucuuccggacgcuggaauugccuggucgccagacagcauaucgagaugagcacaaccggcuggguggggcgguuucgccccucugagccgcacuucacgcucgacggaaacagcuuuuacaaaauuaucuccaaugaagagggcuauagacacauuuguuacuuccagaucgauaagaaagacugcacauucauuaccaaggggaccugggaaguuaucggaaucgaggcucugacaucugauuaucuguacuauauuagcaacgaauacaaaggcaugccuggcgggcggaaucucuauaagauccaacuguccgacuacaccaaagugacaugucuuagcugcgagcugaaccccgagcgcugucaguacuauucugucuccuuuagcaaggaagccaaguacuaucagcucagaugcucuggaccuggccugccccuuuacacgcugcauuccagcgugaaugauaaagggcuccggguccuggaggacaacuccgcucuggacaagaugcuccaaaaugugcagaugcccucuaaaaagcuggauuucauuauccuuaacgaaaccaaauuuugguaucagaugauucugccuccgcacuucgacaagagcaagaaauacccccuccugcuggauguuuaugccggaccuuguucccagaaggccgacacaguguuuagacuuaauugggcuaccuaccucgcgucuacagagaacaucauugucgccagcuucgauggccgcggguccggauaccaaggcgacaaaaucaugcaugcuaucaaccggagacugggcaccuuugaaguggaggaucagauugaggccgcccgccaguucagcaagaugggguuuguugacaauaaacggaucgcuauuuggggauggucuuauggcggguacgugacguccaugguccugggaagcggcucugggguguucaagugcggcaucgccguggcgcccguuuccagaugggaauauuacgauagcgucuauaccgagcgcuacaugggacucccuacacccgaagacaaccuggaucacuauagaaauucuaccgugaugagccgggcugagaacuuuaaacagguggaguaccuucugauucacggcacagccgacgauaauguccauuuccaacaguccgcccagaucagcaaggcucucguggacguugggguggacuuucaggccaugugguacaccgaugaagaccacggaaucgcuucuuccacggcccaucaacacauuuauacacauaugagccacuucaucaagcaguguuucucccugccguga

SEQ ID NO: 68526 - RNA, 2406 nt, Artificial Sequence
  derived and/or modified sequence opt5 from DPP6__Homo_sapiens__NP_001034439
augaaggagaaagccaugaucaagaccgcuaaaaugcagggcaaugugauggaacuggucgggagcaaucccccucaaagaaacuggaagggaauugccaucgcgcuccugguuauucuugugaucugcucccugauugugacaucugucauccuccugacgccggcugaggacaauagccuuucccagaaaaagaaggugaccguugaagaucuguucucugaggacuuuaaaauccacgaucccgaagccaaguggauuagcgacacagaguucaucuaccgggagcagaaaggcaccgugcgccucuggaacgucgaaacaaauaccuccacagugcugauugaggggaagaaaaucgaaucucugagagccauucgguaugagaucagcccugaucgcgaguacgcucucuuuuccuauaacguugaacccauuuaccagcauagcuauaccggauacuaugugcugucuaagaucccucacggcgacccccaaucccuugauccuccggaggucagcaaugccaagcugcaguacgcuggguggggacccaaaggccagcagcucaucuucauuuuugaaaacaauaucuacuauugugcccaugugggcaagcaagcgauuagaguggucucuacggggaaagagggaguuaucuacaacggccuguccgacuggcuuuaugaagaggagauucugaagacccacaucgcccauugguggagcccugaugggacacggcucgcuuacgccgcuaucaaugacucucgcgugcccauuauggaacugccuaccuauacaggauccaucuaccccaccgugaaaccguaucacuacccuaaggccggcagcgagaaccccuccauuucucugcacgucaucgggcucaauggaccuacgcaugaucuggaaaugaugccucccgacgaucccagaaugcgggaguacuauauuacaauggugaaaugggcgaccagcacaaagguugccgugaccuggcuuaaccgcgcucagaaugucuccauccugacccucugcgacgccacaacgggcguguguaccaagaaacacgaagacgagagcgaggcuuggcugcauagacagaacgaagaaccgguuuucucuaaggauggccggaaauuuuucuuuauccgcgccauuccccaagggggaagaggcaaguucuaccacaucacaguguccagcucucagccuaacagcuccaaugacaacauucagucuaucaccagcggggauugggacgucacaaaaauucuugccuaugaugaaaagggaaauaagaucuacuuucuguccaccgaggaccucccccggcgcagacagcuguauagcgcuaacacggugggcaauuucaaccggcaaugccugucuugugaucucgucgaaaauugcacauacuuuuccgcgagcuucucucacuccauggacuucuuucugcuuaaaugugaggggccuggagugcccaugguuaccgugcauaacaccacagauaagaaaaagauguucgaccuggagaccaaugaacacgucaaaaaggccauuaacgauagacagaugccgaagguggaguaucgcgacaucgaaaucgacgauuacaaucucccuaugcagauucugaaacccgcuacauuuacggacaccacacauuacccucuucugcucguuguggauggcacccccggcagccaguccgucgccgagaaguucgaggugucuugggaaacagugaugguuagcucccacggggccgucguggugaaaugcgacggacggggcucuggguuucaaggaaccaagcugcugcaugaggucagacgccggcucggccugcuugaagagaaagaucagauggaagcugugagaacgaugcugaaggagcaguauaucgaccgcacccggguugccguguucgggaaggauuacggcggauaucucagcacauacauucugccugcgaaaggcgagaaccaggggcaaaccuuuacauguggauccgcucugagccccaucaccgacuucaaacuuuaugccucugccuuuuccgaaagauaccucggccugcacgggcuggauaaucgcgcuuaugagaugacgaaggucgcccaccgggugagcgcucucgaggagcagcaguuccugauuauccauccgacagccgacgaaaagauccacuuucagcauaccgcggagcuuauuacacaacugaucagaggaaaagccaacuacucucuccagauuuacccugaugagucccacuauuucaccagcucuagccugaagcagcaccuguaccgcuccaucauuaacuuuuucguugaaugcuuccggauccaggacaaacuucucaccgugacagcuaaggaggaugaagaggaagacuga

SEQ ID NO: 68527 - RNA, 1479 nt, Artificial Sequence
  derived and/or modified sequence opt5 from DPP7__Homo_sapiens__NP_037511
auggggagcgcccccugggcuccugugcugcuccuggcccuugggcugagaggacuccaggcgggcgcucggcgcgccccggaccccggguuccaagagagauuuuuccagcagcggcuggaucacuuuaacuucgaacgcuuuggaaauaagaccuucccucagagauuucuugucuccgaccgguucuggguucgcggcgaggggcccaucuuuuucuacacaggaaacgaaggcgaugugugggccuuugcuaauaacucugccuucguggcugagcuggccgcggaaagaggcgcccuccuggucuuugcugagcaucgguauuacgggaaaagccugccuuucggagcccaauccacgcagcgcggccacaccgagcuccugacaguggaacaggcucuugccgacuucgcggagcugcucagagcccugcggcgcgaucuuggggcucaggacgcccccgcuauugccuuuggaggcucuuaugggggaaugcugagcgccuaccucagaaugaaguauccucaucugguugcuggcgcgcuggccgcuuccgccccggugcucgccgucgcuggccugggggauucuaaucaauucuuucgggacgugaccgccgauuucgaaggacagagccccaaaugcacacagggcguucgcgaggcguuuagacagaucaaggaccuuuuccugcaaggggcuuacgauaccgugcggugggaguuuggaacaugucagccucucuccgacgaaaaagaucugacccagcuuuucauguuugccagaaacgccuucacgguccuggcuaugauggacuaucccuacccuaccgacuuucucggcccccugccggccaauccugugaagguggggugcgaucgccugcucagcgaggcucaacggauuacaggacugagagcccuugcgggccuggucuacaacgccucuggcuccgaacacuguuaugacaucuaccgccucuaucauagcugcgcugaucccaccggguguggaacaggcccugacgcccgggcuugggauuaccaggccugcaccgagauuaaucugacguucgcgucuaacaauguuacagacauguuucccgaucuucccuucaccgacgaacugagacagcgcuauugucucgauacauggggaguguggccucggccggacuggcugcugaccuccuucuggggaggcgaucucagagccgcuagcaacaucaucuuuucuaaugggaaccuggaccccugggccggcggaggcauucgccggaaucuuuccgcuagcgugaucgccgucaccauucaagggggagcccaccaccuggaccucagagcuucccauccugaggaucccgcgucugugguugaggcccgcaagcuggaagcuacaaucauuggcgagugggugaaagccgcccggagagaacagcagccugcucugcggggcgggccccgccuuagccucuga

SEQ ID NO: 68528 - RNA, 2349 nt, Artificial Sequence
  derived and/or modified sequence opt5 from DPP8__Homo_sapiens__NP_060213
auggccgcugccauggagaccgaacagcugggcguggagaucuucgaaacagcggacugcgaggaaaacauugagagccaagauagacccaagcucgagccuuuuuacgucgaacgguauuccuggucucagcugaaaaagcuccuggcugacacgcgcaaauaccacggguauaugauggccaaggccccgcaugauuucauguuuguuaaaagaaaugaccccgauggaccucacagcgaccggaucuacuaucucgcuauguccggcgagaaccgcgaaaauacccuguucuacucugagauucccaagacaaucaacagagccgcugugcuuaugcugagcuggaagccucuccuggaucuguuucaggccacccucgacuaugggauguacucccgggaggaagaacugcuucgcgaaagaaaacggauuggaacagugggcaucgcgucuuacgauuaucaucaggggagcggaaccuuccuguuucaagccggcuccggcaucuaccacgucaaggacgggggaccccagggcuucacacagcagccucuccgcccgaaucugguggagaccagcugucccaacauuagaauggauccuaaacuuugccccgcugacccugauuggaucgccuuuauucauucuaaugacaucuggauuuccaacaucguuacgcgggaggagcgcagacugaccuaugugcacaaugagcucgcuaacauggaagaggacgcccggagcgcgggggucgccacauucgugcugcaagaagaguuugaucgcuacucuggauauugguggugucccaaggcugaaaccacaccguccggcgggaaaauucugagaauccucuacgaggagaaugacgaaagcgagguugaaaucauucacgugaccucuccuaugcuggagacgcggagagccgauuccuuccgcuaucccaagacaggaaccgcuaacccuaaggucacauuuaaaaugagcgaaaucaugauugacgccgagggccggaucauugaugugaucgacaaggagcuuauccagcccuucgaaauucuguucgagggcguggaauacaucgccagagcuggguggacccccgagggaaaauacgcgugguccauucuccuggaucgcucucagacccggcuucagaucguccugauuagcccugagcucuuuaucccgguugaagacgaugugauggagagacaacgccugaucgaauccgugcccgacagcgucacaccucugauuaucuaugaggaaacgaccgauauuuggaucaauauucaugacaucuuccacguguuuccccagucucaugaggaggaaauugaguucaucuuugccuccgaaugcaagacaggcuuccggcaccucuacaaaaucaccagcauucugaaggagucuaaauauaagagaagcuccgggggacuuccugcucccucugacuuuaaguguccgaucaaagaagagauugccaucacaagcggcgagugggaaguucuggggcgccacggauccaacauucagguggaugagguccggagacucguguacuucgaaggcaccaaggacagcccucuggagcaucaccuuuauguugugucuuacgucaaucccggcgaagugacgcgccugacagaucggggguauucccauagcugcuguaucucucaacacugcgacuuuuucaucuccaaauacagcaaccagaagaacccucauugugucucccucuacaaacugucuagccccgaggaugacccuaccugcaagaccaaggaguuuugggccacaauucuggauuccgcuggaccccucccggacuauaccccucccgaaaucuucucuuuugagagcacaacgggcuucacccuguacgggaugcuuuauaaaccccacgaucugcagccuggaaagaaauacccgacagugcuuuucauuuauggcgggccccagguugccaucgcgggcgcuccugugacccuguggaucuuuuacgacacaggauauaccgaaagauacaugggccaccccgaucaaaaugagcagggguacuaucugggauccgucgccaugcaggccgagaaguucccuagcgaacccaaccggcuucuccugcugcauggcuuucucgacgagaaugugcacuucgcucauacgucuauucugcuuuccuuucugguucgcgccgggaaaccuuacgaucuccagaucuauccccaagaaagacacagcauucgggugccggagucuggagaacacuacgagcugcaucugcuucacuaucuccaggagaaccugggcuccagaaucgcugcccugaaggucauuuga

SEQ ID NO: 68529 - RNA, 2679 nt, Artificial Sequence
  derived and/or modified sequence opt5 from DPP9__Homo_sapiens__XP_005259730
augagaaaggugaaaaagcugcggcucgacaaagagaacaccggcagcuggcgcuccuucucucugaauagcgaaggggccgagagaauggcuacaacgggaacccccacagccgaucggggcgacgcggcugccaccgaugacccugccgcucgcuuucagguccaaaagcacuccugggaugggcuuagaucuaucauucauggaagccggaaauacuccggccugaucguuaacaaggccccgcacgacuuccaguuugugcagaagacagaugaaucugggccccauagccaccgccucuauuaccugggaaugccuuauggcuccagagagaauagccuucuguacucugaaauucccaaaaaggugcggaaagaggcucuccugcugcucuccuggaagcagaugcuggaccauuuccaagccaccccucaccacggcgucuauagccgcgaggaggaacuucugagagaacggaaacgccucgggguguuuggaaucacaucuuacgauuuccauuccgagagcggccuguuucuuuuccaggcgucuaacucccuguuucacugcagagacgggggaaagaauggcuucaugguuagccccaugaagccucucgagauuaaaacccaguguuccgggccgcggauggaucccaagaucugcccugccgaccccgccuuuuucucuuuuaucaacaauagcgaucuguggguggcuaacauugaaacgggagaggaacgcagacugaccuucugucaucagggccucuccaauguccuggacgacccuaaaagcgcuggcguggccacauucguuauccaagaggaauuugaucgguucaccggguauugguggugccccacagcgucuugggagggauccgagggccuuaagacccugcgcauucucuacgaagagguggacgaaagcgaggucgaagugauccacgugccgucuccugcccuggaggagagaaaaacggauagcuaccgguaucccagaacaggguccaagaacccuaaaauugcucuuaagcuggccgaauuucagaccgacucucagggaaagaucgucagcacacaggagaaagaacucguucaacccuucuccagccuguuucccaagguggaguacauugcucgcgccggcuggacccgggaugggaaauaugccugggcuauguuccuggacagaccucagcaguggcuccaacuggugcuucugccgcccgcgcucuuuaucccuucuaccgaaaaugaggagcagcgccuggccuccgcucgggccguccccagaaacgugcagccuuacguuguguaugaagaggucacaaauguguggaucaacguucacgauauuuucuaccccuuuccgcagagcgaaggagaggacgagcuuuguuuccugcgcgccaaugaaugcaagacgggcuuuugucaucucuauaaagugaccgcuguccugaagucucaaggcuacgauugguccgagccuuucagccccggggaagacgaguuuaagugcccuaucaaagaagagauugcccugacauccggagagugggaagugcucgcgcggcacggcucuaagaucugggucaacgaggaaaccaaacugguguacuuccaggggacaaaggauacgccccuugagcaucaccuguauguugugagcuacgaagcugccggagagauugucagacucaccacaccuggcuucucccauucuuguagcaugucccagaacuuugacauguucgugagccacuauucuuccguuagcacacccccgugcgugcacgucuacaaacugucugggccugacgaugacccccugcauaagcagccccgcuuuugggccuccaugauggaggcugccagcuguccuccggauuaugugcccccugaaaucuuccacuuucauacccggucugacgugagacuuuacggcaugaucuauaagccccacgcucuccaaccuggcaaaaagcaccccaccguucuguucgucuacggagggccucaggugcagcuggugaauaacagcuuuaaaggaauuaaguaccuccggcugaauacccuugccucccugggcuaugcggucgugguuaucgaugggcgcggaagcugccagagaggccuccgguucgagggggcccugaaaaaccaaaugggccagguggaaauugaggaccaggucgaaggacugcaguuuguggcugagaaguacggcuucaucgaucuuucuagaguugccauucaugggugguccuauggaggcuuucucagccugauggggcugauccacaagccccaaguguucaaagucgcuaucgccggagcgccggugacaguuuggauggccuacgacacgggcuauaccgagcgcuacauggaugugccugaaaauaaccagcauggguaugaggcuggcuccgucgcccuccacguggaaaagcugcccaaugagccuaaccggcuucugauucuccauggauuucuggacgagaaugugcacuucuuccacacaaacuuucuggucucucagcuuaucagagcuggcaaacccuaccaacuccagauuuacccgaaugaacgccauagcaucagaugcccugaguccggggaacacuaugagguuacccugcugcauuuccuccaggaauaccuguga

SEQ ID NO: 68530 - RNA, 897 nt, Artificial Sequence
  derived and/or modified sequence opt5 from DPPA2__Homo_sapiens__NP_620170
augagcgacgccaaccuggauuccucuaagaaaaauuuccucgagggcgaaguggacgaugaggaaagcgucauccugacccuuguucccgugaaggacgaugcuaacauggagcagauggaaccuuccgugucuagcacauccgacgucaaacuggagaagccgaaaaaguacaaucccgggcaccuccugcaaacgaacgagcaguuuaccgccccucagaaggcgagaugcaaaauucccgcccuuccucugcccacaauccucccuccgauuaauaaggugugucgggauacccugcgcgacuggugccagcaacugggacucucuacaaacggcaaaaagaucgaaguuuaucugagacuucaucggcacgcuuaccccgagcagcgccaggauaugccugaaaugagccaggagaccagacugcaacgguguucccgcaaaagaaaggccgugacaaagcgggcucgccuccagagaagcuaugagaugaaugaacgggccgaggaaaccaacacggucgaggugauuaccucugcucccggggccaugcuggcguccugggcccgcaucgcugccagagcuguucagccuaaagcccuuaauagcugcucuauccccguguccgucgaagcguuccugaugcaggccagcggagugcgguggugugugguccauggccgccuccugucugcugacacaaagggguggguuagacugcaauuucacgccggacaggcuugggugccgaccacacaucggagaaugauuucccucuuccugcuuccugccugcaucuuucccagcccuggcauugaggauaacaugcugugucccgacugcgccaaacgcaauaagaaaaugaugaagcggcucaugaccguggagaaauga

SEQ ID NO: 68531 - RNA, 480 nt, Artificial Sequence
  derived and/or modified sequence opt5 from DPPA3__Homo_sapiens__NP_954980
auggaccccagccaguucaacccuaccuacaucccgggcucuccccaaaugcugacagaggaaaauuccagagaugacagcggggccucccagauuucuagcgagacgcucaucaagaaccuguccaaucuuaccauuaacgcuucuagcgaauccgugagcccucugucugaggcccuccugcggcgcgaauccgucggagcggcuguucuuagagagaucgaggaugaauggcuguauagccggcgcggcgugagaacacuccugucugugcagcgggagaaaauggcccgccugagauacaugcuccuugggggaguccggacccacgaacgcagacccacaaauaaggagccuaaaggcgugaagaaagagucccggcccuuuaagugcccuuguagcuucugcguuucuaacgggugggacccguccgaaaaugcccgcauuggaaaccaggauaccaagccccugcaaccuuga

SEQ ID NO: 68532 - RNA, 915 nt, Artificial Sequence
  derived and/or modified sequence opt5 from DPPA4__Homo_sapiens__NP_060659
augcugagaggcagcgccuccucuaccagcauggagaaggcuaaagggaaggaauggacauccacggagaaaucucgggaagaggaccagcaagccagcaaccagcccaauuccaucgcgcucccuggaaccucugcuaagcgcacaaaagaaaagaugagcauuaagggcuccaaagugcugugcccgaagaaaaaggccgagcacaccgauaaccccagaccucagaaaaagauccccauuccuccccuuccuagcaagcugccgcccgucaaucucauccaucgggacauucugcgcgccuggugucagcaacuuaaacugucuuccaaggggcagaaacucgaugcuuacaagagacugugcgccuucgcuuauccuaaccagaaagacuuccccagcacagccaaggaggcgaaaauccggaagucucugcagaagaaacucaagguugaaaaaggagagaccucccugcaaagcucugaaacacacccucccgagguggcccuuccgccugugggcgagcccccugcucuggaaaauuccaccgcccuccuggagggggucaacacggugguugugaccacaagcgcucccgaagcccuucuggcguccugggcccgcaucucugcuagagcccggacccccgaggcugucgaaagcccucaggaggccuccggagugcgcugguguguugugcauggcaagagccucccggccgauacagacggcuggguccaucugcaguuccacgcugggcaggcgugggugcccgagaaacaagaaggaagagugucugcccuguuucuccugccugcuuccaauuuucccccuccccaccuugaggauaacaugcugugcccgaaguguguccaccggaauaagguucucauuaaaagccugcagugggaauga

SEQ ID NO: 68533 - RNA, 606 nt, Artificial Sequence
  derived and/or modified sequence opt5 from DPT__Homo_sapiens__NP_001928
auggaccugagccuccugugggugcuucugccccucgucaccauggccuggggccaguacggggauuauggauacccuuaucaacaguaccacgacuauuccgaugacggcuggguuaaccugaauagacagggguucucuuaccagugcccgcaaggacaggugaucguggcuguccggagcaucuuuuccaagaaagagggcucugaucgccaguggaacuaugccuguaugcccacaccucagagccuuggggaacccacggagugcuggugggaagagauuaauagagcgggaauggaaugguaccaaaccuguuccaacaauggccugguggcuggcuuccagucucgguacuuugagagcguucucgaccgcgaguggcaguucuauugcuguagauacuccaagcggugcccuuauagcuguuggcugacaaccgaauaccccgggcauuauggagaggaaauggauaugauuucuuacaacuaugacuacuacauccgcggcgccacaaccacauuuuccgccguggagagagaucggcaguggaaauucauuaugugccgcaugaccgaguaugacugugaauuugcuaaugucuga

SEQ ID NO: 68534 - RNA, 2277 nt, Artificial Sequence
  derived and/or modified sequence opt5 from DPY19L2__Homo_sapiens__NP_776173
augagaaagcagggcgugagcuccaaacggcugcaaucuagcgggcgcucccagucuaagggaagacggggcgccagccucgcucgcgagcccgaagucgaggaagagauggaaaaauccgcccuugggggaggcaagcugccuagagggucuuggcggagcuccccgggacgcauccagagccugaaagagagaaagggccucgagcuggaaguuguggcgaagaccuuccuucugggccccuuucaguucgugcggaacucucucgcucaacugcgcgagaaaguccaggaacugcaggccagacgguuuuccagccgcacaacgcucgggauugccguguucguugcuauccugcacuggcuucaucuggugacccucuuugagaaugacagacacuucucucaucuguccagccuugagcgggaaaugacauuucgcaccgagaugggacuguacuauucuuacuucaagacaauuaucgaagccccuuccuuucucgagggccuguggaugauuaugaacgauagacugaccgaauauccccucaucaucaaugcuauuaaacgguuccaccuguacccugaggucaucauugccagcugguauugcacauuuauggggaucaugaaccuuuucggacuggagaccaagacguguuggaaugugaccagaauugaaccccucaacgagguucaguccugcgaaggccugggggacccugcguguuuuuacgugggagucaucuucauucuuaauggccugaugaugggccucuucuuuauguauggggccuaccugucuggaacacaacugggcgggcucaucaccgugcugugcuucuuuuucaaccauggagaggcuacacgcgugauguggaccccgccccuucgggaaucuuuuuccuacccuuuccugguccuccagauguguauccugacgcuuauucugagaacaagcucuaaugaucgccggcccuuuaucgcccucugccuguccaacguugcuuucaugcugccuuggcaguuugcccaguucauucucuuuacccaaaucgcgagccuguuccccauguauguggugggcuacauugagccgucuaaauuucagaagaucaucuauaugaauaugauuagcgucacacuuuccuucauccugauguucgggaacucuauguaccucagcuccuauuacagcagcucccugcugaugaccugggccauuauccuuaagagaaaugagauucagaaacucggagugagcaagcugaacuuuuggcugauccaaggcucugcuuggugguguggcaccaucauucucaaauuccugacauccaagauccuugggguuagcgaccacauucgccuguccgaucucaucgccgcucggauucugagauauacggacuuugauacccugaucuacacaugcgccccugaguucgacuuuauggaaaaagccacaccccuucgcuacaccaagacccuccugcugccuguggucauggugauuacguguuucaucuuuaaaaagacaguucgggauaucucuuaugugcucgcuaccaauauuuaccugagaaagcagcuucuggaacacagcgagcucgcguuccauacccugcagcugcuugucuuuacagcccucgcuauccugauuaugcgccugaaaauguuccucacaccccacaugugcgugauggccucccugaucuguucucggcagcuuuuuggauggcuguucagacggguccgcuuugaaaaggugauuuucggcauccucaccguuaugagcauccaaggguaugccaaccugagaaaccagugguccauuaucggagaguucaauaaccugccccaggaggaacuucuccaguggauuaaauacagcacgaccucugacgcuguguuugccggcgcgaugccuacaauggcuuccaucaagcugagcacccugcauccgauugucaaucacccccacuaugaggaugccgaccuccgggccagaacaaaaaucguguacucuaccuauucccgcaagagcgcuaaggaaguucgggauaaacugcuugagcugcaugugaacuacuacguccucgaggaagccuggugcguggugagaacgaagccugggugcucuaugcuggagaucugggacguugaagaccccagcaaugcugccaacccuccccuguguuccguccuucuggaggaugcgcgcccguauuucaccacaguguuucaaaauagcguguacagaguccucaaagugaacuga

SEQ ID NO: 68535 - RNA, 2151 nt, Artificial Sequence
  derived and/or modified sequence opt5 from DPY19L3__Homo_sapiens__XP_011524828
augaugagcaucagacagcggcgcgagauuagagccaccgaaguguccgaggacuuccccgcucaagaagagaacgucaagcuggaaaauaaacucccuucuggcugcacaagccggcgccuguggaagauccuuucccugacgauugggggaaccaucgcccucuguauuggccugcuuacaucuguuuaccuggcgacccuccacgagaacgaucugugguuuagcaauaucaaagagguggaaagagagaucuccuuccggacagaaugcgggcuguauuacucuuauuacaagcagaugcuccaggcuccgacccuggugcagggauuucauggccuuauuuaugacaacaaaacagagagcaugaagaccaucaaucugcuccaacgcaugaacauuuaccaggaggucuuccuguccauccuuuauagagugcugcccauucagaaguaccucgaaccuguuuacuuuuauaucuacacgcuguucgggcugcaggccauuuaugugaccgcccucuacaucacaagcuggcugcuuucuggaaccuggcuguccggccuccuggcugccuuuugguaugucacaaaucggaucgauaccacgcgcguggaguucacaauuccccuuagagaaaacugggcucugcccuuuuucgccauccaaauugcggccaucaccuacuuucuccggccuaaucugcagccucugagcgagcgccucacacugcuugcuauuuucaucucuaccuuucuguucucccucaccuggcaguucaaccaguuuaugaugcugaugcaagcccuuguucuguucacacucgacagccuggauaugcugccggcugugaaagccacguggcucuauggcauccagauuaccucucugcuucuggucuguauccuccaguuuuucaauuccaugauucuggggagccugcuuaucuccuuuaaccucucuguguucauugcgagaaagcugcagaaaaaucugaagacaggcagcuuucucaaccggcugggaaaacuucugcuccaccuguucauggugcugugccuuacccucuuucugaauaacaucaucaagaagauucugaaccucaaauccgacgaacauaucuucaaguuucugaaagccaaguucgggcuuggagcuacacgcgauuuugacgccaaucuguaccucugugaggaggcuuucggccugcugcccuucaacaccuuugggagacuuagcgauacgcuccuguucuacgccuauauuuuuguccugucuaucacaguuauuguggccuucguggucgcuuuucacaaucucuccgacagcaccaaccaacagucugugggaaaaauggaaaagggcaccguugaucugaaaccugagacagcguacaaucuuauccauaccauucuguucggcuuucucgcccugagcacaaugcggaugaaguaucuguggacgucccacaugugcguguucgcuucuuuugggcuuuguagccccgaaaucugggagcuccugcugaaguccguccaccucuacaacccuaaaagaaucugcauuaugcgcuauagcgugcccauccugauucuucuguaccucuguuauaaguucuggccgggaaugauggacgaacugucugagcugcgggaguuuuacgauccugacaccguugaacuuaugaauuggaucaacuccaauacacccagaaaagccguguucgccggcagcaugcagcugcucgcuggggucaagcugugcaccggacgcacacucaccaaccauccucacuacgaggacucuucccugcgggaaagaacgcgcgccguguaucaaauuuacgcgaaacgggcucccgaggaaguccaugcccuucugcgcagcuuuggcaccgauuaugugauccucgaggacuccaucuguuacgagagacggcacagacgcgggugccggcugagagaucugcuugacauugccaauggacacaugauggauggccccggcgaaaacgacccugaucugaagccggcugaccauccccgguucugcgaggaaaucaagcgcaaucucccucccuauguugccuacuucacaagaguguuucagaacaaaaccuuccacgucuauaagcugucucggaauaaauga

SEQ ID NO: 68536 - RNA, 300 nt, Artificial Sequence
  derived and/or modified sequence opt5 from DPY30__Homo_sapiens__NP_115963
auggagcccgaacagaugcuggagggccaaacccagguggccgaaaacccucacagcgaguacgggcucacagacaaugucgaaagaaucguugagaacgagaagauuaaugcugaaaaauccucuaagcagaaaguggaucugcagagccuuccgacgcgggccuaucuggaccaaaccgugguccccauccuccugcagggacuugcggugcuggcuaaggagcgcccucccaacccuauugaguuccucgccuccuaccugcugaaaaauaaggcccaguuugaagauagaaacuga

SEQ ID NO: 68537 - RNA, 1560 nt, Artificial Sequence
  derived and/or modified sequence opt5 from DPYS__Homo_sapiens__NP_001376
auggccgcucccagcagacugcucauccggggcgggcgcguggucaacgacgauuucuccgagguugccgacgugcugguggaagauggagucgugagagcgcuuggccacgaccugcucccucccgggggagcuccggccggccugcggguucuugaugccgcugggaagcuggugcucccuggaggcauugacacccauacacacaugcaguuucccuucaugggcucucgcagcaucgaugacuuucaucaagggacgaaagccgcucuguccggaggcaccacaaugauuaucgauuucgccauuccucagaaagggggaucucugaucgaggcguuugaaaccuggagaagcugggccgaccccaaggucugcugugauuacucccuccacguggcuguuacaugguggucugaccaggugaaggaggaaaugaaaauccugguccaggauaagggcgugaauagcuucaagauguuuauggccuauaaagaccuuuacauggugaccgaccuggagcucuaugaggcuuucucccggugcaaggaaauuggggccaucgcgcaaguccaugccgagaacggagaucugauugcugaaggcgccaaaaagaugcuugcucugggcaucacagggccugagggacacgagcucugucgcccggaagccguugaggccgaagcuacccugagagcgauuacgaucgccagcgcugugaauugcccccuguacauugugcacgucaugucuaaauccgccgccaaggugaucgcugacgcccggcgcgauggcaagguuguguauggggagccuaucgcggcuagccucggaaccgacggcacacauuacuggaacaaagaauggcaccaugccgcccaccacgucauggggcccccucugagacccgauccgucuaccccugacuuucuuaugaaucugcucgcuaacgaugaccugacaaccacgggaacagauaauuguaccuucaacacaugccagaaggcccuuggcaaagacgauuuuaccaagauucccaauggcgugaacgggguugaggaccggauguccgugaucugggagaaaggaguccauagcggcaagauggacgaaaaucgcuucguggcugucaccucuacaaacgccgcgaaaauuuuuaaucuguauccuagaaaggggcggaucgccgugggauccgaugcugacauuguuaucugggaucccaagggcacgcgcaccaucagcgccaaaacacaccaucaggcugugaacuucaauauuuucgaggggauggucugucacggcgugccccucguuaccaucuccagaggaaagguggucuacgaagccggcguguuuucugugacagcgggggacggaaaauucauuccucggaagccguuugccgaguacaucuauaaaagaauuaagcagcgcgaucggaccugcacgcccacaccuguugaaagagcucccuacaagggcgaggucgccacccugaaaagccgcgugaccaaggaggacgcuacagccgggacccggaaacaagcccauccuuga

SEQ ID NO: 68538 - RNA, 2034 nt, Artificial Sequence
  derived and/or modified sequence opt5 from DPYSL2__Homo_sapiens__NP_001184222
auggccgagagaaagcagagcggcaaagcugccgaagacgaggaagugcccgcguucuuuaagaaccugggguccggaucuccuaaaccgcggcaaaaguucugcggcauguuuugucccgucgaggggagcuccgaaaauaaaaccaucgauuucgacucucucagcguuggacgcggcuccggacaggugguggcucagcagagagaugucgcccaccuggggccugacccccaaccucccuacucucggcagggccgcagagccggcggggagccuagcguggaguccggacggaagguugaaauucgcagagcuagcggcaaggaggcccuucagaacaucaaugaucagucugaccggcugcucauuaaagggggaaagaucgugaacgaugaccaauccuuuuaugcugauauuuacauggaagacggccugaucaaacagaucggggagaaucuuauugucccgggaggcgugaagacaaucgaggcccauagccgcaugguuauucccggcgggaucgaugugcacacgagauuccagaugccugaccagggaaugaccucugcggaugacuuuuuccaaggcacaaaagccgcucuggccgggggaaccacaaugauuaucgaccaugucgugcccgaaccuggcaccucccuccuggcugccuuugaucaguggcgggagugggcggacagcaagucuugcugugauuauucccugcacguggacauuagcgaauggcauaaggggauccaggaggaaauggaggcccucgucaaagaucacggaguuaacuccuuccugguguacauggcuuuuaaggaccgcuuccaacuuacagauugccagaucuaugaggugcugucugucauuagagacaucggcgccauugcucaggugcacgccgaaaauggcgauaucauugccgaggaacagcaacggauccucgaccuggggaucaccggacccgagggccauguucuuagccgcccggaagagguggaggcugaagcggucaacagagccauuacgaucgcuaaucagaccaacuguccucuguacauuacaaaagugauguccaagagcucugccgagguuaucgcccaggcucggaaaaaggggaccguggucuauggagaacccauuacagccucccucggcaccgaugggagccacuacuggucuaaaaauugggcgaaggcugccgccuuugugacgagcccuccccugucccccgacccuacaaccccggacuuccugaacucucuccugagcugcggcgaucuucaggucacaggauccgcucauuguaccuucaauaccgcccaaaaggcugugggcaaagacaacuuuacacugauccccgaggggacgaauggaaccgaagagagaaugagcguuaucugggauaaggccguggucacaggcaaaauggacgagaaccaguucguggcgguuaccucuacaaacgccgcuaagguguuuaaucucuacccucgcaaagggcggauugccgucggauccgaugcugaccuggugaucugggaucccgacagcgugaagaccauuucugccaagacgcacaacuccagccuugaauauaauaucuucgagggcauggaaugcagaggguccccucugguugucauuucucagggcaaaaucgugcucgaggauggaacacugcacgugaccgagggcagcgggcgcuacauuccccggaagccguuuccugacuucgucuauaaaagaaucaaggcgcgcucccggcuggccgaacucagaggagugccccgcggccuguacgaugggccuguuugugaggugucugucacccccaaaacagugaccccugcuagcuccgccaagacaagccccgcuaagcagcaagccccgccuguucggaaccuucaucagucuggauuuucccugagcggcgcccagaucgacgauaauauucccagacgcacgacccagcggaucguggcucccccugggggcagagcgaacauuacaucucucggauga

SEQ ID NO: 68539 - RNA, 2055 nt, Artificial Sequence
  derived and/or modified sequence opt5 from DPYSL3__Homo_sapiens__NP_001184223
auggccagcggcagacgggggugggacuccucucacgaggaugaccugcccguguaccucgcucgcccuggaaccacagaucaggucccgagacaaaaguauggcgggauguucugcaacguugaaggagccuuugagagcaaaacgcuggacuucgaugcgcuuuccgugggccagcggggagcuaagacccccagaucugggcagggcagcgaccgcggcuccgggucucggccuggaaucgaaggcgauacaccccgcagagggcagggacgggaggaaagccgcgagccugcccccgccuccccugcuccggccggcguggagauuagaagcgcuaccgggaaagaaguccugcaaaaucucggacccaaggacaaaucugaucggcugcuuaucaagggcggccgcauugugaacgacgaucaguccuuuuacgccgacaucuauauggaggaugggcugauuaagcagaucggagacaaucucaucguuccuggcggggugaaaacaauugaagcgaacggaaagauggucauccccggcgggauugacgugcauacccacuuccagaugccuuacaaaggaaugacaaccguugaugacuuuuuccaaggcacgaaggccgcucuggccggcgggaccacaaugaucauugaucaugugguccccgagccggagagcucucugaccgaggcuuaugagaaauggagagaaugggccgacggaaaguccuguugcgauuacgcgcuccacguggacaucacacauuggaaugauagcgugaagcaggagguccagaaccugauuaaagacaagggcguuaauucuuuuaugguguauauggccuacaaagaucuuuaccagguguccaacaccgaacuguaugagaucuucacgugucucggggagcugggagcuaucgcccaaguccacgcugaaaauggcgacauuaucgcccaggagcagacacggaugcuugaaauggggauuaccggcccugagggacacgugcugagccgccccgaagaacucgaggccgaagcuguuuuuagagcgaucacaauugccucccaaaccaacugcccucuguacgugaccaaggucaugucuaaaagcgcugccgaucugaucucccaggcccggaagaaaggcaaugugguuuucggggagcccaucacagcuagccucggaauugacggcacgcauuauuggucuaagaacugggccaaggcggcugccuuugugaccuccccgccccugagcccggaccccacaaccccugauuacaucaauucucuucuggccagcggggaccuccagcuguccggaucugcucacuguacauucagcaccgcccagaaagcuauuggcaaggauaacuuuacggccauccccgaagggacaaauggcgucgaggaaagaauguccgugauuugggacaaagcggucgccaccggaaagauggaugagaaccaauucguggcuguuaccagcacaaacgccgcuaaaaucuucaaucuuuauccucgcaagggccggaucucugugggguccgacagcgaucuggucauuugggaccccgaugccgugaagaucguuucugcgaaaaaccaucaguccgccgcugaguacaauauuuuugaaggaauggagcucagaggcgccccgcugguggucaucugccaggggaagauuaugcuggaagacggaaaccuccacgugacccagggcgcugggcgcuucaucccuuguagccccuuuuccgauuauguguacaaacggauuaaggccagacgcaaaauggccgaccugcacgcuguuccucggggcauguacgauggacccgucuucgaccuuacaacgaccccuaagggcgggacacccgcgggaucugccagaggcagcccgacccgcccuaauccucccgugcggaaccugcaucaauccggguuuucucucagcggaacacagguggacgagggcgucagauccgcuagcaagcgcaucguggccccucccgggggccggucuaauaucaccucccugagcuga

SEQ ID NO: 68540 - RNA, 1719 nt, Artificial Sequence
  derived and/or modified sequence opt5 from DPYSL4__Homo_sapiens__NP_006417
augagcuuccagggcaagaaauccauccccagaauuaccucugaccggcugcucauccgcgggggaagaauugugaacgaugaccagagcuuuuacgccgauguccacguugaggacggccugaucaagcaaauuggggaaaaucuuaucgugccuggaggcaucaaaacaauugaugcucaugggcugauggugcucccgggaggcgucgacgugcacacgcggcugcagaugcccguucuuggcaugaccccugccgaugacuucugccaggggacaaaggcggcucuggccggaggcaccacaaugauccucgaucauguguuucccgacaccggggucucccugcuggccgcuuaugagcaauggcgcgaaagagccgauucugcugccuguugcgacuacagccuccacguggauauuacacgguggcaugaguccaucaaagaagaacuggaggcgcuuguuaaggaaaagggagugaacucuuuccuggucuuuauggccuauaaagaccgcugucagugcagcgacucccagauguacgagauuuucagcaucauuagagaucucggcgcucuggcccaggugcacgcugaaaauggggacaucguggaggaggaacaaaagcggcuucuggagcucggaaucaccggcccugaaggccacguccugucucaucccgaggaaguugaggccgaggcgguguaucgcgccgugacgauugcuaaacaggccaacuguccucuguacgucaccaaggugauguccaaaggggcugccgaugccaucgcucaggcgaagagacggggaguuguggucuuuggcgaaccgauuacagccagccucgggaccgacggaucucacuauugguccaagaauugggcuaaagccgccgcuuucgugacaucucccccuguuaaccccgauccuaccacggccgaccaucugacaugccuucugagcuccggcgaucuccaggugaccgggagcgcgcacuguacauuuaccaccgcucaaaaggccgucggaaaagacaauuucgcccugauccccgagggcacaaacggcauugaggagcgcauguccauggugugggaaaagugcgucgcuucugggaaaauggaugagaaugaguuuguggccguuacgagcaccaacgcugccaagaucuucaauuuuuacccgagaaaaggacggguggcggucggcuccgacgccgaucuugugaucuggaacccuaaggcuacaaagauuaucagcgccaaaacccacaaucugaacguugaauacaauauuuucgaggggguggaaugucgcggagcucccgccgucgugaucucucagggcagaguggcgcucgaggacgggaagauguucguuacaccuggcgccggacgguuuguccccagaaaaaccuuccccgacuuuguguauaagcgcauuaaagcucggaacagacuggccgaaauccauggcgugccucgcgggcuguacgauggaccgguccacgaggugaugguucccgcuaagccuggcuccggggcccccgcccgggcuagcugcccuggaaagaucucugugcccccggucagaaaccuccaucagagcggcuucucccugucugggagccaagcggacgaucacauugcccgccggacggcucagaaaaucauggccccucccggcggaagauccaauauuacaagccuuucuuga

SEQ ID NO: 68541 - RNA, 1695 nt, Artificial Sequence
  derived and/or modified sequence opt5 from DPYSL5__Homo_sapiens__NP_001240652
augcuggccaacagcgcuuccgugagaauccucauuaagggcgggaaagucguuaaugacgauugcacccacgaggccgacguguacaucgaaaacggaauuauccagcaagugggccgggagcugaugauucccgggggagcgaaggucaucgaugcuacaggcaaacuugugaucccugggggaauugacacgucuacccauuuccaccagacauuuaugaaugccaccuguguugaugacuucuaucauggcacaaaggccgcucuggugggcgggaccacaaugaucauuggacacguccucccggauaaagaaaccagccugguggacgccuacgagaagugccgcggccuugcugaucccaagguuuguugcgacuaugcccugcauguggggaucacguggugggcgccuaaagucaaggccgaaauggagacccucgugagagagaaaggagugaacuccuuucagauguucaugacauacaaggaucuguauaugcugcgggacucugaacucuaccagguccugcacgcuuguaaagauauuggcgccaucgcucgcguucacgccgagaauggggaacuuguggcggagggagccaaggaggcucuggaccucggcauuaccggccccgaagggaucgagaucagcagaccugaggaacuggaagccgaggcuacacaucgggugauuaccaucgccaaccgcacgcacugccccauuuaucuugucaauguguccucuaucagcgccggagacguuauugcugcggccaagaugcaaggcaaagugguccuggcugagacaaccacagcccaugccacccucaccgggcugcacuacuaccaccaggauuggucccaugcugccgcguaugugacaguuccuccgcugagacucgacacgaacaccagcacauaccugaugucucuucuggcuaaugauacccucaacaucguggccuccgaccaccggcccuuuacaaccaagcagaaagccaugggaaaggaagauuucacgaaaaucccucauggcgucagcggggugcaggaccgcaugucugucauuugggagagaggagugguuggcggcaagauggaugaaaaucgguuuguggcugucacauccagcaacgccgcuaaacugcuuaaucuguauccccgcaaggggagaaucauuccuggagccgacgcggaugugguugugugggaccccgaggccaccaagaccaucucugcuuccacacaaguccagggcggggauuucaaccucuacgaaaauaugcggugucacggagugccgcuggugaccauuagccgcggcagaguugucuaugagaacgggguguuuaugugcgccgagggcacaggaaaauucuguccucugcgguccuuucccgacacgguguacaagaaacucguccagagagaaaagacccugaaagugcgcggcguugaccggacaccuuaucuuggggauguggcugucgugguucaucccggaaagaaggagaugggcacaccccuggccgacaccccuaccagaccggugacgcgccacgggggaaugcgggaucuccacgaaucuagcuucucccugagcggcucucagaucgacgaucauguccccaaaagagcguccgcccgcauccuugcuccucccgggggccggagcucuggaauuugguga

SEQ ID NO: 68542 - RNA, 717 nt, Artificial Sequence
  derived and/or modified sequence opt5 from DRAM1__Homo_sapiens__NP_060840
augcugugcuuccucagaggcauggccuuugugcccuuccugcuugucaccuggagcuccgcugccuuuaucauuucuuacguuguggcggugcugagcgggcacgucaacccuuuccucccguauaucuccgacacaggaacgacacccccugagucuggcauuuuuggguucaugaucaauuuuagcgcuuuccugggagccgccaccauguacacccgguauaagauugugcagaaacaaaaccagacauguuacuuuuccacccccguuuucaaucuugugucucugguccucggccugguggggugcuuuggaaugggcaucguugcuaacuuccaggaacuggccgugccugucgugcaugauggcggggcucuccuggccuuuguguguggagucguuuauacacuucugcagagcaucauuuccuacaagagcugcccccaauggaacucucucuccaccugucacauccgcauggugauuagcgcggugucuugcgccgcugucaucccuaugauugugugugccucccugaucagcauuacgaaacuugaguggaauccgagagaaaaggacuauguuuaccauguggucucugcuaucugcgaguggaccguggccuucggcuucaucuuuuacuuccugacauuuauucaggauuuccaguccguuacccuccggaucagcacagaaauuaauggggacaucuga

SEQ ID NO: 68543 - RNA, 618 nt, Artificial Sequence
  derived and/or modified sequence opt5 from DRAP1__Homo_sapiens__NP_006433
augcccagcaagaaaaagaaauacaacgccagauucccuccggcucggaucaagaaaauuaugcagaccgacgaggaaaucggcaagguggccgcggcuguccccguuauuaucucccgcgcccuggagcucuuucuggaaucucuucugaagaaagccugccaagugacacagagcagaaaugcuaagacgaugaccacaucccaccucaaacaguguauugagcuggaacagcaauucgauuuucuuaaggaccugguggccucugucccugauaugcagggggacggagaggauaaccauauggacggcgauaaaggggcucggcgcggaagaaagcccggcagcgggggacggaagaauggcggcauggggaccaaauccaaggacaaaaagcucucuggaacagauagcgagcaggaagacgaguccgaagauaccgacacagauggcgaggaggaaaccagccagccucccccucaagccucucacccguccgcgcauuuccagucucccccuacgcccuuucugccuuucgccagcacccugccccucccgccugcucccccugggcccuccgcccccgacgaggaagacgaggaagauuaugacagcuga

SEQ ID NO: 68544 - RNA, 2223 nt, Artificial Sequence
  derived and/or modified sequence opt5 from DRC1__Homo_sapiens__NP_659475
augaaucccccuggcagccuggaggcccucgacccgaauguggaugaacaccuguccacccagauccuugcucccucuguccauagcgacaacucccaagagcggauucaggccagacgccugagaaucgcggcucggcucgaagcccgcagacgggaggcccugggggaauaccuugauggaaagaaagagucugaggaagaccagagcaaguccuauaaacagaaggaggaaucucgccugaaacucgcuaagcugcugcucugcggcacagagcugguuacgaauauucaaguggccaucgauauuagagagauccaccggcgcguggaagaggaagagaucaagagacagcggauugaaaaacuugagaacgaggucaagaccagccaggacaaauucgaugaaaucacauccaagugggaggaagggaaacagaagcgcauuccucaagagcugugggaaaugcucaauacccagcagcugcauugugcuggacuucuggaggacaagaacaaacucaucagcgagcugcagcaagaacugaagacaaaagaugaccaguacgugaaggaucucaaaaagcagucugacgauauuugccugcuucuggagagaauggaagaacaaguuaaaaaugugaugaagaccuuucgggaggagcucuauaacaucgagaaggccuucgaagucgagcgccaggaacugcuugcguccaauaaaaagaaaugggagcaggcccugcaggcucacaacgccaaggagcucgaauaccugaauaacagaaugaaaaagguggaggacuaugaaaagcaacugaaucggcagagaauuugggacugugaggaauacaacaugaucaaaaucaagcucgagcaggauguucagauucuggagcaacagcuucagcagcgcaaagcuaucuaucaacugaaucaggaaaagcucgaguacaaccuucaggugcugaaaaagcgggacgaagagagcacagucauuaagucucagcagaaaagaaagaucaaccgccugcaugauauucucaauaaccugcgguccaaauacgccaagcagaucaaacaguuucaagaagagaaucagagccugaccucugacuauaagagacucgugaugcaguucaaggagcugcagaaagcgaugcgccacuuugcccuuaucgaugacgaaaaguucugggagauuuggcugaugaacgaagaggaagcuaaagaucucaucgcccgggcuuuugacguggauagaauuauccacacgcaucaccugggccugcccugggccgccccugacuucugguuucuuaauaacgucgggcccauuucccaacagccucaaaagagcgcuacccagaucguugaggagaugcucaugcgcuccgaagaggaagaggcggaggaagccgcugccgagccggaaucuuaccuggaucugcccaaacaaaucagcgagaagacaaccaaacggauucucaugcugcuuugcgacgaauccggauuccugaucgagagcaagcuccugucucugcuucucccucuggagcagaaugaauguuaucugcucagacuggacgccaucuuuuccgcucuuggcauugagagcgaagaugaccuguacaagcucgugaacuucuuucugaaauaucgcgcccaucggcugucuagcucccuucagauuaagcccugcucucaggcgagcauggagaaggcuuccauggaagagacaagcaccagaucugagcucgaacuggccgagcaaacggaaauggagggcgaaaaagaggagucccugguggaaggggagaaagaagaggaggaagagacaccucccagcccgugggucauccacccuaaugaugugcucaagauucuggaagccuucguuaugggacuuaagaaaccccgggacucucgcgcuccucugagagugcagaagaacguccgggauaauuccaaagacagcgaguacuggcaggcccucaccacagugauccccuccucuaagcaaaaccugugggaugcucuguauaccgcccuugaaaaauaccaccucguucugacccagagagcgaagcugcuccuggagaauagcucccuugagcagcagaacacagaacugcaagcccuccugcagcaguaccugaacucuaagaucaacagcgagcuucaggugcccccuacgcaaguccugcgcgugccgaccaaauga

SEQ ID NO: 68545 - RNA, 1341 nt, Artificial Sequence
  derived and/or modified sequence opt5 from DRD1__Homo_sapiens__NP_000785
augagaacccugaacacaagcgccauggacggcacggggcucguggucgagcgggauuucuccguucgcauccugaccgcuugcuuucuuucucugcucauucugagcacacuucugggaaauacccucgugugugccgcggugaucagauuccggcaucugcgcuccaaggucacaaacuuuuucgugauuucucuggcuguuagcgaccuccugguggccguccuugugaugcccuggaaagccguugcugaaaucgccggcuuuuggccuuucggguccuuuugcaauauuuggguggcuuucgauaucauguguucuaccgccagcauccugaaccucugcgucauuuccguggacagauacugggcgaucagcucuccguuucgguaugagcgcaagaugacacccaaagccgcuuucauucugaucuccguggccuggacccuuagcguccugauuucuuuuaucccuguucagcucuccuggcacaaggcuaaacccacgagcccuucugauggaaaugccaccucccuggcggaaacaauugacaacugugauagcucccugucuagaaccuacgccaucagcuccagcgugaucucuuucuauauucccguggcuaucaugauugucacauacacccggaucuaucgcauugcccaaaagcagaucagacggaucgcugcccucgagcgcgccgcugugcacgcgaagaauugccagacgacaaccggcaacgggaaaccuguugaauguucccagccggagagcucuuuuaagaugagcuucaaaagagagacaaaggugcugaaaacccuuuccgucauuaugggaguguucguuugcuguuggcugcccuuuuucauccucaauugcauucugccuuuuuguggcucuggcgaaacccaacccuucugcaucgacagcaacacauuugauguguucgucugguuugggugggccaauuccagccuuaacccuauuaucuacgcuuucaaugccgacuuucggaaggccuucucuacgcugcucggaugcuaucgccugugucccgcuaccaacaaugccaucgagacaguguccauuaacaacaauggcgcggcuauguuuagcucucaucacgaaccgagaggguccaucagcaaggagugcaaccuggucuaccucauuccucaugccgugggauccucugaggaucugaaaaaggaagaggccgcuggcaucgcccggccccuugaaaaacugagcccugcucucuccguuauucuggacuacgauaccgacgugucucuugagaagauccagcccauuacacagaaugggcagcaccccaccuga

SEQ ID NO: 68546 - RNA, 1332 nt, Artificial Sequence
  derived and/or modified sequence opt5 from DRD2__Homo_sapiens__NP_000786
auggacccccugaaccucagcugguacgaugacgaucuggagagacagaauuggucccggccuuucaacggcucugacgggaaggccgaucgcccgcacuauaauuacuaugcuacccuucugacacuccugaucgccgugauugucuuuggaaacguucuugugugcauggcggugagcagagaaaaagcucugcaaacgaccacaaauuaccucaucgucucccuggccguggccgaccugcucguugcuacccuggugaugcccugggucguguaucuugagguugugggcgaauggaaguucucucggauucauugugauaucuuugucacacuggacgugaugaugugcaccgccagcauucucaaccugugugcuaucuccaucgaucgcuacacagccguggcgaugccuaugcuuuauaauaccagauacucuagcaaacggcgcgucacgguuaugauuuccaucgugugggugcugagcuucaccauuucuugcccccuccuguuugggcugaacaaugccgaccagaacgaguguaucauugcuaauccugccuucgucguguacuccagcaucguuucuuuuuaugugcccuucauugucacacuccugguguacaucaagaucuauauuguucuuagacggcgcagaaaacgggugaacaccaagcgcuccagcagagcuuuucgggcccaucugcgcgcgccucucaagggaaauugcacacacccggaagauaugaaacuguguaccgucaucaugaagucuaacggcuccuuccccgugaauagacggagagucgaggccgcucgccgggcccaggagcuugaaauggagaugcugagcuccacgucuccucccgaaagaacacgcuacagcccuauucccccgucccaccaucagcucacccugccugaccccagccaccacgggcugcauucuacaccugauucccccgcuaaacccgagaagaacggacacgccaaagaccauccuaagaucgccaagauuuuugagauccaaaccaugccgaacggcaaaacccggacaagccucaagacgaugucuagacgcaaacugagccagcagaaggaaaagaaagcuacccagaugcuugcgaucgugcugggcguuuucauuaucugcuggcuccccuuuuucauuacacacauccugaauauucacugugacugcaacaucccucccgugcuuuauuccgccuucaccuggcugggguacgucaauucugcugugaacccuaucauuuauacaaccuuuaauaucgaguuccggaaagccuuucucaagauucugcauuguuga

SEQ ID NO: 68547 - RNA, 1203 nt, Artificial Sequence
  derived and/or modified sequence opt5 from DRD3__Homo_sapiens__NP_001269492
auggccagccugucccagcucucuggccaccugaacuauaccugcggggcugagaauagcacaggagccucccaagcgagaccccaugcuuacuacgcccuuucuuauugugcccugauccucgcuauuguguucggcaacgggcuggucugcauggccguucuuaaggaacgggcucugcagacgaccacaaauuaccucguggugagccuggccgucgcggaccugcucguggccacccugguuaugccuuggguggucuaucuugaggugacaggaggcguuuggaacuuuucccgcaucuguugcgauguguucgucacccuggacgugaugauguguacagcuucuauucucaaucugugcgccaucagcauugauagauacaccgcuguggucaugccgguucacuaucagcaugggacgggacaguccagcugucggcgcguggcccuuaugaucaccgcgguguggguccuggccuuugcugugucuugcccccuccuguucggcuuuaacacaaccggcgacccuacaguuuguuccaucagcaaucccgauuucgugauuuacucuuccgucgugagcuuuuaccugccuuucgggguuaccgugcucgucuaugccagaaucuacgugguccugaaacaacggcgcagaaagcggauucuuacgcgccagaacucucagugcaauuccgugagacccggauuuccucagcaaacacugagcccggaccccgcucaccucgaacugaaacgguauuacuccaucugucaggauaccgcccuuggcgggccuggauuccaggagcgcggcggggaacugaagagagaggagaaaacacggaacucucucagccccaccauugccccuaagcugucccuggaaguucgcaagcucagcaauggaagacugucuaccucccuuaaacugggcccccuccagccgcggggcgugccucugagagagaagaaagcuacacaaauggucgcgaucgugcuuggggccuuuauuguuugcuggcugcccuucuuucucacgcaugugcugaacacccacugccagacaugucacgucagcccugaacuguauucugcuaccacauggcucggauacgugaauagcgcccugaaccccgugaucuauaccacguucaauaucgaguuccgcaaggccuuucuuaaaauucuguccugcuga

SEQ ID NO: 68548 - RNA, 1260 nt, Artificial Sequence
  derived and/or modified sequence opt5 from DRD4__Homo_sapiens__NP_000788
augggcaacagaagcaccgccgacgcugaugggcugcucgccggacggggccccgcggcuggggccuccgccggagcuucugccggccuggcugggcagggagccgcggcccuugugggcggcguccugcucaucggggcuguucuggccggaaauagccuugugugcguguccgucgcuacagagcgcgcccugcaaacgccuaccaacucuuucauugugagccucgcggccgcugaccugcugcucgcccugcuuguucugccgcucuuuguguacuccgaaguccagggcggggcuuggcugcuuucucccagacugugugaugcccucauggccauggacgugaugcugugcacagcuagcaucuucaaucugugugcgauuuccguugaucgguuuguggccgucgcugugccucuccgcuauaacagacagggaggcagccggcgccagcugcuucugaucggggccaccuggcuccugucugccgcuguggccgcgcccguccuuugcggacugaaugacguuagaggccgggauccugcugugugucgccucgaggacagagauuacguggucuauuccagcgugugcucuuucuuucugcccuguccucugaugcuccugcuuuacugggccacauuccggggccugcaacgcugggaaguugccagacgggcuaagcuccacgggcgcgccccgagacggcccuccggaccugggcccccuagccccaccccgccugcucccagacugccucaggaccccugcggccccgauugugccccuccggcgcccggacuuccucgcggccccugcgggccugacugugcccccgcugccccgucucugccucaggaucccugcggaccugacugcgcucccccugcccccggccucccgccugaccccuguggcuccaacugcgcgcccccugaugccgugcgggcugccgcucugccgccccagacaccuccccaaaccagacgccggagacgcgccaaaauuacggggcgggagagaaaggccaugcgcguccugccugugguugugggagcuuuucuccuguguuggacccccuucuuugucgugcauaucacacaggcgcuuugcccugccuguagcgugcccccgcggcugguguccgcuguuaccuggcucggcuaugucaauucugcccugaacccugucaucuacacaguguucaaugccgaauuuagaaacguuuuccgcaaagcucugcgggccugcuguuga

SEQ ID NO: 68549 - RNA, 1434 nt, Artificial Sequence
  derived and/or modified sequence opt5 from DRD5__Homo_sapiens__NP_000789
augcugcccccuggcagcaacgggaccgccuacccgggacaguucgcucucuaucaacagcuggcccagggcaaugcggucgggggauccgcuggcgcucccccucuugggcccucucaggugguuacagccugccugcucacgcugcuuaucauuuggacccugcucggaaacgugcuggugugugccgccaucgucagaagccggcaucugcgcgcuaauaugacaaacguguuuauuguuucccucgccgugucugaccuguucgucgcgcuucuggugaugccuuggaaggccguugcugagguggccggcuacuggcccuuuggcgcuuucugcgaugucuggguggccuuugacaucauguguagcaccgcguccauucucaaucugugcgugaucucugucgauagauauugggccaucagccggccuuuccgcuacaaaagaaagaugacacaacggauggcucuuguuaugguggggcuggccuggacccucuccauucugaucagcuuuauuccggugcagcugaacuggcaccgcgaccaggcugccucuuggggaggccucgaucugcccaauaaccuugccaauuggacaccuugggaagaggacuucugggaacccgaugucaacgcugagaauugugacuccagccugaacagaaccuaugcgaucucuuccagccucauuucuuuuuacaucccuguggccauuaugaucguuacguauacccggaucuaccgcauugcucaggugcaaaucagacggauuuccagccuggaacgcgccgccgagcacgcucaguccugcagaucuagcgccgcgugugcucccgauacaucccuucgggccagcaucaaaaaggagaccaaaguccugaagacacucucugugauuauggggguuuucgugugcuguuggcugccguuuuucauccugaauugcauggucccuuuuuguuccggacaucccgaaggcccucccgccggguuccccugcgugagcgagaccacguucgacgucuuugugugguucggaugggcuaacucuagccucaauccuguuaucuacgccuuuaacgcugauuuccagaagguguuugcccagcugcuuggcugcucccacuucuguucucgcacaccggucgaaaccgugaacauuagcaaugagcugaucuccuauaaccaagacauuguuuuucauaaagagaucgcggccgcuuacauucacaugaugcccaaugccgugacaccuggcaacagagaagucgauaaugacgaggaagaggggcccuucgaccggauguuucagaucuaucagaccagcccugauggagaccccguggcugaaucugugugggagcucgauugcgagggcgaaaucucccuggacaagauuaccccguucacaccuaacggguuucacuga

SEQ ID NO: 68550 - RNA, 1104 nt, Artificial Sequence
  derived and/or modified sequence opt5 from DRG1__Homo_sapiens__NP_004138
augagcuccacccuggccaagaucgcugagauugaagccgagauggcgagaacacagaaaaacaaggcuacggcccaccaucucggccugcuuaaagcccggcuggcuaagcuccgcagagaacugaucacccccaaagggggaggcgggggaggcccuggggagggauucgacguggccaagacaggcgaugcucggauuggcuuugucggguucccgucuguuggaaagagcacccuucuguccaaucucgccggcguguacucugaaguggcggccuaugaguuuacaacccugacaaccguccccggggugauccgcuacaaaggagcuaagauucaacugcucgaccugccuggcaucaucgagggggccaaagauggaaagggcagaggccggcagguuauugcuguggcccgcacgugcaaccuuauccugauuguccucgacgugcugaaaccccuugggcacaagaagaucauugaaaaugagcuggaaggauucggcaucagacucaacagcaaaccucccaauauuggguuuaagaaaaaggauaaaggaggcaucaaccugaccgcgacauguccucaguccgagcuggacgccgagaccguuaagucuauccucgcugaauauaaaauucauaaugccgaugugacacugcggagcgacgcuaccgccgaugaccuuaucgaugucguggaggggaaccgcguguacauuccgugcaucuauguccugaauaagauugaccagaucuccaucgaagaacucgauauuaucuacaagguuccccacugugugccuauuagcgcccaucacagauggaacuucgacgaccugcuugagaaaaucugggauuaucugaagcucgugcggauuuacacgaaacccaagggacaacugccugacuacacaucucccgucgugcugccguauucccgcaccacaguugaggauuuuugcaugaaaauccacaagaaucucaucaaggaguucaaauacgcucugguguggggccuuagcgucaagcauaacccucagaaagugggcaaggaccacacccuggaagaugaggacguuauucagaucgugaaaaaguga

SEQ ID NO: 68551 - RNA, 792 nt, Artificial Sequence
  derived and/or modified sequence opt5 from DRGX__Homo_sapiens__NP_001263380
auguucuacuuucacugucccccucagcuggagggcaccgccacauucgggaaccauagcuccggagacuuugaugacggcuuccucagacggaagcaacgcagaaaucggacgaccuuuacacugcagcagcuugaagcucuggaggccguguucgcgcagacccacuauccggaugucuuuacacgcgaggaacucgcuaugaaaaucaaccugaccgaagccagaguucaagugugguuccagaaucggcgcgccaaguggagaaaaacagagcgcggggcuucugaccaggagcccggagccaaggaaccuauggcugaggugacgcccccucccguccggaacauuaauagcccuccgcccggcgaucaggccagauccaaaaaggaagcgcuugaggcccaacagucucuggggcggaccgugggaccugcuggccccuuuuucccuagcugccuccccggcacccugcugaacacagccaccuacgcucaggcccucucccauguugcgucucugaaagggggaccgcuuugcagcuguugcgugccugaccccaugggccuguccuuucucccuacauaugggugucagagcaaucgcaccgccucugucgcuacgcugagaaugaaggcccgggagcacuccgaagcugugcuucaaagcgccaaccugcuccccucuacauccagcucucccggaccuguugccaagccggcucccccugauggcucccaggagaaaaccagccccacaaaggaacaguccgaggcggaaaaaucuguguga

SEQ ID NO: 68552 - RNA, 4014 nt, Artificial Sequence
  derived and/or modified sequence opt5 from DROSHA__Homo_sapiens__NP_001093882
augaugcagggcaauaccugccacagaaugagcuuccaucccgggcggggauguccucgcggcagagggggacacggcgcccggccguccgcucccucuuuucgcccucaaaaccugagacuccugcauccccagcagccucccgugcaguaccaauaugagccuccgagcgcccccuccacaacguucucuaacagcccugcgcccaauuuucuuccuccccggccggacuucgucccuuuucccccucccaugcccccuuccgcucaggggccgcugcccccuugccccauccgcccucccuucccgaaccaccagaugagacauccuuuucccguuccucccuguuucccucccaugccgccucccaugcccugcccuaauaacccgcccgugccuggagcucccccuggccagggcaccuuucccuucaugaugccucccccgucuaugccucaucccccucccccgccugugaugccccaacaggucaauuaccaguauccucccggguacagccaccacaacuuucccccuccguccuucaauagcuuucagaacaaucccucuuccuuccucccuagcgccaacaauucuuccagcccccacuuccggcaucugccucccuauccucuuccgaaggcccccucugaacgcagauccccugagcggcugaaacacuacgaugaccaccgccauagagaucacagccauggacggggcgaacgccacagaucccucgaccggagagagcgcgggcggucucccgauagacgccggcaagacagcagauaucgcuccgauuacgaccggggaagaacaccuagccgccaucggucuuacgaaagaucccgcgagcgggagagagaacggcaccgccacagagauaaccggagaagccccucucuggagcgcagcuauaagaaagaauacaagcgguccggcucuagaagcccgucccgcgagaaaaagagagcccggugggaggaagagaaggaccgcuggagcgauaaucagucuuccgggaaagacaagaacuauaccagcauuaaagaaaaggagccugaagagacaaugcccgauaaaaacgaggaagaggaagaggaacugcucaagcccguguggaucagauguacccauucugagaauuacuauuccagcgacccuauggaccagguuggagauuccacaguggucggcaccucucggcugcgcgaccuuuacgauaaguuugaggaggaacugggcagcagacaagaaaaagcuaaggccgcgcggcccccuugggagccgcccaaaacgaagcucgacgaagaucuggaguccucuagcgaguccgaaugcgagagcgacgaagauucuaccuguuccagcuccuccgacagcgagguguucgauguuauugccgagaucaaacgcaagaaagcucacccugacagacuucaugaugaacugugguauaacgaccccgggcagaugaaugacggaccucucugcaaguguucugccaaggcucggcgcacaggcauuagacacagcaucuaccccggggaggaagccaucaaaccgugccggccuaugaccaacaaugcgggaagacuguuucacuaccgcauuacagugucucccccuaccaacuuccugacggaucggcccacagucaucgaguaugacgaucaugaauacauuuuugagggcuucagcauguuugcccacgcuccucucaccaauaucccccuguguaaggugauuagauucaacaucgacuauacaauucauuuuaucgaggaaaugaugccggagaauuucugcgugaaagggcuugaacuguuuucucucuuccuguuucgcgauauccuugagcuguacgacuggaaccucaagggaccucuguucgaagauuccccucccugcuguccccgguuccacuuuaugccgagauucguccgcuuucugcccgacggcggcaaagagguucucagcaugcaucagauucugcuuuaucugcuccggugcuccaaggcccuggugccugaggaagagaucgcuaauaugcuucagugggaggaacuggaauggcaaaaguacgccgaggaguguaaagggaugauugugaccaaccccggaaccaagccuucuagcgucagaaucgaucagcucgaccgcgaacaguucaaucccgaugugauuacauuuccuaucaucguucacuucggcauucggccggcccagcuguccuaugcuggggacccccaauaccagaaacuguggaagucuuacgugaaacucagacaucugcuugcgaacagcccuaaggucaagcagacggauaaacagaagcuggcccaacgggaggaagcucuccagaaaauccgccagaagaauaccaugagacgggaggugacaguugagcuguccucucagggauuuuggaaaaccggcauucgcagcgacgugugccaacacgccaugaugcugcccguccuuacacaccauaucagauaucaccagugucucaugcaucuggacaagcugauuggguacaccuuccaggaucggugccuccugcaacuugccaugacgcacccuucccaccaucugaacuuuggcaugaaccccgaccacgcuagaaauagccucucuaacuguggaauccgccagccgaaguauggcgaucggaaagugcaucacaugcacaugagaaagaaagggaucaauacacugauuaacaucaugucccgccugggacaggacgauccuacccccagccggauuaaucauaacgaaagacuugaguuccucggcgacgccgucguggaauuucugaccucuguucaccuguacuaucucuuccccucccuggaggaagggggacuugcgacauaccgcaccgcuaucgugcagaaucaacaucuggccaugcucgccaagaaacuggagcuggaucgguuuaugcuuuaugcucacggcccugaccucugcagagagagcgaucugcgccaugccauggcuaacuguuucgaagcccugauuggggcggucuaccucgagggcucucuggaagaggccaagcagcuuuucggaagacugcucuuuaaugaccccgaucugcgggaaguguggcugaacuacccucuucacccgcuccagcugcaggagcccaauacagaccgccaacugaucgagacguccccuguucuccagaaacugaccgaguucgaagaagcuauuggcgugaucuuuacacacgucagacuucuggcccgggcuuucacccuccgcacagugggguuuaaccaucugacccugggacacaaucagagaauggaguuccuuggcgauagcaucaugcagcugguggccacggaauaucucuuuauucauuuccccgaccaccacgaggggcaucugacccuccugcgguccagccuuguuaacaauagaacacaagcgaaggucgccgaggaacugggaaugcaggaguacgcuaucaccaacgacaagacaaaacgcccuguggcccuccggaccaagacgcuggcugaucugcuugaaucuuuuauugccgcccuguauaucgacaaagaucucgaguacgugcacacauucaugaacgucugcuuuuuccccagacugaaggaguucauucucaaucaggacuggaacgauccgaaaagccaacugcagcaguguugccuuacccugcgcacagaaggcaaggagccugacaucccccucuauaagacccugcagaccguggggccuucccaugcucggacauacacgguugcgguguauuuuaaaggcgaaagaaucggaugcggcaaggggcccucuauucaacaggccgagaugggagcugccauggaugcccuggaaaaauacaauuucccucagauggcucaccagaagcgguuuaucgagcgcaaauacagacaagagcuuaaggaaaugcggugggagcgcgaacaucaggagagagaacccgacgagaccgaggauauuaagaaauga

SEQ ID NO: 68553 - RNA, 2640 nt, Artificial Sequence
  derived and/or modified sequence opt5 from DRP2__Homo_sapiens__NP_001164655
augaaccugugcuggaaugagaucaagaaaaagagccacaaccucagagcccggcuggaggcuuucuccgaccauucuggcaaacuucagcugccccuccaagagauuaucgauuggcugagccagaaggacgaagaacuuuccgcccagcugccucuccagggggauguggcgcugguccaacaggaaaaagagacccacgcugccuuuauggaggaaguuaagucucgcggaccguacauuuauagcgugcuggaguccgcccaggcuuuccucucucagcaucccuuugaagaacuggaggaaccucacagcgaguccaaggacacaagccccaaacaaagaauccagaaucuuucucgguucguguggaagcaggccacggucgcuuccgaacugugggagaaacucaccgcccgcuguguggaucagcauagacacauugaacggacacuggagcaacuucuggagauccagggcgcgauggaggagcucagcaccacacugucucaggccgaagggguucgcgcuaccugggagccuaucggagaccuguuuauugauucccuccccgaacacauccaagccauuaagcuguucaaagaggaguuuagcccuaugaaggacggcgugaaacuugucaacgaucuggcucaucagcucgccaucucugacgugcaccuguccauggaaaauagccaggcgcuugagcagauuaacguuagauggaaacaacugcaggccuccgugucugaacggcucaagcagcugcaggaugcucaucgcgacuucgggccgggaagccaacacuuucuguccagcucuguccaggugcccugggagagagccaucuccccuaauaaagugcccuacuauauuaaccaccaggcucagacaaccugcugggaucauccuaagaugacggaacucuaccaaacccuggccgaccuuaauaacaucaaauucagcgccuaucggacagcuaugaagcugcgcagaguccagaaagcgcuccggcuggaccuuguuacccugacaaccgcccucgagaucuuuaaugagcacgaucugcaggcuucugaacaugugauggacguggucgaggugauucacugucugacggcccucuacgaacgccuggaggaggaaagaggcauccuuguuaacgugccccugugcgucgauaugagccucaauuggcugcugaacguguucgacuccggccggucugggaagaugagagcccuuagcuuuaagacaggaauugcuugucucugcggcaccgagguuaaagaaaagcugcaguaucuguucucccaaguggccaauagcgggucucagugugaucagcgccaucucggaguccugcuucacgaggcgauccaagugccgcggcagcugggcgaagucgcugccuucgggggauccaacguggagccuagcguuagaucuugcuuucgcuucuccacaggcaaacccgugauugaggccagccaguuucucgaaugggucaaccuggagccucaguccaugguguggcuggcuguucuucaccgggugaccaucgccgaacaagucaagcaucagaccaaauguucuaucugcagacagugucccauuaagggcuuccgcuaccggagccucaagcaguuuaauguggacaucugccaaacaugcuuccugacggggagagcuuccaaaggaaacaagcugcacuaccccauuauggaguauuacaccccuacaaccucuagcgaaaauaugcgcgauuuugccacaacccucaaaaacaaguuccgguccaaacauuauuuuagcaagcacccgcagagaggcuaccugcccgugcagucuguucuugaggcggacuauuccgagacgccugccagcucucccauguggccucacgcugauacacauucccgcaucgaacacuucgccagccggcuggcugagauggaaucucagaauuguagcuuuuucaacgacucccucagccccgaugacucuauugacgaggaucaauaccugcugagacauuccagcccgaucaccgaccgggaaccugccuuugggcagcaggcgcccugcuccgucgccaccgagucuaagggagagcuucaaaagauccucgcucaccuggaagaugagaaucgcauucugcagggcgaacucagacggcugaaguggcagcaugaggaggccgcugaagccccuagccuugccgacggguccacagaggcugcgaccgaucacagaaacgaggaacugcucgccgaagcucgcauccugcggcagcacaaaucuagacuggagacacgcaugcaaauucuugaggaccauaauaagcagcucgaaagccagcugcagagacugcgggagcuccugcuucaacccccuacggaauccgauggaucuggcagcgccggcuccagccuggccucuagcccccagcaguccgaggggucucacccgcgcgaaaaaggacagaccacaccugacaccgaggcugccgaugacgugggcuccaagagccaagaugugucucucugucuggaggacaucauggaaaagcugagacaugcguuccccuccguccggagcuccgaugugacagcuaacacccuucuggccagcuga

SEQ ID NO: 68554 - RNA, 2523 nt, Artificial Sequence
  derived and/or modified sequence opt5 from DSC1__Homo_sapiens__NP_004939
auggcccuggcuagcgccgcgcccggcuccaucuucugcaagcagcuccuguuuucucuucuggugcucacccugcuuugugacgcuugccaaaaagucuaccugagaguuccuagccaccuccaggccgagacacugguggggaaggugaaccuggaagagugucucaaauccgccucucugauucggagcuccgauccggcuuuccgcauccuugaagacggaucuauuuauacgacccaugaucugauccucagcuccgagagaaagagcuuuucuauuuuccuguccgacggccagcggcgcgaacagcaagagaucaaagucgugcuuagcgccagagagaauaagucucccaagaaacggcacacaaaggauaccgcucugaaacgcuccaagagacggugggccccuauccccgcgagccucauggaaaacucucuggggccuuuuccccagcauguucagcagauucaauccgacgccgcucagaauuacacaaucuucuauagcauuuccggaccuggcguggauaaagagccguuuaaccuguucuacaucgaaaaggacaccggggauaucuuuugcacacgcucuauugacagagagaaguaugagcaguucgcccucuacggauaugcuaccacggccgauggcuacgcgcccgaauacccucugccccuuauuaucaaaaucgaggacgauaaugacaacgccccuuauuuugaacaccgggucaccauuuucacagugcccgagaauugucgcagcggcaccuccguugggaaggugacagcuaccgaccuggaugaaccggacacgcuccauacaagacugaaauacaagauccuucagcaaauuccugaucaccccaaacacuuuagcauccauccugacaccggagucauuacaaccaccacacccuuccuggaucgggagaagugcgacacguaucagcucaucauggaggugcgcgauaugggcgggcagcccuucggacuguuuaacaccggcacaaucaccauuucucuggaagacgagaaugauaacccuccguccuucacagaaaccagcuacgugacggaggucgaagagaauagaaucgacguugagauucuccggaugaaagugcaagaucaggaccugcccaacacaccucacucuaaggccguguauaagauccuucaggggaaugaaaacggaaauuuuauuaucagcaccgaccccaacaccaacgagggcguccugugugugguuaaaccucucaauuacgaagugaacagacaggucauccugcaagugggcguuauuaaugaggcucaguucuccaaggccgccucuagccagacacccaccaugugcacaacgaccgugacagucaaaaucauugauuccgacgaagggccggagugucauccucccgugaaggucauccagagccaagauggauuuccugcuggccaggagcuucugggguauaaagcgcucgaccccgaaauuucuuccggagagggccugcgcuaccagaagcugggggaugaagacaacugguucgagaucaaucagcacaccggagaucuccggacacugaaggugcuugacagagagagcaaauuuguuaagaacaaucaauacaacauuucuguggucgccguggaugcuguuggccgcuccugcaccggcacgcuggugguccaccucgacgauuauaaugaccaugccccucagaucgauaaagaagugaccaucugucagaacaaugaggacuucgccgugcugaagcccguugacccggaugggccugaaaacggaccucccuuucaguucuuucuggacaauagcgcuuccaaaaacuggaauauugaggaaaaggauggcaagacagccauccuucggcaaagacagaaccucgacuacaacuauuacucuguccccauucagaucaaagaucgccacgggcugguggcgacccauaugcugacagugcgggucugcgacugcagcaccccguccgaguguagaaugaaggauaaaucuacgcgcgacgugcggcccaauguuauucucggaagaugggcuauccuggccauggugcuuggcagcguccugcuccugugcauccuguucacauguuuuugcgugaccgccaagcgcacaguuaaaaaguguuucccugaggauauugcucaacagaaccuuaucguguccaauaccgaagggcccggcgaggaagucaccgaggccaacauucggcucccuaugcagacaagcaauaucugcgacacgucuauguccgugggaaccguuggcgggcagggaauuaagacacaacagagcuucgaaauggugaaaggcggguauacccuggauucuaacaagggaggcgggcaccagacacuggaguccgucaaaggcgugggacagggcgacaccgggagauacgcuuauacggauuggcagagcuuuacacaaccccggcucggagaggaaucuauccgcggccauacccugaucaagaauuga

SEQ ID NO: 68555 - RNA, 2544 nt, Artificial Sequence
  derived and/or modified sequence opt5 from DSC2__Homo_sapiens__NP_004940
auggaggccgcuagacccagcggcuccuggaacggggcccugugccggcuccugcuucugacccucgcgauccugauuuucgcuucugacgccuguaagaaugugacacuucacgucccuagcaaacuggaugccgaaaagcucguuggacgcgugaaccugaaagagugcuuuacggcugccaaucugauccauuccucugacccggauuuccagauucucgaagacggcagcguguacaccacaaacaccauccugcuuuccucugagaagcgcagcuuuacaauucugcucuccaauaccgaaaaccaagagaaaaagaagaucuucgucuuucuggagcaccagacaaaagugcuuaagaaacggcauaccaaggaaaaaguucugcgcagagcuaagcggcgcugggcccccaucccuuguagcaugcucgagaacucucuggggcccuucccucuguuucuccaacaggugcaguccgauacggcgcagaacuauaccauuuacuauagcaucagaggacccggcgucgaccaggaaccucggaaucuguucuacguggagcgcgauacagggaaccuuuauugcaccagaccgguugaccgggagcaguacgaaucuuuugagauuaucgccuucgcuacaacccccgauggauauacgccugaacugccccucccucugauuaucaagauugaggacgaaaaugauaacuaccccaucuuuacagaggagaccuacacauucaccaucuuugaaaauugucgcgugggcaccacagucggccaagugugcgccacggacaaagaugagccggacaccaugcacacaagacuuaaguauuccauuaucggacaggugccucccagcccuacccuguucucuaugcaucccacaaccggagucauuacgacaaccuccagccagcucgaccgggaacugaucgauaaauaccagcugaagauuaaaguucaagacauggauggccaguauuucgggcuccagaccacauccaccuguaucaucaacauugacgaugugaaugaccaucugcccacauuuacgcgcaccucuuacgugacaagcgucgaggaaaacaccguggauguugagauccuuagagugacagucgaggacaaggaucuggugaacaccgcuaauuggcgggccaacuauacgauucucaaaggaaaugaaaacggcaauuucaagaucguuaccgacgcgaagacaaacgagggggugcugugcgucgugaaaccucuuaauuacgaagagaagcaacagaugauucugcagaucggagucgugaacgaagccccguuuuccagagaggcuagcccccgcucugccauguccaccgcuacaguuaccgugaaugucgaggaucaggacgaaggcccugaguguaaucccccuauccaaacggugcggaugaaagaaaaugccgagguuggcacaaccagcaacggguauaaggccuacgaccccgagacaagaucuagcuccgggauucgcuacaaaaagcucaccgauccgaccggcugggugacaaucgacgaaaauacggggucuauuaaggucuuccggagccuggauagagaggcugaaaccaucaaaaacggaauuuauaauaucacagugcuggcguccgaccagggcgggagaaccugcacaggaacccucggcauuauccugcaggaugugaacgacaacagcccuuuuauccccaagaaaacgguuauuaucuguaagccuacaaugucuuccgccgagauugucgcuguggaucccgacgaaccuauccacgggcccccguucgauuuuagccuugagucuuccaccagcgaggugcagcggauguggagacugaaagccauuaaugacaccgccgcucgccucuccuaccaaaacgauccucccuucgggucuuaugucgugcccaucacaguucgggacagacugggaaugagcuccgugaccucucuggaugucacacuuugcgacugcaucacggaaaaugacuguacccaccgcguggauccucggauuggcgggggaggcguucagcucgggaagugggccauccuggcgauucugcucggcaucgcucugcuguuuugcauucuuuucacacucguguguggagccagcggcaccuccaagcagccgaaagucauccccgacgaucuggcccagcaaaaccugaucgugagcaauacagaggcuccuggggacgauaagguuuacucugccaacggauuuaccacgcagaccgugggcgcuuccgcccagggggucugcggaacagugggcagcgggauuaaaaauggcggacaggaaaccaucgagauggugaagggcgggcaccaaacaucugaauccuguagaggagcgggccaucaccacacccuugacagcugccggggcggacauacagaggucgauaacugucgcuauaccuacucugaguggcacagcuucacgcagcccagacucggcgaagaguccauucgggggcauacacugaucaaaaauuga

SEQ ID NO: 68556 - RNA, 2691 nt, Artificial Sequence
  derived and/or modified sequence opt5 from DSC3__Homo_sapiens__NP_001932
auggccgcugccggccccagacggagcgugcgcggggcggucugccugcaccuccugcuuacccugguuaucuucuccagagcuggagaggccuguaagaaagugauucucaacgugccuucuaagcuggaagccgacaaaaucauuggccgggucaaucuugaggaaugcuuucgcagcgcugaucugaucagauccucugacccggauuuccgggugcucaacgacgggagcguuuacacagcccgcgcuguggcccuguccgauaagaaaagaucuuuuacgauuuggcugagcgacaagcggaagcagacccaaaaagaggucacagugcuccuggaacaucagaagaaaguuuccaagacccgccacacaagagagaccgugcuucggcgcgcgaaaagacggugggcccccaucccuuguagcaugcaggaaaauucucugggacccuucccucucuuucugcagcaagucgaguccgaugcugcccagaacuauacaguguucuacagcaucucuggccgcgggguggacaaggagccccuuaaucuguuuuauauugaaagagauaccggaaaccucuucugcacgcggccugucgacagagaggaguacgauguuuuugaccugaucgcuuaugccuccaccgcggauggcuacagcgccgaccugccgcucccccugccuauucgcguggaagacgagaaugauaaccaucccguguucacagaagcuaucuauaauuuugagguccuugaaucuucccggccuggcaccacaguggggguugugugugccaccgacagagaugagcccgacacgaugcacacacgccugaaguacagcauucuccagcagaccccgcgguccccuggacuguucucuguccaucccagcacaggcgugaucaccaccguuucccacuaccuugauagagagguggucgacaaauauagccugauuaugaaggugcaagauauggacgggcaguuuuucggacucaucggcacaucuacgugcaucauuaccgucacagauuccaacgacaaugcuccuaccuuccgccagaacgccuacgaagccuuuguggaggaaaaugcuuucaacguugagauccugcggauucccaucgaagauaaagaccugauuaauacagcgaacuggagagugaacuuuaccauccucaaggggaaugagaacggacacuucaaaaucagcacggacaaggagacaaaugaaggcguccugucugugguuaaaccccuuaacuaugaggaaaaucgccaggugaaccuggagauuggcgucaauaacgaagccccuuuugcucgggauaucccgagagugaccgcccucaaucgcgcccuggugaccguucauguccgggaccuugaugaggggcccgaguguaccccugcugcccaauacgugagaauuaaggaaaaccuggcggugggaagcaagaucaauggcuauaaggcuuacgaccccgagaaccggaaugggaacggacuccgcuauaagaaacugcacgauccuaagggcuggauuacaaucgacgaaaucuccgggucuauuaucacaagcaaaauucuggauagagaggucgagacgcccaagaaugaacucuacaacaucaccgugcuggccauugacaaggaugaccgguccugcacaggaacccuugccguuaacaucgaggaugugaaugacaacccgccugaaauucugcaggaguacgucgugaucuguaaacccaagaugggcuauacagauauccucgcuguugacccugacgaacccgugcauggcgccccuuucuacuuuagccugcccaauaccucuccggagauuuccagacuguggagccuuacgaaagucaacgauaccgcugcccgccucucuuaucagaagaaugcgggguuccaagaguacacaaucccuauuaccgugaaagaccgggccggacaggcugccacaaagcugcugagaguuaaccucugcgaauguacccaccccacgcagugccgcgcuacauccagaagcaccggcgugauccuggggaagugggccauucuugcgauccugcucggaaucgcccugcuguuuuccguccuucucacacuggugugcggcguguucggggcuaccaaaggcaagcgguuucccgaggaucuggcccagcaaaaucucauuaucucuaacaccgaagcuccuggagacgaucgcgucuguagcgccaauggcuucaugacacagacgaccaacaauuccucucagggguuuugcggaacaaugggcagcgggaugaaaaacggaggccaggagaccauugaaaugaugaaagggggcaaucaaacacuggaguccuguagaggagccggccaccaucacacccuugacagcugccgcgggggacauacggagguugauaacugucgguauacauacucugaauggcacuccuucacccagccgagacugggcgagaaacuccaucggugcaaucagaacgaagaccgcaugcccagccaggauuaugugcugaccuacaacuacgaggggagaggaucuccugcuggcuccgugggguguugcagcgaaaagcaagaggaggacggccuggauuuccuuaauaaccucgaacccaaguuuaucacacuggcggaggccuguaccaaacgguga

SEQ ID NO: 68557 - RNA, 6039 nt, Artificial Sequence
  derived and/or modified sequence opt5 from DSCAM__Homo_sapiens__NP_001380
auguggauccuggcccucagccuguuccaguccuucgcuaacguguucucugaggaccuucacagcucccuguacuuugucaaugccucucuccaagaaguuguguucgcgagcaccaccggaacgcuggugcccugcccugcugccgggauuccucccgucacccuuagaugguaccuggccacaggggaggaaaucuacgaugugcccggcauucggcacguucaccccaacgggacccuccagaucuuuccuuuucccccuuccucuuuuagcacacugauucaugacaauaccuauuacuguacagcugagaacccguccggaaagauccgcagccaggaugugcacaucaaagccguccugagagaacccuauaccgugcggguugaggaccagaagacgaugcgcggcaauguggcugucuucaaaugcauuaucccuucuuccguggaggccuacauuaccguggucagcugggaaaaggauacaguuucucucguguccgggagcagauuucugaucaccucuacaggagcgcuuuauauuaaagacgugcaaaacgaggauggccuguacaauuaccgguguaucacccgccauagauauacgggcgaaacacggcaguccaacagcgcccgccucuucgucuccgaccccgcuaauucugccccuagcauucuggauggguuugaccacagaaaggcuauggccggacagcggguggagcuucccugcaaggcgcugggccacccggagccugauuaccgcuggcucaaagacaacaugccccuggaacuguccgggagauuccagaagaccguuacaggacuccugaucgagaauauccggccuagcgauucuggcuccuaugugugugaagucagcaaccgcuacgggaccgccaaagugauuggaagacuuuauguuaagcaaccccugaaagcuaccaucucuccccggaaggucaagagcuccgucggcucucaggugagccucuccugcagcgucacaggcacggaggaccaggaacugucuugguacagaaauggggagauucuuaacccuggcaaaaaugugcgcaucaccggcauuaaccaugagaaccugaucauggaccacaugguuaaguccgaugggggagccuaucaguguuuugugcggaaagacaagcucagcgcucaagauuacguccaggugguucuggaagacggcacaccgaaaaucauuucugccuucuccgagaagguggucagccccgccgaaccugugucccugaugugcaaugugaaagggacaccccugccuacaaucaccuggacgcuggaugacgaucccauucuuaagggaggcucucauagaaucagccagaugauuacauccgagggcaacguugucucuuaccugaauaucagcuccagccaagugcgcgacgggggaguguaucgguguaccgcuaacaauucugcgggcgucgugcucuaccaggccagaaucaacguucgcgggccggcuuccauucggccuaugaagaauaucaccgccauugccggaagagauacauauauccacugccgcgugauuggcuaccccuauuacagcaucaaaugguauaagaacucuaaucugcuuccuuucaaccaccggcaggucgcuuuugaaaauaacgggacccugaaacucuccgacgugcagaaggagguugaugagggcgaauacacauguaaugugcugguccaaccccagcugagcacgucucagagcgugcauguuaccgugaaagucccucccuucauucagccguuugaguucccuagauuuuccaucggacaacgcguguucauccccugcguggucguuagcggcgaccuccccauuacaaucaccuggcagaaggacgggcggccuauuccgggaucucugggcgugacaaucgauaacauugacuuuaccuccagccuuagaaucuccaaucugucucucaugcacaacgggaacuacacgugcaucgcccggaaugaagcggcugccguggagcaucagagccagcugauuguccgcgugcccccuaaguucguugugcaacccagagaucaggacggaaucuauggcaaagccgucauucugaacuguuccgcugaaggguacccugugcccaccaucguuuggaaguuuucuaaaggcgccggagugccucaguuccagcccauugcucuuaauggccggauccaaguccucagcaacgggucccugcugaucaagcacgugguugaggaggauucuggauauuaccucugcaaagugagcaaugacgucggcgccgauguguccaagagcauguaucugacagugaagauuccggcgaugaucaccucuuacccuaacacaacccuugccacgcaggggcagaaaaaggaaauguccuguacagcucauggagagaaacccauuaucgucagaugggaaaaggaggaccgcauuaucaauccugagauggcccgguaucugguuagcaccaaagaagugggcgaggaagugaucucuacacuccaaauucugcccaccgucagagaggauuccggguuuuucagcugccacgcuaucaacucuuacggcgaagaccgcggaauuauccagcugaccgugcaggagccgccugaucccccugagauugaaaucaaggacguuaaggccagaacaauuacgcuucgguggaccaugggcuuugauggaaauagccccaucacaggauacgacaucgaguguaaaaacaagagcgacuccugggauagcgcgcagcgcaccaaagacgugucuccccaacucaauagcgccacaauuaucgauauucacccuuccucuaccuauagcaucagaauguacgcuaagaaccggauuggcaaauccgaaccgucuaaugagcugacgaucacagccgacgaagcugcccccgaugggccuccccaggagguccaucuggagccuaucagcucccagucuauucgcgugaccuggaaggcccccaaaaagcaccuccagaacggaaucauuagaggcuaucaaaucggguaccgggaauauagcaccggcggaaauuuccaguucaacauuaucuccguugacacaagcggcgauucugagguguacacccuggacaaccuuaauaaguuuacacaguaugggcuggucgugcaggcuugcaaccgcgcgggaacgggcccuuccagccaagaaaucauuaccacaacccucgaggaugucccgucuuaucccccugaaaaugugcaggccaucgcuacaucccccgagagcauuuccaucucuuggagcacccuguccaaagaggcccugaacgggauucuucagggauucagaguuaucuacugggccaaucucauggacggcgaacugggcgagauuaagaacaucacgaccacacaaccuagccuggaacucgaugggcuggagaaauauaccaauuacucuauccaggugcuugcuuuuacacgggccggagacggcguccgcuccgagcagauuuucaccagaacaaaggaagaugugcccgggccgccugcgggaguuaaagcugccgccgcuagcgccucuaugguguuugucagcuggcugccgccccucaagcugaacggcaucauucggaaguauaccguguucuguucccauccuuaccccacggugaucucugaguuugaagcgagcccugacuccuucucuuaucgcauuccgaaucugagcagaaaccggcaguacuccguuugggucguggcugugacaagcgccgggagaggaaauucuuccgagaucaucaccgucgaaccccuugccaaagcuccugcccgcauucucaccuuuagcggcacagugaccacgcccuggaugaaggacaucguucugccuugcaaagcugugggcgaucccuccccggccgucaaguggaugaaagacucuaacgggacaccuagccuggugaccauugauggacggagauccaucuucucuaauggcagcuuuauuauccgcacaguuaaggcggaggacuccggguauuacagcuguaucgccaacaauaacuggggaucugaugagauuauccucaaccugcaaguucaggugcccccugaccagccccggcuuaccguguccaagacaaccuccucuuccauuacgcugagcuggcucccuggcgauaaugggggaucuagcaucagaggcuacauucugcaguauuccgaagacaacucugagcaauggggcagcuuccccaucuccccgagcgaacgcuccuaccggcuggagaaucuuaaaugcgggaccugguauaaguuuacacugaccgcucagaacggagugggcccugggagaauuucugaaaucaucgaggccaaaacacucggaaaggagccccaguucagcaaagaacaggagcuguucgcuuccauuaauaccacgcgggugcgccucaaccugaucggcuggaaugaugggggaugucccauuacaucuuuuacccuugaauacagaccuuucggcacaaccgucuggaccacagcccaacggacgagccuguccaagucuuauauccucuacgaccugcaggaggccaccugguaugaacugcagaugcgcgugugcaacagcgcuggcugcgcggagaagcaggccaauuuugcuacacuuaacuacgauggguccaccauuccgccccugaucaaaagcgugguccaaaaugaggaaggacucacaaccaacgagggccugaagaugcucguuacgaucucuuguauucuggugggggugcuucuccucuucguccugcugcuugugguuagacggagacgccgggaacagagacugaaacgccuccgggacgccaagucccuggccgagaugcucaugagcaaaaauacaagaaccucugacacccuguccaagcagcaacagacacuucgcaugcacaucgauauuccucgggcucagcugcugaucgaggaaagagacaccauggagacaauugaugaccgcagcacggugcuccugaccgaugccgacuuuggagaagcggcuaaacagaagucucuuacagucacccacacagugcauuaccaauccguuagccaggccaccggcccccugguggaugucuccgacgccagaccugggacgaaccccaccacacggcgcaaugcuaaggccggaccuaccgcgagaaaccgguaugcuagccaguggacacucaaucgcccgcaccccaccaucucugcccauacacugacgaccgauuggagacucccuacaccccgggccgcuggcagcguggacaaagaguccgauucuuacagcgucuccccuucucaggacaccgauagagcccgcagcuccauggugucuaccgaaagcgcuuccagcacauaugaggagcuggcccgggcguacgaacacgccaagauggaggaacaacuuagacaugcuaaauucacgaucaccgagugcuuuauuucugacacauccagcgaacagcugaccgccggcacaaacgaguauaccgacucucugacguccagcacacccuccgagucugggaucugucgcuucaccgcuagcccgccuaagccccaggauggaggccggguuaugaacauggccgugcccaaagcccacagaccuggggaccucauucaucugcccccuuaccuucggauggauuuucugcucaaucgcggaggcccggggaccuccagagaccugagccucggacaggcuugccuggaaccccaaaagucucggacacuuaagcgcccuaccgugcuggagcccaucccuauggaagcggccuccagcgcuucuagcacaagagagggccaguccuggcagcccggcgccgucgccacccugccgcaacgggaaggggcugagcucggacaggccgcgaaaaugucuagcucccaggagucucugcuugauagccgcggccaucugaaggggaacaauccuuaugcuaaauccuacacgcucguuuga

SEQ ID NO: 68558 - RNA, 6342 nt, Artificial Sequence
  derived and/or modified sequence opt5 from DSCAML1__Homo_sapiens__NP_065744
augaccggcgcuggggagcccagacgggaggaaccuccuccccagcccagcgcuggacugcgcuccagagaaucuggcgcccccagcgcugggggaugggagcgggcggaaagaggcagaggggccgccgcucggccugccacaggacccccuccccgcagaaucggcccccucuacggcauguggcuggugacguuccuucugcuccuggacagccuucacaaggcucggccugaggaugucgggaccucucuguauuuuguuaacgacagccuccaacaggugacauucuccucuagcgugggaguugugguucccugcccugccgcgggcucccccagcgccgcucugcgcugguaccuggccaccggggaugacauuuacgaugugccgcauaucagacacguccaugcuaauggaacacuccagcuguacccuuuuucucccuccgccuucaacagcuuuauucacgacaaugauuauuucuguaccgccgagaacgccgcuggcaaaauccggucuccuaauauucgcgugaaggccguuuuuagagaacccuacacagugcgggucgaggaccagcgcuccaugagagggaacguggcuguguucaaaugccuuauccccagcucuguccaagaauauguuuccguggugagcugggagaaggauaccgucuccaucauuccugagcaucgguuuuucaucacguaccacggaggccuguacauuucugacgugcagaaagaagaugcccucagcaccuauagauguaucacaaagcacaaguacuccggcgagacccgccagagcaauggggcccggcugucuguuacagacccggcugaauccauucccaccauccuugauggauuucauagccaggaggugugggcgggccacacggucgaacugccuugcacagccucuggguaucccauuccugcuaucagauggcucaaagacggacgcccccugccggccgacagccgguggaccaagagaaucacaggccugaccauuuccgaucuccgcaccgaggacucugggacauacaucugugaggugacgaacaccuucggaagcgccgaagcuacaggcauucugaugguuaucgauccucuucaugugacccugacacccaaaaagcucaaaaccggcauuggguccacggucauccugagcugcgcccuuacaggaucuccugaguuuaccauccggugguauagaaauaccgaacuggugcuccccgacgaggcgauuuccauccgcggccugagcaacgaaacacugcucauuaccucugcucaaaagucccacagcggggccuaccaguguuucgccacacggaaggcucagacggcccaggauuucgcuaucauugcccuggaggacggaaccccuagaaucgucuccucuuuuagcgagaaagugguuaaucccggcgaacaauucucccuuaugugcgcggccaagggggcuccgccucccacagugaccugggcccuggaugacgagcccaucguccgcgauggcucucaccggacaaaccaguauaccaugagcgacggaacgaccauuucccauaugaaugugacaggcccucagaucagagaugggggaguuuaccgguguaccgcucgcaaccucgugggcagcgccgaauaccaagcgagaauuaauguccgggggccgcccucuaucagagccaugcgcaacauuacagcuguggccggacgggacacccugaucaacugcagagugauuggcuauccuuacuauuccaucaaaugguacaaggacgcccuucugcuccccgauaaucaccgccagguugucuuugagaacgggacgcugaaacugacagacgugcagaagggcauggaugaaggagaguaucucuguagcgugcugauccagccucaacuuucuauuucccagagcguccauguggccguuaaagugcccccucugauccagcccuucgaguuuccgccugccucuauuggccagcuccuguacauccccugcgucgugagcuccggggacaugccuauuagaaucaccuggcggaaggauggacaaguuaucauuagcggcucuggggugacaaucgaauccaaggaguucaugagcucccugcagauuucuagcgucucccuuaaacacaauggaaacuauaccugcaucgcuucuaaugcggccgcuaccgugagccgcgaaagacagcucauuguucgggugcccccgcgcuuugucgugcagccuaacaaucaagacggcaucuacgggaaggccggcgugcugaacuguuccgucgauggauaucccccucccaaaguuauguggaagcaugccaaaggcucugggaauccccagcaguaucacccugugccgcugacaggaagaauccagauucuccccaacagcucccugcuuauccggcacgugcuggaggaggacauuggcuacuaucucugccaagcuagcaauggggucggaacggauaucucuaaguccauguuccugaccgugaagauuccugccaugaucacaagccaucccaacaccacaaucgcgauuaaaggccacgcuaaggaacugaauuguaccgcccgcggggagagaccuaucauuauccggugggaaaaaggcgacacgguuauugaucccgaccgcgugaugagauacgccaucgcuacaaaggauaacggagacgaggucgugucuacccuuaaacucaagccugccgaccggggcgauuccgucuuuuucagcugccaugcgauuaauucuuauggggaagacagaggacugauccagcugaccgugcaggagccgcccgauccucccgagcucgaaauccgcgaggucaaggcucgguccaugaaccugagauggacacaacgcuuugacggcaacagcauuaucaccggguucgauauugaauacaaaaauaaguccgacagcugggauuuuaaacagucuacacggaacaucagcccuacgauuaaucaggccaacaucguggaccuucaccccgccuccguuuauucuaucagaauguacagcuucaauaagauuggacgcuccgagccgucuaaagaacugaccaucagcacagaggaggcugccccugauggaccgcccauggacgugacccuccagccugucacaucccaaucuauucaggugaccuggaaggcucccaagaaagaacugcagaacggcgugauccggggguaccagauuggauauagagagaauagcccuggcuccaacgggcaauacagcaucgucgaaaugaaggccacgggagauucugagguuuauacccuggacaaucuuaaaaaguucgcgcaguacggcguggugguccaggccuuuaaccgcgcugggacaggaccguccagcucugaaaucaaugccaccacacucgaggaugugcccucccagccucccgagaacguucgggcucugagcauuaccuccgacguggccgucaucucuuggagcgaaccucccagauccacacugaauggcgugcucaaaggcuaucggguuauuuucuggagccuguacguggacggggaguggggagaaaugcaaaacaucaccacgacacgcgagagagucgagcuucggggcauggaaaaguuuaccaauuauucugugcagguccuggccuacacccaggcuggggauggagugcgcuccagcguucucuacauucaaacaaaagaggacgugccgggcccucccgcggggaucaaggccgucccuucuagcgcuuccucugugguugugagcuggcugcccccuaccaagcccaacggagucauuagaaaauauacgaucuucuguuccucuccgggcagcggccagccugcccccuccgaauacgagacaagccccgaacagcuguuuuaucggaucgcccaccuuaacagagggcagcaauaccuccuguggguggcugccgugaccucugcgggacgcggcaauuccagcgagaagguuacaauugagccugcugggaaagccccggccaagaucauuuccuucggaggcaccgucacaacccccuggaugaaagaugugcggcugccuugcaacucugugggggaccccgcuccugccgucaaguggacgaaggauagcgaagacuccgcgauccccgugucuauggauggacauagacucauucacaccaauggcacacugcuucugcgcgcuguuaaagccgaggacagcggcuauuacaccuguacagccaccaacacagggggcuuugauacgaucaucgugaaucuccugguccaggugccuccggaccagccccggcugaccguuuccaagacaagcgcuucuuccauuacccuuaccuggaucccuggcgauaacgggggaagcucuauuagaggcuucgugcugcaguauuccgucgacaauagcgaagaguggaaagacguguuuaucucuagcuccgaacgcucuuucaagcucgauagccugaaaugcgggacaugguacaagguuaagcucgccgcuaaaaacuccgugggaagcggccggauuuccgagaucaucgaggccaagacgcauggcagagaacccucuuuuagcaaagaccaacaccuguucacccauauuaauuccacacacgcgcgccuuaaccugcagggguggaauaacggaggcuguccuaucaccgccauuguccucgaguacagacccaaggggacaugggcuuggcagggacugcgggccaauucuagcggcgaaguguuucugaccgagcuucgcgaagcuacgugguaugagcugagaaugcgggccugcaacuccgccggguguggaaaugagacagcucaguucgcgacccucgauuacgacggcucuaccaucccgccuauuaaaagcgcccaaggcgaaggggaugacgugaagaagcuguucacaaucggaugccccgucauucucgcuacccugggcguugcccuucuguuuaucgugcgcaaaaagagaaaagagaagcggcucaaaagacugcgcgaugccaagucccuggcugaaaugcuuaucagcaaaaacaaccggucuuucgacacacccgugaaggggccuccccagggaccuagacugcacauugauaucccgcgcguccagcuccugauugaggacaaggagggcaucaaacagcucggggaugacaaggccacgauucccgugaccgaugcggaauuuucccaagcuguuaauccucagagcuucugcacaggagugucucugcaucaccccacccuuauccaguccacaggcccucugaucgacaugagcgacauucggcccggcaccaacccggucucucgcaaaaaugugaaguccgcccauagcacgcggaaccgcuauuccagccaauggacccugacaaaaugucaggccucuaccccugcuagaacacucaccagcgauuggcggacaguugggucccagcacggagugacggucaccgagucugacagcuacuccgccucucugagccaggauacagacaagggccgcaauuccauggugucuaccgaaagcgcguccagcaccuaugaggaacuugccagagcuuacgagcaugccaagcuggaggaacaacuccagcacgcuaaauuugagaucacagaaugcuucauuucugauuccagcucugaccagaugacgaccgggacaaacgagaaugccgauuccaugaccagcauguccacacccucugaaccuggaaucugucgguuuaccgcuuccccucccaagccccaggacgccgaucgcggcaaaaacgucgcggugccgauuccucacagagccaauaaguccgacuauugcaaccugccccucuacgcuaaaagcgaggccuucuuucggaaggcugaugggcgcgagcccuguccuguugugccgcccagagaagccucuauccggaaucuggccagaacguaccauacacaagcucgccaccuuacccuggacccugcguccaagagccugggccucccccauccuggagcccccgcugccgccucuaccgcuacacugccucagcggacccuugccaugcccgcgccgccugccggcacagcucccccugcccccgggccgaccccugcugagccgcccacggccccuagcgcggcgcccccugcuccguccacagaacccccuagagccggaggcccccacaccaaaaugggagggucucgcgauagccugcucgagauguccacaucuggcguggggcggagccagaagcagggcgcuggagccuauuccaaaagcuacacccuggucuga

SEQ ID NO: 68559 - RNA, 1182 nt, Artificial Sequence
  derived and/or modified sequence opt5 from DSCC1__Homo_sapiens__NP_076999
augaagagaacccgggacgagguggaugccacacugcagaucgcuaaacucaacgccgcggaacugcuucccgcuguccacugccugggcuucgggccuggagccagcggcgccgcugccggggacuuuugucuccuggagcuugaaccgacgcugugccaacagcucgaggauggacauucccugguuauucgcggcgacaaggaugaacaggcugugcuguguucuaaagacaagaccuacgaucucaaaaucgccgacacaagcaauaugcugcuuuucauucccgggugcaagaccccugaucagcugaagaaagaggacucccacuguaacaucauucauacagagaucuuuggauucucuaauaacuauugggaacucagacggcgcagacccaagcugaagaaacuuaaaaagcugcucauggagaauccuuacgaaggccccgauagccaaaaggagaaagacuccaacucuagcaaguauaccacagaggaucugcuggaccagauccaggcguccgaagaggaaauuaugacccagcuccaagugcugaaugccugcaaaaucggcggguacuggcggauucuugaguuugacuaugaaaugaagcugcucaaccacgucacgcagcugguggauagcgagucuugguccuucggaaaaguuccucuuaauaccugucugcaggagcucggcccgcuggaacccgaggaaaugaucgagcauugccugaaguguuacgggaaaaaguauguggacgaaggagaggucuacuuugagcucgaugcugacaagauuugccgcgccgcugccagaaugcugcuucagaacgcggugaaauucaaucuggccgaauuucaagagguuuggcagcagagcgugccugaaggcauggucacaucucucgaucaacugaaggggcuugcucugguggaccggcacucccgccccgagaucauuuuccuccugaaaguggaugaccugccugaagauaaccaggagagauuuaauagccucuucucucugcgggagaaguggaccgaagaggacaucgcccccuacauccaggaucuuuguggagaaaaacagacaauuggcgcucugcucaccaaguauucccacagcuccaugcaaaacggcgucaagguuuacaauucucgcagaccgaucagcuga

SEQ ID NO: 68560 - RNA, 357 nt, Artificial Sequence
  derived and/or modified sequence opt5 from DSCR4__Homo_sapiens__NP_005858
augagccugaucauucucaccagagacgaugagccccggaucuucacaccugacuccgaugccgcuucuccggcccugcacagcacgucuccccuuccugaccccgcguccgcuagcccucugcaucgcgaagagaagauucuccccaaagugugcaacaucgucuccugucugucuuuuagccuuccugccuccccgaccgauagcggccuggccucucccacaauuaucaccagagaagggcagcaauucugggcuaagugccucaucuggaaauaccagcuguaucugcacggacuccauaagaaauccgacggccggcgcgauaagcagauuagcgccucuccuuccacauga

SEQ ID NO: 68561 - RNA, 2877 nt, Artificial Sequence
  derived and/or modified sequence opt5 from DSE__Homo_sapiens__NP_037484
augagaacccacacacggggcgcccccagcguguucuuuaucuaccugcucugcuucgucuccgcuuauauuacggacgagaacccugaaguuaugaucccguuuaccaaugccaacuacgauucucaucccaugcuguauuucagccgcgcggagguggcugaacuucagcugagagccgccuccucucacgagcauauugcugcccggcucacagaagcugugcacaccaugcugagcuccccucuugaguaccugcccccuugggaccccaaggauuauucugcccgcuggaaugagaucuuugggaacaaucucggagcgcuggccauguucuguguccuguacccugaaaacauugaggcuagagacauggccaaagauuauauggaacggauggcugcccaaccgagcuggcucgugaaggacgcgcccugggaugagguuccucuggcccauucccuugugggcuuugcuacagccuacgacuuccuguacaauuaucucagcaaaacccagcaggagaaguuucuggaagucaucgcuaacgccucuggguacauguaugagacauccuaccgcagaggauggggcuuccaguaucuucacaaucaccaacccaccaacugcauggcccugcucacggggagccuggugcugaugaaucagggauaccuccaggaggcuuaucuguggaccaaacagguucuuacaaucauggaaaagucucuggugcuccugcgggaagucaccgauggcucccuuuacgagggcguggcguacgggagcuauacaacccgcucucuguuucaauacauguuccucgugcagagacauuuuaacauuaaucacuucggacauccuuggcugaagcagcacuucgccuuuauguaucggacgauccugcccggcuuccagcgcacagucgcuauugccgacuccaacuacaauugguuuuaugggccggagagccaacucguuuuccuggauaaauuugugaugagaaacggauccggcaacuggcuugccgaccagauccggcgcaauagaguggucgaagggccuggaacccccucuaagggccagcggugguguacacugcacaccgaguuccucugguacgauggcagccugaaauccgugccuccucccgacuuugggacccccacacuucauuauuucgaagacuggggaguugugacguacggcagcgcucugccggccgagauuaacagaucuuuucucuccuucaagagcgggaaacugggaggccgcgcgaucuacgauauuguccaccggaauaaguauaaggacuggaucaaaggguggagaaacuuuaaugcuggacaugaacaccccgaucaaaacucuuucaccuuugccccuaauggcgugcccuucaucacagaggcccuguacggcccuaaguauaccuucuuuaacaauguucucauguucagccccgcuguguccaaaucuugcuuuagcccgugggucggacaggugacagaggacuguuccagcaaguggucuaaauacaagcaugaucuggccgcuuccugccaggggcgcgucguggccgcggaagagaaaaacggcguuguguucauuagaggggaaggagucggcgccuauaauccucagcuuaaccugaagaaugugcaacggaaccucauccugcugcacccccagcuucuccugcugguugaccagauucaccucggggaggaaagcccucuggagaccgcugccagcuuuuuccauaauguggauguccccuuugaggaaacggugguggacggcguucacggagcuuucauccgccagcgggauggccuuuacaagauguauuggauggacgauacaggguacuccgagaaagccaccuuugcgagcgucaccuacccuagaggauaucccuacaacggcacaaacuaugugaaugugaccaugcaucugcgcuccccgauuacacgggccgcuuaccucuucaucgggccuucuaucgacguccaaucuuuuacggugcacggagacucccagcagcuggauguuuucauugccaccucuaagcacgcuuaugccacauaccuguggaccggcgaagccacagggcagagcgcuuuugcgcaagugaucgccgacagacauaaaauucuuuucgaucgcaacuccgcuaucaagagcucuauuguccccgaggugaaagacuaugccgccaucguugagcagaaucuccagcacuucaagcccguguuucagcugcuggaaaagcaaauccucucccgggucagaaacaccgcuagcuuccggaaaacggccgagcgccugcuuagauuuucugauaagcggcagaccgaagaggcgauugacagaaucuucgcuauuucccagcaacagcagcagcaaagcaaaucuaagaaaaaucgccgggccggcaagagauacaaguuuguggaugccguuccugacaucuucgcucagauugaagugaacgagaaaaagauccgccagaaagcccagauucuggcgcaaaaggagcucccgaucgaugaagacgaggaaaugaaagaucugcuggacuuugcugaugucacauacgagaagcauaagaauggaggccuuaucaaagggagauucggacaggcccggauggugaccacaacccacagccgcgcccccucccucagcgcuucuuauacgagacuguuucugauucucaacaucgccauuuucuuugugaugcuggcuaugcagcuuacauacuuccagcgggcccaaucccugcauggccagcgcugucucuaugcgguccugcugaucgacagcugcauucuucucuggcuguacuccucuuguagccagucccaaugcuga

SEQ ID NO: 68562 - RNA, 3669 nt, Artificial Sequence
  derived and/or modified sequence opt5 from DSEL__Homo_sapiens__NP_115536
augcccaagggcggggccccuccguggaucauggcucugauguucaccggacaccuccuguuucuugcccugcucauguucgcguuuagcacauucgaggaauccgugucuaacuacagcgagugggcugucuuuacggacgauauugaccaguucaaaacccaaaagguucaggauuuuagacccaaucagaaacugaagaaauccaugcuucauccuucucuguauuucgacgccggcgaaauccaggccaugcggcaaaagagccgcgcuucccaccuccaucuguuuagagccauucggucugcugugacagugaugcugagcaaccccaccuacuaucucccucccccuaagcacgccgauuucgcggccaaauggaaugagaucuacgggaacaaucugccgccccuugcucuguauugccuccuguguccugaagacaaggucgccuuugaguucgugcuugaguacauggaucgcaugguuggauauaaagacuggcugguggaaaacgcucccggcgaugaggucccuauugggcauucccucacaggauuugccaccgcguucgacuuccuguacaaucugcucgauaaccacagacggcagaaguaccuggaaaagaucugggugaucacagaggagauguaugaauacagcaagguucgcucuuggggcaagcagcuucugcacaaucaucaggccaccaacaugauugcucuccugacgggcgcccuugugaccggggucgacaaaggauccaaggcuaauaucuggaaacaagccgugguggaugucauggagaagacaauguuucugcucaaccacauuguugacggcagccuggacgaagggguggccuauggaucuuacaccgcuaaauccgugacacaguaugucuuccuggcgcagagacauuuuaauaucaacaaucucgauaacaacuggcugaagaugcacuucugguuuuacuaugccacccuucugcccggcuuccagcggacgguggggauugcugacagcaauuacaacugguuuuacggaccggagucucaacucguuuuccuggauaaauuuauccuuaagaauggcgccggcaacuggcuggcccagcagauucgcaagcacagaccuaaagacgggcccauggugccuuccacagcucaacgguggagcacccuccauacagaauauaucugguacgauccccagcugacaccccagccuccggccgacuauggaaccgcgaagauccacaccuuccccaauuggggcgucgugacguacggggcuggacugccuaacacccagacaaauaccuuuguuuccuucaaaucuggcaagcucgggggacgcgccguguaugauauuguccauuuucaacccuacagcuggaucgacggcuggagauccuucaacccuggccacgagcaucccgaucagaauagcuucacauuugccccgaacggacagguguucgucucugaggcucuguaugggccuaaacuuucccaccugaauaacgugcucguuuuugcccccagcccuucuagccagugcaauaagcccugggaaggccaacugggggagugugcucaguggcugaaguggaccggagaagaggugggcgacgccgcgggggaaauuaucacggccucccagcacggcgagauggucuucgugucuggagaggcuguuagcgccuacuccagcgcuaugcggcuuaaaucuguguaccgcgcccuccugcugcucaacucccagacacugcuugucguggaucauauugaaagacaagaggacagcccuaucaauucuguguccgcguuuuuccacaaccuggacaucgauuuuaaguauauucccuacaaauucaugaaccgguauaauggcgccaugauggacguuugggaugcucauuacaagauguuuugguucgaccaccacgggaacagcccgauggccuccauccaggaagcugagcaggccgccgaauuuaaaaagagauggacccaguucgucaaugugaccuuucaaauggagccuacaauuacccgcaucgcuuauguguucuacggacccuauauuaacgucucuagcugccgguucaucgauuccucuaaucccggccuccagaucagccugaacgugaauaacacagagcauguuguguccauugucacggacuaccacaaucugaagaccagauuuaacuaccuuggguucggaggcuuugcgagcguggccgaucaggggcaaaucacacgcuucggccucggaacccaggcuauuguuaaaccugugcggcaugacagaaucauuuuuccguucggcuuuaaguucaauaucgccgucgggcugauucuguguaucucucucgugauccugacauuucaguggcgcuucuaucuuuccuuucggaaacugaugagauggauucucauccugguuauugcccugugguucaucgaacuucucgauguguggucuaccugcagccagcccauuugugcuaaguggacgcgcaccgaggccgaaggauccaaaaagagccugucuagcgagggccaccauauggaccugccugaugucgugaucacaucccuccccgggagcggagcggagauccugaagcaacuuuucuuuaacucuuccgacuuccuguacauucgggugccuaccgcuuauaucgauauucccgaaacagagcucgaaaucgacagcuuugucgacgccugcgaguggaaaguuuccgauauuagaucuggccacuuccgccugcugcggggguggcuucagagccucgugcaggacaccaagcugcaucugcagaauauccaccuccacgaaccuaacagaggcaaacuggcccaauacuuugcuaugaauaaggauaaaaagcggaaauucaagcgcagagagucccuucccgagcagcggucucagaugaagggagccuuugacagagaugcggaauauauccgcgcucugcggagacaucucguguacuauccgagcgcccgcccuguccugucccugucuagcggcuccuggacgcuuaaacugcacuucuuucaggaggugcucggggccagcaugagagcucuguacauuguucgggacccccgcgccuggaucuacucuaugcucuauaacuccaagccuagccuguacucucuuaaaaacgugcccgaacaucuggcuaaacucuucaaaauugagggaggcaaggggaaguguaaucugaacuccggauaugccuuugaauacgagccgcugagaaaagagcuuagcaagucuaaauccaaugcggucagccugcucucccaccuguggcucgccaacacagcugccgcucugcggaucaauaccgaucuucugccuacaagcuaucaacucgugaaguucgaagacauuguucacuuuccccagaaaaccaccgagcgcaucuucgccuuccugggcaucccucugucucccgccagccuuaaccagauucuguuugcuacauccacgaaucucuucuaccugcccuaugaaggggagaucucuccuaccaacacaaauguguggaagcaaaaccucccgagagaugaaauuaagcugaucgagaauauuugcuggacccuuauggaccggcugggcuaccccaaauuuauggauuga

SEQ ID NO: 68563 - RNA, 3150 nt, Artificial Sequence
  derived and/or modified sequence opt5 from DSG1__Homo_sapiens__NP_001933
auggacuggagcuucuuuagaguggucgccaugcuguucaucuuucucguugugguggaggucaacuccgaguuccggauucaggugcgcgauuacaauaccaagaacggcacaaucaaauggcacucuauuagacggcaaaagcgcgaguggaucaaauuugcugccgcgugcagagaaggggaggacaauagcaagcggaaccccauugcuaaaauccauuccgauugugccgccaaucagcagguuacguaucgcaucucuggagugggcauugaccagccuccguacgggaucuucgucauuaaccaaaagaccggagaaaucaauauuacaagcaucguggauagagagguuacccccuuuuucauuaucuauugccgggcucugaacuccaugggccaggaccuugagcgcccucuggaacucagagugcggguccuggauaucaaugacaaucccccuguguuuucuauggccacauucgcugggcagauugaggaaaacagcaacgccaauacccuugugaugauccugaacgcgacagaugccgacgagcccaauaaccucaacuccaagauugcuuuuaaaaucauucgccaggagccuagcgauucuccgauguucaucaucaauagaaacaccggagaaauucggacgaugaauaacuuucuggaccgcgagcaauacggccaguaugcccuggcugucagaggcuccgaucgggacgggggagccgacggcaugagcgcggaaugugagugcaauaucaagauucucgauguuaacgacaauauccccuacauggaacagucuuccuauaccauugagauccaggagaacacacugaauagcaaccuucuggaaaucagagugauugaucucgacgaggaguucucugccaauuggauggcugugaucuucuuuauuuccgggaacgaaggaaauugguucgaaaucgagaugaacgagcgcaccaaugucggcauucugaaagugguuaagccucuugauuacgaagccaugcaaagccugcagcucuccaucggggugcggaacaaagcugaguuucaccauucuauuaugagccaguacaagcugaaggccuccgccaucagcgucacagugcugaacguuaucgaaggacccguguucagaccuggcucuaaaaccuaugucgugacgggcaauaugggguccaacgacaaggucggagauuuuguggcuacagaccucgauaccggccgccccagcacaaccguucgguacgugauggggaauaacccggcggaccugcuugccgucgauucuagaaccggaaaacugacacucaagaauaaagugacgaaggagcaauauaacaugcugggcgggaaauaccagggaaccauucuuagcaucgacgacaaucugcagcgcacauguaccggcacaauuaacaucaauauucaguccuucggcaacgaugaccggaccaauacggaaccuaacacaaagaucaccaccaauacagggagacaagagucuaccagcuccacaaacuaugauacgagcaccacaucuaccgacuccagccagguuuacucuuccgagcccggaaauggcgcuaaggaucuccugagcgacaacgugcacuuugggccugccggaaucggccugcucauuaugggguuccugguccuuggccuggugcccuuucucaugaucugcugugauugcggaggcgcuccccgcuccgccgccggguucgaaccugugccggaguguucugacggagcgauucauagcugggcuguugaaggcccccagccugagccccgggauaucacaaccgucauuccucagauucccccggacaacgccaauaucaucgagugcaucgauaacuccgggguguauacgaaugaauacggaggcagagagaugcaagaccuugggggcggagaacgcaugaccggcuuugagcugacagaaggggugaaaaccucuggaaugccugagauuugucaggaguacagcggcacacugcggagaaacuccaugcgggaaugccgcgaagggggacucaauaugaacuucauggaaagcuauuuuugccagaaggccuacgcuuaugccgaugaggacgaaggcagacccucuaaugacugucugcugaucuacgauauugagggggucggcuccccugcuggaagcgugggcugcuguucuuucaucggggaggaccucgaugacuccuuccuggauacccuuggacccaaauuuaagaaacuggccgacaucagccucggcaaggaaucuuauccugaucuggaccccagcuggccgccucaguccacggagcccguuugccugccccaagaaacagagccuguggucagcgggcacccgcccauuucuccucacuucggaaccacaaccgugaucuccgaaagcaccuaccccuccggcccugggguucuucaucccaagccuauucucgauccccugggcuauggaaacgugacagucacggagucuuacaccacaagcgacacccugaaaccguccgugcacguucaugauaaucggccugcgucuaacguggucgugacagagagaguggucggccccaucagcggggccgaccuccacggaaugcuggaaaugccugaucuucgcgacggcuccaauguuauugugaccgagcgggugaucgcucccucuagcucccugccgacgagccucacaauucaccauccuagagaaucuuccaacgucgugguuaccgagcgcgugauccagcccaccagcgggaugaucggaucucuguccaugcacccugagcuggccaaugcucauaacgucauugugacagaaagaguugugagcggcgccggcgucaccgggaucucuggaacaacgggcauuuccgggggaaucggcagcuccgggcuugugggaaccagcaugggcgcgggcucuggggcccucagcggagcuggcauuuccgggggaggcaucgggcugucuagccugggaggcacagccuccaucggccacaugcggucuagcuccgaccaucacuuuaaucagaccauugggucugcuagccccuccacagcccgcagcagaaucaccaaguacucuacgguucaguauuccaaauga

SEQ ID NO: 68564 - RNA, 3357 nt, Artificial Sequence
  derived and/or modified sequence opt5 from DSG2__Homo_sapiens__NP_001934
auggccagaagccccggccgggcuuacgcccugcuccugcuucugaucugcuucaacgugggguccggacuccaucugcagguccuuucuacccgcaaugagaacaagcugcucccuaaacacccgcaccugguuagacaaaagcgggcguggauuacagcucccguggcccugcgcgaaggcgaggaccucagcaaaaagaauccuaucgccaaaauucauuccgaucuggcugaagagagagggcuuaagaucacguauaaguacaccggaaaaggcauuacagaacccccuuuugggaucuucguguuuaacaaggacaccggagagcugaaugucacaucuauccucgaucgggaggaaacccccuucuuucugcuuacaggcuaugcccuggacgcucgcggcaacaauguggagaaaccucucgaacugagaauuaagguucuggauaucaacgacaaugagccgguguucacccaggaugucuuuguggggagcguugaggaacucuccgccgcgcacacgcuggugaugaaaauuaacgccaccgacgcugaugagcccaauacacuuaacucuaagaucagcuaccggauugucucccuggaaccugccuaucccccuguguucuaccucaauaaggacaccggagagaucuauacaaccagcgugacgcuggaucgcgaagaacauucuuccuacacacuuaccgucgaggcuagagacggcaacggggaaguuacagauaaacccgugaagcaggcccaggugcaaauucggauccuggacgucaaugacaacaucccggugguugagaacaaagugcucgaaggaauggucgaggaaaaucaggugaacguugaggugacccgcauuaaggucuuugaugcggacgagaucggcagcgauaauuggcuggccaacuucaccuuugcuucugggaaugaaggaggcuacuuccacauugagacagacgcccagacgaacgaaggcaucgugacccugauuaaagaggucgauuaugaagagaugaagaaucucgacuuuuccgugaucguugcuaacaaagccgccuuccacaagagcaucagaucuaaguacaaaccuacacccauuccuaucaaggugaaagucaagaaugugaaagaggggauucauuucaaguccagcguuaucuccauuuaugugucugaaagcauggaucgguccagcaagggacagaucaucggcaacuuucaggcuuucgacgaggauaccgggcugcccgcgcacgcccgcuacgucaaacuugaagacagagauaauuggauuucuguggacuccgugacaagcgagaucaagcuggcuaaacuccccgacuuugagucucgguauguucagaacggaaccuacacggucaagauuguggccaucagcgaagauuauccuagaaaaacaauuaccggcaccgugcugaucaaugucgaggacauuaacgauaauuguccgacacuuaucgaacccgugcagaccaucugccaugacgccgaguacguuaacgugacagcugaagaucuggacgggcacccuaacuccggacccuucucuuuuagcgucauugauaagccucccggcauggccgagaaguggaaaaucgcgcgccaggaguccacgagcgugcuccugcaacagucugaaaagaaacugggccgguccgagauucaguuccucaucagcgacaaucaaggguuuucuuguccggaaaagcagguucugacccuuacagugugcgagugucugcacggauccggcugcagagaagcucagcaugauagcuacgucgggcucggaccugccgccauugcucugaugauccuggccuuccuucuccugcugcucgugccccugcuucugcucaugugucacugcggcaaaggggcuaagggcuuuaccccuauccccggaacaauugagaugcugcauccuuggaacaaugagggcgcgcccccggaagacaagguugugccuuccuuccugcccgucgaucaagggggaucucuugugggccgcaacggggugggaggcauggccaaagaggccaccaugaaggggagcuccucugcuagcaucgucaaaggccaacacgaaauguccgagauggacggacggugggaggagcauagaagccuccugucuggccgcgccacgcaguuuaccggggcuacaggagccauuaugaccacagagaccacgaagacagcgcgggccaccggcgcuuccagagauauggccggggcucaggccgccgcuguugcgcugaaugaagaguuccuccgcaacuauuuuacagacaaagccgcuagcuacaccgaagaggacgagaaucacaccgccaaggauugucugcuuguguauucucaggaagagacagaaucccugaacgccagcaucggaugcuguucuuucauugagggcgaacucgacgaucgguuccuggacgaucuggggcuuaaauuuaagacgcucgcugaggugugccugggccaaaagaucgacaucaauaaagagauugaacagagacagaagcccgccaccgagacaagcaugaacaccgcgucccacagccugugcgaacagacaauggucaauucugagaacaccuacuccagcggauccucuuucccugugccgaaaagccuccaagaagcuaaugccgagaagguuacgcaggagaucgugacagaacgcuccgucucuagccggcaggcccagaaaguggcuacaccccugccugaucccauggccuccagaaacguuauugcgaccgagaccucuuaugugaccggcagcacaaugccucccacgaccgucauccuugggccuucccaaccccagagccugauugugacagaacggguuuacgcuccggccucuacccucguggaccagccuuaugccaaugagggaacagucguggugaccgaacgcgucauccaaccccauggcgggggauccaacccucuggagggcacgcagcaucugcaggauguucccuacgugauggugagagagcgggagagcuuucuugcuccgucuuccgggguccagccuacccucgccaugcccaacaucgcugugggccaaaauguuacagugaccgaaagaguccuggccccugcgagcacacugcagucuuccuaccagauucccaccgaaaacagcaugacagcccgcaauaccacgguguccggagcuggcguucccgggccucucccggacuucggacuggaggagagcggccacucuaacagcacaaucaccaccuccucuacacgggugaccaagcacagcacgguccagcacuccuauucuuga

SEQ ID NO: 68565 - RNA, 3000 nt, Artificial Sequence
  derived and/or modified sequence opt5 from DSG3__Homo_sapiens__NP_001935
augaugggccuguuccccagaaccacaggggcccucgcuaucuuuguggucguuauucuggugcacggagagcuucggaucgaaacgaagggccaguacgacgaggaagagaugaccaugcaacaggccaaacgcagacagaagcgggaaugggugaaauucgcgaagccuugccgcgagggggaggauaacagcaaaagaaauccgauugcuaagaucacauccgacuaucaggccacccaaaagauuacauaccggaucucuggagucggcaucgaucagcccccuuuugggauuuucgugguugacaaaaacaccggagauaucaauauuacagccaucguggaccgcgaagagacccccagcuuucugauuacguguagagcucucaacgcccagggccuggaugucgaaaagccucuuauccugaccgugaaaauucucgacaucaaugauaaucccccuguuuucucccagcaaaucuuuaugggcgagauugaggaaaacucugcuagcaacucccuggugaugauccugaaugccacagacgcggaugagccgaaccaucucaauucuaagauugccuucaaaaucgucagccaggaacccgcugggaccccuauguuucugcuuucccggaacacaggagaggugcgcacccugacgaauagccucgacagagaacaggccucuuccuaucggcugguggucagcggcgcugauaaggacggggagggacuuucuacacagugcgaguguaacauuaagguuaaagacgugaaugauaacuuccccauguuucgcgacucccaauacagcgccagaaucgaagagaacauccugucuuccgaacuccugcgguuccaggugaccgaucuggacgaggaauauacagauaauuggcucgcggucuacuuuuucaccagcggcaacgaggggaauugguucgagauucagaccgacccucgcacaaacgaaggaauccugaaggugguuaaagcccuugauuaugagcaacugcaguccgugaagcucucuauugcugucaaaaauaaggccgaauuucaccagagcgugaucuccagauaccggguucagagcacgcccgugaccauucaagucaucaacgugagagagggcaucgcuuuccgcccggccucuaaaacauuuaccguccagaagggcauuuccagcaagaaacugguggacuacauccuugggacauaucaggccauugaugaagacaccaauaaggcugcgucuaacguuaaauacgugaugggacggaaugauggcggguaucugaugaucgacagcaagacggccgagauuaaauucgucaagaacaugaauagagacuccacauuuaucgugaacaagaccauuaccgcugagguucucgccaucgaugaauacacaggaaaaaccucuacaggcacgguguauguccgcgugccugacuucaaugauaacugccccaccgccgugcuggagaaggacgcuguuuguagcuccagcccuucugucgugguguccgcccggacacugaauaacagauacaccgggcccuauacauuugcgcucgaagaucagcccgucaaacugccugcuguguggagcaucaccacgcuuaacgccaccucugcccugcuccgcgcucaagagcagauuccgcccggaguuuaccauaucucccuggugcuuacagacagccagaauaaccggugcgagaugccuagaucccugacccucgaagucugucagugcgauaaucgcggcauuuguggcacaucuuaccccaccacgagcccugggacacgguauggaagaccccacuccggccgccuggggccggccgcuaucggacugcuccugcuuggccugcuccugcugcuucucgccccucugcugcuccugaccugcgacuguggggcgggcucuacaggaggcgugaccgggggauucauucccguuccugauggcagcgaggggaccauccaucaauggggaaucgaaggcgcccaccccgaggacaaggaaauuacaaacaucugcgugccucccgucacggcuaauggggccgauuuuauggaguccagcgaggugugcaccaacacauacgcucggggcaccgccguugaaggaacaucuggcauggagaugaccacgaaacuuggggcggccacagaauccggaggcgcugccggguucgcuaccggaaccgugagcggcgccgccucuggguuuggcgcugcgacaggagucggcauuuguuccagcgggcagucuggaaccaugagaacacggcacagcacgggcgggaccaauaaggacuaugccgauggagcuaucuccaugaacuuccuggacagcuacuuuucucagaaggccuucgccugcgcugaggaagacgauggccaggaggccaaugacugucuccugauuuaugauaacgagggggcggacgcuacaggcuccccggugggaagcgugggcugcuguuccuucaucgccgaugaccuggaugacucuuuucuugauagccucgggccuaaauucaagaaacuggccgaaaucucccugggagucgacggcgaggggaaggaaguucaaccucccucuaaagauagcggauacggcauugaguccugcggccaucccaucgaagugcagcagaccggguuugugaagugucaaacacucucuggaagccagggcgcuuccgcccugagcaccucuggguccguccagccggcggugagcauucccgacccucuucagcacggaaauuaucugguuacggagaccuacucugcuuccggcagccucgugcaacccucuacagccggguucgauccucugcugacccagaacgucaucgugacagagcgcguuauuugccccaucuccagcgugccuggaaaucuugccggccccacccagcucagaggcucccauacaaugcuguguaccgaagacccgugcagccggcugaucuga

SEQ ID NO: 68566 - RNA, 3180 nt, Artificial Sequence
  derived and/or modified sequence opt5 from DSG4__Homo_sapiens__NP_001127925
auggacuggcuguucuuuagaaacaucugccuccugauuauccuuaugguggucauggagguuaauagcgaguucauuguggaggugaaggaauuugauaucgagaacggcaccacaaaauggcagacgguccggcgccaaaagagagaauggauuaaauucgccgcugccugucgggagggggaggacaauuccaagcgcaaccccaucgcgaaaaucagaucugauugcgaaagcaaucagaagauuaccuaccggaucuccggagugggcauugaccgcccuccguaugggguuuuuacaaucaaccccagaaccggagagauuaauaucacaucuguggucgaucgggaaauuaccccucuguuccucaucuacugucgcgcucugaacagcagaggcgaggaccuugagcggccccuggaacuccgcgugaagguuauggauaucaaugacaacgccccuguguuuucccagucugucuauacagccagcauugaggaaaauuccgaugcuaacacccugguggugaaacugugcgccacggacgcugaugaggaaaaucaccucaacagcaagaucgccuacaaaauugucucucaggagcccuccggggcgccuauguucauccugaauagauauaccggagagguuuguacaaugagcucuuuucuugaccgggaacaacauuccauguacaaccugguggugcgcggcagcgauagagacggcgccgcugacgggcucucuuccgagugcgauugucggauuaagguccuggacgugaacgauaauuucccgacccuugaaaagacaagcuauuccgccucuaucgaggaaaacugccugagcuccgagcucaucagacugcaggcuauugaccuggaugaggaaggaaccgacaauuggcucgcccaguaccugauccuuagcggcaacgaugggaauugguuugacauucagacggauccccaaacaaacgagggaauccugaagguugugaagaugcucgacuacgaacaggcgccuaauauucagcugucuaucggcgucaaaaaccaggccgauuuccacuauuccguggcuagccaauuucagaugcaucccaccccuguucgcauccagguggucgacgugcgggaggggcccgccuuccacccgucuacaauggcuuucagcgucagagaaggaauuaagggcuccucucuucugaauuacgugcucggcaccuauaccgccaucgaccuggauacagggaacccugccacggacguucgcuacauuaucggacaugaugcuggcagcuggcugaaaauugacucccggaccggggagauccaauuuagcagagaguucgauaagaaaucuaaguauauuaucaauggaaucuacacagcggaaauucucgccaucgacgauggcuccgggaaaaccgcuacaggaaccauuuguaucgaggugcccgacauuaacgauuauugcccuaauaucuuucccgaacgccggacgaucuguauugacagccccucuguccugaucuccgugaacgagcacagcuacggcuccccuuucacauuuugcguuguggaugagccgcccggcauugccgacaugugggaugucagaucuaccaaugccaccagcgcuauccuuacagccaaacaggugcuguccccuggguucuacgaaauucccauccucgugaaggacucuuauaaccgcgcgugcgagcuggcucagaugguucagcuuuacgccugugacugcgaugacaaccacaugugucuggauagcggagccgcuggcaucuauaccgaagacauuacaggggauacguacggaccugucaccgaggaccaagccggcguguccaauguggggcucggccccgcuggaaucggcaugaugguccuggggauucugcuccugauccuugccccgcugcuccugcugcuuugcuguugcaaacagcggcagccugaaggacucggcacaagauuugcgcccgugccugaagggggagagggcguuaugcagagcuggcgcauugaaggggcccaucccgaggaucggcuguucucugcuuaugcccugccuggcggaggcgggaccgcugacggaggcggguccgugcucggaagaugugcccugcaagcgacacccgcccuucugaaccagcacccgccuuuuagcgaaaucuacaccaauacguaugcugccggcgggaccgucgagggcggagugucuggcguugaacucaacacagggaugggaaccgcugugggccugauggccgccggggcugcgggagccuccggcgcugcccggaagcgcagcucuacaauggggacccugagagauuacgccgacgcugauaucaauauggccuuccuugacagcuacuuuuccgagaaagcguaugcuuacgccgaugaggacgaaggccggcccgccaacgacugccuccugauuuaugaucaugagggagucggcagccccguggggucuaucggauguugcuccuggauuguugacgaucuggacgaaagcuguauggagacgcucgauccuaaguucagaacacuggcugaaaucugccuuaauaccgagauugagccguuucccucccaccaggccugcaucccuauuucuacagaccugccccuccugggcccuaacuacuucgugaaugaaagcuccgggcugacccccucugaggucgaguuccaggaagagauggcggcuagcgaaccuguggugcacggagauaucaucgucaccgagacauauggcaacgccgaccccuguguucaaccgacgaccauuaucuuugauccucagcuugcccccaaugugguggucacagaagcugugauggccccuguuuacgacauucagggcaacaucugcgugcccgcugagcucgccgauuauaauaacgucauuuacgcggaacgcgugcuggccuccccggggguuccugacaugucuaauagcuccaccacagagggauguaugggccccgugaugagcgggaacauccuggucggaccugagauccaggugaugcaaaugaugucucccgaccuccccauuggccagaccguuggguccacgagcccuaugacaucucggcauagagugacccgcuacuccaacauccacuauacccagcaauga

SEQ ID NO: 68567 - RNA, 6819 nt, Artificial Sequence
  derived and/or modified sequence opt5 from DSP__Homo_sapiens__NP_001008844
augagcugcaacggagggucccaccccagaaucaauacccugggacggaugauucgcgccgaaucuggcccugaccucagauacgaagugacaagcgggggaggcgggacgucccggauguauuacucucgcagaggagucaucaccgaucagaacagcgacggcuauugucaaacaggcaccaugucccggcaccagaaucagaacacaauucaggagcugcuucaaaauugcucugauugucugaugcgcgcugaacucaucguucagccggagcugaaguacggggacgggauucagcuuaccagaagccgggaacuggaugagugcuucgcccaggcgaacgaccaaauggagauccucgauucccugauccgcgaaaugagacagaugggccagcccugugacgcuuaucagaaacggcugcuccaacugcaggagcagaugcgcgcccuuuacaaggccauuagcgugccuagagugcggcgcgcuucuuccaaagggggaggcggguauacaugccaaagcggaucuggcugggaugaauuuaccaagcacgucacguccgagugucugggcuggaugagacagcagcgggccgagauggacaugguggcuuggggaguugaucucgccagcguggaacagcauaucaauucucacagaggcauucacaacuccaucggcgacuaccgcuggcaacuggauaaaauuaaggcggaccuucgggagaaaagcgccaucuaccagcuggaagaagaauaugagaaucuccugaaggcuuccuucgagagaauggaccaucugcgccagcuccagaacauuauccaagccaccucucgggaaaucauguggauuaaugauugcgaggaagaggaacugcuuuacgacuggagcgauaagaacacaaauaucgcucagaaacaggaggccuuuuccauuagaaugagccagcuggaggucaaggaaaaagagcucaacaagcugaagcaagaaucugaccagcuugugcugaaucagcaccccgcguccgauaaaaucgaggccuauauggacacccuccagacacaauggagcuggauucugcagaucaccaaguguaucgauguucaucugaaagaaaacgcugccuacuuccaguuuuucgaggaggcucaaucuacggaagccuaucucaaggggcugcaggacagcauucgcaaaaaguacccuugcgauaaaaacaugccccuucagcaucugcucgagcagaucaaggaacuggagaaggagcgggagaagauucuugaguauaagagacaagugcagaaucuggucaacaaauccaagaaaaucgugcagcucaagccucgcaauccggacuaccggucuaacaagcccauuauccugagagcccugugugauuacaaacaggaccaaaagaucgugcauaaaggagacgaaugcauucucaaggauaauaacgagcgcagcaaaugguaugucacaggcccugggggaguugacaugcuggugcccuccgugggccuuaucauuccucccccgaauccucuggcugucgaucucagcugcaagaucgaacaguacuaugaggcgauucuggcccuguggaaccagcuuuacaucaauaugaagucucucguguccuggcacuauuguaugauugacaucgagaaaauccgggcuaugaccauugccaagcugaaaacaaugagacaggaagauuacaugaagaccaucgccgaccuggagcuccacuaucaagaauuuauucggaacagccagggcucugagauguucggggaugacgauaaacgcaagauccagucccaauuuaccgacgcucagaagcauuaccagacacugguuauucagcuucccggauacccucaacaccagacggugaccacaaccgaaaucacacaucacggaaccugccaggaugucaaucauaacaaagugaucgagacgaauagagagaacgacaagcaggaaacauggaugcugauggagcuccagaaaauccggagacaaaucgaacacugugaggggcgcaugacccugaagaaucugccccuugccgaucagggaagcucccaccauauuaccguuaaaaucaacgaacucaagucugugcagaacgacagccaagcgauugcugagguccugaaucagcugaaagacaugcucgccaacuuccggggcuccgagaaguauugcuaccugcagaaugaaguguuugggcuuuuccagaagcuggagaacaucaauggcgucacagauggauaucucaacucucuguguaccgugagagcccugcuucaagcuauccuccagacagaagacaugcugaaaguuuacgaggcccgccugacggaggaagagaccgugugccucgaucuggacaaggucgaggcuuauagauguggccuuaaaaagauuaaaaaugaucugaaccucaaaaagagccugcuggccacaaugaaaaccgaacuucagaaggcgcaacagauccacucccagacaagccagcaauacccccucuaugaccuggaucuggggaaauuuggagaaaaggugacccagcucacggaccgguggcagcgcauugauaaacagaucgacuucagacugugggaucuugagaagcaaauuaagcagcugcggaauuaccgcgacaacuaccaggccuucugcaaauggcucuaugaugcuaagagacggcaggacucucuggaguccaugaaauuuggcgacagcaauaccguuaugcgcuuccugaacgaacaaaagaaucuucauucugagaucuccgggaaaagagauaagagcgaagaggugcagaagaucgccgaacugugugcuaacucuauuaaagacuacgagcuccagcuggccagcuauacauccggacucgagacccugcuuaauaucccuauuaagcggacaaugauccaaagcccgucuggcgucauucugcaggaagcggccgaugugcacgcucgcuacaucgagcuccugaccagauccggggacuauuaccgguuucugagcgaaaugcuuaaaucccuggaggaucucaagcugaaaaacacgaagauugaagugcucgaggaggaacugagacuugcccgcgacgcuaacucugagaauugcaacaaaaauaaguuccuggaucagaaccuccagaaguaucaagccgaauguagccaguuuaaagccaagcuggcuucccuggaggagcuuaaacggcaggcggaacuggacggcaagucugccaaacagaaucucgauaagugcuacggacaaaucaaggagcugaacgagaaaauuacaagacucaccuacgaaauugaagacgagaagcgccggagaaaaagcguugaggaucgcuucgaccagcagaagaaugacuaugaucagcugcaaaaagcucggcagugcgaaaaggagaaccuuggcuggcagaagcuggaauccgagaaagccaucaaggaaaaagaguacgagauugaaagacugcgcguccuccugcaggaggaagggacacggaagagagaguaugaaaaugagcuugccaaggcuucuaaccggauccaagagagcaagaaucaguguacccagguggugcaagaacgcgagucccugcucgucaagauuaaagugcuggaacaggacaaggccagacuccagcggcuggaggaugagcuuaaccgcgcgaaaagcacccuggaagcugagacaagaguuaagcagcggcuggaaugcgagaaacaacagauccagaaugaccucaaccaguggaagacgcaauacucuagaaaggaagaggccauccgcaaaauugaguccgaacgggaaaagagcgaaagagagaaaaauucucugcgcuccgaaaucgagcggcuucaggccgagauuaagagaaucgaagaacgcugucggagaaaacuggaagauagcacccgcgagacacagucucagcucgaaaccgagagaucccgguaucaacgcgagauugacaagcugagacagcggcccuacggaagccaccgcgaaacacagaccgagugcgaauggacgguggauacauccaaacucgucuuugacggccugagaaagaaggugaccgcuaugcaacuuuaugagugucagcugaucgauaaaaccacacuggacaagcuccugaaagggaagaaaagcguugaggaaguggccucugagauccagccuuuccuucggggagcgggcagcauugcuggggccuccgccucucccaaggaaaaguacagccuggucgaggcuaaaagaaagaaacucaucuccccugaaucuaccgugaugcugcucgaggcccaggcugccacaggcggaauuaucgauccccaucgcaacgagaagcugacgguugacagcgcgauugcccgggaucuuaucgacuuugacgauagacaacagauuuacgcugccgaaaaagcuaucaccggcuucgacgauccguuuuccgggaagacagugucugucagcgaggccaucaagaaaaaccugauugaccgcgaaaccggaaugcggcugcucgaggcccagaucgcuuccggcggggugguggauccugucaauagcguuuuccugcccaaggacguggcgcuugccagaggacugauugaucgggaccucuaucgcucucugaacgauccuagagacucccagaaaaauuuuguggaucccgucacaaagaaaaaggugagcuacguucaacugaaggaacggugccgcaucgagccucacaccggccuccuucugcugucugugcagaaaagauccaugagcuuccaggggauucggcagcccgucacggugaccgagcucguugacuccggcauccugcgcccgucuacagugaacgaacuugagagcggacaaaucuccuaugaugaagucggcgagagaauuaaggacuuccugcaggggagcucuuguaucgcuggaauuuacaaugaaaccacaaaacagaagcucggcaucuaugaggccaugaaaauugggcuggugcggccuggaaccgcccuggagcuccuugaagcucaagccgcgacaggcuuuaucguugaccccguguccaaccugcgccugcccgucgaggaggcuuacaagagaggccucguggggaucgaguucaaagagaagcugcuuagcgccgaacgggccgugaccggauauaaugauccugagacgggcaacauuaucucucuguuucaggcuaugaauaaggaacucauugagaaagggcauggaaucagacugcuggaagcccagauugcgacaggcgggaucauugacccgaaggagagccaccgccuccccgucgauaucgcuuacaaacggggauacuucaacgaggaacuuuccgagauccugucugacccuagcgaugacaccaagggcuuuuucgaucccaauaccgaagagaaccugacauaucuccagcugaaagaaagaugcauuaaggacgaggagaccggccuuugucugcucccucugaaggagaaaaagaaacaaguucagacgucccagaagaauacacugcgcaaacggagaguggugaucgucgaucccgagaccaacaaggaaaugucugugcaggaggccuacaagaaagggcucauugacuaugaaacauuuaaggagcuuugcgagcaagaaugugagugggaagagaucaccauuacaggaagcgauggcuccacccgcguugugcuggucgaccggaaaacggggagccaguacgacauccaggaugccaucgacaagggacugguggauagaaaauucuuugaccaguaucgcucuggcucccucagccugacccaauucgcugauaugauuucccuuaagaaugggguuggaacaucuagcuccaugggcucuggcgugagcgacgaugucuuuuccagcucucggcaugaguccgugagcaagaucucuaccauuuccagcgucagaaaccugacaauccgcucuagcuccuucucugacacccucgaagagagcuccccuauugccgcuaucuuugauacggaaaaucuggagaaaaucagcauuacagaagggaucgagcggggaauuguggacuccaucaccggccagagacugcucgaggcccaggcgugcacagggggaauuauccaccccaccaccggccagaaacuuucucugcaagaugccguuagccagggggugauugaccaggauauggcuacacgccugaaaccggcccaaaaggcuuucaucggauucgaaggcgucaaaggcaagaaaaagauguccgccgccgaggcugugaaggaaaaauggcucccuuacgaggcggggcagagauuucuggaguuccaguaucuuacgggaggccugguugaccccgaggugcacgggcggaucucuaccgaggaagccauucgcaagggauuuaucgacggcagagcugcccagcggcuccaagauacaagcuccuacgccaaaauucugaccugcccuaagacaaaacugaagaucucuuacaaggacgcuauuaacagaagcauggucgaggauaucaccgggcuccggcuucuggaagccgcguccgugagcucuaaaggacugcccuccccguauaacaugagcucugcuccuggcucccgcagcggcucuagauccgggagccgguccggaagccgcucuggcagcagauccgggucucggcgcggcagcuucgacgccacgggcaauuccucuuacagcuauuccuacucuuuuagcuccagcucuaucgggcauuga

SEQ ID NO: 68568 - RNA, 3906 nt, Artificial Sequence
  derived and/or modified sequence opt5 from DSPP__Homo_sapiens__NP_055023
augaagaucauuaccuacuucugcaucugggccguggcuugggccauucccgucccucagagcaaaccgcuggagagacacguugaaaaguccaugaaccuccaucugcuugcgcggucuaaugugagcgugcaagacgagcugaacgcuuccggcacaaucaaagaaucugggguccucgugcacgagggagaucgcggcagacaggaaaauacgcaggacgggcauaagggagagggcaacgggagcaaaugggccgagguuggaggcaaguccuuuucuaccuauagcacacuggccaaugaagagggcaacauugaaggguggaauggagauaccggcaaggcugagacauacgggcacgacggaauccauggcaaagaggaaaacaucaccgccaaugggauucagggacaaguguccaucauugauaacgcuggcgccacaaaucggagcaacaccaauggcaacacggacaagaauacccagaacggggaugucggagacgcgggccacaacgaggauguggccguugugcaggaagacgggccccaggucgcuggaucuaauaacuccacagauaaugaggacgaaaucauugagaacagcugucgcaaugagggcaacaccucugaaaucacaccucaaauuaauuccaaaagaaacgggaccaaggaggccgaagugacgcccggaacaggcgaggaugcuggccuugacaauagcgacgggucuccuuccggaaacggcgccgaugaagacgaggaugaggggagcggagacgaugaagacgaggaagcgggcaaugggaaagauuccucuaacaauagcaagggccaggagggacaggaccacggcaaggaagaugaccaugauuccagcaucgggcagaacucugacuccaaagaguauuacgaccccgagggaaaggaagauccucacaaugagguggacggcgauaaaaccagcaagucugaagagaacagcgccgggaucccggaggacaacggaucccaacggauugaagauacacagaaacugaaucaucgcgagucuaagagagucgaaaaccggaucaccaaagagagcgaaacccacgcuguuggcaagucccaggacaaggggauugagaucaaaggccccagcucuggaaaucgcaacauuacaaaggaggugggcaaagggaaugaaggaaaggaggauaaaggccaacacgggaugauccucggaaagggcaacgugaagacgcagggggaagucgugaauaucgagggcccuggacagaaauccgaacccggcaacaagguugggcauagcaauaccggaucugacuccaacagcgauggcuaugacuccuacgauuucgacgauaaaucuaugcagggggacgacccuaauagcuccgaugagucuaacggaaaugacgaugccaacagcgaguccgacaauaacucuagcuccagaggcgaugcuagcuauaacucugacgaauccaaggauaaugggaacggcagcgacucuaaaggagccgaggaugacgauagcgacuccacaagcgauaccaauaacucugacuccaauggcaacgggaauaacggaaaugacgauaacgacaagagcgauuccggcaaggggaaaucugacagcuccgauucugacagcuccgauucuagcaauuccagcgacucuuccgauagcucugacuccgauagcucugacuccaacagcuccagcgacucugauagcuccgacucugauagcuccgacucuagcgauuccgacucuagcgauuccagcaauucuuccgacagcucugauuccagcgacuccucugauagcuccgacagcucugauuccagcgacucuaagagcgacuccucuaaaagcgaauccgauucuagcgacuccgauagcaagucugacuccagcgauuccaacucuagcgacuccucugauaauagcgacuccagcgauucuuccaacagcucuaacuccagcgacucuagcgauuccucugacagcuccgauagcuccucuagcuccgacucuagcaauuccucugacagcuccgauagcucugacuccagcaacucuuccgagagcucugauuccagcgacuccagcgauucugacagcuccgauucuagcgacuccucuaauagcaacuccucugauagcgacuccagcaauucuuccgauagcucugacuccagcaacuccucugacagcuccgauagcucugacuccagcaauucuagcgauuccucugacagcuccgauucuagcaacuccagcgacucuuccgauagcuccgacucuagcgauuccucugacagcuccaauagcucugauuccaacgacagcucuaauuccagcgauucuuccgacagcucuaacagcuccgacagcuccaauucuagcgauuccucugacagcuccgauucuagcgacuccgauagcucuaacuccagcgacucuuccaauagcucugauuccagcgacucuuccaacagcagcgauuccucugacagcuccgauucuagcgacggauccgacucugauagcuccaaucggagcgacucuuccaacagcucugauuccagcgacuccucugauagcuccaacucuagcgacuccagcgauucuuccgacagcaaugaaucuagcaacuccucugauagcuccgacagcucuaauuccagcgauuccgacucuagcgauuccucuaacagcuccgacucuagcgacuccagcaauucuuccgauagcucugaguccagcaacucuagcgacaauuccaacagcuccgauucuagcaauuccucugacagcuccgauucuagcgacuccagcaacucuuccgauagcucuaauuccagcgacucuuccaacagcucugauuccagcgacuccaauagcucugauagcuccgacucuagcaacuccucugauagcuccgacagcucugacuccagcgauucuuccgacagcucugauuccagcaauuccucugacagcuccgauagcucugacuccagcgauucuagcaacuccucugacagcuccaacagcucugauuccagcaauucuuccgacagcuccgauucuagcgacuccucugacagcuccgauagcucugacuccagcgauucuuccgacagcucuaacuccagcgauagcuccgacucuagcgauuccucugacagcuccgauucuagcgacuccucugauagcuccgacagcucugaguccagcgauucuuccgacagcucuaauuccagcgacuccagcgauucuagcgacuccucugauagcuccgacucuagcgauuccucugacagcuccgauagcucugacuccagcaacucuuccgauagcuccgacucuagcgauuccagcgacucuuccgauagcucuaauuccagcgacucuagcgacuccucugaaagcuccgauagcucugacuccagcgauuccucugacagcuccgauucuagcgacuccagcgauucuuccgacagcucugauuccagcaacucuuccgacagcucugauagcuccgacagcuccgacucuagcgauuccucugacagcuccgauucuagcgacuccagcgauucuuccgacagcucugauuccagcgacucuuccgauagcuccgacagcucugauuccagcgacucuagcgauuccaaugagucuagcgacuccucugacagcuccgauagcucugacuccagcaacucuuccgauagcuccgacucuagcgauuccagcgacucuacauccgauagcaaugacgaaucugauucccaaagcaaaucuggcaacggcaauaacaaugggagcgacuccgauucugacagcgagggauccgauagcaaccacucuaccuccgacgacuga

SEQ ID NO: 68569 - RNA, 7950 nt, Artificial Sequence
  derived and/or modified sequence opt5 from DST__Homo_sapiens__NP_001714
augcacagcuccucuuacagcuauagauccucugacagcguguucuccaacaccacaucuacgcggaccagccuggauuccaaugagaaccuccugcuuguccauugcggccccacacugaucaauagcuguauuucuuuuggguccgagagcuucgacggacaccgccucgagaugcugcagcaaaucgccaacagaguucagcgggauucugugauuugcgaagacaaacuuauccuggcuggcaaugcccuccaguccgauagcaagcgccuggagucuggggugcaguuucaaaacgaagcggagauugcuggauacauccuggagugugaaaaucuccugagacagcaugucaucgacgugcagauucuuaucgauggcaaguauuaccaggccgaccaacugguucagcggguggccaaacuccgcgaugagauuauggcucugagaaacgaaugcuccagcgucuauuccaaggggcggauccuuaccacagagcagaccaagcugaugauuucuggaaucacacagagccucaauuccggcuucgcccaaacccugcacccuagccugacgucuggccucacccagucccugacacccagccuuaccucuagcuccaugacaucugggcugagcuccggaaugaccagccgccucacgcccucugugaccccugcuuacacacccggcuuuccuuccgggcugguucccaacuucagcucuggaguggagccuaauucccuucagacacugaagcucaugcaaauuagaaagccgcugcugaaaagcucccuccuggaccagaaccuuaccgaagaggaaaucaauaugaaguuuguccaggaucugcucaacuggguggacgagaugcagguccaacuggaucggaccgaauggggcucugaccuucccagcgucgagucccaucuggagaaucacaagaacguucaccgcgccaucgaagaguucgaaucuagccucaaggaggcgaaaauuuccgaaauccagaugacagccccucugaagcugacguaugcugagaagcuccauagacuggagagccaguacgccaaacuucugaacaccucucggaaucaggaacgccaccucgacacacugcauaacuuuguguccagagcuaccaaugagcugauuuggcuuaacgaaaaggaggaagaggagguggccuacgauuggagcgaacggaauacaaacaucgcgcgcaagaaggacuaucacgccgagcucaugcgcgaacuggaucaaaaagaggagaauauuaagucuguccaggaaaucgcugagcagcugcuccuggaaaaccaccccgcccggcuuaccaucgaggcuuacagagccgccaugcagacgcaaugguccuggauucugcagcucugucagugcguggaacagcauaucaaagagaauacagcuuauuucgaguuuuucaacgacgcgaaggaagccaccgauuaccugcgcaaucugaaggacgcuauucaacggaaauauagcugugauagaucuagcuccauccacaaacuugaggaccucguucaggaaagcauggaggaaaaagaggagcugcugcaguacaagucuaccauugccaaccucauggggaaagccaagacaaucauccaacugaagccucgcaauuccgauugcccccuuaaaaccagcauuccgaucaaggcuauuugugacuaucggcagaucgaaauuacaaucuacaaagaugacgagugcgugcuggccaacaauucccauagagcgaaguggaaagucauuucuccuacgggaaacgaagcuauggugcccagcguuuguuuuaccgugccuccgcccaacaaggaggccgucgaccucgccaaucgcaucgaacagcaguaccaaaacgugcugacacuguggcacgagucccauaucaauaugaagucugucgugagcuggcacuaucuuauuaacgagaucgaucggauuagagcuuccaauguugccucuaucaaaaccaugcucccuggcgaacaccaacaggugcugagcaaccugcagucccgcuucgaggacuuccucgaagauagccaggagucucaggucuuuuccggcagcgacauuacacagcuggagaaggaagugaauguuugcaaacaguacuaucaagagcuucugaagucugcugaacgggaggaacaggaggaguccguguacaaccucuauaucagcgaagucagaaauauccggcugcgccuggagaacugcgaagauagacuuauucggcagaucagaaccccgcucgagcgcgacgaucugcaugaaucuguguuccggauuacggagcaagagaaacugaagaaggaacucgagagacugaaagacgaucuugggaccaucacaaauaagugugaagaguuuuucucccaggccgcggccagcuccagcgugcccacccugcgcucugaacucaacguuguccugcagaauaugaaccagguguacagcauguccucuacauauauugacaaacugaagaccgugaaucuuguccugaaaaacacgcaagcugccgaggcucucgugaagcuguacgagacaaaacucugcgaagaggaagccguuaucgcggauaagaacaauaucgagaaccugauuagcacccuuaagcaguggagauccgagguggacgaaaaacggcaggucuuucacgcccuggaggaugaacuccagaaggcuaaagccaucucugacgagauguucaagacauacaaagaacgcgaccuggauuuugacuggcauaaggagaaggcugaucaacugguggagagauggcagaauguucacgugcagauugacaaccggcuucgcgaucuggaaggaaucggcaaaagccucaaguauuacagagacaccuaucacccucuggaugacuggauucagcaagucgagaccacacagcggaaaauccaggaaaaucagcccgagaacuccaagacgcucgccacccaacugaaucagcagaaaaugcuugugucugaaaucgagaugaagcaaagcaagauggaugagugucagaaauacgccgaacaguauuccgcuacaguuaaggacuacgagcugcagaccaugacauaucgcgcgaugguggauagccaacagaaaucuccugucaagagacggcgcaugcaguccagcgccgaccucauuauccaggaguucauggaucugagaacccgguacacggcucuggugacacuuaugacccaauacauuaaauuugccggggacucucugaagagacucgaggaagaggagaucaagcgcugcaaagaaaccuccgagcauggagccuauagcgaccugcuccagcggcagaaggcuacagugcuggaaaacuccaaacuuaccggcaagauuucugagcuggagagaauggucgccgaacugaaaaagcagaaaagccgcguugaggaagaacuccccaaggugcgggaagcggcugagaaugagcugagaaagcaacagcgcaacguggaagauaucucccuucagaaaauucgggccgagagcgaagccaagcaauacagacgcgagcuggaaacaaucguccgggagaaagaggcugccgaaagagagcucgaacgggugcgccagcugacgaucgaggcggaagcuaagagagccgccguugaggagaaucuccugaacuuccggaaucagcuugaagagaacaccuuuacacgcagaacccuggaagaccaccugaaacggaaggaucucucucugaaugaccuugagcagcaaaagaacaaacugauggaggaacucagacgcaagcgggauaacgaggaagaacugcucaaacugauuaagcagauggaaaaagaccuugcuuuccagaaacagguggccgagaagcaacugaaagagaagcagaaaaucgaacuggaggcuagacgcaagauuacagaaauccaguauaccugucgggagaaugcccucccggucugcccuauuacgcaggcgaccuccuguagagccgugacagggcugcaacaggaacaugauaaacagaaggcugaggagcuuaagcagcaaguugacgaacugaccgccgcuaaccgcaaagccgagcaggauaugcgggaacucacauacgagcugaaugcccuccagcuggaaaagaccagcucugaggagaaagcuagacuucugaaggacaaacuggaugaaacaaacaauacccuccgcugccugaaacuugagcuggaaagaaaggaccaagcggagaaaggauauagccagcagcuccgggagcugggccgccagcugaaccaaacgacaggcaaggccgaagaggcuaugcaggaagccuccgaccucaaaaagaucaaaagaaauuaccagcuugagcuggaaucucugaaccacgagaaggggaaacuccagcgggagguggaucgcaucaccagagcccaugcugucgccgaaaagaauauucaacaccugaacagccagauccacuccuuucgggacgagaaggaacuugagagacugcagauuugucagcgcaaaucugaucaucucaaggaacaauucgagaaaagccacgagcagcugcugcagaauaucaaggcggaaaaagagaacaaugacaagauucaacggcucaacgaagaacuugaaaaguccaaugagugcgcugagaugcugaaacagaagguggaagaacugaccagacagaacaaugaaacaaaacucaugaugcagcgcauccaagccgagagcgagaacaucguucuggaaaagcagaccauucagcagcggugugaggcccuuaaaauccaagcugauggauucaaggaccagcugagaucuacgaacgaacaucuccacaagcagacaaaaaccgagcaggauuuucaacggaagauuaaaugccuggaagaggaccuggccaagucccagaaucucgugagcgaguucaaacagaagugcgaucaacagaacaucauuauccagaauacaaagaaagaaguccgcaaccuuaaugcggagcugaacgcuuccaaggaagagaaaagacggggcgaacagaaggugcaacugcagcaggcccaggugcaagagcucaauaaccgccugaaaaagguccaggacgagcuucaucugaaaaccauugaggaacagaugacacacagaaagaugguucucuuucaggaagagucugggaaguucaaacaaagcgccgaagaguuucggaagaaaauggagaagcugauggaauccaaagugaucaccgagaaugauaucucuggaauuagacuggacuucgugagccuccagcaggaaaacuccagagcucaggagaaugccaaacuuugugagacgaacaucaaggaacuggagcggcaacugcagcaguaucgcgaacaaaugcagcagggccagcacauggaggcuaaucauuaccaaaaaugccagaagcucgaagaugagcugauugcccagaaaagagaggucgaaaaccuuaagcagaaaauggaccaacagaucaaggagcacgaacaucagcuggugcuccugcagugugagauucaaaagaaaagcaccgcgaaggacugcacauuuaaacccgauuucgaaaugaccguuaaggagugucagcacucuggggagcuguccagccggaauacaggccaccuccauccuacccccagaucuccucuucugcgcuggacgcaggaaccccaaccgcuggaggaaaaauggcagcaccggguggucgagcagaucccuaaggaagugcaguuucaaccgcccggagccccucucgagaaggagaaaucccagcagugcuacagcgaauauuucucucagacaagcaccgagcugcaaaucacauuugacgaaaccaacccgauuaccagacuuuccgagaucgagaagauucgcgaucaggcucugaacaauucucggcccccuguuagauaccaggacaacgccugugaaauggagcucgugaaaguccugacaccccuggaaaucgcuaagaauaaacaguaugauaugcauacggaggugaccacacucaagcaagaaaagaacccuguccccagcgccgaggaguggaugcuugaaggcugccgcgccuccgggggacugaagaagggcgacuuccugaaaaaggggcucgagccugaaaccuuucagaauuucgauggagaccacgcuuguagcgugcgggaugacgaguucaaauuucagggccugagacauacaguuaccgcgcgccagcuuguggaagccaagcugcucgauaugcggacgauugagcaacugagacuggggcucaaaacagucgaggaagugcagaagacccuuaacaaguuccugaccaaagcuacauccaucgccggccuguaccucgagucuaccaaggagaagaucagcuuugccuccgcugccgagcgcauuaucauugacaagaugguugcgcuggcuuuccuugaagcccaggccgcuacaggauuuaucauugaucccaucucuggccaaacguauagcguggaggacgccguccugaaaggggugguggacccggaguuccggauuagacuccuggaagcggagaaggccgcuguuggauacuccuauucuagcaagacccuguccgucuuucaggccauggaaaaucgcaugcucgauagacagaaaggcaagcacauccuugaggcucagaucgccagcgggggagugauugacccugugcggggcauccgcgugcccccugagauugcucugcaacaggggcugcucaacaaugccauccugcaguuccuucacgaacccucuuccaacacaagaguguuuccgaauccuaacaauaaacaggcgcuguacuacagcgagcuccugcggaugugcguuuucgauguggaaucucaauguuuucuguuccccuucggcgagagaaacauuuccaaucucaacgucaagaaaacccaucggaucagcgugguugacacaaagaccggaucugaacuuacgguguaugaggccuuucagcgcaaccugaucgagaaguccauuuaccuggaacucagcggccagcaguaucaauggaaagaggcuauguucuuugaauccuacgggcacagcucucauaugcugaccgauacaaagaccggacuucacuucaauaucaacgaggccauugaacagggcacaaucgacaaagcucuggucaagaaauaucaggaggggcucauuacccugacagagcuggccgauagccuccuguccagacuugugccuaagaaggaccugcacucucccguugccggauacuggcucacggcuagcggcgaacggaucuccgugcugaaagcgucucgcagaaaucuugucgaucggaucaccgcccugcgcugccucgaggcucaagugagcacagggggcauuaucgacccccugaccggaaagaaauauagaguggccgaagcccugcaucggggccucgucgaugagggguuugcucagcagcugcgccagugcgaacuuguuauuaccggaaucggccacccuauuacaaacaagaugauguccgugguggaggccgucaaugcgaacaucauuaauaaagagauggggaucagaugucuggaguuccaauaccucacgggaggccugaucgagccccaggugcauucucggcuuagcauugaagaggcccugcagguuggcaucauugacgugcucaucgcuaccaagcugaaagaccagaaguccuacguccgcaacauuaucugcccccaaacaaagagaaaacugaccuauaaggaggcccucgaaaaagcugauuuugacuuccacacagggcugaaacuucuggaggugagcgaaccucucaugaccggaaucucuucccuguacuauagcucuuga

SEQ ID NO: 68570 - RNA, 498 nt, Artificial Sequence
  derived and/or modified sequence opt5 from DSTN__Homo_sapiens__XP_011527445
auggccagcggcgugcaggucgcugacgagguuugcagaaucuucuacgauaugaaggugcggaaauguuccacccccgaagagauuaagaaacgcaagaaagccgugaucuuuugccugucugcggacaagaaguguauuaucgucgaagaggggaaagaaauucucgugggagauguuggcgugacaaucacggacccuuucaagcacuuugucgggaugcugccggagaaagauugcagauaugcucuuuacgacgccagcuucgagaccaaggaaucccggaaagaggaacugauguuuuuccucugggcccccgagcuggcuccucuuaagucuaagaugaucuaugccagcuccaaagaugcuauuaagaaaaaguuucaaggaaucaaacaugagugucaggccaacggccccgaagaccugaaucgcgcgugcauugccgagaagcucgggggaucucugaucguggcuuucgaaggcuguccuguuuga

SEQ ID NO: 68571 - RNA, 2790 nt, Artificial Sequence
  derived and/or modified sequence opt5 from DSTYK__Homo_sapiens__NP_056190
auggagggcgacggggugcccuggggaagcgaaccugucuccggcccggggcccggaggcgggggaaugaucagagagcugugccggggcuucggccgcuacagacgguaucucgggcgccugagacagaaccuucgggaaacccaaaaguuuuuccgcgauauuaaauguucucacaaucauacaugccugagcucccucacgggaggcgggggagccgagagaggcccugcuggggacguugccgaaaccggacugcaggcgggccagcuuucuuguaucagcuuucccccuaaggaggagaaauaccugcagcaaauuguggauugccuccccuguauccugauucugggccaggacugcaacgugaagugucagcuccugaaucuucugcucgggguccaggugcugccuacaaccaaacuuggauccgaagagucuugcaagcugcggcgccucagauucacauauggcacccaaacacggguuagccuggcucugccggggcaguacgaacucgugcacacccuggucgcccaucagggaaacugggagacgauccccgaggaagaucuugaggugcaggaaaauaacgaggacgccgcucacguucuggccgaacucgaggugaccaugcaucacgcucugcuucaagaggucgaugugguggucgccccuugucagggccugcgccccacaguugacgugcucggggaucuggugaaugacuuucugccugucaucaccuaugcgcuccacaaggaugaacuguccgagagagacgaacaggagcuucaagaaauucggaaauacuucagcuuucccguguucuuuuucaagguuccgaaacugggaucugagaucauugauuccagcacacgcagaauggagucugaacgguccccucucuauagacagcugaucgaccuuggcuaccugucuagcucccauuggaacugcggcgcccccgggcaggacaccaaggcucagagcaugcucguggagcaauccgaaaaacugcgccaccugucuacguuuagccaucagguccuccagacacggcugguggaugccgcuaaggcccuuaaucugguucacugucacugccucgacauuuucaucaaccaggcguuugauaugcaaagagaccugcagauuaccccuaagcgccuggaguacacacggaaaaaggaaaaugagcuuuaugagucccucaugaacaucgccaauagaaaacaggaagagaugaaggauaugaucguggaaacccugaacaccaugaaagaggagcugcucgacgaugcuacaaauauggaguucaaggacgucauugugcccgaaaacggagaacccgucggcacgcgcgagaucaaaugcuguauucggcagauccaagaacugauuaucagcagacuuaaccaggccguggcuaauaagcugaucucuuccguugauuaccuccgcgagagcuucguggggacccuggagcggugccugcagucucuugaaaagagccaggacgucuccgugcauauuacaucuaacuaucucaaacaaauccugaaugccgccuaccacguugaggugaccuuucauagcggauccagcgucacaagaaugcugugggaacagauuaagcagaucauucaacgcaucaccugggugucuccuccggcuaucacgcucgaguggaaacggaagguggcgcaggaagccauugagucccugagcgcuucuaaacuugccaaguccaucuguagccaguucagaacacggcugaacuccucucacgaggccuuugcugccagccuccgccagcuggaagcgggccauuccgggagacuggagaagaccgaagaucuuuggcuccggguuagaaaagaccacgcuccccgccuggcccggcugucucucgagagcugcucccugcaagacguccuucugcacagaaagccuaaacucggccaggaacugggacgcggccaguauggggugguguaccugugugauaauuggggaggccauuuccccugcgcccuuaagagcgucgugccucccgacgagaaacacuggaacgaucucgcucuggaguuucauuauaugagaucucugccgaagcacgaacggcucguugaccugcacggguccgugauugauuacaauuacggaggcgggagcucuaucgccguccuucugauuauggagcgccuccauagagaccuguauaccggccugaaggcuggacuuacacuggaaacccggcuccagaucgcccuggaugugguugagggcauucgcuuccuccacucccaagggcuggugcauagagacaucaaacuuaagaacguccugcucgauaaacagaaucgggcgaagaucacagaccugggauuuuguaaaccugaggccaugaugagcggcucuauuguggggacgcccauccacauggcuccugaacuguucaccggaaaguacgauaacagcguugacguguaugccuuuggcauucuuuucugguacaucugcuccgggagcgucaagcugcccgaggcuuuugaacgcugugccucuaaagaucaucucuggaauaacgugagacggggcgcgcgcccugagagacugcccguguucgacgaagagugcuggcagcucauggaggccuguugggacggagauccgcugaagcggccucuucugggcauuguccagcccaugcuccaagggaucaugaauagacugugcaaauccaacagcgaacagcccaaucgcggacuggacgauuccacauga

SEQ ID NO: 68572 - RNA, 630 nt, Artificial Sequence
  derived and/or modified sequence opt5 from DTD1__Homo_sapiens__NP_543010
augaaggccgugguccagagaguuacccgggcuagcgugacagugggcggggagcaaaucuccgccauuggacgcggcaucugcguccugcucgggauuucucuggaagacacgcagaaagagcuugaacacauggugagaaagauccugaaccuccggguuuucgaggaugaaagcggaaaacauugguccaagucugugauggacaaacaguacgagauucugugugucagccaguuuacccuucaaugcgugcugaagggcaauaagcccgauuuccaccucgcgaugccuacagagcaggcugaaggguuuuauaacuccuuccuggagcagcugcgcaaaaccuacagaccggaacucaucaaggacggaaaauuuggcgccuauaugcagguucauauccaaaaugauggccccgugacaauugagcuggagucuccugcccccgggaccgcuacaagcgacccuaagcagcuuuccaaacuggaaaagcagcagcaacggaaggagaaaacccgcgccaagggacccagcgaaucuuccaaagagagaaacacgccucggaaggaagaucgcagcgcuucuuccggcgccgagggggacgucagcucugagagagaaccguga

SEQ ID NO: 68573 - RNA, 1851 nt, Artificial Sequence
  derived and/or modified sequence opt5 from DTHD1__Homo_sapiens__NP_001130008
augugccuggagaagagauaccucgacgugcugagcgaugucaccggcccccagguuuccuguuauaucacagccccuucuuacgugcuucaacagcuggaaugccggauuaucaaccacaugagcucccucauugugggggacaaugaggaacuggucucuaacgugaucacgauugaguguagcgauaaagaaaagcgcguuccguuccccaucggaaucgcuauuccuuuuaccgccagauaucggggcaauuaccgcgacaucauggugaaagucugcgauauuaaccuucaguccucuuaucugaaucccaacagccucgaggggaugaagggaggcuacaaagggacaugugcguccgugaagguuuauaagcugggaaucuucagcguggucucuugccugaaaaaggaguccuuuaccgugacaaagaagggccucgcucugaaaagcucuauggacuccagaauuagccuuaauuacccucccggcguguucaccucuccuguccugguucagcucaagauccaaccgguggaucccgcccugguggcccaccuuaaggcucagcaggacacauuuuacuccguccagagcaccuccccucugauucacauccaacaucccucuacguauccuuuccagaaacccgugacccucuuucugccguguagcccuuaccuggauaagaacaaucucggguccgaaaucgaccacaaacggcgcgccagcgcuacaauuaacagaaucacccccucuuauuucaaucggacaaagauugccuccauccgcaaaccuagaaagaacgcgagcgagugccugaaacuucugggauuucggucucaggauagcggcuggugugggcucgacgauguugugaagaccauucaguccggacuggucucuguggaacuuuacgagcaucuggagcgcuucaucguucuccaccugagcuccacgauggacaauagccaccuggugacauuugucaagucucucgaagaggccaugcuguccaccacagcuugcaucgugcuuagccaucaaaaagacaacccccacagaauugccguccuggugguucccucuaaggaucucucccaggugcugaaagaccuucaucuggaaggcuucgggggaccuccggagcccagccggcacuuucagguccgcgaaggcgagcaacuccugcugagauucaccggcaauaucuucgcuuccucuaacgggaaggauuauggaaaagacuacacccucauuuuucaucugcagcggaagccuagacuugagcugcagaucaaggaaguggaugaguucggcaacuauagcuguccccacuacaaagggacaauuguuguguacaaggucccuaaaggaaagaucgugcccaaucucaaccagucccuggugaucaaugaaaaccacucucaacugccgauuugcaaacuuccucucaagcugcccaagcauaaaaagcugaucaaucgcccucagagcacgaaacggguuuccaaggaccccgucgaggcccucugggauaaccugcuucacuggcuggcggaagaacucagcgaggaaaaugccgagucucuguccagcacccugccucuuagacgcucuacaauucagcucaucaaacugaagaaccccgacgaucugaccgaacagauucaugaguuucucugcuucuggaagaaaucccugccgacauuuaccgacaaacuucggcugcucgcuagacaucugcgcaaaaucggccggagcgaucuggccgaggagcuuaaguucaaaugggagaauaagguguuuacggaaccucaacaguguuucgacguggcucccgaguga

SEQ ID NO: 68574 - RNA, 1380 nt, Artificial Sequence
  derived and/or modified sequence opt5 from DTL__Homo_sapiens__NP_001273158
augggcuacagcucccugauccucgacucuaccgggagcacacuguucgccaacugcacggaugacaauauuuauauguuuaacaugaccggacuuaagacaucccccguggcuaucuucaauggccaccagaacucuaccuuuuacgucaaaagcucccugucuccugaugaccaauuccucguuagcggguccagcgaugaggccgcguauauuuggaaggugucuacaccguggcagcccccuaccgugcugcuuggacauucccaggaagucacaagcguguguuggugccccucugacuuuaccaaaaucgcuacguguuccgaugacaauacccugaagauuuggagacucaaccggggccuggaggaaaaaccugggggagauaagcugagcacaguuggcugggccucucagaagaaaaaggagucccgccccggccucgugaccgucacaagcucccaaucuaccccugccaaagcuccgagagugaagugcaaucccagcaacuccagcccuucuuccgccgcuugugcccccagcugcgcgggggaccugccucuucccucuaauacgccgacauucagcaucaaaaccuccccugccaaggcucggucucccaucaaccgcagaggaagcguuuccagcgugucuccuaagccucccuccagcuuuaaaaugucuauucggaauugggucacacgcacccccuccagcuccccgcccaucaccccucccgccucugaaacaaagauuaugagcccuagaaaagcucugauccccgugucccagaagucuagccaggccgaggcguguuccgagagccggaaccgcgugaaaagacggcucgauucuuccugccuggaaagcgucaagcagaaauguguuaagucuugcaauugugugacggagcuugacggccaaguggaaaaccugcaccucgaucugugcugccuggccgggaaucaggaggaccucuccaaggacagccugggaccgaccaaaucuagcaagauugagggcgcugggacauccaucagcgaaccucccucuccuauuucccccuacgccagcgaguccuguggaacccuuccucugccccuccgcccgugcggcgaaggcucugagauggucgggaaagaaaacagcuccccugagaacaagaauuggcugcuugcuauggccgccaaaagaaaggcugagaaccccucuccccggagcccuuccucucagacaccgaauagccgcagacaguccggaaagacccugcccagcccugugacgaucacacccucuuccaugcggaaaaucuguaccuauuuccauagaaagagccaagaagauuuuugcggcccugagcacucuaccgaacucuga

SEQ ID NO: 68575 - RNA, 1116 nt, Artificial Sequence
  derived and/or modified sequence opt5 from DTNA__Homo_sapiens__NP_001121647
augaucgaggacagcggcaagagagggaacaccauggccgaacggcgccagcuguucgcugagaugagagcccaagaucucgaccggauucgccuguccacauacagaacggcgugcaaacuucgguuugugcagaagaaauguaaucugcaccucgucgauaucuggaacguuauugaagcucugcgcgagaaugcccuuaacaaucuggaccccaacaccgaacucaaugugucuagacuggaggccgugcugagcacaaucuucuaucagcucaacaagcggaugccuaccacacaucagauucacgucgagcaauccaucucucugcuucugaauuuucuccuggcugccuucgauccggaaggacauggcaaaaucagcguguuugcuguuaagauggcccuugcgacccugugcgggggaaagauuauggacaaacuccgcuacaucuucuccaugauuucugauagcuccggcgugauggucuaugggagauacgaccaguuucugcgggaggugcugaagcuccccacagccguuuucgaaggaccuagcuuuggcuauaccgagcagucugcucgcuccuguuucagccagcagaaaaaggugacgcugaacggcuuucuugauacccugaugucugaucccccuccccaaugccucgucuggcugccucuucugcacagacucgccaauguggagaacguguuccauccggucgaauguuccuacugccacagcgagucuaugaugggguuucgguaucgcugucagcagugccacaauuaccaacugugucaggacugcuucuggagaggacaugcuggcgggucccacagcaaccagcaucaaaugaaagaauacacauccuggaagucucccgccaagaaacugaccaaugcgcucagcaagucccugagcugugccucuucccgggagccucuucaccccauguucccugaccagcccgaaaaaccgcugaaccucgcucacaucguuccucccagaccugugacaagcaugaacgauacccuguuuucucauagcgugcccuccucuggaagccccuucauuacgcgcuccagcgacggcgccuuugggggaugcgucuga

SEQ ID NO: 68576 - RNA, 1863 nt, Artificial Sequence
  derived and/or modified sequence opt5 from DTNB__Homo_sapiens__NP_001243232
augaucgaggaaagcggcaacaagagaaaaaccauggccgagaagcggcagcuguucauugaaaugcgcgcucaaaauuuugacgugaucagacucuccacauaccggacggccugcaaacugcgcuucguccagaagagauguaaccuucaccugguugauauuuggaauaugaucgaggcguuucgggacaacgggcucaauacccuggaucauacaaccgaaauuucugugagccgccuugagacagugaucuccucuaucuauuaccagcugaacaaaagacuccccagcacccaccagauuuccgucgagcaaucuaucagccugcugcucaauuucaugauugcugccuaugacuccgaaggacggggcaagcugacaguguuuagcguuaaggccaugcuugcuaccaugugcgggggaaaaaugcuggauaagcuccgcuacguguucucucagauguccgacagcaacggccugaugaucuuuucuaaauucgaucaguuucuuaaggagguccugaaacucccuacggccguguucgaagggccguccuuuggauauaccgagcauagcguuagaacauguuucccccagcaacggaagauuaugcugaauauguuucuggacaccaugauggcugauccucccccucagugccucguguggcugccccuuaugcaccgccuggcccaugucgagaacguguuccacccuguggaauguucuuacugcagaugugaguccaugaugggcuuccgguaucgcugccagcagugucacaauuaccaacucugccagaacuguuuuuggagaggccaugccgggggaccgcacagcaaucagcaucaaaugaaggaacacuccucuuggaaaagccccgcgaagaaacugucccacgcuaucagcaagucucuuggcugcgucccuacacgggagcccccucaucccguuuucccggaacagccugagaaaccccuggaccucgcccacauugugccucccagaccccugaccaacaugaaugauacgauggugucccauaugagcucuggggucccuacaccgaccaagcgccugcaguacagccaggacauccccucccaccucgcugaugagcaugcccugaucgcgucuuauguggcccggcuucaacacugcgcuagaguucuggacagcccuucccgccucgacgaggaacaccggcugauugccagauacgcugcccgccuugccgcugaagcgggaaacgugacacggcccccuaccgaucugagcuuuaacuucgacgccaauaaacagcagagacagcucaucgcugagcuggaaaacaagaaucgcgagauucugcaagagauccagcggcucagacuggaacaugagcaggccucucagcccaccccggaaaaggcccaacagaacccuacacuucuggcugagcuccgccugcugcggcagagaaaagaugaacuugagcagcggauguccgcccuccaagagagccgcagagaacugaugguccagcuggaggaacucaugaagcugcuuaaagcgcaggcuacgggcucuccccacaccuccccuacacaugggggaggccggcccaugccuaugcccgugagaagcaccuccgccggcucuacaccgacccacuguccucaagacagccuguccgggguuggaggcgaugugcaggaggccuuugcucaggggacgcgccggaaucucagaaacgaccugcuggucgccgcugauucuauuacaaauaccaugagcucccuugugaaggagcuccacagcgccgaagagggagcggaagaggaagaggagaaaaugcagaacggcaaggaccgcggguga

SEQ ID NO: 68577 - RNA, 813 nt, Artificial Sequence
  derived and/or modified sequence opt5 from DTNBP1__Homo_sapiens__NP_001258596
augcugagcgcccacugggagaagaaaaagaccucccucguggaacugcaggagcaacuucagcagcugcccgcucucaucgccgaccuggaaucuaugacagcgaaccuuacgcaucuggaggcuagcuucgaagaggucgagaauaaccuccugcaccuggaagaucucugcggccagugugagcuggaaagaugcaaacauaugcaaucccagcagcuugagaauuacaagaaaaacaagcggaaggagcuggaaaccuuuaaagccgagcucgacgccgaacacgcucagaagguucuggagauggaacauacacaacagaugaaacuuaaggagcgccagaaauucuuugaggaagccuuccagcaagauauggagcaguaucugucuaccggguaccuccagauugcugaaagacgggagccuaucggaagcauguccucuauggaagugaauguggacaugcuggagcaaauggaucugauggacauuagcgaucaggaggcccucgacgucuuucugaacuccggcggggaagagaauacagugcuuagcccggcgcugggacccgaaucuuccaccugucagaacgagaucacacuccagguuccuaaucccagcgaacugcgcgccaagccucccucuuccagcucuaccugcacggauuccgcuaccagagacauuagcgagggcggggaguccccugugguccaaucugaugaagaggaagugcagguugacacagcccuugcuaccagccacacagaucgggaggccaccccggacggaggcgaggacuccgauagcuga

SEQ ID NO: 68578 - RNA, 1863 nt, Artificial Sequence
  derived and/or modified sequence opt5 from DTX1__Homo_sapiens__XP_011536311
augagcagacccggccacgggggacugaugccugugaacggccucggguucccgccccagaaugucgcccggguuguggugugggaguggcugaacgaacauucccgcuggagaccuuacaccgcuacagucugccaccauaucgagaaugugcuuaaggaagacgcccggggaucuguugugcugggccaagucgaugcgcagcucgugcccuauauuaucgaccugcagagcaugcaccaguuucgccaagauacggggaccaugagaccuguucggcgcaacuucuacgaccccuccucugcuccuggaaaaggcauugugugggagugggaaaaugauggcggggccuggacagccuaugacauggauaucuguauuaccauccagaacgcuuacgagaagcagcauccguggcuugaccugagcucccucggauuuugcuaucugaucuacuucaauucuaugagccagaugaacagacaaacacggcgcagacggcgccugagacggcgccucgaucuggccuauccccuuaccgucggcuccauuccuaaaagccagucuuggcccgugggggcuuccagcggacagccuuguucuugccagcaaugucugcucgucaauuccacaagagccgcgagcaacgccauccuggcuucucagcggagaaaggcucccccggccccuccccuuccucccccucccccgcccggcgggccucccggagcccuggcggugcgcccuuccgccaccuuuacgggcgcugcccucugggcugcccccgccgcuggcccggcggagccugcucccccucccggggccccuccccggagcccgggagccccuggcggggccagaacccccggacagaauaaccugaaucgccccggcccucaacggacaaccuccguuucugcuagagccagcauuccgcccggggugccugcgcugcccgugaaaaaccucaauggaacaggcccuguccaccccgcucuggccggcaugaccgggauccuucugugcgccgcuggacucccugugugucugacgcgcgcccccaagccgauucuucacccucccccuguuuccaagagcgacgugaaacccgucccgggcgugccugggguuugccggaagaccaaaaagaaacaucugaagaagucuaaaaaccccgaagauguggucagacgcuacaugcagaaggugaaaaacccucccgacgaggauuguacaaucugcauggaacggcucgucacagcuuccggauacgagggcgugcugagacacaaggggguucgccccgagcuggugggccggcucggaagauguggccauauguaucaucugcuuugccuggucgccauguacagcaaugggaacaaagacggaucucuccagugcccuaccuguaaggcgauuuauggcgaaaagaccgggacacagccgcccggaaaaauggaguuccaccugaucccucacagccuucccggcuuuccugacacgcaaaccauccggauuguguacgauauccccacagggauucagggcccugaacacccgaaucccggaaagaaauucaccgcccgcggcuuuccuagacauugcuaucugcccaacaaugagaaggggcggaaaguucucagacugcugaucacagcuugggaacgccggcucauuuucaccaucggaacguccaacacaaccggcgagucugacaccguggucuggaaugagauccaccauaagacagaauuugggagcaaccugaccggacacggcuacccugaugccuccuaucuugacaaugugcuggcugagcucacagcccagggggugagcgaagcggccgcuaaagccuga

SEQ ID NO: 68579 - RNA, 1869 nt, Artificial Sequence
  derived and/or modified sequence opt5 from DTX2__Homo_sapiens__NP_001096064
auggccauggcucccagcccuucccuggugcaggucuacaccucuccggccgcgguugcugugugggaguggcaagacggccucgggacauggcaccccuauagcgccacggugugcuccuucaucgaacagcaguuuguccagcaaaagggacagagauucggccuggggucucuugcccauagcauuccucugggacaggcugaucccucccucgccccuuacaucauugaccugcccucuuggacccaguuucggcaagauacaggcaccaugcgcgcugugagacggcaccuuuucccucagcauagcgccccggggcgcggaguugugugggaguggcuguccgacgauggcagcuggacagcguaugaagccucugucugugacuaccucgagcaacagguggcuagaggcaaccagcugguugaucuggcuccccucggguauaauuacaccgugaacuauacaacccacacgcagaccaauaaaacauccagcuuuugccggucuguccgcagacaggccggaccucccuacccugugaccacaaucauugcgcccccgggccauaccgggguggccuguuccugccaccaaugucugagcggaucucggacgggcccugucuccgggcgcuacagacacagcaugacaaaccuucccgccuauccuguuccccagcaucccccucaccggaccgcuuccguguucggaacacaucaggccuuugcuccguacaauaagcccucucugagcggcgcccgcuccgccccuagacucaacaccaccaaugcuuggggcgcggcucccccuagccuggggucucagccccuuuaucgguccagccugucucaccucggaccgcaacaucugccucccggcagcuccacaucuggggccgugagcgccucccugccuagcggacccucuuccagcccuggcucuguccccgccacggugccgaugcagaugccuaaacccucccgcguucagcaggcucucgccgggaugaccagcgugcugauguccgcgaucggacuucccgucugccugucuagagcuccucaaccgacaagcccucccgccucccggcucgccucuaagagccacggcuccgugaaaagacugcgcaagaugagcguuaagggcgcuacccccaaaccugaacccgagccugaacaggugaucaagaacuacacagaggagcuuaaagugcccccggacgaagauuguauuaucugcauggagaagcugucuaccgccuccggguauagcgacgucacggauucuaaagcuauuggaucccucgccgucggccaccugacaaaguguagccaugcguuccaucugcucugccugcuugccauguacuguaaugggaacaaggacggaucucugcagugcccuagcugcaaaaccaucuauggcgagaagaccgggacacagccccaaggcaaaauggaagugcuccgguuucagaugucccugccuggacacgaggauuguggcaccauucuuaucguuuacagcauuccccacgggauccagggaccggaacacccuaaucccggcaagccuuucacagcuagaggguuuccccgccagugcuaccugcccgacaacgcccaaggacggaaagugcucgagcugcugaaggucgcuuggaaaagacgccucaucuucacggugggcaccucuuccacaaccggggaaacagacaccguuguguggaaugagauucaucacaagacggagauggaucggaacaucaccggccauggauauccugacccgaauuaccugcagaacguccuugccgaacuggcggcccagggcgugacagaggauugucucgaacaacaguga

SEQ ID NO: 68580 - RNA, 1053 nt, Artificial Sequence
  derived and/or modified sequence opt5 from DTX3__Homo_sapiens__NP_001273174
augcccauccugagcuccucuggcagcaagauggccgcuugcgggggaaccuguaaaaacaaggugacagucuccaaaccuguuugggacuuccucucuaaggagacgccggccagacuggcgcggcuucgcgaggaacacagagugagcauucugaucgauggcgaaaccuccgacauuuacgugcuccagcugucuccccaagggccucccccugcucccccuaauggacuuuaucuggcccggaaagcccucaagggccugcugaaggaggcugaaaaagagcucaagaaagcccagcgccagggggagcugaugggaugccuugcucugggcggcgggggagaacauccggagaugcacagagccgggcccccuccccuccgggcggccccucugcuucccccgggcgcucgcggacugccucccccucccccuccccucccgcccccucugcccccuagacugcgggaagaggccgaggaacaggagagcacaugucccaucugccucggcgaaauucaaaacgcuaagacccuggagaaaugucgccauuccuuuugcgaaggguguaucacaagagcccuucaggucaagaaggcgugcccgauguguggacgguucuacggccagcuggugggcaaucagccucaaaacgggcgcaugcucguuagcaaagaugccacccugcuucugcccucuuaugagaaguacggaacaaucgugauucaguaugucuuuccucccggcgugcagggggcugagcacccuaaucccggaguuagauacccgggcaccacgcggguggccuaucucccugacugccccgaagggaacaaaguccugacccuguuccgcaaggcuuuugaucagagacucacauucaccaucggaacauccaugaccacgggccggcccaaugugauuacauggaacgacauccaucacaaaaccagcuguacaggcgggccucaacuguuuggauacccggaucccaccuaccuuaccagagugcaggaggaacugcgcgccaagggcauuacagacgauuga

SEQ ID NO: 68581 - RNA, 1542 nt, Artificial Sequence
  derived and/or modified sequence opt5 from DTX4__Homo_sapiens__NP_001287656
auggaggugggcaucaccauucagcacgccuacgaaaagcaacaucccuggaucgaccugacaagcauuggguucuccuaugucaucgauuuuaacacgaugggacagauuaauagacagacccagcggcaacgcagaguucggcgcagacucgaccugaucuacccuauggugacaggcacccuuccgaaagcucagucuuggcccgugagcccugggcccgccacauccccucccaugucuccuugcagcuguccgcagugcguccuggugauguccguuaaggcggcuguggucaacggaucuaccggcccccuccagcugccugugacacggaaaaauaugcccccucccgggguugugaaacuuccgccucugcccggaagcggcgccaagccucucgauuccaccggcacgauccgcgggccccugaagaccgcccccagccaagucauuagacggcaggcuucuuccaugccuacaggaaccacaaugggcagcccggccucucccccugggcccaacuccaagaccggacgcguggcucuggccacgcucaauagaacaaaccugcagcggcuugcgaucgcccagagccgcgugcugauugcuucuggcgucccuaccguucccgugaaaaaucucaacggguccagcccggugaauccugcccuggcuggaaucacaggcauucuuauguccgccgcgggccugcccgucugucucaccagaccucccaagcuggugcugcacccucccccgguuucuaaaagcgagaucaaguccauuccuggggugagcaacaccucucggaaaacaacgaagaagcaagccaaaaagggaaaaacccccgaagagguccucaagaaauaucugcagaaggugcgccaucccccugacgaagauugcacaaucuguauggagagacuuaccgcuccguccggcuacaaagggccccagccuacaguuaagcccgaccuggugggaaagcucagccggugcggccacgucuaucauaucuacugucugguggccauguauaauaacgggaauaaagauggaucucuucaaugcccuaccuguaagacgauuuacggcgucaaaacaggcacccagcccccugggaagauggaguaccaccugaucccccacagccucccgggacauccugacugcaaaaccauuagaaucauuuauuccauucccccuggcauccaggggcccgaacacccgaacccuggaaagucuuucagcgcucgcggcuuuccccggcauuguuaccugccugauuccgagaaggggagaaaagugcugaagcuccugcuuguugccugggaccgccggcugaucuucgccaucggcacaagcucuaccacaggagaauccgauacggugauuuggaaugagguccaccacaaaaccgaguuuggcagcaaccucacagggcauggauaucccgacgcuaacuaccuggauaaugugcuugcggaacuggccgcucagggcaucucugaggacuccaccgcccaagaaaaggacuga

SEQ ID NO: 68582 - RNA, 639 nt, Artificial Sequence
  derived and/or modified sequence opt5 from DTYMK__Homo_sapiens__NP_036277
auggccgcuagacggggcgcccugaucgugcucgagggggucgaccgcgcgggaaagagcacccaguccagaaaacugguugaagcucuuugcgccgccggccaccgggcugagcugcuccgcuuccccgaaagaucuacagagauugggaagcugcuuagcuccuaccugcagaaaaagucugauguggaagaccauagcgugcaccuccuguuuuccgccaaccggugggagcaagucccucugaucaaagagaagcucucucagggagugacgcugguuguggaucgcuaugcuuucagcggcgucgccuuuaccggggcgaaggaaaauuucucccuugacugguguaaacagccggaugugggacugcccaagccugaccucguucuguuucuucaacugcagcucgccgaugcugccaaaagaggcgcuuucggccaugagcgguacgaaaacggggccuuucaggagcgcgcgcugagaugcuuccaccagcugaugaaggacacaacccucaauuggaaaaugguggaugccagcaagucuauugaggcuguccaugaagacauccgggugcuguccgaggaugccauucgcacagcuaccgaaaagccccuuggagagcuguggaaauga

SEQ ID NO: 68583 - RNA, 4656 nt, Artificial Sequence
  derived and/or modified sequence opt5 from DUOX1__Homo_sapiens__NP_787954
augggcuucugccuggcccucgcuuggacccugcuugugggggccuggacaccccugggagcgcagaacccuaucagcugggagguccaaagauuugacggcugguacaauaaccucauggaacaccgguggggguccaaaggaucucgccugcagagacuuguuccggcuagcuaugccgauggcguguaccagccccugggggagccucaucuccccaauccucgggaccuguccaacacgauuucucgcggacccgccggccuggcuagccucagaaaucggaccgugcugggcgucuucuuuggguaucacgugcuuuccgaucugguuucuguggaaacaccuggauguccggccgaguuccucaacauccgcauucccccuggcgaccccauguuugauccugaccagagaggggaugucgugcugcccuuccaacggagccgcugggacccggaaaccggaagauccccuagcaauccccgggauccugcuaaccagguuacaggcuggcuugacgggucugccaucuacggauccagccauucuugguccgaugcgcugcgcagcuuuucuagaggccagcucgccuccggccccgaccccgcuuucccucgggauagccagaauccgcugcugaugugggccgcucccgacccugccaccgggcaaaacggaccccgcggccucuaugcguuuggggccgagagaggaaaucgggagccuuuccugcaggcucuuggccugcucugguuuagauaccacaaccugugggcccagcgccuugcucggcagcaucccgacugggaagaugaggaacuguuccaacacgccagaaaacgcgugauugccacauaucagaauaucgcugucuacgaguggcucccguccuuucugcagaagacccugccugaguacacgggguaucggcccuuccucgacccuucuaucagcuccgaguucguggcggccagcgaacaauuucugucuaccauggugcccccuggagucuacaugagaaacgcuuccugccacuuccagggcguuauuaaucgcaacagcucugugagccgggcccuuagaguguguaacuccuauuggucucgcgaacaucccagccugcaguccgccgaggaugucgacgcucuccugcuuggcauggccagccagaucgcggaacgggaggaucacgugcugguugaggacgugagagauuuuuggccggggccucucaaauucucucgcacagaccaucuggcuuccugccugcaacggggaagagaucucggccugcccagcuacaccaaggcccgggccgcucuugggcugucucccauuacacgcuggcaggacaucaauccugcccucuccagaagcaacgauaccguccuggaagcuacggccgcgcuguauaaucaggaccuuuccuggcucgagcugcugccgggaggccuccuggaaucucaccgggaccccgggccucuuuuuagcacaauugugcuggagcaguucguuagacuccgcgauggcgaccgguacugguuugaaaacaccagaaauggacuguucuccaaaaaggagaucgaggaaauucgcaacacaacccugcaagaugugcuugucgccgugaucaauaucgaccccucugcucuccagccuaacgucuuuguguggcacaagggcgaucccuguccucagcccagacagcugagcaccgaggggcugccggccugcgcuccuuccguugugcgggacuauuucgaaggaagcggcuuuggguucggagucacaauuggcacgcucuguugcuuuccccuggugucucuucuguccgccuggaucguugcgcgccucagaaugcggaauuucaaacgccugcaagggcaggauagacagagcauugugucugagaagcuggucggcggaauggaagcccuugaguggcagggccauaaagagccuugucggcccgugcucguguaccugcaaccggggcagauccgcguugucgacggaagacugaccgugcuccggacaauucagcugcaaccuccccagaaggugaacuucguccuuuccagcaaucgcggcagacggacccugcuccugaaaaucccuaaggaauacgaucuggugcuucucuuuaaccuggaggaagagagacaggcucugguugagaaucuccgcggggcccugaaggaaucuggacuuagcauccaggagugggaacugcgggagcaagaacucaugagagcugccgugacacgcgagcagcggagacaucugcuggagaccuucuuucgccaccuuuucucccagguccuggacauuaaccaggccgaugcuggcacgcucccccuggacagcucucaaaaagugcgggaagcgcucacaugcgagcuguccagagccgaauuugcugagagccuugggcugaagccccaggauauguucguugaauccauguuuucucucgccgacaaagacggcaauggauaucugagcuuccgcgaguuucuggauauccuuguggucuucaugaagggcuccccugaggaaaaaucucggcugauguuuagaauguacgacuucgaugggaacggacucauuagcaaggacgaguuuauccggaugcugcgcuccuucauugaaaucucuaacaauugucucagcaaagcccagcuggcugaggugguugaauccauguucagagagagcggcuuucaggauaaggaggaacuuaccugggaggacuuccacuuuaugcugcgggaucauaacucugaacuccgcuucacccaacugugcgugaagggggucgaggugccggaggugaucaaagaccugugcagacgggccuccuauauuagccaggauaugaucugucccucuccuagagucuccgcgcgcugcagccggucugacauugaaacagagcuuacaccccagagacugcaauguccuauggauaccgaucccccucaggaaauccgccggagauuuggaaagaaaguuacguccuuccagccgcuccuguuuaccgaggcucaccgcgaaaaguuccagcggagcugccuccaccaaacagugcagcaguuuaaaagauucauugagaauuaccgcagacauaucggcuguguggccgucuuuuaugccauugcugggggccuguuccuugagcgggccuacuauuacgcguucgcugcccaccauaccggaaucacagacaccacgcgcgugggcaucauucuguccagagggaccgccgcuagcaucucuuuuauguucagcuacauucugcucacaaugugccggaaccugaucaccuuucuucgcgaaacauuccugaauagauauguucccuuugacgccgcuguggacuuccaccggcucauugccuccaccgcgaucguccugacggugcuccacucuguuggacauguggucaacguguaccuguuuagcaucuccccucuuucuguucugagcugucuguuccccggccucuuucacgaugacggguccgagcugccucagaaguauuacuggugguucuuucaaacagugcccggacuuaccggcgucgugcugcuccugauucucgccaucauguauguguucgcuucucaucacuuuagacgccggagcuucagaggcuucuggcugacacaucaccuuuacauucugcuguauguccuccugaucauucacggguccuuugcccuuauccagcugccgcgcuuccauaucuuuuuccucguuccugcuauuaucuacggaggcgauaagcuggugagccucucucggaaaaagguggaaauuuccgucgugaaagccgagcugcuucccagcgggguuacccaccugagauuucagcggccccagggauucgaauacaagucuggccaaugggugcgcaucgccugccuggcucucgggaccacagaguaucauccuuuuacgcugaccuccgcgccccacgaggacacacuuagccugcauauuagagccgcuggaccuuggaccacacggcuccgcgaaaucuacuccgccccgaccggcgauagaugugcccgguaucccaaacuguaccuggacggcccuuucggggagggacaccaggaauggcacaaguuugaggucucugugcucguuggcgggggaaucggcgugacgcccuucgcuagcauucuuaaggaucuggucuuuaaauccagcgugucuugccaggucuucuguaagaaaaucuauuuuauuugggugacacgcacccagagacaauucgaauggcuggccgacaucauucgggagguugaggaaaaugaucaucaggaccucguguccguccacaucuacauuacccagcuggcggagaaguucgaucuucgcacaaccaugcuguauaucugcgaaagacauuuucaaaaagugcucaaccggagccuguucacagggcugagaucuaucacgcacuuuggacgcccucccuucgagccguuuuucaauagccuccaggagguucacccucaggugcggaagauuggcgucuuuuccugcgggcccccuggcaugaccaagaacguggaaaaggcuugucagcuuaucaauagacaagaccgcacacauuucucucaccauuacgagaacuuuuga

SEQ ID NO: 68584 - RNA, 4647 nt, Artificial Sequence
  derived and/or modified sequence opt5 from DUOX2__Homo_sapiens__NP_054799
augcugagagcccggcccgaggcucucaugcugcuuggcgcccugcucaccgggagccugggaccuuccggcaaccaggacgcgcuuucucugccgugggaagugcaacgcuacgaugggugguucaauaaccucagacaccaugagcggggagcugucggcugccgccugcagagacggguucccgccaauuaugccgacgggguguaccaggcucuggaggaaccucagcuccccaacccucgcagacugagcaaugccgcuacacggggaaucgccggccuucccucccugcacaaccgcacggugcucggcgucuuuuucggguaucaugugcugucugauguugugagcgucgaaaccccuggauguccggcggaguuucuuaauauuagaaucccucccggcgaccccguguucgauccugaccaacggggcgauguugugcugcccuuucagcgcuccagaugggacccggagacaggacggucuccuagcaacccccgcgaucucgccaaucaggucaccggcuggcuggacggguccgcuauuuacggaagcucucacuccuggagcgaugcccugagaucuuucuccggcggccagcucgcuagcgggccugaccccgccuuuccccgggauucucaaaacccucugcuuaugugggcggccccggaccccgcuacaggacagaauggcccuagagggcuguaugccuucggagcugaacgcggcaaccgggagcccuuucuccaggcccuggggcuucugugguucagauaccauaaucucugggcccagcgccuggcucggcaacacccugacugggaagaugaggagcuguuucagcacgcgagaaagcgcgugaucgccaccuaucagaacauugcuguguacgaauggcuccccuccuuccugcagaaaacacuuccggaguacaccggauaucggccuuuucuggaccccagcaucuccccugaguucgucguugccucugaacaauucuuuagcacgauggugcccccuggcguguacaugagaaaugccuccugccauuuccgcaagguccucaacaaaggcuuucagagcucucaggcucugcggguguguaacaauuauuggaucagagaaaaccccaaucuuaacuccacccaagagguuaaugagcugcuccuggggauggccagccagauuucugaacuggaggauaacaucguggucgaagaccuccgcgauuacuggccgggaccuggcaaguucagccggacagacuauguggcguccucuauucagagagggcgggauaugggacugcccagcuacucccaggcccuucuggcuuuuggccucgacaucccccgcaauuggagcgaucugaacccuaauguugacccgcaagugcuggaggccaccgcugcccuuuauaaccaggaucucucucagcuggaacugcuccugggcggccuucuggagucccacggagaccccggcccucucuucagcgcuauuguccuggaccaguuugugagacugcgggauggggacagauacugguucgagaauacacgcaacggacuuuuuagcaaaaaggaaaucgaggauauucggaauaccacgcucagagacguccugguggccguuaucaacaucgaucccuccgcgcugcaaccuaauguguucgucuggcauaagggcgcccccugcccucagcccaaacagcucacaaccgacgggcugccgcagugugcuccucuuacagugcuggacuuuuucgaaggaagcucccccggcuuugccauuaccaucauugcucucugcugucugccucugguuucucuucuccugagcgggguggucgccuacuuccgcggcagagagcacaagaaacugcaaaagaaacucaaggaauccgugaagaaagaggcggccaaggauggagugcccgcuauggaguggccgggcccuaaagaacggucuagccccaucauuauccagcugcuuuccgaucgcugccugcagguucucaacagacaccugaccguccugcggguggugcaacuucagccucuccagcaggucaaccugauccugagcaauaaccgcggguguagaacacuccugcuuaagauucccaaagaguaugaccuggugcuccuguucucuuccgaagaggagcggggagccuuuguucaacagcugugggauuucugcgugcgcugggcucuuggccugcaugucgccgaaaugagcgagaaggaacucuuuagaaaagccgugacgaagcagcagcgggagcgcauccuggaaauuuucuuuagacaccucuucgcucaaguucuggacaucaaucaggcggaugccgggacccuuccccuggacucuucccagaaggugcgggaggcucucacaugugagcugagcagagccgaauuugccgagucucugggacuuaaaccucaggacauguucgucgaaagcauguuuucccuggcugauaaggacggcaacggguaccucagcuuccgcgaguuucuggauauucucgugguuuucaugaaaggcucuccggaagacaagucccggcugauguuuaccauguaugaucuugacgagaauggauuccugagcaaagaugaguucuuuacaaugaugagauccuucaucgaaaucucuaacaauugccucagcaaggcccaacuggcggagguggucgaauccauguuucgcgagucuggcuuccaggacaaggaggaacugaccugggaggauuuucauuucaugcuucgggaccacgauagcgaacugagauuuacgcagcucugcgugaaagggggaggcgggggaggcaacgggauucgcgacaucuucaagcaaaauauuuccugucgggugucuuuuaucacaagaacccccggcgagcgcagccauccucagggacuggggcccccugcucccgaagccccugagcucgggggaccgggccugaaaaagcgguucgggaaaaaggccgcuguccccaccccuagacuuuacacagaggcccugcaggaaaagaugcagcggggauuucuggcgcaaaaacuccagcaguauaagcgcuucguugagaacuacagacggcacauugugugcguggcuaucuucuccgccauuugugucggcguguuugccgaucgcgcuuauuacuacggcuucgccucucccccuucugacaucgcucagaccacacugguugggaucauucuuuccagaggaacggccgcgagcgugucuuuuauguucuccuauauccugcucaccaugugccggaaucugauuacauuucucagagaaaccuuccugaaccgcuacguccccuuugacgccgcuguggauuuccaccgguggaucgccauggcugccguugugcuugccauucugcauagcgcuggccacgcggucaauguguauaucuuuucuguuuccccgcugagccuccuggccuguaucuucccuaacguguuugucaaugacggguccaaacuuccccaaaaguucuacuggugguuuuuccagacagugcccggaaugaccggcgugcugcuccugcucguccuggcuauuauguauguuuucgccagccaucacuuuagacgccggucuuucagaggguuuuggcuuacgcaccaucuguacauccugcucuaugcccugcuuauuauccacggaagcuacgcucugauucagcucccuaccuuccauaucuacuuucuggugcccgccaucauuuauggcggcgauaaacucgugucccugucucgcaagaaggucgagaucagcgugguuaaagcggaacuucugccuuccggggugacauaccugcaguuccaacggccgcagggauuugaguauaagucuggccagugggucagaauugcuugccucgcccuggggaccacagaguaccaccccuucacccuuacgagcgccccucaugaagacacacugucccuccacauccgcgcugugggacccuggaccacaagacugcgggagauuuauucuagcccuaaaggcaacgggugugccggauaccccaagcuguaucucgauggcccguuuggcgaagggcaccaggaguggcauaaauucgaaguuuccgugcuugucggaggcgggaucggagugaccccuuuugcgagcauccugaaggaccuggucuucaaaucuucccucggcagccaaaugcugugcaagaagauuuacuuuaucugggugacccgcacacagagacaguucgaguggcuugcugauauuauccaagagguugaagagaacgaccaccaggaucuggugucuguccauauuuacgugacgcagcucgccgaaaaauucgaccugcggaccacaaugcuguauaucugugagcgccacuuucagaagguucucaauagaucccuuuucaccgggcugcggagcauuacacauuuuggaagacccccuuucgaacccuuuuucaacucccugcaagaggugcacccucagguccgcaaaaucggcguguuuucuugcgggcccccggggaugaccaagaauguggagaaagccugucagcucguuaaccggcaggauagagcucacuucaugcaucacuacgaaaauuuuuga

SEQ ID NO: 68585 - RNA, 1452 nt, Artificial Sequence
  derived and/or modified sequence opt5 from DUOXA1__Homo_sapiens__NP_001263193
auggccacccugggccacacauuccccuuuuacgcugggccuaagccgacguuccccauggacaccacacucgccagcaucauuaugaucuuucugaccgcgcuugcuacauucauugugauccugccuggaauuagaggcaaaacccggcucuuuuggcugcuucgcgucguuacaucccuguucaucggggccgccauccucgcugugaacuuuucuagcgagugguccgugggacaggucucuaccaauacgagcuauaaggccuucuccucugaauggauuagcgcugauaucggccugcaaguggggcugggaggcguuaacauuacccucacaggcacccccgugcagcagcugaaugagacaaucaacuacaaugaagaguuuaccuggagacuuggggaaaacuaugccgaggaguacgcgaaagcccuggaaaagggacucccugaccccguccuguaucuugcugagaaauucacgccucgguccccgugcggccuguaccgccaguauagacucgccgggcauuacacaagcgcuaugcuguggguggccuuucuguguuggcuccuggcgaauguuaugcuuucuaugcccgugcuggucuacggaggcuauaugcuccuggccaccgggauuuuccaacuucuggcucuccuguuuuucuccauggccacaagccugaccucuccuugcccccuccaccugggagcuuccgugcuucauacccaccauggcccugccuucuggaucacacugacgaccggccuccugugugugcuucuggggcucgccauggcugucgcgcaccggaugcagccccaccgccugaaggccuuuuucaaccagagcguugaugaagacccgaugcuggaguggucuccugaggaaggaggccuccugucccccagauaccggagcauggcugauuccccuaagucucaggacauuccccuuagcgaggccuccagcacaaaagccuauuaccgccccagacggcugucucucgugccugcugaugugcgcgggcuggccccggcggcucuguccgcccuucccggagcccuccuggcucaagccuggagagcucugcucccuggccugcggugccccaaggccgggaaagaaagccgccuuggaccuccccauucuccguggagauuuggcccugagggcugugaggaacggugggcggagcacaccggggacagccccagaccucugcgcggacggggcacagggagacucuggcgcuggggauccaaggaacggagagccugcggcguccgcgcuaugcugccccggcuggugucuaauagcgggcuuaaaagaccuuccugucucgaucugcccaagugcugggacuaucgccgggaugccagagcuuucuuucaucugcucgagccgaccccuuguguuacgagccgccacacaccccugaucuga

SEQ ID NO: 68586 - RNA, 963 nt, Artificial Sequence
  derived and/or modified sequence opt5 from DUOXA2__Homo_sapiens__NP_997464
augacccuguggaacggcgugcuccccuucuacccucagccgagacacgccgcuggguuuagcgucccccugcuuaucguuauucugguguuccucgcccuggcggcuuccuuucuucugauccucccuggcauucggggccauucucgcugguucuggcuggugagaguccugcucagccuguuuaucggggccgagauuguggccguucacuucuccgcugaaugguuugugggaacagucaauacgaacaccucuuauaaggccuucagcgcugcccgggugacagcgcgcguuagacuucuggugggccucgaggggaucaauaucacccugacaggaacccccguccaucaacuuaacgaaacaauugacuacaaugagcaguuuaccuggcggcugaaagaaaacuaugccgcugaguacgccaaugcucucgagaagggccugccugaucccgugcuguaucucgccgaaaaauucacgccuuccucuccgugcggccuguaccaccaguaucaucuugcggggcacuacgccagcgcuacccuguggguggccuuuuguuucuggcuccuguccaacguccuucugagcacacccgcuccucucuacggaggccuggcccugcucaccacaggggccuuugcucuguucggaguuuucgcgcuugccucuaucuccagcgugccccugugcccucuccgccugggaucuuccgcucuuaccacgcaguauggggccgccuuuugggugacacuggcuaccggaguccucugucuguuccugggcggcgccgugguuagccuccaauacgugagacccucugcgcugcggacacuucuggaccaguccgcuaaggauugcagccaggagcgcgggggauccccgcucauucugggcgacccucugcacaaacaggccgcccuucccgaucucaaguguaucaccaccaaucuguga

SEQ ID NO: 68587 - RNA, 663 nt, Artificial Sequence
  derived and/or modified sequence opt5 from DUPD1__Homo_sapiens__NP_001003892
augaccagcggcgaggugaagacaucccugaaaaacgccuacucuagcgcuaagagacucucccccaaaauggaagaggaaggggaggaagaggacuauugcacgccuggagccuucgagcuggaacggcuguuuuggaagggcucuccgcaguacacccacgucaaugagguuuggcccaaacuuuauaucggggaugaagcgacagcucucgaccgcuacagacugcaaaaggccggauucacccaugugcuuaacgccgcucacggccgguggaauguggauacagggccugacuauuaccgcgauauggacauucaguaucauggagucgaggccgaugaccugcccaccuuugaucucagcguguucuuuuacccugcugccgcguucaucgacagagcccuguccgaugaccacucuaagauucugguucauugugugaugggccggagccgcuccgcuacacucguccuggccuaccuuaugauccacaaagauaugacccugguggacgcuauucagcagguugccaagaacagaugcgugcuccccaaucggggcuuucugaaacaacuucgcgagcuggacaagcagcucguccagcagagacggcgcagccaaagacaggauggggaagaggaagacggacgggagcuguga

SEQ ID NO: 68588 - RNA, 1482 nt, Artificial Sequence
  derived and/or modified sequence opt5 from DUS2__Homo_sapiens__NP_001258691
augauccugaacagccucucccugugcuaccacaauaaacuuauucuggcccccauggugagagucggcacccucccuaugcggcugcuugcucuggacuauggggccgauaucguuuacugugaggaacucauugaccugaagaugauccagugcaagcgcguggugaacgagguccugucuacaguggauuucguugcgccggacgauagaguggucuuucggacgugugaacgcgagcaaaauagagugguuuuccagaugggaaccagcgacgcugaacgggcccucgccguggcucgccuggucgagaacgauguggccggcauugacgugaauauggggugccccaaacaguauuccacaaagggaggcaugggggcugcccuucugucugauccugacaaaaucgagaagauccucagcacccuggucaagggaacaagacggcccguuaccuguaaaauucgcauccuuccuucccuggaagauacacucucucuggugaagagaauugagcggaccggcaucgcggccauugcugugcauggccgcaaaagagaggaacggccccagcacccugucagcugcgaggugaucaaggccauugcugacacgcuguccaucccgguuaucgccaacgggggaagccaugaucacauucaacaguacucugacaucgaagacuuucgccaggcgaccgccgcuuccagcgugauggucgccagagcugccauguggaaucccucuauuuuccucaaagagggccugcggccucuugaagaggugaugcagaaguauaucagauacgccguucaauaugauaaccauuacacaaauaccaaguacugucugugccagaugcuccgcgaacagcuggagagcccccaggggcggcuucugcacgcugcgcaauccucuagagagauuugugaagccuuuggacucggcgcuuucuaugaggaaacaacccaggagcuggacgcccagcaagcccgccuguccgcuaaaacgagcgaacagacaggggagccugccgaggauaccuccggagugaucaagauggcggucaaauuugaccggagagcuuaccccgcccagaucacaccgaagaugugccuccuggaauggugucgccgggagaaacuugcccagccuguguaugaaaccguccaaagaccccuggaucgccucuucucuagcauugugaccguugcugagcagaaguaccaguccacacugugggacaaaagcaagaaacuugccgaacaggcugccgcgaucgugugccugcggucucaaggccucccugagggcagacugggggaggaaucccccagccugcacaagcgcaagcgggaggcccccgaucaggacccuggaggcccgagagcucaggaacucgcccagcccggggaucugugcaaaaagccuuuugucgcucuuggaucuggcgaggagagcccccuggaagggugguga

SEQ ID NO: 68589 - RNA, 1449 nt, Artificial Sequence
  derived and/or modified sequence opt5 from DUSP10__Homo_sapiens__NP_009138
augcccccuagcccgcuggacgauagaguggucguugcccucucccggcccgugcgcccucaggaccugaaccuuugccuggauucuagcuaccucggcuccgcuaaucccgggucuaacagccacccucccgugaucgccaccacagucgugucccugaaggcggcuaaucuuacguauaugccuucuagcuccggaagcgccagaucucugaacuguggcugcuccagcgccucuuguugcaccguugcuacauacgacaaagauaaucaagcccagacccaggcuauugccgcggggacaaccacaaccgccaucggaacguccaccacauguccggcuaaccagauggugaauaacaaugagaacaccggcagccucucucccuccagcggggucggauccccugugucuggcacacccaagcaacuggccagcauuaaaaucauuuauccuaaugaccuggcuaagaaaaugaccaagugcuccaagagccaucuccccucucagggcccgguuaucaucgauugucggccuuucauggaauacaacaaaucccacauucagggggccgugcauaucaauugcgcggacaagauuagccgcagacggcugcagcaaggaaaaaucacgguccuugaucugauuucuugucgcgagggcaaggacagcuuuaaaagaaucuucuccaaggaaauuaucguguaugaugagaacacaaaugaacccucucgggugaugccuagccagccccuccacaucguccuggagucccuuaagcgcgaggggaaagaaccccugguucucaagggaggccugagcucuuuuaaacagaaccaugagaaccugugcgacaauucccuccagcugcaagaauguagagaggucgggggaggcgccagcgcugccucuucccuucugccucagccgauucccaccacaccugauaucgagaacgcugaacucacccccauucugccuuuccuuuuucugggcaaugagcaggacgcccaagaccucgauaccaugcagcggcugaacaucggguacgugauuaaugugacaacgcaucugccccucuaucacuacgaaaagggacuguucaacuacaaacgccuuccggccaccgacagcaauaagcagaaccugagacaguauuuugaggaggcuuucgaauuuaucgaggaagcgcaccaaugcggcaaagggcuccugauccacugccaggccggagugucccggucugcuacaauuguuaucgccuaccuuaugaagcauacccgcaugacaaugaccgaugccuauaaguucgugaaaggcaagagaccuauuaucagccccaaucugaacuuuauggggcagcuccuggaguucgaagaggaccugaauaacggagucacgccucggauucucacacccaaacugaugggcguggaaaccguuguguga

SEQ ID NO: 68590 - RNA, 1134 nt, Artificial Sequence
  derived and/or modified sequence opt5 from DUSP11__Homo_sapiens__NP_003575
augagaaacagcgagacccuggaacggggcgucgggggaugccgcguguucuccugucucggcucuuaccccgggaucgagggagccggccuggcucugcuggccgaccucgcgcuugggggaagacuucugggcacacacaugagccaguggcaucacccucgguccggcugggggcgcagacgggauuuuucuggacgcagcuccgcuaagaaaaagggcgggaaucauauuccggaaagauggaaagacuaucuccccguuggacaacggaugccuggcacgcgcuucaucgccuuuaaggugccccugcagaaaucuuucgagaagaagcuggccccugaagagugcuuuagcccccucgaucuguucaacaaaauuagagagcagaaugaggaacuugggcugaucauugaccucaccuacacacagcgguauuacaagccugaagaucugccggagaccgugcccuaucuuaaaaucuuuacagucggacaccaagugccugacgaugagaccaucuucaaguuuaaacaugcuguuaacggcuuccugaaggaaaauaaggacaacgauaaacucauuggcgugcacuguacacacgggcugaaucgcaccggauaccugaucugcagauaucucauugacgucgagggcgugcggcccgaugacgccaucgaacuguuuaaccgcuguagagggcauugccuugagcggcagaauuacauugaagaucugcagaacggaccuaucagaaagaauuggaacuccagcguuccccggucuuccgacuucgaggacagcgcucaccucaugcagccggugcauaauaaaccugucaagcaaggcccccgcuacaaccugcaccagauucaggggcacucugccccuagacauuuucacacgcagacccaaucccuucagcagagcgugcgcaaauucucugagaauccccauguguaucaacggcaccaucugcccccuccgggacccccuggcgaagauuacucccacagacgcuauagcuggaacgucaagcccaacgcgucccgggccgcucaggacagacgccggugguacccuuauaauuacucuagacucagcuaucccgccuguugggaguggacacaguga

SEQ ID NO: 68591 - RNA, 1023 nt, Artificial Sequence
  derived and/or modified sequence opt5 from DUSP12__Homo_sapiens__NP_009171
augcuggaggcccccggcccuagcgacgggugcgaacucuccaacccgucugcuagcagaguguccugugccggacagaugcuggagguccaacccggccuuuacuucgggggagcggcugccguugccgaaccugaucaccuucgggaggcuggcaucaccgccgugcucacaguggacucugaggaacccagcuuuaaggcugggccuggagucgaggaucuguggcgccuuuucgugcccgcccuggacaaaccugaaacggaucuccugucccaucuggacagaugcguugcguuuauuggccaggcccgggcugagggccgcgccgugcucguccacugucaugcuggggugucuagaagcguugccaucauuaccgcguuccugaugaagacagaucagcuuccguuugaaaaagccuaugagaagcugcagauccucaaacccgaggcuaagaugaaugaaggauucgaguggcaacugaagcuguaccaggccaugggcuaugaaguggacaccuccagcgcuauuuacaaacaguaucggcugcagaaggucacagagaaauacccugaacuccaaaaccugccccaggagcuguuugccguggauccuaccacagugucucaggggcucaaggacgagguccuguauaaaugccgcaaguguagacggucccuuuuccgcucuagcuccauccuggaucacagagaaggaagcggccccaucgccuuugcucauaagcggaugaccccgucuuccaugcucacgaccgggcgccaggcgcaaugcacaagcuacuucauugagccuguucaguggauggaauccgcccugcuuggagugauggacggccagcugcucugucccaaaugcucugcuaagcugggcagcuuuaauugguacggggagcaauguuccugcggaagauggaucaccccugccuuccagauucacaaaaaccggguggaugaaaugaagauccugcccguccucggcagccagacagggaaaauuuga

SEQ ID NO: 68592 - RNA, 567 nt, Artificial Sequence
  derived and/or modified sequence opt5 from DUSP13__Homo_sapiens__NP_001007272
auggccgagaccagccugcccgaacucggcggggaggacaaggcuacaccuugcccguccauccuggaacuugaggaacugcucagagccggaaaaucuagcuguucccggguggaugaggucuggcccaaccuguucauuggcgacgcggcuacggccaauaaccgcuuugagcuuuggaagcuggggaucacccacguucucaaugccgcucauaaaggacuguacugccagggcgggccugauuucuauggaucuagcguguccuaccugggcgugcccgcccacgaccucccugauuuugacauuucugcuuauuucagcuccgccgcggauuuuauccauagagcccugaacacacccggcgcuaagguccuugugcacuguguugugggggucagccggucugccacccuggugcucgcuuaccugaugcuucaucaacgccugucccucagacaggccguuauuacagugcggcagcaccgcugggucuucccuaauagaggauuucugcaccagcugugccggcucgaccaacagcugcgcggcgcggggcagagcuga

SEQ ID NO: 68593 - RNA, 597 nt, Artificial Sequence
  derived and/or modified sequence opt5 from DUSP14__Homo_sapiens__NP_008957
augagcuccagaggccacucuacccugccccggacacucauggccccucgcaugaucagcgagggggacauuggaggcaucgcucagauuacguccucucuguuccuugggagaggaagcguggccuccaaccggcaucugcuccaagcgcgcggcauuaccugcaucgucaaugcuacaaucgaaaucccgaacuuuaauuggccccaguucgaguacguuaaggugccucuggccgauaugccccacgccccuauugggcuuuauuuugacaccguggcugauaaaauccauucugucagcagaaagcacggagccacacuggugcauugugcugccggcguuucccggagcgcgacccucugcauugccuaccugaugaaauuccacaacgugugucugcucgaggcuuauaauugggucaaggcccgcagacccgugauccggccuaacguuggcuuuuggcgccagcugauugacuacgaaagacagcuuuucgggaaaucuacagugaagaugguccaaaccccguauggaaucgugcccgauguguacgaaaaggagucccggcaccugaugccuuauuggggcauuuga

SEQ ID NO: 68594 - RNA, 708 nt, Artificial Sequence
  derived and/or modified sequence opt5 from DUSP15__Homo_sapiens__NP_542178
augggcaacgggaugaccaaggugcugcccggacucuaccugggcaauuucaucgacgccaaagaucuugaccagcuggggagaaacaagauuacacacaucauuagcauccaugaguccccucaaccgcuccugcaggauauuacguaucuucggauccccgucgcugacaccccugaaguucccaucaaaaagcacuuuaaagagugcauuaauuucauccauuguugccgccugaacggaggcaauugucucgugcacugcuuugccgggauuucuagaagcacaaccaucgugacagcguacgucaugaccgugacaggacugggcuggcgggauguucuggaagcuauuaaggccacccgcccuaucgccaaccccaauccuggcuucagacagcagcucgaggaauuugggugggcuuccucucaaaagcugcggcgccagcuugaggagagauucggagaaagcccguuucgggacgaggaggaacugcgcgcccuccugccccuuuguaaaagaugccggcagggcuccgcuacgucugccagcuccgcggggccucauagcgccgcuucugagggaaccgugcagcgccugguccccagaacaccucgggaagcccaccgcccccucccgcugcuggcuagagugaagcaaaccuucuccugucucccucggugccugagcagaaaaggcgggaaguga

SEQ ID NO: 68595 - RNA, 1554 nt, Artificial Sequence
  derived and/or modified sequence opt5 from DUSP16__Homo_sapiens__XP_005253545
augcugccccucagccugcagaccguguucucccuuuacuuuugggucaacuggagacgggccucuacacuguucacgugccuccaagagcugaugcagcagaauggcaucggguauguucuuaacgcuagcaauaccuguccuaagccggacuuuauucccgaaucccacuuccugcgcgugccugugaacgauucuuuuugcgagaaaauccuccccuggcuggacaagagcgucgauuucauugaaaaagccaaggcguccaauggaugugugcugguucauugccucgcuggcaucucuagaagcgccacaauugccaucgcuuacaucaugaaacggauggacaugucccuggaugaggccuaucgcuuugugaaggaaaagagaccuaccauuagccccaacuucaauuuucuugggcagcugcucgacuacgagaaaaagaucaaaaaccaaacaggagcuucuggcccuaaguccaaacugaaacuucugcaccucgagaagccgaaugaacccgucccugccgugagcgaagggggacagaagucugaaacaccccuguccccucccugugcggauagcgccaccucugaggcugccggccagcggccgguucauccugcuuccgugcccagcgucccuuccgugcagcccucucugcucgaggacagcccccuggugcaagcccuuuccggccugcaccucagcgcggaucgccuggaagacucuaacaaacuuaagagauccuucagccuggauauuaagucugucagcuauuccgccucuauggcugccagccuccauggguuuuccagcucugaggacgcucuggaauacuauaaaccuuccaccacgcuggauggaaccaauaagcucugccaguucagcccgguucaggagcugucugaacagacacccgagaccuccccugacaaagaggaagccagcauccccaagaaacuucaaacagcccggccuuccgacucucagagcaagcgccugcacuccgugagaaccucuagcuccggcacggcucagcggagccuccugucuccccuucaccgcuccgggagcguggaggauaacuaccauacaucuuuucuguucggacucuccaccagccaacagcaccugacaaagucugcgggccuggggcucaaaggauggcauagcgacauucuggccccgcagaccuccaccccuagccuuacaucuuccugguacuucgcuacggaaagcucccacuuuuauucugccagcgccaucuacggcggcuccgcuucuuauagcgccuacuccuguucucagcugccuaccugcggggaucaagucuauagcgugagacggcgccagaagcccuccgacagagcggauagccggagaucuuggcacgaggaaucccccuucgagaaacaguuuaagcgccggagcugucagauggaguucggagaaucuauuauguccgagaauagaagccgcgaggagcucggcaagguugggucucaauccagcuuuuccggaagcauggaaaucaucgaggugucuuga

SEQ ID NO: 68596 - RNA, 567 nt, Artificial Sequence
  derived and/or modified sequence opt5 from DUSP18__Homo_sapiens__NP_001291723
augaccgcccccagcugcgcuuucccugugcaguuuagacaaccguccgucucuggccugagccagaucacaaagucccucuacauuucuaacgggguugccgcgaauaacaaacugaugcuuagcuccaaucagaucacgauggugauuaacgugucugucgaggugguuaauacccuguaugaagacauccaguacaugcaagugcccgucgcugauagcccuaacucccggcucugugacuucuuugaucccauugccgaccacauccauagcguggagaugaagcagggacgcacacugcuucacugcgccgcuggcguuucuagauccgccgcucugugucucgccuaucugaugaaauaccaugcgaugagccugcucgaugcccacaccuggacaaagucuugccggccuaucauucgccccaauuccggguucugggaacagcugauccauuaugaguuucagcuuuucggcaaaaacaccgugcacauggucagcucuccugugggaaugauuccggacaucuacgaaaaggaggugagacugaugauuccccucuga

SEQ ID NO: 68597 - RNA, 1104 nt, Artificial Sequence
  derived and/or modified sequence opt5 from DUSP1__Homo_sapiens__NP_004408
auggugauggaggucggcacccuggacgccgggggacucagagcucugcuuggcgaacgggccgcgcagugccugcuccuggauugucgcagcuucuuugcuuucaacgccgggcacaucgccggauccguuaaugugagauuuucuacaauugugcggcgcagagcuaagggcgccauggggcuugagcauaucguccccaacgcugaacugcggggacgccuccuggccggcgcguaccacgccgugguucugcucgacgagagaagcgcugcccuggauggcgcuaaacgggacgggacgcuugcccuggcggccggagcucucugccgcgaagccagagcugcccaaguguucuuucugaagggcggguaugaggccuucuccgcuucuuguccugagcuuugcagcaaacaguccaccccgaugggacugucucucccccugagcacauccgucccugauagcgcggaaucuggcuguuccagcugcucuacaccccuguacgaccaagggggaccuguggagauucuccccuuucuguaucuuggcuccgccuaccaugcuagccggaaggauaugcuggacgcccucggcaucaccgcccugauuaauguuucugcuaacuguccuaaucacuucgaagggcauuaucaguacaaauccaucccgguggaggauaaccacaaggccgacaucagcuccugguuuaaugaggcgauugauuucaucgacucuauuaagaacgcuggaggccgcgucuuugugcacugccaggccgggaucagcagauccgccaccauuugucuugcuuaucugaugcggacaaaucgcgugaaacucgaugaagccuucgaguuugucaagcagagacggagcaucauuucucccaacuucuccuucaugggacagcugcugcaguuugaaagccaaguucucgcuccucauugcucugccgaggcgggcagccccgccauggcugugcuggacagagggaccuccacgaccacaguguucaauuuuccugucucuauccccgugcacagcaccaacuccgcccuuagcuaccugcagucuccgaucacaaccuccccuagcuguuga

SEQ ID NO: 68598 - RNA, 573 nt, Artificial Sequence
  derived and/or modified sequence opt5 from DUSP21__Homo_sapiens__NP_071359
augaccgccagcgcuuccucuuucagcuccucucagggcgugcaacagcccagcaucuacuccuuuucucagauuacaagaagccuguuccucuccaacggggucgccgcgaaugacaagcugcuucugagcucuaaccggaucacggcuauuguuaaugccuccguggagguggucaacguguuuuucgaaggaauccaguauauuaaaguuccugugaccgaugcccgcgacagcagacucuacgauuucuucgacccgaucgcugaucugauccacacaauugacaugcggcaaggccgcacccuucugcauugcauggccggggucucuagauccgcuagccucugucuggccuaucugaugaaguaccacucuaugucccuccuggaugcgcauacauggaccaaaagccggcgccccaucauuagaccuaauaacggauuuugggagcagcuuaucaauuaugaauuuaagcuguuuaacaauaacacagugcggaugauuaauucccccguuggcaacaucccugacauuuacgagaaagaucuccgcaugaugaucucuauguga

SEQ ID NO: 68599 - RNA, 618 nt, Artificial Sequence
  derived and/or modified sequence opt5 from DUSP22__Homo_sapiens__NP_001273484
augggcaacgggaugaauaagauccugcccggacucuacauuggcaacuucaaagacgccagagaugcugagcagcugagcaagaauaaagugacccacauccuuuccguccaugacucugcccggccuaugcuggaagggguuaaguaucucugcauuccggcggcugauagccccucccaaaaccugacacgccacuuuaaagagucuaucaaguucauucaugaauguagacuucggggagagagcugccuggugcacugucucgccggcgugucccgcucugucacgcuggugaucgccuacaucaugaccguuacagacuuugggugggaagaugcucugcauaccgugagagccggacggagcugcgcuaauccuaacgucggcuuccagcgccagcuccaggaguuugagaagcacgaagugcaccaauauagacaguggcugaaagaggaauacggcgagagcccccuucaggacgccgaggaagcgaagaauauucuggggaaauauaaggagcagggacggacagaaccucaacccggcgcccgcagaugguccucuuucccugcucucgccccgcugaccuacgauaacuauacaaccgagacguga

SEQ ID NO: 68600 - RNA, 453 nt, Artificial Sequence
  derived and/or modified sequence opt5 from DUSP23__Homo_sapiens__NP_060293
augggcgugcagcccccuaacuucagcuggguccugccggggagacucgccggacuggcccuuccccggcugccugcucacuaccaauuucuccuggaccuuggcguucgccaucuggugucccucaccgagagagggcccccucacucugauagcugccccggacugacacugcaucggcuccgcaucccugacuucuguccgcccgcgccugaucagauugacagauuugugcagaucgucgaugaagcuaaugcccggggcgaggccguggggguucacugcgcucugggauucggccgcacgggcaccaugcuugccuguuaucuggugaaggaaagagggcucgcugccggagacgcgauugccgagauccggcgccugagacccggcuccauugaaacauacgagcaggagaaagcugucuuucaauucuaucagcggaccaaguga

SEQ ID NO: 68601 - RNA, 3477 nt, Artificial Sequence
  derived and/or modified sequence opt5 from DUSP27__Homo_sapiens__XP_005245660
auggccaccagaaaggacacagaggaagaacaggugguccccagcgaagaggaugaagcuaacguucgggccgugcaagcgcacuaccugcgcuccccuucuccgagccaguauuccauggugucugacgcugagacggagagcaucuucauggaacccauucaucucuccucugccaucgccgcuaaacagauuaucaaugaggaacugaagccucccggcgucagagccgaugcugagugcccugggaugcuugagagcgccgaacagcugcucguggaggaccuguacaaccggguucgcgagaaaauggaugacaccucccuuuauaauacacccugugugcuggaucuccaaagagcgcugguccaggaccggcaggaggccccuuggaacgaaguggaugagguuuggccgaauguguuuauugcugaaaagagcgucgccgugaacaaaggacgccugaagagacucggcaucacccacauccugaaugcugcccaugggacaggaguguacaccggccccgaguucuauacagggcuugagauucaguaccugggagucgaaguugacgauuuuccugagguggacaucucucaacacuuccggaaggcguccgaauuucucgaugaggcccugcuuaccuaucgcggcaaagugcuggucagcucugagaugggcauuuccagaagcgcugugcucguuguggccuaccugaugaucuuccauaacauggcuauucuggaagcccucaugacgguccggaagaaacgcgccaucuaccccaaugagggguuucugaagcagcuuagagaacugaacgagaaacucauggaggaacgggaggaagacuauggacgcgagggcgggucugcugaagcggaggagggagaaggcaccggguccaugcugggagccagagugcacgcucuuacaguugaggaagaggacgauagcgccucccaccugucuggcagcucccucggcaaggccacccaggcuagcaagccucugacacugauugacgaagaggaggaagagaaacucuacgaacaguggaagaaagggcaaggacugcuuucugauaaggugccccaggacggcgggggauggcgguccgccagcucuggccaagggggagaggaacuggaggaugaggacgucgaaagaaucauccaggaguggcagagccgcaaugaacgguaucaggcggagggcuacagacgcuggggccgggaagaggagaaagaagaggaauccgaugcugggucuagcgugggaagacgccggagaacccucuccgagagcucugccugggaguccgucagcucucaugacauuugggugcugaagcagcaacuugaacugaaccgcccggaucacggccggagacgccgggccgacuccaugagcuccgagucuacgugggaugcuuggaaugaaagacuccuggagaucgaaaaagaggccagccggcgcuaucaugcuaaguccaagagagaggaagccgcggaccggucuagcgaggccggguccagaguucgcgaagacgaugaggacagcgugggaucugaggcuuccagcuucuacaacuuuugcucucggaauaaagauaagcugacagcccucgaaagauggaaaauuaagcgcauccaguucggcuuucacaaaaaggaccugggggcuggcgauuccagcggagagccuggcgccgaagaggcggucggggaaaagaaccccucugacgugagccuuaccgccuaucaggcuuggaaacugaagcaccagaaaaagguuggauccgagaacaaagaagagguggucgagcucagcaagggcgaagauucugcccuggcuaagaaaagacaacggcgccuggagcuucucgaaagaucccggcagacacuggaggagagccaguccauggccucuugggaagccgacagcuccaccgcuucugggagcauuccucuguccgcguucuggucugccgaucccagcguguccgcugacggagauaccacaagcgugcucucuacgcagucccaucgcagccaccugucucaagccgccuccaauaucgcuggcuguagcaccucuaaccccacaaccccucuuccgaaucugcccguugggccuggcgacacaaucuccauugccagcauccagaacuggauugcgaaugucguguccgagacccucgcucagaagcagaacgaaaugcugcugcuuagcagaucucccagcguggccuccaugaaagccgucccugcugccucuugccucggagaugaccaagugagcaugcuguccggccauucuagcuccucucucgggggaugucugcugccccagagccaggcgcggccguccagcgacaugcaaucuguucuuuccugcaauacgacacugagcucuccugcugaguccugucgcagcaaggugagaggcaccuccaaacccaucuuuucucucuucgccgauaacgucgaccugaaggaacuggggcggaaggagaaagagaugcagauggaacuucgcgagaagaugagcgaauacaaaauggagaagcucgccuccgauaauaaaagaagcucucuguucaagaaaaagaaggugaaagaagacgaggaugacggaguuggcgauggggacgaggauaccgacuccgcuauuggcagcuuucgguacucuagcagauccaacucucagaagccugaaacagauaccugcagcucccuggccgugugugaccacuaugcuucuggaagccgcgucggcaaagagauggauuccagcaucaauaaguggcucucugggcugcggacagaagagaaacccccuuuccaguccgacuggagcggauccucuagaggcaaguacacgcgcagcucccuucugcgggaaaccgagucuaagagcuccagcuauaaauuuucuaagucccaaagcgaggaacaggacacaucuuccuaccaugaggccaacgggaauagcgugagaucuaccagccgcuucuccucuagcuccacacgggaaggaagagagaugcacaaauuuagccgcuccaccuauaacgagacgucuagcucccgggaagagucucccgaaccguacuucuuuagacggaccccugagagcuccgaacgcgaggagucucccgaaccccagagaccuaauugggcgcggagccgcgauugggaggacguugaagaguccagcaagucugauuucuccgaauuuggcgccaaaagaaaguucacacagagcuuuaugcggucugaggaggaaggggagaaggaaagaaccgagaaccgcgaagagggccgguucgcuuccggaagacgcagccaauaucggagaucuacagaccgcgaggaagaggaagagauggaugacgaggccaucauugcugccuggcggagacgccaggaagagaccagaacgaaacuccagaagcggcgcgaagauuga

SEQ ID NO: 68602 - RNA, 531 nt, Artificial Sequence
  derived and/or modified sequence opt5 from DUSP28__Homo_sapiens__NP_001028747
augggccccgccgaggcugggagacggggagccgcgagcccugugccgcccccucugguccgcguugcucccucccucuuccugggcucugccagagccgcuggggccgaggaacagcuugcucgggccggagugacccugugcgugaacgucagccgccaacagccuggccccagagcgccugggguggccgaacuccggguuccgguguuugacgaucccgcugaggaccugcuugcccaccuggaaccuacaugugcugccauggaggcggccguccgcgcuggaggcgccugccucguguacuguaagaauggcagaucccggucugcugccguuugcacggccuaucugaugcgccauagagggcugagccucgcuaaagcguuccagauggugaaguccgcccggcccgucgcugagccuaaccccggauuuuggucucagcugcaaaaauacgaagaggcccuucaggcccagagcugucugcagggcgaaccgccugcucucgggcugggacccgaggccuga

SEQ ID NO: 68603 - RNA, 945 nt, Artificial Sequence
  derived and/or modified sequence opt5 from DUSP2__Homo_sapiens__NP_004409
augggccuggaggccgcuagagaacucgagugcgccgcgcuggggacccuucugcgggacccccgcgaagcugagagaacacuccugcuugauugucggccuuuccuggccuuuugccgcagacacgugcgggccgcucgcccgguccccuggaacgcccuccugagacggcgcgcuagaggaccucccgccgcgguucuggccugucuccugccugaccgggcccuucgcacgagacuggugcggggcgaacucgcucgcgcugugguccuggaugaggggagcgccuccguggcggagcuuagacccgacucuccugcccauguucugcucgcugcccugcugcacgaaacccgggcuggaccgacagccguguacuuccucagaggcggguuugauggauuccagggcugcugucccgaccugugcagcgaggccccugcucccgcgcuuccucccaccggcgauaagacaucccgcucugacagccgggccccggucuaugaucaagggggaccuguggaaauccugcccuaccucuuucugggcuccuguucucauagcuccgaccuucaggggcugcaggcuugcggaauuaccgccguucucaaugugagcgccucuuguccuaaccacuucgagggccuguuuagauauaaauccauccccgucgaggauaaucagaugguggaaauuagcgcuugguuccaagaggccaucggguuuauugacugggugaagaacucuggaggccgcguccugguucauugccaggcgggcaucucccggagcgcuacaaucugucucgccuaccugaugcagucuagacgcgugcggcuugaugaagccuucgacuuugugaaacagagacgcggggucauuucccccaauuucagcuuuaugggacaacugcuccaguucgagacccaggugcugugccacuga

SEQ ID NO: 68604 - RNA, 558 nt, Artificial Sequence
  derived and/or modified sequence opt5 from DUSP3__Homo_sapiens__NP_004081
augagcggcuccuucgagcugucugugcaggaccucaacgaucugcuuagcgacggguccggaugcuacucucugcccagccaaccuuguaaugaagucaccccgagaaucuauguuggcaacgccuccguggcucaggauauucccaagcuccagaaacuggggaucacacacgugcuuaaugccgcggagggacggucuuuuaugcaugucaacacgaaugcuaacuucuacaaggacagcggcauuaccuaucuggggaucaaagccaaugauacacaggaauuuaaccucuccgccuacuucgagcgcgcugccgacuuuauugaucaagcucuggcccagaagaauggaagagugcugguucacugccgggaaggcuauagccgcucuccuacccucgugaucgcguaccugaugaugagacagaaaauggacgucaaguccgcccuuagcaucgugcggcagaaccgcgagauuggccccaaugauggguuccuggcucaacucugucagcugaacgacagacuugccaaggagggaaaacugaagccuuga

SEQ ID NO: 68605 - RNA, 1185 nt, Artificial Sequence
  derived and/or modified sequence opt5 from DUSP4__Homo_sapiens__NP_001385
auggugaccauggaggaacugagagagauggacugcagcguccucaagcggcugaugaaccgcgaugaaaauggcgggggagccggcggguccggaucucacggcacacuugggcugcccagcggaggcaaaugucuccugcuugacugcagaccuuuccuggcucauuccgccggcuacauccucgggucuguuaacgugcgguguaauacgauugugcgcagacgggcgaagggaagcgucucccuggagcagauccugccggcugaagaggaggugcgcgccagacuccggucuggccuguauagcgccguuauuguguacgaugaacgcucccccagagcugagagccuucgggaagacucuaccgucucccuggugguucaagcccuccgcagaaacgcugagcggacagauaucugccugcuuaaagggggauaugagcgcuuuagcucugaauacccugaguucuguuccaagaccaaagcccuggcggccauucccccucccgugccuccgagcgcuacagaaccccucgaccugggcuguucuuccugcgggaccccucugcacgaucagggaggccccgucgagauccucccuuuucuguaucuuggcagcgccuaccaugcugccagacgggacaugcuggaugcgcucgggaucacagcccugcuuaauguguccucugacugccccaaccacuucgaaggacauuaucaguacaaguguauuccgguggaggauaaucacaaggcugacaucagcuccugguuuauggaggccauugaauacaucgaugcugucaaagacugcagaggccgcguucuggugcacugucaggccgggauuagccggucugccaccaucugccucgcuuaucugaugaugaagaaaagagugcgccuggaggaagcguucgaguuugucaagcaacggagauccauuaucagcccuaacuucucuuuuaugggacagcuccugcaguucgaaagccaggugcuugccacguccugcgcugccgaggccgcuucucccagcggcccucugcgcgagcgggggaaaacccccgccacacccaccucccaauuuguuuucagcuuuccugugucugucggagugcauuccgcgccgagcucucuccccuaccugcacuccccuaucacaaccagccccuccuguuga

SEQ ID NO: 68606 - RNA, 1155 nt, Artificial Sequence
  derived and/or modified sequence opt5 from DUSP5__Homo_sapiens__NP_004410
augaaggugaccagccuggacggcagacagcuccggaaaaugcugcgcaaggaggccgcugccagaugcgucguucuugauugucggcccuaccuggcguucgcugccuccaacgugcgcgggucucucaaugugaaccugaauagcgucgugcuuagacgggcccgcggaggcgcuguuuccgccagauaugugcugccugacgaagcugcccgggcgcgccuccugcaagaagggggaggcggggucgccgcugugguugugcuggaucagggaucuagacacuggcagaaacuccgggaagagagcgccgcucgcgucgugcugacaucccuucuggccugccucccggcgggccccagaguguacuuucugaagggcggguaugaaacguucuacucugaguauccugaguguugcgucgacguuaaacccaucagccaggaaaagauugaguccgaacgggcccuuaucagccaauguggaaagccuguggugaacgucucuuaccgccccgcuuaugaucagggcgggccuguggagauucugccguuucucuaccugggauccgccuaccaugcuagcaaaugcgaguuccuggccaaucuccacaucaccgcccugcuuaacguuucuagacggacauccgaggcuugugcgacccaucugcacuauaaguggauucccguggaggacagccauacagccgauaucucuucccacuuucaggaagcuaucgacuucauugauugcgucagagagaaaggcgggaaggugcucguucacugugaagccggaaucagccgcuccccuaccauuugcauggccuaccugaugaaaacaaagcaguuucggcuuaaggaggcuuucgacuauaucaaacaaagacgcucuauggugagccccaauuuuggcuucaugggccagcugcuccaguacgaguccgaaauucugccuagcacccccaacccgcagccucccucuugucaaggggaggccgcgggauccagccugaucggccaucuccagacgcugucuccugauaugcagggggcuuauugcaccuuucccgccagcguccuugcccccgugccuacacacuccaccgucucugaacugagccgguccccgguggcuacagccaccagcugcuga

SEQ ID NO: 68607 - RNA, 1146 nt, Artificial Sequence
  derived and/or modified sequence opt5 from DUSP6__Homo_sapiens__NP_001937
augaucgacacccugagacccgugccuuucgccagcgagauggcuauuuccaagacagucgccuggcucaacgaacagcuggagcuuggcaaugaacggcugcuccugauggauugccgcccgcaagagcuuuacgaaucuagccacaucgaguccgcgauuaacguugcuauccccgggauuaugcugagacggcuccagaaaggaaaucugccugugcgcgcccuguuuacgagaggcgaggaccgggaucgcuucaccagacggugugggacagacaccgugguccucuaugaugaaucuagcuccgacuggaacgagaauacaggaggcgaaucugugcuggggcuucugcucaagaaacugaaggaugagggaugccgcgccuuuuaccuugagggcggcuucagcaaauuucaggcugaguucucccugcauugugaaaccaaccucgacgggagcuguucuuccagcucucccccucugcccguucugggacucggcgggcugagaaucuccagcgauucuuccagcgacaucgaauccgaucuugaccgggauccuaauucugccacagacagcgacggauccccgcugagcaacucucagcccuccuuuccuguggagauucuccccuuccuguaucuuggcugcgcuaaggauagcaccaaucuggacguccucgaagaguuugggaucaaguacauucugaacgugacgccuaaucugcccaaccucuucgagaaugccggagaauuuaaauauaagcaaaucccgauuucugaucacuggagccagaaccugucccaguucuuuccugaggcgaucucuuucauugacgaagcccgcggcaaaaauugcggcguucuugugcauugucuggcugggaucagcagauccgucaccgugacaguggccuaccucaugcagaagcugaaccuuagcaugaacgaugcuuaugacaucgucaaaaugaagaagucuaauauuucccccaacuucaauuuuaugggacaacugcucgauuucgagcggacccugggccugagcucuccuugcgacaaccgcguucccgcccagcagcucuacuuuacaacccccuccaaucagaacguguaccaaguggauagccugcaguccacguga

SEQ ID NO: 68608 - RNA, 1260 nt, Artificial Sequence
  derived and/or modified sequence opt5 from DUSP7__Homo_sapiens__NP_001938
augaagaaccagcugagagggcccccugcccgggcucacaugagcaccuccggggccgcggcugccggaggcacacgcgccgggucugagccgggagcuggcagcggguccggagccggcacgggcgcuggggccgcgaccggagccggcgcuaugcccugcaaaucugccgaauggcuccaagaggaacuggaggcuagagggggagccagccuucugcuccuggacugucggccucaugaacuuuucgaguccucucacaucgagacagcgauuaaucuggccauccccggccucaugcugcgcagacugcggaaggggaaccucccuauucgcagcaucauucccaaucaugcugauaaagaaagauuugccacccggugcaaggcugccacagugcugcuuuacgacgaggccaccgcugaauggcagccugagccgggagcgcccgccuccguccugggccuccugcuucagaaacugcgcgaugacggcugucaggcuuauuaccuccaagggggauucaacaaguuucagacagaguauagcgaacacugcgagaccaauguugauucuuccagcucuccuuccagcucucccccuacguccgugcugggccugggcggacucagaaucagcuccgacuguucugauggcgaaagcgaccgggagcugcccuccagcgccaccgaaucugauggguccccggugccuagcucucagcccgccuucccuguccagauccuucccuaccuguaucucggaugcgcuaaggacagcacaaaccuggaugugcuuggcaaauacggcauuaaguauauccugaauguuacccccaaccucccuaaugccuuugagcaugggggagaguucacauacaaacaaauuccgaucuccgaccacuggucucagaaccugagccaguuuuuccccgaagcgauuuccuuuaucgaugaggcucgcagcaagaaauguggcgugcugguccacugccucgccgggauuucuagauccgugaccguuacgguggccuaccugaugcagaagaugaaucuuagccugaacgacgcuuaugacuucgucaagcggaaaaagucuaauaucuccccuaacuuuaauuucaugggacaacuccuggauuuugaacgcacacuuggccugagcucccccugugacaaccaugccucuagcgagcagcucuacuucuccaccccuacaaaccacaaucuguucccccugaacacccucgaaucuaccuga

SEQ ID NO: 68609 - RNA, 1878 nt, Artificial Sequence
  derived and/or modified sequence opt5 from DUSP8__Homo_sapiens__XP_011518235
auggccggcgacagacugccccggaaggugauggaugcuaaaaagcucgccagccugcuucgcgggggaccuggcgggccgcuggucaucgacuccagaucuuucguugaguacaacagcuggcacgugcucuccucugugaauauuugcuguagcaaacuggucaagcggcgccuucagcaaggaaaagugaccaucgcggaacugauucagcccgcugccagaucccagguugaggccacagaaccucaggauguggucguguaugaccaaucuacgcgggaugcuagcguucucgccgcugacuccuuucugagcauccugcucucuaagcuggauggcugcuucgacuccguggccauucuuaccgggggauuugcgacauucagcucuuguuuucccggccugugcgagggcaagccugccgcucuccugcccaugucccuuagccagccuugucugccgguccccucuguggggcucacccgcauccugccucaucuguaccucggaucccagaaagaugugcugaacaaggaccuuaugacacagaauggcaucagcuauguccugaacgccuccaauucuugccccaaaccugauuucauuugugaaagcagauuuaugcggguucccaucaacgacaauuacugcgagaagcuccugccguggcuugauaaauccauugaguucaucgacaaggcuaagcugagcucuugucaagugauugugcacugccucgccgggaucucccgcagcgcgaccauugccaucgcuuauaucaugaaaacaaugggaaugucuagcgacgaugccuacagauuugucaaggaccggcgcccuuccauuucucccaacuucaauuuucugggccagcugcucgaauaugagagaagccugaaacuucuggcugcccuccagggggauccuggaacccccuccggcacgcccgaaccuccgcccagcccugccgcuggcgcgccccugccucggcuucccccgccuaccucugaguccgccgcuacagggaacgccgccgcucgcgagggaggccugagcgccgggggagaacccccugcgcccccuacacccccggcuaccucugcccuccagcaaggccugagagggcugcaucucuccagcgaccggcugcaggauaccaauagacuuaagcgcuccuucucucuggacaucaaaagcgccuacgcuccuucccggagacccgauggacccggcccuccggaccccggcgaggccccuaagcucuguaaacuggauucucccagcggggcugcccugggacuuuccagcccuucucccgacuccccugaugcggcccccgaagcucgcccgcggccuagacgccggcccagaccucccgccggcagcccggcucgcucuccugcccacucccucgggcugaacuuuggagacgcggcccggcagacgcccagacauggccugagcgcucucucugccccugggcugcccggccccggacaaccugcuggcccgggggccugggcucccccucuugacagccccggaacaccuucccccgauggcccuuggugcuucagcccggagggggcccagggagcgggcggggugcuguucgcccccuuuggccgcgcuggagccccuggccccgggggaggcucugaccuccggagacgggaagccgcucgcgccgagccuagagaugcgcggaccggguggcccgaggaaccggcuccugagacacaguucaagagacgcuccugccagauggaauuugaggaaggaaugguugagggccgggccagaggggaggaacuggccgcucugggcaagcaagccagcuucuccggaucuguggaggucauugaagugagcuga

SEQ ID NO: 68610 - RNA, 1248 nt, Artificial Sequence
  derived and/or modified sequence opt5 from DUSP9__Homo_sapiens__XP_011529425
auggaggccgcucaagugggccccaaggggagacaacugccuggaaaacacgucguugccccgguggugcagcgggucggcagccgcucccccauggaagggcucggaagaucuugccuguggcuucggcgcgagcugagcccucccagaccucggcuccugcuucuggacugucgcuccagagaacucuacgagucugcgcggaucggcggggcucugagcguggcccugcccgcccuccugcuucgcagacugcggcgcggaucccucucuguuagagcucugcuuccuggcccgccccugcagccucccccucccgccccggugcuccuguaugaucagggcgggggacggcgcagacggggcgaagcugaggccgaggcggaagagugggaagccgagagcguccuggggacccuccugcaaaaacuuagagaggaaggauaccuggcuuauuaccuccagggcggguucucccgcuuucaggccgagugcccucaucugugugaaacaagccuugcuggacgggccgggucuuccauggcgcccgugccuggccccguucccguggucggccugggaagccucugccugggcucugacuguuccgaugccgagagcgaagcugacagagauucuauguccugcgggcuggacagcgagggagccacgccuccgcccgugggccuccgcgcuuccuucccugugcagauucugcccaaccuuuaucuggggucugcccgggauagcgccaaucucgagucccuggcuaaacuuggaaucagauacauucugaacgucaccccuaaucuccccaacuuuuucgaaaagaauggcgacuuucacuauaaacaaaucccgauuagcgaucauuggucucagaaccugucccgcuucuuuccugaggcgaucgaguucaucgacgaagcccugagccagaauuguggcguucucgugcacugccuggcuggggugucucggagcgucacagugaccguugccuaccuuaugcagaagcugcaucucucccugaacgaugccuacgaccuggugaagagaaagaagucuaauauuagccccaacuuuaauuucaugggacaacuucucgauuuugaacgcucccugcggcuggaggagagacacagccaggaacagggcucugggggacaggcuuccgccgcgagcaacccucccucuuucuuuacaaccccuacauccgacggcgcuuucgagcucgcccccaccuga

SEQ ID NO: 68611 - RNA, 759 nt, Artificial Sequence
  derived and/or modified sequence opt5 from DUT__Homo_sapiens__NP_001020419
augacaccccugugcccuagaccggcccucuguuaccacuuccugaccagccuucugcgguccgcuaugcagaacgcccgcggcgcgagacaacgggcugaggccgccgugcucucugggcccggaccuccccugggccgcgcugcccagcaugggaucccuagaccccuuagcuccgcuggacggcugucucagggcugccgcggggccagcacggucggagcggccggcuggaagggcgaacucccuaaagcugggggauccccggcccccggcccugagacccccgcuauuucuccuagcaagagagcccggcccgcggaaguugggggaaugcagcugcgcuuugccagacuguccgagcacgcuacagccccgacccggggcagcgcucgcgccgccggguaugaccucuacucugcuuaugauuacacaaucccucccauggaaaaagcgguggugaagaccgacauucaaaucgcccugccuuccggauguuauggcagagucgcuccccggagcggccuugccgccaaacauuucauugaugugggggcuggaguuaucgacgaggauuaccgcggcaaugugggggucgugcuguuuaacuucggaaaggagaaguuugaaguuaaaaagggcgacagaaucgcccagcucauuugcgagcggaucuucuaucccgaaauugaggaggugcaggcgcuggaugacacagaaagagggucuggaggcuuuggcuccaccgggaaaaauuga

SEQ ID NO: 68612 - RNA, 483 nt, Artificial Sequence
  derived and/or modified sequence opt5 from DUX4__Homo_sapiens__XP_011529816
auggcccugcccaccccuagcgacuccacacucccggcugaggccagaggccgggggcgcagacggcgccugguguggacgcccucucagagcgaagcgcuuagagcuugcuucgagcggaacccuuaccccggaaucgccacccgcgaaagacuggcccaagcuauuggcaucccugagccccggguccagauuugguuucagaaugaacgcuccagacagcuccggcaacaccgcagagagucucggccuuggccggggcgcagaggacccccugagggccggagaaagcgcacagccguuaccgggagccagacagcucugcuucugcgggccuucgaaaaagauagauuucccggaaucgcggcccgcgaggaacucgcucgggagaccggccugccugagucccgcauucagaucugguuccagaacagacgggccagacaucccggccaagggggacgcgcuccggcccagguguga

SEQ ID NO: 68613 - RNA, 2211 nt, Artificial Sequence
  derived and/or modified sequence opt5 from DVL2__Homo_sapiens__NP_004413
auggccggcagcuccaccgggggaggcggggugggagagacaaaggucaucuaccaccuggacgaagaggaaacgcccuaucucguuaaaauuccugugccggcugagagaaucacccugggcgauuucaagucugugcuucagcggcccgccggggcgaaauacuuuuucaagagcauggaccaagauuuuggagucgugaaagaagagauuuccgacgauaacgcucgccugccuugcuucaauggcagaguugugucuuggcucgucagcuccgacaacccccagccugagauggccccucccgugcaugaaccgcgggccgagcuggcucccccugcucccccucuucccccgcugccucccgaacgcacaucuggcaucggggauagcagaccucccuccuuucaccccaauguuucuagcucccaugagaaccucgagccugaaaccgagacagaaagcguggucucucugcggcgcgagagaccgcggcgcagagacuccagcgaacacggagccggcgggcaucggaccggaggccccucucgccuggagagacaccucgccggguaugaguccagcuccacacugaugaccucugaacuugagagcacgucccugggagauagcgacgaagaggauaccaugucucgguucuccagcucuacagaacagagcuccgcgucucgccuccugaagagacaccggagacgccggaagcagagaccuccccgccuugagcggaccagcuccuuuagcucugugacagacuccaccaugagccugaauauuaucacggugacacucaacauggagaaauacaauuuccugggcaucucuauugucggccaauccaacgaaagaggggauggaggcaucuauauugggagcaucaugaagggaggcgccguugcugccgacgggcgcauugagccuggagacaugcugcuccaggugaaugauaugaacuuugaaaauauguccaacgacgaugcugugcggguccugagagacaucgugcauaaacccggcccgauuguucuuaccguggccaaguguugggauccuucuccccaggcguacuucacacugccucgcaaugagcccauccagccuaucgaccccgccgcuugggucagccacuccgccgcucucaccggcaccuuuccggccuauccugggucuagcuccaugagcacaauuacgucuggauccagccugcccgauggcugcgaagggcggggacuuucugugcauaccgacauggccuccguuacaaaagcuauggcggcccccgagagcggccuggaggugagagaucgcauguggcucaagaucaccauuccuaacgcuuuccuggggucugacgucguggauuggcuguaccaccacgucgaaggcuuuccggagcggagagaagcccggaaguacgccagcggacuccugaaagcuggccuuauccgccauacagugaauaagauuaccuucuccgagcaauguuauuacguuuucggggaccugagcggaggcugcgagucuuaucucgugaaccugucccuuaacgacaaugaugggagcuccggagccucugaccaggauacgcuggcgccccucccuggcgcuacacccuggccucugcugcccaccuuuagcuaccaguauccugcuccccacccguacuccccucagcccccucccuaucaugaacucucuagcuacaccuacgggggcggauccgccucuagccaacacuccgagggcagcagaucuuccgggagcacacggucugacggaggcgccgggagaaccggacgcccggaggaacgggccccugaauccaaaagcggcucuggguccgagagcgagcccuccagcagaggcggaucucugcgcagaggcggggaagcuagcggaacauccgauggcgggccuccucccucucggggaagcacgggcggggcccccaaccuucgcgcgcauccgggccugcaccccuauggaccucccccuggcauggcccuccccuacaauccuaugauggucgugaugaugccgcccccucccccucccguuccgccugcugugcagccucccggggccccucccgucagagaccugggauccgugcccccggagcugaccgcuucucggcagagcuuccacauggccaugggcaaccccuccgaauuuuucguggauguuauguga

SEQ ID NO: 68614 - RNA, 2151 nt, Artificial Sequence
  derived and/or modified sequence opt5 from DVL3__Homo_sapiens__NP_004414
augggcgagaccaagaucauuuaccaccuggacgggcaggaaacacccuaucucgugaaacugccucuuccggccgagagagucacgcuggcugauuucaagggaguucuccaacggcccagcuacaaauuuuucuuuaaguccauggacgaugacuucggcguggugaaagaagagaucucugaugacaacgccaagcugccuugcuuuaaugggcgcgucgugagcuggcuuguuuccgcggaaggaucucaucccgauccugcucccuucugugccgacaacccuagcgagcugccgcccccuauggagagaaccggcgggauuggagauucccggcccccuucuuuucacccccaugccggcggcgggagccaggaaaaucucgacaacgauacagagaccgacucccuggugagcgcucagcgcgaaagaccgcggcgcagagauggaccugagcacgccacacggcugaauggcaccgcuaagggggagcgcagacgggaacccggaggcuaugacucuuccagcacacucaugucuuccgagcuggaaaccacgagcuucuuugacucugaugaggacgauuccaccagccgcuucuccucuagcacagaacaguccagcgccucuagacuuaugcggcgccauaaaagacggagacgcaagcaaaaagucucccggaucgagagaagcucuagcuuuuccucuauuaccgacagcacaaugucccugaacaucaucaccgugacgcucaauauggagaaguacaacuuccuggggauuagcaucguuggacagucuaaugaacgcggcgauggcgggauuuauaucggauccauuaugaaaggcggggcgguggccgcugacggacggaucgagccuggcgauaugcuucugcaggucaacgaaauuaauuuugagaacaugagcaaugacgaugccgugagagugcuccgcgaaaucguccacaagcccgggcccaucacacugaccguugcuaagugcugggacccuucuccgcggggauguuucacacugcccagauccgagccuauucgccccaucgauccugccgcgugggugagccacaccgccgcuaugaccggcacauuccccgccuacggcauguccccgucucucagcacgauuaccuccacaucuagcuccaucaccagcucuauuccugacacagagcggcuggacgauuuucaucuuuccauccacagcgacauggcugccaucgugaaagccauggcuucucccgaauccgggcuggaggucagagaucgcauguggcucaagauuaccaucccuaacgcguucauuggaagcgacgugguugauuggcuguaucauaauguggaaggcuuuacggaccggagagaggcccggaaauacgcuucuaaccuucugaaggccggguucauccgccacacagucaacaaaauuaccuuuagcgaacagugcuacuauaucuucggagaucucuguggcaauauggccaaccugucccugcacgaccaugaugggagcucuggcgcuuccgaccaagauacccucgcgccccugccucaccccggagccgcuccguggccuauggccuuucccuaccaguaucccccuccgccccauccuuacaauccccacccuggcuuccccgagcuuggguauagcuacggaggcggguccgccucuagccagcauuccgagggaucuagaagcuccggcucuaaccggagcggguccgacagacgcaaggaaaaagauccuaaggcuggcgacagcaagucuggaggcuccgggagcgagucugaccacacaacccgguccagccugagaggaccccgcgaaagagccccgucugagcgguccggcccugcugccagcgagcacucccaucgcagccaccauucucucgcgagcucccugagaucucaccacacacaucccagcuaugggccucccggagugccgccucuuuacggcccucccaugcugaugaugcccccucccccggccgcuauggggcccccuggcgcucccccuggacgggaucucgccuccguucccccugaacugacggccucucgccagagcuuuagaauggcgaugggcaauccguccgaguucuuuguggacgucauguga

SEQ ID NO: 68615 - RNA, 1191 nt, Artificial Sequence
  derived and/or modified sequence opt5 from DXO__Homo_sapiens__XP_006715068
auggaccccagaggcaccaagcgcggggccgagaaaacagaaguggcugagccucggaacaagcugccgagacccgccccuagccuccccacggauccugcgcuguacuccggacccuucccuuuuuaucggcgcccgucugaacuuggcugcuucagccuggacgcucagagacaauaccacggggaugcccgggcccuccgcuauuacucucccccucccaccaauggaccuggccccaacuuugaccugagagauggguauccggaccgguaccagccucgcgaugaggaaguccaggagagacuugaccaucugcucuguuggcugcuggagcaccggggacgccucgaaggcggccccggguggcuggcugaggccaucguuacauggagaggacaucuuaccaaacugcucacaaccccuuaugaacggcaggagggcuggcaacuggcugccucccgcuuccaggggacacuuuaccugagcgagguggaaacccccaaugcgagagcccagcggcucgcuagacccccucugcugcgcgagcucauguacaugggauauaaguuugaacaguacaugugcgccgauaaaccgggcuccucucccgacccuagcggggaggugaacacgaaugucgcuuucuguuccgugcugcggagcagacuuggaucucacccccugcucuuuuccggcgaaguugauugcaccgacccucaagcccccagcacacagccgccuaccuguuauguggagcugaagacaucuaaggagaugcauucccccggccaguggcgcagcuucuaccggcacaaacuucugaaguggugggcgcagucuuuucucccugggguccccaacgugguugccggauucagaaauccugauggcuuuguguccagccugaaaaccuuccccacgaugaagauguuugaauauguccgcaacgaccgggacggguggaauccguccgugugcaugaacuucugugcugccuuccugucuuuugcucaaagcacagugguccaggaugacccuagacucguucaccuguucuccugggagcccggaggccccgugaccgugagcguccaucaggaugccccuuacgccuuucuuccgauuugguauguggaagcuaugacacaagaccugcccucuccucccaaaaccccuucccccaaguga

SEQ ID NO: 68616 - RNA, 2010 nt, Artificial Sequence
  derived and/or modified sequence opt5 from DYM__Homo_sapiens__NP_060123
augggcagcaacuccucuagaaucggggaccugcccaagaaugaguaccucaaaaagcugagcggaaccgaauccauuucugagaacgauccuuucuggaaucagcuucugagcuuuuccuucccggcccccacaucuagcuccgaacucaaacugcuugaggaagcuacgaucagcgugugccggucucuggucgagaacaauccucgcaccggcaaccucggggcccugauuaagguuuuucuguccagaacaaaagagcucaagcugagcgcggaaugucaaaaucacaucuucauuuggcagacccauaacgcucuuuuuaucaucugcugucugcucaagguguucauuugccagaugucugaggaagaacugcagcuucacuuuacauaugaggaaaaaucccccggaaauuacagcucugacuccgaggaucugcucgaggagcugcuguguugccucaugcaacugaucaccgacauuccucuucuggauaucacauaugaaauuagcguggaggccaucuccaccauggucguguuccucucuugucagcuguuucauaaggagguucuucggcagagcauuucccacaaauaccugaugcgcggccccugccucccuuauacgagcaagcuggugaaaacccugcucuacaacuucaucagacaggaaaagccgcccccucccggggcccaugucuuuccucaacagucugacggaggcggccugcuuuaugggcuggcuuccggaguggccacaggccucuggaccguuuucacacucgggggagugggcagcaaggcugccgcgucucccgagcuuagcuccccgcuggccaaucagucucuccugcugcuccugguccuugcuaaccugaccgaugccagcgacgcuccuaaucccuaccggcaggccaucauguccuuuaaaaacacgcaagauagcucuccuuuccccuccagcauuccccacgcguuccagaucaauuuuaacucucucuacacagcccugugugaacagcaaaccuccgaccaggcuacacugcuucucuauacccugcugcaccagaacagcaauauucgcaccuacaugcucgccagaacagauauggagaaccuggugcuuccuauccuggaaauucucuaucauguggaggagcgcaauucccaccaugucuacauggcucugaucauccugcuuauucucacggaagacgauggguucaaccggucuauccacgagguuauucugaagaauaucaccugguauagcgaaagagugcugacagagauuucccucggaucucugcuuauccugguggucauccggaccauucaguacaacaugacacgcaccagagacaaauaucuccacacgaauugccuggccgcccuggcuaacaugagcgcgcaauuucggucccuucaucaguacgccgcucagcgcaucauuagccucuucucucugcuguccaagaaacacaauaaggugcucgaacaggccacacaaagccugagaggcucucuuuccagcaacgacguuccgcugcccgauuacgcccaggaccucaaugugaucgaggaggucauucggaugaugcuggaaaucauuaacucuugucugaccaauagccuucaucacaacccuaaucucguguaugcucugcuguacaaaagagaucucuuugagcaguuccgcacccaucccuccuuucaggacaucaugcaaaacaucgaucugguuauuagcuucuuuucuucccggcuucugcaggccggcgcggaacucagcguggagagaguccuggagaucauuaagcaggggguggucgcucugccuaaggaccgccuuaaaaaguuccccgaacugaaauuuaaguauguggaggaggaacagccggaagaguucuuuaucccuuacguuuggucccucguguauaacucugccgucggacuguacuggaauccccaagauauucagcuguucacaauggacagcgauuga

SEQ ID NO: 68617 - RNA, 633 nt, Artificial Sequence
  derived and/or modified sequence opt5 from DYNAP__Homo_sapiens__NP_775900
augguggccgacaucaagggcaacgagcagauugaaaaauacagcuggagagaggcuugcgauaccggguccucucggauggaccgcaagcacggaaaauauauccugaaugucgaacauagcgagaaccaacccccuauuacacacccgaaugaucaggaagcccauuccucuaucuguuggugccuccccagcaacgacauuacguccgauguuucuccuaaucugaccggcgugugugugaaccccgggauccuugcgcacagcagaugccugcaguccgagagcuguaauacacaggucaaggaguacugccggaacgacuggucuauguggaaaguguuccucgcuugucugcuugccugcguuaucaugaccgccauuggagugcugaucauuugucucgucaauaacaagggcuccgcuaauagcucuaucgugauucaacuguccacaaacgauggggaaugcguuaccgugaagccuggaacacccagcccugccuguccgcccaccaugacgaccacaucuaccgucccugcuuccacagccaccgagagcacgacauccaccgcgacagccgcuaccaccucuacagaacccaucacgguggccccuaccgaccaucuguga

SEQ ID NO: 68618 - RNA, 13941 nt, Artificial Sequence
  derived and/or modified sequence opt5 from DYNC1H1__Homo_sapiens__NP_001367
augagcgaacccggagggggaggcggggaagacggauccgccggccuggaagugucugcugugcagaacguugccgaugugagcgugcuccaaaagcaccugagaaaacuugucccucugcuccuggaagacgggggagaggcgccggcugcccuugaagccgcucuggaggagaaguccgcccucgaacagaugcggaaguuccugucugauccccaggugcacacaguucugguggagcgcagcacacucaaggaagacgucggcgaugagggcgaggaagagaaagaauuuaucuccuacaacauuaacaucgacauucacuauggggugaagucuaauagccuggcuuucaucaagagaacgccuguuauugaugccgacaaacccguguccagccagcuucggguccugacccucucugaggauuccccuuacgaaacacugcacagcuuuaucucuaacgcgguggcccccuucuuuaaguccuauauccgcgagagcggaaaagcugacagagauggcgacaagauggccccuucuguggagaaaaagauugcugaacuugagauggggcugcuccaucugcagcagaauaucgaaauuccggagaucucccugcccauucacccuaugaucaccaacgucgccaagcagugcuacgaacggggagagaaacccaagguuacagauuucggcgacaaaguggaggacccuaccuuucucaaucagcugcaaagcggggugaaccgcuggauuagagaaauccagaaggucacaaaacuugaucgggaccccgcguccggaaccgcccugcaggagaucucuuucuggcucaaucuggaacgcgcucuuuaucgcauucaggagaagcgggaaagcccggaggugcugcucacgcuggauauccugaaacacggcaagcgcuuucacgccaccguuuccuucgacacagauaccggccucaagcaagcucuggagacagugaacgacuacaauccucuuaugaaagauuuuccccugaacgaccuccugagcgccaccgaacuugauaagauuagacaggcccuggucgcuaucuucacgcaucuccggaaaauucgcaauacaaaguauccuauccagagagcgcugcggcugguggaggccaucucuagagaccucuccagccaacugcuuaaaguucuggggacccgcaagcucaugcacguggcuuacgaagaguuugagaaggucaugguggccuguuucgaagucuuccagacaugggaugacgaguacgaaaaacuccaggugcugcuucgggacauuguuaagagaaaacgcgaggaaaaccucaagaugguguggcggaucaaucccgcccauagaaaacugcaggcucgccuggaucaaaugcggaaguuuagacgccagcacgagcagcuccgggccgucauugugagaguucugcgcccccaggugaccgcggucgcucaacagaaccagggagaggugccugaaccgcaggacaugaagguggccgagguucuuuucgaugccgcugacgccaacgcuaucgaagaggucaaucuggccuaugaaaacgugaaagagguggauggccucgacgucucuaaggaggggaccgaagcgugggaggccgcuaugaaacgguacgaugaaagaauugaccggguggagacacgcaucacggccagacugcgggaucaacugggaaccgcuaagaaugccaacgaaauguuuagaaucuucagccgcuuuaaugcgcuuuucguucggccccacauuagaggcgccauccgcgaguaucagacacagcucauucagagagugaaagacgauaucgagucccugcaugacaaguuuaagguccaauacccucagucucaggcuugcaaaaugagccacgugcgggaucugcccccuguuuccgggagcauuaucugggccaagcaaauugaccgccagcucaccgcuuauaugaaaagaguggaagacguccugggaaagggcugggagaaccauguggaaggccagaaacuuaagcaggauggggacucuuuccggaugaaacugaauacacaagagaucuuugaugacugggcccgcaagguucagcagagaaaccucggaguguccggccggaucuucaccauugagagcacgcgcgucagagggcggacaggaaaugugcugaagcugaaagugaacuuucuucccgaaaucauuacccucucuaaggagguccgcaaucugaaauggcugggcuucagaguuccgcucgccaucgugaacaaggcucaccaggcgaaucaacuguacccuuuugccauuucccuuaucgaaagcgugcggaccuaugagagaacaugugaaaaagucgaggagcgcaacaccaucucccugcucguggcugggcugaagaaggaaguucaggcccugauugccgagggcaucgcucuugugugggaaucuuacaaacucgaucccuacguccagcggcuggccgagacaguguucaauuuccaggaaaagguugacgaucugcucauuaucgaggagaaaauugaccuggaagugagaagccuugagacgugcauguaugaucauaagaccuuuuccgaaauccugaaccgcguccaaaaagcgguggacgaucucaaccugcacucuuacagcaaucugccuaucuggguuaacaaacuugacauggagauugaacggauccugggagugagacuccaggcuggccugcgcgccuggacacagguccuccuggggcaagccgaggauaaggcugagguggacauggacaccgaugcgccccaggugucccacaaaccuggaggcgaacccaagauuaaaaaugucguucaugagcuucggaucacaaaccaggugauuuaucugaauccgccuaucgaagaguguagauacaagcucuaucaggagauguucgcguggaaaauggugguccugagccugccccgcauccaaucucagcgguaccagguggggguucacuaugaacuuaccgaggaagagaaguuuuacagaaacgcucugacgcggaugcccgacggaccuguggcccucgaagaguccuacagcgccgucaugggcauugugucugagguugaacaguaugugaaggucuggcugcaauaccagugccucugggauaugcaggcugagaauaucuauaaccgccugggggaagaccuuaauaaauggcaggcccugcucgugcaaauuagaaaggcucggggcaccuucgauaacgccgagaccaagaaggaauuuggaccggucgugaucgacuacggcaaaguucaguccaaggugaaucugaaauaugauagcuggcauaaggagguccugucuaaguucgggcagaugcuuggaagcaacaugaccgaguuucacucccagauuagcaaaucucgccaagaacuggagcagcacuccguggacacagcgagcaccuccgaugccguuacguucaucacauacgugcagucucucaagagaaaaauuaagcaauuugaaaaacaggucgagcuguaucggaauggccagagacuccuggaaaagcagcgcuuccaauuucccccuagcuggcuuuacaucgacaacaucgagggggaguggggagcuuucaaugauauuaugcggagaaaggacuccgccauccagcaacagguggcuaaccugcaaaugaaaauugugcaggaagaccgcgccguugagucucggaccacagaucugcucaccgacugggaaaagaccaaacccgucacaggcaaccugagaccugaggaggcccuucaggcucugacgaucuacgaagggaaguuuggccgccucaaagaugaccgggagaagugugcgaaggccaaagaagcucuggagcucaccgauacaggacugcuuagcggcuccgaagagagaguccagguggcccuggaggaacugcaagaccucaagggggucuggucugagcugagcaaagugugggaacagauugaucagaugaaggagcaacccuggguuuccgugcagccucgcaaacuuagacagaaucuggacgcccuccugaaccagcucaagagcuuccccgcucggcugcgccaauaugccucuuacgaguucguccagagacuucugaagggauauaugaaaaucaauaugcuggugaucgagcucaaguccgaggcgcugaaagaucggcauuggaagcagcuuaugaaacgccugcacguuaacuggguggucagcgaacucacccugggccagauuugggacguggaucuccaaaagaaugaggcuaucguuaaggacgugcugcuugucgcccagggggaaauggcccuggaggaauuucugaaacagauuagagagguguggaacacauacgagcucgaucuggugaauuaucagaacaagugccggcuuaucagaggaugggacgaccuguucaauaaagucaaggaacauauuaacucuguuuccgcuaugaaacucagcccguacuauaagguguuugaggaagaugcccugucuugggaggacaaacugaaucgcaucauggcccuguucgauguguggaucgacguccaacggagauggguguaccuugagggcauuuuuaccggguccgcugauaucaagcaucugcugccuguugaaacgcagcgcuuccagagcauuuccacagaguuucucgcccugaugaagaaagugagcaagucuccccuugucauggacgugcugaacauccagggcguucaacggagccucgaaagacuggccgaucugcucggaaaaauucagaaggcucuuggcgaguaccuggaacgggagcgcuccucuuucccuagauuuuauuucgugggggacgaggaucugcucgaaaucauuggaaauagcaaaaacgucgccaagcugcagaagcauuuuaaaaagauguucgcuggcguguccucuaucauccuuaaugaggacaacagcgucgugcuggggauuuccucucgggaaggagaggaaguuauguucaaaacccccgugagcaucaccgagcacccgaagauuaacgaguggcucacacugguggaaaaagagaugcgcgucacccuggccaagcuccuugcggaauccguuacagagguggaaaucuuuggcaaggccacgagcauugauccuaauaccuacaucacauggaucgacaaauaucaagcucagcuggugguccugucugcccagauugcuugguccgagaacguggagaccgcccucagcucuaugggcgggggaggcgaugccgcuccccugcacuccguucuuagcaauguggaagucacacugaacgugcucgcggacuccguccugauggagcagccuccccugagacggcgcaagcucgaacaucuuaucaccgagcuggugcaccaaagagacguuacgcggucucugauuaaaagcaagaucgauaaugccaaauccuucgaguggcucagccagaugcgcuuuuacuucgaccccaagcagaccgaugugcugcagcaacuuucuauucagauggcuaacgccaaguuuaauuauggguucgaauaccugggaguccaggacaaacucgugcagacaccucugaccgauagauguuaucugacaaugacccaagcccucgaggcucggcuuggcggguccccguuuggacccgccggcacaggcaagaccgaaagcguuaaagcgcuggggcaucagcugggaagauucgugcucgucuuuaacugcgacgagacguucgauuuucaggcuaugggccgcaucuucguggggcugugucaagugggagccuggggcugcuuugacgaguucaaucggcuugaggagagaaugcugucugccguuagccagcagguccagugcauccaagaagcucuccgcgagcacuccaacccuaauuacgauaagacaucugcccccauuaccugugaacugcugaacaaacaggugaaggugagcccugacauggcgaucuucauuaccaugaaucccggguacgccggacgguccaaccucccugauaaucuuaaaaagcuguuuagaucucuggcuaugacaaagccggaccgccagcucaucgcccaggucaugcuguauagccaaggcuuccggaccgcugagguucuugccaacaaaauugugcccuuuuucaagcugugcgacgaacagcucuccagccagucucauuacgauuuuggccugagagcucugaaauccgugcucgucagcgccgggaaugugaagcgcgagcggauccagaaaauuaagagagagaaggaagaaagaggagaagcgguugacgagggcgaaaucgccgagaaccuuccugagcaagaaauccugauucaguccgugugugagacgaugguccccaaacugguggcugaagauaucccucuccuguucucucuucugagcgacguuuuucccggggugcaguaucaccggggagagaugacagcccucagagaggaacugaagaaagucugccaagagauguaccugaccuauggcgauggggaagaggugggaggcauguggguggaaaagguccuccagcuuuaccagauuacacagaucaaccacggccugaugaugguugggccguccggaucuggcaaaagcauggcuuggcgcgugcugcucaaggcccuggagagacuugaggggguggaaggagucgcccauauuaucgacccuaaggcuaucuccaaagaucaccuguauggcacccucgaccccaauacacgggaguggaccgaugggcuguucacgcaugugcugcgcaagauuaucgacagcguuagaggagaacuccaaaaacggcaguggauuguguuugauggcgacgucgaucccgaguggguggaaaaccuuaauucuguucuggacgacaacaagcugcucacccugccuaauggcgagagacuuucccugcccccuaacgugcggaucauguucgagguccaggaucucaaauacgcgacacuggccaccgugagccgcugugggaugguuugguuuucugaagacgugcuguccacagauaugauuuucaauaacuuucucgcuagacugcggagcaucccgcuugacgagggagaagaugaggcccagcgcagacggaagggcaaggaagacgagggggaggaagccgcuucucccaugcugcaaauccagcgcgaugccgcgaccauuaugcagccuuacuucacgagcaauggacucgucacaaaagcccuggagcacgcuuuccagcuugaacacaucauggaccugaccagacuccggugccugggcucccuguuuucuaugcuccaucaagccugucgcaacguggcucaguauaaugccaaccaccccgauuucccuaugcagauugagcagcuggagagauacauccaacgguaucuugucuacgcgauucuguggagccucuccggggacagccgccugaagaugagagccgaacuuggagaguauauccggcgcauuacaaccgugccccugccgaccgcuccuaauauccccaucauugauuacgaaguuuccaucucuggcgaguggagcccuuggcaggccaaagugccccagauugaagucgagacacauaagguggcugccccugacgugguugugcccacgcucgacaccgucagacacgaggcucugcuguauacauggcucgccgaacauaaaccgcuggugcuuugcggcccucccggguccggaaagaccaugacacuguuuucugcgcuccgggcccugcccgauauggagguugugggccuuaacuucagcuccgcuaccacgccugaacugcuccugaaaacauuugaccacuacugugaguacagacgcaccccgaauggggucgugcuggcccccguccaacucggaaaguggcuggugcuuuucugcgaugaaaucaaccugccugacauggauaaguauggcacccagcggguuauuucuuuuaucagacagaugguggagcacgggggauucuaccgcacaagcgaccagaccugggucaaacucgagcggauccaauuugugggcgcuuguaaucccccuacagaucccggcagaaagccucugucccaucgcuuccuucggcacguuccgguggucuauguggacuaccccgggccugccagccugacgcagauuuauggaaccuuuaauagagccaugcuccgccugauccccucucugcggacauacgcggaaccucucaccgcugccaugguggaguucuauacaaugucccaggaaagauuuacccaggauacgcaaccccauuacauuuacagcccgcgcgagaugacccgguggguuagaggcaucuucgaagcucugcggccucuugagacacugcccgucgaggggcucauuagaaucugggcccacgaagcccugcgccuuuuccaggaccggcugguggaggaugaagagagacgcuggaccgacgagaacaucgauacaguggcucucaaacacuuucccaauauugacagagaaaaggccaugucucggccuauccuguauuccaacuggcugagcaaagacuacauucccgucgaucaggaggaacuccgcgacuaugugaaggcgagacugaagguuuucuacgaggaagaacuugaugugccucugguccucuuuaaugaggugcuggaccauguucuucggaucgaucgcauuuucagacagccgcaaggacaucugcuccugaucggcgugucuggggccggcaaaaccacacugucccgguuugucgcuuggaugaacggacucagcguguaucagauuaagguucaucgcaaauacacgggcgaagacuucgaugaggaccugagaaccgugcuucggcgcuccgggugcaagaaugagaagaucgccuuuaucauggaugagagcaacguccuggacucuggauuccucgaaagaaugaauacacugcuugcuaacggcgaggugcccgggcuguuugagggagaugaauaugccacccucaugacccagugcaaggagggcgcgcaaaaggaagggcugaugcuggacagccacgaggaacuuuacaaaugguucacaucccaggugauucggaaucugcaugucguuuuuacgaugaacccuucuagcgagggccucaaggaucgcgccgcuaccucccccgcccuguucaauagaugugugcucaacugguuuggagacuggucuacagaggcucuguaccaggugggcaaagaguucaccagcaagauggaccuugagaaaccuaauuauaucguccccgauuacaugccggugguuuaugacaagcugccucagcccccuucccaccgggaagccauugugaacucuugcgucuucgugcaccaaacacugcaucaggcuaacgccagacucgcgaagcgcgggggacggaccauggccaucacgcccagacacuaccuggauuuuauuaaucauuaugcuaaccuuuuccacgagaaacgcagcgagcuggaagaacagcagaugcaccucaauguuggccugcggaagaucaaagaaacaguggaccaagucgaggaacucagacgcgaucugcggaucaagucccaggagcuggaggugaaaaacgccgcugccaaugacaaacuuaagaaaauggucaaggaucagcaggaagccgagaaaaagaaagugaugagccaagaaauucaggagcagcugcauaagcagcaagaaguuaucgcggacaaacagaugucugugaaggaggaucucgacaaggucgagccugcugugauugaagcccagaacgccguuaaauccaucaagaaacaacaccugguggaggucagaagcauggcuaaucccccggccgcugugaaacuugcccuggaaucuauuugucuccugcucggggaguccaccaccgauuggaaacagauccgcagcaucauuaugcgggaaaacuuuaucccuacaauugugaauuucuccgcggaggagaucucugacgccauuagagaaaagaugaagaaaaacuacaugagcaaucccuccuauaacuacgagaucguuaaucgggcuagccuggccugcggacccauggucaagugggcuaucgcccagcugaacuacgcggacaugcuuaaacgcguggaaccucugagaaaugagcuccagaagcuggaggaugacgccaaagauaaccaacagaaggcuaacgaaguggagcagaugauucgggaccuugaagccucuaucgcucgcuauaaggaggaauacgccguccugauuuccgaggcucaggccaucaaagcggaucucgccgcuguggaggccaagguuaauagaagcaccgcccugcugaaaucucucagcgcugaacgggagagaugggaaaagacauccgagaccuuuaaaaaccaaaugucuacgauugccggcgacugucugcuuagcgcggcuuucaucgccuaugccggguacuuugaucagcagaugcgccagaaucuguucacaaccuggucccaucaccuccaacaggcuaacauucaguuucggacagacaucgccagaaccgaauaucugucuaaugcugaugagcgccuucgguggcaagccagcucccugccggcggacgaucucugcacggagaacgccaucaugcugaagagauucaaucgcuacccccugauuaucgacccuagcggccaggcuaccgaauuuauuaugaacgaguauaaggauagaaaaaucacacggaccucuuuccucgacgacgccuuucgcaagaaucuggaauccgcucuuagauucggaaacccccugcucgugcaggaugucgagagcuacgacccugugcugaaucccguucuuaaccgggaagugcgcagaacaggcgggcggguccugauuacccucggagaucaggacaucgaucuguccccuucuuucgugaucuuucugagcacacgcgaccccaccguggaguucccgccugaucucuguuccagaguuacguuugucaauuucacagugacccggucuagccugcaaucccagugccuuaacgaggugcugaaagccgaaagacccgacgucgaugagaagcgcagcgaccuccugaaacuucagggcgaauuucagcugcggcucagacaacuggagaagucucugcuccaggcgcugaaugagguuaaagggcgcauucuugaugacgauaccaucauuacaacccuggaaaaccucaagcgggaggccgcugaagugacaagaaagguggaggaaacggacaucgucaugcaggagguggagaccguuucccagcaauaccugccucuuagcacagccuguucuuccauuuauuucaccauggaaagccugaaacagauccauuuucucuaccaguauucucugcaauucuuucuggacaucuaccacaacgugcucuaugagaaucccaaccugaagggagucacagaucacacccagcgccuuuccauuaucacgaaagaccuguuccagguggcuuuuaaucggguugccagaggcaugcuccaucaggaucacauuaccuucgccaugcugcuugcucggaucaagcugaaaggcacagugggggaaccgaccuacgacgcggaguuucaacauuuccuccgcggaaacgaaauuguccugagcgccggcucuacaccuagaauccaggggcugaccguggagcaggcugaggccgugguccggcucagcugccugcccgccuucaaggaucuuauugcuaagguucaggccgacgaacaauuuggaaucuggcuggauuccagcucccccgagcagacggugccuuaucucuggucugaagagacacccgcgaccccuaucggccaggcuauucaccgccugcugcucauccaggccuucagaccggaccggcuucuggccauggcucauauguuugugagcacaaaucugggggaauccuucaugucuauuauggagcaaccccucgaucugacccacaucgucggaaccgagguuaaaccuaacacacccgugcuuauguguagcgugccuggcuacgacgccuccggccacgucgaagaucuggcugccgagcagaauacgcagauuaccucuaucgcgaucgggagcgccgaaggauuuaaccaggcugacaaggccauuaauacagcugugaaauccggccgcuggguuaugcucaagaacgugcaucuggcccccggguggcugaugcaacuugagaaaaagcuccacagccugcagccucaugcgugcuucagacuguuucucaccauggagaucaauccgaagguccccgugaaccugcuucgggccggaagaauuuucguuuuugaaccucccccuggcgugaaagcuaauaugcugcgcacauucucuuccauccccgucagccggauuugcaagucuccgaacgagagagcccgccucuacuuucugcuggcuugguuccacgccaucauccaggaacggcuuagauaugccccucucgggugguccaaaaaguacgaguucggagaaagcgaccugcgcucugcuugugauaccguggacacguggcuggaugacacagcgaaaggccggcaaaauauuucccccgauaagauccccuggagcgcccucaagacccugauggcucagucuauuuauggcgggagagucgacaacgaguuugaucagcgccuucugaacaccuuccucgagcggcuguuuacaaccagauccuucgacagcgaauuuaaacuggccugcaagguggauggacacaaagacauccagaugccugauggcauucgcagagaggaguucguucaauggguggagcuucuccccgacacacagacgccuagcuggcuggggcugccgaauaacgccgaacggguccuccugaccacacagggaguggauaugaucuccaagaugcuuaaaaugcagaugcuggaggacgaggacgaucucgcuuacgccgaaaccgagaagaaaacacgcaccgacucuacgagcgauggcagacccgcguggaugcggacccugcauacaaccgcuuccaauuggcugcaccuuauuccucaaacacucucucaucugaagagaaccguggaaaacaucaaggacccccuguuucgcuucuuugagcgggaaguuaaaaugggggccaagcuccugcaggaugucagacaggaccuugccgauguggugcagguuugugagggcaagaagaaacaaacaaauuaucugcggacccucaucaacgagcuggucaagggcauucugccucgcagcuggucccacuacacggugcccgcuggcaugacagugauccagugggucucugacuucagcgaaagaauuaagcagcuucaaaauaucucccucgccgcugccagcgggggagcgaaagagcugaagaacauucaugugugccugggcgggcucuuuguuccggaagccuauaucaccgcuacccggcaguacguggcccaggcuaauucuuggucccuggaggagcuuugucuggaagucaacgugacaacgagccagggagccacccucgaugcgugcucuuucggcguuacagggcugaaacugcaaggagccaccuguaauaacaauaaacuuucccucagcaacgcuaucuccacagcccugccucugacccagcuccgcugggugaaacagacaaauaccgagaagaaggcuucugucgugacgcugcccguguaccuuaacuuuaccagagccgaccugauuuucacaguugauuucgaaaucgccaccaaagaggacccucggagcuuuuaugaacgcggcgucgcugugcucugcacagaguga

SEQ ID NO: 68619 - RNA, 1827 nt, Artificial Sequence
  derived and/or modified sequence opt5 from DYNC1I1__Homo_sapiens__NP_001129029
augagcgacaaguccgaucugaaagccgagcucgaaagaaagaaacagcggcuggcucaaauccgcgaggaaaagaaaagaaaggaggaggaacggaagaaaaaggaggccgacaugcagcagaaaaaggaacccgugcaggaugacucugaucuugaccgcaaaagacgggagaccgaagcgcugcuccaaagcauuggcaucuccccugagccgccccuggucccuacacccaugucuccuagcuccaagucuguuagcacgcccuccgaggcugggagccaggauucuggagaccuuggcccucugacccgcagacggcuccacaagcuggggguguccaaagugacacaggucgauuuccugccgcgcgaagugguuagcuacucuaaggagacccagacaccccucgccacccaucaauccgaagaggacgaagaggaugaggaaaugguggagagcaaagucggacaggacucugaacuggagaaccaggauaagaaacaggaagugaaggaggccccucccagagagcuuacagaagaggaaaaacaacagauucugcacuccgaggaauuucucaucuucuuugaccggaccauucgcguuaucgagagagcucuggccgaggacagcgauaucuucuuugacuauuccggccgggaacuugaggaaaaggauggggacgugcaggcuggagccaaucugucuuucaaccgccaauuuuacgaugagcauuggagcaagcacagagucgugacgugcauggacuggucccuccaguauccugagcugaugguggcgagcuacaauaacaaugaagaugcuccccaugagccggacggcgucgcccugguuuggaacaugaaauucaagaaaaccacaccugaauauguguuucacugucagucuuccgugaugagcgucugcuucgcccgguuucaccccaaucucgugguuggcgggaccuacucuggacagauugugcugugggauaacagaagccaucgccggacaccuguccaaagaacgccccuuuccgcugccgcgcacacccaucccguguauuguguuaauguggucggcacacagaacgcccacaaucugaucaccgugucuacagacgggaagaugugcagcuggucccucgauaugcugagcaccccucaggagucuauggaacuugucuacaacaaauccaagccgguggcuguuaccggaauggccuuccccacaggcgacgugaauaacuuugucguggggagcgaggagggaacgguuuacaccgcuugucgccacggcucuaaggccggcauuggggaaguguucgagggacaucagggcccugucacagggaucaauugccacauggccgugggacccauugacuucucccaucuguuugugaccagcuccuucgauuggacaguuaaacucuggaccacgaagcacaacaaaccucuguauucuuuugaagacaacgcugauuacgucuaugacgugauguggagccccgugcauccggcgcuguucgccugugucgauggcauggggcggcucgaccuguggaaucuuaacaaugauacagaggugccuaccgcuuccguugccaucgaaggagccucugcucugaacagagugcgcugggcccaagcgggcaaggaggucgcugugggcgacagcgaggggcggauuuggguuuacgaugugggagaacucgccgucccccacaaugacgaguggaccagauuugcccgcacacugguggaaauccgggcuaacagagccgauuccgaggaagagggcaccguugagcuuagcgcuuga

SEQ ID NO: 68620 - RNA, 1893 nt, Artificial Sequence
  derived and/or modified sequence opt5 from DYNC1I2__Homo_sapiens__NP_001258715
augagcgacaaguccgagcugaaagccgaacucgagagaaagaaacagagacuggcucaaauccgcgaagagaagaaaagaaaggaagaggagcggaagaaaaaggaaaccgaucagaaaaaggaggccguggcgcccguccaggaagagucugaccuugagaaaaagcgcagagaagcugaggcccugcuccagagcaugggccugacaccugaauccccgauugccgagcaaccccuucggguugugacggcugauaccugccuguuccacuaccucgugccucccccuaugucucccagcuccaagucugucagcacaccuuccgaagccgggagccaggacucuggagauggcgcuguggggucccgcagaggaccgaucaaacugggcauggccaagauuacccagguugacuuucccccucgggagaucgugacauauaccaaagagacacagacccccgucauggcgcaaccuaaggaagaugaggaagaggacgaugacgugguugcccccaaaccgccuauugaacccgaggaggaaaagacgcugaaaaaggaugaggaaaacgacagcaaggcuccuccccaugagcucaccgaagaggagaaacagcagauccugcacucugaagaguuccuuuccuuuuucgaucauagcacacgcaucguggaaagagcccugucugagcagauuaauaucuuuuucgacuacuccgggcgggaccucgaggauaaggaaggagagauucaagcuggcgccaaacugagccuuaaccgccaguuuuucgacgaaagaugguccaagcaccgggucgugucuugucuggauuggagcucccaguaucccgagcuccugguggcgagcuacaauaacaaugaagacgccccucaugagccggauggcgucgcucugguuuggaacaugaaauauaagaagaccacacccgaguacguguuucacugccaaucugccgugauguccgcuaccuucgccaaauuucacccuaaucucgucguugggggaacguauagcggccagaucgugcugugggacaaccgcucuaauaagagaacacccgugcagcggaccccucuuagcgccgcugcgcauacacaccccgucuacugugugaacguuguggggacccagaaugcccauaaccugauuuccaucucuaccgauggaaaaauuugcagcuggucccucgacaugcugagccacccgcaagauucuauggaacuuguccacaagcaguccaaagcuguggccgucacaagcaugucuuucccugugggcgacguuaauaacuuuguggucggguccgaggaaggaagcguguacacggccuguagacauggcuccaaggcuggcaucucugagauguucgaagggcaccagggacccaucaccggcauucauugccacgccgcgguuggggcuguggauuucagccaucuguuugucacauccucuuucgacuggaccgugaagcucuggacaaccaaaaauaacaagccucuguauagcuuugaggacaacgccgauuacguguaugacguuauguggucccccacgcacccugcccuguucgcuugugucgauggaaugggccgccucgaccuguggaaucuuaacaaugauacagaggugcccaccgccagcaucucuguggaagggaacccggcucugaaucgggucagauggacccacuccggacgcgagauugccgugggcgacagcgaaggccagaucguuauuuacgaugugggggagcaaaucgcggucccucggaacgacgaaugggccagauuuggacgcacacucgcugagaucaaugccaaccgggcugaugccgaggaagaggcggccacccggauucccgcuuga

SEQ ID NO: 68621 - RNA, 1572 nt, Artificial Sequence
  derived and/or modified sequence opt5 from DYNC1LI1__Homo_sapiens__NP_057225
auggccgcugugggcagagucgggagcuucggauccucucccccuggccugagcuccaccuacacagggggaccgcucggcaacgagaucgccucugggaauggaggcgcggcugccggcgacgaugaagacgggcagaaccuguggagcugcauucuuuccgagguuucuacgcggagccgcuccaagcugcccgccggcaaaaaugugcuccugcuuggagaagauggggcuggaaagaccagccugaucagaaaaauucaaggcaucgaggaauauaagaaagggcggggacucgaguaccuguaucugaacgugcacgacgaggaucgcgacgaucagacaagauguaaugucuggauucucgacggcgaucuguaccauaagggccuucugaaguuuucucucgacgccgugucccugaaagauacccuuguuaugcugguggucgacaugagcaagccuuggacagcucucgauucucugcagaaaugggccuccgugguucgggaacacguggacaagcugaaaauucccccugaggaaaugaagcagauggagcaaaagcucauccgcgacuuccaggaguaugucgaacccggggaggauuuuccugcgagcccgcagagacggaacaccgccucucaggaagacaaagaugacuccguggugcugccccuuggagcugauacacugacccauaaucucggcaucccuguccugguugugugcacgaagugugacgccaucagcgugcuugagaaagaacacgauuaccgcgacgagcauuucgauuuuauucaaucccacaucagaaaguucugccugcaguauggggcugcccucauuuacaccucugucaaagagaacaagaauaucgaccugguguacaaauauauuguucagaagcuguacggauuucccuauaagaucccugcgguggucguggaaaaagaugccguuuucauccccgcuggcugggacaacgacaagaaaauugggauccuccacgagaauuuucagacacugaaggccgaagauaacuucgaggacauuaucaccaaaccgccugugcggaaguuuguccaugaaaaggagauuauggcugaggaugaccaaguguuccuuaugaaacugcagagccuccuggccaagcagcccccuacagccgcuggacgccccgucgaugcgucccccagagugccuggcggcagcccgcggacccccaaucgcucuguuuccagcaacguggccucugucagcccuauccccgcuggguccaaaaagaucgacccuaauaugaaagccggagccacgucugaaggcgugcuugcuaacuuuuucaacagccugcucuccaagaagacagggagccccggaggcccggggguuucuggcggauccccugccggcggggcgggaggcgggagcucuggacugcccccuuccaccaaaaagagcggccaaaaacccgugcuggauguccacgcugagcucgacagaauuacacggaagccugugaccgugucccccaccacaccgacgucuccuaccgaaggggaggccagcuga

SEQ ID NO: 68622 - RNA, 12945 nt, Artificial Sequence
  derived and/or modified sequence opt5 from DYNC2H1__Homo_sapiens__NP_001073932
auggccaacggaaccgcugacgugagaaagcuguucaucuuuacaacgacccaaaauuacuucgggcucaugagcgagcugugggaucaaccccuucugugcaacugucucgaaauuaauaacuuucuggacgauggaaaucaaaugcuucugcggguccagcgcuccgacgccggaaucucuuucagcaacacaauugaguuuggggauaccaaagacaagguucucguguucuuuaaacugagaccugaagugaucacagaugagaaucugcacgacaacauucucgucuccucuaugcuggaaagccccaucuccucucuuuaucaggcggugcggcaaguuuucgcucccaugcugcucaaggaucaggaguggagccgcaauuuugacccuaaacugcagaaccuucuguccgagcucgaagccggacugggcaucgugcugagacggagcgauaccaaucucacaaagcugaaguucaaagaggacgauacccgcgggauucuuacgcccucugacgaauuucaguucuggaucgagcaagcccauagaggaaacaagcagauuuccaaagagcgggcuaauuacuuuaaggaacuguucgagaccaucgcccgcgaguucuauaaccucgacagccugucucuucuggaggucguggaucucguugaaacaacccaggacguggucgaugacguguggagacagacagagcacgaucauuacccugagucccggaugcugcaucugcuggacauuaucggcggcagcuuugggcgcuucgugcagaagaagcugggaacccuuaaucugugggaagaucccuauuaccucgucaaggagucucugaaagcuggcauuuccaucugcgaacaguggguuaucguguguaaccaccuuacggggcaaguguggcaaagauaugucccucacccguggaagaacgagaaauacuuucccgaaacacuggacaagcucggaaaacggcuggaggaggugcuggccauucgcaccauccacgaaaaguuccucuacuuucugccugcgagcgaggagaagauuaucugccuuacaagaguuuucgagcccuuuaccggccugaauccugugcaguauaaccccuacaccgaaccgcucuggaaggccgcugucucccaguaugagaagauuaucgccccugcugagcagaaaaucgccgggaagcugaaaaauuacauuucugaaauccaagauagcccccagcagcugcuucaggcguuccucaaguauaaagagcuggugaagcggccuacaauuuccaaggaacugaugcucgagagagagacgcugcuugcccgccugguugacagcaucaaagauuuucggcucgacuucgaaaacagaugucgcggcauucccggcgacgcuucuggcccccuguccgggaagaaucugagcgagguggucaacucuaucguguggguccggcaacuugaacucaaaguggaugacaccaucaagauugccgaggcucugcugagcgaucucccuggauuuagaugcuuccaucaguccgccaaagaccugcuugaucagcugaagcucuacgaacaggagcaauuugacgauuggucucgcgacauccagagcggccuguccgauagccggucugggcuguguauugaggccuccagcagaaucauggaacuugacucuaaugauggacuccugaagguucacuauuccgaccgccuggugauucuccugcgggaggucagacagcuuagcgcucugggcuucgugaucccggcgaaaauucagcaaguugccaacaucgcucagaaguucugcaaacaggccaucauucucaagcaaguggcccauuuuuacaauuccaucgaucagcagaugauucagucucaacgccccaugaugcugcagagcgcucuggccuucgaacagaucauuaaaaacuccaaggcggggucuggaggcaagagccagaucacaugggacaauccuaaagagcuugaaggcuacauccaaaagcuccagaacgcugccgagcggcuggccaccgagaauagaaaacugcggaaguggcacacaaccuuuugugaaaaagucguggugcucaugaacauugaccugcuucgccagcagcaaagauggaaggaugggcugcaggagcuccggacgggacuggcuacaguugaagcccagggcuuccaagcuagcgacaugcacgccuggaaacagcauuggaaucaccagcuguauaaggcgcuugagcaucaguaccaaauggggcuggaagcccucaacgagaaccugcccgagaucaauauugaucucaccuauaagcagggaagacugcaguuucgcccucccuucgaagagauccgggcuaaauacuauagagaaaugaagcgcuuuauuggcaucccgaaccaguucaaaggggucggcgaggccggagacgagagcaucuuuucuauuaugaucgauagaaaugcuuccggcuuccuuaccauuuuuagcaaggccgaagaccuguuccggcgccucucugcggugcugcaccaacauaaagaguggaucgugauugggcaggucgauauggaagcccugguggagaagcaccuuuuuacaguucacgacugggaaaagaacuucaaagcucugaagaucaaaggaaaggagguggagagacucccuuccgccgucaaaguggauugccugaauaucaacuguaaucccguuaagaccgugauugacgaucucauccagaagcuguucgaccuucugguccucagccugaaaaagucuauucaggcucaucugcacgaaaucgauacauuugugacggaggccauggaaguucuuaccauuaugccucaaagcguggaggaaaucggcgacgccaaccugcaguacuccaaacuccaggagcggaagcccgagauucugccucucuuccaggaagcugaggacaaaaaucgccugcuuagaacagucgccgggggaggccuggaaaccaucagcaaccugaaggccaagugggauaaauuugagcucaugauggaaucucaucaacugaugaucaaggaccagauugaggugaugaaagggaaugugaagucccggcuucagaucuauuaccaagagcuggaaaaauucaaggcucgcugggaucagcucaaacccggcgacgaugucauugagacaggacagcacaacacccuggacaagagcgccaagcucaucaaagaaaagaaaauugaguuugaugaccuggagguuacgagaaagaaacuuguggaugacugccaccauuuccggcuggaagaaccgaauuuuucccuggccucuagcaucuccaaggauaucgaaucuugcgcucagauuugggccuucuacgaggaauuucaacagggcuuccaggagauggcgaacgaggacuggaucaccuuucgcacaaagaccuaucucuucgaagaguuccugaugaauuggcacgacagacuucggaaaguggaagaacauagcgucaugacagugaagcugcaguccgaaguugauaaauacaagauugugaucccuauucucaaauaugucagaggggagcaccugucucccgaccauuggcucgaucuguuucgccuucugggacugccccggggcaccagccucgagaagcugcuuuucggggaccugcucagaguggcugauacgaucguugccaaggccgcugaccugaaagaucucaacucccgcgcccaaggagaagugacaauccgggaggcgcugagagaacuugaccuguggggcgucggggcuguguuuacccugauugauuacgaggacagccagucucgcacaaugaagcucaucaaagauuggaaggacauuguuaaccaggugggcgauaaucggugucugcuucagucccugaaagacagcccuuauuacaagggauucgaagacaaggucucuaucugggagagaaaacucgccgagcuggaugaauaucugcaaaaccucaaucacauucagcgcaaguggguguaccuugagccgaucuuuggcagaggggcgcugcccaaagaacagacccgguucaaccggguggacgaggauuuucgcuccauuaugaccgacaucaagaaagauaauagagucacaacgcugaccacacacgcuggaauccggaacagccuccugaccauucuugaccaacugcagcgcugccagaagucucucaaugaguuccuggaagagaagagauccgccuuuccucgguucuacuuuaucggcgaugacgaucugcucgaaauucuugggcagagcacaaaccccuccguuauccaaagccaucugaaaaagcuguucgcuggaauuaauucuguguguuuugacgagaaaagcaagcacaucaccgccaugaaaucccucgaaggcgagguggucccuuucaagaacaaagugccccugucuaauaacguugagacguggcuuaaugaucuggcgcucgaaaugaagaagacacuggagcagcugcucaaagaaugcgugaccaccgggagaagcucccagggcgccgucgacccuucucuuuuccccagccagauccugugucuggcugagcaaauuaaguuuacagaagauguggagaacgccaucaaagaccauucccuccaccagauugagacccagcugguuaauaaacuugaacaguauacaaacaucgacacgucuagcgaggauccgggaaacaccgaauccggcauucuggagcucaaacugaaggcucugauccucgacaucauucauaauaucgauguggucaagcaacuuaaccagauucaggugcacacaaccgaagacugggccuggaaaaagcagcugcgcuucuacaugaaaagcgaucacacaugcuguguccaaaugguggacucugaguuucaguauaccuacgaguaucaggggaaugccuccaagcugguuuacacgccucucaccgauaaaugcuaucugacacuuacccaagcuaugaagaugggacugggcgggaaccccuacggaccugcgggcacaggcaagaccgaaagcgugaaagcccucgggggacugcugggccggcagguccucguguucaauugugacgaggggaucgauguuaagucuaugggaagaauuuuugugggccuugucaaaugcggggcuuggggauguuucgacgaauuuaaccgccuggaggaguccgugcugagcgccguguccaugcagauccagacaauucaagaugcccucaagaaucaucggaccguuugcgaacugcuuggcaaagaggucgaagugaacucuaauagcggcaucuucaucacgaugaaccccgcugggaagggauacggcgggagacagaagcugccggacaaucucaaacagcuguuucgcccuguggccaugucccaccccgacaacgagcugauugcggaagucauccucuauagcgagggauucaaggaugcuaaagugcuuucucggaagcugguugccauuuuuaaucuguccagagagcuccugacaccucagcaacauuacgacuggggccuucgcgcccugaaaaccgugcucagagggagcggaaaccugcugcggcagcucaauaagucuggcaccacacagaacgcuaaugaaagccacaucgucgugcaggcccuucgccugaacaccauguccaaauucacguuuacagauugcaccagauucgacgcgcugauuaaggauguuuuccccggcaucgagcucaaggaaguggaguaugacgaacugucugcugcccuuaaacaagucuuugaggaggccaacuacgaaaucauucccaaucagaucaagaaagcucuggagcucuaugaacagcugugucaacggaugggggugguuauugugggaccuagcggcgccgggaaguccacacuguggcgcaugcucagagcugcccuuugcaaaaccggaaaggucgugaagcaguacacaaugaacccgaaagcgaugccccgguaucagcugcugggccacaucgauauggacaccagagaguggucugauggggugcucacgaauagcgcccgccaggucguucgggaaccucaagacguguccagcuggauuaucugugauggagacaucgaucccgaguggauugagucucugaacuccgugcuugacgacaauagacugcucaccaugccuagcggcgaacgcauccaguucggccccaacgucaauuuuguguucgagacacaugaucuguccugcgcuucuccugccaccauuagccggauggggaugaucuuucuguccgacgaagagacagaucucaacucucuuauuaagagcuggcugagaaaucagccggcugaguaccggaacaaucuggaaaacuggaucggagacuacuucgagaaagcccuccaguggguucugaagcaaaaugauuauguggucgaaaccucccuugugggcacgguuaugaacgggcugagccaccuccauggaugucgcgaccacgaugaguuuauuaucaaucugaucagaggccucgggggaaaccucaacaugaaaucucggcuggaguucacaaaggaaguguuucauugggcccgcgaguccccgccugacuuccacaagcccauggauaccuacuaugacagcacaagaggccggcuugcuaccuacguccugaaaaagccugaagaucucaccgcggacgacuuuucuaauggccugacacuucccgugauucagacgccggauaugcagcgcgggcuggacuauuucaaaccuuggcucuccagcgauaccaagcagcccuuuauccuggucggacccgagggcugcgggaaaggaaugcugcucagauacgccuucucucaacugcggagcacacagauugcuaccgugcacuguuccgcccagacaaccucucgccaucuucugcaaaagcucagccagacgugcaugguuaucuccacaaacaccggcagaguguaucggccuaaggacugugaaagacuggugcuuuaccugaaagauauuaaucuccccaagcuggacaaaugggggaccagcacacuggucgccuuccuccagcagguucugaccuaccaaggauuuuaugaugagaaccuugaaugggugggccuggagaauauccagaucguggcuuccaugucugccggcgggcgccucggacggcacaagcugacaacgagauucaccagcauuguccgccuuugcuccaucgacuacccugagcgggaacagcugcagacaauuuauggcgcguaccucgagccggugcugcauaaaaaccugaagaaucacucuaucugggggagcuccucuaaaauuuaucuccuggcuggaagcaugguucaaguguacgaacaggucagagccaaguuuaccguggaugacuauucccacuacuucuuuacacccuguauccuuacccaguggguccugggccucuuccgcuacgaucuggaagggggaagcucuaaccauccucuugacuaugugcuggaaaucguugccuacgaggcucggagacucuuucgcgauaagauugugggcgccaaagagcugcaccuguucgacaucauucucacguccgucuuucagggcgacugggggagcgauauccuggacaauaugucugauuccuucuaugugaccuggggagcgcggcauaacagcggcgccagagcugcccccgggcaaccucuucccccgcacggaaagccucugggcaaacucaauucuacagaccugaaggauguuauuaaaaaggggcuuauccauuacggccgcgacaaccagaaucuggauauucuccuguuucacgaagugcuggaguauaugucccggaucgacagaguccucagcuuccccggaggcucccugcuucuggcugggcgcagcggagugggcagacggaccaucacaucucucgugagccacaugcauggggccguucuguuuuccccuaagauuucucgcggauacgaacuuaaacaguucaagaacgaucugaaacacguccuccagcuggcuggcaucgaggcccaacagguggugcugcuccuggaggacuaucaguucguccaucccaccuuucuugaaaugauuaauagccugcucuccucuggggagguuccuggccuguacacacuugaagaacuggaaccccuccugcugccgcuuaaggaucaagcgagccaggacggauucuuuggcccuguguucaacuacuuuacguauagaauccagcagaaccugcacauugugcucaucauggauuccgccaauucuaacuucaugaucaauugcgagagcaaccccgcucugcacaaaaagugccaaguccucuggauggaggggugguccaauagcucuaugaagaaaauucccgaaaugcuguuuuccgagaccggaggcggggaaaaguacaacgacaaaaagcggaaagaggaaaagaagaaaaauagcguggacccugauuuccuuaagucuuuucugcugauccaugaguccuguaaagccuauggagcuacaccgagcagauacaugaccuuccuccacguuuauuccgccauuucuagcuccaagaaaaaggagcugcuuaagcggcagagccaucugcaggccggcgugucuaaacucaacgaagcuaaggcgcuggucgacgagcucaaucgcaaagccggggaacaguccgugcugcugaagaccaaacaagaugaggcugacgccgcccuucagaugaucacaguuagcaugcaggaugcuucugaacagaagacggagcuggagagacucaaacaccggauugccgaagagguggucaagaucgaggaacgcaagaacaaaaucgacgaugagcugaaggaagugcaaccccuugugaaugaggcgaaacuggccgucggcaacauuaagccugaaagccucuccgagaucagaucucugcggaugcccccugacguuauucgcgauauccucgaaggagugcugagacugaugggcauuuuugacaccagcuggguguccaugaaaucuuuccuugcuaagagagggguccgcgaggauaucgccacauuugacgcuagaaauaucagcaaggagauucgggaauccguggaggaacugcuguucaaaaacaagggcagcuucgaccccaaaaaugccaagcgcgcgucuaccgccgcugccccucuggcugccuggguuaaagcuaacauccaguacucccaugugcuugagcggauucacccgcuggaaacagagcaggccggccucgagagcaaccugaagaagaccgaagaucggaaacgcaagcuggaggaacuccucaauuccgucgggcaaaaagugucugagcuuaaggaaaaauuucagagcagaacguccgaggcggccaagcuggaggcugaaguuucuaaggcccaggagacaaucaaagcugccgaagugcucauuaaccagcuggaccgggagcacaagagauggaaugcccaagucguggagaucaccgaggaacuugcgacccugcccaaacgcgcucagcucgccgcugccuucauuacauaucugagcgccgcuccugaaucccugcggaagaccugccucgaggaauggacaaaaagcgccggacuggagaaguuugaucuuagacgcuuccuguguaccgagucugaacagcucaucuggaaauccgagggccugcccagcgacgaucuuucuaucgaaaacgcgcugguuauucuccagaucauuggccugaaguccuggagccgggugugcccuuuucugaucgaccccucuucccaagccacggaguggcucaagacacaucugaaagauagcagacuugaagucauuaaucagcaggacucuaacuucaucaccgcucuggagcucgccgugcgcuuugggaagacacugaucauucaggagauggauggagucgaaccggugcuuuacccucugcuccggagagaccugguugcucaaggcccccgcuacgugguccagaucggggauaaaauuaucgacuauaaugaggaguuccggcuguuucucagcaccagaaaccccaauccuuucauucccccugaugccgcguccaucgugacggaggugaacuuuaccacaacccgcagcggacugcggggccagcuucuggcccucacaauccagcacgaaaagccggaccuggaggagcagaagaccaaacuucugcagcaggaagaggacaagaaaauucaacucgcuaagcuggaagagucccugcucgagacacuggccaccucucaggggaauauccuugaaaacaaagaucugauugagagccucaaucagacgaaggcuuccucugcccugauccaggaaagccuuaaagaguccuacaagcugcaaauuucucucgaccaggaaagagaugcuuaucugccccuggccgagagcgcguccaagauguacuucaucauuagcgaccucucuaaaaucaacaauauguaucgguuuucccuggccgcuuuccuuagacuguuccagcgcgcccuccagaacaagcaagauagcgagaacacagaacagcggauccagucucugauuuccagccugcagcauaugguuuacgaguauaucuguagaugccucuuuaaagcugaccaacuuauguucgcccugcacuuugugcgcggaaugcauccugaacuguuccaggagaaugaaugggauaccuuuaccggcgucgugguuggcgacaugcucagaaaggccgauucucagcagaaaauucgggaccagcugcccuccuggaucgaucaggagcgcagcugggcgguggcuacacuuaagauugcccugccuucucucuaccagacccuguguuucgaggacgccgcucuguggagaacauacuauaacaauuccaugugcgaacaagaguuucccagcauccuugccaagaaagucagccucuuccagcagauccuggugguccaggcucugcggccggaucgccuccaauccgccauggcgcuguuugccuguaagacgcuugggcugaaagaagugucuccucucccccugaaccugaagagacuuuacaaagagacccucgaaauugagccuauccugauuaucauuagccccggagcugacccuucccaggagcugcaggaacucgccaaugcugagcggucuggcgaaugcuaucaccagguugccauggggcaaggacaggcggaccuggccauccagaugcuuaaggagugugcucgcaacggcgauuggcugugccucaaaaaucugcaccugguggucagcuggcuucccgugcucgagaaggaacugaacacacugcaaccgaaggacaccuucagacucuggcugacagccgagguucauccuaauuuuacccccauccuucugcaguccucucucaaaauuacguacgaauccccucccgggcugaagaaaaaccugaugcggaccuaugaguccuggacaccggaacagaucagcaagaaagauaauacccaccgcgcucaugcccuuuucucucucgcuugguuccacgccgcgugccaggagagacggaacuacauuccccaaggauggacaaaguuuuaugaguucucccugagcgaccugcgcgccggcuacaauaucauugauagacucuuugacggcgcuaaggaugugcagugggaguucguccacgggcugcuugagaacgccaucuacggaggccggauugacaauuauuuugaucugagagugcuccagucuuaccugaaacaguucuuuaacuccagcgugaucgacguuuucaaccaacgcaauaagaaauccaucuuuccuuauucugucagccugccccaguccuguucuauucuugauuaccgggccgugaucgaaaagauuccugaggacgacaaacccagcuucuuugggcucccugcuaacaucgccagauccagccagcgcaugauuucuucccaggugaucagccaacugcggauccugggaagaucuauuaccgcgggcagcaaguucgaucgcgaaaucugguccaaugagcucucucccguccugaaccuuuggaagaaacugaaucagaacagcaaucucauucaucagaaggugccgccucccaacgaccggcagggguccccuauccugagcuuuauuauccuggagcaauucaaugcuaucagacuuguucagucugugcaccagucccucgccgcccugagcaaagucauucgcggaacgacacugcucuccucugaagugcaaaagcuggcuagcgcccuucugaaccagaaaugcccccucgcuuggcaguccaagugggagggcccggaagauccucugcaguaucugcggggccuuguugccagagcgcucgccauccaaaauuggguggacaaggcugagaaacaggcccugcugucugaaacccucgaucugagcgagcuuuuccaucccgacacauuucugaacgcucuccggcaggagaccgcccgcgcggucgggagauccguggauucucugaaguucguugccagcuggaaaggacggcugcaggaagcuaaacuucaaauuaaaaucuccggccuccugcuggagggguguagcuuugacggaaaucagcucucugaaaaccagcuggauucccccagcgugucuuccguccuuccuugcuucaugggcuggauuccccaggacgccugugggccuuacagcccggaugagugcaucucucugcccguguauaccagcgcugagcgcgacagaguggucacaaauauugauguuccuuguggaggcaaccaagaccaguggauccagugcggcgccgcccucuuucugaagaaccaauga

SEQ ID NO: 68623 - RNA, 270 nt, Artificial Sequence
  derived and/or modified sequence opt5 from DYNLL1__Homo_sapiens__NP_001032584
augugcgacagaaaggccgugaucaaaaacgcugauaugagcgaggaaaugcagcaagacuccgucgagugugccacccaggcgcuggaaaaguacaauauugagaaagauaucgcugcccacauuaagaaagaguucgacaagaaguauaaccccacauggcauugcaucguuggccggaauuuugggucuuacgugacgcacgaaaccaaacauuucauuuauuuuuaccucggacagguggccauccugcuuuucaagagcggcuga

SEQ ID NO: 68624 - RNA, 270 nt, Artificial Sequence
  derived and/or modified sequence opt5 from DYNLL2__Homo_sapiens__NP_542408
augagcgacagaaaggccgugaucaaaaacgcugauauguccgaggacaugcagcaagaugccgucgacugcgcgacccaggcuauggaaaaguacaauauugagaaagauaucgccgccuauauuaagaaagaguucgacaagaaguacaaccccacauggcacuguaucguuggccggaauuuugggucuuaugugacgcaugaaaccaaacacuucauuuacuuuuaucugggacagguggcuauccuccuguucaagagcggcuga

SEQ ID NO: 68625 - RNA, 312 nt, Artificial Sequence
  derived and/or modified sequence opt5 from DYNLRB1__Homo_sapiens__NP_001268658
augaacagccagagacggggcccccacuccugccugaagaccgccccuaaagcuaagccguuccauugggaggcccucgcggcuuaccugcuugacacaucuauccccauuaaaagcacgauggauaauccuaccacaacccaauaugccucccugaugcacucuuuuauccucaaggcccgcagcacagugagagacauugauccccagaacgaccugaccuuccuucggauccgcuccaaaaagaaugaaauuauggucgcuccugauaaggacuacuuucugaucguuauccagaaccccacagaguga

SEQ ID NO: 68626 - RNA, 300 nt, Artificial Sequence
  derived and/or modified sequence opt5 from DYNLT1__Homo_sapiens__NP_001278531
auggaggacuaccaggccgcugaagaggccaucgaaagcgcgauuggcgggaacgcuuaucaacacuccaaggugaaucaguggaccacaaacgucguugagcagacgcugucucagcucaccaaacugggaaagcccuucaaauacaucgugacaugcgugauuaugcaaaagaauggcgccgggcuucauaccgccagcuccuguuuuugggauucuagcacagacggauccugcaccgucagaugggaaaacaaaacaauguauuguaucgugucugcuuucggccugagcauuuga

SEQ ID NO: 68627 - RNA, 351 nt, Artificial Sequence
  derived and/or modified sequence opt5 from DYNLT3__Homo_sapiens__NP_006511
auggaggaauaccacagacauugcgacgaggugggcuucaacgccgaagaggcucacaauaucgucaaggaauguguugauggggugcugggaggcgaggacuauaaccauaauaacauuaaucaguggaccgccagcaucguggagcaaucccucacacaccuggucaaacuugggaaggcguacaaauauauugugacgugcgcuguugugcagaagucugccuacggauuucauaccgccagcuccuguuucugggauacaaccucugacggcacaugcaccguccggugggaaaaccgcacaaugaauuguaucgugaacguuuuugcuauugccaucgugcuguga

SEQ ID NO: 68628 - RNA, 2292 nt, Artificial Sequence
  derived and/or modified sequence opt5 from DYRK1A__Homo_sapiens__NP_001387
augcacaccggcggggagacaagcgccugcaagcccuccucugugagacuggcuccuagcuucuccuuucaugccgcgggacuccagauggcuggccaaaugccgcacucucaucaguacagcgaccggcgccagcccaacaucuccgaucagcaagucucugcccugagcuauuccgaccagauucagcagccucuuacgaaucaaguuaugcccgauaucgugaugcugcagagacggaugccucagaccuuccgcgaccccgccacagcuccucucagaaaacugagcguggaucuuauuaagaccuacaaacacaucaacgaagucuauuacgccaagaaaaagcggcgccaucagcaagggcagggagacgauucuucccacaagaaagagagaaagguguauaaugacggcuacgaugacgauaacuaugacuacauuguuaaaaauggggaaaaguggauggaucgguacgagaucgacagccugaucggaaaaggcucuuuuggccagguggucaaggcuuaugaccgcguggaacaagaguggguugccauuaagaucauuaaaaacaagaaagcguuccucaaucaggcccagaucgaggugagacugcuggaacucaugaacaagcacgauacagagaugaaauacuauauuguccaucugaagcggcacuuuauguuccgcaaucaucuuugucugguguuugaaaugcucuccuacaaccuguaugaccuucugagaaauaccaacuuccgcggggugagccucaaucugacacggaaauuugcucagcaaaugugcaccgcccuucucuuccuggcuacgccggagcuuucuaucauucacugugaucugaagcccgagaacauccuccugugcaauccuaagagauccgccaucaaaauugucgacuuuggaagcuccugucagcuuggccagcggaucuaccaguauauucaaucuagauucuaccgcagccccgaaguucugcucgggaugccuuacgaucuggcgaucgacauguggucccugggaugcauucucguggagaugcacaccggcgaaccccuguuuagcggggccaacgagguggaucagaugaacaagaucgucgaagugcuuggaaucccgccugcucauauucuggaccaggcccccaaagcucggaaguucuucgagaaacucccugauggcacauggaaucugaagaagaccaaagacggcaagagagaguauaaaccucccgggacacgcaagcugcacaacauccugggaguugaaaccggcgggcccggaggccggagagccggggagucuggacauacgguggccgauuaccucaaauuuaaggaccugauucugcgcaugcucgacuaugauccgaagacacggauccagcccuacuaugcucugcaacacuccuucuuuaaaaagaccgcggacgaaggcacaaauaccagcaacucugucagcaccuccccugccauggagcagucucagagcuccggcacaacgagcucuaccuccagcagcuccgggggaagcuccggcacaucuaauagcgggagagcucgcuccgaucccacccaucagcaccggcacucuggaggccauuucacagccgccgugcaagcuauggacugugaaacccacagcccucagguuagacagcaauuucccgccccgcuugggugguccggcacggaggcgccuacacaggugaccgucgagacccaucccgugcaggaaacaaccuuccacgucgcuccucagcaaaacgcccugcaccaucaccauggaaauagcucucaccaucaccaccaucaccaucaccaucaccaccaucacggccagcaggcccucgggaaccgcacacggcccagaguguacaauuccccuacgaacucuucuuccacccaggauagcauggagguuggacauucucaccacagcaugacaucccugucuagcuccaccacaagcuccucuaccagcuccucuagcacgggcaaucaagggaaccaggcuuaucagaaucggcccguggccgcuaacacccuggacuuuggacagaauggcgccauggaugucaaccuuacaguguacuccaacccgcgccaagaaaccgggauugcgggccauccuacauaccaguucucugccaauaccggacccgcucacuauaugacggagggccaucucacaaugagacagggggccgaccgggaagagagccccaugaccggaguuugcgugcaacaguccccugucgcuagcucuuga

SEQ ID NO: 68629 - RNA, 1890 nt, Artificial Sequence
  derived and/or modified sequence opt5 from DYRK1B__Homo_sapiens__NP_004705
auggccgugcccccuggccacgggccguucagcggauuucccggcccucaggagcauacccaaguccugcccgacguuagacuccugccucggcgccuuccccuggcuuucagagaugccacauccgcgccucuccggaagcugucuguggaccuuaucaaaacguacaagcacauuaacgaaguguauuacgcuaaaaagaaacgcagagcccagcaggccccgccccaggauagcuccaauaagaaggagaaaaagguccugaaccauggguaugacgaugacaaucacgauuacaucgugcggucuggagaacgcuggcucgagagauaugaaauugacagccugaucggcaaaggguccuuuggacaaguugugaaggcuuacgaucaucagacccaggagcuggucgccauuaaaaucaucaagaacaagaaggcuuuccucaaucaggcccaaauugagcugcggcuucuggaacucaugaaccagcacgacacagagaugaaauauuacaucgugcaccugaaacgccauuuuauguucagaaaucaccuuugccugguuuuugaacuccugucuuacaaccuguaugaucuccugcggaauacccauuuccgcggcgugagccuuaaccugacaagaaagcucgcgcagcagcuguguaccgcccuucuguuucucgcuacaccugagcuguccauuauccacugcgaccugaaacccgagaauauucuccuguguaacccuaagcggagcgccaucaaaauugucgauuucggcagcuccugccaacuugggcagcgcaucuaccaguauauccaaagcagauuuuaccggucucccgaagugcugcucggaaccccguaugaccuggcuauugacauguggucccuuggcuguauccugguggagaugcacacgggggaaccucucuucagcggaucuaaugaggucgaucagaugaacagaauuguugaagugcugggcauucccccugccgcgaugcuggaccaggcccccaaggcucgcaaguacuuugagcggcuccccgggggaggcuggacccugagacgcacaaaagagcuucggaaggauuaucagggcccugggaccagacgccugcaagaagugcucggaguccagacaggcgggccgggaggccggagagccggggagcccggacauuccccugcugacuaccugcgcuuccaggaucuggugcuucggaugcucgaauacgagcccgccgccagaaucagcccucugggcgcucugcagcacggcuucuuucgccggaccgcggacgaagccacgaauacagggcccgcuggauccucugccagcaccuccccggccccucucgauacaugccccucuucuuccaccgcuagcucuaucagcuccucuggcgggagcuccggaucuucuuccgacaacagaaccuaucgguacagcaaccgcuauuguggcgggccugggcccccuaucacagauugcgagaugaauagcccccaaguuccgccuucccagccccugagacccugggccggaggcgacgugccucauaaaacgcaccaggcgccggcuagcgccuccucucuucccgggaccggagcccagcugccuccccaaccucgguaccucggcagacccccuagccccacauccccgccucccccugagcugauggaugucucucuggugggcggacccgcugacuguagcccgccucaucccgccccugcuccccagcaccccgccgcguccgcccuucgcacccggaugacaggcgggagaccuccgcugcccccucccgacgauccugcuacccucggcccccaccugggacuccgcggcguuccucagagcacggccgcuucuuccuga

SEQ ID NO: 68630 - RNA, 1587 nt, Artificial Sequence
  derived and/or modified sequence opt5 from DYRK2__Homo_sapiens__NP_003574
augaacgaccaccuccaugugggcagccacgcccaugggcagauccaaguccagcagcuguucgaggauaauuccaacaagagaaccguucugacaacgcagcccaauggacuuaccacagugggcaaaaccgggcugccuguggucccggaacggcaacucgacucuauucaccgcagacagggaagcuccacaucucuuaagagcauggagggcauggggaaagugaaggcuacccccaugacaccugaacaggccaugaaacaguacaugcaaaagcugaccgcguuugagcaucacgaaaucuucuccuaucccgagauuuacuuucugggacucaacgcuaagaaacggcagggcaugacgggcgggccuaauaacggaggcuaugaugacgaucaggggucuuacguucaggugccccacgaccaugucgccuaucgcuacgaggugcugaagguuaucggaaaaggcagcuucgggcaaguggucaaggccuaugaucacaaagugcaucagcacguggcucugaagauggucagaaaugaaaagcgguuucaccgccaggccgcugaggaaauuagaauccucgagcaucugcggaaacaagacaaggauaacaccaugaauguuauccacaugcuugagaacuucacauuucgcaaucauauuugcaugaccuucgaacugcucuccaugaaccuguacgagcuuaucaaaaagaauaaauuucagggauucagccugccucucgugagaaaguuugcccacucuauucugcagugucuggacgcgcuccauaaaaaccggaucauucacugcgaucugaagccggaaaauauccuucugaagcagcaaggccgcuccggcauuaaagugaucgacuucgggagcucuuguuacgagcaccagagagucuauacauacauccagucccgguuuuaucgcgcccccgaagugauucucggagcuagauacggcaugccuaucgauauguggagccuggggugcauucuugccgagcugcucaccggauauccccugcugccuggcgaggacgaaggggaccagcucgcuuguaugaucgagcugcuuggaaugcccucucaaaagcugcucgaugccuccaaacgggcgaagaacuucguuagcuccaaaggcuacccgagauauugcacggugacaacccugucugacggcagcgucgugcuuaacgggggacgcucccggagaggcaagcugcgcgggccucccgaaagccgggaguggggaaaugcccucaagggcugugaugacccucuguuccuggauuuucucaaacagugccuggaaugggaccccgcuguuagaaugacacccgggcaggcccuucgccauccuuggcugcggagacgccucccgaagcccccuaccggcgagaaaaccucugugaagcggauuacagaguccacgggagcuaucaccagcaucucuaaacugcccccucccagcuccucugccagcaagcugagaacaaaccuugcccagaugaccgaugcuaauggcaacauucaacagcgcacaguccucccgaagcugguguccuga

SEQ ID NO: 68631 - RNA, 1707 nt, Artificial Sequence
  derived and/or modified sequence opt5 from DYRK3__Homo_sapiens__NP_001004023
augaaguggaaagagaagcugggcgacgggguguacgauaccuucaugaugaucgacgaaacaaaaugucccccuugcagcaacguccucugcaauccguccgagcccccucccccuagacggcugaacaugacgaccgaacaguuuacaggagaucacacccaacauuuccuugacggcggggagaugaagguugaacagcuguuucaggaguucggaaaucgcaaaucuaacacaauucagagcgauggcaucuccgacucugagaaguguagccccaccgugucccaagggaagucuagcgauugccucaauacagugaaauccaacucuagcuccaaggccccuaaagucgugccgcugacccccgaacaggcucuuaagcaguauaaacaccaucugacggccuacgagaagcucgaaauuaucaauuauccugagauuuacuuuguuggacccaacgcgaagaaaagacacggcgugaucggcgggccuaauaacggaggcuaugacgaugcugacggggccuacauccaugucccccgggaucaccuggccuaucgcuacgaggugcugaagauuaucggaaaaggcagcuucgggcagguugcuagaguguacgaccacaagcuccggcaauaugucgcccugaaaauggugcgcaaugaaaagagauuucaucggcaggcugccgaggaaauucgcauccuugagcaccugaaaaagcaggauaagaccggaucuaugaacgugauucauaugcucgaauccuucacauuuagaaaucacgucuguauggcguucgagcugcuuagcaucgaccuguacgagcucauuaaaaagaacaaauuucagggcuucucuguucaacuggugcggaaguuugcccaguccauccugcagagccucgacgcucugcacaaaaauaagaucauucauugcgaucuuaagccggaaaacauccugcucaaacaccauggccgcuccucuaccaaggugauugacuucgggagcuccuguuucgaguaucaaaaacuguacacauauauccagagcagauuuuaccgggccccugaaauuauccuuggaucucgcuauuccacccccaucgauauuuggagcuucggcugcauccuggcugagcuccugacggggcagccucuguuucccggagaagacgagggcgaucagcucgccuguaugauggagcugcuugggaugcccccuccgaagcugcucgaacaaucuaaaagagcgaaguacuucauuaacagcaagggaaucccccgguacugcuccgucacaacccaggccgacggcagagugguucuggugggcgggcgcucucggagaggcaaaaagcgcggaccucccgggagcaaagauuggggaacagcucuuaagggcugugacgauuaucuguuuauugaguuccucaaacggugccugcacugggacccuuccgccagacugacccccgcucaggcccuccgccauccguggaucagcaagucugucccucggccccugaccacaaucgauaagguguccgggaaaagaguugugaauccugccagcgcuuuucagggccuuggaucuaagcugcccccugucgugggcauugcgaacaaacucaaggccaaucugauguccgaaacgaacgggagcaucccccugugcuccguccuuccgaaacucauuucuuga

SEQ ID NO: 68632 - RNA, 6246 nt, Artificial Sequence
  derived and/or modified sequence opt5 from DYSF__Homo_sapiens__NP_001123927
augcugugcugucugcuggugagagccagcaaccuucccuccgcuaagaaagaccggcgcucugauccugucgccagccugaccuucagaggcguuaagaaacggaccaaggugaucaaaaauuccgugaacccggucuggaaugagggguuugaaugggaccucaagggcauuccccuggaucagggcucugagcuucacgugguugugaaggaccaugaaacgauggggcgcaacagauuccugggagaggcgaaagucccucuccgggaagugcuggcuacccccagccuguccgccucuuuuaaugccccucuccuggauacaaagaaacaacccaccggcgcuagccuuguucuccagguguccuacacaccucucccgggggccgucccccuguucccucccccuacaccccuugagccgagcccuacacugcccgaccucgaugugguggcugacaccggaggcgaggaagauacggaggaccagggccugaccggggaugaagccgagccuuuucuggaccagucuggaggccccggggcgcccacaaccccucgcaagcucccguccagacccccuccccacuauccuggaaucaaacggaagcgcagcgcccccacaucuagaaagcugcuuuccgauaaaccgcaagacuuccagauucggguccagguuaucgagggccgccagcugccuggggugaacauuaagcccguggucaaagugaccgcugccggacaaacgaagagaacacggauccauaaaggcaauagcccucucuuuaacgaaacccuguucuuuaaucuuuucgacucucccggcgagcuguuugaugaaccuaucuucauuacaguuguggacucccgcagccucagaaccgaugcucugcugggggaguuucggauggacgucggaaccaucuacagagaaccccgccacgccuaucuccggaaguggcugcuucuguccgauccggacgauuucucugcgggcgccagaggguaccucaaaacaagccugugcgugcuuggaccuggcgacgaggcuccccuggagcgcaaggaucccuccgaagacaaggaggauauugaaagcaaccuccugcggccuacggggguugcccugagaggagcucauuucugucucaaaguguuucgcgccgaggaccugccgcagauggacgaugccgucauggacaaugugaagcagaucuucggcuuugaaucuaacaaaaagaaucuugucgaucccuucguggagguuuccuuugcuggcaaaaugcugugcagcaagauucucgagaagaccgcgaacccucaguggaaucaaaacaucacacugcccgccauguucccuucuaugugugagaagaugcggauuagaaucaucgacugggaucgccugacccacaacgacauuguggcuacaaccuaucuuagcauguccaagaucucugcccccgggggagagauugaagaggaaccugccggcgcugucaaacccagcaaggccuccgaucucgacgauuaccugggguuucugccgacguucggaccuugcuauaucaaucucuacggcagcccccgggaguuuacaggguucccugaccccuacaccgagcugaacaccggcaaaggagaaggcguggcguauagagggcgccuucugcucucucuggagacaaagcugguugaacacuccgagcagaagguggaggaucuuccggcugacgauauucuccgggucgaaaaauaccugagacggcgcaaguauagccuguuugccgccuucuacucugcuaccaugcuccaggacguggacgaugccauccaauuugagguguccaucggaaauuauggcaacaaauucgacaugacaugucugccucuugcuagcacgacccaguacuccagagccguuuucgaugggugccauuauuacuaccugcccuggggaaaugucaagccuguggugguccucucuagcuauugggaagacauuucccaccggaucgagacacagaaccagcugcugggcauugcggauagacuugaagccgggcucgagcaagugcaucuggcucugaaagcccaguguucuaccgaggacguugauagccucguggcucagcugacagacgaacuuaucgccggcugcucccagccccugggagauauucacgagacccccagcgcgacgcaccucgaccaauaccuguaucagcugcgcacccaucaccuuucucagaucacagaagccgcucucgcccugaagcugggccauuccgagcucccugcugcccuggaacaggccgaggauuggcuucugcggcucagagcucuggcggaggaaccgcaaaauagccugcccgacaucgucauuuggaugcuucagggggauaagcgcguggccuaccagagaguuccugcucaccaggugcuguuuucucggcgcggagccaacuauuguggcaaaaauugcgggaagcuccaaaccaucuuccugaaauaccccauggagaaggucccuggagccagaaugcccgugcagauucggguuaaacucugguuuggccuguccguggacgaaaaggaguucaaccaguuugcugaagggaaacuuagcgucuucgccgagacauaugagaaugaaaccaagcuggcgcucgugggcaacuggggaacgacaggccugaccuacccuaaguuuucugacgugacagggaaaaucaagcugccgaaagauagcuuccgccccuccgcuggauggaccugggccggcgacugguuugucugcccugagaagacccuucugcaugauauggacgccgggcaccucagcuucguugaagagguguuugagaaucaaacaagacugcccggaggccaguggauuuacaugucugauaacuauacggacgugaauggggaaaaaguccucccuaaggaugacaucgaguguccccugggcuggaagugggaagaugaggaaugguccaccgaccuuaaccgggcuguggaugagcagggaugggaguacagcauuacaaucccgccugaacgcaaacccaagcacuggguucccgccgagaaaauguauuacacccauagacggcgcagaugggugcggcugagacgccgggaccucucccagauggaagcgcugaagagacaccgccaagcugaggccgaaggcgaggggugggaguaugccucucuguucggauggaaauuucaucuugaauaccggaagacagacgcuuucagacgccggagauggcgccggagaauggagccucuggaaaagaccggccccgccgcugucuucgcccucgagggggcgcugggaggcgugauggaugacaaaagcgaagauuccaugucuguuagcacgcucuccuuuggcgugaaccggccuacaaucucuugcauuuucgacuaugggaaucgcuaccaccugagauguuacauguaucaggcccgggaucuugcugccauggacaaggauagcuuuuccgacccguacgcuaucgucagcuuccugcaccagucucagaaaaccgugguugugaagaacacccugaaucccacaugggaucaaacccucaucuuuuacgagauugagauuuucggagaaccugccacagucgccgagcagcccccuuccaucgugguggaacuguacgaccaugauacguauggcgcugacgaguuuauggggcgcugcaucugucagcccagccuugagagaaugccgcggcuggcgugguucccucucaccagaggaucucagcccuccggcgaacugcucgccagcuuugagcugauucaacgcgaaaaaccugcuauccaccauauucccggguucgagguccaggaaacaucucggauccuugaugaguccgaggacaccgaccugccuuaucccccgccucagagagaagccaacauuuauaugguuccccaaaauaucaagcccgcccugcagcgcacagcuaucgagauucucgccuggggacugcggaacaugaaaagcuaccagcuugcgaauaucuccagcccuucucuggugguggaaugcggcggccagaccguccaaagcugugugauuagaaaccuccgcaaaaauccgaacuuugauaucugcacgcuguucauggagguuaugcucccccgggaagaacuguacuguccucccauuaccgugaaggucaucgacaauagacaguucgggcgcagaccugugguuggacagugcacaauccggucccuugagucuuuucugugugaucccuauagcgcugaauccccuucuccgcagggcgggcccgacgaugugagccugcucuccccuggagaggacguccugauugauaucgacgauaaagaaccccuuauuccuauccaagaggaagaguucauugacugguggucuaaguuuuucgccagcaucggcgagcgcgaaaaaugcggguccuaccuggagaaggauuuugacacccucaaaguguaugauacacagcuggaaaacgucgaggccuucgagggacucagcgacuuuugcaauaccuucaagcuguacagaggcaagacacaggaagagaccgaagaccccucugugauuggcgaguuuaaagggcuuuucaagaucuauccgcugccugaagaucccgcuauccccaugccuccccggcaguuucaccaacuggccgcgcagggaccucaggagugucucguucgcauuuacaucgugagagcuuucggccugcagccgaaagaccccaacgggaagugcgauccuuauauuaaaaucuccauuggcaaaaagagcgucucugaccaagauaauuacauccccuguacgcuugagccuguguuuggaaaaauguucgaacugacaugcacccucccccuggagaaggaccugaaaaucacccucuacgauuaugaccuucuguccaaggaugagaagauuggggagacaguuguggaccuggaaaaccggcuccugagcaaguucggagccagauguggccuuccgcagaccuacugcgucuccggcccuaaccaguggcgcgaucaacugcggcccucucagcuccugcaucuguuuugucagcagcacagagugaaggccccuguguaucgcacggaccggguuauguuccaagacaaagaguacagcaucgaggaaauugaggcugggagaauccccaauccucaccucggacccgucgaagaacggcuugcccugcaugugcugcagcagcagggccucgugccggaacacgucgagucccgcccucuguauagcccccuucaacccgauauugagcaggggaagcugcagauguggguggaccucuuuccuaaagcucugggaagaccgggacccccuuucaacaucacaccccggcgcgccagacgguuuuuccugcgcugcaucauuuggaauaccagagauguuauccucgacgaucuuucucugacaggggaaaagauguccgacauuuacgugaaaggauggaugaucggcuuugaggaacauaagcagaagaccgauguccacuaucggagccugggcggggagggaaacuucaauuggcgcuuuauuuucccuuuugacuaccuccccgcggagcaaguguguacaaucgccaaaaaggaugcuuucuggagacuggacaaaaccgaaucuaagauuccugcccggguuguguuucagaucugggauaacgacaaauucagcuucgaugacuuucuuggcucccugcagcucgaccugaauagaaugcccaagccggcuaagacggccaaaaagugcucucuggaucaacucgacgaugccuuccauccugagugguuugucagccuuuucgaacagaaaaccgugaaggggugguggcccuguguugcugaggaaggagagaaaaagauccuggcgggcaaacuggagaugacacucgaaauuguggccgaguccgaacacgaggaacgcccugcugggcagggacgggacgagcccaacaugaauccgaagcuggaggauccuagacgccccgacaccucuuuucuuugguucacaagccccuacaagaccaugaaauuuauccuguggcggagauuccgcugggccauuauccucuuuauuauccuguucauccugcuccuuuuucuggccauuuucaucuaugcuuuuccuaacuacgccgcgaugaagcuggucaaacccuucuccuga

SEQ ID NO: 68633 - RNA, 1131 nt, Artificial Sequence
  derived and/or modified sequence opt5 from DYX1C1__Homo_sapiens__NP_001028731
augccccuccaggugagcgacuacuccuggcaacagaccaagacagccgucuuccugucucugccucuuaaaggcguuugcgugagagauacggacguguuuuguaccgagaacuaucugaaggucaauuucccgcccuuucucuucgaagccuuucuguacgccccuaucgaugacgagagcuccaaagcgaagauugggaacgauacaaucguguucacccuuuauaaaaaggaagcugccaugugggagacacugucuguuaccggaguggacaaggaaaugaugcagcggauucgcgagaaaagcauccuccaggcccaagagagagcuaaggaagccacagaggcuaaagccgcggccaagcgggaagaucagaaauacgcucuguccgucaugaugaagauugaggaggaagaacgcaagaaaaucgaagacaugaaggagaaugaaagaaucaaagccaccaaggcucuggaggccuggaaagaguaucagcggaaggcggaggagcagaaaaagauucaacgcgaagagaagcucugccagaaagaaaagcagaucaaagaggagagaaagaaaauuaaguacaagucucugacgcggaaccuugccagccgcaaucuggcucccaaaggcagaaacuccgaaaauaucuuuaccgagaagcucaaagaagauagcauuccugcuccccggucugugggguccaucaagauuaacuucacaccucgcguuuuuccgaccgcucugagagagagccagguggccgaagaggaggaauggcuucacaaacaagccgaggcucggcgcgcgaugaauacagacaucgccgaacugugugaucucaaggaggaggaaaagaaccccgaguggcugaaagacaagggaaauaaacuguucgcuaccgaaaacuaucucgccgccaucaaugcuuacaaccuggccauuagacuuaauaacaagaugccucugcucuaccugaaccgggcggcuugccaucuuaaacugaagaaucuccacaaggccaucgaggauucuuccaaagccuauagaauuaugaagcgccaucugcggcugauccaccccacgaaacucuacaagcugaugcuuagacgcuuuggcauguga

SEQ ID NO: 68634 - RNA, 2547 nt, Artificial Sequence
  derived and/or modified sequence opt5 from DZIP1__Homo_sapiens__NP_055749
augcaggccgaggcugccgacugguucagcuccaugcccuuucaaaagcacguguacuauccucuggcgucuggcccggaagggcccgaugucgcuguugccgccgcugccgcuggagccgcgagcauggccugcgcuccucccuccgccgcuucuggcccucuccccuucuuucaguucagaccucggcuggagagcguggacuggcgcagacuuuccgccaucgauguggacaaagucgcgggggccguggauguucugacccuccaggaaaacauuaugaauaucacauuuuguaagcuggaggacgaaaaaugcccgcauugucagucuggaguggaucccguccuucugaagcucauucggcuggcucaauucacgaucgaguaccugcuccacagccaggaguuucugaccucccagcuucauacacuggaagaacgccucagacugagccacugcgacggcgaacagucuaaaaagcugcuuaccaagcaagccggggagauuaaaacacucaaggaggaauguaaacggcgcaagaaaaugaucuccacccagcagcugaugaucgaggcuaaggccaacuauuaccagugccauuucugugauaaggccuuuaugaaucaggcuuuccugcagagccacauucagagacggcacacagaagagaacucucauuuugaauaucagaaaaaugcgcaaaucgagaagcuccgcuccgagauugugguucugaaagaagaacuucagcugaccagaagcgaacucgaggccgcucaccaugccucugccgugcgguucuccaaggaauacgagaugcagaaaacgaaggaggaagacuuucugaaacuuuucgaucgcuggaaggaggaagagaaggaaaaacuggucgacgagauggagaaggugaaagaaauguucaugaaggaguuuaaagaacucaccagcaagaacuccgcucuggaguaucaacugucugagauccaaaagagcaauaugcagauuaaauccaacaucggaacacucaaggaugcccacgaguucaaagaggacagaagcccuuacccccaggacuuucacaaugugaugcaacugcuugauucucaggaauccaaguggaccgcgcggguccaggcuauucaucaggagcacaaaaaggaaaagggccgccugcucagccauaucgagaaacugagaacaucuaugaucgacgaucuuaacgccagcaauguuuucuacaagaaacggauugaggaacugggccaaagacuccaggagcagaacgaacugaucauuacccagcgccaacagaucaaggacuuuacgugcaauccucugaacuccauuucugagcccaaagugaaugccccggcucuccacacacuggaaaccaagagcucccuuccuauggugcaugagcaggccuucagcucucacauccuggagcccaucgaggagcucuccgaagaggaaaaggggcgggagaacgagcaaaaacugaacaauaacaagaugcaccugagaaaagcucuuaagagcaauucuucccucacaaaaggacugcgcaccauggucgaacagaaccugauggagaagcucgaaacccugggcauuaaugccgauauccgggggauuagcuccgaccagcuucauagagugcugaaaucuguugagagcgagcgccacaagcaggaacgggagaucccuaacuuucaucaaauuagagaguuccucgaacaccagguguccuguaagaucgaagagaaagcgcugcugucuagcgaucagugcuccgucagccagauggacacacuuucuacgggagaggugcccaagaugauccaacuccccuccaaaaaucgccagcugauucggcagaaggccguuagcaccgauagaacaucugugccuaaaaucaagaagaacgucauggaagacccguuuccccgcaaauccagcaccauuacaaccccucccuucucuagcgaggaggaacaggaagaugacgaccugauccgggcuuaugccuccccuggcccccucccggugccucccccucaaaauaaggggagcuuuggcaaaaacacggucaagucugaugcugacggaacagagggcuccgagauugaagauaccgacgauagccccaaaccugccgggguggcgguuaagacccccacagagaagguggagaaaauguucccgcacagaaagaaugucaacaaaccugugggaggcaccaauguucccgaaauguuuaucaagaaagaggaacugcaggagcuuaagugugccgacguggaagaugaggacugggauauuuccucucuggaagaggagaucagccucgggaagaaauccggaaaggaacagaaagagcccccuccggcuaagaacgaaccccauuucgcccacguccugaaugcuuggggcgccuucaacccuaaagggcccaagggagagggccugcaagaaaacgagucuagcacacuuaaauccucucucgugacggugaccgacuggagcgauacauccgacguuuga

SEQ ID NO: 68635 - RNA, 1314 nt, Artificial Sequence
  derived and/or modified sequence opt5 from E2F1__Homo_sapiens__NP_005216
auggcccuggcuggcgcccccgccgggggaccuugcgcuccggcccucgaggcccugcuuggcgcuggggcccugagacuccuggacagcucccagaucgugauuaucucugcugcccaagaugcgagcgcgcccccugcucccaccggaccugccgcucccgccgcgggcccuugugacccggaucuucuccuguucgccacaccccaggcuccucggcccacgccuuccgcuccccgcccggcccuggggagaccucccgucaagcggcgccuggaccucgaaaccgaucaccaguaccuggccgagucuagcggaccugccagaggccggggccgccaucccgggaaaggaguuaagucccccggcgaaaaaucuagauaugagacaagccuuaaccugaccacaaagcgguuucucgaacugcuuucccacagcgcugacggggugguggaucugaauugggcggccgagguccucaaagugcagaagcgcagaauuuacgacaucaccaacguucuggagggcauucaacugaucgcuaagaaaucuaagaaucauauccaguggcucggaucccacacaaccgugggggucggaggccggcuggaaggccuuacgcaggaucugcgccagcuccaagagagcgaacagcagcuggaccaucuuaugaacauuugcaccacacagcugagacuccugucugaggauaccgacucccaacggcuggccuaugugacaugucaggaucuccgcagcaucgccgacccugcugagcagaugguuauggugauuaaagccccgcccgaaacccaacugcaggcggucgacucuuccgagaauuuccagaucagccuuaaguccaaacaggggccuauugauguguuucugugccccgaagagacggugggaggcaucucuccugggaagacacccagccaagaagucaccuccgaggaggaaaacagagcuacagacagcgccaccauuguuucuccgccucccuccagcccucccucuagccucaccacagauccuucccagucucugcuuagccuggagcaggaaccccuccugucccggaugggaagccugagagccccgguggacgaggaucgccucucuccucugguggcugccgacucccuucuggaacacguccgggaggauuucagcggccuccugcccgaggaauuuaucucucuguccccuccccacgaggcucuugacuaccauuucgggcucgaagagggagaaggcaucagagaucuguuugacugugauuucggcgaccugacgccgcucgacuuuuga

SEQ ID NO: 68636 - RNA, 1005 nt, Artificial Sequence
  derived and/or modified sequence opt5 from E2F3__Homo_sapiens__NP_001230005
augccccugcagcaacaggccaagagacggcucgagcugggcgaaagcgggcaccaguaccuuuccgacggacugaaaaccccuaagggcaaagggcgcgcugcccucagaucuccggauagccccaagaaaaagacacgguaugacacgucccugggacuucugaccaagaaauucauccagcuccugucucaaagcccugauggcgugcuggaccucaacaaggcggcugagguccugaaaguucagaagcgcagaauuuacgauaucacaaaugugcuugaagggauucaucugaucaaaaagaaguccaaaaacaaugugcaguggaugggaugcucucucagcgaggacggcggcaugcuggcccagugucaagggcuuuccaaggaagucaccgagcugagccaggaggagaaaaagcucgaugaacugauucagucuugcacacuggaccucaaacugcuuaccgaagauuccgagaaccagcggcuggccuaugugacauaccaagacauccgcaagaucagcggacucaaagaucagaccguuauuguggucaaggcucccccugagacgagacuggaagugcccgacucuaucgagucccuucagauucaccuggccagcacccaaggcccuaucgaaguuuaucucuguccggaggaaacagagacccauucucccaugaagacaaauaaccaggaucacaaugggaacauuccuaaacccgcuuccaaggaccuggccagcaccaauuccggacauucugacugcagcguguccaugggcaaccugagcccucucgcgucucccgccaaucugcuucagcagacggaggaucaaaucccguccaaccuggaagggccuuuugucaaucuccugcccccucuucugcaggaggacuaccuccugagccugggagaagaggaaggcauuucugaucucuucgacgcuuaugaucuggagaaacuuccccugguggaggacuuuauguguagcuga

SEQ ID NO: 68637 - RNA, 1242 nt, Artificial Sequence
  derived and/or modified sequence opt5 from E2F4__Homo_sapiens__NP_001941
auggccgaggcuggcccccaggccccuccgcccccugggacccccagcagacacgaaaagucccugggacuccugacaacgaaauucgugucucuucugcaagaggcgaaggacggcguccucgaucugaaacuugcugccgacacccuggccguucggcagaagcgcagaaucuacgauauuacaaacgugcucgaagggaucggacugauugagaaaaagagcaagaauagcauccaguggaaaggcguggggccuggaugcaacacccgggaaauugcugacaagcugaucgagcucaaagccgagaucgaggaacugcagcaacgcgaacaggagcuugaucagcauaaggucugggugcagcaaucuauuagaaauguuacagaggacgugcagaacagcugucuggcuuaugucacccacgaagauaucugccgguguuuugccggcgacacacuccuggcgauucgcgcccccuccggcaccucucuugaggugccuaucccggaagggcugaauggacagaaaaaguaccagauucaucucaagagcguuuccggccccaucgaggugcugcuggucaacaaagaagccuggagcucuccucccguggccgugccuguucccccgccugaggaucuccugcaaucccccagcgcugucucuacgccuccuccccuucccaagccggcccuggcgcagucccaggaggccagcagacccaauucuccucaacucacccccacagcugugccuggguccgccgaagugcagggaauggcuggccccgccgccgagauuaccgucagcgggggaccgggcacagacuccaaagauucuggcgaacugagcucccuuccucuggggcccaccacgcucgacacacggccucugcagagcucugcucugcucgauuccagcucuagcuccucuagcuccuccucuuccagcucuaacuccaauagcuccucuagcuccggacccaacccuucuaccagcuucgagcccaucaaggcggacccgacaggcgugcuggaacuuccuaaagagcuguccgagaucuuugaccccacccgcgaaugcaugagcucugagcuccuggaggaacuuauguccagcgaaguuuucgcuccccugcucagacugucuccuccgcccggggaucacgacuauauuuacaaucuggaugaguccgagggagugugugaccucuuugaugucccugugcugaaccuuuga

SEQ ID NO: 68638 - RNA, 1038 nt, Artificial Sequence
  derived and/or modified sequence opt5 from E2F5__Homo_sapiens__NP_001077057
auggccgcugccgagcccgcgagcuccggccagcaagcuccugccgggcagggacagggccagagaccgcccccucaacccccucaggcccaggcuccccagccuccgcccccuccccaacucgggggagccggcgggggaucuagccggcacgaaaagucccugggccugcuuaccacaaaauucgugucucugcuccaggaggcuaaggacggcguccuggaucuuaaagccgcggccgacacgcuggcuguucgccagaagagacggaucuacgauauuaccaacgugcucgaagggaucgaccugauugagaaaaagagcaagaauagcauccaguggaaaggagugggcgccgggugcaacacaaaggaagucauugaucgccugagauaucucaaagcugagaucgaggaccuggaacuuaaggagcgggaacuggaucaacagaaacucuggcugcagcaaucuaucaagaaugugauggacgauagcauuaacaaucgcuuuuccuacguuacccaugaggacaucuguaacugcuucaauggagauacacuucuggccauucaggcgccuagcggcacccagcucgaggugcccaucccggaaauggggcagaacggacaaaagaaauaucagauuaaucugaagucucacuccggcccuauccauguccugcucauuaacaaagaguccucuuccagcaagcccgugguuuuuccugugcccccucccgacgaucugacacagccgucuucccagagccuuacccccgucacgccucaaaaauccucuauggccacccagaaucugcccgaacagcacgugagcgagagaucccaggcucuccaacagacaagcgccaccgacaucucuuccggcagcaucucuggggacauuaucgaugaacugaugagcuccgacguguucccucuucugcggcucucucccacaccggcugaugacuacaacuuuaaucuggaugacaacgagggagucugugaucuguucgacguucagauucucaauuauuga

SEQ ID NO: 68639 - RNA, 750 nt, Artificial Sequence
  derived and/or modified sequence opt5 from E2F6__Homo_sapiens__NP_001265204
augaaccccagcccuuccaagaucagaauuaaucuggaggacaacgugcaguacgucucuaugcggaaagcccucaagguuaaacgcccgagauucgaugugagccugguguaucuuacccggaaguuuauggaccugguccgcuccgcucccggcgggauccucgaucugaauaaaguggccacaaaacuuggaguuagaaagcggcgcguguacgacauuacgaacguccuggauggcaucgaccucguggaaaagaagucuaaaaaucacauuagauggaucgggagcgaucuguccaacuucggagcgguuccucaacagaagaaacugcaggaggaacucucugaccugagcgcuauggaggaugcccuugacgaacugaucaaggauugcgcccagcaacucuuugagcugaccgacgauaaggagaaugaacggcuugcuuaugugacauaccaggacauucauuccauccaggccuuccacgagcagauugucaucgcugugaaagcccccgcggaaacccgccuggacgugccugcccccagagaggauagcauuacaguccauauccggucuaccaacggcccuauugacguuuaucucugugagguggaacaagggcagacauccaauaagcgcagcgagggagugggcaccucuuccagcgaaucuacgcacccggagggccccgaagaggaggaaaacccucagcaguccgaggaacugcuggaggucagcaauuga

SEQ ID NO: 68640 - RNA, 2736 nt, Artificial Sequence
  derived and/or modified sequence opt5 from E2F7__Homo_sapiens__NP_976328
auggaggugaacugccugacccucaaggaccugaucagccccagacagccucggcuugauuucgccgucgaagacggcgagaaugcucaaaaagaaaacauuuuuguugaucgcuccagaauggccccgaagacacccaucaaaaaugagccuauugaccugucuaagcagaaaaaguucacgcccgaacggaacccuaucacccccgugaaguuuguggaucgccagcaggcggagccuuggacaccgaccgcuaaucucaaaaugcugauuagcgccgccucccccgacaucagagaucgggagaagaaaaaggggcuuuuccgcccuaucgaaaacaaagacgaugcuuuuacagacucucugcaacucgaugucgugggagacagcgccguugaugaguucgaaaagcagagacccucccggaagcagaaaucucugggccugcucugucagaaguuucuggcucgcuacccuagcuauccccuuuccaccgagaaaacaaccauuagccuggacgagguggccgucucucucgggguggaaagacggcgcaucuacgacauuguuaaugugcuggagucccuucaccuggucagcagaguggcgaagaaccaauauggauggcauggccggcacucucucccgaaaacgcugcgcaaucugcagagacucggggaagaacagaaguacgaagaacagauggccuaucugcaacagaaagagcuugaucugaucgacuacaaguucggagaacggaagaaagauggcgacccugauucccaggagcaacagcuccuggacuuuagcgaacccgauugcccuucuuccagcgcuaacuccagaaaggacaaaucucuucgcauuaugagccagaaguucgugaugcuguuucucgucuccaaaaccaagaucguuacacuggauguggccgcuaagauucugaucgaggaaagccaggacgcccccgaucauucuaaauucaagaccaaagugcggagacucuaugacaucgcgaauguccugacaucccuugcccugauuaagaaagugcacguuaccgaggagcgcggccggaagcccgcuuuuaaguggaucgggccuguggacuucagcucuagcgaugaggagcucgucgacguguccgccucuguucugccggaacuuaaaagagagacguacggacaaauucaggugugugcuaagcagaaacuggcccgccauggcagcuucaacacaguccaggccuccgaacggauccaaagaaaggugaauagcgagcccucuuccccuuaccgcgaggaacaggggagcggaggcuauucucucgagauugggucccuggcugcggucuaccggcagaaaaucgaagauaacagccagggaaaggccuuugcuuccaagagagugguucccccuucuagcucccuggaccccguggccccguucccuguccucucuguggaucccgaguauugcguuaauccucuggcccaccccguguuuagcgucgcucaaaccgaccuucaggccuucuccaugcagaacggccugaacggccagguggaugugagccucgcgucugcugccuccgccguugagagccugaaaccugcucugcuugccgggcaaccccucgucuacgugccgucugcuucccuguuuaugcuguauggaagccuccaggaaggcccugccucugggagcggauccgagcgcgacgaucggagcucugaagcgcccgccacaguggagcuguccagcgcucccuccgcccagaagagacuuugugaggagcggaaaccucaagaggaagacgagccggcuaccaagcgccagucuagagaauacgaggauggcccccugagccucgucaugccuaaaaagcccuccgacucuaccgaucuggccagcccuaaaacaauggggaaucgggcguccaucccccugaaggacauucacgugaacggacagcuuccugccgcugaagagaucucuggcaaggccacggcuaauagccucguuuccagcgaguggggcaaccccucuagaaauaccgacguggaaaaaccguccaaggagaacgaaagcacaaaagagccuucucugcugcaguaucucugcguccaaucccccgccgggcugaauggauucaacgugcuucugagcggcucucagaccccucccacaguugggccguccagcggacagcucccuuccuuuagcgugcccuguaugguccugccuucuccuccccugggccccuucccggugcuuuacagccccgccaugccugggcccguuuccucuacccucggcgcucugccuaauacgggacccgugaacuuuagccugccuggccucggguccauugcgcagcugcuugucggaccgacagccguggugaaucccaagucuagcacccugccuuccgcugauccccaacuccagucucagccuagccugaaccugucccccgucaugagccgcucucauuccguugugcagcaaccggaaagcccuguguacgucggccaccccgugucuguugugaaacuucaucagucccccgucccugugacccccaagagcauccagcggacacacagagagaccuucuuuaagacaccugggucccucggagacccgguucugaaacgcagagagcggaaucaaucucgcaacacgagcuccgcccagagacggcuggaaauucccagcggcggggccgauuga

SEQ ID NO: 68641 - RNA, 2604 nt, Artificial Sequence
  derived and/or modified sequence opt5 from E2F8__Homo_sapiens__NP_078956
auggagaacgaaaaggagaaucuguucugcgaaccccacaaaagaggccucaugaagaccccucugaaagagagcacaacggccaacaucgugcuugcugaaauucagccggacuuugggccccugaccacaccuaccaagcccaaagagggaucccaaggcgagccuuggacacccaccgccaaucucaagaugcugaucucugcggucagcccugaaauucggaaccgcgaucagaagagagggcuuuucgacaaucgguccggacugccggaggcuaaagauuguauccaugaacaccucucuggcgacgaguuugaaaagagccagcccucccgcaaagaaaagucucuggggcugcucugccauaaauuccuggccagauacccuaacuaucccaauccugccguuaacaaugauauuugucuugacgagguggcugaggagcugaacguggaacggcgcagaaucuacgauaucgucaaugugcucgagagccugcacaugguuucccggcuugccaagaaccgcuauacauggcauggaagacacaaucugaacaagacccucggcacgcugaaaagcauuggcgaggaaaauaaguacgcugagcagaucaugaugauuaaaaagaaagaauaugagcaagaauuugacuucaucaagucuuacuccauugaggaucacaucauuaaaagcaacaccgggcccaacggacauccggacaugugcuuuguggagcugccuggcgucgaauuucgggccgcgucuguuaauucccgcaaggauaagagccucagagugaugucucagaaauuugugaugcuguuccuugucuccacaccccagaucgugagccuggagguggccgcuaagauccucauuggggaagaccacgucgaggaucuggacaaauccaaguuuaaaaccaagauccggcgccuuuaugacauugccaacguucugucuagccucgaucugaucaagaaagugcaugugacagaagagagaggacggaagccugcuuucaaauggaccggccccgagauuucccccaauacgagcgggucuuccccugucauccacuuuacaccgagcgaccuggaagugagacgcucuagcaaggagaacugugccaaaaaucucuucuccacccggggaaagcccaacuucacaagacacccuucucugaucaaacuuguuaagagcauugaauccgaucgccggaagaucaauagcgcgcccucuuccccuauuaaaaccaacaaggccgagagcucucaaaauuccgcucccuuuccgagcaaaauggcccagcuggcugccaucugcaagaugcagcucgaggaacaguccucugagagcagacagaaggugaaaguccaacuggcccgcuccggcccuuguaagcccguggcuccucuugaucccccuguuaacgcggaaauggagcugaccgcccccucucucauucagccgcugggcauggugccucugauccccagcccccucuccagcgcugucccucugauccuuccgcaggcccccucugggccuuccuacgccauuuaccugcaacccacacaggcucaucagagcgugacgccuccccagggacucucuccuaccgucugcacaacccacuccagcaaagccacaggcucuaaggacagcaccgacgcgacgacagaaaaagcugccaaugauaccuccaaggccagcgcuucuacccggcccgggucccugcugccggccccugagagacaaggagcuaaaagccgcacacgggagcccgccggcgaaagaggguccaagcgcgcgucuaugcuugaggacagcggauccaagaaaaaguucaaagaagaucucaagggccuggagaacgugucugccacccuguuuccuagcggcuaucucaucccccugacacaguguuccucucuuggggcugaaagcauucuguccggaaaagagaauagcucugcccucuccccgaaccaucggaucuacagcucuccuauugcuggcguuauccccgugacguccagcgagcugaccgccgucaauuucccuucuuuucacgugacaccccugaaacuuaugguuucccccaccagcguggcggccgucccuguggggaacuccccggcucucgccagcucucaucccgugccuauucagaaccccagcuccgcuaucguuaauuucacacugcagcaccugggacucaucucuccuaacguccaacugagcgccucccccggcucugggauugugccugugagcccgagaaucgaauccgucaauguggcccccgagaacgcuggcacccagcagggacgggcgacgaauuaugacucuccuguucccggccagagccaaccuaacgggcaguccguggccgucaccggagcucagcagcccgugccgguuacaccuaagggcagccaacuuguggccgaaucuuucuuccgcacccccgggggacccacaaagccuaccuccagcucuugcauggauuuugagggcgccaauaagacgucccuggggacacucuucgucccccagagaaaacuggaagugagcaccgaggacguucacuga

SEQ ID NO: 68642 - RNA, 2355 nt, Artificial Sequence
  derived and/or modified sequence opt5 from E4F1__Homo_sapiens__NP_004415
auggagggcgccauggcugugagagucaccgccgcgcacacagcugaagcccaggccgaggcugggcgggaagccggagagggcgcuguugccgcgguggccgcugcccuggcucccagcggguuccucggacugccugccccguuuuccgaagaggacgaggaugacgugcaucgcugcggcagaugucaagcggaguucacggcccuugaagauuuuguccagcacaagauccagaaagccugccagcgggcucccccugaagcucugcccgccaccccugccacaaccgcucuccuggggcaagaggugguucccgcggccccuggaccggaggaacccauuacaguggcucauaucgucguggaggccgccucucuugcugccgacauuagccacgcguccgaucugguuggcggcgggcauaucaaggaagugauugucgcugccgaggccgaacucggagacggcgagauggcugaggccccugggucuccccaccagcagggacugggccuggcuggggaaggagagcaggcccaagugaaacuccuggugaacaaggauggccgcuacgucugugcgcuuugccacaaaaccuucaagacaggcagcauccugaaggcccauaugguuacccacuccucuagaaaagaccaugaauguaagcucugcggggcuagcuuucggacgaaaggaucccugauccgccaccacagacggcauaccgaugagcgcccuuauaaguguagcaaaugcggcaagucuuucagagaauccggggcccuuacacggcaccucaagagccugacccccuguacagagaaaauucgcuuuucuguguccaaggacguggucgugagcaaagaggaugcuagagccggaucuggcgcgggggccgcuggacugggcaccgccacguccagcguuacaggcgaaccgaucgagaccuccccugugauucaucuggucacagacgcuaaggggaccgugauccacgaaguucaugugcagaugcaggagcucucucugggaaugaaagcccuugcccccgaaccucccgucagccaggagcugcccugcuccagcgagggcucucgggaaaaucuccugcaccaagcuaugcagaacuccgggauugugcuugagcgcgcggccggagaagagggcgcucuggagccugccccggccgcugggagcucuccccagccucucgccgucgcggcuccccaacugccugugcuggaaguucagccccucgagacccagguggccagcgaagccuccgcugucccgagaacacacccuuguccccagugcucugagacguucccuaccgccgcgacacuggaagcucauaagcggggccacaccggacccagaccuuuugccugcgcccaauguggcaaggcuuuccccaaggccuaccuucugaagaaacaucaggaggugcacguucgcgagcggagauuucgcugcggggauuguggaaagcucuauaaaacaaucgcucacgugcggggccauagacgcguccacagcgacgaacggccguacccuugccccaagugugggaaaagauauaagaccaagaaugcccaacaggugcauuuccgcacgcaccuggaggaaaaaccccaugugugccaguuuuguucccggggauucagagagaagggcagccuuguucgccacguccggcaccauacaggggaaaaaccuuucaagugcuacaaauguggcagaggauuugcggagcacggcacccugaaccggcaucuccgcaccaaagggggaugccugcuggagguggaggaacuccuggugucugaagacuccccggccgcugccacaaccguccuuacagaggauccccacacggugcugguugaguucagcucuguggucgcugacacccaggaauauauuaucgaggccacagccgaugacgcugaaaccuccgaggcgacagaaaucauugagggcacccagacggagguggauagccauaucaugaagguugugcagcaaauuguccaccaggccuccgcugggcaccagaucauugugcagaauguuaccauggacgaagagacagcccucggaccugaagccgcugccgcggauaccaucacaaucgcuacccccgagucucugacggaacaaguggccaugacacuggccagcgcuauuuccgagggcaccguccuugccgcgagagcugggacaucuggcaccgagcaggccaccgugacaauggugagcuccgaagacaucgagauucucgaacaugccggagagcuggucaucgcuagcccugaaggccagcuggagguucaaacggugauuguguga

SEQ ID NO: 68643 - RNA, 807 nt, Artificial Sequence
  derived and/or modified sequence opt5 from EAF1__Homo_sapiens__NP_149074
augaacggcaccgccaauccccugcucgacagagaggaacacugccugcggcuuggggagagcuucgaaaagcgcccuagagcuuccuuucauacaauccgguacgauuucaaaccggccucuauugacacgagcugugagggagaacuccaggugggcaagggggaugaggucaccaucacacugccccacauuccuggauccacacccccuaugaccguuuuuaaaggcaacaagcgccccuaucaaaaagacugcgugcugaucauuaaucaugauaccggggaguacgugcuugaaaagcugucuagcuccauccaggucaagaaaacaagagcggagggaucuagcaagauccaggcucggauggaacagcaaccuacccgcccgccccagacgucccagccucccccucccccgccucccaugccuuucagagcccccaccaaacccccugugggcccgaagacaagcccccucaaagacaacccuucucccgagccucagcuggaugacauuaagcgggagcugcgcgccgaaguugauaucauugagcaaauguccagcucuagcggcuccucuuccagcgacuccgaaucuagcuccgggagcgaugacgauucuuccagcucuggaggcgaggacaaugggcccgcuagcccgccucagcccucccaccagcagccuuauaacucuagacccgccguggcuaauggaaccagccggccucaaggcuccaaccagcucaugaauacacugcgcaacgaccuucagcugagcgaaucuggguccgauagcgacgauuga

SEQ ID NO: 68644 - RNA, 783 nt, Artificial Sequence
  derived and/or modified sequence opt5 from EAF2__Homo_sapiens__NP_060926
augaacagcgccgcuggcuucucccaccuggacagacgggagcgcgugcucaagcugggggaaucuuuugagaaacagcccagaugcgccuuccauaccguccgguacgauuuuaagccugcgagcaucgacacauccucugaaggauaucuugagguuggcgaaggggagcaagugacgauuacccugccgaauaucgagggaagcacacccccugugaccgucuucaaaggcuccaagaaacccuaccucaaggaauguauucugaucauuaaccacgauacaggggagugccgccuugaaaagcugucuagcaauaucaccgugaaaaagacaagaguugagggauccagcaaaauccaguaucggaaggagcagcagcaacagcagauguggaacucugcucgcaccccuaaucucgugaaacauucccccagcgaagacaagaugucuccugccuccccgauugaugacaucgagagagaacugaaggccgaggcuagccugauggaucagaugucuuccugugacagcuccucugauagcaaauccucuagcuccagcucuagcgaagacuccucuagcgauuccgaggacgaggauugcaagagcucuacguccgacaccggcaacugugucagcggccaccccacaaugacccaauaccggauuccugacaucgaugccucucauaaucgcuuuagagacaacuccgggcuccugaugaauacacuucggaacgaucugcagcucagcgaauccggaucugacagcgaugacuga

SEQ ID NO: 68645 - RNA, 1572 nt, Artificial Sequence
  derived and/or modified sequence opt5 from EARS2__Homo_sapiens__NP_001077083
auggccgcucugcucagacggcugcuucagcgcgagagacccagcgccgcguccggccggccuguggggcgcagagaagcuaaccugggaaccgacgccggcgucgccguucgggugcgcuucgcuccgucucccacaggguuucuccaccugggaggccuuagaacggcccuguacaauuauaucuucgcuaagaaauaccaagggagcuuuauucuccggcuggaggauaccgaccagacacgcguggucccuggagccgcggaaaacaucgaggauaugcuggaaugggccggcauucccccugacgagucccccagacggggcgggccugcuggaccguaucagcagucucaacgccucgagcuguacgcccaggcuaccgaagcccuucugaagacaggcgcggccuaucccugcuucuguagcccucagagacucgagcugcuuaaaaaggaagcucugcggaaucaucagacccccagauacgauaacagaugccggaauaugucccaagaacagguggcccagaaacucgcuaaggacccuaagcccgccaucagauuucgccuggagcagguugugccggccuuccaagaucuggucuauggguggaaccggcacgaaguggcuucuguugagggagacccugugauuaugaaaagcgauggcuuucccacauaccaucucgcgugugucguggacgaucaccauauggggaucucccacgugcugagaggaagcgaauggcuugucucuaccgccaagcaucugcuccuguaccaggcucuuggcuggcagccuccccacuucgcccaucugccccuccugcugaaucgcgacggcuccaaacucagcaagcggcaaggggauguuuuucuggagcacuucgccgcugacggauuucuuccugacucucugcucgauaucauuacgaacugcggcuccggguucgccgaaaaucagaugggaagaacccugccggagcuuaucacacaguuuaaccugacccaggugacaugucacagcgcgcuccuggaccuggagaaacuccccgaguucaaucgccugcaccuucaacggcuggugucuaacgagucccagagacgccagcucgucggcaagcugcaagugcugguugaagaggcuuucgggugccagcuucagaaucgggaugugcucaacccugucuauguggaacgcauucugcugcuccgccagggacauaucugucggcugcaggaccuuguuagccccguguacuccuaucuguggaccagaccugccgucggccgggcccaacucgaugcuauuucugagaagguggacgucaucgccaaacgcgugcugggccugcuugagagaagcuccaugagccucacgcaggauaugcugaauggggaacugaagaaacucucugagggacuggaaggcacaaaguacuccaacguuaugaaacuucugcggauggcucucagcgggcagcagcaaggacccccgguggccgagaugaugcuggcgcugggcccuaaggaagucagagagcgcauucagaaagugguuucuagcuga

SEQ ID NO: 68646 - RNA, 642 nt, Artificial Sequence
  derived and/or modified sequence opt5 from EBAG9__Homo_sapiens__NP_001265867
auggccaucacccaguucagacuguuuaaguucugcacaugucucgcuacgguguuuagcuuccugaaacggcuuauuugccgcuccggcagagggcggaagcugucuggagaccaaaucacccuccccacaaccgucgauuacagcuccguuccuaaacagacagacguggaggaauggaccucuugggaugaggacgccccgacaagcgugaagauugaaggcgggaacggaaaugucgcgacccagcagaacucccuggagcaacuugaacccgauuauuuuaaagacaugacgccuaccauccgcaagacacagaagauugugaucaaaaagagagagccccugaauuucggcaucccugaugggucuaccggauuuagcucccggcucgcugccacacaggaccugcccuucauucaccagagcucugagcugggcgaucucgacaccuggcaagaaaacacgaaugccugggaggaagaggaggaugcugccuggcaggcugaagagguucugcgccagcagaaacuugccgacagagaaaagcgggcggccgagcaacagcgcaaaaagauggaaaaggaggcucagagacugaugaaaaaggagcaaaacaaaaucggcgugaagcucuccuga

SEQ ID NO: 68647 - RNA, 1776 nt, Artificial Sequence
  derived and/or modified sequence opt5 from EBF1__Homo_sapiens__NP_076870
auguucggcauccaggagagcauucagagauccgggucuagcaugaaggaggaaccccugggauccggcaugaacgccguccggaccuggaugcagggggcuggaguccucgacgccaauacagcggcucagucuggcguugggcuggcccgcgcccacuuugaaaaacagccuccgagcaaccuuagaaaguccaauuucuuucauuucgugcuggcucucuacgaucggcaaggacagcccguggagaucgaacgcacggccuuugucggcuucguggagaaagagaaggaagcuaacucugagaaaaccaauaacggcauucacuauagacugcagcuucuguacagcaaugggauccggacagaacaggacuuuuauguucgccucauugauuccaugaccaagcaagccaucguguacgagggacaggacaagaacccugagaugugcagaguccugcugacacaugaaaucauguguagccggugcugugauaaaaagucuugcggcaaucgcaacgagacccccuccgacccugugauuaucgauagauucuuucucaaauucuuucugaaguguaaucagaacugccuuaaaaaugcggggaacccccgggacaugcgcagauuccagguuguggucagcacaaccgugaauguggauggacacguccuggccguuucugacaacauguuugugcauaacaauuccaagcacggccggcgcgcuagacggcucgauccuagcgaagggacgccgucuuaucuggagcacgccacccccuguauuaaggcuaucuccccuagcgaaggauggacaaccggcggcgccacagugauuaucauuggggacaacuucuucgauggacuucaagucaucuuuggcaccaugcuggugugguccgagcucaucacgccccaugcgauuagaguucagacaccuccccgccacaucccggggguggucgaggugacccugucuuacaaaagcaagcaguucugcaaaggaacaccuggccgguuuauuuauaccgcccugaaugaacccaccaucgacuacggguuccaaagacuccagaagguuauuccucgccaucccggagaccccgagcggcugccuaaagaagugauccuuaagagagcugccgaucuggucgaggcucucuacggcaugccgcacaacaaucaggaaaucauucugaaacgcgccgccgacaucgcugaggcgcuuuauuccgugccccggaaccacaaucagcugccugcccucgcuaacacaagcguccaugccggcaugauggggguuaauucuuuuuccggacaacuggccgugaacgugagcgaggcuucucaggccacgaaucagggcuucaccagaaacagcuccucugucagcccccacggguacgugccuuccacaacaccccagcaaaccaauuauaacagcguuaccacgucuaugaauggauacggcuccgcggcuaugagcaaccucgggggcucuccgacauuucugaacggauccgccgccaauagcccuuaugcuauugugcccuccucuccuaccauggccagcuccaccucucugcccagcaacuguuccucuagcuccggcaucuucagcuuuucuccugcuaauauggucuccgccgugaagcaaaagagcgcguucgcccccgugguucgcccgcagacaucuccucccccuaccugcacaagcacgaacggaaauucccuucaggcuauuagcgggaugaucgugcccccgauguga

SEQ ID NO: 68648 - RNA, 1728 nt, Artificial Sequence
  derived and/or modified sequence opt5 from EBF2__Homo_sapiens__NP_073150
auguucggcauccaggacacccuggggagaggacccacacucaaggagaaaagccugggcgccgaaauggauuccgugcggucuuggguccgcaacguuggggugguggacgcuaaugucgccgcgcaaagcggaguggcucuuuccagagcccacuuugagaagcagccuccgucuaaccugcggaaaagcaauuucuuucauuucguucucgcccuguacgaucgccagggccagcccguggaaauugagagaacggcuuuugucgacuucguggaaaacgauaaggagcaagggaaugagaaaaccaacaauggaacacacuauaaacuucagcugcucuacuccaacggcguucggaccgaacaggaccuguaugugcgccugaucgauucugucacaaagcagccuauugccuacgagggccaaaauaaaaaccccgaaaugugcagagugcuccugacccaugaggugauguguagccggugcugugagaagaaauccugcgggaaucgcaacgaaacaccuagcgaccccgucaucauugauagauuuuuccuuaaguuuuuccugaaauguaaucagaacugccucaagaccgcuggaaauccucgggacaugcgcagauuucagguugugcugucuacgaccgugaacgucgauggccacgugcuugccguuuccgacaacauguucgugcauaauaacagcaagcacgggcggcgcgcgagacggcuggauccgucugaggccacacccuguaucaaagcuaucuccccuagcgaaggauggaccacaggcggggccauggucauuaucauuggagacaacuuuuucgacggccuccaggugguuuucggcaccaugcugguguggucugagcugaucacgccccacgcuauuagaguccaaacaccuccccgccauaucccggggguggucgaagugacccucuccuauaagagcaaacaguuuugcaagggagccccuggccgguucauuuacacagcgcugaaugagcccaccaucgauuauggguuucagagacuucaaaaaguuaucccucgccaccccggagaccccgagcggcuggccaaggaaaugcuccugaaaagagcugccgaucuuguggaggcucuguacggcaccccucauaauaaccaggacauuauccucaagcgcgccgccgauauugcugaagcgcuguacuccgucccgcggaaucccucucagcugccugcccucagcuccagccccgcucacucugggaugaugggaaucaacuccuauggcagccagcugggcgugucuauuagcgaguccacacaagggaauaaccagggauacaucagaaauacgucuagcaucuccccucgcggcuauucuagcuccagcacaccccagcagucuaacuacuccaccagcuccaauucuaugaacggguauagcaauguuccgauggccaaccuuggagugccuggcucccccggguuccugaacggcucuccuaccggaagccccuacggcauuauguccagcucuccuacagucggguccagcucuaccuccagcauccuccccuuuucuagcuccguguucccggccgugaagcaaaagagcgcuuuugccccuguuauucggccccagggaucucccuccccugcguguagcuccggcaaugggaacggauucagagcuaugacgggccuggucgugccgcccauguga

SEQ ID NO: 68649 - RNA, 1656 nt, Artificial Sequence
  derived and/or modified sequence opt5 from EBF3__Homo_sapiens__NP_001005463
auguucggcauccaggagaacauucccagagggggaaccacaaugaaggaggaaccucugggcagcgggaugaauccgguccgguccuggaugcacacggccggagucguugacgcuaacaccgccgcgcaaucuggcguggggcucgcucgcgcccauuuugaaaaacagcccccuagcaaucugagaaaguccaacuucuuucacuucgugcuugcccuguacgaucggcagggacagcccgucgagaucgaacgcacagcuuuuguggacuucguugagaaagagaaggaaccuaauaacgagaaaaccaauaacggcauucauuauaagcuccaacugcuuuacucuaauggcgugagaacagaacaggaucuguauguccggcucaucgacagcaugaccaagcaggccauuguguacgaggggcaggauaaaaaccccgagaugugccgcguucugcugacacacgaaaucauguguuccagaugcugugacaagaaaucuugcggaaaucggaacgagaccccuagcgauccggugaucauugaccgcuuuuuccucaaguuuuuccugaaauguaaucaaaacugccuuaagaaugcuggcaaccccagagauaugcggcgcuuucaggucgugguguccacgaccgucaacguugacgggcaugugcuggccgugagcgauaauauguucguccacaacaauucuaagcacggaagacgggcgcgcagacucgacccuuccgaagccacacccuguaucaaagcuauuagcccuucugagggcuggaccacagggggagccaccgugaucauuaucggcgauaacuuuuucgacggccugcagguuguguucgggacgaugcuugucugguccgaacugauuacaccccaugcuauccgggugcagaccccgccuagacacauccccggaguuguggaggucacacucagcuauaagucuaaacaauuuugcaagggcgccccugggcgcuucguguacaccgcgcugaaugagcccaccauugacuauggauuucagcggcugcagaaagucauccccagacauccuggcgauccggaacgccuccccaaggaggugcugcuuaaacgggccgcugaccugguugaagcccucuacgggaugccucacaacaaucaagagauuauccugaagagagcugccgauauugccgaagcucuuuacuccgugccccgcaaccacaaucagaucccuacacugggaaacaaucccgcgcauacgggcaugaugggcgucaacagcuucuccucucagcucgccgugaauguuagcgagaccucccaggcuaacgaccaagugggguauagccggaauacaucuuccgucagcccgagaggauacgugccuucuagcacaccccagcaguccaacuauaacaccgugucuaccagcaugaauggcuacggguccggagccauggccagccugggcguuccugggucucccggcuuucugaacggauccagcgcuaauucuccuuauggcaugaagcagaaauccgccuucgcgcccgucgugcgcccgcaagcuagcccuccucccuccuguacgucugccaacgggaauggacuccaggccaugagcggccugguggugcccccgauguga

SEQ ID NO: 68650 - RNA, 1797 nt, Artificial Sequence
  derived and/or modified sequence opt5 from EBF4__Homo_sapiens__NP_001103984
auggacgcccugcccagaagcggccucaaccugaaggaggaaccucuucugccggcugggcucggauccgugcggucuuggaugcagggcgccgggauccuggaugcgagcaccgcugcccaauccggagucggccuugcccgcgcucacuucgagaaacagcccccuucuaaucugagaaagagcaacuuuuuccauuuuguucucgccauguacgaccggcaggggcagcccguggaaguggagcgcacagcuuucauugauuuugucgaaaaagacagagagccuggagccgagaagacgaauaacggcauccacuaucggcugcgccugguguacaauaacggccucagaaccgaacaagaucuguauguucggcuuauugacuccaugucuaaacaggcgaucauuuacgaggggcaggauaagaaucccgaaaugugccgcgugcugcucacacaugagaucauguguagcagaugcugugaccggaaguccugcggaaaccgcaaugagaccccuagcgauccggucaucauugacagauucuuucugaaauucuuucuuaaguguaaccagaauugccugaaaaacgccggcaauccccgggauaugcgcagauuccaagugguugugucuacaaccgucuccguggacgggcacgugcucgcugucagcgauaacauguuuguucauaauaacucuaagcacggacggagagcccgccggcuggacccuuccgaagcugccacacccuguaucaaagcgauuagcccuggcgagggguggaccacgggaggcgccaccgugaucgugauuggcgacaacuucuuugaugggcugcaggucguguucggaaauguucucguguggucugaacugaucacaccccacgcuauuagaguccagaccccgccucgccauauccccggcgugguugaggugacacuuuccuauaagagcaagcaguucugcaaaggguguccuggacgguuugucuacaccgcccugaacgaacccacgaucgacuauggcuuccaaagacuccagaaggugauuccccgccacccuggggauccggagcggcugcccaaagagguccuucugaagagagcugccgaccucgccgaagcucuguacggagugccuggcuccaaucaggagcugcuccugaaacgcgcggccgauguugcugaagcccuuuacucuacaccccgggccccuggcccccuggcuccgcucgccccuagccauccccacccugcgguggucgggaucaacgcuuuuuccagcccccuggccauugccgugggagacgcuaccccuggccccgagccgggguaugccagaucuugcuccagcgcuucuccucgcggauucgcccccagccccggcucccaacagucuggguacggcggaggccuuggggcgggacugggcggguauggagccccuggcguugcugggcucggcgugccgggaagccccuccuuucugaauggcagcacagccaccucuccuuucgcuaucaugcccuccagcccuccccuggccgcggccucuuccaugagccucccugcugccgcucccaccacauccgucuuuucuuucagcccggugaacaugauuuccgccgugaagcagcggucugccuuugcuccuguucugagacccccuagcuccccgccccaggcguguccucgggcccacggggaaggacuucccgaucagagcuucgaggacucugauaaauuucauuccccugcucgcggccugcaagggcucgccuacagcuga

SEQ ID NO: 68651 - RNA, 690 nt, Artificial Sequence
  derived and/or modified sequence opt5 from EBI3__Homo_sapiens__NP_005746
augacaccccagcugcuccuggcccuugugcugugggcuagcugcccuccguguuccggcagaaaggggcccccugccgcgcucacccugccccggguccaaugccgcgcuucuagauacccuaucgccguugacuguagcuggacgcuucccccugccccgaacuccaccucucccgugagcuucauugcuacauaucggcugggaauggccgcucgcggccacuccuggccuugccuccagcagacccccacaucuaccagcuguacaaucaccgaugugcagcuguuuuccauggccccuuacguccugaaugugacggcgguucaucccugggggucuagcuccagcuucgugccguuuauuaccgagcacaucauuaaaccugaucccccugaaggagucagacucucuccccuggccgagcggcaacuucaggugcagugggaacccccuggcuccuggccguuccccgagaucuuuagccugaaguauuggauccgcuacaaaagacagggggcugcccgguuccaucgcguuggaccuauugaagcuacaucuuuuauccucagagccgugcggccccgcgcgagauauuacguccaaguggccgcucaggaccugaccgacuauggcgagcuuuccgauuggagccugccugccacagcuaccaugucccucggcaaguga

SEQ ID NO: 68652 - RNA, 693 nt, Artificial Sequence
  derived and/or modified sequence opt5 from EBP__Homo_sapiens__NP_006570
augaccacaaacgccggcccccugcacccuuacuggccgcagcaucucagacuggacaauuucgugcccaacgaucggccuacguggcacauccuugcugggcuguuuagcgucaccggaguucucguggugacaaccuggcugcuuuccggccgcgccgcggucgugccccuggggacauggagacggcucucucugugcugguucgcuguuuguggauuuauucaucuggugaucgagggcugguucguccucuauuacgaagaccugcuuggggaucaagccuuucugagccagcucuggaaggaguaugccaaaggagacucccgcuacauucugggcgauaauuucaccgugugcauggaaacaaucaccgcuugucuuuggggcccucugucucucuggguugugauugccuuucugagacagcacccccugcgguucauccuccagcuggucgugagcguggggcaaaucuauggagacguccuuuacuuucugacggagcaucgcgauggcuuccagcacggggaacucggacacccucuguauuuuugguucuacuuuguuuucaugaacgcucuuuggcuggugcucccgggcgugcugguccuggacgccgugaagcaucucacccacgcgcaguccacacuggaugccaaagcuaccaaggccaaaucuaagaagaauuga

SEQ ID NO: 68653 - RNA, 405 nt, Artificial Sequence
  derived and/or modified sequence opt5 from EBPL__Homo_sapiens__NP_001265565
augggcgccgagugggaacugggggcugaggccggaggcagccuccugcuuugcgcggcucugcucgccgccgggugugcucugggacuuagacugggccgggggcagggagccgcugaccgcggcgcccucaucuggcugugcuacgaugcgcuggugcacuucgcccucgaaggccccuuugucuaucugucccuuguugggaacguggcuaauucugacggacugauugccagccucuggaaggaguacggcaaagcugaugccagauggguguauuucgacccuaccaucgucuccguggaaauucugacaguugcgcuugaugggucucuggcccucuuucugaucuacgcuauugugaaggagaaauauuaccgggaccgcgucgccuggggagaguga

SEQ ID NO: 68654 - RNA, 2034 nt, Artificial Sequence
  derived and/or modified sequence opt5 from ECD__Homo_sapiens__NP_001129224
auggaggaaaccaugaagcuggccacaauggaggacacgguggaauacugccucuuccugauccccgaugagagcagagacuccgauaaacacaaggaaauucuucagaaauauaucgagcggauuaucacccgcuuugcuccuaugcuggucccguacauuuggcaaaaccagcccuucaaucucaaguauaaaccuggcaaagggggaguucccgcccauauguuuggcgugacaaaguucggggacaacaucgaggaugaaugguuuaucguguacgucauuaaacagaucaccaaggaguucccugaacugguggcgagaauugaggacaaugauggagaguuucuucugaucgaagcugccgacuuccuccccaaauggcuggauccugagaacucuacaaaucggguguuuuucugucacggcgaacugugcauuaucccggcuccccgcaagagcggggcugaguccuggcucccuaccacacccccuaccauuccccaggcccugaacaucaucacggcucauucugaaaagauucuugccagcgaguccaucagagcggccguuaaucggcgcauuagaggauauccggagaagauccaagccucucugcaccgggcccauuguuuucucccugcuggcauugucgccgugcugaagcagcgccccagacuuguugcggccgcugugcaggccuucuaccugcgggacccuaucgaucuccgcgcuugcagagucuuuaaaaccuuccugcccgaaacacggaucaugaccagcgugacauucaccaagugucuguaugcccagcucgugcaacagcgcuuuguccccgacagacgguccggcuacagacugccuccgcccagcgauccucaguaccgcgcccacgagcuugggaugaaacuggcucacggauucgaaauucucugcucuaaguguagcccccauuuuuccgacugcaaaaagucucugguuacggcguccccucuuugggccagcuuccuggagucucucaaaaagaacgacuauuuuaagggccugaucgaaggguccgcucaguaccgggagagacuggagauggccgaaaauuauuuccaacucagcguggauuggcccgagcgccuggaagugcaguggcgggacccgggacuucugcaggccccucccccuggcuuuacacccuucauuugucucucccugcuuucuaccugggauaacagcucccuggcuaugagcccuggggaggaaauccucacacugcugcaaaccauucccuuugacaucgaggaucucaaaaaggaggccgcgaaucugccgccugaagacgaugaccaguggcuugaucugucucccgaccagcucgaucagcugcugcaagaggcugucggcaaaaaggaauccgagagcgugucuaaagaggaaaaggagcagaacuacgaccuuaccgaaguuagcgaguccaugaaggccuucaucucuaaagugagcacacacaagggagccgaacuccccagagagccuuccgaggcuccgauuacguuugacgccgauagcuuccugaauuauuuugacaaaauccugggcccccgcccuaacgaaucugauuccgacgaucucgacgaugaggacuucgaaugccuggauagcgacgaugaccuugauuucgagacccaugaacccggggaggaggcuucucugaagggaacacucgacaaucugaaauccuacauggcccagauggaccaggaacuggcgcacaccuguauuagcaaguccuuuacaacccggaaccaagucgagccugugucucagacgacagauaacaauagcgacgaagaggauuccggcaccggggaaucuguuauggcccccguggacgucgaucuuaaccucgugagcaauauccuggaguccuauagcucucaggcuggacuggccggcccugcuuccaaccuccugcagagcauggggguccaacuucccgacaauaccgaucacagaccgacaucuaagccuaccaaaaacuga

SEQ ID NO: 68655 - RNA, 2211 nt, Artificial Sequence
  derived and/or modified sequence opt5 from ECE2__Homo_sapiens__NP_001032401
augaacguggcccugcaggagcucggcgcugggagcaaugucggauuccaaaagggcaccagacagcugcuugggucccggacacagcuggaacucguucuggccggagcgucucuucugcucgcugcccugcugcucggcugccugguggcccuuggggugcaguaccaccgcgaccccagccauuccacgugucugaccgaggcuugcaucagagucgccggaaaaauucucgaaucucuggaucggggcgugagcccuugugaggacuuuuaucaauucuccugcggcggguggauccgcagaaacccgcuucccgauggacggucucgcuggaauacauuuaacagccugugggaccagaaucaggcuauucucaagcaucugcuggaaaacaccacauucaauuccagcucugaggccgagcagaaaacccaaagauuuuaccucuccugucugcagguugaacggaucgaggaacuuggcgcgcagccucugcgcgaucucauugagaagaucgggggauggaacaucacaggccccugggaccaggauaauuucauggaggugcugaaagccgucgcugggaccuauagagccacgccuuucuucaccguguacauuagcgcugacucuaaguccagcaacucuaauguuauccaaguggaucaguccggacuuuuucugcccagccgggacuauuaccucaaccgcacagccaaugaaaagguccugaccgcguaucuggauuacauggaggaacucggcaugcugcuuggcgggagaccuacauccacccgggagcagaugcaacaggugcuggaacucgagauucagcuggccaacaucacggugccgcaggaccaacgcagagaugaggagaaaauuuaccacaagaugucuaucagcgagcuucaggcucuggcccccuccauggacuggcucgaauuucugagcuuucugcucucuccucuggagcuuuccgacagcgaacccgucguuguguauggaauggauuaccugcaacaggugucugagcucauuaaucggacagagccuagcauccugaacaacuaucugaucuggaaucuuguccagaaaaccacauccucucucgacagacgcuucgaaagcgcucaggagaagcugcuggaaacccucuacggcaccaaaaaguccugcgugccccgguggcagacauguauuagcaacacggaugacgcccugggguuugcccuuggaucucuguucguuaaggcuaccuucgauagacaguccaaagagaucgcggaaggcaugauuagcgagauccgcacagccuuugaggaagcucucgggcaacugguguggauggacgagaagacccggcaggccgccaaagaaaaggcugaugccauuuaugacaugaucggauucccggauuuuauccuggagccuaaagagcuugacgaugucuacgacggcuaugaaauuucugaggacuccuucuuucagaauaugcucaaccuguacaauuucagcgcgaaggugauggcugaucagcugagaaaacccccuucccgcgaccaauggucuaugacaccccagaccguuaacgccuacuaucuccccacgaagaaugaaaucguguuuccugccggcauucugcaggcuccguucuacgcccggaaccaccccaaggcucuuaauuuugggggaaucggcgucgugauggggcaugagcugacacacgccuucgaugaccaaggaagagaauaugauaaagagggcaaccuccgcccuugguggcagaaugagagccuggcggccuuucggaaccacaccgcuugcauggaagaacaguacaaucaguaucaagucaacggggaaagacugaauggccgccagacccuuggagagaacauugccgacaacggcgggcucaaggcugccuacaaugcguauaaagccuggcugcggaagcauggagaggaacagcagcugcccgcugugggccucacaaaccaccaacuguucuuuguuggguucgcccaggugugguguuccgucagaaccccugagucuagccaugaaggacuugugacagauccccacuccccggcucgguuccgcguucugggcacgcucagcaauucuagagacuuucugcggcacuucgggugcccugugggcucccccaugaacccuggacagcugugugaggucugguga

SEQ ID NO: 68656 - RNA, 2322 nt, Artificial Sequence
  derived and/or modified sequence opt5 from ECEL1__Homo_sapiens__NP_001277716
auggagcccccuuacagccugaccgcccacuaugacgaguuccaggaggugaaguacgucuccagaugcggcgcugggggagcccggggcgcgucucucccgcccggguuuccucugggagcugcccgcagcgccacaggcgcuagauccgggcuuccccgguggaaccgcagagaaguuugucugcucucuggacugguguucgccgcuggccuuugcgccauccuggcggccaugcucgcucugaaauaucugggcccuguggccgcugggggaggcgccugucccgaggggugcccugaacggaaggcguuugcccgcgcugccagauuccucgcugccaaucuggaugccagcauugacccgugucaagauuuuuacuccuucgcuugcggaggcuggcuucggcgccaugcgauccccgacgauaaacugacguaugggaccauugccgcuaucggagagcagaacgaggaaagacuccggcgccugcuugccagaccuggcggcgggcccggaggcgccgcucagcggaagguccgcgccuuuuucagaucuugucuggacaugcgggagauugaaagacucgggccucgccccaugcuggaggugaucgaggauugcggaggcugggaccucgggggagcggaagaacggccgggcguugcugccagaugggaucugaaucgccugcuuuacaaagcccagggcguguauagcgcugccgcucuguuuucccucacagucagccuggacgaucggaacucuuccagauacgugauccgcauugaccaagaugggcuuacccugccugaacggacacucuaccuggcccaggacgaggacagcgaaaagauccuggcggccuauagaguuuucauggagcgcgugcucucucugcuuggagcugaugccgucgagcagaaggcucaggaaauucugcaaguggagcagcagcucgccaauaucaccguguccgaacacgacgaucugcggagagacgucagcucuauguacaacaaaguuacacuuggccagcugcaaaagauuacgccccaucuccgcuggaaauggcugcuggaucagaucuuucaggaggacuucuccgaagaggaggaaguggugcuccuggcgaccgauuauaugcaacaggucagccagcuuauucgguccaccccucacagagugcugcauaauuaccucguuuggcggguggucgugguucugucugagcaccugagcccucccuuucgcgaagcccuucacgagcucgcucaggaaauggagggguccgacaagccccaagagcuggccagagugugucugggacaggcuaaccggcauuucggcauggcccucggggcccuguucguccacgaacauuuuagcgcugcgucuaaagccaaggugcagcagcuugucgaggauaucaaguauauccugggccaaagacucgaggaacuggacuggauggaugcugagacacgcgccgccgcucgggccaaacugcaguacaugauggugaugguuggauauccggacuuccuucucaagcccgacgcgguggauaaagaauacgaguuugaaguccacgagaagaccuacuucaaaaauauucugaacuccaucagauuuagcauucagcugucugugaagaaaauccgccaggaaguugacaaguggcuccugccuccccaagcucuuaaugccuauuaccugccuaacaagaaucagaugguguuccccgccggcauucuccagccgacacuguaugauccugacuuuccccagagccugaacuacgggggaaucggcaccaucauugggcacgagcuuacgcauggauaugaugacuggggcgggcaauacgauagauccggcaaucuccugcacugguggacagaggcuucuuauagccgguuccugcgcaaagccgaaugcaucgucagacucuacgacaacuuuaccguguacaaccagcgggugaauggaaagcauacacugggcgagaacauugcggauaugggagggcuuaaacuggcuuaucacgccuaccagaaguggguucgcgaacauggcccugagcacccccucccuagacugaaauauacccacgaccaacuguucuuuaucgccuucgcucagaauugguguauuaagcggcgcucccagagcaucuaccuucagguccucaccgauaagcaugcccccgaacacuauagagugcuggggucugugucccaauuugaggaguucggacgggcuuuccauugcccgaaagacagcccuaugaaccccgcccacaagugcucugucugguga

SEQ ID NO: 68657 - RNA, 681 nt, Artificial Sequence
  derived and/or modified sequence opt5 from ECHDC1__Homo_sapiens__NP_001099014
augaugcugcagcuccuggagaaggugaucgaacuugagaacuggaccgaaggcaaagggcugauugucagaggagccaagaauacauucagcuccggcucugaccucaacgcuguuaaaagccuggggacgcccgaggauggaauggccgugugcauguuuaugcaaaauacccuuacacgguucaugcgccugccucucaucuccguggcgcugguccagggcugggcucucgggggaggcgccgaauuuaccacagccugugacuucagacugaugaccccggagucuaagauucgguuugugcacaaagagaugggcaucauucccagcuggggagggacaacccgccugguugaaaucaucggcuccagacaggcucuuaaggugcugucuggggcccucaagcuggauagcaaaaacgcucuuaauauuggaauggucgaggaagugcugcaguccagcgacgagacgaagucucucgaggaagcccaagaguggcugaaacaguucauccagggcccucccgaaguuauucgggcgcugaagaaauccgugugcagcgggcgcgagcucuaccuggaagaggcccuucagaacgagagagaucugcucggaaccgucuggggcggcccugcuaaucuggaagccaucgcuaagaaggggaaauuuaacaaguga

SEQ ID NO: 68658 - RNA, 912 nt, Artificial Sequence
  derived and/or modified sequence opt5 from ECHDC3__Homo_sapiens__NP_078969
auggccgcuguggccguccugagagcguucggcgcuagcgggcccaugugccuccggcgcggaccuugggcccagcugccggccagauuuuguucccgggaccccgcuggcgccgggcgcagagagucugaaccucggcccaccagcgcucgccaacuugauggaaucagaaacauuguucuguccaauccuaagaaacggaacacacucucucuggccaugcuuaagagccugcaguccgacauccuccacgaugcggacucuaaugaucugaaagugauuaucauuagcgccgagggccccguguucuccagcgggcaugaccugaaggaacucacggaggaacagggacgcgauuaccacgcugaggucuuucagaccugcucuaaagugaugaugcauaucagaaaccacccuguuccggugaucgccauggucaauggccuggcuacagccgcgggcugucaacuuguggccuccugcgacauugcuguugccagcgauaagucuuccuucgcuacccccggggugaacgucggacuguuuuguagcacaccuggcguggcccucgcccgggcugugccccgcaaggucgcgcuggagaugcuuuucaccggggaaccuaucucugcccaggaggcucugcuccauggacugcuguccaaaguugugcccgaagccgagcuccaggaggaaacaaugagaauugcccggaagaucgcuagccugucccgcccgguggucucucuuggcaaagccaccuuuuauaagcagcugccucaagaccucgggacggcguacuaucugaccagccaggcuaugguggauaaucuugcccugagagacggacaggagggcauuacagccuuccuccagaaacggaagcccguuuggucccacgaaccuguguga

SEQ ID NO: 68659 - RNA, 873 nt, Artificial Sequence
  derived and/or modified sequence opt5 from ECHS1__Homo_sapiens__NP_004083
auggccgcucugagagugcuccugagcugcguccggggcccccuucgcccuccgguuagaugucccgccuggcggccuuucgcguccggggcuaacuuugaguacaucauugccgaaaagcgcggcaaaaauaacaccgugggacugauccagcucaauagacccaaggcccugaacgcucuuugcgacgggcugauugaugagcucaaucaagcccugaaaacauucgaagaggacccugcugugggagccaucguccugacgggcggggauaaggcguuugccgcuggagccgacauuaaagaaaugcagaaccucucuuuccaggauuguuauagcuccaaguuucugaagcacugggaccaucuuacccaggugaaaaagcccguuaucgcugccgugaauggcuacgcguucggcgggggaugcgagcuggccaugaugugugauaucauuuaugcuggcgagaaagcccaauuugcucagccugaaauccucauugggacaaucccgggagccggcgggacccagcggcugacacgcgccgucggaaagucucuugcuauggagauggugcugaccggcgacagaauuagcgcgcaggaugccaaacaagcuggccucguuuccaagaucugccccguggaaacacuggucgaggaggccauucagugugccgaaaagaucgcuucuaacagcaaaaucgugguggccauggcgaaggaguccgucaaugcugccuucgaaaugacccugacggaggggagcaaacucgaaaagaaacuguuuuacucuaccuucgccacagacgaucggaaggagggaaugaccgcuuuuguugagaaacgcaaggccaacuucaaggaccaguga

SEQ ID NO: 68660 - RNA, 858 nt, Artificial Sequence
  derived and/or modified sequence opt5 from ECI1__Homo_sapiens__NP_001171500
auggcccugguggcuagcgucagaguucccgcccgggugcuccugcgcgcgggcgcuagacuuccuggggccgcccugggacggaccgagcgcgcugccggcgggggagacggcgcuagacgguucgggucccagcgcgugcucgucgaaccggaugccggagcgggcguggccguuaugaaguuuaaaaaucccccugugaacucucugagccuugaguuccugacagaacucgucaucucccuggagaagcuggaaaacgacaaaucuuuuagaggcgugauucucacgagcgaucggcccgggguuuucuccgcuggacuggaccuuaccgagaugugcggccgcucuccugcccacuacgcuggguauuggaaggccgugcaagagcuguggcucagacuguaccagagcaaucuuguccugguguccgcgaucaacggagccugucccgcuggcgggugccucguggcccugacaugugauuaucggauucuggcugacaauccucgccucaaagauacccuggaaaacacaaucggacauagagccgccgagcgggcgcuucagcugggccuccuguuuccgcccgcugaagcccuucaggucggcauuguugaccaaguggugccugaggagcagguccagagcaccgcucugucugccaucgcccaguggauggcuauccccgaucacgcccgccaacucacaaaggcgaugaugagaaaggcuaccgccucccggcuggugacgcagagagacgccgauguucagaauuucgugagcuuuauuucuaaagacuccauccaaaagagccugcagauguaccucgaacgccugaaagaggaaaagggguga

SEQ ID NO: 68661 - RNA, 1095 nt, Artificial Sequence
  derived and/or modified sequence opt5 from ECI2__Homo_sapiens__NP_006108
augaacagaaccgccaugcgggcuagccagaaggacuucgaaaauuccaugaaccaagugaaacugcucaagaaagaucccggcaaugaggucaagcugaaacuuuacgcccuguauaagcaggcgacagaggggccuugcaacaugccgaagcccggaguuuuugaccucaucaauaaagcuaagugggaugccuggaacgcccugggcucucuuccuaaagaagcugcccgccagaauuacguggaccuggugagcucccucucucccagccuggaguccucuagccaggucgaaccugggacggauagaaaguccaccggauucgagacacuggugguuaccagcgaggacggcauuacaaaaaucauguuuaaccggcccaagaagaaaaaugcuauuaacaccgaaauguaucacgagaucaugcgcgcccucaaggcggccucuaaagaugacuccauuaucacagugcugaccgggaauggagauuacuauagcucuggcaacgaccuuacgaauuucaccgauaucccuccgggcggggucgaagagaaggcuaaaaacaaugccgugcugcucagagaguuuguuggauguuucauugacuuucccaagccucugaucgcuguggucaacggccccgccguggggauuuccgugacacuucugggacucuucgaugcggucuacgccagcgaccgggcuaccuuucauacaccuuucucucaccugggccaaucccccgaagggugcagcuccuauaccuuuccgaaaaucaugucuccugccaaggcuacggagaugcugauuuucggaaagaaacucacagccggcgaagccugugcucagggccugguuaccgagguguuucccgacagcacauuccagaaggaaguguggacccgccuuaaagcguucgccaagcugccucccaacgcucucagaaucuccaaagaggucauucggaagcgcgagagagaaaagcugcaugccgugaaugccgaggaaugcaacguucuucaggggcgguggcugagcgaugaguguaccaaugcuguggucaacuuucucucucgcaaauccaagcuguga

SEQ ID NO: 68662 - RNA, 618 nt, Artificial Sequence
  derived and/or modified sequence opt5 from ECSCR__Homo_sapiens__NP_001071161
augggcaccgccggggcuaugcagcugugcugggugauccucggauuccugcuuuuuagaggccacaacagccaacccacaaugacgcagaccuccucuagccaagggggacugggcgggcucucccugacaaccgagccugucucuagcaauccgggauacauucccuccucugaagccaaccggccuagccaucuuuccagcacaggcacccccggcgcggggguuccuucuuccggacgcgacggcgggacaagcagagauaccuuccagacggugcccccuaauucuaccacaaugucccugagcaugcgggaggacgcuaccauccucccgucucccacauccgaaaccgugcugacggucgccgccuuuggagugauuagcuucaucguuauucugguggucgugguuaucauccucgugggcgucgugucccugcgcuuuaaguguagaaaaucuaaggagagcgaagauccucagaaacccggguccagcggacuuucugaguccugcagcacagcuaacggcgagaaggacucuauuacccugaucagcaugaaaaauauuaacaugaauaacggcaagcagucccucucugccgaaaaggugcuguga

SEQ ID NO: 68663 - RNA, 891 nt, Artificial Sequence
  derived and/or modified sequence opt5 from ECSIT__Homo_sapiens__NP_001135936
augagcugggugcaggccacccugcucgcuagaggccugugccgggccuggggagggacauguggcgcggcucuuacggggaccuccaucucucaagucccccgcagacugccucggggacuccacugcagcgccgccgcucauuccucugagcagagccugguuccgucucccccugaaccccgccagagaccuacaaaggcccuugugcccuucgaggaccuguuuggccaggcuccugggggagaacgggauaaagccuccuuccuccaaaccgugcagaaguuugcggagcacagcguccgcaaaagaggccauauugacuucaucuaccuggcccugcggaagaugcgcgaauauggcguggagagagaucucgcuguuuacaaccagcugcuuaauauuuuuccgaaagagguguuccggccccgcaacaucauucagagaaucuuuguccacuauccucggcaacaggaaugugggaucgccgugcuggagcagauggaaaaucauggaguuaugcccaacaaggagacagaguuccuccugauucagaucuuuggccgcaaguccuacccuaugcuuaaacuggugagacucaagcugugguucccccgguuuaugaaugucaacccguucccugugcccagagaccugccucaagaucccguggaacucgcuauguuugggcugcgccacauggagcccgaccuuagcgcccgggucaccauuuaucagguuccucugccgaaagauucuacaggagcggccgaucccccucagccccacaucgugggcuccgggagagacgcuggaggcguggaaccucuccugcccgacgccgcuggcccgggggucugcgaggaauggcuuggacaacugcgcguguga

SEQ ID NO: 68664 - RNA, 2745 nt, Artificial Sequence
  derived and/or modified sequence opt5 from ECT2__Homo_sapiens__NP_001245244
auggccgagaacagcgugcugaccuccacaacgggcagaaccucucucgcugacagcuccaucuucgauucuaaggucacagaaauuagcaaagagaaucugcuuaucggguccaccucuuacguugaagaggaaaugccccagauugagacacgggugauccuggugcaagaggccggaaagcaggaggaacucauuaaagcgcugaagaccaucaaaaucauggaagucccugugauuaagaucaaggagagcugcccgggcaaauccgacgagaaacuuauuaaaagcguuaucaacauggauauuaaggugggguuugucaaaauggaaucuguggaggaauuugagggacuggacucccccgaauuugagaauguuuucguggucacagauuuucaggacagcguguucaacgaucucuauaaggcugacugucgcgugaucggcccucccgucguucugaauugcucucagaagggggagccucugcccuuuuccuguagaccucucuacugcaccagcaugaugaaccuggugcuuuguuucacgggauuucggaaaaaggaggaacuggugcgccucgucacccuggugcaccauaugggcggcguuauuagaaaagauuucaauucuaaggugacacaccuugucgccaacugcacccaaggggaaaaauuucggguggccguuucccugggaacaccgaucaugaagcccgaguggaucuauaaggcuugggaacgcagaaaugagcaggacuucuacgccgcuguggaugacuuucggaacgaguucaaggucccucccuuccaggauuguauucucagcuuucugggcuucuccgacgaagagaagaccaauauggaagagaugacggaaaugcagggaggaaaauaucugccucucggcgacgagcgcugcacacaucugguggucgaggaaaacaucgugaaggaucuucccuuugagccgucuaaaaagcuguacguugugaaacaagaaugguucugggggagcauucagauggacgccagagcgggagagaccauguaucucuacgagaaggccaauacaccugaacugaagaaauccgucagcaugcuuucucugaacacccccaauuccaaccggaagcgcagacggcucaaagagacccuggcucagcugagccgcgaaacagaugugucuccuuuuccucccagaaagcggcccagcgccgagcacucccucucuaucggcagccugcuugacauuuccaacacgccggaaagcucuaucaauuacggcgauacccccaaauccuguacaaagagcucuaaguccagcaccccuguucccuccaaacagucugcuagauggcaaguggccaaggagcuguaucagacagagagcaacuacgucaauauccucgcgaccauuauccagcuguuccaagugccucuugaagaggaagggcagcgcggaggccccauucuggccccggaggaaaucaaaacgauuuuuggguccaucccugacaucuucgaugugcauacaaagauuaaagacgaucucgaggaccugaucguuaacugggaugagucuaagagcauuggagacaucuuucugaaguauuccaaagaccucgucaagaccuaucccccuuucgugaauuucuucgaaaugagcaaagagaccauuaucaagugcgaaaaacagaagccccgguuucacgcuuuccugaaaauuaaccaggccaagccugaguguggcagacaaucucuuguggaacugcucauccgccccguccagcggcugccguccguggcucugcuucucaaugaucugaagaaacacacagccgacgagaacccugauaagagcacccuggagaaagccaucgggucucucaaggaaguuaugacacauauuaaugaggacaaaagaaagacggaagcucagaagcagaucuucgauguggucuacgagguggacggaugccccgcgaaccugcuuuccagccaccgcucucugguucaacggguggagaccauuagccucggcgaacaucccugcgauagaggcgagcaggucacacuguuucuguucaaugacugucuugaaaucgcccgcaaacggcacaaggugauugggaccuuuagauccccucacggacagacacgcccgcccgcuagccucaaacauauccaccugaugccucugucucagaucaagaaaguucucgauauucgggagaccgaagacugccauaacgccuucgcccugcuugugagacccccuacggagcaagcuaauguccugcucuccuuucagaugaccagcgaugagcugcccaaggaaaacuggcugaagaugcuuugucggcacguggccaauacaaucugcaaagcggacgcugagaaccucauuuacaccgccgauccugaauccuucgaggugaacacaaaggacauggacucuacccugagccgcgccuccagagcuaucaaaaagacgucuaaaaaggucacacgggccuuuagcuucuccaagacccccaaaagagcucugcgccgggcccucaugacaucucauggcagcguugaagggagauccccgagcucuaaugauaagcacgugaugucccgccugagcucuaccuccagccuugcggggauuccuucucccucccuggugagccucccuuccuuuuucgagagacggagccacacccugucucgcagcacaacgcaucugaucuga

SEQ ID NO: 68665 - RNA, 894 nt, Artificial Sequence
  derived and/or modified sequence opt5 from EDA2R__Homo_sapiens__NP_001186616
auggacugccaggagaacgaauacugggaucaauggggcagaugugugaccugccagcggugugggcccggacaggagcugagcaaggacugcggcuauggggaaggaggcgaugccuacuguacagcuugcccuccgcgcagauauaaauccucuugggggcaccaucggugucagagcugcaucacgugugccgucauuaaucgcguucaaaaggugaacugcaccgcgacauccaaugcuguguguggagacugccuccccagauucuaccggaaaacccgcaucggcggccugcaggaucaggagugcauuccuuguacaaagcagacccccacaucugaaguccaaugcgccuuucagcuuagccugguggaggccgacgcuccuaccguucccccucaggaggccacgcucguggcucuggucuccucucuucuggugguuuucacccucgccuuucuggggcuguucuuucucuauuguaaacaguucuuuaacagacacugccaacggggaggccugcuucaguucgaagcggauaagacagccaaggaggaaagccuguuuccggugcccccuuccaaagagaccagcgcugagucucaggucuccgaaaauaucuuccaaacacagccccucaacccuauucuggaggacgauuguagcucuaccuccggguuucccacgcaggagagcuucacaauggccucuugcaccuccgaaagccauucccacugggugcauucuccgaucgaauguacagagcuugaccugcagaaguuuagcuccagcgcuucuuacaccggagccgagacccucggcgggaauacaguggaauccacgggagaucgccuggagcugaacgucccuuucgaaguucccagcccuuga

SEQ ID NO: 68666 - RNA, 1170 nt, Artificial Sequence
  derived and/or modified sequence opt5 from EDA__Homo_sapiens__NP_001005609
augggcuaccccgagguggaaagacgggagcugcucccugccgcugccccgcgcgaaagagggagccagggaugcggcugugggggagcgcccgcucgggccggcgaggggaacuccugccugcuuuuccugggauuuuucggccucucucuggcccuucaucugcucacccuguguugcuaucuggaacuccgcagcgagcugagacgggagcgcggcgcugaauccagacuugggggaucuggcacaccugggacgagcggaacccuguccucucucggcgggcuggaccccgauagcccuaucacaucccaccuuggacaacccagcccuaagcagcagccgcuggagcccggcgaagccgcucuccacucugacucccaggauggccaucaaauggcccugcugaacuuuuucuuuccugacgagaaacccuacagcgaggaagagucucggcgcgucagacggaauaagcgcuccaaaagcaaugaaggggcggauggaccuguuaagaacaaaaagaagggcaaaaaggccgggcccccgggaccuaaugggcccccuggcccucccggacccccgggcccccagggcccucccgggauuccuggaauccccggcauuccggggaccacagugaugggaccucccggcccucccgggccucccggcccgcagggaccucccggccuccaggggcccucuggagcugccgacaaagcuggcaccagagagaaccaaccugccgugguccaucugcaggggcagggauccgcgauccaggugaagaaugaucuuagcggcgggguucugaacgacuggucccggauuacaaugaauccgaaaguguucaagcuccacccccgcucuggcgaacuggagguccuuguggauggaaccuauuuuaucuacagccaaguuuauuacaucaacuucacggacuuugccuccuaugagguggucguggaugaaaagccuuuccugcaguguaccagaagcauugagacaggcaaaaccaauuacaacacaugcuacaccgcuggggugugucuccugaaggcccggcagaaaaucgcugucaagaugguucacgccgacauuucuaucaauauguccaaacacacgacauuuuucggagccauuagacugggcgaagcucccgcgagcuga

SEQ ID NO: 68667 - RNA, 618 nt, Artificial Sequence
  derived and/or modified sequence opt5 from EDARADD__Homo_sapiens__NP_542776
auggccagccccgacgauccucugagagcugaccacauggugaaggagccggucgaagauaccgaccccuccacacucucuuucaacaugagcgauaaauacccuauccaggacacggagcugcccaaggccgaagagugcgauaccauuacacuuaauuguccucggaacuccgacaugaaaaaucaaggcgaagagaacggguuucccgauucuaccggagacccucugccggagaucagcaaggauaauuccugcaaagaaaacuguacaugcucuagcugucuccugcgcgcgcccaccauuuccgaccuucugaaugaucaggaccuccuggacguuaucagaauuaagcuggauccuugccaucccacagugaagaacuggcggaauuucgcuagcaaauggggcaugucuuaugacgagcucuguuuucuggaacagcgcccucagucccccacccuugaguuccugcucagaaacagccaacggacgguggggcagcugauggagcuuugccgccuguaccacagagccgaugucgaaaaggugcuccggcgcuggguugacgaggaauggccgaaaagagagcggggagauccuucucgccauuuuuga

SEQ ID NO: 68668 - RNA, 1347 nt, Artificial Sequence
  derived and/or modified sequence opt5 from EDAR__Homo_sapiens__NP_071731
auggcccacgugggcgacugcacccagacacccuggcugccuguccucguugugagccugauguguuccgcuagagccgaguacucuaacugcggggaaaaugaguauuacaaccaaacgaccggacuuugucaggaaugcccgcccuguggcccuggggaggaacccuaucugagcugcggauacggcacaaaggaugaggacuaugggugugugccuugccccgcggagaaauucuccaagggaggcuaccagaucugucggcgccauaaagauugcgaaggcuuuuucagagcuaccguccucacaccuggggacauggagaaugaugccgaauguggaccgugccugcccggcuauuacaugcuugagaaccggccucgcaauauuuacgggauggugugcuauucuugucugcucgcucccccuaacaccaaggagugcguuggagccacaagcggcgccuccgcuaauuuucccgggaccucuggaagcuccacgcugagcccguuccagcacgcccauaaagaacugucuggccaaggccaccucgcgaccgcccugaucauugcuauguccacaaucuuuauuauggccaucgcuaucgugcuuauuaucauguucuacauucugaagaccaagccuagcgcccccgcguguugcacaucucauccugggaaauccgucgaggcccaggugagcaaggacgaagagaaaaaggaagcucccgauaacguugugauguuuucugagaaagacgaguucgaaaagcucaccgccacgcccgcuaagccuacaaaauccgagaaugaugccagcuccgaaaacgagcagcugcuuucuagaagcgucgacuccgaugaggaaccggcccccgacaagcagggaagcccugagcugugucuccugucucuggugcaccucgcucgggaaaaauccgcgaccagcaauaagucugccggcauccaaagccgccggaaaaagauucuggauguguaugcuaacgucugcgggguuguggagggacuuucccccacagaacugccuuuugacugucucgagaaaaccucuagaaugcugagcuccaccuacaauagcgaaaaggccguggucaagacauggcgccaccuugccgagucuuucggccugaaaagagacgagaucgggggaaugacggauggcaugcagcucuuugaccggauuuccaccgcuggcuauagcauccccgaacugcugacaaagcucgugcagaucgagcgccuggaugccguugaaucucuuugcgcggacauucuggagugggcugggguggucccgccugccucccagccccaugccgcuagcuga

SEQ ID NO: 68669 - RNA, 4206 nt, Artificial Sequence
  derived and/or modified sequence opt5 from EDC4__Homo_sapiens__NP_055144
auggccagcugcgcuuccaucgacauugaggaugccacccagcaccugagagacauccucaagcuggaucggcccgcgggcgggccuucugcugaaagcccgcgccccuccucugccuacaacggagaccuuaauggccugcucgugccugauccccuguguagcggggacuccacaucugccaacaaaacgggacuuagaaccaugccucccauuaaucugcaagagaagcaggucaucugccucagcggcgaugacuccagcacauguauugggauccuggcuaaagaaguugagaucguggccucuuccgauagcucuauuuccagcaaggcucggggaucuaacaaagugaagauccagccugucgccaaguaugacugggaacagaaauacuauuacggcaaucugauugcgguguccaacagcuuccucgccuaugcuauccgcgccgcuaauaacggcuccgccaugguuagagugauuucugucagcaccuccgagcggacacugcuuaagggguuuaccggaagcguggcggaucuggccuucgcucaucucaauucuccgcaacuggccugccuugacgaggcuggcaaccuguuuguuuggcgccucgcccuggugaaugggaaaauccaggaagagauucugguccacaucagacagcccgaaggaacaccucucaaccauuuccggcgcaucauuuggugucccuuuaucccugaggaguccgaagauugcugugaggaaagcucucccaccguggcccugcuucacgaggacagagcugaagugugggaccuggauaugcuccggagcucccauucuacguggccggucgacguuagccagauuaagcaaggcuucaucguggugaaagggcacucuaccugccugagcgagggagcgcuuucuccugauggcacaguccuggccaccgcuucccacgacggcuacgugaaguuuuggcagauuuauaucgaggggcaggaugaaccccgcugucuccaugaguggaagccucacgacggaagaccccugagcugccuucucuucugugauaaucauaaaaagcaggaccccgauguuccuuuuuggcgguuccugaucacaggcgccgaccaaaaccgcgaacuuaaaauguggugcaccgugucuuggacgugccugcagacaauuagauuuuccccggauaucuucagcuccgucucugugcccccuagccucaagguuugucuggaccuuuccgccgaguaccugauucucucugacgugcagcggaaaguccuguacgugauggaacugcuccaaaaucaggaggaggggcacgcuugcuuuagcuccaucagcgaguuccugcuuacccaccccguccugucuuucggcauucaggugguuuccagaugucgccuccggcauacagaggugcugccugccgaagaggaaaacgauagccugggagcggacgggacccacggagcuggcgccauggagucugccgcuggcguccuuaucaagcucuuuugcgugcauaccaaagcccugcaggauguucaaaucagauuccagccccagcugaacccggacguggucgcuccucuccccacacacacggcccaugaggauuuuaccuucggggaaucccgcccugagcugggaagcgaaggccuugggucugcggcccacggaagccagcccgaccugcggagaauuguggagcucccugcucccgccgauuuucugucccugagcucugagacaaagccgaagcugaugaccccugacgcuuucaugacacccuccgccagccuccaacagaucaccgcgucccccucuagcuccucuagcggcuccucuagcuccagcuccuccagcuccucuagccugacggccgugucugcuauguccagcacauccgccguugauccuagccugacccgcccgcccgaagaacucacccugucuccuaaacuucagcuggacgggagccucacaauguccucuagcggcucccugcaggcuucuccccggggacugcuuccuggccuccugcccgccccugccgauaagcugacccccaaagggccgggacaagucccuacagcuacgagcgcgcucucccuggaacuucaggagguggaaccccugggccucccucaggccucucccagcagaacccgcuccccggacgugauuagcucugcuuccacagcccugagccaggauaucccugagauugccucugaggcucugucccggggguuuggaagcuccgcccccgaaggccuugagccugacucuauggcgagcgcugccuccgcccuccaucugcugagccccagaccccgcccugggccggaacucggcccccaacugggacuugacggcgggccuggagauggcgaccggcacaauacccccucucugcucgaggcugcccugacacaggaagcguccaccccugauagccaggucuggcccacggcuccugacaucaccagagagacauguucuacccuggccgagagcccgcggaacgggcuucaagaaaagcacaaaucccuggccuuccauagacccccuuaucaccuccugcagcagcgcgauucucaggacgcuagcgccgagcaauccgaucacgacgaugaaguggcuucucucgccagcgcguccggaggcuuugggacaaagguucccgccccucggcugcccgcuaaggacuggaaaaccaagggcagcccgagaacgucuccuaaacuuaagcgcaaauccaagaaggaugacggagaugccgcuaugggcagccggcugacagagcaucagguggccgaaccucccgaggacuggcccgcccucauuuggcagcagcaaagagagcuggcugaacugcgccacucccaggaggaacuucugcagagacucugcacccagcuggaggggcuccaaucuacagucaccggacauguggagcgggcgcuggaaacccgccacgagcaggaacagagacggcuugagcgcgcccuggcugaaggccaacagagagggggacagcuccaggagcaacugacacagcagcugagccaggcccuuuccucugccguugcuggccggcuggagcgcagcaucagagacgaaaucaaaaagacggugcccccuugugucucccggagccucgagccgauggccgggcaacugucuaauuccguggcgaccaaacucacagcuguugaaggcagcaugaaggagaacauuucuaaacugcuuaaguccaagaaucugaccgaugccaucgcccgcgcugccgcggacacacugcagggacccaugcaggcugccuacagagaagccuuccagagcgugguccucccugcuuuugagaaaucuugccaagccauguuccagcagauuaacgauagcuuucggcugggcacccaggaguaucuucaacagcuggaaucccauaugaagucuagaaaagcucgcgagcaggaagcccgggagcccgugcucgcgcaacugagagggcucgugagcacgcugcaguccgccacagaacagauggcugccaccgucgcuggaagcguucgcgccgaggugcagcaccaacuucacguggccgucggcucccugcaggagucuauccuggcucaggugcagcggauuguuaagggggaagugagcgucgcgcucaaagagcaacaggccgcugugaccuccucuaucaugcaggccaugagaagcgccgcuggaacaccuguucccuccgcccaucuggacugucaggcgcaacaggcucacauccuucagcugcuccaacagggccaucugaaucaggccuuccagcaagcccucaccgcugccgaucugaaccuugugcuguacgucugcgaaacaguggacccggcgcagguuuucggccagccucccuguccucugucucagcccgugcuccugagccuuauucaacagcuggccuccgaucucgggacgcgcaccgaccugaagcucagcuaucuggaggaggcugucaugcaccuugaucauucugacccuaucacacgggaucacaugggauccgugauggcccaggugagacagaaacuguuucaauuccugcaggcugaaccccacaauagccucggcaaggccgcucgccggcugucucuuaugcugcaugggcucgucaccccgucccugccuuga

SEQ ID NO: 68670 - RNA, 1974 nt, Artificial Sequence
  derived and/or modified sequence opt5 from EDEM1__Homo_sapiens__NP_055489
augcaguggagagcccuggugcucggccugguccuucugcggcucgggcugcacggaguucuuuggcugguguucggccucgggcccagcaugggauuuuaccaacgcuucccucuguccuuuggcuuccagagacugcggucuccggacgggcccgcuagcccuaccuccggacccgugggccgcccuggcggggucucuggacccagcuggcuccagccuccgggcacaggggccgcgcagucccccagaaaggcuccucggcgccccggaccuggcaugugcgggcccgccaacuggggauaugugcugggcggcagagggcggggaccggaugaguacgaaaaacgcuauucuggcgccuuuccuccccaacuuagagcucagaugcgggaccuggcccgcgggauguucguuuuuggauacgauaauuauauggcucaugccuucccucaggacgagcucaaccccauccacuguagaggccgggggcccgaucgcggagacccuagcaaucugaacauuaaugaugugcuuggcaacuacucccugacgcucgucgacgcgcuggauacccuggccaucaugggcaauagcucugaauuucagaaggcugugaaacucguuauuaacacaguguccuucgacaaggauagcaccguccaaguguuugaggccacaaucagagugcuggggucucuucuguccgcucaucggauuaucaccgacagcaaacagccguucggagauaugacaaucaaggacuaugacaaugaacuccuguacauggcccacgaucuugcggucagacugcuccccgccuuugagaacaccaagacgggcauuccuuacccccgcguuaaucugaaaaccggggugccucccgacacaaacaaugagaccugcacagcuggagccggcucucugcucguggaguucgggauccugucccggcuucugggcgauagcaccuucgaaugggucgcuagacgcgccgugaaggcccucuggaaccugcgguccaaugacacgggacuucugggcaacguugugaacauucagacagggcauugggucggaaaacagucuggccucggggcuggacuggauagcuuuuaugaauaccugcucaaguccuauauccuguucggcgagaaagaggaccuugaaauguuuaaugcggccuaccaaagcauucagaacuaucugagacgcgggcgggaggcuuguaaugaaggcgagggagauccgccucucuacgugaacguuaauauguucucuggccagcugaugaacaccuggaucgacucccugcaagccuuuuuccccgggcuucaggugcucauuggagaugucgaagacgccaucugccugcacgcuuuuuauuacgccaucuggaagagauacggcgcgcugccugagcgcuauaauuggcagcuccaggcucccgaugugcuguucuacccucuucggcccgagcuggucgaaagcacauaucuccuguaccaagccaccaagaacccguuuuaucugcacguggggauggacauucuucagucucucgagaaauacaccaagguuaaauguggauaugccacacugcaucacgugaucgacaagagcacggaagauagaauggaguccuucuuucugucugaaaccugcaaauaccucuaccugcuuuucgacgaggauaauccuguccauaagagcggcacacgcuauauguuuaccacagaggggcacauuguguccguugacgaacaucugcgggagcuccccuggaaagaguucuucagcgaagaaggcggacaggaucagggcgggaagucugugcacagacccaagccucacgagcugaaagucaucaacuccagcucuaauuguaaccgggugccggacgagcgcagauacucccugccccuuaagagcauuuauaugcggcaaaucgaucagauggugggacucaucuga

SEQ ID NO: 68671 - RNA, 1413 nt, Artificial Sequence
  derived and/or modified sequence opt5 from EDIL3__Homo_sapiens__NP_001265571
augaagagaagcguggccgucuggcugcucguuggccugucccuuggggugccccaguucggaaaaggcgacaucugcgauccuaacccgugugagaaugggggaauuugccugcccggccucgcugacgggucuuuuagcugugaaugcccugauggauucaccgaccccaacuguuccucuguggucgaggugggcccuugcacacccaauccuugucacaacggcgggacgugcgaaaucagcgaggccuaccggggagauaccuuuauuggcuauguuuguaagugcccgcgcggguucaauggaauccauugucaacacaacauuaaugaaugcgagguggagcccugcaaaaacggcgggaucuguacagaccuggucgcgaauuacuccugcgaauguccuggagaguuuaugggcagaaacugccaguauaaguguucuggcccccuugggaucgaaggaggcauuaucagcaaucagcagauuaccgcuuccagcacacaucgggcccuguucgggcuccaaaaaugguacccuuauuacgcccgccugaacaagaagggacugaucaaugcuuggaccgccgcugagaacgauagauggcccuggauucagaucaaucuccagcggaaaaugcgcgugacaggcguuauuacccagggggccaagagaaucggaucuccggaguauaucaaauccuacaagauugcguacagcaacgacggcaaaacgugggccauguauaaggugaagggcaccaacgaagauauggucuuucgggggaauaucgacaacaauacaccuuacgcuaacucuuucacacccccuauuaaagcccaauaugugcgccuguacccccaggugugcagacggcacuguacccuucgcauggagcugcucggaugcgaacuguccggcuguagcgagccccuugggaugaagucuggacauauccaggauuaucagauuaccgcuuccagcaucuuuagaacgcugaauauggacauguucacaugggaaccucggaaagcccgccucgauaagcaaggcaaagucaacgcguggaccuccgggcacaaugaccagucucaguggcugcaaguugaccugcucgugccgacaaaggugaccggcaucauuacccagggagccaaagauuuuggccacguccaguucguggggagcuacaagcuggcuuauuccaacgacggagagcauuggacaguuuaccaggaugagaagcaaagaaaagacaagguguuucagggcaauuucgauaacgacacgcaccggaaaaaugucaucgaucccccuauuuacgccagacauauccgcauucuucccuggagcugguaugggcggaucacccugagaucugaacuccugggaugcacagaggaagaguga

SEQ ID NO: 68672 - RNA, 639 nt, Artificial Sequence
  derived and/or modified sequence opt5 from EDN1__Homo_sapiens__NP_001946
auggacuaccugcucaugaucuucagccugcuuuuuguggccugccagggcgcucccgagaccgccguccugggggcggaacucuccgcuguuggagagaacggcggggaaaagccuacaccgucucccccuuggagacugcggcgcagcaaaagauguuccugcucuagccuuauggauaaggaguguguguauuucugccaccuggacauuaucugggugaauacgcccgaacaugucgugccuuacggacucggcucuccccgguccaaacgcgcccuggagaaccugcucccuaccaaggccacagauagagagaaucggugucaaugcgcuagccagaaagacaagaaguguuggaacuuuugccaggccgggaaagaacugcgcgcugaggauauuauggaaaaggacuggaauaaccacaaaaagggaaaagauuguuccaaacuuggcaagaagugcaucuaucagcaacugguuagaggccggaagauucgcagaagcucugaggagcaucuccggcagacccgcuccgaaacaaugagaaauagcgugaaaucuuccuuccacgacccgaagcugaaagggaagcccagccgggagcgcuacgucacccauaacagagcccacugguga

SEQ ID NO: 68673 - RNA, 579 nt, Artificial Sequence
  derived and/or modified sequence opt5 from EDN3__Homo_sapiens__NP_001289385
auggagcccggccuguggcuccuguucgggcuuaccgugacaagcgccgcuggauuugucccuugcucccagucuggcgacgccgggagacggggaguuagccaagcgccgacggcugcccgcuccgaaggcgauugugaggaaaccguggccgggcccggagaggaaacaguggcuggcccuggcgaggggaccgucgcccccacagcucugcagggaccuucucccggcagcccugggcaggagcaggccgcggaaggagccccggagcaccauagaucccggcgcugcaccuguuucacauacaaggacaaagaaugcguguauuacugucaccucgauaucauuuggaucaacacccccgagcaaacgguuccuuauggccugucuaauuacagagggagcuuucggggaaagcgcuccgcuggcccccuuccuggcaaccugcagcucagccauagaccccaucugcggugcgccuguguggggcgcuaugacaaggcuugccugcacuucuguacccagacacucgaugucucuagacugaaaucccggaccaauaaagccagccgccuuuga

SEQ ID NO: 68674 - RNA, 957 nt, Artificial Sequence
  derived and/or modified sequence opt5 from EDNRA__Homo_sapiens__NP_001159527
auggagacccugugccucagagccagcuucuggcuggcucuugugggcugugucaucuccgacaaccccgaacgguacucuacaaaucugagcaaccacguugaugacuuuacgaccuuccgcgggacagagcucuccuuucuggugaccacacaucagccuaccaaucuugugcugccgucuaacggaagcaugcacaauuauugcccccaacagacaaagauuaccuccgccuucaaauacaucaacacggucauuucuuguaccaucuuuauugugggcaugguugggaaugcgacacuccugagaaucaucuaucagaacaagugcaugcggaauggaccuaacgcucugauugccagccucgcccugggcgaucuuaucuacguggucauugaccugcccaucaauguguucaaauuuuaucaggauguuaaggacugguggcucuuuggguuuuacuucuguaugccucuggugugcaccgcuauuuucuauacacuuaugaccugugaaaugcugaaccgcagaaauggaucccuccggaucgcccugagcgagcaucugaaacaacgcagagaagucgcuaagacgguguucugccucguggucauuuuugcccuguguugguucccccuucaccugucucggauccucaagaaaacaguuuacaacgagauggauaagaaucgcugcgagcugcuuuccuuccugcuccugauggacuacaucggcauuaaccuggcgaccaugaacagcuguaucaauccuauugcccucuauuuugugucuaaaaaguucaaaaacugcuuucaguccugccuguguugcuguugcuaccagagcaagucucuuaugacauccgugccgaugaauggcaccagcauccaguggaagaaccaugaucaaaauaaccacaauaccgacagauccucucacaaagauagcaugaacuga

SEQ ID NO: 68675 - RNA, 1329 nt, Artificial Sequence
  derived and/or modified sequence opt5 from EDNRB__Homo_sapiens__NP_000106
augcagcccccuccgagccugugcggcagagcccucguggcucugguccuugccugugggcugucccggaucuggggagaggaacgcggcuuucccccugacagagcgacaccccuccugcaaaccgcugagauuaugacgccucccaccaagacacuuuggccuaaagggucuaacgccagccuggcccggucccucgcuccggccgaaguucccaagggagaucgcaccgcuggcucuccucccagaacaaucagcccucccccgugccaggggccuauugagaucaaagaaaccuuuaaguacauuaauacagugguguccugucuggucuucgugcugggaaucaucggcaacucuacccuccugcggauuaucuauaaaaauaagugcaugcgcaacggccccaauauucuuaucgccagccuggcgcucggggaccugcuucacauuguuaucgauauuccuaucaacguguacaagcugcucgccgaggacuggcccuuuggagcugagauguguaaacugguccccuucauccagaaggccuccgugggcauuacgguucugagccucugcgcucugucuaucgauagauaucgggccguggcguccuggagccgcauuaaagggaucggagucccuaaguggaccgccguggaaauugugcuuaucugggucguuucuguggugcuggcugucccggaggccaucggcuuugacauuaucacaauggauuacaaaggguccuaucucagaauuugucugcuucaucccgugcagaagaccgcuuucaugcaauuuuacaagacagccaaagacugguggcuguucagcuuuuauuucugccucccucuggccaucaccgcuuucuucuacacgcugaugacaugugaaaugcuccggaagaaaucuggaaugcagauugcgcugaaugaucaccuuaagcagcgcagagagguugccaaaaccguguuuugccugguccucguguucgcucuguguuggcuuccccugcaucucucccggauccugaagcugacacucuacaaccagaaugacccuaaccgcugcgagcugcuuagcuuccugcucguucuggauuauaucggcauuaauauggccucccugaacucuugcaucaaucccauugcccuuuaccucgugagcaaaagauuuaagaacuguuucaaguccugccuguguugcuggugucagagcuuugaagagaaacaaucucuggaagagaagcaguccugccucaaauucaaggcuaaugaccacggcuaugauaacuuucggagcucuaacaaauacagcuccucuuga

SEQ ID NO: 68676 - RNA, 4236 nt, Artificial Sequence
  derived and/or modified sequence opt5 from EEA1__Homo_sapiens__NP_003557
augcugagacggauccuccagcgcacccccggcagaguggggagccaaggauccgaccuggauucuagcgccacaccuauuaacacggucgacguuaauaacgaguccucuagcgaaggcuucaucugcccgcaguguaugaagucccuugggucugcugaugagcuguuuaaacacuacgaagccgugcaugacgcgggaaaugauagcggccacgggggagaguccaaccucgcucugaagcgggacgaugugacccuucugcgccaggaaguccaggaccuccaagccagccugaaagaggagaagugguauucugaggaacugaaaaaggaacucgagaaguaccagggccugcagcagcaagaggccaaacccgauggccuugugacagacuccagcgcugaacugcagucucucgagcagcagcuggaagaggcccaaaccgaaaauuucaacauuaagcagaugaaagaucuuuuugagcagaaggcugcccaacuggcgacagagaucgccgacauuaaauccaaguaugaugaagagagaagccuccgggaagcugccgagcagaagguuacccgccugacagaggaacugaauaaagaggcuaccgugauccaggaccucaagacggaacugcuucagagaccugggaucgaggacgucgccgugcugaaaaaggaacucguucaagugcagacccugauggauaacaugacacuugagcgggaacgcgagucugagaaacugaaggacgaaugcaaaaagcuccagucccaguacgcgagcuccgaggccaccauuucucaacugagaagcgaacuggcuaagggaccccaggaggucgccguguaugugcaggagcuccagaaacugaaguccagcgucaaugaacuuacacagaaaaaccagacccugacggagaaucuccugaagaaagaacaggauuacacaaaacuugaggaaaagcauaacgaggagucuguuuccaaaaagaauauccaggcuacccugcaccaaaaagaccucgauugucagcagcugcaaagccggcugucugccagcgaaacaucccuccaucgcauucacguggagcugucugaaaagggcgaggccacccagaaacuuaaggaggaacugagcgagguggaaaccaaguaucagcaccucaaagcugaguucaagcagcugcaacagcagagagaagagaaagaacagcaugggcugcaacuucaguccgagaucaaccagcuccacagcaagcugcuggagacagaacggcagcucggagaggcgcauggccgccugaaagaacaaagacagcuuucuuccgagaagcugauggacaaggagcagcaagucgccgaucuccagcugaaacugagccggcuugaggaacagcucaaggaaaaagugaccaauucuacggagcugcagcaccaacuggacaagacaaaacagcagcaccaggaacaacaggcucuccagcaguccaccacagccaagcugagagaggcccaaaacgaucuugagcagguucugcgccagauuggggacaaagaucagaagauccaaaaccucgaagcucugcugcaaaagagcaaagagaauauuucccuucucgaaaaggagcgggaagaccuguacgccaaaauccaggcgggagagggcgagaccgcugugcugaaccaacuccaggaaaagaaucauacgcugcaggagcaggucacacaacuuaccgaaaaacugaagaaccagucugagagccacaagcaggcccaggaaaaucuccaugaccaagugcaggagcagaaagcccaccugagagcugcccaggaucgcguucugucccuugagaccucugugaacgaacucaauagccaacugaacgaguccaaggaaaaagucagccagcuggacauccagauuaaggcuaaaacagagcuccugcuuucugccgaggcggccaagaccgcucaacgggccgaucugcagaaucaucucgacacagcucagaacgcccugcaggauaagcaacaggaacugaauaaaaucacgacccagcuugaccaggugacagcgaagcugcaagauaaacaggagcacugcucccagcucgaaagccaccugaaggaguacaaagaaaaguaucucucucuggagcagaagaccgaggaacuugagggccaaauuaaaaagcuggaagccgacucccucgaggucaaagcuagcaaggaacaggcccugcaggaucugcagcaacagagacagcuuaacacagaccuggagcuccgcgcuaccgagcugucuaaacaacucgaaauggagaaggaaaucgugagcuccacgcggcuggaucuucagaaaaagagcgaggcccuggaaucuauuaagcagaaacucaccaagcaggaggaggaaaaacaaauccugaagcaggacuuugagacacugucccaggaaaccaaaauccagcaugaggagcuuaauaaccgcauucaaacaaccguuacggaacugcagaaggugaagauggagaaagaagcccucaugacagagcugagcaccgucaaggauaaacucuccaaggugucugacagccugaaaaauuccaagucugaguucgaaaaggagaaccagaaagggaaggcugcgauccuugaccuggaaaagacauguaaggagcugaaacaccagcuccaaguucagauggaaaacacccugaaggagcagaaggaacuuaaaaagagccuggagaaagagaaggaagccucccaucaacucaaacuggagcucaauucuaugcaggaacagcugauucaggcucaaaacacccuuaagcagaaugagaaggaggaacagcagcugcaaggaaacaucaaugagcugaaacagagcuccgaacagaagaaaaagcagauugaggcccuccaaggcgaacugaaaaucgccgugcuucagaagacagagcuggagaacaaacuccagcaacagcugacgcaggcugcccaggaacucgcggcugagaaggaaaagaucagcguccugcaaaauaacuacgagaaaucucaggaaaccuuuaagcagcuucaguccgauuucuaugggagagagagcgagcugcuggccacacggcaagaccucaaaucuguggaagagaagcugucccuugcccaggaagaucugauuagcaauagaaaccagaucggaaaucagaacaaacucauucaagagcugaagaccgcuaaggccacacucgaacaggacucugcgaaaaaggagcagcagcugcaagagcgcugcaaagcccuucaggauauccagaaggaaaaaucccugaaggagaaggaacuggugaaugagaaaagcaagcucgcugaaauugaggagaucaaaugucggcaagaaaaggagauuaccaaacugaacgaggaacuuaagucccacaagcuggagagcaucaaagaaaucacgaaucucaaggacgccaaacagcugcugauucagcagaagcucgagcuucaaggcaaagcugauucucugaaggccgcuguugaacaggagaaaagaaaccagcagauccugaaggaccaagucaagaaagaagaggaggaacucaagaaagaguuuauugaaaaggaggccaaacugcacagcgaaaucaaggagaaggagguggggaugaaaaagcaugaagagaacgaagcgaaacuuacaaugcagauuaccgcccugaaugagaaccucggaaccgugaagaaagaauggcaguccucucagcggcgcgucagcgagcuggagaagcaaacagaugaccugagaggcgaaaucgcugugcucgaggccaccguucagaauaaccaggaugaacggagagcccuucuggagcgcugccugaagggcgagggggaaaucgagaaacuccaaacaaaggugcuggaacuucagcggaaacuggacaauacgaccgcugccguccaggagcucggaagagaaaaccagucccugcaaauuaagcacacacaggcucugaaucgcaaaugggcggaggauaacgaggugcagaauuguauggccugcggcaagggguucucuguuaccgugagacggcaucacugucgccagugcggaaacaucuuuugcgcugaauguagcgccaagaaugcccucacaccuuccucuaaaaagcccgucagagugugcgacgcuuguuucaacgaccuucaaggcuga

SEQ ID NO: 68677 - RNA, 1326 nt, Artificial Sequence
  derived and/or modified sequence opt5 from EED__Homo_sapiens__NP_003788
augagcgagagagaaguguccaccgcccccgcuggcacagacaugccugccgcgaagaaacagaagcugucuagcgaugagaacuccaauccggaccucucuggggaugaaaacgacgaugcugucagcaucgaguccggaacgaauaccgaacggcccgacacaccuaccaacacacccaaugccccuggccgcaaaucuugggggaagggaaaauggaaaagcaagaagugcaaguacuccuucaaauguguuaacagccugaaggaggaucacaaucaaccccuuuuuggcgugcaguucaacuggcauucuaaagagggggacccucugguguuugccaccgucggauccaauagagugacacucuaugaaugccacagccagggcgagauucggcugcuucagucuuacguugaugcugacgccgaugaaaacuucuauaccugugcuuggacguacgacuccaauaccagccauccgcugcucgccguggcgggcucucgcgggaucauuagaaucauuaaccccaucacaaugcaaugcaucaagcacuaugucggacauggcaaugccauuaacgagcugaaguuucacccucgggaucccaaucugcuccuguccgugagcaaagaccacgcccuucgccuguggaacauccagaccgacacacucguugcuauuuucgggggaguggagggccauagagaugaaguccuguccgcugacuacgaucuucugggggagaagaucaugucuuguggaauggaccacagccucaaacuguggcggauuaacuccaagcgcaugaugaaugccaucaaagaaagcuaugauuacaacccuaauaagaccaacagacccuuuauuucucagaaaauccauuucccggacuuuuccacgcgggauauccaccgcaauuacguggacugcgugagauggcugggcgaucucauucugagcaagucuugugagaacgcgaucgucugcuggaagccuggcaaaauggaagacgauauugacaagaucaaacccagcgaguccaauguuacaauucuugggcgguucgacuauucucagugugauaucugguacaugcgcuuuagcauggacuucuggcaaaagaugcuggcccucggaaaccaggugggcaaacuguaugugugggaucuugaggucgaagacccucacaaggcuaagugcaccacacugacccaucacaaauguggggccgcuaucagacagaccuccuuuagccgggauucuuccauucucaucgccgugugcgacgaugccagcauuuggagaugggaccgccugcgguga

SEQ ID NO: 68678 - RNA, 1389 nt, Artificial Sequence
  derived and/or modified sequence opt5 from EEF1A1__Homo_sapiens__XP_011533816
augggcaaggagaaaacccacaucaacauuguggucaucgggcauguugacagcggaaaguccacaacgaccggccaccugauuuacaaaugcgggggaaucgauaagagaacaauugaaaaauucgagaaggaagccgcugagaugggcaaggggucuuuuaaauacgccugggugcucgacaagcugaaagcggaacgggagcgcggaaucaccaucgauauuagccuuuggaaguucgagacauccaaauacuaugugaccaucauugacgcucccggccauagagauuuuaucaagaauaugauuacaggcaccucucaggccgacugugccguccugaucguggcugccgggguuggagaguucgaagcuggcauuagcaagaacgggcaaacgcgggaacacgcccuccuggcguacacccuuggagugaaacagcugaucgucggcgugaauaagauggauuccacagagccuccguauucucagaaacgcuacgaggaaaucguuaaggaggugagcaccuauauuaaaaagaucggguacaaccccgacacagucgccuuugugccuauuuccggauggaauggcgauaacaugcucgaacccagcgcuaauaugccuugguucaaaggcuggaaggugaccagaaaggacgggaacgccucuggaacgacacugcuggaggcucucgauugcauccugcccccuacccggccgacagacaaaccccuucgccugccucuccaggaugucuacaagauuggcgggaucggaaccguucccgugggcagaguggaaaccgggguccugaaaccuggaauggugguuacauuugcccccgugaaugucacgaccgaggugaaguccguugagaugcaucacgaagcgcuuagcgaggcccugccgggcgacaacgugggcuucaaugucaaaaacgugucugucaaggacgugcggcgcgggaauguugcuggagauuccaagaacgacccucccauggaagccgcuggcuuuacagcccaagugaucauucucaaucacccugggcagaucagcgccggauaugcucccguccuggauugucauaccgcgcacauugccugcaaauucgcugagcugaaggagaaaaucgacagacggucuggcaagaaacucgaagaugggcccaaguuucugaaguccggcgacgccgccauuguggauaugguuccuggaaaaccgauguguguggagagcuucuccgacuaucccccucuuggccgcuuugcugucagagauaugcggcagacaguggccguggggguuaucaaggcggucgacaaaaaggcugccggagccggcaaagugaccaagucugcucagaaggcccaaaaagcuaaguga

SEQ ID NO: 68679 - RNA, 1392 nt, Artificial Sequence
  derived and/or modified sequence opt5 from EEF1A2__Homo_sapiens__NP_001949
augggcaaggagaaaacccacaucaacauuguggucaucgggcauguugacagcggaaaguccacaacgaccggccaccugauuuacaaaugcgggggaaucgauaagagaacaauugaaaaauucgagaaggaagccgcugagaugggcaaggggucuuuuaaauaugccugggugcucgacaagcugaaagcggaacgggagcgcggaaucaccaucgauauuagccuuuggaaguucgagacaaccaaauacuauaucacaauuaucgacgcucccggccauagagauuuuauuaagaauaugaucaccggcacgucccaggccgacugugccgugcugauugucgcugccggggugggagaguucgaagcuggcaucucuaagaacgggcaaacccgggaacacgcccuccuggcguacacacuuggaguuaaacagcugaucgugggcgucaauaagauggauagcaccgagccugccuauuccgagaaacgcuacgacgaaauugugaaggagguuucugcuuauaucaaaaagauuggguacaacccggccacagugcccuuugucccuaucagcggauggcauggcgauaauaugcucgaacccuccccuaacaugcccugguucaaaggcuggaagguggagagaaaggaagggaaugcuagcggagugucucugcuggaggcccucgacaccauucugccuccgacgcggcccacagauaaaccucuucgccugccccuccaggacgucuacaagaucggcgggaucggaaccguuccugugggcagaguggagacagggauucugcggcccggaauggucgugaccuuugcgccgguuaacaucaccacagaagugaaauccgucgagaugcaccacgaagcccuuagcgaggcucugccuggcgauaaugugggcuucaacguuaagaaugugucugucaaagacauucgcagagggaacgugugcggagacuccaagagcgaucccccucaggaagccgcucaauuuacgucucaggucaucauucucaaucaucccggccagaucuccgccggguauagccccgugaucgacugucacaccgcccauauugcuugcaaguucgcggagcugaaagagaagaucgaucggcgcuccggcaaaaagcuggaagacaacccuaaaucucucaagagcggagaugccgcuauuguugagauggugccggggaagcccaugugugucgaauccuuuagccaguacccuccccugggcagauucgccgugcgggacaugcgccaaacaguugccgugggagucaucaaaaauguggagaagaaaucuggcggggcuggaaaggugaccaaauccgcccagaaggcgcagaaggcuggcaaauga

SEQ ID NO: 68680 - RNA, 678 nt, Artificial Sequence
  derived and/or modified sequence opt5 from EEF1B2__Homo_sapiens__NP_001032752
augggcuucggggaccuuaagagccccgccggacuccaggugcugaacgauuaccuugcugacaaauccuauaucgagggcuacgucccuucucaagccgauguugcgguguuugaagcugugagcuccccgcccccugccgaccugugccacgcccucagaugguauaaucauauuaagucuuacgagaaagaaaaggcuagccugcccggggucaaaaaggcccuuggaaaguauggcccugcugauguggaggacaccacaggguccggagccacggauucuaaagacgaugacgauaucgaccuguucggcagcgaugacgaagaggaguccgaagaggcgaagcggcuccgcgaagagagacuggcccaguacgagagcaaaaaggcuaaaaagcccgcccugguugcuaagucuuccauucuccuggacgugaaaccuugggaugacgaaaccgauauggccaagcuggaggaauguguccggagcauccaggcggacggccuggugugggggucuuccaaacucguuccggugggauauggcauuaagaaacugcagauccaaugcgucguggaggaugacaagguggggacagauaugcuugaggaacagaucaccgccuuugaggacuacguccagagcauggauguugcugccuucaacaaaauuuga

SEQ ID NO: 68681 - RNA, 1944 nt, Artificial Sequence
  derived and/or modified sequence opt5 from EEF1D__Homo_sapiens__NP_001123525
augagaagcggcaaggccuccugcacccuggagacagugugggaagacaaacacaaguacgaggaagcugagcggcgcuucuaugaacaugaggccacgcaggcggcugccucugcccaacagcuccccgcugaggggccugccaugaacggaccgggccaggaugaccccgaagaugcugacgaggccgaagcgccugaugggggaagcagacgggacccccgcaaaucccaggauucuagaaagccucugcaaaagaagcggaagcgcagccccaaauccggccuugggccugccgaccuggcucuccugggacuuucugccgagagagucuggcuggauaagagccucuuugaccaggcugaguccagcuaccggcagaaacuggccgauguugcggcccaggcugccuggccgcccgcucuggccccuuggggccucuguacccacggcaaucaaguggccugccaucacgugacaugggggaucugggucaacaagucuuccuucgaccaggcugaacgcgcguuuguggaguggagccaggcccugcuucuggcucccgaaggaucuagacggcagggcaccccuaauacagggcaacagguugccgugcccgaucucgcccaucagccguccccucccgucaacggacaaccuccccugggcagccuucaggcucuggugcgcgagguuuggcucgaaaaacccagauaugacgccgcggagcggggguucuacgaggcucuguuugacggacacccuccgggcaaggugcgccugcaggaaagagccggccucgccgagggggcucggagaggacgccgggauagacgcggccggaauauucuggggaacaagagagccggacuucgccgggcugacggcgaagcccccucugcgcugccuuauuguuacuuccuccagaaagaugccgaggcucccuggcuguccaagccugccuaugacagcgcugaaugcagacaccaugccgcggaggcccuucgcgucgcuuggugucuggaggccgcuucccucucucaccggcccgggccgagaagcggacuguccgugagcucucugcgcccuaaucggaaaauggccaccaacuuucucgcccaugaaaagaucugguucgauaaauuuaaguacgacgaugcugagagacgguucuacgaacaaaugaauggccccguggcgggcgccucccgccaggagaacggggcuagcgucauucugagagacaucgcccgggccagagaaaauauucagaaaucucuugcuggaagcuccggcccuggggccucuagcggaacauccggcgaucacggggagcugguugugcgcaucgcgagccucgagguggaaaaccagucucugcggggcgucgugcaagagcuucagcaggcuaucuccaagcuggaagccagacucaauguucuggagaaaagcucucccggacaccgcgccaccgcuccucagacgcaacaugugucccccaugagacaggucgagccgccugccaaaaagcccgcgacccccgcugaagacgaugaggacgacgauauugaccuguuuggcagcgauaacgaagaggaagacaaagaggccgcccagcuccgggaggaacgccugagacaguaugcugagaagaaagccaagaagccugcucuuguggccaaauccucuauccugcucgauguuaagccgugggacgaugaaacagacauggcgcaacuggaggccugcgugcggagcauucagcuggaugggcuugucuggggagcuuccaaacucgugcccgucggcuacgggauccgcaagcugcagauucaaugugugguugaagacgauaaagugggaaccgaccugcucgaggaggaaaucacaaaguucgaggaacacguccagucuguggauauugccgcuuuuaauaagaucuga

SEQ ID NO: 68682 - RNA, 420 nt, Artificial Sequence
  derived and/or modified sequence opt5 from EEF1E1__Homo_sapiens__NP_001129122
auggccgcugccgcggagcugagccuccuggaaaagucccuuggccugucuaaagggaacaaguacagcgcucagggagagagacaaauccccgugcuccagaccaauaacggcccuucccugacagggcuuacgaccauugccgcccaccuggucaaacaggcuaauaaggaauaucuccugggaucuacagccgaggaaaaagcuaucguucagcaauggcuggaguaccgggugacccagguggacggccauagcuccaagaacgauauucacacacuccugaaggaccuuaauucuuaucuggaggauaaagucuaccucaccggguauaacuucacacuggccgacauccuucuguacuauggacuccaucgcuuuauuaucagaaagcugcggcacaccgaagugggcaauuga

SEQ ID NO: 68683 - RNA, 1314 nt, Artificial Sequence
  derived and/or modified sequence opt5 from EEF1G__Homo_sapiens__NP_001395
auggccgcuggcacccuguacacauaucccgagaacuggagagccuucaaggcgcucaucgcugcccaguacagcggggcccaagugcggguccuguccgcuccuccgcacuuucauuucggacagacgaaucgcacccccgaauuucuuagaaaauucccugccggcaagguucccgcuuuugagggggacgauggauucugcguguuugaaucuaacgccauugcguauuacgugagcaaugaggaacugcggggcuccacaccugaggccgcugcccaggucgugcaguggguuucuuucgcugacagcgauaucgugcccccugccuccaccugggucuuuccgacacucgggauuaugcaccauaacaaacaagcgaccgagaaugccaaggaagaggugcgcagaauccugggacuucuggacgcuuaucucaaaacacggaccuuccugguuggcgaacgcgugacgcuggccgauauuaccgucguguguacacuccuguggcuuuacaaacaggugcuggagcccucuuuuagacaggcuuucccuaacaccaaucggugguuucucacaugcaucaaccagccccaauuccgcgccguccugggcgagguuaaacuuugugaaaagauggcccaguucgacgcuaagaaguuugcggagacccagccuaagaaagauacgcccagaaaggaaaaggggagccgggaggaaaaacagaagccgcaagccgagcgcaaagaggaaaagaaagcugccgccccugcucccgaggaagagauggacgaaugcgagcaggcccuggcggcugagccuaaggccaaagaucccuucgcccaccuccccaaguccacauuugugcuggacgaguucaagagaaaauauagcaaugaggauacccugucuguggcucucccuuacuuuugggaacauuucgacaaggauggauggucccugugguacagcgaguaucgguuuccggaagaacuuacacagaccuucaugucuuguaaccugaucaccggcauguuucaacgccucgacaaacugagaaagaaugccuucgcuuccgucauucuuuuugggacaaacaauucuagcuccaucagcggaguguggguuuuccggggccaggagcuggccuuuccccucuccccugacuggcaaguggauuacgaaucuuauacguggagaaaacuggaccccgggagcgaggaaacccagacacugguccgcgaguacuucuccugggagggagcguuccagcacgugggcaaggccuuuaaccagggcaagauuuucaaauga

SEQ ID NO: 68684 - RNA, 2577 nt, Artificial Sequence
  derived and/or modified sequence opt5 from EEF2__Homo_sapiens__NP_001952
auggugaacuucaccgucgaccagaucagagccauuauggauaagaaagcuaauauccggaacaugagcguuauugcccacguggaccauggcaaguccacacugacggauucucucgugugcaaagcggggaucauugcuagcgcccgcgccggagagaccagauuuacagacacccggaaggaugaacaagagcgcuguaucacaaucaaauccaccgcuauuucucuguucuacgaacuuagcgagaaugaccugaacuuuaucaagcaguccaaggauggcgccggguuccucauuaaucugaucgacucucccggacacgucgauuuuagcuccgaagugacagcugcccuuagaguuaccgacggcgcgcugguggucguggauugcguuagcgggguguguguccagacggagaccgugcuccggcaggccauugcugagcgcaucaaaccugugcugaugaugaacaagauggacagagcccugcucgaacugcaacuugagccggaggagcuguaucagacauuccagcggauugucgagaauguuaacgugaucaucucuaccuacggagaaggcgaguccggccccauggggaauauuaugaucgauccugugcucggaacagucggcuuugggagcggacugcauggcugggcuuucacccuuaaacaguuugccgaaauguauguggcgaaguucgccgcuaaaggggagggacaacugggccccgccgaacgcgcuaagaagguugaggacaugaugaaaaagcucuggggcgacagauacuuugauccugccaacgggaaauucucuaaguccgccacgagccccgagggaaagaagcugccucggacauuuugccagcugauucucgacccgaucuucaaaguguucgaugcuauuaugaauuuuaagaaggaagagaccgcgaaacugaucgaaaaacuugacaucaaacuggauucugaggacaaggauaaagaaggcaagccccuccugaaggccgucaugcgcagauggcuuccugcuggggacgcccugcuccagaugauuacaauccaucugcccuccccugugaccgcccagaaauaucggugugagcugcucuacgagggacccccggaugacgaagcugccaugggcauuaagagcugcgauccuaaagggccccugaugauguauaucuccaagaugguuccuaccucugacaaaggacgcuucuacgcguuuggcagaguguucagcggccuugucuccacagggcugaaggugcggauuaugggacccaacuacacgcccggcaagaaagaggaccucuaucugaagccuauccaaagaaccauccuuaugauggggcgcuacgucgaaccgauugaggaugugcccuguggaaauaucguuggccuggugggggucgaccaguuucucgugaaaacaggcaccauuacaaccuucgaacacgcucacaacaugcggguuaugaaguuuagcgugucuccugucgugagaguggccguugaggccaaaaaucccgcugaucugccuaagcuggucgagggacucaagcgccuggccaaauccgaccccauggugcagugcaucauugaagagagcggcgaacacaucauugcuggggccggagagcuucaucuggagaucugucucaaggaucuggaagaggaccacgcgugcaucccgauuaaaaagucugauccuguggucagcuaucgggaaacgguguccgaggaaucuaacguucugugucuuagcaaaucccccaacaagcauaauagacucuacaugaaagcccgcccuuuccccgacggccuggcugaggauaucgacaagggggaggugagcgcccggcaagaacugaagcagagagcucgcuaucucgccgagaaauacgaaugggaugucgcggaggcccggaagauuuggugcuuuggaccugacggcacagggcccaacauccugaccgauauuaccaaaggcgugcaguaucuuaaugaaaucaaggacucuguuguggcuggauuccagugggccacaaaagagggcgcucugugcgaggaaaacaugagagggguccgcuuugacgugcacgauguuacccuccacgccgacgccauccaucggggaggcgggcaaauuaucccgacagcuagacggugucuguacgcguccgugcugacggcccagccucgccuuauggagcccauuuaccucgucgaaauccagugccccgaacagguggugggaggcauuuaugggguccugaauagaaagcggggccacguuuucgaagagagccaaguggcuggaaccccuauguuuguggucaaggccuaccugccggugaacgagucuuucggcuucacagccgaucucagauccaauaccgggggacaggcuuuuccccaguguguuuucgaccauuggcagauccugccuggcgaucccuuugacaacagcucccgcccuucucaaguggucgccgaaacacggaaaagaaaggggcuuaaagagggaauccccgcgcuggauaauuuccucgacaagcuguga

SEQ ID NO: 68685 - RNA, 1791 nt, Artificial Sequence
  derived and/or modified sequence opt5 from EEFSEC__Homo_sapiens__NP_068756
auggccggcagacgggugaacgucaauguuggggugcugggacacaucgacagcggcaagaccgcucucgcccgcgcgcuguccacaacggcuucuaccgccgccuucgauaaacagccccaaagcagagagcgggggauuacacuugaccugggauuuuccugcuucucugugccucucccggcucgccugagaagcucccuucccgaauuucaggccgcuccugaggccgaacccgagccuggcgaaccccugcuccaggucacccugguggauuguccugggcaugcgucucugauccggacaauuaucggaggcgcccagauuaucgaccucaugaugcugguuaucgaugugaccaagggcaugcaaacacagagcgcugagugccuugucauugggcagaucgccugucagaaacuggugguugugcucaacaagauugaccugcuuccggagggaaaacgccaagcugccaucgauaagaugaccaagaaaaugcagaagacgcuggaaaauaccaaauucagaggcgcgcccauuaucccugucgccgcuaagcccgggggaccugaggcccccgaaacagaggcuccgcagggcauuccugagcucaucgaacugcugaccucccagaucagcauucccacacgggacccuucugggcccuuucucauguccguggaucacugcuucagcaucaaaggacaaggcaccgugaugacgggcacaauucugucuggguccaucagccuuggagacucugucgagauucccgcccugaagguugugaagaaagugaaguccaugcagauguuucauaugccuaucaccagcgccaugcagggcgaucgccucgggaucugugucacacaauucgacccgaaacugcuugaaagaggacuggugugcgcucccgagucccuccacaccguucaugcggcccugauuucuguggaaaagaucccuuacuuucggggcccccugcagaccaaagcuaaguuccacauuacagucgggcacgagacggugaugggacgccucauguuuuucagcccugcccccgauaacuuugaccaggagccgauccuggacuccuucaauuucagccaggaauaucuuuuucaagagcaguaccugucuaaagaucucaccccugccguuacagacaacgaugaagcugacaagaaggccggccaggcgaccgagggccauugucccagacagcaaugggcucugguggaguucgaaaaaccugucacaugcccccggcuuugucuggugauugggucccgccucgaugccgacauccacaccaauacgugcagacuggccuuucauggaauccugcuccacggccuggaggaucggaacuaugcugacagcuuccuuccuagacugaaggucuacaaacucaagcacaaacaugggcugguggaacgcgccauggaugacuauucuguuauuggacggagccuguuuaagaaggagacaaauauccagcuuuucgugggccucaaaguccaccuguccaccggggaacugggcauuaucgauucugcuuuuggacagagcggcaaguucaaaauucauauccccgggggacucuccccggagagcaagaaaauucugaccccugcccuuaagaagagagcgcgcgccggcagaggggaagcuacacggcaggaggagucugccgaacgcuccgagcccagccaacacgugguucugucucucaccuuuaaacgguacguguucgacacacauaagagaaugguccagucccccuga

SEQ ID NO: 68686 - RNA, 429 nt, Artificial Sequence
  derived and/or modified sequence opt5 from EFCAB11__Homo_sapiens__NP_001271195
auguucuuuagcgaggccagagcucggucccgcaccugggaagccucucccagcgagcacagaaaguggguggaagucuucaaagcgugcgacgaggaucauaagggcuaccugucccgggaagacuuuaaaacagcuguugugaugcuguucggguauaagccuucuaaaaucgagguggauagcgucauguccucuauuaacccgaauacgagcggaauccuccuugagggcuuucugaacauugugcgcaagaagaaagaagcccagagauaccggaaugagguucgccacaucuucaccgccuuugacacauauuacagaggguuccucacccuggaagauuuuaagaaggcuuuccggcaaguggcccccaaacuuccugagcgcacaguccuggagguguuuagaggaauuuucuccgcuuga

SEQ ID NO: 68687 - RNA, 480 nt, Artificial Sequence
  derived and/or modified sequence opt5 from EFCAB1__Homo_sapiens__XP_005251361
augaacagaaagaaacugcagaagcucaccgacacacugacgaaaaauugcaagcaccuuuuccggggcuuugauaaagacaacgaugggugugugaauguccuggaguggauccauggacucagccuguuccuucgcggcucccuggaagagaagaugaaguacugcuuugaaguuuucgaccucaacggggauggauuuauuucuaaagaggaaauguuccacaugcugaagaauagccugcucaaacaacccuccgaggaggacccugaugaaggcaucaaggaccugguggagauuacccuuaaaaagauggaucaugaccacgaugggaagcugucuuuugccgacuaugaacucgcugugagagaggagacacugcuucuggaagccuucggaccgugucuccccgauccuaaaagccagauggaguuugaagcgcaggucuucaaggaccccaacgaguuuaaugacauguga

SEQ ID NO: 68688 - RNA, 1482 nt, Artificial Sequence
  derived and/or modified sequence opt5 from EFEMP1__Homo_sapiens__NP_001034438
augcugaaggcccucuuccugaccaugcuuacacuggcucucgugaaaagccaggacacggaggaaaccaucacauacacccaaugcacagauggcuaugagugggaccccgucagacagcaguguaaggauauugacgaaugcgauaucguuccugacgccuguaaagggggaaugaagugcgugaaccacuacggcggguaucugugucuuccgaaaaccgcgcagauuaucgugaauaacgagcaaccccagcaggaaacacagccugcugagggaaccuccggcgccacgaccggggucguggccgcuucuagcauggccacauccggaguucugcccggcggcggguuuguggcuucugccgcggccgucgcuggaccugagaugcaaaccggccggaauaacuucgugauucgcagaaaucccgccgauccucagcggaucccgagcaaccccucccaucgcauccagugcgcugccggguacgaacagucugagcacaauguuugucaagacauugaugaaugcacagcgggaacccauaacuguagagccgaccaggugugcaucaaucuccggggcagcuuugcuugucagugcccucccggguaucaaaagcgcggagagcagugcgucgauauugacgaguguacgaucccucccuacugccaccagagaugugugaacacaccgggcuccuucuauugccaguguagcccuggcuuucaacuggccgcuaauaacuauaccugcguggauauuaaugaaugugacgccucuaaccagugcgcccagcaguguuacaauauccugggguccuucauuugccaauguaaccagggauacgagcucagcucugaccggcugaacugcgaagauaucgacgagugccgcacauccagcuaccuuugucaguaucagugcgucaaugaacccggcaaguuuucuuguaugugcccucaaggguaccagguugugagaucccggaccugucaggauaucaacgagugcgagaccacaaaugaaugucgcgaggacgaaaugugcuggaacuaucauggaggcuucagauguuacccccggaaucccugccaggauccuuauauucugacgccggagaaccgcugugugugccccgucagcaaugcuaugugcagagaacucccucaauccaucguguacaaauacaugucuauucggagcgacagauccguucccagcgauaucuuucagauucaggcgaccacaaucuaugccaacaccaucaauacauuccgcauuaagucugggaacgagaauggagaguuuuaccugcggcaaaccuccccugugagcgcuaugcuuguccuggugaaaucucucagcggccccagagaacacaucguugaccuggagaugcugacgguguccucuauuggcacauuccgcaccagcuccguccuccggcugaccaucauuguggggccguuuagcuucuga

SEQ ID NO: 68689 - RNA, 1332 nt, Artificial Sequence
  derived and/or modified sequence opt5 from EFEMP2__Homo_sapiens__NP_058634
augcugcccugcgccagcugucucccuggcucccugcuucugugggcucuccugcuucugcuccuggggucugccagcccgcaggacuccgaggaacccgauucuuacaccgagugcacagacggauaugaaugggauccugacagccaacacuguagagaugugaacgagugccugacgauccccgaagcguguaagggcgagaugaaaugcauuaaucauuacgggggauaucucugucugccucgguccgcugccgucaucaacgaccuucacggcgaggggcccccuccgcccguuccucccgcccagcauccuaaucccugcccgccuggauacgaacccgaugaccaggauucuuguguggacguggaugagugcgcucaggcccugcacgacugucgcccuagccaagauugccauaaccuccccggcuccuaucagugcaccugucccgacggcuacagaaagauugggccugaaugcgucgacaucgaugagugucgguaucgcuacugccagcacagaugugugaaucugccgggcagcuuccggugccagugugagcccggauuucaacuugggccuaacaaucgcucuugcguugacgugaacgaaugugauaugggagcucccugcgagcagagauguuucaauuccuacggcacauuucugugccggugccaccagggguaugaacuccaucgcgacggauucagcuguucugauauugacgagugcuccuacagcucuuaucugugucaguacagaugcaucaacgaaccuggccgguuuuccugucacugcccccaaggcuaucagcugcucgccacccgccugugucaggauaucgacgagugcgagagcggggcgcaucaauguuccgaagcccagacaugcgucaauuuccacggaggcuacagauguguggauaccaaccggugcguugagccguauauucaggugucugaaaaucgcugccuuuguccugcuagcaacccccugugcagagagcagccuuccagcaucguccaccgguacaugacaauuaccucugaaagauccgugcccgccgacguguuucaaauccaggcuacgagcgucuacccuggggccuauaaugcguuccagauucgcgccggaaacucucagggcgauuuuuacauccggcaaauuaacaauguuagcgcuaugcucgugcuggccagacccgugaccgggccgcgcgaguauguccuugaccuggagauggugacaaugaacucccucaugucuuaccgggcuagcuccguucugagacugaccguguucgucggagccuauacauuuuga

SEQ ID NO: 68690 - RNA, 2502 nt, Artificial Sequence
  derived and/or modified sequence opt5 from EFHB__Homo_sapiens__NP_653316
augaacauggagaucggccacccccaugaagggaaggacgaucugggagacaaaagagugauuaugggcaccaaguucccuauggagcucgggauccgggucggacugggcaaagaagauagccgcugcggggaguccccgguugugucuaauaagugugaaggaagaauggcgcccccugagacaaaauuuccccuuagcaagggccuggagaugggccucgaacggcagaacauuucccgcacggugaugcaaagagggucucugggagucgacagcguguccgcuucucagggcaccaagccuagccuucugcccgggcggaugggacucgagaaugaaucccugcuggccggcuacacacacgagcgcaucauucagccuccgcucgggagaguuugcggaagcucucaggcggcuggcucccggcgcgcuccccuggccagcggcccugaggggguggaggaacuugucggaaaacccgccuucgugauggaaccuagacaagagauggaaaaggagucuaccuguguucugaugaaacccaacacagagaucaagcucccgguggaagucgauaucggccugacccaggccgaggggccugacgaaaccaaaaauaccgagccccagaugggacuugugauugaaccuccccagugccaauuugcucagcagcaugagcagcggaaggaggccggcaacaucgaauccgggguggagcccccugaucgcauuagaccgaucuauagcggaaaguucuuugaccggacgcccuguuggccuucugcgggcaaagucauucccguuggcuaccgcguggcuaccugccugacagaaaagcucccuagacugaucacacccccggaggccaaaaaguauuucaauuuucgguacccucccgccgggguggaaagagucuucuauggacgcgcuaacgauccucaaauugcccccuaccugacacacggcauccgguccaaaaucagcgugcucgcgaauacccugauuaacccucagcccaucacgacauuucagcaaaagauuaaagacaagaaggaguccaucuaucuuucuaauagacgcgccccgcuggggaaaagccaugaucaggcuccuggacuccccaagggcauggacaccacaaacaccaccuucgggacagccguuauuaaagaguacuccgcuaaggauguggucaaucccccuaaaagcuacgaagagguguuuaaggaaggcaacgagggacacgaccuguauguugugucucacaaugacuacuaugccggcgaggccaagaaccggaaauacaacccguccagcuuccauagauguucugucuauggggugcccacgccucacuuuaaugauggacgcgcuauggccaagagccuuuacuggcugcaugaacuccagaugaaacggggcgccaaguucgucuccaaaagagcugacgauuucaaggagaaguuucagcacaaacuggggcgcgugcuggaccccaucgccgaaaccaugaacguuccucccgauugcacauucggagccugucuccggccugaggaauauggcgugggggaccugauccacaauagacuucccgaugaguaccugcgcggcaaggaccggcaaagagcucucauugccgcgguccggcaucaccugaaaaaggugaacuaccagaaauuugauacccuucuggcugccuuccgccauuaugacaagaagggagauggcaugaucgacaaagacgagcuccaggaagccugcgaucaggcuaaucugucucuggacgauaagcuccuggaccaacuuuuugauuacugugacguugauaacgacggguucauuaauuaucuggaguuugccaacuuccucaauuggaaagauaagaugcugcugaaagaauacgaggaaagagugaucauuaagggacggaaaccggacugcgucaacccuacagaggcuaauguggaggaacccgagcagacccuucucaucaagccugaagauaucgugcugaaggaggccggcagcacggagaaaacacugagaacccuccugcgccccuccgacaagguuagcaacuauuacaaaaccacaucuuccgaaauuaaugcgaucgucggggccauuccgucuaccugcuauccuaucuguggagugcccacaauucggagcgauaucccugcuccccgcauuagaagaaucuccgaccggacgaacuacggcgaggaagggagcgccuacucccuucuguaucccaccaucuuugcucgcaagggcguguucgagagagacuuuuucaaaacacggucuaaggaagagauugccgagauccucugcaauauuggagucaagcugagcgaugaagaguuugaaaacguguggaaccuggcguccaaaaagcaccaucgcggcgagguuuguguggaaaauaucagaaacguccuugacgagcuccggcacgccgaucgcauuaaaugcaagacccugauguga

SEQ ID NO: 68691 - RNA, 1866 nt, Artificial Sequence
  derived and/or modified sequence opt5 from EFHC1__Homo_sapiens__NP_001165891
augcugaagaccgccuuccacagaagccagacacucuccuaccggaacggcuaugcuaucgugcgcagacccacggucgggauuggaggcgaccggcugcaauuuaaucagcuuucucaggccgagcuggaugaacucgcgagcaaagcuccuguucugaccuacgggcagccgaagcaagcucccccugccgacuucauccccgcccauguggccuuugauaaaaaggugcuuaaauucgacgcuuauuuucaggaggaugucccuauguccacagaggagcaguaccgcauuagacaggugaacaucuauuacuaucuggaagacgauucuaugagcguuauugagcccguggucgaaaauuccggaauccuccaaggcaagcugaucaagcggcagcgccuggccaaaaacgacagaggggaucacuaccauuggaaggaccucaaucggggaauuaacaucaccauuuacggcaaaacauuccgcgugguugauugcgaccaguuuacccagguguuccuggaaucucaaggcaucgagcuuaauccuccggaaaagauggcgcuggaucccuauacagagcucagaaaacagccucugcggaaguacgucacccccagcgacuuugaccagcuuaagcaauuccugacguuugauaaacaggugcuccgcuucuaugccauuugggacgauaccgacuccauguacggggaguguagaacauauaucauucacuacuaucugauggaugacaccguggaaauccgggagguccaugaacgcaacgauggaagagacccuuuuccccugcucaugaaucggcagagaguuccgaaggugcugguggagaacgcuaaaaauuucccucagugcguccuugaaaucagcgaucaagaggugcuggagugguacacagccaaggacuucauuguuggcaaaucucucaccauccuggggcgcacguuuuucauuuacgauugugaccccuuuacacggagauauuacaaggaaaaauucggaaucaccgaccuuccucgcauugauguguccaagcgggagcccccucccgucaagcaggaacugccgcccuauaacggcuuugggcucguggaggacagcgcucagaauugcuucgcccugaucccuaaagcgcccaagaaagauguuaucaagaugcuggugaacgacaauaaaguccucagauaccuggccgugcuugaaucuccuauucccgaggauaaggaccgccgguuugucuucuccuauuuucuggcuacagauaugaucagcauuuucgagccgccugugagaaacucuggaaucauuggcggcaaguaccucgggcgcaccaaaguugugaagcccuauuccaccgucgacaacccuguguacuacggacccagcgacuuuuucaucggcgccguuaucgaaguguuugggcaccgguucauuauccuggauacagaugaguauguccuuaaauacauggaauccaaugcugcccaguauucuccugaggcccuggcuagcauucaaaaccacgugagaaagcgcgaagcgcccgccccggaggcugaguccaaacagacggaaaaggacccuggagugcaggagcucgaagcccugaucgauaccauucagaagcaacugaaagaccauagcuguaaggacaauauccgggaggccuuccagauuuacgauaaagaggcuucuggcuauguugacagagauauguuuuucaagaucugcgaaucccucaacguccccguggacgauagccuggugaaagagcuuauccggauguguucucacggggaaggaaagauuaauuacuauaacuuuguccgcgccuucagcaauuga

SEQ ID NO: 68692 - RNA, 2250 nt, Artificial Sequence
  derived and/or modified sequence opt5 from EFHC2__Homo_sapiens__NP_079460
auggcccugccccuccugccuggcaacagcuucaauagaaacguggggaaggagaaauuucacaagucccagcauuggggauucugcaauaacgucaugaugcuuguuucugacgaaaaaccgggcaucgggggagagccccugcucggccaaaagauuaaaccuaaguguagcaucuaccccaagggggauggauccgacgugccuucuuggguggcuuuugauaaacagguccugagcuucgacgccuaucuugaagaggaagugcuggauaagucccagaccaauuaccggauucgcuauuacaaaaucuauuuuuaccccgaggacgauacaauucagguuaacgagccugaagugaagaauagcggccuccugcaaggcacgagcaucagacggcaccgcaucacccugccgcccccugacgaggaucaguucuauacagucuaccauuuuaacguggggaccgaaguuguguucuacggaagaacauuuaaaauuuaugacugcgaugcguucacccggaauuuucuccgcaagaucggcgucaaggugaaucccccugugcagugucccgaggacccguacaugaaaauuagacgggaggucguugaacacguggagccucugcgccccuaugaaucccuugauacacugaagcaguuccuccaauaccaugggaaaauccugugcuuuuucugucuuugggacgacagcgugucuauguucggagauagacgggagcugauucuccacuauuuucugugcgacgauaccaucgaaauuaaggagcugcucccucacuccagcggccgcgacgcucugaaaauguuccuuagacggucuaagcugcccaaaaacugucccccucgcgucuaccagccggggcagaucacggauagagccgugcucaacuccuauggagacuuuaucaagaaucaggccgauggcuaccuguucgaccgguacaaacuuggcaagguugaucaagaguuuuauaaggacagcgaucugucucucggggugaccauuaacgucuggggaagaaaagugcugcuguacgacugcgacgaguucacaaaguccuauuacaaaagcaaguauggcaucgagaauuuuaccuccguuucuuguaagcccccuucucccccucccaaaauugaacgcaaguucccgccuuacaacggguuuggauccgaggaagauagccuccggaacugcaucgaccugaaacccacaccucauagacgcaauuucaagaaauuuauggagaaggauucuuauggcuccaagagcaacauucuucgguucuuugcuaaacuggugaccgacaagugugucgaucucgacagaauguucgugaucucuuacuaccugggggaugacacgaucagcgucuucgagcccauugaacgcaauuccggaaucgccggcggcauguuucuuaaacggucuagagugaagaaaccugggcaggagguuuucaagagcgaacuguccgaguauauuaaggcugaagaacucuacaucggagugacagucaacgugaauggcuaucuguuucgccugcucaacgccgaugaguacacccugaauuauauggaacagaacacagacaaauaccccuucagcaaucuuaagcuggcgcuccaaaaacugaagcaggaggaagggaaaucucgggagcugaagcagguuuuuaaagccgcugauuccaagcacaccaacaugguggacuauaauaccuucagagauauucuuaugagccucacagucggaaaccuggccgagcaggaauuugugacgaucgcucgccauuaccgggugccggaggggaccugcucugacauggacuuccugaucgcccucgcgcacgaaaaguuuaaaaagaauauguucgagaacuuugauacauucauuuacuccugcguuuaugaagacagagagaaaaagaauguccugccuaccaaagauaucaagcggcuuuguaagagcucccgccugccccucucugacgaucugcuggagagccuucucuccagauuugaagacucugagaaacaaauugauuacaagagcuucuucuccgcccugaacuggcggaaaaaccccgugccugaacugcagccggcuagcuaucucaaggagagaugcgaagacguguggcugggcaugcccucuccuauccccgccaaauacauugauuauuggacauuucuuaaggacgcuuucggccuggaggaggaauga

SEQ ID NO: 68693 - RNA, 432 nt, Artificial Sequence
  derived and/or modified sequence opt5 from EFHD1__Homo_sapiens__NP_001230181
augggcgagcugcaguacgacgccgggagagauggauucaucgaccucauggaacugaagcugaugauggagaagcugggcgcuccccaaacccaccucgggcuuaagagcaugauuaaagaaguggaugaggacuuugauggaaaacuuuccuuccgggaauuucugcucaucuuccauaaggccgcggcuggcgagcugcaggaggacucugggcugauggcccucgccaagcugagcgaaauugaugucgcucuugagggaguuaagggcgccaaaaacuuuuucgaagcuaaggugcaggcccuguccucugcgagcaaauuugaggccgagcucaaggcugaacaggacgagcgcaaaagagaagaggaggaacggcgccugagacaagccgcuuuccagaaacuuaaggccaauuuuaacacauga

SEQ ID NO: 68694 - RNA, 618 nt, Artificial Sequence
  derived and/or modified sequence opt5 from EFNA1__Homo_sapiens__NP_004419
auggaguuccugugggcuccccuccugggccuuugcuguagccuggccgccgcggacagacacaccguguuuuggaacuccucuaauccuaaguuccggaacgaagauuacacaauccauguccagcucaaugacuauguugauauuaucugcccgcacuacgaggaccauagcguggcugaugccgccauggaacaauauauucuguaccuuguggagcacgaagaguaucagcugugucagccccaguccaaagaccaaguccgcuggcagugcaacagaccuucugcuaagcaugggcccgagaaacucagcgaaaaguuucagcgguucacgccuuuuacccugggaaaagaguucaaggaaggccacuccuacuauuacaucucuaagcccauucaccagcaugaggaucgcugucugagacucaaagugacaguuagcgggaagaucacccacuccccucaagcccaugacaauccgcaggagaaacggcuggcugccgaugaccccgaagugcgcguccuucacagcaucggacacucugcggccccuagacuguuuccccucgcuuggacagugcugcuucugccucuccugcugcuccagacccccuga

SEQ ID NO: 68695 - RNA, 642 nt, Artificial Sequence
  derived and/or modified sequence opt5 from EFNA2__Homo_sapiens__NP_001396
auggcccccgcucagagaccucugcucccgcugcuucugcuccugcuuccccugccucccccucccuucgcccgggcggaggacgcugcccgcgccaacagcgauagauacgcuguguauuggaaucgguccaacccucgcuuucacgccggcgcuggggacgauggaggcggguacaccgucgaaguuucuaucaaugacuaucucgauauuuacugcccgcauuauggagcgccccugccucccgccgagagaauggaacacuacgugcuguauauggugaacggcgaggggcaugccagcugugaccaccggcaacgcggauucaagagaugggaaugcaaucggccugcugcccccggcggcccgcucaaauuuuccgagaaguuccagcuguuuacaccuuucucucuuggguuugaguuccgccccggacaugaauacuacuauaucagcgcuacgccucccaacgccgucgauagacccugucugcggcucaaaguguacguucgcccuaccaaugagacacuguaugaagcgccggagcccauuuuuaccuccaacaauucuugcagcuccccuggcggguguagacuuuuccugagcacaauccccgugcucuggacccugcugggaucuuga

SEQ ID NO: 68696 - RNA, 717 nt, Artificial Sequence
  derived and/or modified sequence opt5 from EFNA3__Homo_sapiens__NP_004943
auggccgcugcgccccugcuccugcuucugcuccuggugccugucccgcuucugccccuccuggcccagggcccugggggagcucugggcaacagacacgccguuuacuggaauagcuccaaccaacaucuccggcgcgagggguauaccguccaggugaaugugaacgacuaccuggauaucuauugcccccacuacaauucuagcggagugggcccuggggccggacccggcccuggcgggggagcugaacaguauguucuuuacaugguguccagaaacggcuaucggacauguaaugccucucagggguucaagcgcugggagugcaacagaccgcaugcuccccacagcccuauuaaauuuuccgaaaaguuccaacgguacucugccuuuagccugggauacgaguuccaugcgggccacgaauauuacuauaucuccacgcccacccacaaucuccauuggaaaugucugcgcaugaaggucuuugugugcugugccagcacaucucacuccggggagaaaccuguucccacccuuccgcaguucacaaugggaccuaacgugaagauuaauguccuggaggacuuugaaggcgagaacccccaggugccuaagcucgagaaaagcaucucuggcaccucccccaagagagaacaucugccccuggcuguggggauugccuucuuucucaugacauuccuggcuagcuga

SEQ ID NO: 68697 - RNA, 606 nt, Artificial Sequence
  derived and/or modified sequence opt5 from EFNA4__Homo_sapiens__NP_005218
augagacugcucccccugcuucggaccgugcugugggccgcuuuccucggcagcccucugcgcgggggauccucucuuagacacgucguuuacuggaacagcuccaauccgcggcugcuccgcggcgacgccgugguggagcuggggcugaacgauuaucucgacaucgucugcccccauuacgaaggaccugggcccccugagggccccgaaacauuugcgcuguauaugguggauuggccuggauacgagucuugucaggcugaaggcccgagagccuauaagcgguggguuugcagccuucccuucggccacgugcaauuuuccgagaaaauucagcgcuucacgccuuuuucucugggguucgaguuucuccccggagaaaccuacuauuacaucagcgucccuacacccgaguccagcggccagugucugagacuucaggugucuguuugcuguaaggaacggaaauccgagagcgcccauccgguggggucuccuggagaguccggcaccagcggguggcgcggaggcgacacacccucuccucugugccuccugcugcuccugcuucugcucauucugagacuucugcggauccucuga

SEQ ID NO: 68698 - RNA, 687 nt, Artificial Sequence
  derived and/or modified sequence opt5 from EFNA5__Homo_sapiens__NP_001953
augcugcacguggagaugcucacccuggucuuccuuguucuguggaugugcguguuuagccaggaccccggcuccaaggccguggcugauagauacgccgucuauuggaacucuagcaauccucgguuccaacgcggggacuaccauaucgauguguguauuaacgacuaucucgauguuuucugcccgcacuacgaagacuccgugcccgaggauaaaacagaaagauauguccuguacauggugaauuucgacggauauucugcgugugaucauacgagcaagggcuuuaaacggugggagugcaaccgcccucacucccccaaugggccucuuaaguucucugaaaaauuucagcuguucacccccuuuagccucggauucgaguuuagaccuggccgggaguacuucuacaucuccagcgcuauuccggacaacgggcgcagaucuugucugaagcugaagguuuuugugcggcccacaaauuccugcaugaaaaccaucggaguccaugaucgcguguucgacgugaacgauaaggucgaaaauagccucgagccugccgacgacacaguucacgaaucugccgagcccuccagaggcgagaacgcugcccagaccccucggauucccagccgccugcuugcuauccugcucuuucugcuugccaugcugcucacacuguga

SEQ ID NO: 68699 - RNA, 1041 nt, Artificial Sequence
  derived and/or modified sequence opt5 from EFNB1__Homo_sapiens__NP_004420
auggccagacccggccagcgguggcuggggaaguggcucguggcuauggucguuugggcccugugccgccuugcgaccccucuggcuaaaaaccucgagccggugagcugguccucucugaaucccaaguuccuuagcggaaaaggccuggugaucuacccuaagauuggggacaaacucgauaucauuugucccagagccgaagccggacggccuuaugaguacuauaagcuguaccugguccgccccgaacaagcugccgcuugcuccacagugcucgacccuaacguucuggugacguguaauagaccggagcaggaaauccgguuuaccauuaaguuccaggaguuuucucccaacuauaugggccuugaguucaaaaagcaccaugauuacuauaucacaagcaccuccaaugggucucuggaaggacucgagaaccgcgaaggcggcgucugcagaacacggaccaugaaaaucauuaugaagguggggcaggacccuaaugccguuacacccgagcaacugaccacgagccgcccuuccaaagaggcggauaacaccgugaagauggccacacaggcucccggaagcagaggcucucuuggggacuccgauggaaagcacgaaaccgucaaucaggaggaaaagagcggcccgggggccucuggaggcuccagcggcgacccugauggguuuuucaacucuaagguggcucuguuugccgcggugggagccggcugugucaucuuccuccugauuaucauuuuucugacaguucuccugcuuaaacugcggaagcgccauagaaaacacacccagcaacgggcugccgcucucucccugagcacgcuugccucccccaaagggggaucuggcacagccgggaccgagccuagcgacaucauuaucccccugcgcacaaccgaaaauaacuacugcccccauuacgagaaaguguccggagauuauggccacccuguguacaucguccaggagaugccgccccagagcccugcuaauauuuauuacaagguguga

SEQ ID NO: 68700 - RNA, 1002 nt, Artificial Sequence
  derived and/or modified sequence opt5 from EFNB2__Homo_sapiens__NP_004084
auggccgugagacgggacagcgucuggaaguacugcuggggcguucugauggugcucugucgcaccgcuaucuccaaaucuauugugcuggagcccaucuauuggaacagcuccaauucuaaguuccuuccugggcagggacugguccucuacccgcaaauuggcgauaaacuggacaucauuugccccaagguggauagcaaaacaguugggcaguaugaauacuauaagguguacauggucgacaaggaucaggccgacagauguacgaucaaaaaggagaacaccccucuucugaauugcgcgaaacccgaucaggacaucaaguuuacaauuaaauuccaagaauuuuccccuaaccucuggggacuggaguuccagaagaauaaggauuauuacaucauuucuaccagcaacggcucccuggaagggcucgacaaucaggagggaggcgugugucagacacgggcuaugaaaauccugaugaagguuggccaagaugccagcucugccggguccacccgcaacaaagaccccacaagacggccugagcuugaagcuggaaccaauggccgcagcucuacgaccuccccguuugugaagcccaacccugggagcucuacagauggaaauuccgccggccacagcgggaacaauauucugggauccgaggucgcucucuucgccggcaucgcgucuggcugcauuaucuuuaucgugauuaucauuacccuggugguccuucugcucaaauacagacggcgccauagaaagcacagcccccagcauacaaccacgcugucccugagcacacucgccaccccuaaacggucugggaacaauaacggauccgaacccagcgacaucauuaucccgcugcgcacagcugacucuguuuucuguccucacuaugagaaggugagcggcgauuacgggcaucccguguauaucguccaggagaugccuccccagucccccgccaacauuuacuauaagguguga

SEQ ID NO: 68701 - RNA, 1023 nt, Artificial Sequence
  derived and/or modified sequence opt5 from EFNB3__Homo_sapiens__NP_001397
auggggcccccucacagcgggccgggaggcgugagagucggggcccugcuccugcuuggaguucugggccucguguccgggcugucucuugagcccguguacuggaacagcgcuaauaagcgguuccaggccgaaggaggcuauguccuguacccucaaaucggcgaccgccucgaucugcugugccccagagcgcggccucccgggccucauuccucuccgaacuaugaguuuuacaaacucuaucuggugggaggcgcucaggggcgcagaugugaagcucccccugcccccaaucuucugcugaccugcgaccggccugaucucgaccuucgcuucacaauuaaguuucaggaguacagccccaaccuguggggacacgaguucagaucccaucacgauuauuacaucauugccacgucugacggcacccgggaagggcucgagagccugcagggaggcguuugucugacacgcggcaugaaagugcuccugagagucgggcaauccccgcggggaggcgccgugccucgcaagcccguuagcgaaaugccuauggagagagaucggggcgcugcccauucucuugaacccggaaaagagaaucugcccggcgacccuaccuccaacgcgacaagccgcggggccgagggaccgcugcccccucccucuaugccugcuguggccggcgcugccggcgggcucgcgcuucugcuccugggagucgccggcgcugggggagccaugugcuggagacggagacgcgcuaagcccuccgaaagccggcacccgggcccugggucuuuuggcagaggaggcucccuggggcucggaggcgggggaggcauggggccccgcgaggccgaaccuggcgagcugggaaucgcccuucggggcgggggagcugcggaucccccuuucuguccccacuacgaaaaggugagcggcgacuaugggcauccgguguacauuguccaggauggaccuccccaguccccucccaauaucuauuacaaaguuuga

SEQ ID NO: 68702 - RNA, 2466 nt, Artificial Sequence
  derived and/or modified sequence opt5 from EFR3A__Homo_sapiens__NP_055952
augcccaccagagugugcuguugcuguagcgcccugcggccucgcuacaagagacucgucgacaacaucuucccggaggaucccaaagacggccugguuaagacagauauggaaaaacuuacguuuuaugcuguguccgccccugagaagcuggaccggauugggucuuaccucgcggaacgccugagcagagaugugguccggcaccgcuccggauaugugcuuaucgcuauggaggcccuggaccagcuccugauggccugccauucucaaagcauuaaacccuucguugaauccuuucugcacaugguggcuaagcuccuggagucuggcgagccuaaacuucagguccuggggaccaauagcuucgugaaauuugccaacaucgaagaggauacacccuccuaccauagacgguaugacuucuuuguuagccgcuucucugcuaugugucacuccugccauagcgauccugaaauuagaaccgagauccggaucgccggaauuagaggcauccaggggguggucagaaagacagugaaugacgagcuccgggcgaccauuugggaaccgcagcacauggauaaaaucgugcccucucugcuuuuuaacaugcaaaagauugaggaagucgacucccgcaucggaccucccagcucuccuuccgccacagauaaagaggaaaaucccgcuguucuggccgagaacuguuucagagagcuccugggccgggcuaccuuuggcaauaugaacaaugccgugagaccgguguucgcgcaccuggaccaucacaagcucugggacccuaacgaauuugccguccauugcuucaagauuaucauguacagcauccaggcucaguauucccaccacgugauucaggagauccuggggcaucuugaugcccgcaaaaaggacgcuccccggguuagagccggaauuauccaagugcugcucgaagccgucgcuauugcggccaaaggcucuaucgggccuacggugcuggagguuuucaauacccuucugaagcaccuccgccugagcguggaauuugaggcuaacgaucugcagggaggcuccgucgggagcgugaaucucaacacaucuuccaaagacaaugaugagaagaucguccagaacgccauuauccagaccauuggauucuuuggcagcaaccugcccgacuaccaacggucugaaaucaugauguucauuaugggcaaagugcccguuuuugggacaagcacccauacgcuugauaucucccagcugggagaccucggcacaagacgcauccagauuaugcugcuucggucucugcucauggugaccagcggguacaaggccaagacaaucgucaccgcucugccuggauccuuccuggauccgcuccugagccccucucuuauggaggacuaugaacugagacaacucgugcuggagguuaugcacaaucugauggaucgccaugacaaccgggccaaacuuagaggcauucgcaucauuccugacguggcggaucucaagaucaaacgggaaaagauuuguagacaggacaccuccuuuaugaaaaagaaugggcagcagcuguaccggcacaucuaucugggaugcaaggaggaggauaacguccaaaagaauuacgaacuccuguauacaagccuugcucugaucacgauugagcucgccaacgaagagguggugaucgaccugauucgccuggccaucgcccuucaggauucugcuauuaucaaugaggacaaccuccccauguuccacagauguggcaucauggcucugguugccgcguaccugaauuuugucucccagaugauugccgugccugcuuucugccagcaugugagcaaggucaucgaaauucggaccauggaggcccccuauuuucucccggaacacaucuucagagauaaaugcaugcugccuaagucccuugagaaacaugaaaaggaccuguacuuucucacaaacaagauugcugagucucugggcgggagcggauacuccguggagcgccugucuguucccuaugugccucaagucaccgaugaagaccggcuuagcagacgcaaauccaucguggauacaguuagcauccagguggacauucucucuaauaacguccccuccgaugacgugguuagcaauaccgaggaaaucacguucgaggcccugaagaaagcgauugacacaucuggcauggaggaacaggagaaggaaaaacgccggcuggugaucgagaaguuccagaaggccccuuuugaagagauugcugcccaaugugaauccaaagcuaaccuccugcacgaucgccuugcccagauccuggagcucaccaucagacccccgccuagccccucugggacccugacaauuaccagcggacacgcccaguaccaguccguccccguguaugagaugaaguucccugaccugugcguguacuga

SEQ ID NO: 68703 - RNA, 2454 nt, Artificial Sequence
  derived and/or modified sequence opt5 from EFR3B__Homo_sapiens__NP_055786
auguacggcgugugcggguguugcggagcccugagaccccgguauaagcgccucgucgacaacaucuucccugaggauccggaagacggccugguuaaaaccaauauggagaagcugacauuuuacgcucugagcgcccccgaaaaacucgauagaauuggggcguaucuguccgagcggcuuauccgcgacgugggaagacaccgguacggcuauguguguauugcuauggaagcccuggaucagcuccugauggccugccauugucaaucuaucaaccuguucgucgagagcuuucucaagaugguggcuaaacugcuugaguccgaaaagccuaaucugcagauucucgggacgaacucuuucguuaaguuugccaauaucgaggaagacacccccagcuaccaccgcuccuaugauuucuuugugucuagauucagcgagaugugccauuccagccacgacgaucuggagaucaaaacaaagauucggaugucuggaaucaaaggccuucagggcgucgugcgcaagaccguuaacgacgaacugcaggcuaauauuugggauccucaacauauggacaaaaucgugcccucccuccuguuuaaccugcagcacgucgaggaagccgagagcagaucuccuuccccgcuccaggcgcccgaaaaggagaaggagagcccugccgaacuggcugagcggugucuucgcgaacugcucgggagagccgcuuucggaaauauuaaaaacgccaucaagcccgugcugauucaccuugauaaucauucucugugggagccuaaaguguuugcgauccggugcuucaagaucauuauguacuccauccagccccaacacagccaucucgucauucagcagcugcugggccaccucgacgccaacucccgcucugcugccacaguuagagcugggaucguggaagugcugagcgaggccgccgucauugcugcgaccggauccgugggcccgacaguucuugagauguuuaauacccugcuccggcagcugagacuuagcaucgacuacgcccugacggggucuuaugauggagcugugucccucggcaccaaaaucauuaaggaacacgaggaacgcauguuccaagaggccgucaucaaaacagugggcagcuucgccucuacccugccuacauaccagcggagcgaaguuauucuguuuaucauguccaaggugcccagaccuucucuccaucaggcugucgacaccgggcgcacgggagagaaccggaauagacugacacaaauuaugcuucuuaagagccuccuucagguguccaccggcuuccaguguaacaacaugaugagcgcccugcccucuaauuuucuggaucgccuccuguccacagcgcugauggaggacgcugaaauccgccucuucguccuggagauccuuauuagcuuuaucgauagacacgggaaccgccauaaauucucuaccauuuccacccugagcgacaucuccgugcucaagcugaaaguugauaagugcucucggcaggacacaguguuuaugaaaaagcacagccaacagcuguauagacauauuuaccuuuccuguaaggaagagacgaauguccagaaacacuaugaggcccucuacggacugcuggcccucaucucuauugaacuggcuaacgaggaagugguuguggaucuuauccgccugguccucgccgugcaggacguggcucaaguuaaugaggaaaaccugcccgucuauaaucggugcgcccuguacgcgcuuggcgccgcuuaccucaaccugaucagccagcugaccacagugccugccuucugccagcacauucaugaggugaucgagaccagaaagaaagaagcuccguauaugcuccccgaggaugucuuuguggaacggccucgccugucccagaaucuugacgggguugugauugagcuccuguucagacaaagcaagaucucugaaguccugggaggcuccggcuacaacagcgaccggcugugucuucccuauauuccucagcucacagaugaggacagacugucuaaacgccgguccaucggggagaccaucagccuccagguggaaguugagucuagaaauagccccgaaaaggaggaacgcgugccggccgaggagauuacguacgaaacacugaagaaagcgaucgucgauuccguggccguugaggaacaggagagagagcggcgcagacaaguggucgaaaaguuucagaaagcuccuuucgaggaaauugccgcucacugcggagcccgggccagccugcuucagucuaagcugaaccaaaucuuugagauuaccauccggcccccucccuccccuagcggcaccaucacagcugcguaugggcagccccagaaucauuccauuccgguguacgaaaugaaauucccugaccucuguguguauuga

SEQ ID NO: 68704 - RNA, 1179 nt, Artificial Sequence
  derived and/or modified sequence opt5 from EFS__Homo_sapiens__NP_001264103
auggccaucgcuaccagcguguacgucguucccccuccggccagacccugcccuacauccgggcccccugcgggccccuguccuccgucucccgaccugauuuauaagaucccucgggcuagcggaacgcagcucgccgcuccccgcgaugcccuggagguguacgacgugccucccaccgcccuuagagucccguccucuggcccuuaugauugccccgcuagcuucucccacccucugacacggguggcgccccaacccccuggggaagacgaugccccgcccucuccugagcccccuggagcccucgcuagccaugaccaggauacccuggcccagcuucuggcucgcuccccgcccccuccccacagaccucggcuccccagcgccgaaucucugucccgcagaccucugcccgcgcucccgguuccugaggcccccagccccucuccugugccgucccccgcuccuggccggaaagggagcauucaggaccgcccccugccucccccucccccgagacuuccuggauacggcggccccaaggucgaaggggauccugagggacgggagauggaagacgaucccgccggccaucacaacgaguaugaagggaucccgauggcugaggaguacgacuaugugcaucugaaaggaauggauaaggcccaaggcucucgcccucccgaccaggccuguacaggggacccugaacuccccgagagaggaaugcccgcuccucaggaagcgcuguccccgggcgagccccuuguugugagcaccggcgaucugcagcuccuguacuuuuacgccgggcaaugccagucccacuauucugcucugcaggccgccgucgcugcccucaugagcuccacacaggcgaaucaaccuccccggcuguucgugccucacagcaaacgcguggucguugcugcccauagacuuguguuugugggagacacccugggccggcucgccgcuucugcuccccugagagcccagguccgcgccgcggggacggcccuuggacaggcucugcgggccaccgugcucgcuguuaagggcgccgcgcugggguacccuuccagcccggccauucaagaaauggugcagugugucacagagcuggcuggacaggcccuccaguucaccacacugcuuaccucucuggcucccuga

SEQ ID NO: 68705 - RNA, 3210 nt, Artificial Sequence
  derived and/or modified sequence opt5 from EFTUD1__Homo_sapiens__NP_001035700
auggugcugaacagccucgacaagaugauccagcugcagaaaaauaccgccaacauuagaaauaucugcguccuugcucacguugaucauggcaacgaggaauaccugauuaaucucaucgacucccccgggcacguggauuucucuagcgagguguccacagccguccggauuugugacggaugcaucaucgugguugaugcgguggaaggcgucuguccucagacgcaggcugugcugcgccaggccuggcuugagaacauuagaccgguucuggugaucaauaagauugaccggcucaucgucgaacugaaauuuacaccccaagaggccuauucucaucugaagaacauucucgagcagaucaaugcucugaccgggacccuuuucacaagcaaagugcuggaagaacgcgccgaaagagagaccgagucccaggugaacccuaauucugaacagggagagcaagucuacgauuggagcacaggccucgaagacaccgaugacucccaccuguauuuuagccccgagcaggggaacguuguguucacgucugcuauugauggauggggcuuuggcaucgaacauuucgcccggaucuacucccagaagauugggaucaagaaagaggugcuuaugaagacccuguggggagacuauuacauuaauaugaaagcgaagaaaaucaugaagggcgaucaggccaaggggaaaaagccucucuuuguccaacugauucuggagaacaucuggagccucuaugacgcugugcugaaaaaggacaaagauaagaucgacaaaauuguuacaucucuuggacugaagaucggcgcccgcgaagcuagacacuccgaucccaaggugcagauuaaugccaucugcagccaguggcucccuauuucucacgcgguccuggccauggugugucaaaaacuuccgagcccccuggacaucaccgcugagcggguugaacgccucaugugcacagggagccagaccuucgauuccuuuccucccgagacgcaggcccugaaggcugccuucaugaaauguggaucugaagacacagccccugugaucauuuuugucagcaagauguucgcuguggaugcgaaagcccugccccagaacaagccgagaccucucacccaagaggagaucgcucagcggcgcgaaagagcccggcagcgccaugccgagaagcuggcugccgcgcagggccaagcuccccuugaaccuacacaggacggcuccgccauugagaccugccccaaaggggaagaacccagaggagaugagcagcaggucgaaagcaugaccccuaagccggugcugcaagaggaaaacaaucaggagucuuuuaucgccuucgcucggguuuucuccggcguggccagacgcgggaaaaagauuuuuguccucggacccaaauacagcccucuggaguuccuucggagagugccccugggcuuuucugcuccucccgacgggcucccgcagguuccucacauggccuacugugcgcuggaaaaccuguaucuccugaugggacgcgagcuugaauaccuggaggaagugcccccuggcaauguccucggcaucgggggacugcaggauuucgugcuuaagagcgccacacugugcucccuccccucuuguccucccuuuauuccgcugaacuucgaggcuacgccuaucgugcggguugccgucgagcccaagcaucccagcgaaaugccucaacuggugaaaggcaugaagcuccugaaucaggcugacccgugcgugcagauccuuauucaagagaccggggaacacguccuggugacagccggagagguucaccuccagagaugccuggacgaucugaaagaacgcuuugcgaagauccauauuuccgugagcgagcccaucauuccuuuccgggagaccaucacaaaacccccuaaggucgacauggugaacgaagagaucggcaagcagcagaaaguugccgugauucaccaaaugaaggaagaucagucuaaaauccccgaggggauucaggucgacuccgauggccuuaucaccauuacgacaccuaauaagcucgcuacccugagcgugagagccaugccccugccggaagagguuacccagauccucgaggaaaacucugaccugauccgcuccauggagcaacuuacaagcucccugaaugaaggagagaacacccauaugauucaccagaaaacacaggagaagaucugggaauuuaaaggcaagcucgagcagcaucugacggggcggagauggcgcaauauuguggaucaaaucuggucuuucggaccucggaaguguggccccaacauucuggucaauaaaagcgaagacuuucagaacuccguguggaccgggccugcugauaaggccucuaaagaggccagcagauaucgggaccuuggaaauuccaucgugagcggcuuccagcucgcuacacugucugggcccaugugcgaggagccgcugaugggcgucuguuuuguucucgagaagugggaucuguccaaauucgaggagcaaggagcgagcgaccuugccaaggaaggccaggaggaaaacgagaccugcucugggggaaacgagaaucaggaacugcaggauggcuguuccgaggcuuucgaaaagcgcacaagccaaaaaggggagucuccucucaccgacugcuacggacccuuuagcggccagcugaucgccacgaugaaggaagccuguagauaugcucugcaagugaaaccucagcggcuuauggccgcgauguauaccugcgacauuauggcuacaggggaugugcucggcagagucuacgccgugcuguccaagcgcgagggacggguucugcaagaggaaaugaaagagggcaccgacauguucaucauuaaggccgugcuccccgucgcugaauccuuuggguucgccgaugagaucagaaagcgcacaucuggacuggcgagcccccagcuuguguuuucccacugggagauuaucccuuccgacccguucuggguucccaccacggaagaggaauaccugcacuuuggcgagaaagcugauucugaaaaccaggccagaaaguacaugaaugccgugcggaaacgcaaggggcucuaugucgaggagaaaauuguggaacaugcugagaagcagagaacacugagcaagaacaaauga

SEQ ID NO: 68706 - RNA, 2814 nt, Artificial Sequence
  derived and/or modified sequence opt5 from EFTUD2__Homo_sapiens__NP_001136077
auggacgaugacgaugacgaugacgaugugggcgaccacgaugacgaucaucccgggauggaggucguucugcacgaagacaagaaauacuauccuaccgccgaggaaguguacggaccggagguggaaacaaucguccaggaggaggauacgcaaccccucaccgaaccuauuaucaagcccgugaaaacaaagaaauucacccugauggagcagacacuuccuguuaccguguaugaaauggacuuucuggcugaccucauggauaacagcgagcugauuagaaaugucacacuuugcggccaucugcaccaugggaagaccuguuucguggacugccucaucgagcagacgcaccccgaaauucggaagcgcuacgaucaggaccuguguuauaccgauauccuguuuacagagcaagaaagaggaguuggcaucaaauccaccccugugacagucgugcucccggacaccaaggggaaaucuuaccuguucaacauuauggauacgcccggacacgugaauuuuagcgacgaggucacagccggccuucggaucuccgauggcguugugcuguucauugacgcggcugaaggggugaugcucaacaccgagcgccugaucaagcaugccguccaggagagacuugccgugacaguuugcauuaauaaaaucgaucggcugauucucgaacugaagcugccucccaccgacgcuuauuacaagcuccgccacaucguggacgaggucaacggacugaucucuauguacagcaccgaugaaaaucuuauucuguccccucuccugggcaacguguguuuuucuagcucccaguauagcaucugcuucacacuugggucuuuugccaaaauuuacgcugacacguucggagauaucaauuaucaggaguuugccaagagacuguggggcgacauuuacuucaaccccaaaacccggaaguuuaccaaaaaggcgccgacauccagcucucaacgcuccuucguugaguucauccucgagccucuguauaaaauccuggcccagguggucggggauguggacacaagccuccccagaacccuggaugagcuuggcauucaucugacgaaggaagaacucaagcugaauauccggccucuucugcgccucgucuguaaaaaguuuuucggagaauuuacaggcuucguggacaugugcguucagcacauucccucucccaaagugggggcuaagccuaaaaucgagcacaccuacaccggaggcgucgauuccgaccugggggaagccaugagcgauugugacccggauggaccccugaugugccauacaaccaagauguauuccacagacgacggcgugcaguuucacgcuuucgggagaguucucucuggaacgauucaugccggccaaccugugaagguccugggcgagaacuacacccuugaggaugaagaggacagccagaucuguacaguggggcggcuguggaucuccguggcgcgcuaccacauugaaguuaauagaguccccgccggaaacugggugcucaucgagggcguggaucagccuauugucaaaaccgcuacaaucaccgagccccgggggaaugaagaggcccaaauuuuuagaccgcugaaguucaacacgaccagcgugaucaaaauugcuguugaaccugugaaccccucugagcugccuaagaugcuugacggacuccgcaaagucaauaaguccuaucccagccugacaaccaagguggaagagucuggcgagcauguuauccuggggacaggcgaacucuaccuggauugcgugaugcacgaccuucggaaaauguauagcgagaucgauauuaaggucgccgacccugugguuaccuuuugcgaaacgguggucgagacauccucucugaaauguuucgccgaaacccccaacaagaaaaauaagaucacaaugauugcugagccgcucgagaagggacuggcggaagauaucgagaacgaaguggugcagauuaccuggaaucgcaaaaagcugggcgaguuuuuccagaccaaauacgacugggaucuucucgccgcuagaagcaucugggccuuugggccugacgccacaggacccaacauccuggucgaugacacgcugcccuccgaaguugacaaggcucuccugggcagcgugaaagauucuauugugcagggguuccaauggggaacccgggagggcccucuuugcgacgagcugaucagaaaugucaaguucaaaauucucgaugccgugguugcgcaggaaccgcugcaccgcgggggcggacagaucauucccacagcucggagaguggucuauuccgccuuucugauggccaccccucgccuuauggagcccuacuauuucguggaaguucaggcuccugccgacugugugagcgcugucuacacagugcucgcccggagacgcggccauguuacccaagaugcgcccaucccugggucuccccuguacacgaucaaggccuuuauuccggcuaucgacuccuucggauuugagacagaucugcggacccacacccagggccaggccuucagccucuccguguuucaucacuggcagauugucccuggggacccccuggauaagucuaucgugauuagaccucuugagccccaaccggcuccucaccuggcccgggaguucaugaucaaaacacgcagacggaagggacucagcgaagacguguccaucucuaaauuuuucgaugaccccaugcugcuggaacuugcgaagcaggacgucguucucaacuauccuauguga

SEQ ID NO: 68707 - RNA, 3501 nt, Artificial Sequence
  derived and/or modified sequence opt5 from EGF__Homo_sapiens__NP_001171601
augcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgacgcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcgggugcagcuccccugauaauggaggcuguagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacuccacacccccuccccaucucagagaagaugaccaccauuauagcguccgcaacucugauuccgaguguccucugagccacgacggauacugccugcaugauggcguguguauguauaucgaggcccuugacaaguacgcuugcaauugcguugugggcuacauuggggaaagaugucaguaucgggaucucaaauggugggagcugcgccacgccggacacggccagcaacagaaggucaucgugguugcugugugcgucgugguucuggugaugcuccugcuucugucccucuggggagcccauuacuauagaacccagaaacugcugagcaagaaccccaaaaauccuuacgaagagucuagccgggacguccgcuccagacggcccgccgauacagaagacgggaugucuagcuguccgcagccuugguucguggugauuaaggagcaccaagaccuuaagaacggcgggcagcccgucgcuggagaggauggccaggcggccgacggcuccaugcagccuaccucuuggcgccaagaaccccagcugugcgggaugggaacggagcagggcuguuggaucccgguuagcuccgauaaagggucuugcccucaggugauggaaagaucuuuucauaugcccuccuauggaacccaaacacucgagggcgggguggagaagccucacagccugcucucugcuaauccccuguggcagcagcgggcccuugaucccccucaucaaauggaacugacccaguga

SEQ ID NO: 68708 - RNA, 1665 nt, Artificial Sequence
  derived and/or modified sequence opt5 from EGFL6__Homo_sapiens__NP_001161362
augccccugccuuggagccucgcccugccgcuucugcucuccuggguggcuggcggguucggaaacgccgcgucugcuagacaccauggccugcuugccagcgcccggcagcccggggucugccacuacggaaccaagcuggcuuguugcuauggcuggcgcagaaauuccaaagggguuugugaggccacaugcgaaccuggauguaaguuuggcgagugcgugggccccaacaaaugucggugcuucccuggguacacgggaaagaccuguucucaagacgugaaugaaugcggcaugaaaccccgcccuugucagcauagaugcgucaacacacacgggagcuauaagugcuuuugucucuccggacauaugcugaugccggaugcuaccugcguuaauucucggacaugugccaugaucaacugccaguacagcugugaggacaccgaagagggcccccagugccuguguccuuccagcgggcuccgccuggcgcccaauggaagagauugccuugacauugaugagugugccucuggcaaggugaucugcccuuauaaccggcgcugugugaauacauucggcuccuacuauugcaaaugccacauuggguuugaacugcaauacaucagcggaagauacgacuguauugauaucaacgagugcaccauggacucucacacguguucccaucacgcuaauugcuucaacacccagggcagcuuuaaguguaaaugcaagcagggguauaaaggaaauggccuccgguguucugccauccccgaaaacuccgucaaggaggugcugcgcgcuccggggacaauuaaggauagaaucaaaaagcugcuugcccauaaaaauagcaugaagaaaaaggcgaaaauuaagaacguuaccccugagcccacacggaccccuacgcccaaggugaaccuccagcccuucaauuacgaagagaucgucucccgcggaggcaacucucacggcgggaaaaagggaaaugaagagaaaaugaaggaaggccuggaggacgagaaaagagaagagaaggcccugaagaacgauauugaggaacggagccucagaggggacguguuuuucccuaaagugaaugaagcuggagaguuuggccugauccuuguccaacgcaaggcccugacauccaaacucgagcacaaggcugaucugaacauuagcguugacugcucuuucaaucaugggaucugugacuggaaacaggaucgggaagacgauuuugacuggaacccggccgauagagacaaugccaucggcuucuauauggcugugcccgcgcuugccggacacaagaaggauauuggccgccugaaacuccugcugccugaccuccagccccaguccaacuucugccugcuuuuugauuaccggcuggcuggggacaaggugggaaaacucagagucuucgugaagaauagcaacaaugcccuggccugggagaaaaccacaucugaagaugagaaguggaagaccggcaaaauccaacuuuaucaggggaccgacgcuacaaagagcauuaucuuugaagccgagcgcggaaaaggcaagacgggggagauugcgguugacggcgugcugcucgucuccggacuguguccugauucucugcucagcguggacgauuga

SEQ ID NO: 68709 - RNA, 822 nt, Artificial Sequence
  derived and/or modified sequence opt5 from EGFL7__Homo_sapiens__XP_011517068
augagaggcagccaggaggugcugcucauguggcugcuuguccuggccguugggggaaccgaacacgcuuaccggcccggccgcagagugugcgccgugcgggcgcauggggacccugucuccgagucuuucgugcaacgcguuuaucagccguuucucacaacgugugauggacacagagcuugcagcaccuaccggacaaucuaucgcaccgccuacagacggucccccggccuggccccugcucgccccagauaugccuguugcccuggguggaagcggacaucuggacuucccggcgcuuguggcgccgcgauuugccagccuccgugucgcaacgggggaagcugcgugcagcccggcagaugucggugcccugccggguggcgcggagacaccugucaauccgaugucgacgaaugcucugcuagacggggcgggugcccccagagaugugugaauacagccggaagcuacuggugccaguguugggagggccauucccugagcgcugauggcacccucugcguuccuaaagggggacccccgcgcguggccccuaaccccacgggcgucgacucugcgaugaaggaagaggugcagcggcugcaauccagaguggaucugcucgaggaaaaacugcagcuuguccuggccccucuccacagccuggcuucucaggcccuugagcaugggcugcccgaccccggaucccuccugguucacagcuuccagcaacugggccgcaucgauucucucuccgaacagauuagcuuucuggaggagcagcuuggguccuguucuugcaagaaagacagcuga

SEQ ID NO: 68710 - RNA, 882 nt, Artificial Sequence
  derived and/or modified sequence opt5 from EGFL8__Homo_sapiens__NP_085155
augggcagcagagccgagcugugcacccuccuugggggauucuccuuucugcugcuccugauccccggcgaaggggcuaagggaggcucucuucgggagagccaggggguguguuccaaacaaacacuggucguuccucuccacuacaacgaaucuuauagccagccgguguacaagcccuaucugacgcugugcgccggacgcagaauuuguuccaccuaccggacaauguaucgcgugauguggagagagguccggcgcgaagugcagcagacccaugcgguuugcugucaaggcuggaaaaagagacacccuggcgcucucacaugcgaggccaucugugccaaacccugccugaaugggggaguguguguccggccugaccagugcgagugugcucccggcuggggagggaagcauugccacguggauguugacgaaugccgcaccucuauuacacuuuguagccaucacugcuucaacaccgccggcuccuuuacgugugggugcccucacgaucuggugcucggagucgacggcagaaccuguauggagggcagcccggaacccccuacaucugcuuccauccugagcguggccgugcgggaggcggagaaggaugaacgcgcccuuaaacaggagauucaugaacugagagggcggcucgagcgccuggaacagugggcuggacaagccggcgcuugggucagagccguucugcccgugccucccgaggagcuccagccggaacagguggcggagcugugggggcggggagacagaaucgaaucucuuuccgaucagguccugcuccuggaggaacgccuuggcgccugcagcugugaggacaauucucuggggcucggagugaaccaccgguga

SEQ ID NO: 68711 - RNA, 3054 nt, Artificial Sequence
  derived and/or modified sequence opt5 from EGFLAM__Homo_sapiens__NP_001192230
auggaccugaucagaggcgugcuccugcggcuucugcuccuggccagcucccuugggcccggagcugucucucugcgcgccgcgauuagaaagccuggcaaaguugggccgccccucgauaucaagcugggagcucugaacugcaccgccuucagcauucaguggaaaaugccucggcaccccggcuccccuauccucggguacacaguguuuuauucugaggugggagccgacaagagccugcaagaacagcuucauuccgucccccugucucgcgauauuccuacgaccgaggaagugaucggcgaccucaaaccgggcacagaguacagaguuagcaucgcugccuauucccaggcugggaagggacggcugagcucuccccgccacgugaccacacuuucccaggauagcugucugccucccgccgcgccucaacagccccaugucauugugguuucugacuccgaaguggcccucagcuggaagccgggcgcuucugagggguccgccccuauccaguacuauagcgucgaguucauuagacccgauuuugacaaaaaguggaccuccauccacgaacggauucagauggauucuauggugaucaaaggacuggacccugauacaaacuaccaauucgcugugcgcgccaugaacagccauggccccucccccagaagcuggccuucugacauuauccggacccugugcccggaggaagcgggguccggacgcuauggccccagauacaucacggauaugggcgccggggaggacgacgagggauuugaagaugaccucgaucuggacauuagcuucgaggaagucaagccucuucccgcuaccaaaggcgggaauaagaaguuucugguugagucuaaaaagaugagcaucuccaacccuaaaacaauuucucggcucauucccccgaccagcgccucccugccugugacaaccguggcuccccagccuauccccauccagcgcaaggggaaaaauggcgucgccaucaugagcagacuuuucgauaugccuugugacgaaacgcugugcucugccgauuccuuuugugugaacgacuacacauggggaggaagccggugccaguguacccucggcaagggcggggagucuugcuccgaggauauuguuauccaauauccccaguucuuuggacacagcuacgugacauucgaaccgcugaaaaauuccuaucaggcuuuucaaauuacccuggaguucagagcggaagccgaggacggccuccugcuuuacuguggggaaaacgagcacggacgcggcgauuucaugucucuggcuaucauucggagaagccuccaguuucgcuucaauugcgggaccggcgucgccaucaucguguccgagacaaagauuaagcugggaggcuggcauacgguuaugcuuuaucgggacgggcugaacggacuccugcagcugaauaacggcaccccugugacagggcagucucaaggacaguacagcaaaaucaccuuuagaacaccccucuaucugggcggggcccccuccgcuuacuggcuuguccgcgccaccggcacgaaucggggauuccagggcugugugcagagccuggcggucaacgggagacgcauugacaugcggccuuggccgcucggaaaggcucugucuggcgccgaugugggggaaugcuccagcggaaucugcgacgaggccucuuguauucacggcgggacaugcaccgcuaucaaagccgauuccuacauuugucugugcccccuuggcuuuaagggaagacauugugaagacgcuuucacccucacaaucccucaauuucgcgagagccugcggucuuaugccgcgacccccuggccucuggaaccccagcacuaccucagcuucauggaguuugagaucacauucagaccugauuccggcgacgggguucugcuuuauagcuacgauacgggaucuaaagacuuucuguccauuaaucucgccggcgggcacguggaguuccgguuugauugcggaagcggcaccgggguccugcgcuccgaggacccccugacacuuggcaacuggcaugaacucagagugucucggaccgcuaagaacggaauccugcagguugauaagcagaaaauuguggagggcauggccgaagggggauucacacaaaucaaguguaauaccgacauuuucaucggcggggucccgaacuaugaugacgugaaaaagaauagcggagugcugaaaccuuuuuccggcucuauccagaagauuauccucaacgacagaacgauucacguuaagcaugauuucaccagcggcgucaauguggaaaacgcugcccaccccugcgugcgcgcgccuugugcccaugggggauccugccggcccagaaaagagggcuacgacugugauugcccgcugggguuugaaggacuucacugccagaaggaguguggcaauuauugccugaacacaaucauugaagcuaucgagaucccucaguucauugggcgcucuuaccucaccuacgacaaucccgauauccugaaaagagucagcggaucccggagcaacguguuuaugcgcuucaagacaaccgccaaagacggccugcuucucuggagaggcgauucuccuaugcggcccaauuccgacuuuauuagccuggggcugcgcgauggagcucucguuuucucuuauaaccugggcuccgggguggccagcaucauggucaauggaucuuuuaacgacggcagauggcaccgggugaaggccguucgcgaugggcaauccggaaagauuacgguggacgauuacggcgcuagaacaggcaaaagccccgggaugaugcggcagcuuaauaucaacggagcgcuguaugucggcgggaugaaggagaucgcccuccauaccaaccgccaguacaugagaggacuggugggcuguauuucccacuucacacugagcaccgacuaucauaucucucuuguugaagacgcuguggaugggaaaaauauuaauaccugcggagccaaguga

SEQ ID NO: 68712 - RNA, 3633 nt, Artificial Sequence
  derived and/or modified sequence opt5 from EGFR__Homo_sapiens__NP_005219
augagacccagcggcaccgccggggcugcccugcucgcgcugcuugcugcccugugcccugccucccgggcucucgaggaaaagaaagugugucagggaacaucuaacaagcugacgcaacuuggcaccuucgaggaccacuuucugagccuccagcgcauguucaauaacugcgaagucguucuggggaaucuggagaucacauacgugcagagaaacuaugaucucuccuuucugaaaaccauucaggaaguggccggauacguccuuaucgcucugaauacaguggagcggauuccgcucgagaaccugcaaaucauucgcggcaauauguauuacgaaaacucuuaugcccuugcgguucugagcaauuacgacgccaacaagaccgggcucaaagagcugcccaugagaaaucugcaggaaauccuccauggagcugugcgguucuccaacaauccugcccuguguaacgucgagucuauccaguggcgcgauauugugagcuccgacuuucuuagcaauaugucuauggauuuccagaaccaccugggcuccugccaaaagugugaccccagcugcccuaacggcucuuguuggggagcuggggaggaaaauugccagaagcucacaaaaaucauuugugcccagcagugcuccggcagaugucggggaaagagccccucugauugcugccauaaccaaugugcggccgggugcaccggcccucgcgaguccgacugucugguuugcagaaaauuucgggaugaagcuacguguaaggauaccugcccgccccuuaugcuguauaauccuacaaccuaccagauggacgugaaccccgaggggaaauacagcuucggagccacaugugucaagaagugcccucgcaauuauguggugaccgaccacggcuccugugucagagcuugcggcgccgauucuuacgaaauggaggaggacgggguucggaaauguaagaaaugcgaaggacccugccgcaagguguguaacggcaucgggauuggagaguuuaaagacagccucuccaucaaugccacgaacauuaagcauuucaaaaauugcacaagcaucucuggcgaucugcacauccugccgguggcuuuuagaggggacuccuucacccacacaccuccccucgauccucaggaacuggacauucuuaagaccgucaaggagaucaccggauuucugcucauucaagcguggcccgaaaaccggacagaucugcaugccuucgagaaucuugagaucauuagaggccgcacgaaacagcacggccaguucagccuggcugugguuucucucaacaucaccagccuggggcugcggucccucaaggaaaucucugacggagaugugauuaucagcggcaauaaaaaccuguguuaugccaauacaauuaacuggaagaaacuuuuugggaccuccggacagaagacaaagaucauuagcaacagaggcgaaaauucuugcaaagccaccgggcaagucugucaugcucugugcucccccgaaggcuguuggggaccugagccgcgcgacugcgugagcugucggaacguuucuagaggccgcgaaugcguggauaaguguaaucuccuggagggggagccccgggaguucgucgagaacuccgaaugcauccagugccacccugagugucugccccaggccaugaauaucacgugcacaggaagaggcccugacaacuguauucagugcgcgcacuacaucgaugggccccauugugugaaaaccugcccggcuggagucaugggcgagaauaacacccuuguguggaaguaugccgacgccgggcacguuugucaucucugccacccuaauuguacauacggcugcaccggacccggccuggaaggguguccuacaaacggacccaaaauuccuagcaucgcuacgggcauggugggggcccugcuccugcuucuggucguggcucucggaauuggccuguuuaugcgccggagacauaucguucgcaagcggacccugagacggcuucuccaagagcgcgaacugguggagccccugacaccguccggggaagccccuaaucaggcgcuccugcggauucuuaaggagaccgaguucaaaaagaucaaaguccugggcucuggagccuuuggcacaguguauaaggggcucuggauccccgaaggagagaaagugaagauucccguugcuaucaaggaacugagagaggccaccagcccuaaagcuaacaaggaaauucuggacgaggccuacgucauggcguccguggauaauccgcacgugugcagacuucucggcaucugccugacgucuaccguccagcugauuacacagcucaugcccuucgggugucugcuugacuacgugcgcgagcacaaagauaacaucggaagccaauaucugcucaauuggugcguucagaucgccaagggcaugaacuaccuggaagaccggagacuggugcaucgcgaucuugcugccagaaacguccucgugaaaaccccucagcacguuaagauuacagacuuugggcuggcuaaacugcucggcgccgaggaaaaggaguaucaugccgaaggaggcaaggugcccaucaaauggauggcucuggaguccauucuucaccggaucuacacccaccagagcgaugucuggucuuauggggugacgguuugggagcugaugacauucggauccaagccuuacgacggcauucccgcgagcgaaaucucuuccauccucgagaaaggggaacgccugccucaacccccgauuuguaccaucgauguguauaugauuauggucaagugcuggaugaucgacgccgauagcagaccuaaauuucgggagcugauuaucgaguucucuaagauggcucgcgacccccagagauaccuugugauccagggagaugaacggaugcaucugccuagccccacagacuccaauuuuuaccgcgcccucauggacgaggaagauauggacgauguggucgacgccgaugaguaucugauuccgcaacagggcuucuuuagcucuccuuccaccagcagaacaccccuccuguccucucuuagcgcuaccuccaacaauucuacgguugccuguaucgaccggaacggccugcagagcugcccuauuaaggaagauuccuuccuccagcgcuacucuagcgaccccaccggggcgcugacagaggauuccaucgacgauaccuuccugcccgugccugaguauauuaaucaaagcgugccgaaaagacccgcuggaucuguccagaacccuguguaccacaaucagccccuuaacccugcccccucccgggacccucauuaucaggauccgcacagcacagccguuggcaaucccgaauaccugaacaccgugcaaccuacgugugucaauucuacauuugacucccccgcucauugggcccagaaggggagccaccagaucucucucgacaacccugauuaucagcaagacuucuuucccaaagaggcgaagccgaauggaauuuucaaaggcuccaccgcugaaaacgccgaguaccugagaguggccccucagagcuccgaauuuaucggggcuuga

SEQ ID NO: 68713 - RNA, 1281 nt, Artificial Sequence
  derived and/or modified sequence opt5 from EGLN1__Homo_sapiens__NP_071334
auggccaacgacagcggcgggcccggaggcccuuccccgucugagagagaucggcaguacugcgaacugugugggaagauggagaaucuccugcgcugcagcagaugucgguccucuuucuauugcuguaaagaacaccaacgccaggacuggaagaaacauaaacuugugugccagggaagcgagggcgcucuggggcacggagucggcccccaucagcacuccggcccugcgcccccugccgcuguucccccuccgagagccggggcccgggaaccccgcaaggcugccgcuagacgggauaacgccucuggagacgcggccaagggcaaggugaaagcuaagccucccgccgauccugcugccgcggccagccccugucgcgcugccgcugggggacaaggcuccgccguggccgcugaggcggagccggggaaagaggaaccucccgccagaagcucucucuuucaggaaaaggcuaaucuguacccucccuccaacacccccggagacgcccuuagcccuggcggcgggcugcggccgaauggacagacaaaaccccucccugcccugaagcuggcucucgaguauaucguccccugcaugaacaagcauggcauuugugugguugaugacuuccuggggaaagagacgggacagcaaaucggcgaugaagugcgcgcccuucacgacaccgggaaguuuacagauggacagcuggucucucagaaauccgacagcucuaaggauauuagaggcgacaaaaucaccuggauugagggcaaggaaccugggugcgagacaaucggacuccugauguccagcauggacgaucuuauccggcacuguaauggcaaacugggguccuacaagauuaacggacgcaccaaggcgaugguggcuugcuaucccggcaaugggacaggcuacguuagacauguggacaacccgaauggagauggccggugcgucaccuguaucuauuaccucaacaaagacugggaugccaaggugucugggggcauucugagaaucuucccugaaggaaaagcccaguuugcugacauugagcccaaguucgaucgccugcucuuuuucuggagcgaccggagaaauccucacgaggugcaacccgccuacgcuacgcgcuaugccaucaccgucugguacuuugaugcggacgaacgggccagagcuaaaguuaaguaucugacaggggagaagggagugcgcguggaacuuaacaaaccuuccgauagcgucggcaaggacguguucuga

SEQ ID NO: 68714 - RNA, 1224 nt, Artificial Sequence
  derived and/or modified sequence opt5 from EGLN2__Homo_sapiens__NP_444274
auggacagccccugccagccucaaccgcugucccaggcccucccccagcugccuggcucuagcuccgagccccuugaaccugagcccgggagagcucggaugggaguggaaucuuaccugccuuguccgcuccugcccagcuaucacugcccuggcguccccuccgaggccucugcggggagcggaaccccucgcgcuacagccacguccaccacagccagcccccuuagagauggcuucgggggacaggacggcggcgaacugcggccgcuccaaucugagggggcugccgcucugguuaccaagggaugucagcgccuggccgcgcagggcgccagaccugaggcucccaaacggaagugggccgaagaugggggagacgcuccuucccccagcaaacgccccugggccagacaggagaaccaagaagcggagcgggagggcgggaugucuugcuccuguagcucuggauccggcgaagccagcgcuggccucauggaggaagcccugccuuccgcuccggagcgccuugcccuggauuacaucgugcccugcaugagauauuacgggauuugugugaaggacucuuuucucggagccgcucugggcgggcggguccuugcggaaguggaggcccugaaacgcggaggcagacuccgggaugggcagcugguuagccagcgcgcuaucccucccagauccauucggggagaccagaucgccuggguggagggccaugaaccuggcugcagaagcauuggggcccugauggcucacgucgaugccgugauccgccauugugcgggacggcucggcucuuauguuaucaaugggagaacaaaggcuaugguggccugcuaccccggaaacggccugggguauguccgccacguggacaauccgcauggcgauggacgguguauuaccugcaucuacuaccuuaaccaaaauugggacgugaagguccacggcgggcugcuccagauuuucccugagggaagacccguuguggccaacaucgaaccucuguuugaucgccuucugauuuucugguccgaccggagaaauccccacgaggugaaaccugcuuaugccacacgcuacgcuaucaccgucugguauuuugacgccaaggaacgggcggccgcuaaagauaaguaccagcucgccagcggccaaaaaggggugcagguucccgugucucagccgccuacgcccaccuga

SEQ ID NO: 68715 - RNA, 720 nt, Artificial Sequence
  derived and/or modified sequence opt5 from EGLN3__Homo_sapiens__NP_071356
augccccugggccacaucaugagacucgaccuggagaagauugcccuugaauacaucgugccuugccugcaugaggucggguucuguuaucucgauaacuuucugggagaaguugugggcgacugcgugcuugagcgggucaaacagcugcacuguaccggggcucuccgcgauggacaacuggccggcccgagagcgggggugagcaagcggcaucugcgcggagaccagauuacauggaucggcggcaaugaagaggggugcgaggcuauuuccuuccuccugucucuuaucgauagacugguucucuacuguggaagccggcugggcaaauauuacgugaaggaacgcuccaaagccauggucgccugcuaucccgggaacggaacgggcuacgugagacacguugacaauccuaacggggauggacgguguauuaccugcaucuauuaccuuaauaagaacugggacgcuaagcugcauggcggcauccuccgcauuuuucccgaggggaaaucuuucaucgccgauguggaaccuauuuuugacagacugcuguucuuuuggagcgaucggcgcaauccccacgagguccagccuuccuacgcuacaagauaugccaugaccgugugguacuucgacgcggaggaacgggccgaggcuaagaaaaaguuucgcaaccucacaagaaaaaccgaaucugcccugacagaggauuga

SEQ ID NO: 68716 - RNA, 1632 nt, Artificial Sequence
  derived and/or modified sequence opt5 from EGR1__Homo_sapiens__NP_001955
auggccgcugccaaggcggagaugcagcugaugagcccccuccaaaucuccgacccuuucggcucuuuuccgcacagccccaccauggauaacuacccuaaacuggaagagaugaugcuucuguccaauggggcuccccaguuccucggagccgccggcgcuccugaagggucuggaagcaacuccucuagcuccagcucuggcgggggaggcggcgggggaggcggguccaauagcagcuccucuucuuccacauuuaacccccaggccgacacgggagagcagccuuaugaacaucugaccgcugagagcuucccggauauuucccuuaauaacgagaaggugcuggucgaaacaucuuaccccagccaaaccacaagacucccucccaucaccuauacaggccgguuuucccuggagccugcccccaauagcgggaacacccuguggccggaaccucucuucucucugguuuccggacuugugagcaugacgaaucccccugcgucuagcuccucugcccccagccccgcugccuccagcgcuucugccucccagagcccuccgcugucuugcgcggugcccuccaacgacagcuccccuauuuacucugccgcucccaccuuuccuacacccaauaccgauaucuucccggagccucagagccaggccuuucccggcuccgcuggcacagcccuccaauauccucccccugccuaccccgcugcgaaagggggauuccaggucccgaugauuccugacuaucuguuuccccagcagcaaggcgaucuugggcugggaacccccgaccagaagccuuuccagggccucgagucucgcacgcaacagccgagccugacaccccuguccaccaucaaagccuuugcuacacagagcgggucucaggaucucaaggcccugaacaccuccuaccaaagccagcuuaucaagccuucuagaaugcggaaauaccccaaucgcccuuccaagacacccccucacgaaagacccuaugccuguccgguggagagcugcgaccggcgcuucucuagaagcgaugaacugacccggcauauucgcauccacacgggacagaaaccuuuccaguguagaauuugcaugcggaacuuuucccgcagcgaccaucucaccacacacaucagaacccacacaggcgagaagcccuucgcuugugauauuugcggccggaaauuugcccgcucugacgaaagaaagcggcauaccaagauccaccugagacaaaaagacaagaaagcggauaaguccguuguggcuagcuccgccacgucuagccuuuccucuuacccuagccccgucgccacauccuauccgucuccugugaccaccagcuaccccuccccugcuacaaccagcuaucccucucccguuccuacauccuucagcucuccgggguccagcacguaccccucuccugugcauuccggauuucccagcccuuccgucgccaccacauauagcucugugcccccugcuuucccggcccaggugagcuccuuucccucuagcgcggucaccaauuccuucucugccagcacaggccuguccgacaugaccgcuacguuuucuccucgcaccauugagaucuguuga

SEQ ID NO: 68717 - RNA, 1431 nt, Artificial Sequence
  derived and/or modified sequence opt5 from EGR2__Homo_sapiens__NP_001129650
augaugaccgccaaggcuguggacaaaauccccgucacacugagcggcuucguucaccagcucuccgauaacauuuacccuguggaggaccuggccgcgacgucugugaccaucuuuccgaaugcugaacuugggggacccuucgaucaaaugaacggcgucgccggggacggaaugauuaauaucgauaugacaggcgagaagagaagccuggaccucccuuaucccuccucuuuugccccugugagcgcuccccggaaccagaccuucacauacauggggaaauuuuccauugauccucaguauccgggagccucuugcuaccccgaaggcaucaucaauauuguuagcgcuggcauccugcagggggugaccuccccugccagcacaaccgcgucuuccagcgucacgucugccucccccaacccucuugcuaccggaccccugggcguguguacaaugagccaaacccagccggaccucgaucaucuguauucuccucccccucccccucccccguacuccgggugcgccggagaccuguaucaggaucccagcgcuuuccucuccgccgcgacaaccucuacgagcuccagccuggccuacccucccccucccucuuacccguccccuaagcccgcuacagacccuggccuuuuucccaugauuccugauuaucccggguucuuuccgagccagugucaacgcgaccugcacggaaccgccggcccugacagaaaacccuuccccugcccucucgauacacugcggguuccgcccccucuuacaccccugucuaccauccgcaauuuuacccucggcgggccuagcgcuggagugacgggccccggggccuccggaggcucugaggggccuagacugcccggaagcuccagcgccgcugcggccgcugccgccgcugccgcguacaacccgcaucaucugccucuccggcccauucugcgcccuagaaaguaucccaaucggccgucuaagaccccuguccacgaacgccccuacccuugucccgcugagggcugcgacagacgguucucccgcagcgaugagcuuacaagacacauccggauucacaccggccauaaacccuuucagugucgcaucugcaugagaaacuucucucgguccgaccaccugacaacccauaucagaacgcacacaggggaaaagccuuucgccugugauuauugcggacgcaaauuugcccggagcgacgagagaaagcgccacaccaaaauucaucuccggcagaaggaaagaaaguccucugcuccgagcgccuccgugcccgcuccuucuaccgccagcuguuccggcggggugcagcccggaggcacacugugcagcucuaauuccagcucucuugggggcggaccucuggcgcccugcuccagccgcacccggacaccuuga

SEQ ID NO: 68718 - RNA, 1002 nt, Artificial Sequence
  derived and/or modified sequence opt5 from EGR3__Homo_sapiens__NP_001186810
auggacaucggccugaccaacgagaagcccaauccugaacucagcuacuccgggucuuuccagccggcccccggaaacaaaacagugacguaucugggcaaguuugcuuucgauagcccuuccaauuggugccaagacaacauuaucucucuuaugagcgccgggauucugggaguucccccugcguccggcgcucucucuacccagacaagcaccgccuccaugguccagcccccucagggggauguggaggccauguacccggcucugcccccuuauagcaauuguggagaccuuuacucugaacccguguccuuucacgauccucaaggcaaccccggccuggccuauagcccgcaggacuaccagucugcuaaaccugcccucgauuccaaucuguuccccaugaucccugacuauaaccuguaccaucaccccaaugauauggggagcauucccgagcauaagccuuuucagggaauggacccgaucagagucaaucccccucccaucacaccucucgaaaccauuaaagcguucaaggauaagcaaauccaccccggcuuugggucucugccgcagccuccccuuacacugaaaccuauucggccccgcaaguacccuaacagacccuccaaaaccccgcuccaugagcggccucacgccugccccgcugagggaugugaccgcagauucagccgguccgaugaacugacgcgccaccuuagaauccauaccggccacaagcccuuucagugccggauuuguaugcgcucuuucagcagauccgaccaucugacaacccacauccggacacacaccggggagaaaccuuuugccugcgaguucuguggacgcaaguuugcuagaagcgacgaacggaagcgccaugccaaaauucaccucaagcagaaagagaagaaagcggaaaagggcggcgccccgucugcuuccagcgcucccccugugucucuggcccccguugugacgacaugcgccuga

SEQ ID NO: 68719 - RNA, 1770 nt, Artificial Sequence
  derived and/or modified sequence opt5 from EGR4__Homo_sapiens__NP_001956
auggccguggcuagaggcgucgggagccccgagccugccccgccccagcuguacaaguggggaggcugcgggcucggagaaccuggcuccgcgcuggagcggcgcggggcugccgccagaggacgguguggccgcgcuagagcuccccggcuuccugacucuuucccccgcggcgaaugcccuaaaccgggggccagagcgccccggagcguucgcuguggagagccucugcccccugccucucccccgccugccagaccccaagcucagcgggcccgcccuagagcuccccacucccggcgcagagccaugcuccaucugagcgaauuuuccgagcccgaugcgcuucuggugaagucuaccgagggcugcugugccgaaccuagcgcugagcucccgcggcugcccgccagagacgcuccugccgccacaggguaucccggagcuggcgauuuccuguccugggcgcucaacagcugcggggccucuggagaccuggcugauuccuguuuucuugaaggcccugcccccacgccgccucccggccugagcuacucuggguccuucuuuauccaggccgugccugagcacccccaugacccugaggcucucuucaaucugaugagcggcauucuuggccuggcccccuuuccggggccugaagcggcugccucucgcagcccccucgaugcccccuucccugcuggauccgacgcccugcugccgggacccccugaucucuauucccccgaccugggggcugccccuuuucccgaggcguucugggaagccucuccuugcgcuggagcccccagccagugucuuuacgagccgcaacuguccccucccgaugucaaaccuggccuccgggcucccccggccagcccugcgcuggacgccgugucugcuuuuaagggccccuaugccccuugggaacuucuguccguuggggcucccggaaacugcggcagccagggggauuaccaggccgcccccgaggcuagauucccugugaucggaaccaaaauugaggaccuccugucuaucagcuguccggcggaacugcccgccgucccugcuaaucgccucuaucccuccggcgccuacgacgccuuuccucuggcucccggggaucuuggcgagggagccgaaggccugccugggcuccugacaccgcccucuggagagggcgggagcuccggagacggcggggaguuccuugcgagcacccagccucaacugucuccccucggccugcgguccgcugccgccgcugauuucccuaagccccugguggccgacauuccgggaagcucuggcguugcggcuccucccgugcccccucccccuccgacacccuuuccucaggccaaggccagacgcaaagggcggagaggaggcaagugcuccacccgcugcuucuguccccggccucacgcuaaagccuuugcuugccccgucgaaagcugugugagauccuucgcccgcucugaugagcucaaccggcaucugagaauccacacagggcacaagccguuucagugccggaucugucuucgcaauuucagcagauccgaccaucugaccacgcacgugcggacccauacaggagaaaaaccuuuugcgugcgaugucuguggcagacgcuucgcccggucugacgagaagaagagacacagcaaaguucaccucaagcagaaagcucgcgccgaagagagacugaaggggcugggcuuuuacucccuuggacucagcuucgcuucucuguga

SEQ ID NO: 68720 - RNA, 3483 nt, Artificial Sequence
  derived and/or modified sequence opt5 from EHBP1__Homo_sapiens__NP_001136087
auggccagcguguggaagagacugcagcgggucggcaaacacgcuuccaaguuccaauuuguugccucuuaccaggagcucaugguggaaugcaccaaaaaguggcagcccgacaaacugguggucguguggacacgcagaagccggcgcaaguccucuaaggcgcauagcuggcagccugggaucaaaaacccguauagaggaguuguggucuggcccgugccugagaauauugaaaucacgguuacccuuuucaaggauccccacgcugaggaauuugaggacaaagaguggacauucgugauugaaaacgaguccccuucuggccggcgcaaggcccuggccaccagcuccaucaauaugaaacaauacgcuagccccaugccuacacagaccgaugucaagcucaaguuuaaaccgcugucuaagaaagugguguccgccgcccuucaguucagccugucuuguauuuuucucagagaagggaaggccacagacgaggauaugcagucccuggcgagccugaugucuaugaaacaagccgacaucggaaaccucgaugacuucgaggaagauaaugaggacgaugacgaaaaccgggucaaucaggaggaaaaggcugccaaaaucaccgagcugauuaacaaacuuaauuuucuggaugaggcugaaaaggaccucgccacgguuaacuccaaucccuucgacgauccugacgcggccgagcugaaccccuuuggcgauccugacagcgaggagcccaucaccgaaacagcuuccccgcgcaaaaccgaggauucuuucuauaauaacagcuacaauccuuuuaaggaggugcagacaccccaguaucuuaacccuuucgacgaacccgaggccuucgugaccauuaaagauuccccuccccaaagcacgaagagaaagaacauccggccggucgacaugucuaaguaccuguaugcugauuccagcaagacagaagaggaggaacucgacgagucuaaucccuuuuacgaaccuaaaagcacacccccucccaacaaucuggugaacccgguucaggagcuggaaaccgagcgcagagugaagcggaaagccccugcucccccuguccucucccccaagaccggggugcugaaugagaacaccguuucugcuggaaaagaucuuagcacauccccuaagcccagcccgauuccuucucccgugcugggccgcaagcccaaugcgucccagagccuccuggucuggugcaaagaagugacgaagaacuacagaggcgucaaaaucaccaauuucacaaccucuuggcggaacgggcuuuccuuuugugccauucugcaucacuucagaccugaccucaucgacuauaagagccugaauccgcaagauaucaaagagaacaauaagaaggcuuacgacggauuugccuccauuggcaucucucgccugcucgaacccagcgauauggugcugcuugccauuccugacaaacugacaguuaugaccuaucucuaccagauccgggcucauuucuccgggcaggagcugaacgugguccagauugaagaaaauucuagcaaguccacguauaaagugggaaacuacgagacagauaccaacagcucuguugaccaagaaaaguuuuaugccgagcuuuccgaucugaaaagagaacccgagcuccagcagccuaucagcggcgcgguggacuuccugucucaggaugacuccgucuuugugaaugauagcggggugggagaaucugagagcgagcaccaaacccccgacgaucaccuguccccuagcacagcuucucccuacugccgccggaccaaguccgacacagaaccgcagaaaagccagcaguccucuggcagaacgagcggcuccgacgauccugggaucuguucuaacaccgacagcacacaagcccagguucuccugggaaagaagcgccuucugaaagccgagacccucgaacuguccgaucuguacgucucugacaagaaaaaggauaugagcccucccuucauuugcgaggaaacagacgagcagaaacuucagacccucgauaucggcuccaaucuggagaaggaaaagcuggagaacagccggucucucgaauguagauccgaccccgagagcccgauuaaaaagacgucucuguccccuaccagcaaacuuggguauucuuacucccgcgaucuggaccucgcuaagaaaaagcaugccagccugcggcaaacagaguccgaucccgacgcugauagaaccacacugaaucacgccgaccauagcucuaagaucgugcagcaccgccuucucagccggcaggaggaacugaaagaaagagcgcgggugcugcucgagcaagcccgcagagacgcugcccugaaggcuggaaacaaacacaauaccaacacggccacaccuuuuugcaaucggcagcuuuccgaucagcaggacgaagagagacgccggcaacugagagagcgcgcgagacagcucauugccgaagcucggucuggcgucaagaugagcgagcugcccuccuauggggaaauggccgcugagaaacugaaggaacgcucuaaggccagcggagagcagaacuccaaacuuguggaucucaagcugaaaaagcugcucgagguucagccccaaguggccaauucuccuagcuccgcugcgcagaaagccgucaccgaaagcucugagcaggacaugaaguccggcacagaagaucugagaaccgagcggcuucagaaaaccacagaacgcuucagaaacccggugguuuuuagcaaggacucuacggugcggaagacccaacugcaguccuucagccaguacaucgagaaucgccccgagaugaaaagacaacgguccauccaggaagauacaaagaaaggcaacgaggaaaaggcugccauuaccgagacacagcgcaaaccuucugaggacgaaguccucaauaagggguucaaggauaccagccaguaugugguuggagagcuggccgcucuggaaaacgagcaaaaacagaucgacacgagagccgcgcuuguggaaaagcggcucagauaccugauggauacaggccgcaacaccgaggaggaagaggcuaugaugcaggaaugguuuaugcuggucaauaaaaagaacgcccucauucggagaaugaaucagcugucccuucuggagaaagaacaugaccucgagcgccgguaugagcugcugaacagagaacuucgcgccaugcuggcuaucgaggacuggcaaaagaccgaagcccagaagcggagagagcagcuccugcucgaugaacugguggcgcuugugaauaaacgcgacgcucugguccgggaucucgacgcccaggagaagcaagccgaggaagaggaugaacaccuggagagaacacuggagcagaacaaagggaagauggcuaaaaaggaagagaaguguguucuucaguga

SEQ ID NO: 68721 - RNA, 1647 nt, Artificial Sequence
  derived and/or modified sequence opt5 from EHD1__Homo_sapiens__NP_001269374
auggagcagcccggcaccgccgcuagcccuguguccgggucuauguucagcugggucuccaaggacgccagacggaaaaaggaaccggagcuguuucaaacaguugcggaaggacuccgccagcuguacgcucagaaacuucugccccucgaggaacacuauagauuccaugaguuucacucuccugcccuggaggaugccgacuucgauaacaagcccauggugcuucuggugggccaguacagcacggggaaaaccacauuuauccggcaucucauugaacaagacuucccuggaaugcgcaucggccccgagccuaccacagauuccuuuauugcugucaugcacgggccgaccgaaggagugguucccggcaaugcccugguggucgacccuagacggcccuuccgcaagcugaacgcuuuuggcaaugccuuccucaacagauuuaugugcgcgcagcugccuaaucccgugcuugauucuaucagcauuaucgacacaccggggauccuguccggagagaagcagcggauuagccgcggcuaugauuucgccgcuguucucgagugguuugccgaaagaguggaccggaucauucugcuuuucgaugcucauaaacuggacaucucugaugaguucuccgaagucauuaaggcccucaaaaaccacgaggacaagauccgcguggugcugaauaaagcggaccagauugaaacccaacagcugaugagagucuacggggcccucauguggagccugggaaagaucaucaacacgccugagguugugcggguguauauuggcucuuuuuggucccacccccuucugaucccugauaaucgcaaacucuucgaggcugaggaacaggaccuguuuaaggauauucagagccuucccagaaacgccgcucugcggaagcucaaugaccugaucaaaagagcccgccuggccaagguccaugcuuacauuaucucuucccucaaaaaggaaaugcccaacguguucgggaaagagagcaagaagaaagaacugguuaauaaccuuggagagaucuaucaaaagauugagcgggaacaccagaucuccccuggcgauuuuccgucucugagaaaaaugcaggagcuccugcaaacccaggacuucagcaaguuucaggcgcuuaaacccaagcugcucgauacaguggacgauaugcuggccaaugacauugcucgccugauggucauggugcggcaggaagagucccucaugccuagccaaguugugaagggcggggccuucgauggaaccaugaacggccccuuugggcauggauacggcgaaggggccggagagggcaucgacgacgucgaguggguggucggcaaagauaagccuacauacgacgaaauuuucuauacccugucucccgugaacgggaaaaucacgggagcuaaugccaagaaagagaugguuaaguccaagcucccgaacacagugcugggcaaaaucuggaagcucgcggaugucgacaaagaugggcugcuggacgaugaagaguuugcucuugccaaucaccucauuaaggugaaacuggagggacacgaacugccugccgaccuucccccucaucugguucccccuagcaagagacgccacgaguga

SEQ ID NO: 68722 - RNA, 1632 nt, Artificial Sequence
  derived and/or modified sequence opt5 from EHD2__Homo_sapiens__NP_055416
auguucagcuggcugaagagaggcggggcccggggacagcaacccgaggcuauccgcaccgugacauccgcccucaaagaacuguacagaacgaaacuucugccucucgaggaacacuaucgguuuggcgcguuccauucuccggcucuggaggacgccgauuuugacgggaagcccaugguccuuguugccggacaguacagcaccggcaagacauccuucauucaguaucugcucgaacaggaggugccugggucucgcgugggacccgagccuaccacagauugcuuugucgcugugaugcacggcgacaccgaaggcacaguucccgggaacgcccugguggucgauccugacaaaccguucagaaagcugaaucccuuuggaaacaccuuccucaaucgguuuaugugugcucaacugccuaaccaggugcuugagagcaucuccauuaucgauacgcccggcauucugucuggggccaagcagcgcguuagcagaggauacgacuucccugcggugcuccggugguuugccgaacgcgucgaucugaucauccuucuguucgacgcucauaaacucgagauuuccgaugaguuuagcgaagccaucggcgcucugagagggcacgaggacaagauucggguggugcugaauaaagccgauauggucgaaacccagcaacucaugcgcguuuauggagcgcugaugugggcccuuggcaagguggugggcacacccgagguccugagaguguacaucgggucuuucuggucccagccgcuccugguuccugacaaccggcgccuuuucgaacuggaggagcaggaccucuuuagagauauucagggacugccccggcaugcugcccugagaaaacucaaugaccuggugaagcgcgcucggcuugucagagugcacgccuauaucauuagcuaccugaagaaagaaaugccuucuguuuucggcaaggagaacaaaaagaaacaacucauccugaaacuucccgugaucuuugccaagauucagcuggaacaccauaucucccccggggauuucccugacugccagaagaugcaagagcuccugauggcucacgauuuuaccaaguuccauagccugaaaccgaagcuccuggaagcgcuugacgagaugcugacacacgauauugccaaacucaugccccugcugcgccaggaggaacuugagucuaccgaagucggagugcagggcggggcuuuugagggaacgcacaugggcccuuucgucgaacggggccccgacgaggccauggaggauggggaagagggauccgacgaugaagccgagugggugguuacaaaggacaaaagcaaguacgacgagaucuuuuauaaucucgcuccugccgauggcaagcuguccgggucuaaagcgaagaccuggauggugggaacaaaacugcccaacagcguccucggcagaauuuggaagcuguccgacguggaucgcgacgggaugcuugaugacgaagaguucgcucuggccagccaucucaucgaagccaaacuggagggccacggacugccggcuaaucuuccucggagacucguucccccuucuaagcgccggcauaagggcuccgccgaauga

SEQ ID NO: 68723 - RNA, 1608 nt, Artificial Sequence
  derived and/or modified sequence opt5 from EHD3__Homo_sapiens__NP_055415
auguucagcuggcugggcaccgacgauagacggcgcaaggaccccgagguguuucagacagucuccgaagggcucaaaaagcuguacaaaucuaaacuucugccucucgaggaacacuauagauuccaugaguuucacagcccggcccuggaagaugcugacuucgauaacaagcccaugguucuucuggugggacaauacuccacgggcaagaccacauuuauccgguaucuccuggagcaggacuucccugggaugcgcauuggacccgagccuaccacagauucuuuuaucgccgugaugcagggcgacauggaagggauuauccccggaaaugcgcuggucguggauccuaagaaaccguucagaaagcucaacgcuuuuggcaaugccuuccugaaccgguuuguuugcgcccagcuucccaauccugugcuggagagcauuuccgucaucgacacccccggcauccucucuggggaaaaacaacgcauuagcagaggauacgauuucgcugccgugcuggagugguuugcugagcggguugaccgcaucauucuucuguucgaugcccauaagcucgacaucuccgacgaguucagcgaagugauuaaagcgcugaagaaccacgaagauaagaugagagucgugcugaauaaagccgaccagaucgagacacagcagcucaugcggguguauggcgcucugauguggucucuugggaagauugucaacaccccugaaguuauccgcguguacaucggauccuuuuggagccauccccugcucauuccggauaauagaaaacuguucgaggccgaggaacaagaccuuuuucgggauauccagucucugccucgcaacgcugcccucagaaagcugaaugaccugauuaaacgggcgagacucgccaaggugcacgcuuauaucauuuccagccugaaaaaggagaugcccucugucuucggcaaggauaacaaaaagaaagaacuugugaauaaccuggccgagaucuacgggcgcaucgaacgggagcaccagauuuccccuggagacuuucccaaucucaagagaaugcaggaucaacugcaggcucaggacuucagcaaauuucaaccccuuaaguccaagcugcucgagguuguggaugacaugcuggcccaugacaucgcccagcugaugguccucgugcgccaggaagagucucagcggccuauucaaaugguuaaaggcggcgcuuucgaagggacgcugcacggaccguuuggccauggguacggagagggcgcgggggaaggaaucgaugacgccgaguggguggucgcuagagauaagcccauguaugacgagauuuucuacacccuuagcccuguggauggcaaaaucacaggcgccaacgccaagaaagaaaugguccgcuccaagcugcccaacagcgugcucgggaagaucuggaaacuggcugacauugauaaggacggaaugcuggaugacgaugaguuugcccuugcgaaucaccucaucaaaguuaagcuggaaggccacgagcugccuaacgagcuccccgcucaucugcuuccgccuucuaaacggaagguggccgaauga

SEQ ID NO: 68724 - RNA, 1626 nt, Artificial Sequence
  derived and/or modified sequence opt5 from EHD4__Homo_sapiens__NP_644670
auguucagcuggaugggcagacaggccgggggacgggagcgcgcuggcggggccgacgcgguccagaccgucacaggaggccugagaucccucuaccugcggaagguucuuccccuggaagaggcuuaucgcuuucacgaguuccauucuccugcccucgaagaugccgacuuugaaaacaaaccgaugauccugcuuguggggcaguacagcacgggaaagaccacauucauuagauaucugcucgagcaggauuuucccggcaugcggaucggcccugagcccaccacagacuccuucauugcugugauguacggggaaaccgagggaucuacaccuggcaaugcccuggucguggaucccaaaaagccuuuucgcaaacugagcagauucgggaacgcuuuucucaaucgguucaugugcucccagcugccgaaccaaguucuuaagucuaucagcgugauugacucccccggaauccugagcggcgaaaagcagcgcaucucuagaggguaugauuuuugucagguccuccagugguucgccgagcggguggaccgcauuauccugcuuuuugaugcgcacaaacuggacauuuccgaugaguucagcgaagccaucaaggcuuucagaggacaagacgauaaaauucggguugugcucaauaaggccgaccaggucgacacccagcagcugaugcgcguguacggcgcucugauguggucucucggcaaagugaucaacacgccugagguccugagaguuuauauuggguccuuuugggcccaaccccuucagaauaccgauaaccggagacuguucgaagcggaggcccaggaccucuuucgcgauauccaaagccugccucagaaggcugccgugcggaagcucaaugaccugaucaaaagagcucgccucgccaaggugcaugccuacauuaucucuuaccugaaaaaggaaaugcccuccgucuucggaaaagagaacaagaaacgggagcugauuagcagacucccggaaaucuauauucagcugcagcgcgaguaccaaaucuccgcuggcgauuuuccugaagugaaggcgaugcaggagcagcuugaaaauuaugacuucacaaaguuucacucucugaaacccaagcucaucgaggccguugauaacaugcugagcaauaaaauuuccccucuuaugaaccugaucagccaggaggaaaccucuacacccacccaacucgugcaagggggagcuuucgacggcacgacagaggggcccuuuaaucagggauacggcgaaggcgccaaggagggggccgaugaagaggagugggucguggcuaaagacaagccuguuuaugaugaacuguucuacacccuguccccgauuaacggaaagaucagcggcgugaacgccaaaaaggagauggucacaucuaaacuccccaauagcgugcuggggaagauuuggaaacuugcggacugcgacugugauggaaugcuggacgaagaggaguuugcucucgccaagcaucugaucaagaucaaacuggauggcuaugaacuuccuuccucucuucccccucaccuggugcccccgagccaccggaagucccugccuaaagccgacuga

SEQ ID NO: 68725 - RNA, 969 nt, Artificial Sequence
  derived and/or modified sequence opt5 from EHF__Homo_sapiens__NP_001193545
augggccugcccgagagacgggggcucgugcugcuucugagccucgccgaaauccuguucaagauuaugauccuugagggaggcggggucaugaaccugaauccuggaaacaaucuccugcaccagccgcccgcuuggaccgacuccuacucuacaugcaacguuagcuccggcuuuuucgggggacaauggcaugaaauucacccucaguauuggacgaaauaccaggugugggaguggcugcagcaucuccuggauaccaaucaacuugacgccaacuguauccccuuucaggaguucgauauuaauggcgaacaccugugcucuaugagccuccaggaguuuacacgcgcggcuggcaccgccgggcagcugcuuuauuccaaccugcaacaucucaaguggaauggacaguguucuagcgaccuguuccaguccacacacaacgugaucgucaaaaccgaacagacagagccuagcaucaugaauaccuggaaggaugaaaacuaccuguaugacacgaauuacggcucuaccguggaucuccuggacuccaaaacauuuugcagagcccaaauuagcaugaccacaaccucucaccuucccguugcugaguccccugauaugaagaaggagcaggacccgcccgccaaaugucauacgaagaaacacaacccucgggggacacaucugugggaguucauccgcgauauucuccugaaucccgacaagaacccuggacuuaucaaaugggaagauagaagcgaaggcguguuucgguuccugaagucugaggcugucgcccagcucugggggaagaaaaagaacaauuccagcaugaccuaugaaaaacugucccgcgcgaugagauacuacuauaagcgggagauucuggagcgcguggacggaagacggcucguuuacaaauuuggcaagaacgcccgcggcuggagagaaaaugagaacuga

SEQ ID NO: 68726 - RNA, 1884 nt, Artificial Sequence
  derived and/or modified sequence opt5 from EHHADH__Homo_sapiens__NP_001159887
auggccuucggcgggggacuggagcucgcucugggcugccacuacagaaucgcccaugcggaagcucagguggggcuucccgaggucacccugggacuccugccuggcgcccgggggacacaacuucugccgcgccucacgggaguucccgccgcucuggaccugauuaccagcggcagacggauccucgccgaugaagcucugaaacuuggcauucuggacaagguggugaacuccgauccugucgaggaagccauccgcuuugcgcagagagugucugaccagccccucgagagccggcgccuguguaauaagccuauucagucccuucccaacauggauucuaucuucagcgaggcccugcucaaaaugagacggcaacacccugggugccuggcucaggaagccuguguucgcgcugugcaggccgcgguccaguauccguacgaggugggaaucaagaaagaagaggagcuguuucucuaucugcuucaauccggccaggccagagcucugcaguacgccuucuuugcugaacggaaggccaauaaguggucuacacccagcggggccuccuggaaaaccgcuagcgcgcgcccuguuucuuccgugggagucgugggccucgggacaaugggaagaggcauugugaucagcuucgcccgggcucgcauucccgucaucgccguugacucugauaagaaccagcuggccaccgcuaauaaaaugauuacauccgugcuugagaaggaagccagcaaaaugcaacagucuggccauccuugguccgggcccaagccgagacugaccagcuccgugaaggagcucggaggcgucgaccuggugaucgaagcgguuuuugaggagaugucucugaaaaagcaaguguucgcugaacucagcgccgucugcaaaccugaggccuuucuguguacgaacaccuccgcucuugauguggacgaaauugccagcucuacagaucggccccaccugguuaucgggacccauuucuuuuccccugcucacgugaugaagcuccuggaggucauccccagccaauauucuagccccacaaccauugccacggugaugaaucuuuccaaaaagaucaaaaagauuggagucgugguuggcaacugcuucggguuugugggaaauagaaugcugaacccuuacuauaaucaggcguacuuccuccuggaagagggcucuaagccggaggaagucgaccaggugcuggaggaguucggcuuuaaaauggggcccuuccgcguuagcgaucucgccggacuggacgugggcuggaagucccggaaagggcagggacuuacaggcccuacccugcuccccgggaccccugcuagaaagcgcggcaaccggagauacugucccaucccggacguccugugcgaacugggacgcuuuggccagaaaacagggaagggaugguaucaguacgauaagccucuuggccggauucacaaacccgacccuuggcucagcaaguuccugucuagauaucgcaaaacccaucacaucgaaccccggacaaucucccaggaugagauucuggagagaugucucuacagccugaucaaugaagccuuucgcauucuuggggagggaaucgcugccucuccugaacauauugacgugguguaucugcacggcuacggguggccccggcacaagggcggaccgauguucuaugcguccacgguuggccucccuaccguccuggagaaacugcagaaguacuacagacaaaaccccgauaucccccagcuugagccuagcgacuaucucaagaaacuggccucccaggggaauccgccccugaaggaauggcagucucucgcuggaagcccuuccucuaaacuguga

SEQ ID NO: 68727 - RNA, 2427 nt, Artificial Sequence
  derived and/or modified sequence opt5 from EHMT1__Homo_sapiens__NP_001138999
auggccgcugccgacgcggaggcugugcccgccagaggcgaaccucagcaagauugcugugucaagaccgagcugcucggggaagagacaccgauggccgcugacgaaggaagcgccgagaaacaggcuggcgaggcccacauggcggccgauggggaaacgaacggauccugcgaaaauucugacgcuagcucccaugccaacgcugccaagcacacccaggauucugcgcggguuaauccccaggacggcacaaacacccugacacgcaucgccgagaauggggugagcgagagagauuccgaggcugccaaacaaaaccaugugaccgcugacgauuucguccagacaucugugauuggaagcaauggcuacauccuuaacaagccugcccugcaggcccagccccuccggaccacguccacccuggcuagcucucuuccuggccacgcggccaaaacacugcccgggggagcuggcaaggggcgcaccccuuccgccuuuccgcaaacacccgccgcuccucccgccacccucggagaaggcagcgcggacacggaggauagaaagcugccugcucccggggccgacguuaaagugcaucgggcccgcaagacaaugccgaaaucugucgugggacugcacgcugccuccaaggauccuagagaaguucgggaggcucgcgaccacaaagaacccaaggaggagauuaauaagaacaucagcgacuucggcagacagcagcuccugccucccuuucccucucuucaucagucccugccucaaaaucaguguuauauggccaccacaaaaagccagaccgcgugccucccguucgugcuggccgcugccgucucccggaagaaaaagcgcagaaugggcaccuacucucuugugcccaaaaagaaaacaaaggugcugaagcaacggacggucauugaaauguuuaaaagcaucacccacuccacaguugggagcaagggagagaaagaucucggcgcuucuucccugcaugugaacggggaaagccuggagauggacucugaugaagacgauagcgaggagcucgaagaggacgauggacacggcgccgaacaggcggccgcuuucccuaccgaggacucccgcacaucuaaggaaagcauguccgaggccgauagagcucagaaaauggacggggagagcgaagaggaacaggagucuguggauaccggagaggaagaggaaggcggcgacgaguccgaccugagcucugaauccagcaucaagaagaaauuucuuaagcggaaagggaagacggauucccccuggauuaaaccugccagaaagcgccggagacgcucucggaagaaacccagcggagcccugggcuccgagucuuauaagagcuccgcugggagcgcggagcaaacagccccgggagacucuaccggcuacauggaagucucccucgauagccuggaccuuagagugaaagggauccugucuucccaggcugagggccucgccaauggaccugauguucuggaaaccgacggccugcaggaggugccccucuguagcugccgcauggaaacaccuaagucucgggagauuaccacacuggccaacaaucaguguauggcuacggagagcgucgaucacgaacuugggagaugcaccaacuccgugguuaaauaugagcugaugcgccccagcaacaaggccccucuccuggugcuuugugaagaccaucggggaagaauggucaagcaccaaugcugucccggcugcggguacuucugcacagcgggaaauuuuauggagugucagccggaaucuuccaucagccaucgcuuccacaaagauugcgcuucccgggugaacaaugccucuuauuguccucauugcggcgaggagagcuccaaggccaaagaagucaccauugcuaaggccgacacaaccucuacggugacccccguucccgggcaggagaaaggcagcgcgcuggaaggcagagcugauacaaccacaggauccgccgccgggccuccgcucucugaggacgauaagcugcagggagcugccagccacgugcccgagggcuuugacccuaccgggcccgcuggacugggccggccuacgcccgggcucucccaaggcccuggaaaagaaacacuggagagcgcccuuaucgcgcuggacucugaaaagcccaagaaacuccgcuuccacccgaagcagcuguacuuuuccgccagacagggcgagcugcagaaaguccuucucaugcugguggaugggauugacccuaacuucaagauggaacaucaaaauaaacggagcccccugcacgcugccgcugaggccggacauguugauaucugucacaugcucgugcaguucugcagacugggcucuccucgcucccgggggugucuuugguga

SEQ ID NO: 68728 - RNA, 3702 nt, Artificial Sequence
  derived and/or modified sequence opt5 from EHMT2__Homo_sapiens__NP_001276342
augagaggccugccccgggggcgcggacucaugagagcccggggccgcgggagagcugccccuccgggaagccggggccgcgggagaggaggcccccaccggggccgcgggagaccucggucccugcuuucucugccccgcgcgcaggcuagcuggaccccucaacucuccacaggacugacgucucccccugugccgugccuucccagccagggcgaggccccugccgaaaugggggcucugcuccuggagaaggaaaccagaggagccacagagcggguccauggcucccugggggacacaccccgcucugaagagacccucccuaaagcuacccccgauagccuggagccggccggaccuuccagccccgcgucuguuacagugaccgugggcgacgaaggcgccgauacgccugucggggcuacaccccuuaucggagacgaguccgaaaaccuggagggcgauggggaccucagaggaggccggauucugcuugggcacgccaccaagagcuuccccucuuccccuagcaaaggaggcucuuguccguccagagcuaagaugagcaugaccggcgccgggaaaucucccccuuccgugcagagccuggcgaugcgccuccuguccaugcccggagcccagggcgcugccgcugccgggagcgagccucccccggccacaaccucuccugaaggacaacccaagguucaucgggcuagaaagacgauguccaaaccuggcaaugggcagcccccugugcccgagaagcgcccgccugaaauccagcacuuucggaugagcgaugacguccauucucugggcaaagugacaagcgaucucgcgaagagacgcaaacugaacuccggaggcgggcuuucugaggaacugggaagcgcccggagauccggcgagguuacccucacaaagggggaccccggaagccuggaggaaugggagaccguggucggcgaugacuucucucuuuacuaugauuccuacagcguggacgaacgcguggacucugauuccaagagcgaggucgaagcucugaccgagcagcucuccgaggaagaggaagaggaagaggaggaagaggaagaggaggaagaggaagaggaagaggaggaagaggaagaggacgaagagucugggaaucaaagcgaucgguccggcucuagcggaagacgcaaagccaagaaaaaguggcggaaagacucccccuggguuaagccuagcagaaaacggcgcaagagagagccgccccgggccaaggaaccuagaggcgugucuaacgauacauccagccuggagacggaacgcggguuugaggaacugccccucugcucuugucggauggaggcuccuaaaauugacagaaucuccgagcgcgccggacacaagugcauggcgaccgaaagcguggauggcgagcugucuggguguaaugcugccauucuuaaaagagaaacaaugcggcccagcucccgcgucgcccugauggugcucugcgagacccacagagcucggaugguuaagcaucacuguugcccuggauguggcuauuucugcacagccgggaccuuucuggagugucaucccgacuuccgcguggcucacagauuucacaaagccugcgucagccagcuuaacggcaugguguucugcccgcauuguggagaagaugcgucugaggcccaggaaguuacgaucccucggggcgacggggugacacccccugcuggaaccgccgcucccgccccgccuccccugucccaggaugucccuggccgcgcggacaccagccaacccuccgccagaaugcgggggcacggagagccccgcagaccuccgugcgacccccucgcugauacaaucgacucuagcggcccuucccugacccugcccaaugggggcugucucucugccgugggacugccucuuggccccgggcgggaagcucuggagaaggcccucgucauucaggagagcgaaagacgcaagaaacugcgguuucauccuagacagcuguaccuuuccgugaagcaaggagagcuccagaaaguuauccugaugcugcucgauaaccuggacccgaauuuccagucugaucagcaaagcaagcgcacaccccuucacgccgcugcgcagaaaggcuccguggaaauuugccauguccugcuccaggccggggcuaacaucaaugccguggacaagcagcaacggacgccucugauggaggccguugugaacaaucaccuggaagucgcuagauauauggugcagcgcggaggcuguguguacagcaaggaggaggauggcucuaccugccuucaccaugccgcgaaaauugggaaccucgaaaugguuucccugcugcucagcacaggacaggucgacgugaaugcucaggauucuggcggguggacccccaucauuugggccgccgagcacaagcauaucgaagugauccggaugcugcuuacaagaggagcugacgucacccugacggauaacgaggaaaacauuugucuccacugggccuccuuuaccggcagcgcggcuaucgccgaggugcugcugaaugcccgcugcgaccuucacgcuguuaacuaucauggggauacaccucuccacauugccgcucgggagucuuaccaugacugugugcugcuguuccucuccagaggagccaaucccgaacugcggaacaaagagggcgacaccgcgugggaucuuacaccggaacgcagcgacgucugguuugcccugcaacucaauagaaagcugcggcugggcguggggaaccgcgcuaucagaaccgagaaaauuaucugccgggauguugccagaggauacgagaaugugccuauccccugugucaacggcguggacggggaacccugcccugaggauuauaaguacauuuccgaaaauugcgagacgagcacaaugaacaucgaccgcaauauuacccaccuucagcauuguacaugcguugaugacuguucuagcuccaacugccucuguggacagcugucuauccggugcugguaugauaaggacggcagacugcuccaggaguucaauaaaauugaacccccucugaucuucgaguguaaccaggcuugcagcuguuggcgcaauugcaagaaccgggugguccaauccgggaucaaagugagacuucagcuguaccgcaccgccaagaugggauggggcgugcgggcccuccaaaccauuccgcagggcacauuuaucugugaauaugucggggagcugauuucugaugcugaagcggacguuagagaggaugacagcuaccuguucgaccuugauaacaaagacggagaaguguauugcaucgaugcccgcuacuacggcaauauuuccagauuuaucaaccaccugugcgaccccaauauuaucccugugcgggucuucaugcuccaccaggaucugcgcuuucccagaaucgcuuucuuuucuagccgggacauucgcacgggggaggagcucggauucgauuauggcgacagauuuugggauaucaaguccaaauacuucaccugucagugcgggagcgaaaaguguaagcauucugccgaggccauugcucuggaacaaucccggcuugccagacuggacccucaccccgagcuccugccggaacugggaagccuuccucccgugaacacauga

SEQ ID NO: 68729 - RNA, 1023 nt, Artificial Sequence
  derived and/or modified sequence opt5 from EI24__Homo_sapiens__XP_011541371
auggccgacagcgugaagaccuuccugcaggaucucgcuagaggcaucaaagacuccauuugggggaucugcacaauuucuaagcuggaugcccggauccaacagaaacgcgaggaacagagacggcgcagagcgagcuccguccuugcucagcggcgcgcccaaucuauugagagaaagcaggaaagcgagccccggaucguuucccgcaucuuucaguguugcgccuggaacggaggcguguucugguuuucucugcuccuguucuacagaguguuuauuccuguccuucagagcgugacggcucggaucauuggggacccgucccugcacggagauguuuggagcuggcucgaguucuuucugaccucuaucuucuccgcccugugggugcucccccuguuuguccuuagcaaagugguuaaugcuauuugguuccaagacaucgccgaucuggcguuugaagugucuggccgcaagccucaucccuucccuuccgucagcaagauuaucgccgacaugcucuuuaaccugcuucugcaggcucucuuccugauccaggggauguucgugucucuguuucccauucaccucgugggacagcuggucucccuucugcauaugagccuccuguauucccuuuacuguuucgaguauagaugguuuaauaaaggcaucgaaaugcaccaacggcugucuaacauugagcgcaauuggccuuacuauuucggcuuugggcucccgcuggccuuccugacagcuaugcagagcuccuacaucauuagcggaugccucuuuucuauccuguucccccuuuuuaucauuuccgccaacgaagcgaagaccccuggcaaagccuaucuguuccagcucagacuguuuagccuuguuguguuccugucuaaucggcucuuucauaagacaguguaccugcaaagcgcucuguccucuagcaccuccgccgagaaauuccccagcccucaccccucuccggcuaagcucaaggccacagccgggcacuga

SEQ ID NO: 68730 - RNA, 564 nt, Artificial Sequence
  derived and/or modified sequence opt5 from EID1__Homo_sapiens__NP_055150
augagcgagauggccgaacuguccgagcucuacgaagagucuagcgaccugcagauggaugugaugcccggcgaaggggaccuuccucaaauggaggucggauccggcucuagagagcugagccuccggccgucccgcucuggggcucagcagcuggaagaggaaggacccauggaggaggaagaggcccagccuauggcggcucccgaaggcaagagaagccuugccaacgggccuaaugccggagagcaacccggccagguugcuggcgccgauuucgaauccgaggacgagggggaagaguuugaugacugggaagaugacuaugauuacccugaggaggaacagcugagcggagcuggcuaucgggugucugccgcgcucgaggaagccgacaaaauguuccugcgcaccagagagccggcucuggaugggggauuucagaugcacuacgaaaagacacccuucgaccaacucgccuuuaucgaggaacuguucucccuuaugguggucaaccggcugacggaggagcucggcugcgaugaaauuaucgaccgcgaguga

SEQ ID NO: 68731 - RNA, 498 nt, Artificial Sequence
  derived and/or modified sequence opt5 from EIF1AD__Homo_sapiens__NP_001229411
augagccaggccaccaagagaaaacacguggucaaggagguucugggcgaacauaucgugcccuccgaccaacagcagauugugcggguccuccgcacaccugggaacaaucugcacgagguggaaacggcucagggacaaagauuccuuguuucuaugccgagcaaauaccggaagaacaucuggauuaaacgcggcgauuuucugaucguggaccccauugaggaaggggagaaggucaaggccgagaucuccuucgugcucugcaaagaucauguuagaucucugcagaaggaaggauuuuggccugaggcguucagcgaaguggcugagaaacacaauaaccggaaucgccagacccagcccgagcuuccugccgaaccccaacuguccggcgaggaaucuagcuccgaggacgauagcgaccucuuugucaacacaaauagacggcaguaucaugaaucugaggaggaauccgaggaagaggaagccgcuuga

SEQ ID NO: 68732 - RNA, 435 nt, Artificial Sequence
  derived and/or modified sequence opt5 from EIF1AX__Homo_sapiens__NP_001403
augcccaagaacaaaggcaaagggggaaagaauagacggcgcggcaagaacgagaaugaaagcgagaaaagagaacugguguucaaggaggacgggcaggaauacgcccaagucaucaagaugcucggaaacggccggcuggaggcuaugugcuuugaugggguuaaacgccuuugucacauuagaggaaagcugcggaaaaagguguggaucaauaccuccgacauuauccucgugggccugcgcgauuaucaggacaacaaagccgaugucauucuuaaguacaaugcggacgaggcuagaucucugaaggccuauggcgaacucccugagcaugccaaaaucaacgaaacagauacguucgggccgggagacgaugacgagauccaguuugaugacauuggcgaugacgacgaggauaucgacgauauuuga

SEQ ID NO: 68733 - RNA, 384 nt, Artificial Sequence
  derived and/or modified sequence opt5 from EIF1AY__Homo_sapiens__NP_001265541
augcccaagaacaaaggcaaagggggaaagaauagacggcgcggcaagaacgagaaugaaagcgagaaaagagaacugguguucaaggaggacgggcaggaauacgcccaagucaucaagaugcucggaaacggccggcuggaggcucuuugcuuugaugggguuaaacgccugugucacauuagaggaaagcuccggaaaaaggacaauaaagccgaugugauccugaaguauaacgcggacgaggcucgcucccuuaaggccuacggcgaacugccugagcaugccaaaauuaaugaaaccgauacauucggcccgggggacgaugacgagauccaguuugaugacauuggagaugacgaugaggacaucgacgauaucuga

SEQ ID NO: 68734 - RNA, 342 nt, Artificial Sequence
  derived and/or modified sequence opt5 from EIF1__Homo_sapiens__NP_005792
augagcgccauccagaaccugcacuccuucgaccccuuugcugaugccucuaagggcgacgaucuccugccugcggggaccgaggacuacauucauauccggauucaacagagaaauggacgcaaaacacuuacgaccgugcagggcaucgcugaugacuaugauaagaaaaagcuggucaaagccuucaagaagaaauuugccugcaacgggacaguuauugaacacccggaguacggagaagugauccagcuccaaggcgaccagagaaagaauaucugucaguuccugguggagauugggcuugcuaaagaugaccagcugaagguccauggauuuuga

SEQ ID NO: 68735 - RNA, 1758 nt, Artificial Sequence
  derived and/or modified sequence opt5 from EIF2A__Homo_sapiens__NP_114414
auggcccccagcaccccucugcucacagugagaggcuccgaggggcuguacauggucaacggaccgccccacuucacggaaucuaccguuuuuccucgggagagcggcaagaauugcaaaguguguaucuucuccaaggacgggacacuuuuugcuuggggaaacggcgaaaaagugaauauuaucucugucaccaacaaggggcugcuccauagcuucgaucugcuuaaagccgugugccuggaguuuucccccaagaauacaguucucgcgaccuggcagccuuauacaaccucuaaggacggaacggcuggcauucccaaccugcaacuguacgaugugaaaaccggcacaugucucaagagcuucauccagaaaaagaugcagaauuggugcccuuccuggagcgaagacgagacccugugugcccgcaacgucaauaacgaggugcacuuuuucgaaaauaacaauuuuaacacaauugccaauaaacuucaucugcagaagaucaacgauuucguucucucuccggggccccaaccuuauaagguggcugucuacgugcccggauccaaaggcgccccuagcuuugugagacuguaucaguaccccaacuucgcugggccgcacgccgcgcuugccaauaaguccuuuuucaaagcugacaaggucaccaugcuguggaacaaaaaggccacggcuguucucgugaucgccucuacagauguggacaaaaccggagcgagcuauuacggcgagcagacacugcauuacauugccaccaauggggaaucugcugucgugcagcugccuaagaacggacccaucuaugauguuguguggaacuccagcuccaccgaguucugcgccgucuacggcuuuaugccugcuaaggccacaauuuucaaucucaaaugugaccccguguuugauuucggcacggggccccggaaugccgcuuauuacucuccucacggacacauccugguucuugcgggcuuugggaaccugcgcggacaaauggaggugugggacgucaagaauuauaaacucauuagcaagccgguggccuccgauagcaccuacuucgcuuggugccccgacggcgaacauauccugacagccaccugugccccuagacuucgggucaacaauggguauaaaauuuggcacuacacaggaucuauccugcauaaguacgacgugcccuccaacgcugagcucuggcagguuagcuggcagccuuuucuggauggcaucuuccccgccaagaccauuacguaucaggcggugccgucugaagucccuaaugaggaacccaaaguggcuacagccuaccgcccucccgcccugagaaacaagccuaucaccaauagcaaacuccacgaggaggaacccccgcaaaacaugaagccucaguccggcaacgacaaaccccugucuaagaccgcucuuaagaaucagcggaaacacgaggccaagaaagcugccaagcaagaagcgcgcagcgauaaaucccccgaccuggccccuacaccggcuccccagagcaccccuagaaacacaguuucucaguccauuagcggggaucccgagaucgacaagaagauuaaaaaucucaagaaaaagcugaaagccaucgaacagcuuaaggagcaagcugccacgggaaaacagcuggagaagaaccagcucgaaaagauccagaaagagaccgcgcugcugcaagaacucgaggaucuggaacuuggcauuuga

SEQ ID NO: 68736 - RNA, 1893 nt, Artificial Sequence
  derived and/or modified sequence opt5 from EIF2AK1__Homo_sapiens__NP_055228
augcagggcgggaacagcggagugagaaagcgggaggaagagggcgacggggccggagcugucgccgcgcccccugcuaucgauuucccggccgaaggccccgacccugaguacgaugaauccgacguucccgccgagauucaagugcugaaagagccucuccagcagcccaccuuuccuuucgcuguggccaaucagcugcuucuggucucucuccuggaacaccuuagccaugugcacgagccgaacccccugcgcuccagacaaguuuuuaagcuccugugccagacauucaucaaaauggggcugcucucuagcuuuacguguuccgaugaguucucuagccugcggcuucaucacaaucgcgcuauuacccaucugaugagauccgccaaggaacgggugcgccaggacccuugcgaggauaucagccggauucagaaaaucagaucucgcgaagucgcgcucgaggcccaaacauccagauaucugaacgaauuugaggaacuugcuauccugggaaagggcggcuacgggcggguguauaagguucgcaauaaacucgacggacaguacuaugccauuaagaaaauccugauuaagggcgcuaccaaaacaguguguaugaagguccugagagaggugaaggugcucgccgggcugcagcaccccaacaucgucggauaccacaccgcguggauugagcauguucacgugauccagccucgggccgaucgcgcugccauugaacuucccagccuggaggugcucucugaccaagaagaggauagagaacagugcggcgucaaaaaugacgaguccucuagcuccagcaucaucuucgcugagccgacaccugaaaaggagaaacgguuuggggaauccgauaccgagaaccagaauaacaagucugugaaauauacgaccaaucugguuauuagagaaagcggagagcuugaguccacacuggaacuccaagagaacggccuggccggccugagcgccucuuccaucguggaacagcagcucccccugcgccggaauagccaucuugaggagucuuucaccagcacagaagaguccucugaagagaacgucaauuuucuggggcagaccgaagcucaauaccaccucaugcugcacauucagaugcagcuuugugagcugagccucugggacuggaucguggagagaaacaagcgcggacgggaauacguugacgaguccgcgugcccuuaugugauggccaacgucgcuacgaaaauuuuccaggaacugguggagggcgucuuuuacauccauaauauggggaucgugcacagagaucugaagccccgcaacauuuuccuccauggacccgaccaacagguuaagaucggcgauuucgggcuggccuguacagacauucuucagaaaaauaccgauuggacaaaccggaauggaaagagaaccccuacccacacaagccgcgugggcacgugccuguaugccucuccggaacagcucgagggcuccgaguacgacgcuaaaagcgauauguauucucugggggucgugcugcuugaacucuuucaacccuucggaaccgagauggaacgggccgagguucugacaggccugagaaccgggcagcucccugaaucccugcgcaagcggugucccgugcaggcgaaauacauccagcaucuuacaagacggaacagcucccaacgcccuucugcuauucagcugcuccagagcgagcuguuucaaaauuccggaaacgucaaucugacccuucagaugaagaucaucgagcaggaaaaggagauugccgaacucaaaaagcagcugaaccugcucucucaagacaaaggcgugagagaugacgggaaggauggcggagugggcuga

SEQ ID NO: 68737 - RNA, 1533 nt, Artificial Sequence
  derived and/or modified sequence opt5 from EIF2AK2__Homo_sapiens__NP_001129124
auggccggcgaccugagcgcuggguucuuuauggaggaacucaacaccuacagacagaagcaaggagugguccugaaauaucaggagcuucccaauuccggcccuccgcacgaucggcgcuucacauuucagguuaucauugacgggagagaguuccccgaaggagaaggccggucuaagaaagaggccaagaacgcggcugccaaacuggccguggagauccucaauaaggaaaagaaagcugugagcccucugcuucugacgaccacaaacuccucugaggggcucagcaugggaaauuacauuggccugaucaaccgcauugcccagaagaaaagacugaccgucaauuaugaacaaugcgcuuccggcgugcaugggcccgagggauuucacuacaaguguaaaaugggccagaaggaguauucuaucgggacaggaagcaccaagcaggaagccaaacagcucgcggccaagcuggcuuaccuucaaauccuguccgaggaaacaagcguuaaaucugauuaucucuccagcggcucuuucgccaccacgugcgagucccagagcaacucucuggugaccuccacacuugcuagcgaauccucuagcgagggggacuuuuccgccgauaccagcgagauuaauucuaacuccgacagccucaauucuagcucccugcugaugaacggacugcggaauaaccagcgcaaggcgaaaagaucucucgccccucgguucgaucugcccgacaugaaggaaacaaaauacaccgucgauaagcgcaaggcugagagagaagugaaagcccuugcuaagcuggaccauguuaauaucgugcacuacaacggcuguugggauggcuuugacuaugauccugagacgagcgacgacucccucgaaagcucugauuacgacccggagaacuccaaaaauagcucucgguccaagacaaaaugccuguucauucagauggaguuuugugauaaggggacccuugaacaauggaucgagaagcgcagaggagaaaaacuggacaagguccucgcccuggagcuguucgaacagauuacaaaaggcguggauuauauccauagcaagaaacucauucaccgggaccugaagcccuccaacaucuuucuuguggauaccaagcaggucaaaaucggggacuucggacugguuaccucucucaagaaugauggcaaacgcacaagaagcaaggggacgcugcgguacauguccccugagcaaauuucuagccaggacuauggaaaagagguggaucuuuacgcccugggccucauccuggcugaacugcuccacgugugcgacaccgcguucgagacauccaaguuuuucaccgaccugagagauggcauuaucagcgacauuuuugauaagaaagaaaagacacuucugcagaaacuccugucuaagaaacccgaggaccgcccuaacaccuccgagauccugcggacgcuuacagucuggaagaaaagccccgaaaagaaugagagacauaccuguuga

SEQ ID NO: 68738 - RNA, 3351 nt, Artificial Sequence
  derived and/or modified sequence opt5 from EIF2AK3__Homo_sapiens__NP_004827
auggagagagccaucagccccggccugcucgugcgggcucugcuucugcuccugcuucugcucgggcuggccgcgcgcaccgucgcugccgggagagcccggggccugccugcuccgacagccgaagcugccuucgggcucggagcggccgcugcccccacguccgcuacccgcguuccugccgcgggcgccguggcugccgcugaggugacagucgaagacgccgaggcccugcccgcugcggccggggaacaggagccuagaggacccgagccugaugacgaaaccgagcuucggccgcgcggcagaucucuggugauuaucagcacacucgauggccggauugcugcccuggaccccgaaaaccacgggaagaaacaaugggaucuugacguuggauccggcucucuggugagcuccucucucagcaagccugaggucuuugggaauaaaaugaucauucccucccuggauggagcccuguuccagugggaccaggaucgcgagagcauggaaaccgugccuuuuacaguugagucucuccuggaauccagcuacaaguucggcgacgaugugguccuugugggaggaaaaucucugaccacguauggccucuccgcuuacagcggcaaggugagauauaucugcucugcccuggggugucggcagugggacuccgaugagauggaacaagaggaggacauccuucugcuccagcgcacccagaagacagucagagcgguuggaccccggagcggcaacgaaaaauggaauuuuuccguggggcauuucgagcugcgcuacauuccggacauggaaaccagagcuggauuuaucgagucuacauucaagccuaacgaaaauaccgaggagagcaaaauuaucuccgauguggaagaacaggaagccgccauuauggacaucgucauuaaggugagcguugcugauuggaaagugauggccuuuucuaagaagggcgggcaccuggagugggaauaucaauucugcacgcccaucgcuuccgccuggcuccugaaagacggaaaggucaucccuauuagccuuuuugaugacacaucuuacaccagcaacgaugacgugcuggaggaugaggaagacaucguugaggcggcccggggcgcuacagaaaauuccguguaucucggcauguacagagggcagcuguaccuucagucuagcguccgcauuuccgagaaauuccccagcucucccaaggcccuggaguccgugaccaacgaaaaugcuaucauuccucucccgaccaucaaauggaagccccugauccauagcccuucucggacacccguccuggugggauccgaugaguuugacaaaugucucagcaacgacaaguucucccacgaagaguauucuaauggcgcccugagcauucuucaguacccuuaugauaacggguacuaucugcccuacuauaagagagaacgcaauaaacgguccacgcaaaucaccguuagauuccucgacaacccgcauuacaauaagaacauucgcaaaaaggauccugugcugcugcuucacugguggaaagagaucgucgcgacaauucucuuuugcaucaucgccaccacauucauugugcggagacuguuucacccccauccucaccgccagcggaaggagucugaaacccagugucaaacggagaacaaguacgacagcguuuccggagaagcuaaugauagcucuuggaacgacaucaaaaauuccggcuauauuagcagauaccugacagauuucgagcccauccagugccucgggcgcggcggauuuggcguggucuucgaagccaagaacaaaguggacgauuguaauuaugcuauuaagcggaucagacugccuaaccgggagcuugcccgcgagaaagugaugagagaaguuaaggcccuggcuaagcucgagcaucccgggauuguccgguacuuuaaugcguggcuggaagccccgccugagaaauggcaggaaaagauggacgagaucuggcugaaagaugagucuaccgacuggccccuuuccagccccucuccuauggaugcuccgagcgugaagaucagacgcauggaccccuucgccaccaaagaacacauugagaucauugccccuagcccccagcggagcagaucuuuuuccgugggaaucagcugcgaccaaacauccucuagcgaaucccaguucucuccucucgaguuuagcggcauggaucacgaggacauuuccgaaucugucgaugcugccuauaaccugcaggacagcugucugaccgauugcgacguggaggaugggacaauggacggaaaugaugaaggccauuccuucgagcucugucccagcgaagcgucuccuuacguucgcuccagagagcggacguccucuuccaucguguuugaggacagcgggugcgauaacgcuucuuccaaggaggagcccaagaccaaucgccugcacaucggcaaccauugcgccaauaaacuuacagccuucaagccgaccagcuccaaaagcucuagcgaagcuacacuguccauuucuccucccagaccuaccacgcucagccuggaccugaccaagaacacaaccgagaaacuucagcccuccucuccgaaggucuaucucuacauccaaaugcagcugugucggaaagaaaaucugaaggauuggaugaacggacgcugcacaauugaggagagagaacggagcgugugucuccacaucuuccugcagauugccgaggcgguugaauuucuucauuccaagggccugaugcaccgcgaccucaaaccuucuaacaucuucuuuaccauggacgauguggucaaggugggggacuucggacugguuacggcuauggaucaggacgaggaggaacaaacagugcugacccccaugccugccuacgccagacacacaggccaggucgggaccaaacuuuauaugagccccgagcagauccauggaaauuccuacagccacaagguggauaucuuuucucucggccugauucuguucgaacuccuguaucccuuuuccacccagauggagcgggugcgcacacuuacggacgucagaaaccugaaauucccuccgcucuuuacccaaaaguaccccugcgaauauguuauggugcaggauaugcugagcccuucucccauggagcggccugaggcuauuaauaucauugaaaacgccguguucgaggaccuggauuuucccgggaagacaguccuuagacagcgcucccggagccuguccucuagcggcaccaaacauuccagacaaagcaauaacucucacuccccucucccgagcaauuga

SEQ ID NO: 68739 - RNA, 4950 nt, Artificial Sequence
  derived and/or modified sequence opt5 from EIF2AK4__Homo_sapiens__NP_001013725
auggccggcgggagaggagcucccggccgggggcgcgacgagccuccggaaagcuacccccagagacaagaucacgagcugcaggcccucgaagcgaucuauggagcugacuuccaggaucugcggccugacgccugcggccccgugaaggagccucccgaaauuaaccuuguccuguacccucaggggcucaccggagaggagguuuaugugaaaguggaucugcgcgucaaguguccgcccacauacccugacgugguucccgaaaucgagcuuaaaaaugccaagggccuguccaacgaaucugugaaucuccugaaaagcagacuggaggagcucgcuaagaagcauugcggcgaagucaugauuuuugagcuggccuaucacgugcaauccuuccuuucugaacauaacaaaccucccccgaagucuuuucacgaggaaaugcuggagcggcgcgcucaggaggaacagcagagacuccuggaggccaaacggaaggaggaacaagaacagcgcgagauccuucaugagauucagagacggaaagaagagaucaaggaagagaagaaacgcaaggaaauggcgaaacaggagagacuggagaucgccucccucucuaaucaagaucacacgagcaagaaagacccugggggacaccggaccgcugccauucugcauggcgggucccccgauuucguuggaaacggcaagcaccgcgcuaauagcucugggagaucccggagagaacgccaguacagcguguguaacucugaggacuccccuggaagcugcgaaauccuguauuuuaauaugggcucucccgaucagcucaugguccauaaaggcaaguguauuggguccgacgagcaacugggaaaacuuguguacaacgcccuggagacagcgaccggcggguucgugcuccuguacgaauggguccuucaguggcagaaaaagaugggacccuuucugacaagccaggagaaagaaaagaucgauaaaugcaagaagcaaauucagggcaccgagacagaguucaauucccucguuaaacugucucacccuaacguggugcgguaucuggccaugaaucucaaggaacaggacgacagcaucgucguggauauucugguugagcacaucuccggggugagccuugcugcccaucugucucacuccggaccgauccccguccaucagcucagacgcuacaccgcucaacugcuuagcggccuggacuaucuccacucuaacagcgugguucauaaagugcuguccgccucuaauguccugguggaugccgaaggcacggucaagauuaccgacuacagcaucuccaaacggcucgcugauauuuguaaggaggacguguuugaacagacaagaguucgcuucagcgauaacgcgcugccuuauaagaccgggaaaaagggagacguguggcggcuuggccugcuccugcugucucuuucccaggggcaggagugcggagaauaccccgucacaaucccuagcgaucuccccgccgacuuucaagauuuccugaaaaagugugugugccuggacgacaaagagagauggucuccgcagcagcuccugaagcacuccuuuauuaacccucagcccaagaugccucuuguugagcaaagccccgaagauuccgagggccaggacuauguggaaaccgucaucccuucuaaucgccugcccagcgcugccuucuucuccgagacgcagcggcaauuuucuagauacuucaucgaauuugaggagcuccagcugcuggggaaaggcgccuucggagcugugauuaaggugcagaacaaacuugauggcuguugcuacgccguuaagcgcaucccgauuaauccugcgagccggcaguuuagacggaucaaaggggaagucacacuccugucccgccugcaccaugagaacauugugagauauuacaaugcuuggaucgaacggcacgagagacccgccggacccggcaccccuccgcccgacagcgggccucucgccaaggaugaccgcgcugcccggggacaacccgcuucugauacagacggccuggauuccguggaggccgcggccccucccccuauccuuagcagcuccgucgaauggagcaccucuggggagagaagcgcuuccgcccgcuuccccgcuaccggcccgggaagcucugacgaugaagacgaugacgaggacgaacauggcgggguguuuucccagagcuuccugccugccuccgauucugagagcgacauuaucuuugauaacgaggacgaaaauuccaaaucucagaaccaggaugaggacugcaaugaaaagaacggaugucacgagagcgaacccuccguuacaacggaggcggugcacuaucucuacauucaaauggaguauugcgaaaagucuacccugagagauacaaucgaccagggccuguaccgggauaccguccgccuuuggagacucuuccgggagauucuggacgggcuggccuauauccaugaaaaaggaaugauucaccgcgaucucaagccugugaauaucuuucuggacagcgaugaccauguuaaaaucggcgacuucgggcuugcuacagaucaccuggccuuuuccgcugacagcaagcaggaugaccagaccggcgaucucauuaaaucugaccccuccggacaucugacgggcaugguggggacagcccuguacgucagcccggaggugcaaggaucuaccaaguccgccuacaaccagaagguugaucuuuucagccucggcaucauuuucuuugaaaugucuuaucacccuauggugaccgcuuccgagagaaucuucguccugaaucagcugcgggaccccacaagcccuaaauuucccgaggauuucgacgauggggaacacgcgaagcaaaaauccgugauuagcuggcuccugaaccaugaccccgccaagcgcccuaccgcuacagagcuucugaaaucugaacuccugccgcccccucagauggaggagagcgaacugcacgaggugcuucaucacacgcugaccaaugucgacggaaaggccuacagaacaaugauggcccagaucuuuucccagcggaucucucccgcuauugauuauaccuacgacagcgauauccucaagggcaacuucuccauucgcacagccaaaaugcaacagcauguuugugaaaccaucauuagaaucuuuaagcggcacggggcggugcagcugugcacgccucuccugcuucccagaaaccgccagaucuaugagcacaaugaagcugcccuguucauggaccauucuggcaugcucgugaugcugccuuuugaucugcggauuccguucgccagauacgucgcucgcaacaauauccuuaaccugaaacgguauuguauugagagaguguuucgcccccggaagcucgacagauuccacccuaaagagcugcucgaaugcgccuuugauaucguuaccagcacaaccaauuccuuccugcccacagcggagauuaucuacaccaucuacgaaauuauccaagaguucccugcccuucaggaacgcaacuauucuauuuaccugaaucauacgaugcuccugaaggcuauccugcuucacuguggcauucccgaggacaagcugagccagguguauaucauucucuacgaugccgucacagagaaacugacccggagagaaguggaggcuaaguuuugcaaccucucccugagcucuaauucccuuugucggcuguauaaauucaucgaacagaagggagaccugcaagaucucaugccgacaaucaacagccugauuaaacagaagaccgggaucgcccagcuuguuaaauacggacugaaggaccucgaggaaguggucggccugcucaagaaacuggggauuaaacuucaggugcugaucaaucugggacucguuuauaaggugcaacagcacaacggcauuaucuuucaguucgucgcuuuuaucaagcgcagacaacgggccgugccugagauucuggcggccggcgggcgcuacgaucuucugaucccccaguucagaggaccccaggcucucggcccugugcccaccgccauuggggucucuaucgcuauugacaaaaucuccgccgccguucugaauauggaggaaagcgugacaaucuccucuugcgaccuccugguggucagcgugggacagauguccaugagccgggcuauuaaccuuacgcaaaagcuguggaccgcgggcaucacagccgagauuauguacgauuggucucagucccaggaggaacugcaggaguauuguagacaucacgaaaucaccuacguugcucucgugagcgacaaggaggggucucaugucaaaguuaagagcuuugaaaaagagcgccaaacagaaaagcgggugcuggagaccgagcuuguggaucacguccugcagaaacucagaacgaaggugacagacgaacgcaauggacgggaggccuccgauaaccuggccguccagaaccucaagggcucuuucagcaaugcuuccggccuguuugaaauucauggggccaccgugguuccuaucgugucuguccuugcgccggagaaacugagcgcuuccaccagacgccgguaugaaacacaggugcaaaccagacugcagacaagccucgccaaccugcaccagaagucuuccgagauugagauccuugccguugaccugcccaaagaaacgauccuccaauuccugagccuggagugggaugcugacgaacaggccuuuaauaccacagugaagcagcuccuuucccgccugccuaaacagagauaccugaagcucgucugcgaugagauuuauaacaucaagguggaaaagaaggugucuguucuguuccuuuacagcuaucgggacgauuacuaccgcauucuguucuga

SEQ ID NO: 68740 - RNA, 918 nt, Artificial Sequence
  derived and/or modified sequence opt5 from EIF2B1__Homo_sapiens__NP_001405
auggacgauaaggagcugaucgaauacuucaaaagccagaugaaggaggaccccgauauggccuccgcuguggccgcgauuagaacccuccuggaauuucuuaaacgggacaagggcgagacaauccaagggcugcgcgcuaaccucacgucugccauugaaacccugugcggagucgauagcuccguugccgugucuagcggcggggagcuuuuccugagauuuaucucccucgcuucucuggaguauagcgacuacuccaaauguaagaagauuaugaucgaacggggagagcuguuccuccgcagaaucagccugucucggaauaaaauugccgaucuuugccacacauuuaucaaggacggcgcuaccauucugacacaugccuauucccgcgugguccucagagugcuggaagcggccguugcugccaaaaagcgguucagcguguacgucaccgagucucagccugaucuuuccgggaaaaagauggcuaaggcccugugucaccucaacgugccgguuacagugguccuggacgcggccgugggauauaucauggagaaagcugaucuggugauugucggcgccgaaggcguuguggagaaugggggaaucauuaacaagaucggcaccaaucagauggcugugugcgccaaagcccagaacaagcccuuuuacgucguggcugagagcuucaaauuuguucgccucuucccucugaaucaacaggacgugcccgauaaguuuaaauauaaggcggacacgcuuaaggucgcccagaccgggcaggaccugaaagaagaacauccuuggguggauuacacagcucccucucucaucacccugcuuuucacagaccugggaguucucaccccuuccgccgugagcgaugagcugauuaagcuguaccucuga

SEQ ID NO: 68741 - RNA, 1056 nt, Artificial Sequence
  derived and/or modified sequence opt5 from EIF2B2__Homo_sapiens__NP_055054
augcccggcagcgccgcuaagggguccgagcugucugaaagaaucgagagcuucguggaaacccucaaacggggaggcgggccucgcuccucugaggaaauggccagagagacacugggacuucugcggcagauuaucacggaccaccgcuggagcaacgcgggcgagcucauggaacugauuagacgggaggggcgcagaaugaccgcugcccaaccguccgaaacaaccgucggaaauaugguucggcgcgugcuuaagaucauuagagaggaguacggccggcugcauggccgcucugaugaaagcgaccagcaggagucccuccacaaacugcugacaagcgggggacucaacgaagauuuuucuuuccauuaugcccagcugcaauccaauaucaucgaggcuauuaacgaacuucugguggagcucgagggcaccauggaaaauaucgccgcucaggcccuggagcacauucauagcaacgaagucaucaugacaauuggguuuucuagaaccguggaggcguuccuuaaggaagccgcucggaaacgcaaguuucacguuaucguggccgagugcgcucccuucugucagggacacgagauggccgucaaucuguccaaggcgggcauugaaacgaccgugaugacagacgccgcuaucuuugccguuaugagcagagugaacaaagucaucauugggaccaagacaauccucgcuaauggagcccugcgggccgugaccggcacgcauacacuggcucucgcggccaaacaccauucuaccccucugauugugugcgcucccauguucaaacuuuccccucaguuucccaacgaggaagauagcuuccacaaguuugucgccccugaggaaguucugccguucacagagggcgacauccucgagaagguguccgugcacugucccgucuuugauuacgugccucccgaacugauuacccuuuucaucucuaauaucgggggaaacgccccuagcuauauuuacagacugauguccgagcucuaucaucccgacgaucacguucuguga

SEQ ID NO: 68742 - RNA, 1269 nt, Artificial Sequence
  derived and/or modified sequence opt5 from EIF2B3__Homo_sapiens__XP_011540698
auggaguuccaggccguggucauggcuguuggcgggggaagcagaaugaccgaccugacauccucuauccccaagccucuccugccggugggcaacaaaccccuuauuugguacccucugaaucuccuggaacgggugggguuugaggaagucaucgugguuacgacccgcgaugugcaaaaggcccuuugcgcggaguucaaaaugaagaugaaacccgacauugucuguaucccugaugacgcugauaugggaacagccgacagccugagauauauuuaccccaagcucaagaccgaugugcugguucuguccugcgaccucaucacagauguggcccugcacgaagucguggaccuuuuucgggcuuaugaugccucucuggcuaugcucaugcgcaaaggccaggacagcaucgagccugugccggggcagaagggcaaaaagaaagccgucgagcagagagauuucauuggaguugacuccaccggcaagcggcugcuuuuuauggcgaacgaagccgaccuggaugaggaacucgugaucaaggggucuauucugcagaaaagcaucacauccauucgcagcgagcugauccccuaccucgugagaaagcaauucucuuccgcuagcucucagcagggacaagaggaaaaagaggaagaccugaagaaaaaggagcuuaaaucccuggauauuuauagcuuuaucaaggaagccaauacccucaaccuggcuccuuacgacgccuguuggaaugcgugccggggcgaucgcugggaggaccuuucuagaucccagguccgguguuaugugcauaucaugaaggaggggcugugcagccgcguuuccacgcucggacuguacauggaagccaacagacaggugcccaaacugcucucugcucuguguccugaggaacccccgguccacagcuccgcccagauugugagcaagcaucuuguuggcguggauucucugaucgggccugagacccaaauuggagaaaaauccagcaucaagcggucugucauuggcagcuccugccucaucaaagaccgcgugacaaucaccaauugucugcuuaugaacucugucacaguggaggagggcagcaauauucagggguccguuaucugcaacaaugcugugauugaaaagggagccgauaucaaggacugucugauuggcagcgggcagagaaucgaggccaaagcuaagcgggucaacgaagugaucguuggaaaugaucaacucauggagauuuga

SEQ ID NO: 68743 - RNA, 1572 nt, Artificial Sequence
  derived and/or modified sequence opt5 from EIF2B4__Homo_sapiens__NP_001029288
auggccgcuguggccgucgcgguuagagaggacagcggcuccgggaugaaggcugaacugcccccuggaccgggcgccguggggcgggagaugaccaaagaagagaagcuccagcugcgcaaagaaaagaaacaacagaagaagaaaagaaaggaggagaaaggagccgaacccgagacaggcucugcugugagcgccgcucagugccaggucgggccuacgcgggaacuucccgaguccggaauccaacugggcaccccucgcgagaaggugcccgccggcagaucuaaagcggaacuccgggccgagcgcagagcuaagcaggaagccgagcgggcucugaagcaggcccgcaaaggggaacagggaggcccuccgcccaaggcgagcccuuccacagccggggagacccccucuggaguuaaaagacuuccugaguacccccaaguggaugaccugcuccugcggcgccuggucaagaaaccggaaagacaacaggugccuacacggaaggauuauggcagcaaaguuucccucuucagccaccuuccccaguacucucgccagaacucccuuacccaguuuaugagcauuccuucuuccgugauccaucccgcuauggucagacuggggcuccaguauagccaaggacuggugucuggcuccaaugcccgguguauugcucugcugagagcccuccaacaggugauccaggacuacacaacgcccccuaacgaggaacugagccgcgaucuggucaauaagcucaagccguauauguccuuccugacccagugccggccccuuucugccagcaugcacaacgcuauuaaauuucugaauaaggagaucaccuccguuggcagcucuaaaagagaagaggaggcgaaguccgaacuccgcgccgcuaucgaccgguacgugcaggagaaaauugugcuggccgcccaggcuaucagcagauucgccuaucagaagauuucuaacggggaugucauccuuguguacggauguagcucccugguuucucgcauucuccaagaagcguggacagagggccggagauuucgcguggucgugguugacagccggccuuggcuggaagggagacauacccugcgcucccucgugcacgcuggaguccccgccagcuaccugcuuaucccugccgcuucuuaugugcugcccgaggucuccaaggugcuccugggcgcccaugcccuucuggcuaaugggagcguuaugucucgggugggaacagcgcagcucgcccuggucgcuagagcccacaacgugccgguucuggugugcugugagaccuacaaauucugcgaacggguccagacggaugcuuuuguguccaaugagcucgacgauccugacgaucugcaguguaagcgcggcgaacacguggcccuugcgaacuggcaaaaucaugccagccugagacuccugaaccugguuuaugacgucacacccccugagcuuguggaccucgugauuaccgagcugggcaugauccccugcuccucugucccugugguucugcgggugaaaagcuccgaucaguga

SEQ ID NO: 68744 - RNA, 2166 nt, Artificial Sequence
  derived and/or modified sequence opt5 from EIF2B5__Homo_sapiens__NP_003898
auggccgcucccguggucgccccuccgggcguuguggugagcagagcgaacaagcgguccggggcuggacccggcgggucuggaggcgggggagcccgcggcgccgaggaggaaccucccccuccccugcaggcuguccucguggccgacagcuucgauagacgguuuuucccuaucuccaaagaccaaccgcgcguucugcuuccccuggcuaauguggcccucauugauuacacccuggaauuucuuacagcgacgggcguccaggagaccuucguguuuugcuguuggaaggccgcucagaucaaagaacaucugcucaagucuaaauggugcagaccuacaagccugaacguugugcggauuaucaccuccgagcuguaucgcucucucggggacguccugagagauguggacgccaaggcucuugugcggagcgauuuccugcucgucuacggagacguuauuuccaauaucaacaucacacgcgcccuggaggaacacagacuucggcgcaagcuggagaaaaaugugagcgugaugaccaugauuuuuaaggaaucuucccccagccacccuacaagaugucaugaggauaacgucgugguugcgguggacucuaccacgaaucggguccuccacuuccagaaaacccaaggccugcgcagauuugccuucccccugucccucuuucaggggagcucugauggaguggagguucgguaugaccugcuugauugccauaucuccauuuguagcccccagguggcucagcuguucacagacaacuuugacuaccaaaccagagaugacuucguccgcggccuccuggugaaugaagagauccuugggaaccagauucacaugcacgucacagccaaggaauauggagcucggguguccaaucugcauauguacucugccguuugcgccgaugugaucagacgcugggucuauccucucacccccgaggcuaacuucacggacagcacaacccaguccuguacacacagccggcauaauauuuacagaggcccugaagugucucugggccacggguccauccuggaggagaacguucuccugggaagcggcaccgugaucgggucuaauugcuuuauuaccaacagcgucaucggacccggcugucacauuggggauaacguggugcuugaccagacauaccuguggcaaggaguucgcgucgcggccggcgcucagauccaucagucccuccugugcgauaaugccgaagugaaagagcgggugacgcuuaagcccagaucuguccugaccagccaagugguugugggcccuaacauuacacucccggaaggguccgucaucagccugcacccgccugacgccgaggaagaugaggacgauggagaguucucugacgacuccggcgcugaucaggaaaaggacaaagugaagaugaaaggguauaaucccgccgagguuggagcggcuggcaagggguaccuguggaaagccgccggcaugaacauggaagaggaagaggagcuccagcagaaucuguggggacuuaagaucaacauggaagaggaaagcgagucugaguccgaacaaagcauggauuccgaggaaccugacucucgcggcgggagcccccagauggaugacauuaaaguguuucagaaugagguccugggaacccuccagcggggcaaggaagagaacaucuccugugauaaucuggugcuggagauuaacucucuuaaguaugcuuacaauaucagccucaaagaaguuaugcaagugcugucccaugucgugcuggaguucccgcuccagcagauggacagcccucuggauucuuccagauauugcgcccuucugcucccccugcugaaggcuuggagcccuguguuucgcaacuacauuaaacgggccgcggaccaccuugaagcccucgcugccaucgaggauuucuuucuggaacaugaggcucuggggaucucuauggccaagguccucauggcguucuaucagcuggagauucuugccgaagagacaauccuguccugguuuagccaaagagacaccacggauaaaggacagcagcuccggaagaaucagcaacugcagcgcuucauucaguggcugaaggaagcugaggaagagucuagcgaggacgacuga

SEQ ID NO: 68745 - RNA, 948 nt, Artificial Sequence
  derived and/or modified sequence opt5 from EIF2S1__Homo_sapiens__NP_004085
augcccggccugagcugcagauucuaccagcacaaguuuccugagguggaagacgucguuauggugaacgugcgguccaucgccgagaugggggcuuaugucucucuccuggaauacaauaacauugagggaaugauccuucugagcgaacucucccgcagacggauucgcucuaucaauaaacugauuagaaucggccggaacgagugugugguugugauccgcgucgauaaggagaaaggguauauugaccuuagcaagagacggguguccccggaagaggccaucaaaugcgaagauaaguucaccaagucuaaaacaguuuacagcauucugcgccauguggcggagguccucgaguauacgaaggacgaacaacuggagucccuguuucagagaaccgcuuggguguucgaugacaaauacaagcggcccggauauggcgccuacgaugccuuuaaacacgcugugagcgacccuucuauccucgauucccuggaccuuaaugaagaugagcgcgaaguccugauuaacaauaucaacagacggcucacaccccaggccguuaagauucgcgcugacaucgagguggccuguuacggguaugagggaaucgaugcggugaaggaagcccugagagcuggccuuaauugcagcaccgagaacaugccuauuaaaaucaaucugauugcucccccucgguacgucaugacaaccacaacccucgaaagaacggagggccugucugugcugucccaggccauggccguuaucaaggagaaaauugaagagaagcgcgggguguucaacguccaaauggaaccgaaagugguuaccgacacagacgagaccgaacucgcgcggcagauggagagacuggaacgcgagaaugccgagguggauggagacgaugacgcugaagagauggaagccaaggcugaggauuga

SEQ ID NO: 68746 - RNA, 1002 nt, Artificial Sequence
  derived and/or modified sequence opt5 from EIF2S2__Homo_sapiens__NP_003899
augagcggcgacgagaugaucuucgaucccaccauguccaagaaaaagaaaaagaaaaagaagccuuuuaugcuggacgaagagggggauacacagacggaagagacccaaccgucugaaacaaaagagguggagcccgaaccuaccgaggacaaggaucucgaagccgacgaggaggauacacggaaaaaggacgcuagcgaugaccuggaugaccuuaacuucuuuaaucagaaaaagaagaaaaagaaaaccaagaaaauuuucgauaucgacgaagccgaggaaggagucaaggaccugaaaauugaguccgauguucaggaacccacagagccugaggacgaucucgacaucaugcugggcaacaagaagaaaaagaaaaagaaugugaaauuucccgaugaagacgagauucuugaaaaggaugaggcgcuggaagacgaggauaacaagaaagacgaugggaucucuuucagcaaucagaccggaccugcuugggccggcuccgagagagacuacacguaugaggaacuccugaaccgcguguuuaauaucaugagagaaaagaacccggacauggucgccggggagaaacggaaguucgugaugaaacccccucaaguugugcgcgucggaaccaagaagacaucuuuugugaauuucaccgauauuugcaaacugcuccacagacagcccaagcaucugcuugcuuuucugcucgccgaacugggcacaagcggcuccaucgacgggaacaaucagcuuguuauuaaaggacgguuccagcaaaagcagaucgagaacgugcugcgcagauacauuaaagaguaugucaccugucacacgugccggagcccugauacaauccuccagaaggacacccgccuguacuuucugcagugugaaacaugccauucuagauguuccguggcuagcauuaagaccggcuuccaagccgugaccgggaaacgggcgcagcuccgcgccaaggcuaauuga

SEQ ID NO: 68747 - RNA, 1419 nt, Artificial Sequence
  derived and/or modified sequence opt5 from EIF2S3__Homo_sapiens__NP_001406
auggccggcggggaggcuggagugacccugggccagccccaccucagcagacaagaccugacaacgcuugaugucaccaagcugacaccucucucccaugaaguuaucucucggcaggccaccauuaacaucgggacaauuggacacguggcgcauggcaaaagcaccguggucaaggcuaucuccggggugcacacaguucgcuucaaaaaugagcuggaaagaaacauuaccaucaaacuuggauacgccaaugccaaaaucuauaagcuggacgauccgucuugcccccggccugaguguuaccgcagcugcggcuccucuacgcccgacgaauuuccuaccgauauucccggcacaaaggggaacuucaaacucgugagacaugucagcuuuguggacuguccuggacacgauauccugauggcuaccaugcugaauggcgccgcuguuauggacgccgcgcuccugcuuauugccgggaacgaguccugcccgcagccccagacaagcgagcaccuggcugccaucgaaauuaugaagcucaaacauauccugauucuucaaaauaagaucgaucuggugaaagagucucaggcuaaggaacaguaugagcagauccucgccuucguccaaggaaccguggcggagggcgccccuauuauccccauuuccgcucagcugaaguacaacaucgaaguggucugugaguauauuguuaaaaagaucccugugcccccgcgggacuuuacgagcgaaccucgccugaucgugauuagaucuuucgaugucaauaaacccgggugcgagguggacgaucucaagggaggcguugccggcggguccauccugaaaggagugcuuaaggucggccaggaaauugaggugcggccugggaucguuagcaaagacucugagggaaagcugauguguaagcccaucuuuuccaaaauugugagccucuucgcugaacacaacgaccugcaguacgccgcccccggcgggcuuaucggagucggcacaaagauugauccuacccugugccgcgcugacagaauggugggccaaguccucggggcggugggagcccugccggagaucuuuacagaacuggagauuuccuauuuccuccugcggcgccuucugggcguuagaaccgaaggggauaaaaaggcugccaaagugcagaagcucucuaagaaugagguccugauggugaacaucggaagccuuuccaccggcgggcggguuagcgccgugaaagcugaccugggcaagauuguccucacaaaucccguguguacggaggugggagaaaagaucgcccugucucgcagaguugagaagcauuggcggcugauuggcugggggcagaucagacgcggagucaccaucaaaccuacaguggaugacgauuga

SEQ ID NO: 68748 - RNA, 4149 nt, Artificial Sequence
  derived and/or modified sequence opt5 from EIF3A__Homo_sapiens__NP_003741
augcccgccuacuuccagagaccugagaacgcucugaagcgggccaaugaauuucucgaggugggcaaaaagcaaccggcgcuggacguccuuuaugauguuaugaaaagcaagaaacaccgcaccuggcagaagauccaugaacccauuaugcugaaguaccucgagcugugcguggaccuuagaaaaucccaccuggcuaaggaagggcucuaucaguacaaaaacaucugucagcaagugaauauuaagucucuggaggaugucgugcgggccuaucugaaaauggccgaggaaaagacagaggcugccaaggaagagagccagcagaugguucucgacaucgaggaucuggacaacauucagacgccugaauccgugcuucugucugcugucagcggagaggauacccaagaccgcacagauagacuccugcuuacccccugggugaaauuccugugggaauccuaccggcagugccucgaccugcugcgcaauaacucuagaguugagcggcucuaucaugauaucgcccagcaggcguuuaaguucugucugcaauacacacgcaaagccgaauuuagaaaacuuugcgacaaucugcggaugcaccucagccagauccagcgccaucacaaccaauccaccgcuauuaaucugaacaauccugagagccagucuaugcaccuugagacaagacuggugcagcucgauuccgccaucagcauggaacuguggcaggaggcuuucaaagccgucgaagacauucauggccuguuuucucucuccaagaaacccccuaagccgcaacugauggcgaacuacuauaauaaggugagcaccguguucuggaaaucugggaacgcccuuuuucacgcuuccacgcugcaucggcucuaccaccugagccgcgagaugagaaagaaucuuacccaggacgaaaugcagcggauguccacaagaguccugcucgccacccugucuauccccauuacaccugagcgcaccgauaucgcucggcugcucgacauggauggaauuaucguugagaaacagagacgccuggccacgcuucugggccuccaagcucccccuacacggaucgggcugauuaacgacauggugagauucaacgugcugcaguaugucgugcccgaaguuaaggaucuuuacaauuggcucgagguggaauuuaacccgcugaaacugugugagcgcgucaccaaggugcucaauuggguucgggaacagccugagaaggagcccgaacugcagcaauaugugccucagcuucagaacaauacaauccugagacuccugcagcaagucagccagauuuaccaguccaucgaguucagccgccugaccucucuugugcccuuugucgacgccuuccaacucgaacgggcgauuguggaugccgcuagacacugcgaccugcagguucgcaucgaucauaccucccggacacugagcuucggaucugaccucaacuaugccacgagagaggaugcccccaucggcccucaucugcagagcaugccguccgagcagauucggaaucaacuuaccgcuaugucuagcgugcuggccaaagcgcucgaagucaucaagcccgcucacauucugcaggagaaagaagaacagcaccagcuggccgugacagccuaccuuaagaacucccgcaaagaacaucaaagaauccucgcucggagacagaccauugaggagcgcaaggaacggcuggagagccugaauauccagagagaaaaggaggaacucgagcagcgcgaggccgaacugcaaaaaguuagaaaggcugaggaggagcggcuucgccaggaagccaaagagagagagaaggaacggauccugcaggagcacgaacaaauuaaaaagaagacagugcgcgagagacucgagcagaucaaaaagaccgaacugggcgcgaaagccuuuaaggacauugacaucgaggaucuggaggaacuugacccugauuucauuauggcuaaacaggucgaacagcucgagaaggagaaaaaggaacugcaagagcggcugaagaaccaggaaaagaagaucgacuacuuugagcgcgccaaaagacucgaagagauuccccugaucaagucugcuuaugaggaacagcggaucaaagauauggaccuuugggagcagcaagaagaggaacgcauuacgacaaugcagcuggagagagagaaggcccucgaacacaagaaucggauguccagaaugcuggaggaucgcgaccuguucgugaugcggcuuaaagcggccagacagagcguguacgaagagaagcugaaacaguuugaggaacgccucgcugaggaacggcauaacagacuggaggaacgcaagcggcaaagaaaagaggagcgccggaucaccuauuacagagaaaaggaggaagaggaacagcggcgcgccgaggagcagaugcucaaggaaagagaggaacgggagcgcgcugaaagagccaaacgggaggaggaacugagagaguaucaggaacgcguuaagaaacuugaggaggucgaacggaagaaaagacaacgcgagcuggaaauugaggaacgggagagacgccgggaggaagagagacgccucggggauucuucccugagcagaaaggacucccgguggggagaucgcgacucugaaggcaccuggagaaaggggccugaggccgauagcgaauggcggcgcggacccccggagaaagaguggagacggggcgaagggagagacgaggaccgcucccaccggagagaugaggaacgcccucggagacugggagacgaugaagaccgggagcccucucuucgcccugaugacgauagagugccccggcgcggcauggacgaugacagaggcccucggcgcgggcccgaggaagauagauucagccggcgcggagcugacgaugacagaccguccuggcggaauacagacgaugacagaccuccccgccggaucgcggaugaggacagaggcaacuggcgccaugccgaugacgaucggcccccuagacgcgggcuggacgaagaucggggaagcuggagaaccgcugacgaggaucgcggcccgcggagagggauggacgacgaucgcggaccccggagaggcggcgccgacgaugagagaucuuccuggcgcaaugccgacgaugaccgggggccucgcagaggacucgaugacgaucggggccccagacgggggauggacgaugaccgcggaccuagacggggcauggaugacgaccgcgggcccagacggggcauggaugacgaucgcggaccuagacggggccuggacgaugaccgcgggcccuggagaaacgcugaugacgaucggauuccgcgcagaggagccgaagacgaucggggcccuuggcgcaacauggacgaugacagacucagccggagagcggacgaugaccgcuuuccccggagaggggaugacucucgcccuggacccuggcggccgcuggugaagccuggcggguggagagagaaagaaaaggcucgcgaggaauccuggggacccccucgggagagcagacccucugaggaacgcgagugggaucgggaaaaagagagagaccgcgauaaucaggaccgggaagagaacgauaaggaccccgagagagaacgggauagagagcgcgacgucgaccgggaagauagauuccgcagaccucgggacgagggcggcuggcgcagagggccggccgaagagagcuccagcuggcgggauucuucccgcagagacgaucgggaccgcgaugacagacggcgcgagagagaugaccggcgcgaucuuagagaacggagagaccugcgcgaugaccgggacagacgcggacccccucuccggagcgagagagaagagguguccucuuggcgccgggccgaugacagaaaagaugaccgcguugaggaacgggaucccccuagacgggugcccccuccggcucugagccgcgacagagagcgggaucgcgacagagaacgggagggcgaaaaggagaaggccuccuggagagcggagaaagaucgcgaaucucugcggagaacaaagaaugagacggacgaagauggguggaccacaguccgccgguga

SEQ ID NO: 68749 - RNA, 2445 nt, Artificial Sequence
  derived and/or modified sequence opt5 from EIF3B__Homo_sapiens__NP_001032360
augcaggacgccgagaacguggcuguccccgaagccgcggaggaaagagcugagccuggccaacagcagccggccgccgaacccccucccgcugaggggcugcuccggccugccggacccggcgcuccugaggccgcggggaccgaagccagcuccgaggaaguuggaaucgcugaggccggcccggagucugaagugcgcacagagcccgcugccgaagcggaggccgcuagcgggccuuccgaaucucccagcccucccgccgcugaggagcugccgggaucccacgccgaaccucccgugccugcccagggcgaggcucccggcgaacaagcgagagaugagcggucugacagccgcgcccaggcugucuccgaagaugccgggggaaaugagggcagagccgcugaggccgaaccccgggcgcuugagaacggggacgcugaugaaccuagcuucucugacccggaggauuuuguggacgauguuuccgaagaggagcugcucggagacgugcugaaggaucgcccccaggaagccgacggcauugauagcgucaucgugguugacaaugugccucaggucgggcccgacagacuugagaaacugaagaacgugauucauaaaaucuucucuaaguuuggaaaaauuacgaaugauuucuacccugaagaggacggcaagaccaagggcuauaucuuucucgaguacgccucccccgcucacgccguggaugcugucaaaaacgccgacggguauaagcuggauaaacaacauacauuccggguuaaucuguuuaccgacuucgauaaguacaugacaaucagcgacgaaugggauauuccggagaaacagccuuuuaaggaccucggaaaccugcgcuauuggcuugaagaggcggaaugcagagaucaguacucugugaucuucgaguccggcgaccggaccagcaucuuuuggaaugacgugaaggaucccgucuccauugaggaacgcgccagauggacagagaccuaugugcgguggucuccuaaagggacguaccuggcuaccuuccaccagcgcggaauugcccucuggggcggggaaaaguuuaaacaaauccagagauucagccaucagggaguucaacugauugacuucucccccugugagcgguaccuugugacauuuagcccucugauggauacccaggacgauccccaggcuaucaucauuugggacauccucacaggccacaagaaaagaggcuuccacugcgaaucuuccgcccauuggccgauuuuuaaguggagccacgaugggaaauucuuugcgcgcaugacccuggacacgcugucuaucuaugagacaccuagcaugggacuccuggauaagaagucccuuaaaauuucuggcaucaaggacuucagcuggucccccgggggaaacaucauugccuuuuggguccccgaggauaaagacaucccugcucgggugacccugaugcagcucccgacaagacaagaaauucgcguucggaaucuguucaacguggucgauuguaaacuucauuggcagaagaauggcgacuaccugugcgugaaggucgacagaacccccaaggggacccagggcgugguuacaaacuuugagaucuuccgcaugcgggaaaaacaggugccugucgaugugguugagaugaaggaaacgauuaucgccuuugcuugggagcccaauggaagcaaauucgccgugcuccacggcgaggccccuagaaucucugucuccuuuuaucacgugaagaacaacgggaaaauugaacugaucaagauguucgacaagcaacaggcuaauaccauuuucuggagcccccagggacaguuugugguucuggcgggccuccgcucuaugaacggggcccuggcuuucgucgauacauccgacuguaccgugaugaauaucgccgagcauuacauggccagcgauguggaaugggacccuacaggacgguaugucgugaccuccguuucuugguggagccacaaaguggauaacgcuuacuggcuuuggacguuucaaggcagacugcuccagaagaauaacaaagaccgcuucugccagcugcuuuggcggcccagaccgccuacacugcucucccaggagcaaauuaagcagaucaaaaaggaucugaagaaauauucuaagauuuuugagcagaaagaccggcugagccaauccaaggccagcaaagaacucgucgagcgcagacggaccaugauggaagauuucagaaaguaccgcaaaauggcgcaggagcuguacauggaacagaagaaugagcggcuugagcugagagggggcguggacaccgaugaacucgacucuaacguugacgauugggaggaagagacaaucgaauuuuucgugaccgaggagaucauuccccugggaaaucaggaauga

SEQ ID NO: 68750 - RNA, 2742 nt, Artificial Sequence
  derived and/or modified sequence opt5 from EIF3C__Homo_sapiens__NP_001254503
augagcagauucuuuaccacaggcuccgacucugagagcgaauccucucugagcggggaggaacucgugacgaagcccgucggaggcaacuacgggaaacagccucugcuucuguccgaggaugaagaggacaccaagcggguugugcgcucugccaaagauaagagauucgaggaacucacaaaucugauccggaccauucgcaacgcuaugaaaaucagagacgugacaaagugccuugaggaauuugagcugcucggaaaggccuauggcaaagcgaaaagcauugucgauaaagagggggugccgcgguucuacauccgcauucuggcugaccuggaagauuaucucaaugagcugugggaagacaaggagggcaaaaagaagaugaacaaaaauaacgccaaggcccuuuccacccugagacaaaagauccggaaguacaaucgcgauuuugaaagccacaucacaucuuauaaacagaaccccgagcaguccgcugacgaggaugccgaaaagaaugaggaagacagcgagggaucuuccgaugaagacgaggacgaggauggcguuagcgcugccaccuuccucaaaaagaagucugaagcgccuuccggggagagcagaaaauuucugaagaaaauggacgaugaagacgaggauuccgaagacucugaggaugacgaggauugggacacgggaagcaccuccagcgauucugacuccgaagaggaagagggcaagcagacagcccuugcuagccgguuccugaaaaaggcccccaccacagacgaggauaagaaagcugccgaaaagaaacgcgaggacaaggcgaaaaagaagcaugauagaaaaucuaagcggcucgacgaagaggaagaggauaacgaagggggagaaugggagcgcgugagaggcggggucccucuggugaaagaaaagcccaaaauguuugccaagggaaccgagauuacgcacgcuguugugaucaagaaacugaaugaaauucuccaagcccggggcaagaaaggcacagacagagcugcccagaucgagcugcuucagcugcucguccagauugccgcugagaacaaucugggggaaggagugaucgugaagauuaaauucaacaucaucgcgagccuuuacgauuauaauccuaaccuggccaccuacaugaagccggagauguggggcaaaugucucgacugcauuaacgaacugauggauauccuguuugcuaaucccaacauuuucgucggggagaauauccucgaagaguccgagaaccugcauaaugccgaccaaccucuucgcguucggggauguauucugacacucguggaaagaauggaugaggaauuuaccaagaucaugcagaacaccgacccccacucucaggaguacguggagcaucugaaggaugaagcccaggucugcgcuaucauugagcgcgugcaacgguaucuugaagagaaaggcacaacggaagagguuuguagaaucuaccugcuccgcauucugcacaccuauuacaaguucgacuauaaagcccaccagcggcagcugacaccucccgaggggagcuccaagagcgaacaagaccaggcggagaaugaaggagaggauucugcugugcucauggaaagacugugcaaauacaucuaugccaaggaccgcaccgaucggauuagaacaugugccauccuuugccauaucuaccaccaugcucugcacucccgcugguaccaggcccgggaccucaugcugaugagccaucugcaggauaacauucaacacgcugacccgccuguccagauccuuuauaauagaaccauggugcagcucggcauuugugccuuccggcagggccugacgaaggaugcgcacaacgcccugcucgacauccaaucuuccgggcgcgcuaaagagcugcuuggacagggccugcuccugagaagccugcaggagcggaaucaggaacaagagaagguugaaagacgcagacaggugcccuuucaucuucacauuaaccucgagcugcuggaaugcgucuaccucguguccgccaugcugcuugagaucccuuauauggcugcccaugagucugaugcgcggcgcagaaugauuagcaaacaguuccaccaccagcugcgggucggggaacgccaaccccuccugggacccccugaguccaugagagaacaugugguugccgcuucuaaggccaugaaaaugggcgacuggaagacaugucacagcuuuaucaucaaugagaagaugaacgggaaagugugggaucuguucccggaggcugacaagguccggaccaugcuugugcgcaaaauucaggaagagucccucagaaccuaccuguuuacauauagcucuguuuacgauuccaucagcauggaaacccugucugacauguucgagcucgaccugcccacagugcauuccauuaucagcaagaugauuaucaaugaggagcuuauggccucucuggaucagccuacgcaaaccgucgugaugcaccggacagagcccaccgcccagcagaaccucgcucugcagcuggcggaaaaacuuggcagccucguggagaacaaugaacgcguuuuugaccacaagcaaggaacauauggcggguacuucagagaucagaaggacggauaccggaaaaacgagggcuauaugcgcagagggggauaccggcagcagcaaucccagaccgccuauuga

SEQ ID NO: 68751 - RNA, 1338 nt, Artificial Sequence
  derived and/or modified sequence opt5 from EIF3E__Homo_sapiens__NP_001559
auggccgaguacgaccugaccacaagaaucgcucacuuccucgaucggcaucugguguuuccccuucuggaguuccucagcgucaaggaaauuuauaacgaaaaagagcugcuucagggcaagcuggaccuccuguccgauacgaauaugguugacuuugccauggauguguacaaaaaccuguauucugacgauaucccucacgcgcuccgcgaaaagagaaccacaguggucgcucaacugaaacagcuucaggccgagaccgagccgauugugaagauguucgaagaccccgagacaacccggcagaugcaaagcacacgcgaugggagaaugcuguuugacuaccucgccgauaagcauggauuccggcaggaauaucuggacacccuuuaccgcuaugcuaaauuucaguacgagugcggcaauuacuccggggccgcugaguaucuguacuucuuuagaguucucgugccugccacggaucggaacgcgcugucuagccuguggggaaagcucgccuccgaaauccugaugcagaauugggacgcugccauggaggaccuuacccgccugaaagaaacaauugauaacaauucugucagcagcccccuccaaucccugcagcagagaaccuggcuuauccacuggucucuguucguguuuuucaaccauccuaagggccgggacaauaucauugaucucuuucuguaucagccccaauaccugaacgcuauccagacaauguguccucacauucuccgcuaucugaccacggccguuaucacaaauaaagacgugagaaagcggcgccagguccuuaaggaucuggugaaagugauucaacaggaguccuacaccuauaaggacccgaucacagaguucgucgaaugccucuacguuaacuucgauuuugacggggcgcagaaaaagcugagagagugugaaagcgugcuugugaaugauuucuuucuggucgccugccucgaggacuucauugaaaacgcucggcuguuuaucuucgagaccuuuuguagaauccaccagugcauuucuaucaauaugcuggccgauaaacucaacaugacccccgaagaggcugagcgcuggauugugaaccugauccggaaugccagacuugacgccaagauugacuccaaacugggacauguugugaugggcaacaaugcugucagcccuuaccaacaggugaucgaaaagacaaagucucucuccuuccgcagccagaugcuggcgaugaacaucgagaaaaagcugaaucagaacucccggucugaagcccccaauugggcuacgcaagauagcggcuuuuauuga

SEQ ID NO: 68752 - RNA, 1074 nt, Artificial Sequence
  derived and/or modified sequence opt5 from EIF3F__Homo_sapiens__NP_003745
auggccacccccgcugugccugucagcgccccgcccgcgacaccuacgcccguuccugcugccgcccccgcuuccgugccugccccgacccccgcuccugccgcggcccccgugccugcugccgcucccgccucuagcuccgacccggcggccgcugccgcugccacagccgcuccuggccagacccccgcgucugcccaagcuccugcccagacacccgcccccgcucugccugggccggcccuccccggaccuuuccccggcgggagagucgugcggcugcacccuguuauccuugcgagcauuguggauuccuacgagcgcagaaacgaaggagcugcccgggucaucggcacccugcucgggacaguggacaagcauucuguugaggugaccaauugcuuuagcgucccccacaacgaauccgaggaugaaguggccguggacauggaguucgcuaaaaauauguaugagcugcauaagaaagucagcccgaacgaacuuauucugggaugguacgccacgggccacgauaucaccgagcauucuguucucauucacgaauauuacucccgcgaggcuccuaaucccauccaccugacaguggacaccagccugcagaacggcagaaugucuaucaaggccuauguguccacacucaugggggucccuggacggaccaugggcgugauguuuacgccccugacaguuaaauacgcguauuacgauaccgagcgcauugggguggaccuuaucaugaagacauguuucagcccuaauagagucauuggacugucuuccgaucuccagcaagugggcggggccagcgcucggauccaggacgcccuguccaccguucuucaguacgcugaagaugugcugucuggaaaggucagcgccgacaacaccgugggccgcuuucucaugucccuggucaaucaggugcccaaaauuguuccggaugacuucgagacaaugcugaacagcaauaucaacgaccuccugauggugacguaucuugcgaaucugacccaaucucagauugcccucaacgaaaagcuggucaaucuuuga

SEQ ID NO: 68753 - RNA, 1059 nt, Artificial Sequence
  derived and/or modified sequence opt5 from EIF3H__Homo_sapiens__NP_003747
auggccagcagaaaggagggcaccggguccacagcuacgucuagcuccucuaccgccggagcggcuggcaaagggaagggaaaaggcgggagcggagacuccgccgugaagcagguccaaaucgauggccugguugugcucaaaauuaucaagcacuaccaggaagagggccaggggacagaagugguccagggagugcugcuuggccugguuguggaggaccggcucgaaauuaccaacugcuuccccuuuccucaacauacagaggaugacgccgauuucgacgagguccaguaucagauggaaaugaugcgcucucugagacacgugaauaucgaucaucuucacguugggugguaccagagcaccuauuacggauccuuugugacacgggcucugcucgacagccaauucucuuaucagcaugccauugaggaauccgucgugcugaucuacgauccgaucaagaccgcucagggcagccugucucucaaagccuaucgccugacgcccaaacuuauggagguguguaaggagaaggacuuuuccccugaagcgcugaaaaaggccaacauuaccuucgaguacauguuugaagagguccccaucguuauuaagaauagccaccucaucaacgugcugaugugggaacuugagaaaaagucugcuguggccgauaaacacgagcugcucucccuggcuagcuccaaucaucuggggaagaaccuccagcugcuuauggacagagucgaugaaaugucucaagacauugugaaauacaauacauauaugcggaacaccagcaagcagcagcaacagaaacaccaguaccagcaacgcagacagcaggagaauaugcagcggcaaucccgcggagaaccuccccugccugaggaagaccucagcaagcuguucaagccgccccagccucccgccagaauggauucucuucugaucgcgggccagauuaacacauauugccagaauaucaaagaguuuaccgcccaaaaccucggcaagcuguucauggcucaggcccugcaggaguacaauaacuga

SEQ ID NO: 68754 - RNA, 630 nt, Artificial Sequence
  derived and/or modified sequence opt5 from EIF3J__Homo_sapiens__NP_001271265
auggccgcugccgcggcugccgccggcgacagcgauuccugggacgcugaugccuucucuguggaggaccccgucagaaagguugggggaggcgggaccgcuggaggcgaucggugggaaggggaggacgaagaugaggacgugaaacuggaggaaccugaggaaccgaaggugcucacacccgaggaacagcuggccgauaaacuucgccugaagaaacuccaagaggagagcgaccuggaacuugcgaaggagacguuuggagucaacaaugccguguacggcaucgaugcuaugaacccuuccucuagagacgauuucaccgaauuuggcaagcugcucaaagacaagauuacacaguaugagaaaagccuguacuaugccuccuuccuggaaguucucgugcgggacgucugcaucucucuggagauugaugaccuuaagaaaaucaccaauagccugacagugcucuguuccgagaagcagaagcaggaaaaacaaagcaaggcuaaaaagaaaaagaaagggguugugcccggaggcgggcugaaggccaccaugaaggaugaccuugcggauuacggaggcuaugacgggggauacguccaggauuaugaggacuuuauguga

SEQ ID NO: 68755 - RNA, 657 nt, Artificial Sequence
  derived and/or modified sequence opt5 from EIF3K__Homo_sapiens__NP_037366
auggccauguucgagcagaugagagcuaacgugggcaagcugcucaaagggaucgaccgguacaaucccgaaaaccuggccacccuugagcgcuaugucgaaacacaagcgaaggagaaugcuuacgaucuggaagccaaccucgccguucugaaacuuuaucaguuuaauccugcuuucuuucagacgaccgugacagcccagauucugcucaaggcucugaccaaccugccgcacacagacuucacccucugcaaauguaugaucgaucaagcccaucaggaggagagacccauucggcagauccuguaccuuggagaccugcucgaaacaugccacuuucaggcguucuggcaagcccuggaugagaauauggaccuucuggaaggcauuaccggguuugaggauagcgugcgcaaguucaucugucaugucgugggaaucacguaucagcacauugacagauggcuccuggcugagaugcugggcgaucucuccgacucucagcugaagguuuggaugagcaaauacgggugguccgccgaugaaucuggacagaucuuuauuugcagccaagaggaauccaucaagccuaaaaacauuguggagaagaucgacuucgauucugucagcuccauuauggcuagcucucaguga

SEQ ID NO: 68756 - RNA, 1125 nt, Artificial Sequence
  derived and/or modified sequence opt5 from EIF3M__Homo_sapiens__NP_006351
augagcgugcccgccuucaucgacauuuccgaggaagaucaggcugccgagcugagagcguaccucaagucuaaaggcgcugaaaucagcgaggaaaacuccgaagggggacugcacgucgaccuugcccaaauuaucgaggccugcgauguuugucugaaggaagacgauaaagacguggagucugugaugaauagcgucgugucccuccugcuuauucuggaaccugauaagcaggaggcucucaucgagucucugugcgaaaaacugguuaaguuucgggagggcgaacgcccgagccucagacugcagcuucuguccaaccucuuccaugggauggacaagaauacccccgugcgguauacagucuacuguagccugaucaaaguggccgcuucuugcggagccauucaguauaucccuacggagcuugaucaaguucgcaaguggauuuccgacuggaaccugaccacagaaaagaagcacacccuccugagacugcucuacgaggcgcugguggauuguaaaaagagcgacgccgcuucuaaggucaugguggagcuucugggcuccuauacagaagauaaugccagccaggcucggguggacgcccaucgcugcaucgucagagcgcucaaagaccccaacgccuuucuguucgaucaccuucugacccucaagccuguuaaauuucuggagggggaacugauucaugaccuccugacaaucuucgugucugcuaaacuugccuccuacgugaaauuuuaucagaauaacaaggauuucauugacagccugggacuccugcacgagcagaauauggcuaaaaugcggcuucugaccuuuaugggcauggccgucgaaaacaaggagaucuccuucgauacgaugcaacaggagcuccagaucggcgccgacgauguggaggcuuuuguuauugacgcggugcgcaccaagauggucuacuguaaaaucgaucagacacaaagaaaggugguugugucucacagcacccaucggacauucgggaaacagcaguggcaacagcuguacgacacccugaaugccuggaagcagaaccucaauaaagucaagaacucccugcuuagccugucugauacguga

SEQ ID NO: 68757 - RNA, 1044 nt, Artificial Sequence
  derived and/or modified sequence opt5 from EIF4A1__Homo_sapiens__NP_001191439
augagcgccucccaggacucuagaagccgggauaacggccccgacgggauggagccugaaggagugaucgaguccaauuggaacgaaauugucgauucuuucgacgauaugaaucugagcgagucccuccugcgcggcaucuacgcuuauggguuugaaaagccgucugccauucaacagagagcgauccuucccugcauuaaaggauacgacguuaucgcucaggcccagagcggcaccgggaagacagccacguucgcuaucuccauucugcaacagaucgagcucgaucugaaagccacccaggcucuugugcuggccccuacacgggagcucgcgcagcaaauucagaagguggucauggcccugggagacuauaugggcgcuagcugucacgccugcaucggcgggaccaacgugcgcgcugaaguucagaaacugcagauggaggcgccccauauuaucgugggaacaccuggcagagucuuugauaugcucaaucggcgcuaccugucucccaaguauauuaagauguucgugcuugacgaagccgaugagaugcuguccagaggguuuaaagaccaaaucuacgauaucuuccagaagcucaacagcaauacccagguugugcugcuuucugccacaaugccuuccgacguccuggaggugaccaaaaaguuuaugcgggacccgauucgcauccucgugaaaaaggaggaacugacgcuggaaggaauuagacaauucuauaucaacgucgagcgggaagaguggaagcucgauacccugugugaccuuuacgagacacugaccauuacacaggcuguuaucuuuaucaauacccgcagaaaaguggauuggcucacggaaaagaugcacgcccgggacuucacagugagcgcuaugcauggcgauauggaccagaaagagcgcgaugucauuaugagagaauuucggucuggguccagcagagugcugaucaccacagaccuucugggaaagcucuacccccagaaccgcucccgguggaccguuuggccuuga

SEQ ID NO: 68758 - RNA, 1224 nt, Artificial Sequence
  derived and/or modified sequence opt5 from EIF4A2__Homo_sapiens__NP_001958
augagcggcggguccgccgacuacaacagagagcacggaggccccgaagggauggauccugacggagugaucgagucuaauuggaacgaaauugucgauaauuucgacgauaugaaccugaaggagagccuccugcggggcaucuaugcuuacggguuugaaaaaccguccgccauucagcaacgcgcgaucauucccugcaucaagggauaugacguuaucgcucaggcccagucuggcaccggcaaaacagccacguucgcuauuagcauccuucagcaacuggagauugaguuuaaggaaacccaggcccucgugcuggcuccuacaagagagcuugcccagcagauccaaaaagugauucuggcgcucggggauuacaugggagccaccugucaugcuugcaucggcgggacaaauguccggaacgaaaugcagaagcugcaggccgaggcuccccacauugugguuggaaccccuggccgcguguucgacaugcugaauagacgguaucucucccccaaguggaucaaaauguuuguccuggaugaggccgacgaaaugcuuucucgcggguucaaggaucagaucuacgagauuuuucaaaaacugaacacaagcauccaggugguucuccuguccgcgaccaugccuacggacgugcuugaagucaccaagaaauucaugagagauccgauucggauccuggugaagaaggaggaacucacacuggagggaauuaaacaguuuuauaucaauguggagcgcgaagaguggaagcuggacacccucugugaccuguacgaaacacuuaccaucacgcaagccgucauuuuccugaacacaagacggaaaguugauuggcucaccgagaagaugcaugcucgcgacuuuacagugagcgcccugcacggcgauauggaccagaaagaaagagaugugaucaugcgggaguuccgcucuggcuccagcagaguccuuauuaccaccgaccugcucgcucgggggaucgaugugcagcagguuucucuggugauuaauuacgaccugcccacaaacagagagaauuauauccaucgcaucggacggggcgggagauuuggacgcaagggcgucgccauuaacuucgugacggaagaggauaaacggauccucagagacauugaaaccuucuacaauacaaccguugaggaaaugccuaugaacguggccgaucugaucuga

SEQ ID NO: 68759 - RNA, 1236 nt, Artificial Sequence
  derived and/or modified sequence opt5 from EIF4A3__Homo_sapiens__NP_055555
auggccaccacagcuacgauggccaccagcggcuccgcgagaaagcggcugcucaaagaggaagacaugacaaagguggaguucgaaaccucugaggaagucgauguuacacccaccuuugacacaauggggcugcgcgaggaucuucugagaggaaucuacgcuuauggcuucgagaaaccuagcgccauucagcaacgggccaucaagcagauuaucaaagggcgcgacgugauugcucagucccagucuggaaccggcaagacggccaccuuuagcaucuccgugcuccaaugccuggauauccaggucagagaaacacaggcucuuauucuggccccgacccgggagcucgcggugcagauccaaaaggggcugcuggcccucggagacuacaugaacguucagugucacgcuugcauuggcggcacaaaugugggggaagauauccgcaaacuggacuauggacagcaugucguggccggcacccccgggagaguuuucgauaugauucggcgcagaucucuucggacgcgcgcuaucaagaugcuggugcucgacgaggccgaugagaugcugaacaaaggauuuaaggaacagauuuacgacgucuauagauaccuuccucccgcgacacaaguggugcugaucagcgccacccucccucacgagauccuggaaaugacaaauaaauucaugaccgaucccauucggauccuggucaagcgcgacgagcucacccuggaaggcauuaagcaguuuuucguugcuguggagagagaggaauggaaauuugacacacuuugugaucuguaugacacgcucaccaucacacaggccgugauuuucugcaacaccaagcggaaagucgauuggcugacagagaagaugagagaagcuaauuuuaccguguccagcaugcauggggacaugccucaaaaagagcgcgaaucuaucaugaaggaguuccgguccggagccagcagaguucuuaucucuacggaugugugggcccgcggccuggacgucccccaggugucccucauuaucaacuacgaucugccgaauaaccgggagcuguacauucacagaaucggccgcagcgggcgguauggaagaaaaggcguugcuauuaauuuugugaagaacgacgauauccgcauccuccgggacauugaacaguacuauucuacacagaucgaugagaugccuaugaaugucgcggaccugauuuga

SEQ ID NO: 68760 - RNA, 1836 nt, Artificial Sequence
  derived and/or modified sequence opt5 from EIF4B__Homo_sapiens__NP_001408
auggccgcuagcgccaagaaaaagaacaaaaagggcaaaaccaucucccugacagacuuccucgcggaggaugggggaacgggcgggggaucuaccuacgugagcaagcccgucuccugggcugacgaaacagaugaccuggagggcgauguuucuaccacauggcacagcaaugacgaugacguguauagagccccuccgauugaucgguccauccuucccaccgccccucgcgcugccagagaacccaacauugaccggucucgccugccuaagagcccucccuacacagcuuuucucgggaaucugccguaugaugugaccgaggaauccaucaaagaguucuuuagaggacuuaacauuagcgccguccggcugccccgcgagccuucuaaucccgaaagacucaagggcuucggcuacgcggaguuugaagaccuggauucccugcucagcgcccugucucuuaacgaggagucccuggggaaucggcgcaucagaguggacguugcugaccaggcccaagauaaagaccgggaugaccgcagcuucggaagagaucggaaccgcgacucugauaagacggacaccgauuggagagcucggccugccacagacuccuuugaugacuaucccccgagacgcggcgacgauagcuucggggacaaauaccgggauagauaugacuccgaucgcuaccgggacggauacagagauggcuaucgcgacgggccucggagagauauggaccgcuacggaggccgggauagauaugacgaucgcggcucucgggacuacgacagaggguaugauagccggaucggauccggccgcagagcguuugggagcggauaccggagagacgaugacuaucgcggcgggggagaucgguacgaagacagauacgaucgcagagacgaucggucuugguccagccgcgacgauuauucuagagacgauuaccggcgcgacgacagagggcccccucagcggcccaagcucaaucugaagccccgcagcaccccuaaagaggaugacuccucugccagcacaucccagagcaccagagcugccucuauuuucggcggcgcuaagccgguggauacggccgcccgggaacgcgaggucgaagagagacuucagaaagagcaagaaaagcugcagcggcagcucgacgagcccaaacuggaaagacgcccucgggagagacaucccuccuggcgcagcgaagagacacaggagcgggaaagaucucgcaccggauccgagagcucccaaacaggcaccucuaccacaagcucccggaacgcuagacgccgggaaucugaaaagagccuggagaaugagacgcucaacaaagaggaagauugccacuccccuaccagcaagcccccgaagccugaccagccccugaaagugaugccugcgcccccucccaaggagaaugccuggguuaaaagaucuuccaacccgccugcucggagccagucuuccgauacagaacagcaaagccccaccucugggggaggcaagguggcccccgcccagccuagcgaggaggggccgggccgcaaagacgaaaauaaggucgauggaaugaacgcucccaagggccagacagggaacuccagcagaggaccuggcgacgggggaaaucgggaucauuggaaagagucugaccgcaaggacggcaaaaaggaucaagacuccagaagcgcccccgaaccuaaaaagcccgaggaaaacccugcguccaaguuuucuagcgcuuccaaauaugccgcccuuucuguggauggggaggacgagaaugaaggcgaggauuacgcugaauga

SEQ ID NO: 68761 - RNA, 705 nt, Artificial Sequence
  derived and/or modified sequence opt5 from EIF4E2__Homo_sapiens__NP_001263265
augaacaauaaguucgacgcccugaaagaugacgauagcggcgaccacgaucagaacgaggaaaauuccacccaaaaggacggggagaaagaaaagacagagagagauaaaaaccagucuagcuccaagcggaaggcugugguccccggaccugccgaacauccgcuccaguacaauuauacguuuugguacucucgcagaacccccggccggccuacaagcucccagucuuaugagcaaaacaucaaacagauugggaccuucgcgagcguugagcaguuuuggcgcuucuacucccacauggugagacccggagaccugacaggccauagcgauuuucaccuuuucaaggaagggaucaaaccuaugugggaggacgaugcuaauaagaacggaggcaaauggauuauccggcugcgcaagggccucgccucuagaugcugggaaaaucugauucuugccaugcugggggagcaguuuauggugggagaggaaaucuguggcgcugucguguccguucgguuccaagaggacaucauuagcaucuggaacaagaccgccucugaucaggcuacaaccgcccgcauuagagacacgcuccggcgcgugcugaaucugcccccuaacaccaucauggaauauaaaacacauaccgacuccauuaaggauaauagcucuuuuagaaacacaaaaaucacccucuga

SEQ ID NO: 68762 - RNA, 357 nt, Artificial Sequence
  derived and/or modified sequence opt5 from EIF4E3__Homo_sapiens__NP_001128121
augagaggcgagcggcgcccccugugggaagaggaaagcaacgccaaagggggaguguggaagaugaaggucccuaaagacuccaccucuacaguuuggaaggagcuccugcuugcuacgaucggcgaacaguucaccgauugcgccgcggcugacgaugaggugauuggggugagcgucuccgugagagaccgggaggauguugugcaagucuggaaugugaacgccucucugguuggagaagccacagugcucgagaaaaucuacgaacugcuuccgcacauuaccuuuaaggcugucuucuauaagccccaugaggagcaccaugccuuugaaggcgggcgcggaaaacacuga

SEQ ID NO: 68763 - RNA, 357 nt, Artificial Sequence
  derived and/or modified sequence opt5 from EIF4EBP1__Homo_sapiens__NP_004086
augagcggcggguccucuugcagccagacccccuccagagccaucccugcuacacggcgcgugguccugggagacggcguucaacucccgcccggggauuacucuacgaccccuggaggcacacuguucagcaccacacccgggggaaccagaauuaucuaugaccggaaguuucuuauggagugucgcaacuccccugugacaaaaacgcccccuagagaucugccgaccauucccggcgugaccucuccuagcuccgacgaacccccuauggaggccagccagucucaccuccgcaauucccccgaagauaagcgggcgggcggggaggaaagccaguucgagauggacaucuga

SEQ ID NO: 68764 - RNA, 363 nt, Artificial Sequence
  derived and/or modified sequence opt5 from EIF4EBP2__Homo_sapiens__NP_004087
augagcuccucugccggcagcgggcaccagcccucccaaucuagagcuaucccuacccggacaguggccauuagcgacgcggcucagcugccgcaugauuacugcacgacccccggaggcacacucuucuccaccacaccugggggaacccgcaucauuuaugacagaaaguuucugcuugaucggcgcaacucucccauggcccagacaccucccugucaucugccuaauaucccgggcgucaccagccccgggacgcucauugaggacuccaaaguugaagugaacaaucugaacaaucuuaacaaucacgauagaaagcacgccgugggagacgaugcucaguucgagauggacaucuga

SEQ ID NO: 68765 - RNA, 303 nt, Artificial Sequence
  derived and/or modified sequence opt5 from EIF4EBP3__Homo_sapiens__NP_003723
augagcaccuccacaucuugccccaucccuggcgggagagaccagcugccggauuguuacagcacgacccccggaggcacacucuaugccaccacaccugggggaacccggauuaucuacgaccgcaaguuccugcuugagugcaaaaacucccccauugcuagaacaccucccuguugccugccucaaaucccgggcgugaccacgcccccuaccgcgccccucucuaagcuggaggaacuuaaagaacaggagacagaagaggagauuccugaugacgcccaguuugaaauggauaucuga

SEQ ID NO: 68766 - RNA, 714 nt, Artificial Sequence
  derived and/or modified sequence opt5 from EIF4E__Homo_sapiens__NP_001124150
augcuggaccucaccagcagaggccagguggggacaucccggcgcauggccgaggcugccugcucugcgcacuuccuggaaacgacccccacaccuaacccgcccaccacagaggaagagaagaccgaaagcaaucaagaggucgcuaacccugagcauuacaucaaacacccccuucagaauagaugggcccugugguuuuucaagaacgauaaauccaagacauggcaggccaaucuccggcugauuucuaaauuugacaccguugaagauuucugggcucuuuauaaccauauccagcugagcuccaaucucaugccuggaugugacuacucucuguuuaaggauggcauugagcccaugugggaagacgagaagaacaaacgcgggggaagauggcugaucacgcucaauaagcaacagcggcgcagcgaucuggacagauucuggcuugagacccugcucugccugauuggcgaauccuuugaugacuauagcgaugacguguguggggccguggucaacgugcgggcuaaaggagauaagaucgccaucuggacaaccgagugcgaaaaucgcgaggcgguuacacacauuggcagaguguacaaagaacggcuuggccugccuccgaagaucgucauuggguaucagucucaugccgacaccgcuacgaaguccggaagcacaaccaaaaaccgcuucgugguuuga

SEQ ID NO: 68767 - RNA, 2436 nt, Artificial Sequence
  derived and/or modified sequence opt5 from EIF4ENIF1__Homo_sapiens__NP_001157974
auggacagacggagcaugggcgagaccgaauccggggaugccuuccuggaccucaagaaacccccugcuucuaagugcccgcaccgcuacaccaaagaggaacugcuugauaucaaggagcugccccauagcaaacagagaccuuccugucucucugaaaaguaugacagcgauggagugugggaccccgagaaguggcacgccucccuguacccugcgucuggccggagcucccccgucgagagccuuaaaaaggaacuggauacggaccgcccuucucucguuagacggauuguggggaucguggagugcaacggaggcgucgcugaagaggaugagguggaaguuauucuggcccaagagccggccgcugaccaggaagugccccgcgaugccguccugccugagcagucccccggggacuuugauuucaaugaauuuuucaaccucgacaaagugccuugucuggcuagcaugaucgaggacguucuuggagagggcucuguguccgccagcagauuuucucggugguucuccaaucccagccgcuccggcucuagaagcuccagccuggggucuaccccgcaugaggaacucgaacggcuggcgggacuugagcaggccauucuguccccuggccaaaacagcgggaauuauuuugcucccaucccucucgaagaucacgccgagaacaaggucgacauccuggagaugcugcagaaagcuaagguggaucucaagccccugcuuucuagccuguccgccaauaaagaaaagcucaaagagucuagccauuccggagugguccugagcguugaagagguggaagcgggccuuaaggggcugaaaguggaccagcaggucaagaacucuacacccuucauggccgagcaccucgaggaaacccuguccgcugugacaaauaaccgccaacugaaaaaggauggagacaugaccgccuuuaauaagcucguuagcacaaugaaaagaaaccuggagucucaccuuauguccccugcugaaauuccgggccagcccgugccuaagaauauccugcaggagcuccugggccagcccguccaacggccugccagcuccaaccuucugucugggcucaugggaagccuggagcccaccacgucccugcucggccagcgcgccccgucuccuccccugagccagguguuccaaaccagagcugcguccgccgauuaccuucggccucgcauucccagcccuaucggguuuacacccggaccgcagcagcugcucggcgacccuuuccaggggaugagaaaacccaugucucccauuaccgcucaacagaugucccagcuggaacugcagcaagccgcccuugagggacucgcucugccucaugaucuggccguucaggcggcuaauuuuuaucagccgggcuucggcaagccccagguggaccggacaagagauggguuccgcaaccggcaacagagagucaccaaaagcccugcccccgugcaccgcggaaacucuuccagcccugcccccgcugccucuaucacgagcaugcucuccccuagcuuuacacccaccucugucauucggaagauguacgaauccaaggagaaaagcaaggaggaaccggcuuccggcaaagccgcgcugggggacucuaaggaggacacacagaaagccagcgaagagaaucuucuguccucuagcuccgugccuucugcugauagagacagcucccccaccaccaacagcaagcucucugcccugcagcgcuccagcugcucuacaccucugucccaagcuaaucgguauacgaaggaacaggauuacagacccaaagccaccggacgcaagacaccgacccuugcgagcccuguucccacaaccccuuuccuccggcccgugcaucaggucccccuggugccucacguuccgauggugagacccgcccaccaacugcauccuggccucguccagcggaugcuggcucagggggugcacccccagcaucuuccuucucugcuccaaacgggcgugcugcccccuggaauggaccugucccaccuucagggcaucagcgggccgauccucggacagcccuuuuacccucugcccgccgcuucccauccucugcucaacccccgcccgggcacaccucugcaccuugccaugguucagcaacagcugcagagaagcguccuccacccucccgggucuggaagccaugccgcugcgguguccgugcagaccacaccccaaaauguccccucucggagcggccugccucacaugcauucccagcuggagcacagaccgucucagcgcagcuccucucccguggggcuugccaaaugguucggcagcgauguucuccaacagccucugcccuccaugccugcuaaggugauuagcgucgacgaacuggaguaucggcaguga

SEQ ID NO: 68768 - RNA, 4821 nt, Artificial Sequence
  derived and/or modified sequence opt5 from EIF4G1__Homo_sapiens__NP_001181876
augaacaaggcuccccagagcaccggcccuccgcccgccccuucccccgggcugccucaacccgccuucccuccgggacagacagcgcccguggucuuuucuacgccucaggcuacccagaugaauacacccagccaaccuagacagggcggguuccggucccuccagcacuuuuaccccucucgcgcccagccgccuagcuccgccgcuucuagaguucaaagcgccgcucccgcccggccuggacccgcggcccauguguaucccgcuggcucccaggugaugaugaucccuagccagauuucuuacccggccucccagggggcuuauuacauccccggacaaggccgcagcaccuaugucgugccuacacagcaguaccccguucaaccuggcgcccccggguucuauccgggagcgucuccuaccgaguuuggcacauacgccggggcuuacuaucccgcccagggagugcagcaguucccuaccggcgucgcucccgccccugugcugaugaaccaacccccgcagauugccccuaaaagagaacggaagacgauccgcauuagagaccccaaucaagggggaaaagauaucaccgaggaaaucauguccggcgcucggacagcgagcacccccacaccuccgcagaccggcgggggacuugagccccaggccaacggcgaaacgccucagguugcugugauuguccgccccgacgauagaucucagggggccaucauugccgaccggccuggacugcccggcccugagcacucccccagcgagucccagccgucuagcccuucccccacaccuagccccucuccggugcucgaaccuggguccgagcccaaucuggcugugcuuagcaucccuggagauaccaugacaaccauucaaaugucugucgaagagagcacccccaucucccgcgagacaggcgaacccuacagacugucuccugagccgacgccccucgccgaaccuauucuggagguugaagugacccugagcaagcccgugccugaguccgaguuuagcucuagcccccuccaggcgccuacaccgcuggcuucccauaccgucgaaauccacgagcccaacggcauggugccuucugaagaccuugagcccgaaguugaguccagcccugagcuggcucccccgccugccugccccuccgaaucucccgugccuaucgcccccacagcccagccugaggaacuccugaauggggcuccgagcccucccgccgucgaucuuucccccgugucugagccugaggaacaggcgaaagagguuaccgccagcauggcucccccgacgauuccuuccgccacacccgcuaccgccccuagcgcgaccucucccgcccaagaagaggaaauggaggaggaagaggaagaggaagagggagaggcuggcgaagccggggaggcugaauccgagaagggaggcgaggaacugcucccucccgagagcacaccgaucccugccaaccugucucagaaucuggaagccgcugcggccacccagguggcugucuccgugcccaagcggcgcagaaaaauuaaggagcucaacaaaaaggaagccgucggggaccugcuugaugccuucaaagaggcuaaucccgccgugccugaaguugagaaccaaccgcccgcgggcagcaauccuggacccgagucugaaggcagcggggugccuccccggccugaggaagcugacgagacaugggauuccaaggaggacaagauccauaacgccgaaaauauucagccgggagagcagaaauaugaauacaagagcgaucaguggaaaccccugaaccucgaggaaaagaaaagauaugaccgcgaguuucugcuuggcuuccaauuuaucuucgccucuaugcagaagccugaggggcugccccacaucuccgacgucgugcucgauaaagcuaacaagacgccucugcggccccuggacccgaccagacuccagggaauuaauuguggcccugauuuuacacccagcuucgccaaccuggggcgcaccacacuuuccacccggggacccccuagaggcggccccgggggagaacugccucgcggcccggcggggcucggaccccggagaucucagcaaggcccucgcaaggagccccggaaaaucauugcuacgguucugaugaccgaagacaucaaacuuaauaaagccgagaaggccuggaaaccuagcuccaagagaacagcugccgauaaggaccgcggggaagaggaugcugacggcucuaaaacccaggaucuguuccggagagugcggagcauucucaacaagcugacaccccagauguuucagcaacugaugaaacaggucacccagcucgccaucgacacggaggaacgccugaagggagugaucgaucuuauuuucgagaaagcgaucuccgaaccgaauuuuucuguggccuacgcuaacaugugcagaugucugauggcccucaagguuccuacaaccgagaagcccacagucaccgugaauuuccggaaacugcugcuuaacagaugccaaaaggaauuugagaaagacaaggacgaugacgagguguucgaaaagaagcagaaggagauggaugaagcugccaccgccgaggagcgcggccggcucaaagaggaacuggaagaggcuagagacauugcgcgcagacggagccuggggaauaucaaguuuauuggagaacucuucaaacugaagaugcuuacagaggccaucaugcacgauugugucgugaaacugcucaagaaccaugacgaggaaucccuggagugccugugucgccuucucacgaccauuggcaaagaucuggacuuugaaaaggcuaagccuagaauggaucaguauuucaaucagauggagaaaaucaucaaggagaaaaagacaagcucucggauucgcuuuaugcugcaagacguucucgaucugagaggguccaacugggugccccggcgcggagaccagggcccuaaaaccaucgaucagauucacaaggaagccgagauggaggaacauagagaacacaucaagguccagcaacuuauggccaaagggagcgacaagcggcgcggcggacccccgggcccucccauuucuagagggcugccccucguggacgauggaggcuggaauacaguuccuaucuccaaagggagccggccgaucgacaccucuagacugacgaagauuacaaaacccggauccaucgauagcaacaaucagcuguucgcuccuggcggccgccuuuccugggggaagggaagcucuggcgggagcggagccaagcccuccgacgcggcuucugaggccgcccggccugcuaccagcacccucaacagauuuuccgcccugcagcaggcggugcccacagaaucuaccgauaaccgccgggucgugcaaagaagcucccugucucgcgagcggggcgagaaagcuggggacagaggagaucgccucgaacggagcgagagaggcggcgaccgcggggaucggcuggacagagcccggacgccugccacaaagcgcuccuucagcaaagaaguugaggagagaucucgggaaagacccucccagccggagggacuucgcaaggcugccagccugaccgaagaucgggacagaggccgcgaugcugugaaacgggaggccgcgcucccucccgucucuccucugaaggccgcucuguccgaagaggagcuugaaaagaaaagcaaggccauuaucgaggaauaccuccaccugaaugacaugaaagaggcugugcagugcgugcaggaacuggccucccccucucuccuguucauuuuugucagacaugggguugagagcacacuugagcgcuccgccaucgcucgggaacacaugggacaacugcuccaucagcugcugugugcgggccaccuuagcaccgcccaguacuaucaagggcuguacgagauccucgaacuggcugaggacauggaaauugauaucccgcauguguggcucuaucuggccgagcuugugacaccuauucugcaggagggaggcguccccaugggcgaacucuucagagagaucaccaagccccugcgcccucuggggaaagccgcuucucuucugcucgaaauucugggacuccugugcaaguccaugggccccaaaaagguggggacgcuuuggagagaggccggacugagcuggaaggaguuucucccugaaggccaggacaucggggcguucguugcugagcagaaaguggaauacacccugggagaggaaucugaggccccgggccaacgggcccugcccagcgaggaacuuaaccgccagcuggagaagcuccugaaagaaggcuccucuaaucagagagucuuugauuggaucgaggcuaaccucagcgaacagcaaauuguguccaauacacugguucgggcccuuaugaccgcgguguguuauucugccaucauuuucgagacaccucugcgcgucgacguggcuguucugaaggccagagcuaaacuccugcagaaguaccuuugcgaugagcagaaggaacugcaggcccucuaugcucugcaagcccucguggucacccuggagcagcccccuaaccuucugcggauguuuuucgacgcgcuguacgaugaagacguggugaaagaggaugccuuuuacagcugggaauccagcaaggaccccgcugagcagcaagggaaaggagucgcccucaagucuguuacagcuuucuuuaaauggcugagagaggccgaagaggaauccgaucacaauuga

SEQ ID NO: 68769 - RNA, 2610 nt, Artificial Sequence
  derived and/or modified sequence opt5 from EIF4G2__Homo_sapiens__NP_001036024
auggagagcgccaucgcugaaggcggggccuccagauucucugcgagcuccggaggcgggggaucucggggcgcuccccagcacuacccuaagaccgccgggaacagcgaguuucugggaaaaacaccgggccaaaaugcccagaaguggauucccgcucgcuccacgagacgggacgauaacucugccgcuaauaacagcgccaaugaaaaagagcgccaugacgcgaucuucagaaaggugcggggcauucucaacaaacugaccccugaaaaguuugauaagcugugccuugagcuccugaaugucgggguugaguccaaacuuauccugaagggagugauucuccugaucguggacaaagcccuggaagaacccaaguauagcucucucuacgcucagcugugucuucgccuggccgaagaugcuccuaacuucgacggccccgccgcggaggggcagccuggacaaaaacaguccacaaccuuuagacggcuccugaucagcaaacuucaggaugaguucgaaaaucgcacaagaaacgucgacguguaugauaagcgggagaauccgcugcuccccgaagaggaggagcagcgcgccauugcuaagaucaagaugcugggcaacauuaaauuuaucggggagcugggaaagcucgaccugauucacgaaucuauccuucauaaaugcauuaagacccugcucgagaaaaagaagagaguucaacugaaagauaugggcgaagaccuugagugucugugccagaucaugcggacagugggcccucgccucgaucacgaaagagccaagucccugauggaccaguacuucgcucggauguguagccugaugcucucuaaagagcugcccgccagaauccgcuuucuucugcaggacaccgucgagcuccgggaacaucacugggugccuagaaaggccuuccuggauaaugggcccaaaacgauuaaccaaauccgccaggacgcuguuaaggaucuuggaguguuuauuccggcgccuauggcccagggcaugcgguccgacuucuuucuggaggggcccuucaugccucccagaaugaagauggaucgcgacccccucggaggccuggcugauauguucgggcaaaugccuggaagcggcaucggcaccgggccgggagucauucaggaccgguuuucccccacaaugggcagacaccgcucuaaucagcuguucaacgggcauggaggccacaucaugccucccacccagagccaauuuggggaaaugggcggaaaauucaugaagucccagaucagccuccggccugcccagucuuuucugaugaacaaaaaucaggugcccaaacuucaaccgcagauuacaaugaucccucccuccgcccagccucccagaacccagacgccuccccugggccaaacaccgcagcucgggcugaagaccaacccuccccugauucaggagaagcccgcuaagacaagcaaaaagccuccgcccucuaaagaggaacuucucaagcugaccgagaccguggucacagaauaucugaauagcggaaacgccaaugaggcgguuaacggcgugcgcgaaaugcgggcuccuaaacauuuccuccccgagaugcuguccaaggugaucauucuuucucuggauagaagcgacgaggauaaggaaaaagccuccagccucaucucucugcugaagcaggaggggaucgccacguccgacaauuuuaugcaggcuuuccuuaacguccucgaccaaugcccuaaacuggaaguggauauuccccugguuaagagcuaccucgcccaguuugcugcccgggcgaucauuucugagcugguguccaucagcgaacuugcccaaccucuggaguccggaacccacuucccccucuuucugcugugucuucagcagcucgcuaaacugcaggaccgcgaguggcugacagaacucuuccaacagucuaaggucaauaugcagaaaaugcugccggagauugaucagaacaaggacagaaugcuugaaauccuggagggcaaggggcucagcuuucuguucccucugcuuaaacucgaaaaggagcugcugaaacaaauuaagcucgaucccuccccucagaccaucuauaaauggaucaaggacaauauuucucccaagcugcacguggauaaaggcuucguuaacauccuuaugaccagcuuucugcaguacauuuccagcgaggugaauccgccuucugacgaaacagauuccagcucugcccccuccaaggagcagcucgaacaagagaaacagcugcugcuuagcuucaagccugucaugcagaaauuucugcaugaccacguggaucuccaagucucugcucuguacgcccuccaggugcauugcuauaacagcaauuuccccaagggaaugcugcuucgguuuuucguucacuuuuacgacauggaaaucauugaggaggaagcguuccuggccuggaaggaggauaucacgcaggaauuucccggcaaagggaaggcucucuuccaggugaaccaauggcugacauggcuggagaccgccgaggaagaggaauccgaggaagaggcugacuga

SEQ ID NO: 68770 - RNA, 747 nt, Artificial Sequence
  derived and/or modified sequence opt5 from EIF4H__Homo_sapiens__NP_071496
auggccgacuucgauaccuacgacgauagagcuuauagcuccuuuggcgggggacggggcucucgcgggagcgccggaggccacggguccagaucucagaaggagcugcccacagaaccuccguacacggcguaugugggaaaccuccccuucaauaccguccaaggcgacaucgaugcuauuuuuaaagaccugagcauccgguccguucgccuugugagagauaaggacacagauaaauucaagggcuuuugcuacguggaguucgacgaagucgauucucugaaagaggcccucaccuaugacggggcccugcuuggagaucggagccugcgcguggacauugcugaaggcagaaagcaggacaagggaggguuuggcuuccggaaagggggaccugaugaccgcggcaugggcuccagcagagagucucgcgggggaugggauucccgggacgauuuuaacagcggcuucagagacgauuuucucgggggacggggcgggucucgccccggagacagacggacaggcccucccaugggcuccagauuccgcgaugggccuccgcugcggggaagcaauauggacuuuagagagcccaccgaagaggaacgcgcccagcggccuagacugcagcucaagccccgcacaguugcuaccccucugaaccaaguggccaaucccaacucugcgaucuucggcggggcccggccgagagaggaggucgugcagaaagaacaggaguga

SEQ ID NO: 68771 - RNA, 462 nt, Artificial Sequence
  derived and/or modified sequence opt5 from EIF5A2__Homo_sapiens__NP_065123
auggccgacgagaucgauuucaccacaggcgacgcuggggccagcuccacguaccccaugcagugcucugcgcugagaaagaacggauuugugguccucaaaggccggccuuguaagauuguugaaaugagcaccuccaaaacagggaagcacggacaugcuaaagugcaccuggugggcaucgauauuuucaccgggaagaaguaugaggacaucugcccgucuacacauaauauggauguccccaacauuaaacgcaaugacuaccaacuuaucuguauccaggauggauaucugagccuccugaccgaaacaggcgaggugagagaagaccuuaagcugccugagggcgagcucgggaaagaaauugagggaaaguacaacgccggcgaagauguucagguguccgucaugugcgccaugucugaggaguaugcuguggccaucaaacccuguaaguga

SEQ ID NO: 68772 - RNA, 555 nt, Artificial Sequence
  derived and/or modified sequence opt5 from EIF5A__Homo_sapiens__NP_001137232
augugcggcaccgggggaacagacagcaagacgagacggcccccucaccgcgccuccuuccugaaaagacucgagucuaagccgcugaaaauggcugaugaccuugauuuugaaaccggcgacgccggggcgagcgcuacauuccccaugcaguguuccgcccugcggaagaacggauuugugguccucaaaggccgcccuugcaagaucguugagaugucuaccagcaagacagggaaacauggacacgccaaggugcaucuggugggcauugauaucuucaccggcaaaaaguacgaagacauuugucccuccacacacaauauggaugucccuaacaucaaaagaaaugacuuucaacuuauugggauccaggauggauaucugucucuccugcaggacagcggcgaggugcgggaagaucugcgccuccccgagggggaccugggaaaggagaucgaacagaaguacgauugcggcgaggaaauucuuaucaccguucuguccgcuaugacggaggaggccgcuguggccauuaaagcgauggccaaguga

SEQ ID NO: 68773 - RNA, 1296 nt, Artificial Sequence
  derived and/or modified sequence opt5 from EIF5__Homo_sapiens__NP_892116
augagcgugaacgucaauagauccguuucugaccaguucuaccgguauaagaugccccgccugaucgccaaaguggagggcaaggggaacggaauuaaaaccgugaucgucaauaugguggauguugcuaaggcccucaacagaccuccgacauaccccacgaaauauuuuggcugcgaacugggggcgcaaacccaguucgacgugaagaaugaucgguacauugucaacggaagccacgaggcuaauaaacuucaggacaugcuggauggcuuuaucaagaaguucgugcucuguccugaaugcgagaaccccgaaacagaccugcauguuaauccuaaaaagcagaccauugggaacuccuguaaagccugcggauaucgcggcaugcuugauacacaccauaagcuguguaccuuuauccucaagaaucccccugagaacucugacagcggcacagggaaaaaggagaaagaaaagaaaaauagaaagggaaaagauaaggagaacggcuccgugucuagcuccgaaaccccgcccccucccccucccccgaaugagaucaacccucccccucacacgauggaggaagaggaagacgaugacuggggagaggauaccacagaagaggcccaacggcgcagaauggacgagauuagcgaccaugcuaagguccugacccugucugaugaccucgaacggacaaucgaggaacgcgugaacauucuguucgauuuugugaaaaagaaaaaggaggaaggggucaucgacuccagcgauaaagagauuguugccgaggcugaaagacuugacgugaaggccaugggcccccuggugcucaccgagguccuguucaaugaaaagauccgggagcagauuaaaaaguaccgcagacacuuucuucgguucugccacaacaauaaaaaggcgcagcgcuaucugcuccaugggcuggaaugugugguugccaugcaccaggcucaacugaucucuaaaaucccccauauucucaaggagauguacgaugccgaccugcuugaggaagaggugaucauuuccuggagcgaaaaggcuucuaaaaaguacgucuccaaagagcuggccaaggagaucagagugaaagcggaaccuuuuauuaaguggcucaaggaggccgaagaggaaagcuccggaggcgaggaggaagaugaggacgaaaacaucgagguuguguauucuaaagcugccagcgucccgaagguggaaacggucaaauccgauaauaaggacgacgauaucgacauugaugcuaucuga

SEQ ID NO: 68774 - RNA, 738 nt, Artificial Sequence
  derived and/or modified sequence opt5 from EIF6__Homo_sapiens__NP_001254739
auggccgugagagcuagcuucgagaacaauugcgaaaucggcuguuuugccaagcugaccaacacauacugccucgucgcgauugggggauccgagaauuucuauucuguuuuugaaggcgagcugagcgacacgauccccguggugcacgcuuccauugccgggugucggaucauuggacgcaugugcgucggcaacagacaugggcuucuggugccuaauaacaccacagaucaggaacuccaacacauccgcaauucucugccggacaccguucagauccggagaguggaggagcggcuuagcgcccugggaaacgucacaaccuguaaugauuacguggcucucguucaucccgaccuggaucgcgaaacagaggaaauucuggccgacgugcucaaagucgagguguucagacagaccguggcugaucagguccugguuggcuccuauugcguguuuucuaaccaaggcgggcuugugcacccuaagacgagcaucgaggaccaggaugaacuguccagccuccugcaggucccccuuguggccggaaccguuaaucggggcucugaggugauugcggccgggauggucgugaacgacuggugugcuuucugcggacuggauacaaccuccacagaacucagcguuguggagucugucuuuaaacugaaugaagcccagccuuccaccaucgcuacgagcaugcgcgacucucugauugauucccucacauga

SEQ ID NO: 68775 - RNA, 1092 nt, Artificial Sequence
  derived and/or modified sequence opt5 from ELAC1__Homo_sapiens__NP_061166
augagcauggacgugaccuuccugggcacaggggccgcuuaccccuccccuacgagaggagccucugcggucguucuccggugcgagggcgaauguuggcuguuugauugcggggagggaacccagacacaacuuaugaaaagccagcugaaggcuggccgcaucaccaagauuuucaucacacaccuccauggggaccacuuuuucggacugccgggccuucuguguaccauuucccuccagucuggcagcaugguguccaaacagcccaucgaaauuuaugggccugugggacugagagauuuuaucuggcggacaauggagcugucucauaccgaacucgucuuccacuacgugguucaugagcuggugcccacggccgaccaaugcccugccgaggaacuuaaggaguuugcucacgucaaccgcgccgauagcccucccaaagaggaacagggcagaaccauccugcucgacuccgaggaaaauagcuaucugcuuuucgaugacgagcaguuugugguuaaggcuuuccggcuguuucaccgcauuccgucuuucggguuuuccguggucgaaaagaaaagacccggaaagcucaacgcccagaaacugaaggaucugggcgugccucccgggccugcguacggaaaacucaagaauggcaucagcgugguccuggagaacggcguuacaauuucuccccaagacgugcuuaagaaaccgaucguggggcggaagauuuguauccugggagauugcuccggcgucgugggggacggaggcguuaaacucuguuucgaagccgaucugcuuauucaugaggcuacccuggacgacgcccagauggauaaggcuaaagagcacgggcauagcacaccucagauggccgcgaccuucgccaagcucugccgcgcuaaaagacuggugcugacgcacuuuucucagcgguauaagcccgucgcccucgcucgcgaaggagagacagacggcaucgccgaacugaagaaacaagccgaguccgugcuugaucugcaggaaguuacccucgcugaggacuucauggugaucagcauuccuaucaagaaauga

SEQ ID NO: 68776 - RNA, 2361 nt, Artificial Sequence
  derived and/or modified sequence opt5 from ELAC2__Homo_sapiens__NP_001159434
augugggcccugugcagccuccugagauccgcugccggccggaccaugucucaggggcgcacaaucagccaagcgcccgcuagacgggagcgcccuagaaaggacccgcuucggcaccugagaacgagagaaaaacggggacccuccggcuguucugggggaccuaacaccguguaccuccaggucguugccgccggcagccgcgauuccggggcugcccuguauguguucucugaguuuaauagauaccuuuucaacugcggagaaggcgugcagcggcugaugcaggagcauaagcucaaagucgcucgccuggacaauauuuuucugacaagaaugcacuggagcaacgugggcgggcucuccggaaugauccugacccuuaaggaaacaggccugcccaaauguguucucagcgggccuccccaacuggagaaguaucuugaggccauuaagaucuucucuggaccucugaaaggcauugaacucgcggugcggccgcauuccgcccccgaguacgaagaugagaccaugacagucuaucagaucccuauccacagcgugucucagcgcagagggguucgggacuccagccugguggucgcuuuuauuugcaagcugcaucucaaaagaggaaauuuccuggugcuuaaggccaaagagaugggccugcccgugggcaccgcugccaucgcgccuauuaucgccgcugucaaggaugggaagucuauuacgcacgaaggacgcgagauccucgccgaagaacuguguacacccccggacccuggcgcugccuuuguugugguggaaugccccgaugaguccuucauucagccuaucugugagaacgccaccuuucaacgguaccaggggaaagcugacgcgcccgucgcccuugugguucacauggcucccgccagcgugcuggucgauuccagauaucagcaguggauggaacgcuucggaccugacacccaacaucucgugcugaaugagaacugcgccucuguucacaaucugcggagccauaagauccagacacagcucaaccugauucacccggauaucuuuccccuucugaccuccuucagauguaaaaaggaaggcccuacgcucagcgugcccaugguccaaggggagugccugcuuaaauaccagcugcgcccucggagagaauggcagcgcgacgcuauuaucacauguaaucccgaggaguuuauuguggaagcccuccagcugccgaacuuccaacagucuguccaggaguaccggagauccgcgcaggauggaccugcucccgccgaaaagcgcagccaauauccugagaucaucuuccugggcaccggcucugccauucccaugaaaauccggaaugugagcgcuacacucguuaacauuuccccugacaccucucugcuucuggacugcggggaaggaaccuuuggccagcucugcagacacuacggggaucagguggaccggguccugggaacacuggccgcuguguucguuagccaucuucacgccgaucaucacacgggccuccccuccauccugcugcagcgcgagagagcgcucgccagccuggggaagccgcuucauccucugcucguggucgcucccaaucaacugaaggccuggcugcagcaguaucacaaccagugucaagaggugcuucaccauauuucuaugauccccgcuaaaugccuccaggaaggcgccgagaucuccagcccugcgguggaacggcugauuucuucccugcucagaaccugugaccuggaggaguuucagacaugccuuguucgccacuguaagcaugccuucggaugcgcucugguccacaccagcggcuggaaagugguguacuccggggauacaaugccgugugaagcccucguccggaugggaaaggacgcuacccugcugauccacgaggccacgcuugaagauggccucgaggaagaggccguggagaaaacacauucuaccaccagccaagcuauuuccguugggaugagaaugaacgcggaauuuaucaugcugaaucacuucucucagcgcuaugccaaggugccccuguuuagcccuaacuucuccgagaaggucggaguggcuuuugaccauaugaaaguuugcuucggcgauuuucccacaaugccuaagcucauucccccucugaaagcccuuuucgccggggacaucgaagagauggaagagagacgggagaagcgcgaacugagacaggugcgggcugcccuccugagccgcgagcuggcgggcggacuugaagauggcgagccccagcaaaaacgcgcucacaccgaggagccgcaggccaagaagguccgggcccaguga

SEQ ID NO: 68777 - RNA, 804 nt, Artificial Sequence
  derived and/or modified sequence opt5 from ELANE__Homo_sapiens__NP_001963
augacccugggcagacggcucgccugccuguuccuugcuugugugcugcccgcccuccugcuugggggaacagcgcuggcuagcgagaucgucggcgggcgcagagcccggccucacgccuggccguuuaugguuucccuccagcugcgcggaggccauuucugcggggcuacgcugauugcccccaacuuugugaugucugcugcccacuguguggcgaaugucaacgugagagccguucgggugguccucggagcucauaaucugagccgcagagaaccuacccggcaaguguucgccguucagcgcaucuuugagaacggcuacgaccccgugaaucuucugaacgauauugucauccuccagcugaauggcuccgcuacaauuaacgccaauguccagguggcgcaacuuccugcccaggggagacggcugggaaacggcgugcagugccucgcuaugggguggggacugcugggccgcaauagagggaucgccucuguucuccaggaacugaacgugaccguggucacaagccuuugucggcgcuccaaugugugcacccugguuagaggacggcaagcuggcguguguuucggcgacucugggagcccccucgucugcaacggacugauccacggcauugccuccuuugugagagggggaugugccagcggccuuuauccugaugcuuucgcgccgguugcccaguuugugaauuggaucgacucuauuauccagcgcuccgaggauaaccccugcccucauccccgggacccugaucccgcuagcagaacacacuga

SEQ ID NO: 68778 - RNA, 981 nt, Artificial Sequence
  derived and/or modified sequence opt5 from ELAVL1__Homo_sapiens__NP_001410
augagcaacggcuacgaggaccacauggccgaagauugcagaggggacaucggacggaccaaucugauugugaacuaucugccccagaauaugacacaagaugagcugcgcucccuuuucucuagcaucggcgaagucgaguccgcuaagcugauuagagacaaaguugccgggcauucucucggauacggcuuugugaacuaugugacggcgaaggaugcugaacgggccaucaauacccugaacgggcuucgccugcagagcaaaacaauuaaggucuccuacgccagaccuucuagcgaggugaucaaagacgcuaaucucuauaucuccggacugccgcggaccaugacacagaaggauguugaggacauguucagccgcuuuggcagaauuaucaacucucgggugcuggucgaucagaccacaggccucucccgcgggguggccuucauuagauuugacaagcggagcgaagcugaggaagccaucaccucuuucaauggacacaaacccccuggcuccagcgagcccauuacgguuaaguuugcggccaacccuaaucaaaacaaaaauguggcucugcuuucucagcuguaccauucccccgcccgcagauucgggggaccuguccaccaucaggcucagcgguuucgcuucagcccgaugggcguggaucacauguccgggcucucuggagugaacguccccggcaaugccagcuccggcugguguaucuuuauuuauaaccuggggcaagacgcggaugagggaauccuuuggcagauguucggcccuuuuggggccguuaccaacgugaaggugaucagagacuucaauacaaacaaaugcaagggauucggcuuugucaccaugacaaauuacgaagaggcugccauggcuauugccagccugaacggguaccggcucggagacaagauccuccaggugucuuucaaaaccaauaagucccacaaauga

SEQ ID NO: 68779 - RNA, 1041 nt, Artificial Sequence
  derived and/or modified sequence opt5 from ELAVL2__Homo_sapiens__NP_001164668
auggagacccagcugagcaacggccccacaugcaauaacacggccaaugggccuaccacaaucaacaauaacuguuccucuccgguggacagcggaaauaccgaagauuccaagacaaaccucauugucaauuaccugccccaaaacaugacccaggaggaacuuaaaucucuguucggcagcaucggggagauugaauccugcaagcucguuagagacaaaaucacaggacagucucugggcuauggguuugugaauuacauugauccuaaggacgcugagaaagccaucaacacccuuaauggacugcggcuccagacgaagaccaucaaggugagcuaugcgcgccccuccagcgcuucuauuagagaugccaaccuguacgucuccggccugccuaaaacaaugacccaaaaggagcucgaacagcuguucagccaguauggccggaucauuacaucucgcauccuuguggaccagguuaccgggauuuccagaggagugggcuuuauccgguucgauaaacgcauugaggccgaagaggcuaucaaggggcugaauggacaaaaacccccuggcgccacggagccgaucacagucaaguuugcuaacaaccccagccagaagaccaaucaggccauucucucucagcuguaccaauccccuaacagacgguaucccgggccucuugcgcagcaggcccaacgcuucagauuuagccccaugacaaucgacggaaugaccucccuggcuggcauuaauaucccgggccacccugggaccggaugguguauuuucguguacaaccucgcccccgaugcugacgaaucuauccuguggcagauguuuggcccuuucggggccguuacaaaugugaaagucauccgggauuuuaacacgaauaagugcaaaggauucggcuuugugaccaugacaaacuacgacgaggcggccauggcuauugccagccugaauggguaucgccucggagauagagugcugcaggucuccuucaagaccaacaaaacacauaaggcuuga

SEQ ID NO: 68780 - RNA, 1104 nt, Artificial Sequence
  derived and/or modified sequence opt5 from ELAVL3__Homo_sapiens__NP_001411
auggugacccagauccugggcgccauggagagccaagucgggggaggccccgcugggccugcccucccgaacggaccccugcuuggcacaaauggggcgacggacgauuccaagaccaaccugauuguuaauuaccucccucagaacaugacacaggacgaauuuaaaucucuguuuggaagcaucggcgauauugaguccugcaaacuugugagagacaaaaucaccggccagucucugggguauggauucgugaauuacagcgaucccaacgacgcugauaaggccauuaauacacucaacggccugaaacugcaaaccaagacaaucaaggucuccuaugcccggccuucuagcgcuuccauccgcgacgccaaucucuacgugagcgggcugcccaaaaccaugucucagaaggaaauggagcagcuuuucucccaguauggaagaauuaucacgagccggauucugguugaucaagugaccggcgucucucgcggggugggauucaucagauuugacaaacggauugaagcugaggaggccaucaagggccucaacggccagaaaccucugggggcggccgaaccgauuacaguuaaguucgcuaauaaccccucccagaagaccggacaggcccuucugacacaccucuaccaaagcucugcucgcagauaugccggcccucugcaucaccagacccagcgguuucgccuggauaaucuccugaacauggcguacggggugaaaagcccccuuucccugaucgccagauucuccccuaucgcuauugacggaaugucuggccucgccggggucggacugagcggcggcgcugccggggccggaugguguaucuuuguguacaaucuuucccccgaggcugaugaaagcgugcuguggcaacucuucggcccguuuggggcggucacgaacguuaaggugauucgggacuucacaaccaacaaaugcaagggauuuggcuucgugacaaugaccaauuaugacgaggccgcuauggccaucgccucucugaacggguaccgccugggcgagagaguccuccagguguccuucaaaaccagcaagcagcauaaggcuuga

SEQ ID NO: 68781 - RNA, 1116 nt, Artificial Sequence
  derived and/or modified sequence opt5 from ELAVL4__Homo_sapiens__NP_001281277
auggaguggaacggccugaagaugaucauuagcaccauggaaccccagguguccaaugggccuacaucuaacacgagcaauggaccguccucuaacaauagaaacugccccagcccuaugcaaaccggcgccacaaccgacgauuccaaaacaaaucucaucgucaacuaccugccccagaauaugacccaggaggaguuccggucucuuuuugggagcauuggagaaaucgaauccuguaagcugguucgcgacaaaauuacaggccagagccucggguauggauucgugaacuacaucgauccuaaggacgcugagaaagccaucaauacccugaacggccuuagacugcaaacgaagaccauuaaggugucuuaugcgcggcccuccagcgcuucuauccgcgaugccaaucucuacgucuccggccugccuaaaacaaugacccagaaggagcuggaacagcucuuuagccaguaugggagaauuaucacaucucggauucugguggaccaaguuaccggagugucccgcggcgucggguucaucagauuugauaaacggauugaggccgaagaggcuaucaagggacuuaacggccagaaaccgagcggggccacggagcccaucacagugaaguucgcuaauaacccuucccagaagucuagccaggcccugcucucccaacuguaccagagccccaaccgcagauauccuggaccccuucaccaucaggcgcaacgguuucgccuggacaaucuccugaacauggccuacggcguuaaaagauucucuccgauuaccaucgauggcaugacaucccugguggggaugaauauuccuggacacaccggcaccggguggugcaucuuugucuacaaccucagccccgacucugaugaaagcgugcuguggcagcuuuucggaccuuuuggcgcugugaauaacgucaagguuauucgggacuucaauacaaacaaauguaagggguuuggauucgugacgaugaccaauuaugaugaggccgcuauggccaucgcgucccugaacggcuaccgccucggcgacagagugcugcaggucucuuucaaaacaaauaaggcccauaaaagcuga

SEQ ID NO: 68782 - RNA, 1788 nt, Artificial Sequence
  derived and/or modified sequence opt5 from ELF1__Homo_sapiens__NP_001138825
auggccgcugugguccagcaaaacgaccugguuuucgaguuugccagcaaugugauggaagaugagagacagcucggcgaccccgcgaucuucccugcugugauugucgaacacgugccgggggccgauauccugaacuccuacgccggacuugcuugcguugaggaacccaaugacaugauuaccgagucuagccuggauguggccgaggaagagaucauugacgaugacgaugacgauaucacacucacggucgaagcuagcugucaugacggcgaugagaccaucgagacaauugaagccgcggaggcccugcuuaacauggacucuccugggcccaugcuggacgaaaagcggaucaauggcauuccugaggugauggaaacccagcagguucaagagaaauaugcugauagccccggagccuccucuccugagcagccgaagcgcaaaaaggggagaaaaacaaagcccccucggcccgacagcccugcuaccacacccaacaucuccgugaagaaaaagaauaaagauggaaagggcaacaccauuuaccucugggaauuucugcuggcccuccugcaggacaaagcgacgugcccgaaguauaucaaguggacccagcgcgagaaaggcauuuucaagcuggucgauagcaaagccgugucuagacugugggggaagcacaaaaauaagccugacaugaacuacgaaacaaugggacgggcucuccgcuauuacuaucaaagaggcauccuggccaaaguggaggggcagcggcuugucuaccaguuuaaggaaaugcccaaggaucugaucuacauuaaugacgaggauccuuccagcucuaucgaguccagcgaccccucucucuccagcuccgcuaccucuaaccgcaaucagacaagcagaucccggguuuccucuucccccggagugaaaggcggggccaccacggugcugaagccuggaaacagcaaagccgcuaagccgaaagaucccgucgaaguggcgcaaccuucugagguucugcgcacagugcagcccacccagagcccuuaucccacacaacucuucagaaccguccaugugguucagccggugcaggccgucccugaaggcgaggcugcccggaccuccacaaugcaggacgaaacgcuuaauucuagcgugcaauccauucgcaccauccaggcccccacacaggucccugugguugugagccccagaaaccagcaacuucacaccgucacacugcagaccgugccucucacgacaguuauugcuucuaccgaccccuccgccggcaccgggagccagaaguuuauccugcaggcgaucccgucuucccaaccuaugacagugcuuaaggagaacgucaugcugcagagccagaaagcuggauccccucccucuauugugcucggccccgcccaggugcaacagguucugaccagcaauguccagacaaucuguaacgggacgguguccguggccucuagcccguccuucagcgcuaccgcccccgucgugacauuuucuccucgguccagccaacugguugcucaucccccuggaaccgugauuacaucugucaucaagacccaggagacgaaaacccucacacaggaaguggagaagaaagaauccgaggaucaccugaaggagaauaccgaaaagacagagcagcaaccccagccuuacguuaugguggucagcucuagcaacggcuucaccucccagguggccaugaaacagaaugaacuucuggagcccaacagcuuuuga

SEQ ID NO: 68783 - RNA, 1515 nt, Artificial Sequence
  derived and/or modified sequence opt5 from ELF2__Homo_sapiens__NP_001263386
auggccaccagccugcacgagggccccacaaaccagcucgaccugcuuaucagagcuguggaagccuccguccauucuagcaaugcgcacugcacggauaagaccauugaggcugccgaagcccugcuccauauggaguccccuacaugucugcgggacucucgcagcccgguugaaguguucgugcccccuugcgucuccacccccgaguuuauccacgcugccaugagaccugaugugauuacagagaccguuguggaagucucuacagaggaaagcgagcccauggacaccuccccuaucccgacgagccccgauucucaugagccuaugaaaaagaaaaaggggaacaccacauaccuuugggaguuccugcucgaccugcugcaagauaaaaauaccuguccccgguauauuaaguggacacagcgcgaaaagggaaucuuuaaacucguggacuccaaggcuguuagcaaacuguggggcaagcacaaaaacaagccugauaugaauuacgaaaccauggggagagcccuucgguauuacuaucagcgcggaauccuggcgaagguggagggccagagacucgucuaccaauucaaagacaugcccaagaacauuguggugaucgaugacgauaaaucugaaacgugcaaugaggaccuggccgggacaaccgacgagaagucccuugaacgggucagccugucugcugagucccuccugaaagccgcuagcuccguucgcucuggaaagaacagcuccccgauuaauuguagcagagccgaaaaaggcguggcgcggguggucaacaucacaucuccuggccacgaugccuccagccgcucucccaccaccacagcuagcguguccgccacggcugccccuagaaccguucggguggccaugcagguccccgugguuaugacaucucuggggcagaagauuagcaccguggcuguccaguccgugaaugcgggagcuccccucaucacaagcaccucuccuacgacagccaccuccccgaaggucgugauucaaaccauccccacaguuaugccugccagcaccgagaacggcgacaaaaucacaaugcagcccgccaagauuaucacgauuccugcuacccagcuggcccagugccaacuucagacaaaaucuaaucugaccggguccggaagcaucaacauugugggcacaccccucgcgguccgcgcucugaccccgguguccaucgcccaugggacgccuguuaugagacuuucuaugcccacccagcaagccagcggacagacaccuccccgggugaucuccgcugucauuaagggcccugaagugaaaucugaggccguggcuaagaagcaggagcacgauguuaaaacccugcagcucgucgaagagaagcccgccgacggcaauaaaacagugacccauguggucgugguuagcgcgccguccgccaucgcucugccugugacgaugaagacagaagggcuggucaccugugagaaauga

SEQ ID NO: 68784 - RNA, 1116 nt, Artificial Sequence
  derived and/or modified sequence opt5 from ELF3__Homo_sapiens__NP_001107781
auggccgcuaccugcgagaucagcaacauuuucuccaauuacuuuucugccauguauagcuccgaagacucuacacuggcgagcgugcccccugcugccacguucggcgccgaugaccucguccugacccuuuccaacccgcagaugucucuggaggggacagaaaaggcuagcuggcucggagagcaaccccaguuuugguccaaaacccagguucuggauuggaucagcuaccagguggaaaagaauaaauaugacgccucugcuauugauuucuccagaugugacauggauggcgccacacuuugcaacugugcgcuggaggagcuccggcugguguuugggccucugggagaccaacuccacgcccagcugcgcgaucuuaccuccucuuccagcgacgaacugucuuggaucauugagcuccuggaaaaggauggcauggcuuuccaggaggcccuugaccccgggccuuuugaucagggaucccccuucgcucaagagcugcucgacgacggccagcaggccagcccuuaccauccgggcuccugcggggcgggagcccccucuccuggcagcuccgaugucagcacagcugggaccggagccucuagauccagccacucuagcgacuccggcgggucugauguggaccuggaucccacggacggaaaacuguuuccuagcgauggcuuccgggacuguaagaagggcgaucccaaacaugggaagcgcaaaagaggacggccgcgcaagcucuccaaagaauauugggacugccuggagggcaaaaagagcaagcacgcuccuagagggacccaucuuugggaauuuauccgggauauccugauucaccccgagcucaaugaaggacugaugaagugggagaaccgccacgagggcguuuucaaauuucuuagaucugaagccguggcccagcugugggggcaaaagaaaaagaauagcaacaugacauacgagaaacucagccgggcuaugcgcuauuacuacaagagagaaauccuggagcgggucgacggacgcagacugguguauaaguucggcaaaaauucuuccggcuggaaggaagaggagguucuccagagccggaacuga

SEQ ID NO: 68785 - RNA, 1992 nt, Artificial Sequence
  derived and/or modified sequence opt5 from ELF4__Homo_sapiens__XP_005262446
auggccaucacccugcagcccagcgaccucauuuucgaguuugcuuccaacggcauggaugacgauauccaccaacuggaagacccuucuguguucccggccgucauuguugaacaggugcccuacccugaucuucugcaucucuauagcgggcuggagcuugacgaugugcacaauggaaucauuacagacggcacgcugugcaugacccaggaucagauccucgagggguccuuucugcugacagacgauaacgaagcgaccucucauacaaugagcaccgcugagguccuccugaauauggagucccccucugacauccuugaugaaaagcaaauuuucagcacauccgagaugcugccugacagcgaccccgccccugccgugacccucccgaacuaccuguuucccgcuucugaaccugaugcccuuaauagagcuggagacacguccgaucaggagggccacagccuggaggaaaaagccucucgggaggaauccgcgaagaaaaccggaaagagcaaaaagcgcaucagaaagacaaaagggaaccggucuaccucccccguuacagacccuagcauucccauccgcaagaaauccaaggauggcaaaggcucuaccauuuaucucugggaguuccugcuggcccuccugcaggacagaaauacguguccgaaguacaucaaguggacacagcgggaaaaagggauuuuuaagcugguggauagcaaagcugucuccaagcuguggggaaaacaaaagaacaaaccugacaugaauuaugagaccaugggccgcgcccucagauacuauuaccagcgggggauccuggcuaagguggagggacagcgccuuguuuaccaguucaaggaaaugcccaaagaucugguggucaucgaggacgaagaugagagcucugaagccacagcggccccuccccaagccuccaccgccagcguggcuucugccagcaccacaagacggacguccucucgcgugagcuccagaagcgcuccccagggcaaggggucuuccagcugggagaaaccuaagauucagcaugucggacuccaaccgucugcuucccuggagcugggccccagccucgacgaagagaucccuaccacauccaccaugcugguuucucccgcggaaggccaggugaaacuuacaaaggccgugagcgcuuccucugucccuagcaacauucaccuggggguggcccccguuggauccggcagcgcccucacccugcagacgaucccgcuuacaaccgugcugaccaaugggccucccgcuucuacaaccgccccuacacagcucguccugcaauccgugcccgcggcuagcacguuuaaggacaccuucacacugcaggccucuuuuccucucaacgccuccuuccaggauagccagguugcugcccccggagcuccgcugauucuuucuggccugccucaacuccuggccggggcgaaucggcccaccaaccccgccccuccgacagugaccggagcuggccccgccggcccuagcucccagcccccugggacggucaucgcugccuuuauccgcaccagcggaacaaccgcggcccccagagugaaagagggcccucugcggucuuccagcuauguccaggggauggugacaggagcucccauggaaggccuucucguuccggaggagacccugagagaacugcuccgcgaccaggcccaccuucaaccucuucccacacagguggucucccgggggucucauaauccuagccugcucggcaaccagacgcugucucccccguccagaccuaccgugggacugacacccguugcugagcuugaacucagcuccggcucugggagccugcugauggccgagccuuccgugaccaccagcggaucucuccugacacgcucccccacgcccgccccuuucagcccguucaaccccaccucucuuauuaagauggagccucacgauaucuga

SEQ ID NO: 68786 - RNA, 483 nt, Artificial Sequence
  derived and/or modified sequence opt5 from ELF5__Homo_sapiens__NP_001230009
augcuggacagcgugacccacuccacauuccuccccaacgccucuuuuugcgauccucugaugagcuggacggaccuuuucuccaaugaggaauacuauccggcuuuugagcaucagaccgaugccgacucuaacugucugaagacaagcggcaucaaaucccaagauugccacucucauagcagaaccucccuccagagcucucaccugugggaguucguccgggaccuucugcucucccccgaagaaaauugugggauucuggagugggaggaucgcgaacagggaaucuuuagaguugucaagagcgaggcgcuggcuaaaauguggggccagcggaagaaaaacgaccgcaugacauacgaaaagcucucuagagcccugcgguauuacuauaagaccgggauucuugagcgcguggauagacggcugguguacaaauucggaaagaaugcccauggcuggcaagaggacaaacucuga

SEQ ID NO: 68787 - RNA, 288 nt, Artificial Sequence
  derived and/or modified sequence opt5 from ELK1__Homo_sapiens__NP_001244097
auggaccccagcgugacccuguggcaguuccuccugcaacuucugagagagcagggcaacgggcacaucauuuccuggacaucucgggauggaggcgaauuuaagcucgucgacgccgaggaaguugcucgccugugggggcuucggaaaaauaagacgaacaugaauuacgauaaacugagcagagcccuccgcuauuacuaugacaagaacaucauuagaaaaguguccggacagaaguucguguacaaguuugucucuuauccugagagccauugcgcgccguga

SEQ ID NO: 68788 - RNA, 1224 nt, Artificial Sequence
  derived and/or modified sequence opt5 from ELK3__Homo_sapiens__XP_006719338
auggagagcgccaucacccuguggcaguuccuccugcaacuucugcucgaccagaagcacgaacaucugauuugcuggacauccaacgauggcgaguuuaaacuucugaaggcugaagagguggccaaacucugggggcugagaaagaauaaaacgaacaugaauuacgacaagcugucucgggcgcuccgcuauuacuaugauaagaacaucauuaaaaaggucaucggacagaaauucguuuacaaguuugugagcuuccccgaaauucugaaaauggacccucacgcuguggagaucuccagagagucucuucugcuccaggauagcgacuguaaggccuccccggaaggccgggaggcccauaagcacgggcuggcugcccuucgcucuaccagcagaaaugaauauauccauuccggacuguacagcucuuuuacaauuaacucccuccaaaaucccccugaugcuuucaaagccaucaagaccgagaaacuggaggaacccccugaggacucucccccugucgaagaggugcggacaguuauucgcuuugugaccaacaagacagauaaacacgucaccagaccggugguuagccugcccuccacgagcgaagcggccgcugccucugcuuuccucgccuccagcguguccgcgaagaucucuagccugaugcuuccuaaugccgcuuccauuagcucugccucccccuuuagcucucggagcccuucccugucucccaacagcccgcucccuuccgagcaccgcagccuguuccuugaggcugccugccaugacucugauucccuggaaccccucaaucugagcucuggcuccaaaaccaagagcccuucccugccucccaaggccaaaaagcccaaagggcucgagaucucugcuccgccccugguccuuagcggaacagacauuggcuccaucgcgcugaacucuccugcccuccccagcggcucccugaccccugccuuuuucacagcucagacccccaaugggcuucugcucacgccgagcccucugcugucuuccauccacuuuuggagcucucucucccccguggccccucugagccccgcuagacuucagggaccuucuacacuguuccaguuccccacccuccugaacggccauaugccggugccuauucccagccuggaucgggccgcgucccccguccuucucagcucuaauucccaaaagagcuga

SEQ ID NO: 68789 - RNA, 1218 nt, Artificial Sequence
  derived and/or modified sequence opt5 from ELK4__Homo_sapiens__NP_068567
auggacagcgccaucacccuguggcaguuccuccugcaacuucugcagaagccccagaacaaacacaugauuugcuggacauccaaugauggccaguuuaagcuccugcaagcugaggaaguggccagacuuugggggauccggaaaaacaagccuaauaugaacuacgacaaacugucucgcgcgcucagauauuacuaugucaagaauauuaucaagaaaguuaacggacagaaguucguguacaaauuugugagcuauccggagauucugaauauggaucccaugacggucggccggaucgaaggggacugugagucccugaacuucucugaagugagcuccucuagcaaggauguugagaauggaggcaaagacaagccuccccagccuggggcuaagaccuccagccgcaacgauuacauccauucuggacucuauuccagcuuuacacuuaauucucugaacuccagcaaugugaaacuguucaagcucauuaaaaccgagaaccccgccgaaaagcuggccgagaaaaagucuccucaggaaccgacacccuccgucaucaaauuugugaccacaccuagcaagaagcccccuguugagcccguggcugccaccauuuccaucggcccgucuauuagcccuuccagcgaggaaacgauccaagcucuugagacccuggucucucccaaacucccuucccuggaagcccccacaagcgcgucuaaugugaugaccgccuucgcuacaacgcccccuauuagcuccaucccgccccugcaggagccucccagaaccccuucucccccgcucagcucccacccugacaucgauacagacauugauagcguggccucucagcccauggaacugccugagaaccuuucccuggagcccaaggaccaggauagcguccuccuggaaaaagacaagguuaacaauucuucccggagcaaaaagccuaagggccuugagcuggcucccacccucgugaucacauccucugacccgagcccucuggggauucugucccccucucuccccaccgccagccugaccccugcguuuuucucccaaguggccugcagccuuuuuauggucucuccgcugcucuccuucaucugucccuuuaaacagauucagaaccuguacacacaagugugcuuccuucugcuccgcuucguucuggaaagacugugugugacggucauguga

SEQ ID NO: 68790 - RNA, 1923 nt, Artificial Sequence
  derived and/or modified sequence opt5 from ELL2__Homo_sapiens__NP_036213
auggccgcuggcgggaccggaggccugagagaggaacagcgguacgggcucagcugcggacgccugggccaagacaacaucacagugcuucacgucaagcugacggagaccgccauuagagcgcucgaaacauaucagucccauaagaaucugauccccuuccggccuucuauucaguuucaggggcuucacggacugguuaagaucccgaaaaacgauccccucaaugaggugcauaacuucaauuuuuaccugagcaacgugggcaaggacaauccucaaggcuccuucgauuguauucagcagaccuuuucuagcuccggggcuucucagcugaacugccucggauucauccaagacaaaaucacagucugugccaccaaugauagcuaucagaugacacgcgaaagaaugacccaggccgaggaggaaucccggaaccgcagcacgaaggugauuaagcccggcgggccuuacguuggaaaaagagugcagauccggaaggcuccccaagccgucucugacaccgugccugagcgcaaaagauccacaccgaugaaucccgcuaacaccauucggaagacacacucuagcuccaccaucagccagcgcccuuauagagaucggguuauucaucugcuugcccugaaagcguacaagaagcccgaacuccuggcccgccuucagaaagacggcgugaaucaaaaggauaaaaacucucugggggcuauccuccagcaggucgccaaucugaacuccaaggaccugagcuauacgcucaaagauuacguguuuaaggagcugcagagagacuggccuggauacuccgagauugaucggagaucucuugaaagcgugcugucccgcaaacucaaccccagccaaaaugcugccggcacaucucgguccgagagcccggucugcucuagcagagacgcgguuuccucuccucagaagcgccugcuugacagcgaguucaucgauccccugaugaacaagaaagcccggaucucccaccucaccaauagagugccucccacacugaacggccaccugaaucccaccagcgaaaagucugcugccgggcucccucugccgcccgcugccgccgcuauuccuacacccccuccccuuccguccaccuaucugccuaucagccaucccccucagauugugaacucuaauuccaacagccccuccacgccugaaggacgcggcacccaggaccuccccgucgauucuuuuagccaaaaugacuccaucuacgaggaucagcaggacaaauauacaucucggaccagccuggagacacuuccgccuggguccgugcugcucaagugucccaaacccauggaagagaaccacagcaugucucauaagaaguccaaaaagaaaagcaagaaacacaaggaaaaggaucagauuaaaaagcacgacaucgagaccaucgaagagaaagaggaagaucugaagagagaggaagagauugcgaaacugaauaacucuuccccuaauagcucuggaggcguuaaggaagacugcacggccagcauggagccguccgcuaucgagcuccccgauuaccugauuaaguauaucgccauugugagcuacgaacaacgccagaacuauaaagacgacuucaaugccgaguacgaugaauaccgggcccuucaugcuagaauggagacagucgcgcgccgguuuaucaagcuggacgcucagagaaaacggcucucuccuggguccaaggaguaucagaacgugcacgaagagguucugcaagaauaccagaaaaucaagcagagcucccccaacuaucaugaggaaaaauaccgcugugaguaucugcacaauaaacuugcccauauuaagagacucaucggagaguucgaucaacagcaggccgaaucuuggagcuga

SEQ ID NO: 68791 - RNA, 1866 nt, Artificial Sequence
  derived and/or modified sequence opt5 from ELL__Homo_sapiens__NP_006523
auggccgcucugaaggaggacagaagcuacggccucuccugcgggcgggugucugauggaagcaaagucuccguuuuccacgugaagcugaccgacucugcccuucgcgcguuugaaagcuauagagcucggcaggauuccgugucucugcgccccagcaucagauuccaaggcucccaggggcauauuagcaucccucagccggacugucccgccgaggcccggacauuuucuuucuaccucuccaacauuggacgcgauaauccucagggcagcuuugacugcauccaacaguaugucucuucccacggggaagugcaucuggauugucuuggaagcauucaggacaaaaucacgguuugcgcuaccgaugacucuuaccagaaggccagacaauccauggcucaggccgaggaagagacacggagccgcuccgcgaucgugauuaaagccggcggcagauaucuggggaagaagguccaguuccggaaacccgcuccuggagccaccgaugcugugcccucucgcaagagagccacaccuaucaaccucgcgagcgccauucggaaauccggcgcuagcgccguuucugggggauccggcgugagccagcgcccguuuagagaccggguccugcaucugcucgcucugagacccuaccgcaaggccgagcuucugcuccggcugcaaaaagaugggcuuacccaggccgacaaggacgcucuggauggacuccugcagcaaguggcgaauaugucugccaaggacggcacauguacccugcaggauugcauguauaaagacgugcagaaggauuggccuggcuacagcgaaggggaccagcaacuccugaaaagaguccuuguucgcaagcugugucagccccaguccacgggaucucuccugggcgauccugcugccagcuccccgcccggggagcggggaagaagcgccucuccuccccagaaacgccuucaaccucccgacuucaucgauccccuggcuaacaagaaaccucggauuucccacuuuacccagagagcccagccggcggugaauggcaagcucggggugcccaacggacgcgaagcucugcugccuacacccggcccucccgccagcaccgacacacucucuuccagcacccaucugccgccucggcuugagcccccuagagcccacgauccccuggcugacgucuccaaugaccucggccacucugggcgcgauugcgagcacggagaagccgcugccccugcgcccacggugcggcugggccuuccgcugcucacagacugugcccagccuagcagaccccaugggucccccucucggagcaagccuaaaaagaaauccaagaaacacaaggauaaggagcgcgcugccgaagacaaaccgagagcucaacugcccgauugcgccccugcgacccacgccacacccggagcuccugccgacacccccggccugaacgggaccuguagcguuucuuccgugccuacaagcacgucugagacccccgauuaccuccugaaguaugcugccaucuccagcucugaacagcggcagagcuacaaaaaugacuucaacgccgaguauuccgaguacagagaucuucaugcucgcauugaacggaucacaagacgcuuuacccagcuggacgcgcaacucagacagcugagccagggcucugaggaauaugagacaacccggggacaaauccugcaggaauaccgcaagauuaaaaagacgaauacaaacuauucccaggagaagcacagaugcgaguaccuucauagcaaacucgcccacaucaagcggcugauugcugaauacgaucagcgccaacugcaggccuggccguga

SEQ ID NO: 68792 - RNA, 744 nt, Artificial Sequence
  derived and/or modified sequence opt5 from ELMO1__Homo_sapiens__NP_569709
augcaaguggucaaggagcagguuaugagagcccugaccacaaaacccagcucccucgaccaguucaagucuaaacugcagaaccuuagcuacacggaaauccugaagauucggcaguccgagcgcaugaaucaagaagauuuucagucuagaccuauccucgagcugaaagaaaagauucagccggagauccuugagcugauuaagcagcaacggcucaaccgccugguggaagggaccugcuucagaaaacugaaugcccggcgcagacaggacaaguuuugguauugucggcucagccccaaccacaaagugcugcauuacggcgaucuugaggaauccccucagggagaggucccccacgacucucugcaggauaagcucccuguggccgacaucaaagcgguugugacaggcaaggauugcccccauaugaaggagaaaggggcucugaagcaaaauaaagaaguccuugagcuggccuucagcauccucuaugacuccaacugucagcugaauuuuauugccccugauaagcacgaauacugcaucuggaccgacggacugaacgcucuccugggcaaagauaugaugagcgaccuuacacgcaaugaucuggacacccuccugucuauggagauuaaacuuagacugcucgaccuggaaaacauccagauuccggaugcucccccucccaucccuaaggagcccuccaauuaugacuucguguacgauuguaacuga

SEQ ID NO: 68793 - RNA, 2163 nt, Artificial Sequence
  derived and/or modified sequence opt5 from ELMO2__Homo_sapiens__NP_877496
augcccccuccgagcgacaucgugaaggucgccauugaguggcccggcgccaacgcccagcugcucgaaaucgaucagaaaagaccucuggcguccauuaucaaggagguuugcgacggguggucucuucccaauccugaauacuauacccugcgguacgcugauggaccccagcucuauauuacagagcagacgcgcagcgacaucaaaaacggcaccauccugcagcuugccauuuccccuucuagagccgcucggcaacugauggaacgcacacagagcuccaauauggagaccagacucgaugccaugaaggagcuggcuaaacugucugccgacgugacauucgcgaccgaauuuaucaacauggaugggauuaucgugcucacacggcuggucgagagcggaaccaaacuucugucccacuacagcgaaaugcucgccuucacgcugaccgcuuuucuugagcugauggaccauggcauugugucuugggauaugguuuccaucacauucauuaagcagaucgccggguaugugagccagccgauggucgacgugucuauccuccaacgcucccuggcuauucuggagagcaugguucucaauucucagucccuguaccagaaaaucgccgaagagauuaccgugggacagcuuaucagccaccuccaagucuccaaccaggaaauucagacauaugcgaucgcccugaucaaugcucuguuucuuaaggcccccgaggauaaaagacaagacauggcuaacgccuucgcccagaagcaucugcggucuauuauccucaaucacgugauucgcggcaacagaccuaucaaaaccgaaauggcucaucagcuguacgugcugcagguccucacguuuaaucugcuugaggagcggaugaugacaaagauggaucccaacgaccaagcgcagcgcgacauuaucuucgaacugagacggaucgccuuugaugcugagagcgacccuuccaaugcccccggcagcgggaccgaaaagcgcaaagccauguacacaaaggauuauaaaaugcucggauucaccaaccacauuaauccggcuauggacuuuacccagacaccucccggcaugcuggcccuugauaacaugcuguaccucgcgaagguucaccaggacacguauaucagaauugugcuggagaacucuucccgggaagauaaacaugaguguccuuucgggagaagcgcuaucgagcugaccaagaugcucugcgaaauucugcaagugggagagcuucccaaugaaggccgcaacgacuaccaccccauguuuuucacacaugaucgggccuucgaggaacuguuugggaucuguauucagcuccugaauaaaaccuggaaggagaugagagccacagcugaggacuucaacaaggucaugcaagugguucgcgaacagaucacccgggcccugccuucuaaaccgaauagccuugaucaauuuaaguccaaacucagaucucugagcuauuccgagauccugcgccuccggcagagcgaaagaaugucucaggacgacuuccaguccccucccauuguggagcugcgcgagaagauccaacccgaaauucuugagcugaucaaacagcagcggcucaacagacugugcgaaggaagcucuuuucgcaagauuggcaaucggagacggcaagagcgcuucugguacuguagacuggcucuuaaccacaagguccuccacuauggcgaucuggacgauaauccucagggggaagugacguuugagucccugcaggagaaaauccccguugccgacaucaaggcgauugugacaggaaaagauugcccgcauaugaaggaaaagagcgcccucaagcagaacaaggagguccuggaacuugcuuucuccauccuguacgacccugaugagacccucaauuuuauugcccccaacaaauacgaauauuguaucuggauugacggccugucugcucugcuugggaaggauaugagcuccgagcucaccaaaucugaccuggauacacugcucagcauggagaugaagcugcggcuucuggaccucgaaaauauccaaaucccugaggcucccccucccauuccgaaagaaccuuccagcuacgauuucguguaucacuacggauga

SEQ ID NO: 68794 - RNA, 981 nt, Artificial Sequence
  derived and/or modified sequence opt5 from ELMOD1__Homo_sapiens__NP_001123509
augaagcacuuccugagaaugcucauccaggugugccuguacuuuuauuguaaauuccuuuggcggugccugaaguuugucaugcgcaaacucaccggcagaugugagcugcaacggauuugcuacaacacaaagcccggggccagccgcacgaugaaaaucgaaaccucccuuagagacucuaagagcaagcugcuccagacauccguuucugugcauccugaugcuauugagaaaaccaucgaagacauuauggagcugaagaaaaucaauccggaugugaacccccagcugggaaucagccuccaggccugucugcuucaaauugucggcuaucggaaucugaucgcggacguggaaaagcuccgcagagaggcuuacgauuccgacaacccucagcacgaggaaaugcugcuuaaacuguggaaguuccucaagcccaauacaccucuggagucucggauuagcaaacaguggugcgaaaucggguuucagggagaugaccccaagaccgauuuccgcggcauggggcugcucggacuguauaaccuucaauacuuugccgagagagacgccacagcugcccagcagguucuguccgauagccuccauccuaaauguucuaaguucuccaaagcugagugggaaaagaaacggauggacaaggccauuggcuauagcuuugcgaucgugggcauuaauaucaccgaucuggccuacaaccuucuggucucuggggcucucaagacgcacuucuacaauaucgccccggaggcucccacccugucccauuuucagcaaacauucugcuaucugaugcacgaauuucacaaauucuggauugaggaagacccuauggacaucauggaguucaaccgcgugagagagaaguuucggaaacgcauuaucaagcagcuccagaaucccgauauggcccuguguccucauuucgcggccagcgaaggacuuauuaacauguga

SEQ ID NO: 68795 - RNA, 882 nt, Artificial Sequence
  derived and/or modified sequence opt5 from ELMOD2__Homo_sapiens__NP_714913
auguucaucagccugugggaguuuuucuacggccacuuuuucagauuuuggaugaaguggcuccugcggcagaugaccgggaaaugcgaacuucaacgcauuuucgacacauaugugggagcccagagaacgcaucggaucgagaacucccugaccuacucuaagaauaaaguccuccagaaggcuacacacguugugcagagcgaaguggauaaauaugucgacgauauuaugaaggagaagaacaucaaucccgaaaaagacgccuccuuuaagauuuguaugaaaaugugccugcuucaaaucaccggcuacaagcagcuguaucucgauguggagucuguucgcaaaagaccuuacgacagcgauaaccugcagcaugaggaacugcucaugaagcuguggaaucuucugaugccgacaaagaaacucaacgcgcggaucuccaagcagugggcugagauuggguuccaaggagacgaucccaaaaccgacuuucgcggcauggggauccugggacuuauuaaucugguguauuucucugaaaacuacacaagcgaggcccaccagauccucuccagaagcaaucauccuaagcugggcuacucuuaugccauugucggcaucaaccugaccgagauggcuuacucccuccugaaaagcgaagcccuuaaguuucaccuguauaaucucgugcccgggauuccuacgauggagcacuuccaucaguuuuacuguuaucugguuuacgaguucgauaaauucugguuugaggaagaacccgagucuaucauguauuucaaccuuuaccgggaaaaguuucacgagaagaucaaaggacugcuccuggacugcaauguggcucugacccucaaggucuga

SEQ ID NO: 68796 - RNA, 1146 nt, Artificial Sequence
  derived and/or modified sequence opt5 from ELMOD3__Homo_sapiens__NP_001128494
augaacgagaaguccugcuccuuccacucuaaagaagaacugagagacggccagggggaacggcucagcgccggauacucccccucuuaugauaaggacaaaagcgugcuggcuuuucgcggcaucccuauuuccgagcuuaagaaucaugggauccugcaagcccucaccacagaagcguacgagugggagccgagagucguuucuacggaaguggugcgggcucaggaggaaugggaggccgucgauaccauucagcccgagacaggaagccaggccuccagcgaacaaccuggccagcugaucucuuucuccgaggcccuucagcacuuucagaccguggaccugagccccuucaaaaagcgcauucaaccuacaaucagacggaccgggcucgcugcucugcgccauuaucuguuuggacccccuaagcuccaccagagacugcgggaggagcgcgaucuuguucugacaaucgcccaguguggccucgacucucaggauccggugcauggcagaguccugcaaaccauuuacaaaaagcugacgggguccaaauucgacugcgcgcuucacggaaaccacugggaagaucucggcuuucagggggccaaucccgcuaccgaccugcggggagccggcuuccuggcucuccugcaucuucuguaucucgugauggauagcaagacacugccuauggcccaggagaucuuucgccuuucuagacaccauauucaacaguuccccuuuugucugauguccguuaacaucacccacauugcgauccaggcccuccgggaggaaugccugagccgcgaguguaauagacagcaaaaagugauuccugucgugaacuccuucuacgcugccacauuucugcaccucgcucauguguggcggacccagagaaagacgaucucugacagcggguucguccugaaggaacuugagguucuggccaaaaagagcccccgccggcuccugaaaacacuugaacuguaucucgccagagugagcaagggacaggcuucucugcugggcgcgcagaaaugcuacggcccggaggccccucccuucaaggaucucaccuuuacaggggaguccgaccugcaaagccacucuagcgaaggaguguggcuuaucuga

SEQ ID NO: 68797 - RNA, 3138 nt, Artificial Sequence
  derived and/or modified sequence opt5 from ELMSAN1__Homo_sapiens__NP_919254
augaaccugcaggcucaacccaaggcucagaauaaaagaaagcggugccucuucggcgggcaggagccugccccgaaagaacagcccccuccccugcaaccuccccagcagagcauccgcgugaaggaggaacaguaccuuggacacgagggcccugggggagcggucuccaccucucaaccgguugaacugcccccucccagcucccucgcucugcuuaacucugugguguauggcccugagagaacaagcgccgccaugcugucccagcaggucgcuucugugaaauggcccaauagcguuauggccccggggcggggaccugagcgcggcggcgggggaggcguguccgacagcucuuggcagcaacagcccgggcagccuccuccccauuccacguggaacugucacagccucucucuguacuccgcuaccaagggaagcccccauccgggcgucggggugcccacauauuacaaucacccugaagcccugaagagagagaaagcgggaggcccccaacucgaucgguauguucgcccuaugaugccccagaaggugcagcuggaagucggcagaccgcaggccccucuuaacucuuuucaugcugccaaaaagcccccuaaucaaucccugccccuccagccuuuccagcuggcuuuugggcaccaggugaaccggcaaguguuccgccagggacccccgccucccaaucccgucgccgcguuuccuccgcagaaacagcaacagcagcagcaaccccagcagcaacagcagcagcaacaggccgcccuuccucagaugccccuguucgagaacuuuuacagcaugccucagcaacccucccagcagccucaggacuucggccuccaacccgccgggccgcugggacagucucaccuggcucaucacagcauggccccuuaucccuuuccucccaauccggauaugaacccugagcucagaaaggcccugcuucaggacuccgcuccccaaccugcgcugccccagguucagauucccuucccucggcgcagcagacggcucucuaaggaaggcauccugccgcccuccgcccuugauggggcuggaacccagccuggccaagaggccacaggcaaucuguuucuccaucacuggccccugcagcagccucccccugggagccugggacagccgcaccccgaagcccucggcuucccucuggagcuucgcgaaucucaacugcuccccgacggggagagacuggcuccuaacggacgggagagagaagcccccgcgaugggcagcgaggaagggaugcgcgcuguguccaccggcgauugcggacaggugcuucggggcggggucauucagucuacaagacgccggagacgcgccagccaggaggccaaucugcucacccuggcucaaaaagccguggaacuggcuucccuccagaacgccaaggacggaagcggcucugaggagaaacggaaguccguucuggcgagcacgaccaaaugugggguggaauuuucugagccgucccuugccacaaagagagcucgcgaagauagcggaauggucccucugaucauucccguguccguucccgugcggaccgucgacccuacagaggccgcucaggccggcgggcucgaugaagacggcaaaggacccgagcagaacccugcggagcauaagccgucugugaucgucaccagacgccggagcacgagaauccccggcacagaugcccaagcucaggccgaagacaugaaugugaagcuggagggggaaccuuccguucggaaacccaagcagcgcccuagacccgagccgcugauuaucccuaccaaagcuggaacauucauugcucccccuguguacucuaacaucacccccuaccaaagccaccuucgguccccugucagacucgccgaccaucccagcgagcgcucuuucgaacugccgccuuauaccccuccgcccauucugucccccgugcgggagggcagcgggcucuacuuuaaugcuaucauuucuacauccacgauccccgcgccucccccuaucacccccaagagcgcccacagaacacugcuucgcaccaacucugcugaaguuacaccuccggugcugagcgucaugggagaggccacccccguguccauugaaccuagaaucaaugugggcagccgguuccaggccgagauuccccucaugcgcgauagagcucuggccgcggcugacccucauaaagccgaucugguuuggcagcccugggaggaccuugaaucuucccgggagaagcagcgccaagucgaagaucuccugacggccgcuugcagcuccaucuuuccgggggccggcacaaaccaggagcuggcgcuccacugucugcacgaaucuagaggagacauucuugagacccugaauaagcuccugcugaaaaagccucuucggccccauaaccacccccucgcuaccuaucauuacacaggcagcgaucaguggaaaauggccgagcgcaagcuguucaauaaagggaucgccaucuauaagaaggacuuuuuccuggugcagaaacucauucaaaccaagacaguggcucagugcgucgaauuuuacuauacguacaaaaagcaagugaaaaucggaagaaacggcacccugacauucggggauguugacaccuccgaugagaagucugcccaggaagagguggaagucgacauuaagacaagccagaaauuuccucgggugccccuuccucgcagagaguccccgucugaggaacggcuggagcccaagagagaaguuaaagagccucgcaaggagggagaagaggaagugcccgagauccaggaaaaagaggagcaggaagagggccgggaaagaagccgccgggcugccgcggucaaggccacccaaacgcuccaggcuaaugaguccgccagcgacauucugauccugagaucucacgaauccaacgcuccugggagcgccggcggacaggccucugagaaaccccgcgagggcaccgggaagucccggagagcccuuccguucagcgaaaagaaaaagaaaacagagaccuuuucuaagacacagaaucaagaaaacaccuucccuuguaaaaagugcggacgcuga

SEQ ID NO: 68798 - RNA, 2175 nt, Artificial Sequence
  derived and/or modified sequence opt5 from ELN__Homo_sapiens__NP_000492
auggccggccugaccgcugccgcgcccagaccuggggugcuccugcuucugcucagcauccugcacccgucccggcccggaggcgucccuggggcuauucccggaggcguuccugggggaguguucuaccccggcgccggccuuggggcccugggaggcggggcucucggaccuggcgggaagccgcugaaacccgugccuggaggccuggccggcgcugggcucggagccggccugggggcguuucccgccgucacauucccuggagcucuugugcccggcgggguugccgacgcugccgcggccuauaaggcugccaaagcuggagccggccugggcggggugccgggagucggcgggcucggagugucugccggcgcuguugugccucagcccggggcgggcgucaagccuggaaaagugcccggcguggggcugcccggagucuacccuggcgggguucuuccgggagcccgcuuucccggcgugggggugcugccuggcguccccacgggagcuggcgugaagccuaaggcccccgggguuggaggcgccuucgcugggaucccgggagugggcccuuuugggggcccccaaccuggagucccccucggcuauccuauuaaagcccccaagcugccugggggauacggccugccguauaccacagggaaacuccccuacggauauggccccgggggcguggcgggagcugccggcaaggccggguacccuaccggaacaggcguugggccgcaggcugccgcugccgcggccgcuaaagccgcugccaaguucggagcgggcgccgcuggcgugcugcccggggucggaggcgccggggugccuggaguccccggcgcuaucccugggauuggaggcaucgccggcguggggacccccgccgcugcggccgcugccgccgcugccgcgaaggcugccaaauacggagccgcugccggccuuguuccugggggacccggcuuugggccgggaguggucggcgugccuggcgcggggguucccggagugggcgucccuggggcuggaauccccguggugccgggcgccgggauuccuggagccgcuguucccggcgucgugagcccugaggccgcugccaaggcggccgcuaaagccgcuaaguauggcgccagacccggggugggagucggcgggauccccacauacggagugggcgccgggggauucccuggcuuuggcguuggggugggaggcauuccgggggucgcuggagugcccggcguugggggagugccuggcgucggcggggugcccggaguuggcaucuccccugaagcgcaggccgcugccgccgcuaaagccgcgaaguauggggugggaacccccgcugccgccgcugccaaagcggcugccaaggccgcucaguucggccuggucccuggggugggaguggccccgggcgucggcguugcucccggggugggaguggccccuggcgucgggcucgcgcccggagugggcguugccccuggggugggcgucgcucccggagugggcguugccccggggauuggaccuggcgggguggcugccgccgcuaagucugcggccaaagucgcugccaaggcccaacugcgggcugccgcgggacuuggcgcugggauccccggccugggagugggcguuggggugcccggacucggcgucggggccggagugccuggccugggggugggcgccggaguccccggcuuuggggcuguuccuggagcccuggcggccgcuaaagccgcuaaguacggcgccgcugugccgggggugcucggaggccugggcgcccuugggggagucggcauucccgggggagugguuggcgcggggccugccgcugccgcugccgccgcuaaagcggccgcuaaggccgcccaguucggacuggugggcgcugccggccucgggggacugggcgucgggggacuuggcgugcccgggguuggaggccugggcgggaucccucccgcggccgcugccaaggcugccaaauauggagcggccggccucgggggagugcugggcggggcuggacaguuuccgcugggcggcgucgccgcucgcccuggguucggacucagccccaucuucccuggcggggccugccugggaaaggcuuguggcagaaaacggaaguga

SEQ ID NO: 68799 - RNA, 252 nt, Artificial Sequence
  derived and/or modified sequence opt5 from ELOF1__Homo_sapiens__NP_115753
augggcagacgcaagagcaaacggaagcccccuccgaaaaagaaaaugaccgggacacuggagacgcaguuuaccugccccuucuguaaccacgaaaaguccugcgacgugaagauggauagagcccggaauacaggagucaucucuuguaccguuugccucgaggaguuccaaacaccuauuaccuaccugagcgaacccguggacguguauuccgauuggaucgacgcuugugaagccgcgaaccaguga

SEQ ID NO: 68800 - RNA, 891 nt, Artificial Sequence
  derived and/or modified sequence opt5 from ELOVL2__Homo_sapiens__NP_060240
auggagcaccugaaggccuucgacgaugaaaucaacgcuuuucucgacaauauguucggccccagagauagccgggugcgcgggugguuuaugcuggacuccuaccuuccuaccuucuuucugacagucauguaucuccugucuauuuggcuuggaaacaaauacaugaagaauagaccggcccugagccuccggggcauccugacgcuguauaaccucgggauuacccugcuuuccgcguacaugcuggcugagcucauccugucuacaugggaaggaggcuauaaucuucagugccaagaucugaccagcgccggggaggccgacauucgcguugcuaaagugcucuggugguacuauuucuccaagucuguggaauuucuggauacaaucuucuuuguccugcggaaaaagaccagccagaucacauuccuccauguguaccaccaugccuccauguuuaacauuuggugguguguucugaauuggauccccugcggacagagcuucuuuggcccuacccuuaacucuuucauucacauccugauguacuccuauuacggccucagcguguuccccucuaugcauaaguaucugugguggaaaaaguaccuuacgcaggcucaacugguccaguuugugcucaccauuacacacaccauguccgccguugugaaaccuuguggguuccccuuuggaugccugaucuuccagagcucuuauaugcugacacucgucauucuguuucuuaauuucuacgugcagaccuauagaaagaaaccuaugaagaaggacaugcaagagccgcccgcgggcaaagaggugaagaacggguuuuccaaagccuacuucacggcugccaauggagucaugaacaagaaagcucaguga

SEQ ID NO: 68801 - RNA, 945 nt, Artificial Sequence
  derived and/or modified sequence opt5 from ELOVL4__Homo_sapiens__NP_073563
augggccugcucgacagcgagcccggguccgugcugaacgucguuucuaccgcccuuaaugauacaguggaguucuacagauggacguggagcaucgcugacaagcggguggaaaacuggccucugaugcaguccccguggcccacccucucuauuagcacacuguaucuucuguuugucuggcucggaccuaaauggaugaaggaucgcgaacccuuccaaaugagacuggugcugaucauuuacaauuuuggcaugguucuccugaaccuuuucaucuuucgggagcuguucaugggguccuauaaugccggauacucuuauauuugccagagcguggacuacuccaacaauguccacgaagugcgcaucgcggcugcccucuggugguauuuuguuagcaaaggcguggaguaccuggauaccgucuucuuuauccuuagaaagaaaaacaaucaggugucuuuccugcauguguaccaccauuguacaauguuuacccucugguggauugggaucaagugggucgccggaggccaggcuuucuuuggcgcccaacugaacuccuucauucacguuaucauguauagcuacuaugggcugacagcuuucggaccuuggauucagaaguaccucugguggaaacgguaucugaccaugcuucagcugauccaguuucaugugacgauuggccacaccgcccucucucuguacacagacugccccuucccuaaguggaugcacugggcgcuuaucgccuaugcuaucuccuuuauuuuccuguuucucaauuucuacauccgcaccuacaaagagccgaagaaacccaaggccgggaagacagcuaugaacggaauuagcgccaauggcgugucuaaauccgaaaagcaacugaugaucgagaacgggaaaaagcagaaaaauggaaaggcgaaaggcgauuga

SEQ ID NO: 68802 - RNA, 981 nt, Artificial Sequence
  derived and/or modified sequence opt5 from ELOVL5__Homo_sapiens__NP_001229757
auggagcacuucgacgccagccuguccaccuacuuuaaggcucuccugggccccagagauacacgggugaaagggugguuccuucuggacaacuauaucccuacguuuauuugcucugucaucuaccuccugauuguuuggcuuggaccgaaguauaugcgcaauaaacagcccuucagcuguagaggcauccuggugguguacaaccucgggcugacccugcucucccuguauauguuuugcgaaucuaagcgggagcaaccucgcagaagcgccugugcgucccggacagaucccucuacccagcagcagcuuccugaaaaucgccuggucacaggagugugggagggcaaauacaacuucuuuugccaagggaccagaacagcuggagaaagcgacaugaagauuauccggguucucuggugguauuacuucuccaagcugaucgaguuuauggauaccuucuuuuucauucuucgcaaaaauaaccaucagaucacggugcugcacgucuaccaucacgccagcaugcucaauauuuggugguuugugaugaacuggguucccuguggccauucuuauuucggcgccacccucaauuccuucauccacgugcugauguacagcuauuacgggcugucuuccgucccuagcaugagaccguaucugugguggaagaaauacauuacacagggacagcuucugcaauuugugcucaccaucauucagacaucuugcggcgugaucuggcccuguaccuucccucugggguggcuuuauuuucagaucggauacaugauuucccugaucgcucucuucacgaacuuuuacauucagacauauaauaagaaaggcgccagccggcgcaaggaccaccugaaggaucaucaaaacggguccauggcugccgucaauggacacaccaacucuuucagcccccuggagaauaacguuaaaccuagaaagcuccggaaagacuga

SEQ ID NO: 68803 - RNA, 798 nt, Artificial Sequence
  derived and/or modified sequence opt5 from ELOVL6__Homo_sapiens__XP_011530536
augaacaugagcgugcugacccuccaggaguacgaauuugagaagcaauuuaaugaaaacgaggccauccaguggaugcaggaaaauuggaaaaaguccuuccuguuuucugcucuuuaugccgcguucauuuuuggcgggagacaccugaugaacaaacgggcuaaguucgagcuccgcaaaccccugguccuuuggagccugacacucgccguguuuuccaucuucggagcccugagaacgggcgcuuacaugguguauauucugaugaccaaggggcucaagcagucugugugcgaccaaggauuuuacaauggcccugucagcaaauucugggccuaugcuuuugugcuguccaaggccccggagcuuggggauacaaucuucauuauccugcggaaacagaagcucaucuuucugcauugguaccaccauauuaccguucuucuguauucuugguacagcuacaaagacaugguggcgggaggcggcugguucaugacaaugaacuaugggguccacgccgugauguacuccuauuacgcucuccgcgccgcuggauucagaguuagccggaaguuugccauguucaucacccugucucagauuacacagaugcugaugggcuguguggucaauuaucucguguuuugcuggaugcaacaugaucagugucacucccacuuccagaacaucuuuuggagcucucugauguaccuuuccuaucugguucucuucugccauuucuucuuugaagcguacauugggaagaugcgcaaaaccacgaaggccgaguga

SEQ ID NO: 68804 - RNA, 846 nt, Artificial Sequence
  derived and/or modified sequence opt5 from ELOVL7__Homo_sapiens__NP_001098028
auggccuucagcgaccugaccuccagaacagugcaccucuacgauaacuggaucaaggacgcugauccccgggucgaggacuggcugcuuaugucuagcccucugccgcagacgauucuccugggcuuuuauguuuacuucgugaccucccuugggcccaaacugauggaaaaucgcaagccuuuugagcucaaaaaggccaugaucacauauaacuucuuuauugugcuguucucugucuacaugugcuaugaauuugugaugagcggauggggcaucggguacuccuucagaugugauauuguugacuauucucggagccccaccgcgcugcgcauggcuagaacaugcuggcucuacuacuuuuccaaauucaucgagcugcuugauaccaucuuuuucgugcugcggaagaagaauagccaagucacauuucuccauguguuccaccauaccauuaugccuuggacguggugguucggaguuaaauuugccgccggcgggcugggaaccuuccacgcccuucugaacacagcugugcaugucgugauguauucuuacuauggccucuccgcucugggccccgccuaccagaaguaucugugguggaaaaaguaccucaccagccugcagcuugugcaguuugucaucguugcgauucacaucucucaauucuuuuucauggaagacuguaaauaucaguuuccuguguucgccugcauuaucauguccuacagcuuuauguuccugcuccuguuucuucacuucugguaccgcgcuuauacaaaggggcagagacugccgaagaccgugaaaaauggaacguguaagaacaaagauaauuga

SEQ ID NO: 68805 - RNA, 2676 nt, Artificial Sequence
  derived and/or modified sequence opt5 from ELP2__Homo_sapiens__NP_001229804
augguggcccccguccuggagaccagccacguuuucugcuguccuaacagagugcggggcgugcucaauugguccucugggccgcgcggacugcuugcuuuuggcacaagcugcuccgucgugcuguacgacccccucaagagaguuguggucacgaaccugaaugggcauaccgcccgggugaacuguauccaguggauuugcaaacaagauggaucuccuagcacagaacuuguuuccggcgggucugacaaucaggugauccacugggagauugaagauaaccagcugcucaaggcgguccaucugcagggacacgagggccccguguaugcugugcaugccgucuaccaacgcagaaccagcgacccugcccuguguacacucaucguuuccgcugccgcugauagcgccgugcggcuguggucuaaaaagggccccgaagugaugugccuucagacccugaauuucgggaacggauuugcgcucgcccugugucuuuccuuccugccuaauacagacgucaccuggaaaacgggccagguggagcgcgggagagcuuggaagccgcccgccagccucgcucugugcucucgguccugugauagcaugguuucuugcuaugccuccauucuguguaaggcgcucuggaaagagaagcugcacaccuuuuggcaccauaaccgcaucagcuuccuuccuuccgccuuuagacccaucccuauucuggcuugcggaaaugacgauugccggauccacauuuucgcccagcaaaacgaccaguuucagaaagugcucucucuguguggccaugaagauuggauccgcggggucgagugggcugccuucggaagagaccuuuuucuggccagcugcucccaggauugucucauucggaucuggaagcuguacauuaaaagcacaucucuggaaacccaagacgacgauaauauccgccucaaggagaacacauucaccaucgagaaugaauccgugaagauugcuuuugcgguuacgcuggagacagugcuugccggccacgaaaacugggucaacgcugugcacuggcagcccgucuucuauaaagacggcgugcugcagcaaccgguuagacuccugagcgccucuauggauaagaccaugauccuuugggccccugacgaggaaagcgggguguggcuggagcagguccgggugggagagguuggcgggaauacacucggauucuacgauugccaguuuaacgaagacggcuccaugauuaucgcucaugccuuccacggggcgcugcaucuguggaaacagaauaccgugaaccccagagaguggaccccugaaauugucaucucuggacacuuugauggcgugcaagaccucgugugggaucccgagggcgaguucaucauuacaguugggacggaccagaccacacgccuguuugcucccuggaagcggaaagaucagagccaggucaccuggcaugaaaucgccagaccucaaauucacggauaugaccuuaagugucuggccaugaucaaucgcuuccaguuuguguccggcgcugacgagaaagugcuccgggucuucagcgccccgagaaacuuuguggaaaauuucugcgcuauuacagggcagucucugaaccacguucuguguaaucaggauuccgaccuucccgagggagccaccgugccugcgcucggccugagcaacaaggccgucuuucaaggggauaucgcuucucagcccuccgacgaagaggaacugcucacgagcacaggcuucgaguaccaacagguggccuuucagccuuccauccugaccgagcccccgaccgaagaucaucuucugcagaauacacucuggccugagguucagaagcuguacggacacggcuaugaaauuuucugcgugaccuguaacucuagcaaaacacugcuugcuuccgccugcaaggcggccaaaaaggagcaugcugccaucauucucuggaauacgaccucuuggaaacaaguccagaaccugguguuccacagccugacaguuacccagauggcuuuuucccccaaugagaaguuccuccuggccgugagccgcgaccggacauggucucuuuggaagaaacaggauaccaucuccccugaauuugagcccgucuucagccuguuugccuucacgaacaagauuaccucugugcacuccagaaucauuuggagcugugacuggucuccugauagcaaauacuuuuucacagggucccgcgacaagaaaguggucguuuggggagaaugcgauagcaccgacgauugcaucgagcauaacaucggccccuguucuuccgugcucgacgucgggggagcugugacagcggugagcguuugcccggugcugcacccuucccaacgguaugucguggccguuggccuggaaugugggaagauuugccuuuacaccuggaagaaaacggaccaggugcccgagaucaaugauuggacacauugugucgagaccucucagagccagucccacacacucgcuauuagaaagcugugcuggaaaaacuguucuggcaagaccgaacaaaaagaggccgaaggagccgaguggcugcauuuugcuagcugcggcgaagaccacaccgugaagauccaccgcguuaauaagugugcccucuga

SEQ ID NO: 68806 - RNA, 1602 nt, Artificial Sequence
  derived and/or modified sequence opt5 from ELP3__Homo_sapiens__NP_001271151
augaugcugaccaucggcgacgugauuaagcagcucaucgaggcccacgaacaagggaaagauauugaccugaacaaggucaaaacaaagacggcugccaaauacggacuuagcgcgcagcccagacugguugauaucauugcugccgugccuccgcaguaucggaaggugcucaugcccaagcugaaagccaagccuauccgcaccgcuuccggcaucgccgucguggcuguuaugugcaaaccccauagauguccucacauuucuuucacagggaauaucugcguguacugucccggaggcccugacagcgauuuugaguauuccacccagucuuacacaggguaugaaccgaccagcaugcgggccauucgcgcgagauacgaccccuuccuucaaacacggcaucgcaucgagcagcugaagcagcucggacacuccgucgauaaaguggaauuuauuguuaugggcggcaccuucauggcccugccugaggaguauagagacuacuuuauccggaaccugcaugaugcucucucugggcacacgagcaauaacauuuacgaagccgugaaguauuccgagcgcagccugaccaagugcaucggaaucacaauugaaaccagacccgacuacuguaugaaacggcaccuuucugauaugcugacauauggcugcacccgccucgagaucgggguccaguccguguacgaggacguggcuagagauacgaaucggggacauacagucaaggccguuugugagagcuuccaccuggcgaaagacucuggcuuuaaggugguggcccauaugaugccugaccuucccaacgucgggcuggagcgcgauauugaacaauucaccgaguuuuucgaaaauccggcuuuuagaccugacggacucaaacuguaucccacacuggugauccggggcaccggccucuacgagcuguggaaguccgggagauauaaaagcuacucuccuuccgaucuuguugagcugguggcccgcauucucgcucuggucccucccuggacccggguguacagaguucagcgcgacauccccaugccgcuugugagcuccggagucgaacacggcaaccugcgggagcucgcccuggccagaaugaaggaucuggggauccagugccgcgacgugcggacaagagaagucggcauucaggagauccaccauaaggugcgccccuaucaaguugaacucgugcggagagauuacgucgcuaauggagggugggagacguuccugucuuaugaggacccugaucaggacauucuuaucggacugcuccgccugcggaaauguagcgaagagaccuuuagauucgaacuuggcggcgggguguccauuguucgggagcugcacguguacggaagcgucgugcccgugucuucccgcgauccuacaaaguuccagcaucaaggcuuugggaugcuccugauggaagaggcggagagaaucgcccgggaagaacacggaagcggcaaaaucgcuguuauuucuggggucggcaccagaaacuauuaccgcaagaucggauaucggcugcagggccccuacauggugaaaaugcucaaguga

SEQ ID NO: 68807 - RNA, 1431 nt, Artificial Sequence
  derived and/or modified sequence opt5 from ELP4__Homo_sapiens__NP_001275654
auggccgcuguggcuaccugcggcagcgucgcggcuuccacagggucugccguugccacggcuagcaaguccaacgugaccucuuuccagagacggggaccccgcgccagcgugacaaaugacuccggcccuagacuggucucuaucgcugggacccggccgagcgugcgcaacggacaacuccugguuuccacaggccuucccgcccuggaucagcuccuugggggaggccuugcggugggcaccguccugcucaucgaggaagacaaauacaauaucuauagcccucugcuguuuaaguacuuccucgccgaggggauugugaacggacacacacugcuuguugcuucugccaaagaagaucccgcuaauauccugcaggagcucccugcgccccugcuugacgauaaguguaaaaaggaauuugacgaggauguguauaaccauaagaccccugaguccaauauuaaaaugaagaucgccuggagauaccagcugcucccgaaaauggaacaaaucggccccgucucuagcucccgguucgggcacuauuacgacgccagcaagcgcaugccucaggagcugauugaagccucuaacuggcauggauuuuuccugcccgagaaaaucuccagcacgcucaagguggagccuugcucccugacccccggcuauacaaagcugcugcaguuuauucagaauaucauuuacgaagagggguucgauggaucuaacccgcaaaagaagcagagaaauauccuccggauuggcauccagaaccugggcagcccucuuuggggagacgauaucuguugcgccgaaaaugggggcaacucccacagccugaccaaauuucucuacgugcugcgcgggcugcucagaacaucucuguccgcuuguauuaucaccaugcccacgcaucuuauucagaauaaggccaucauugcccgggucacaacccugagcgacguuguggugggacucgagucuuucaucggcagcgaacgcgagacaaacccucuguauaaagauuaccacgggcuuauccacauuagacaaaucccccggcugaacaaucucauuugcgacgaguccgacgucaaggaucuggcuuuuaaacugaagcgcaaacucuucaccaucgaaugggugcaggacaacuaucugagacaggagcggaauauuuaucccccuggauuuucuuaccuucugaaacaaaaggauagcgcguggggcgaaggcucccuccagcauagcaccuuccugaugucuuuccuggccaaagcuacagccuuugccuccagacuuguucgccacagcgagccgcucaagcagaacgggucuggacggaucagacaggcugccggcccccgccuguggcaugacgggcggagacaagaagcgccuggacugcucggcauucccccuuga

SEQ ID NO: 68808 - RNA, 801 nt, Artificial Sequence
  derived and/or modified sequence opt5 from ELP6__Homo_sapiens__NP_001026873
auguucguggagcugaacaaucuccugaacaccacacccgacagagccgaacagggcaaacuuacgcugcucugcgaugcuaagaccgacgggagcuuucugguccaccauuuccuuuccuuuuaccugaaggccaauuguaaaguuugcuucguggcgcucauccaaucuuuuagccacuauuccauugugggacagaagcugggcgucucucugacaauggcucgggagcgcgggcagcucguguuccuggaaggacuuaaaagcgccguugauguggucuuucaggcccaaaaggagccucauccgcugcaguuccucagagaagcuaacgccggcaaucugaagccccuuuuugaguucgugcgggaggcucugaaaccuguugacuccggggaagcccgcuggaccuaccccgugcuccuggucgaugaccugucugugcuccugagccuuggaaugggcgcgguggccguccuggauuuuauccacuauuguagagcuacaguuugcugggagcucaagggcaacaugguggugcugguccaugacuccggggaugccgaagacgaggagaaugauauucuucugaacggacucagccaccagucucaccugauccugcgggcugaaggccucgccaccggguucugucgcgacgugcauggacagcugcggauucuuuggagacgcccuucccaacccgcgguucacagagaucagagcuuuacauaccaguauaaaauccaggacaagucuguguccuucuucgccaaaggcaugagcccugcuguccuguga

SEQ ID NO: 68809 - RNA, 672 nt, Artificial Sequence
  derived and/or modified sequence opt5 from ELSPBP1__Homo_sapiens__NP_071425
augaccagauggagcuccuaccugcucggcuggacaacguuccugcuuuauucuuacgagagcuccgggggaaugcacgaagagugcguguuucccuucaccuauaagggcucugucuacuuuacauguacccauauccacagccuguccccuuggugcgccacacgggcuguuuauaacgggcaguggaaauacugucaaucugaagacuauccgcgcugcauuuuccccuuuaucuacagaggaaaggccuacaauagcuguauuucccagggcagcuuccucgggucucuguggugcuccgugaccagcguguuugaugagaaacagcaguggaaguucugugaaacaaacgaguauggaggcaauucucuucggaaaccuugcaucuuucccuccauuuaccgcaacaaugucgugagcgacuguauggaggaugaaucuaacaagcuguggugcccuaccacggagaauauggacaaggauggcaaaugguccuucugugcggacaccagaaucagcgcucucguucccggguuuccuugccauuucccguuuaacuauaagaauaaaaacuacuucaauugcacaaacgaaggauccaaggagaaucugguguggugugccaccucuuauaacuacgaucaagaccacacaugggucuauugcuga

SEQ ID NO: 68810 - RNA, 984 nt, Artificial Sequence
  derived and/or modified sequence opt5 from EMB__Homo_sapiens__NP_940851
augagagcccugcccggccuccuggaggcuagagcccgcaccccuagacuucugcuccugcagugccuucuggcggcugcccggccgagcuccgccgacgggucugcucccgauagcccuuucacaucucccccucuccgcgaagagaucauggccaacaauuuuucccuggaaagccacaacauuucccugacggagcauucuagcaugcccguggaaaagaauaucacccucgagagaccuuccaacgucaaucugacaugucaauucaccacaagcggagaccuuaacgcuguuaaugugaccuggaaaaaggauggcgagcagcuggaaaacaauuaccucgugucugccacaggguccacccuguauacgcaguaccgguuuaccauuaucaacagcaaacagaugggaucuuauuccugcuucuuucgcgaggaaaaggagcaaagaggcacauucaauuuuaaagucccggagcuucacgggaagaacaagccccugauuagcuacgugggagacucuaccguucucacauguaaaugccagaauuguuucccucugaacuggaccugguauuccagcaauggcuccgugaagguccccgugggcguucagaugaacaaauacgugaucaacgggacguaugcgaaugaaacaaagcugaaaaucacccagcuccuggaggaagauggagagucuuacuggugccgggcccuuuuucaacugggcgaaagcgaggagcauauugaacucgucgugcuguccuaccuugugccucugaagcccuuccucgucaucguugcugaggugauucugcugguggccacaauccuccugugugaaaaguauacccagaaaaagaaaaagcacagcgacgaggggaaagaauuugagcagauugagcagcuuaagucugaugacuccaacggaaucgaaaauaacgucccgcgccaucggaaaaaugagagccugggccaauga

SEQ ID NO: 68811 - RNA, 765 nt, Artificial Sequence
  derived and/or modified sequence opt5 from EMC10__Homo_sapiens__NP_778233
auggccgcugccagcgcgggcgcuaccagacugcuccugcuucugcucauggccguggccgcucccucccgggcccgcgggucuggaugcagagcuggcacaggggcccggggagcgggcgccgaggggcgcgaaggagaggcuuguggcacggucggccugcuucuggaacacagcuucgagaucgacgauuccgccaacuuuagaaagcgggggucucuccuguggaaucagcaagacggaacccugagccucucccagcgccagcugucugaagaggagagaggccggcuucgcgauguugcugcccugaacgggcucuacagagugcggauuccucgcagaccgggagcgcuggacggccuugaagccgggggauaugugagcuccuucguccccgcuugcagccugguggagucucaucucuccgaucagcugacacugcacguugacguggccggcaaugucgugggcguuagcguggucacccauccugggggaugucggggccacgaaguggaggauguggaccucgagcuguuuaacacaucuguccaacuucagcccccuaccacagcucccgggccugaaaccgccgccuucaucgagcgccuggaaauggagcaggcucagaaagcgaagaauccgcaagaacagaaauccuuuuucgccaaguacuggcauauuauccucggaggcgcuguucugcuuacggcccugagacccgccgcuccugggcccgccccucccccgcaggaggcguga

SEQ ID NO: 68812 - RNA, 894 nt, Artificial Sequence
  derived and/or modified sequence opt5 from EMC2__Homo_sapiens__NP_055488
auggccaaggugagcgagcuguacgacgucaccugggaagagaugagagauaaaaugcggaaguggcgcgaagagaacuccagaaauucugaacagaucguugaggugggcgaggaacucauuaacgaguaugcuagcaaacugggggacgauaucuggauuaucuacgaacaagugaugauugccgcgcuugacuauggacgggaugaccuggcucucuucugccugcaggagcuucgcagacaguuucccggcucccaccgggucaagcgccugacagggaugagauucgaggccauggaacgguacgaugacgccauccagcucuaugaucgcauccugcaagaggacccuacgaauaccgcugccagaaaacggaagauugcuauccgcaaggcccaggggaaaaacguggaagcgauuagagagcugaaugaauaccucgagcaguuuguuggcgaucaggaggccuggcaugaacuggcugagcuuuauaucaacgaacacgacuacgccaaggcugccuucugucuggaggaacucaugaugacaaauccgcauaaccaccuguacugccaacaguaugcggaggugaaauacacccagggaggacuugagaaucuggaacucucucggaaguauuuugcccaggcucugaaacugaacaaucgcaacaugagagcccucuucggccuguacaugagcgcuucccauauugccucuaaucccaaggccagcgcuaagaccaaaaaggauaacaugaaauaugcguccugggccgcuagccaaaucaaucgggccuaccaguuugccggcagaucuaagaaagagacaaaguauucccuuaaagcugucgaagacaugcuggagacacuccagauuacccaaagcuga

SEQ ID NO: 68813 - RNA, 786 nt, Artificial Sequence
  derived and/or modified sequence opt5 from EMC3__Homo_sapiens__NP_060917
auggccggccccgagcugcuccuggacagcaacaucagacuuugggugguccugccuauuguuaucauuaccuucuuuguggggaugauccggcacuacguguccauucuccugcagucugauaagaaacuuacacaagaacaggucagcgacucccaggugcugauccgcucuagaguucuccgggagaauggaaaguauaucccgaaacagagcuuccugacgcgcaaguacuauuuuaacaaucccgaagauggcuucuuuaaaaagaccaagagaaaaguggucccucccuccccuaugacagaccccaccaugcugacagauaugaugaaggggaacgugaccaauguucucccuaugauucugaucggaggcuggauuaacaugacauucucuggguuugugaccacgaaagucccguucccccuuacccugcgguuuaagccuaugcuccaacagggaaucgagcugcuuacacuggacgcuagcuggguguccagcgccucuugguacuuccucaauguguuuggccugcgcuccauuuauagccugauccucggccaggauaacgcggcugaccagucuagaaugaugcaagaacagaugaccggggccgccauggcuaugcccgccgauacaaauaaggcuuucaaaaccgagugggaggcccuggaacuuacggaccaucagugggcgcuggaugacgucgaggaggaacucauggccaaggaucugcacuuugagggaauguucaaaaaggaacuucagacauccauuuucuga

SEQ ID NO: 68814 - RNA, 729 nt, Artificial Sequence
  derived and/or modified sequence opt5 from EMC7__Homo_sapiens__NP_064539
auggccgcugcccuguggggcuucuuucccgugcuccugcuucugcuccugagcggggacguccaguccucugagguuccuggagcggcugccgaaggcagcgggggauccggcguggggaucggagauagauucaagauugagggccgggccguggucccgggcgugaaaccccaagacuggaucucugcugcccgcguucuuguggauggggaggaacacgucggauuucugaagaccgacggcagcuucgugguucaugauauuccuuccgggucuuacguggucgaaguggugagccccgcuuauagauuugacccuguccggguugauaucacauccaaaggaaagaugcgcgccagauacgugaacuauauuaaaacgagcgaggugguccggcuccccuacccucugcagaugaagucuuccggcccgcccagcuauuucaucaagcgcgagucuuggggguggaccgacuuucugaugaauccuauggugaugaugaugguucucccccugcuuaucuucgugcugcucccuaaagucgugaacacauccgaucccgacaugagacgggaaauggagcagagcaugaauaugcugaacucuaaucacgaacuuccggauguuuccgaguuuaugacccgccuguucagcuccaagucuagcggaaaauccagcucuggcuccagcaagacaggcaaaucuggggcgggaaagagacgguga

SEQ ID NO: 68815 - RNA, 381 nt, Artificial Sequence
  derived and/or modified sequence opt5 from EMC8__Homo_sapiens__NP_001135760
augcccggcgugaagcugaccacacaggccuacugcaaaaugguccuccacggggcuaaguauccucauugugccguuaacggacugcuuguggcggagaaacaaaagccgagaaaagaacaucugccccucggcgggccuggagcucaccacacgcuguucguggacugcaucccccuuuuucauggcacccuggcccucgccccuaugcuggaggucgcucugacacucauugauagcugguguaaggaccacuccuacgugaucgccggguauuaccaggcuaaugaacggguuaaggaugccucucccaaccagguggcggagaaagucgccagccgcauugcugaaggauucuccgacaccgcccugaucauguga

SEQ ID NO: 68816 - RNA, 747 nt, Artificial Sequence
  derived and/or modified sequence opt5 from EMCN__Homo_sapiens__NP_001153166
auggagcugcuccaggugaccauccuguuccuucugcccagcauuugcuccucuaacagcacaggcguccucgaagccgcuaauaacucccugguugugacgaccacaaagccuucuaucaccacaccgaauaccgagagccuucagaaaaacguggucacacccaccacggggaccacaccuaagggaaccauuacaaaugaacugcucaaaaugucccugaugucuaccgccacguuucugacaagcaaggacgagggccucaaagcgaccacaaccgaugugagaaagaacgacuccaucauuagcaauguuaccgugacaucugucacgcugcccaacgcuguguccacccuucaaagcucuaagccuaaauccagcguucugcagcccgaugccucuccuuccaagacagggacccucacaagcaucccggugaccauccccgaaaauacgucccagucucaagucauuggaacagagggcgggaaaaacgccagcaccuccgcuaccagccggucuuacuccagcaucauucugccuguggugaucgcccuuauugucaucacacugucuguuuucgugcucgugggacuguaucgcauguguuggaaggcugaccccggcaccccugagaauggcaacgaucagccccagagcgacaaagaauccgucaagcugcucacagugaagacgauuucucacgagagcggggaacauuccgcccagggaaaaaccaagaauuga

SEQ ID NO: 68817 - RNA, 765 nt, Artificial Sequence
  derived and/or modified sequence opt5 from EMD__Homo_sapiens__NP_000108
auggacaacuacgccgaucugagcgacaccgagcucacaacgcugcuuagacgguauaauaucccccacggcccuguggucggguccacccgcagacuguacgaaaagaaaauuuucgaguaugaaacacagcggcgcagacucucuccgcccagcuccucugcugccagcuccuacucuuuuagcgaucugaacuccacccggggagacgcggauauguaugaccuuccuaagaaagaggaugcucugcucuaccaaagcaagggcuauaaugacgauuacuacgaagagucuuauuucacaacccgcacauacggggagcccgaauccgccggaccuagcagagccguucggcagucugugaccuccuuucccgacgcugaugccuuccaucaccaggugcaugacgaugaccugcugagcagcuccgaggaagagugcaaagaccgcgagagaccuauguauggccgggauagcgcuuaccaguccaucacgcacuaucgcccggucucugccagcagauccagccucgaccugucuuacuaucccaccuccagcucuaccagcuuuauguccucuagcuccucuucuuccagcuggcuuacacggcgcgcgauuagaccugaaaaccgggcccccggggcuggacugggccaagauagacaggugccucucuggggccagcugcuucuguuccucguuuuugugaucguccuguucuuuauuuaccauuucaugcaggccgaggaagggaaucccuuuuga

SEQ ID NO: 68818 - RNA, 1713 nt, Artificial Sequence
  derived and/or modified sequence opt5 from EME1__Homo_sapiens__NP_689676
auggcccugaagaaaagcucccccucucucgacagcggcgauuccgacucugaggaacugccuaccuucgcuuuucuuaagaaagagccgagcuccacaaagagacggcagcccgaacgcgaggagaaaaucguggucguugauauuucugacugcgaagccagcuguccucccgcgccugagcuguucuccccucccgugccggaaaucgcugagacggugacccaaacacagcccgucagacuccugagcucugaauccgaggaugaggaagaguuuauuccucuugcccagcggcugaccugcaaguuccucacacacaagcagcugagccccgaagacucuuccagcccugugaaaucuguucuggaucaucaaaacaaugagggggccuccugugacuggaagaaacccuuuccgaagaucccugaagugccccuccacgauaccccugagcgcagcgcugccgacaacaaagaucugauucuugaccccugcugucagcugcccgcuuaccucuccacaugcccuggacagucuagcucccuggccgucaccaagacgaauagcgauauccuuccgccccagaagaaaaccaagccuucucaaaaagugcagggcagagggucccauggaugucggcagcagcgccaagcgagacagaaggagagcacacugcggcgccaggaacggaaaaacgccgcucucguuaccagaaugaaggcccaacgccccgaggaaugccugaaacacaucauugugguccuggacccugugcuccugcagauggagggcgggggacagcuucugggcgcucuccagacaauggaauguagaugcgugaucgaggcccaagcgguccccuguucuguuaccuggcggcgcagagccggcccgagcgaggaccgggaagauuggguggaggaaccuacggugcugguccuucugagagcugaggccuucguguccaugauugacaaugggaagcagggaucucucgauagcacaaugaagggcaaagaaacccugcagggguuuguuacagacaucaccgcuaagaccgccggaaaagcccugucccucgugauugucgaucaggagaagugcuucagcgcucaaaaucccccucgccggggcaaacagggggcgaacaagcagacaaagaaacagcaacagagacagcccgaggccucuaucggauccauggugagccgcguugacgcugaagaggcccugguggaucuucagcugcauacggaagcccaagcucagauuguccagucuuggaaggagcucgccgacuuuaccugcgcguucacaaaagcuguggccgaggccccuuuuaagaaacugcgggaugaaaccacauucuccuuuugucuugagagcgacugggcuggcggcgucaagguggaucuggccgggagaggacucgcucugguuuggcgccggcaaauccagcagcugaacagagugucccucgaaauggccucugcggucgugaaugccuaucccagcccgcagcugcuuguucaggcuuaccaacagugcuucuccgacaaggagcgccagaaccugcucgccgacauccaagugcggagaggcgaaggggucaccucuacgagccgccggauuggaccugagcuguccagacggaucuaucugcagaugacaacccuucagccccaccucagccuggauucugcugacuga

SEQ ID NO: 68819 - RNA, 735 nt, Artificial Sequence
  derived and/or modified sequence opt5 from EMG1__Homo_sapiens__NP_006322
auggccgcucccagcgacggcuucaagccuagagagcgguccgggggagaacaggcccaagauugggacgcgcugccgcccaagcgcccuagacucggcgcugggaacaagaucggaggccggcgccugauugugguccuugagggggccucucuggaaaccguuaaagugggaaagacauacgagcuccugaauugcgauaaacacaagagcauccuucugaagaacggcagagaccccggcgaagcccggccugauauuacgcaucagucccuccugaugcugauggacucuccccucaaucgcgcugggcugcuucagguguauauccacacccagaaaaacguccugauugaggugaauccucaaacaagaaucccgcggaccuuugaucgcuucuguggacucaugguucagcugcuucauaagcugagcgugagagccgcugacggcccccagaaacuccugaaggucaucaaaaacccuguguccgaucacuuucccguugggugcaugaaggugggaacaucuuucagcauuccugucguguccgacgugcgggagcugguccccagcucugauccgaucguuuuuguggugggcgccuucgcgcaugggaaggucuccguggaauacaccgagaaaaugguuagcauuucuaauuauccucucuccgccgcucugacaugugccaaacuuaccacggcuuuugaagagguguggggagucaucuga

SEQ ID NO: 68820 - RNA, 3051 nt, Artificial Sequence
  derived and/or modified sequence opt5 from EMILIN1__Homo_sapiens__NP_008977
auggcccccagaacccuguggagcugcuaccucuguugccugcuuacagcugccgcgggcgcugccuccuauccuccgcggggguucucucuguacacgggaagcuccggcgcccucucucccgggggaccucaggcucaaaucgcuccccgcccugccagcagacaccggaacuggugugccuauguggucacccgcacaguuuccugcgugcuggaggacggcguggaaaccuacgucaaguaucagcccugugcgugggggcagccucagugcccgcaaucuauuauguacagacgguuucuucgccccagauaucggguggccuacaaaacaguuaccgauauggaguggcgcuguugccagggauacggcggcgacgauugugcugaaagcccugcccccgcucuggggccugccuccagcacacccagaccgcucgcgcggccugcccgccccaaucugucuggauccagcgcuggcucuccucuguccgggcucggaggcgaggggcccggagaaagcgagaaggugcagcagcuggaggaacaaguccagucucuuaccaaagagcugcagggccucagaggcgugcugcaggggcuuuccggacggcuggccgaagacguucaacgcgcuguggagacggccuucaacggcagacagcagcccgccgaugcugcggcccggccugggguccaugagacccucaaugaaauccaacaccagcugcagcugcucgacacaagagugagcacccaugaucaggagcugggacaccuuaacaaucaucacggcggguccucuagcuccggaggcagccgcgcuccggcccccgccucugcuccucccggcccuuccgaggagcugcuccggcaacuggaacagagacuucaggagagcugcucugugugucuggccgggcucgacggauuucgccggcagcaacaggaggauagagaacgccugcgggcgauggagaagcugcucgcuagcgucgaagagagacagcgccaccuggccggccuugccguugggcggagacccccgcaggaaugcugcuccccugagcugggacgccggcucgcugagcuggaaagacggcuugacgugguggccggcucugucacagugcugagcgggcgcagaggcaccgagcucggaggcgcugccgggcaaggaggccaucccccuggguauacgucccuggcgagccggcugucuagacucgaagaucgcuucaacuccacacugggacccagcgaggaacaggaggagucuuggccuggcgcccccgggggccuuucccacuggcugccggcugcccggggaagacucgaacagcugggcgggcugcuugcuaauguuagcggagagcucggcgggcgccuggaccugcucgaagaacagguggccggagcgaugcaagccuguggccagcugugcuccggggcuccuggcgagcaggauucucaagucagcgaaauucuuuccgcccuggagagacgggugcucgacucugaaggacagcugcgccugguuggcagcgggcuucauaccguggaggcugccggagaagccagacaggcuacacucgagggccugcaggaggucguggggcggcugcaagaccgcgucgaugcgcaggacgaaaccgccgcugaguuuacccucagacugaaccuuacagccgcccggcugggacagcucgaaggccugcugcaggcucacggggaugagggcuguggagccugcggcggggugcaagaggaacuuggacgccucagagacggcguugagcgguguuccugcccccugcugcccccucgcgggccgggagcgggccccggcgucgggggaccuagcagaggcccccucgauggguucucuguguuuggaggcuccagcgggucugcucugcaggcccuucagggagaacuguccgaggugauccucagcuucucuagccugaaugacucccugaacgaacuucagacgaccguugagggccaaggcgccgaucucgcugaccugggggccacaaaagaucggauuaucagcgaaaucaauagacugcagcaggaggcgaccgagcacgcuacagaaucugaggaacgcuuucggggacucgaggagggccaagcccaggccgggcaguguccuucccuggaaggaagacuuggccgccuggagggggugugcgaacggcucgacaccgucgcuggaggccugcagggccugagagaggggcuuagccgccauguggccggacugugggcuggccuccgggaaacgaacacaaccucccaaaugcaggccgcgcugcucgagaagcugguugggggacaggccggccuugggagacgccugggagcucucaauucuagccugcagcugcuugaggaucggcugcaccaacucucccugaaggaccucaccggccccgccggcgaagcugggccucccggaccgccuggccugcaggggcccccuggacccgccggcccgccugggucucccggaaaagacggccaggagggcccuauugggccucccggaccccagggcgaacaagggguggagggagccccggcugcgcccgucccucagguggccuucagcgcugcccuuucccugcccagaucugaaccuggcacagugcccuuugaucggguccuccugaacgacgggggauacuaugauccugagaccggcguguucacagccccgcuggcuggccgcuaccuucugagcgccguucucacggggcauagacacgagaagguggaagcgguccugucccggagcaaucagggaguggcucgcguugacucuggcggguaugagcccgaaggacucgagaacaaaccuguggccgaaucccagcccagcccuggcacccugggggucuuuucucuuauccugccccugcaagccggagauacaguguguguugaccucgugaugggccagcuggcucauuccgaggagccgcuuaccauuuucagcggcgcccugcucuacggggauccugaacuggagcacgcguga

SEQ ID NO: 68821 - RNA, 3162 nt, Artificial Sequence
  derived and/or modified sequence opt5 from EMILIN2__Homo_sapiens__NP_114437
auguggcagccccgccggccuuggccgcgcgugcccuggagaugggcccuggcucuccuggcccuugucggcgcggggcugugccacgcuggaccucaacccggcuacccugcccggcccagcgcccgcaacaagaauuggugugcuuauaucguuaacaaaaauguguccugcucugugcucgaggggagcgaauccuucauucaggcccaguacaacugugcuuggaaucagaugccuugcccgucugcccuggucuauagagugaacuuucggccccgcuacguuaccagauauaagacagugacgcaacuugaguggcgguguugcccuggauuccgcggcggggacugucaggaaggacccaaagauccugucaagacccugagacccacaccggcgcggccucgcaauagccucaaaaaggccaccgacaacgagcccucccaguuuucugaaccuagaaagacacugagccccaccggcacagcucagcccuccuggggcguggauccuaaagaggggccgcaagagcugcaggaaaagaaaauccagguucucgaggaaaaggugcugcggcuuacccgcacgguccuggaccuccagagcucucuggccggaguguccgagaaucuuaaacaugcuacccaagaugacgccagcagaacacgggcgcccggccugucuucccagcacccuaagcccgauaccacagugagcggggacaccgagacgggacagucuccuggcgucuucaacacaaaggaauccgggaugaaagauauuaagagcgagcucgccgaaguuaaagacacccugaagaauaaauccgauaagcuggaggaacucgacggaaaagugaagggcuacgagggccaacugagacagcuucaggaggcugcccaggggcccacagugaccaugaccacaaacgaacuguaucaggcuuacgucgauucuaagaucgacgcccuccgcgaggaacugauggagggaauggaccggaaacuugccgaucugaagaauagcugcgaauacaaacucacgggccugcaacagcagugugacgauuauggguccagcuaccugggagugauugagcucaucggcgagaaggaaaccucucugagaaaagagaucaacaaucuucgcgcucggcugcaagaaccguccgcgcaggccaacugcugugacagcgagaagaacggggauauuggacagcagaucaagacacucgaccaaaagauugaaagaguugcugaggccacccgcaugcugaauggccggcuugauaacgaguuugacagacugaucgugccugaacccgaugucgacuucgaugccaaguggaaugagcucgacgcucgcauuaacgugacagaaaagaaugccgaggagcauugcuuuuauaucgaagagacccugcggggcgcgauuaacggggaaguuggagaccugaagcagcucguggaucagaaaauccagucucuggaggacagacuuggcagcguccugcuccaaaugacgaauaacacaggggcugaacuguccccucccggagccgccgcucugccuggcgugucugggagcggcgaugagcgcgucaugauggagcuuaaucaccucaaggacaaggugcagguuguggaagauaucugccugcugaacauucagggaaaaccccauggcauggagggggcccucccgaaucgggaagacagagcuguccgggauucccugcaccuucugaaaagccucaacgacaccaugcaccgcaaauuccaagagaccgaacagacaauccagaagcugcagcaagauuuuucuuuccuguacucccagcuuaaucauaccgagaacgacgugacacaccuccagaaagagaugagcaauuguagagccggagaaaacgcgggcauggggcgguuuacgaagguuggagagcaggaaagaaccguggauacacugccuucuccccaacaucccgucgcccacugcuguucccagcuggaggaacgcuggcagcggcuccagagccaagugauuuccgagcuggacgcuugcaaggaguguacccagggcgugcagagagaaguuucuauggucgaggggcgcgugagccacauggagaaaacaugcuccaaacuugauucuaucagcggcaaccugcaaagaauuaaagaaggacucaauaagcauguguccagccuguggaacuguguccggcagaugaauggcacccugcgcucucacuccagagacaucagcgggcuuaaaaacucugugcagcaguucuauucccauguuuuucaaaucagcacggaccuccaggaucuggugaaguuccagccuucugccaaagcuccgagcccgccucccccugccgaggcgcccaaggaaccucugcagcccgagccggccccuccccggccuuccggacccgcuaccgccgaagacccgggccgcagaccuguccucccccaacggccucccgaggaaagacccccucagccgcccgggagcacaggagugauugcugagaccggccaggccgggccucccgccggcgcuggaguuucuggccgcgggcugccucggggaguggauggccagacaggguccggaaccguccccggcgcggagggguucgccggcgcuccuggauaccccaagagcccucccguggccucccccggcgccccuguucccucucuugugagcuuuuccgcugggcugacgcaaaaaccguucccuucugacggaggcgucgugcucuuuaauaaggugcuggucaacgauggggacguuuauaaucccagcacaggaguguucaccgcccccuacgauggccgcuaccugaucacagcgacccuuaccccugaaagagacgcuuauguggaggccguccucuccgugucuaacgccagcguugcucagcugcacacagccggcuaccggagagaauuucuggaguaucauagacccccuggggcgcuccacacgugcggaggcccgggggcuuuccaccugauugugcaucuuaaagccggagaugccgucaaugugguugugaccggcgggaagcuggcucacacagacuuugaugaaauguacuccaccuucagcggagucuuucucuaucccuuccugucucaucuguga

SEQ ID NO: 68822 - RNA, 2301 nt, Artificial Sequence
  derived and/or modified sequence opt5 from EMILIN3__Homo_sapiens__NP_443078
augggcagacggcgccugcucguguggcugugcgccgucgcugcccuucugagcggggcgcaggcuagaggaacaccccuccuggcccggccugccccgcccggcgcuucccgcuacucucuuuauaccacgggguggagaccucggcugcgccccggaccucacaaggcccucugugcuuacguugugcauagaaacgugaccugcauccugcaagagggcgccgagagcuaugucaaggcggaguaccggcagugucgcugggggcccaagugcccuggaacagugaccuauagaacaguucugcggccgaaauacaaggugggcuauaaaaccgucacagaccucgccuggcgcuguugccccggcuucaccgggaagagauguccugaacaccugacggaucauggagcugccucuccccagcuugagccugaaccccagauuccguccggccaacuggacccugggccccggccucccagcuacucccgcgcugcccccucuccucacggaagaaagggcccggggcucuuuggagagcggcuggagagacuugaaggcgaugugcagcgccuggcgcagaccuacggcacacucagcgggcugguugccucccaugaggaccccaaucggaugaccggaggcccuagagcucccgccgugccugucggguucggagugauccccgaaggccugguggggccgggagaucgcgcucggggcccucucacacccccucuggacgagauucuuagcaaagucaccgagguuucuaacacgcugcagacaaaggugcaacuccuggauaaagugcacggccuugcccuggggcacgaagcccaucuccagagacugcgcgaggcucccccuagcccccugaccucccucgcgcugcuugaagaguaugucgaccggagacugcaccgccucuggggaucucugcuugauggcuuugaacagaagcugcagggggugcaauccgagugcgaccuccggguucaggaggugagacgccagugugaagagggacaagccgcuagccggagacugcaucagucucuggauggccgggaacucgcccugcgccaggagcuuucccagcuggggagccaacuccagggccuguccgucucuggaagaggcagcugcugugggcagcuggcccuuaucaaugcucggauggacggacucgaaagagcccugcaggcggugacagagacccaacgcggcccgggggcuccugccggagaugagcugacccggcucuccgccgcuaugcuggaaggcgggguugacggccuucuggagggacucgaaacacugaacggcacggaagggggagccagaggcugcugccugcgccuugacaugggaggguggggcgucgggggcuucggaaccaugcucgaggagagagugcagagccuggaggaacggcuggcuacacucgccggcgagcugucucacgauuccgcgagccccgggcgcucugccagaccccuugugcagaccgaacuggcuguccucgagcagcggcuggugagccuggagacauccuguaccccuucuacgacaagcgccauucuugacucccucguugcugaagugaaagccuggcaaagccgcucugaggcgcugcugagacaggucgccucccacgcugcccuccugcagcagcuuaauggaaccguggcugaaguucaaggccagcuggccgaggggaccggaagcucucuccagggcgaaaucacacugcugaaggugaaccuuaauuccgucagcaagucccucaccgggcugucugauagcgugucccaauacucugacgccuuucuggcugcgaacacaagccucgaugagcgggagcgcaaaguggaagccgagguucaggcuauccaggaacaggucuccagccaaggcucuagacugcaggccggacaucgccaggugcuuaaucugcggggcgagcucgaacagcugaaggccgggguggcuaaagucgccuccggacugagcagaugccaagacacggcgcagaaacuucagcacaccgugggccauuucgaucagcggguugcucaaguggagggggccuguagacgccugggacuccuggccgcuggccucgacucucugccgacagagccccuucggccuagagaaggccuguggucccacgucgaucagcucaaccgcacccuggcccagcauacacaagacauugcgcggcugagagaugaccuucuggacugccaggcucagcucgccgaacaggugcgccccgggcaagccaauuga

SEQ ID NO: 68823 - RNA, 2505 nt, Artificial Sequence
  derived and/or modified sequence opt5 from EML1__Homo_sapiens__NP_001008707
auggaggacggcuucagcuccuacucuagccuguaugauaccuccucucuccugcaguuuugcaacgacgauagcgccuccgcugccucuagcauggaagugacagacagaaucgcgucccuugagcaacggguccagaugcaggaagaugacauucagcugcucaagagcgcucuggccgauguugugcgcagacuuaauaucacggaggaacaacaggccgugcugaaccggaaagggcccaccaaggcucgcccucucaugcagacacugccgcugagaaccacagucaauaacggaaccgugcuccccaaaaagccuacaggcucucugcccuccccuagcgggguucggaaagagaccgccgugcccgcuacgaagcgccuuaauagaucugucucccugcucaacgccuguaagcugaaucggagcaccccuucuaacauuaaacgcacauccagcuccgagagagugucuccgggaggccggcgcgaaagcaauggggacuccagaggaaaccggaaucgcaccggcagcacaucuuccagcucuagcggcaagaaaaacuccgagucuaagcccaaagaaccuguuuucagcgcggaggagggguacgugaagauguuucuuagaggacggcccgucaccauguauaugccuaaggaucagguggacuccuacagccuggaagccaaaguggagcuccccacgaagagacugaaacuggaaugggucuauggcuaccgcgggcgggauugcagaaauaaccucuaucugcuuccgacaggagagaccguuuacuucaucgcuucuguggugguccuguacaauguggaggaacaacuccagcgccacuaugccggccauaacgacgauguuaagugucuggcugugcacccugaccggauuacaaucgccaccgggcaggucgcgggaaccuccaaagacggcaagcagcuucccccucaugugagaaucugggauagcguuacacugaacacgcuccacgugauuggcaucggguuuuucgaccgcgccgugaccugcauugcuuuuucuaaauccaauggaggcacaaaccugugugccgucgaugacagcaaugaucauguccuguccgugugggacuggcaaaaggaggaaaagcucgcugauguuaaaugcucuaacgaggccguguucgccgcugacuuucaccccaccgauacaaauaucauugucaccuguggaaagagccaccuguacuucuggacgcuugaaggguccucucugaacaaaaagcagggccucuuugagaaacaggaaaagcccaaguucgugcugugcguuacauuuagcgagaauggggacaccaucaccggagauuccagcggcaacauucuuguguggggcaaagggacaaaucggaucucuuaugcgguccaaggagcccaugagggcgggaucuucgcucuguguaugcucagagacggaacccugguguccggcgggggcaaggaccgcaaacugauuagcuggucuggaaacuaccagaagcuccggaaaacagaaaucccugagcaguucggcccgauuagaacgguggccgaagggaagggagauguuauccugauuggcaccacacgcaauuuuguccuucaggggacccuguccggagacuucacacccaucacccaaggccacacggaugagcucugggggcuggccauccaugcuagcaagucucaguuucugaccugcggccacgacaaacacgccacacuuugggaugcggugggacaucggccugugugggacaagauuaucgaagaucccgcucagagcuccggcuuccacccuagcgggucugucguggccguuggaacccucacaggcagaugguuuguguucgacaccgagacgaaagaucuggucacagugcauaccgacgggaacgagcagcuguccguuaugcgguauagccccgauggaaauuuucucgccauuggcucccacgacaacuguaucuacauuuauggggugucugauaauggccgcaaguacacaagagucggaaaaugcagcggccauuccucuuucaucacccaccuggacuggagcgugaacucccaauuucuuguuucuaacagcggggacuacgaaauccuguauugggugccguccgcuugcaagcaggucgugagcguggagaccacacgggauauugaaugggccacguacaccuguacacucggauuccacgucuuuggcguuuggccugaggggucugacggaaccgauaucaaugcugugugcagagcccaugagaagaaacugcuguccacaggcgacgauuucgggaaggugcaccuuuuuagcuaucccuguucucaguuccgcgcgccuucccauauuuacggcggacacagcucucacgucaccaacguggacuuccucugcgaagauucccaucugaucagcacgggcgggaaagacacauccauuaugcaguggcggguuaucuga

SEQ ID NO: 68824 - RNA, 2553 nt, Artificial Sequence
  derived and/or modified sequence opt5 from EML2__Homo_sapiens__NP_001180197
augcuggagagacgggcccuccuguggcagcgcgaagcuggccccggguggggagacagagcccgggcgggcaccgggggagcuggcgggggaugcggcggcgccauggccgagcgcgggccugcuuucuguggacuuuacgauacaagcucccugcucagauauugcaacgacgauaaucugucuggcacgagcgggauggaaguggacgaucgggucuccgcccuugagcaacgccugcagcuccaggaagacgagcuggcuguucugaaggccgcgcucgccgaugcucugagacggcuucgcgccugugaggaacagggagcugcccugagagcgcggggcaccccgaaagggcgcgcucccccuagacucggaacaaccgccucugugugccaacugcuuaagggccugcccacacggaccccucucaacggcagcgggcccccucgcagagugggaggcuacgccacauccccgucuagccccaaaaaggaggcuaccuccgggcggagcucugucagacgcuaucuguccccugaacggcuggccagcgugagacgcgaggacccccggucuagaacgaccuccucuagcuccaauuguagcgccaaaaaggagggaaagacaaaagaaguuaucuuuuccguggaggauggcucugucaagauguuccuccgcgggcggccugugcccaugaugauuccggacgaacuggcuccuaccuacagccuugauacaagauccgagcugcccagcugccgccucaaacuggaauggguuuauggauaccggggcagagacugucgcgcgaaccuuuaucugcucccuaccggcgagaucguguacuuugucgccucuguggcugugcuguacuccgucgaggaacagcggcagagacacuaucuggggcauaaugaugacauuaagugccucgccauccaccccgacaugguuacgauugccacaggacagguggcuggcaccacaaaagaggggaagccccugccuccgcaugugcggaucugggauagcgucucucuuagcacccugcacgugcucggacugggcguuuucgaccgcgccguguguugcgucggguuuuccaagucuaacggcggaaaucuucugugugcgguggaugaaagcaacgaccauaugcucuccguuugggauugggcuaaagagaccaagguggucgacgugaaaugcagcaaugaagccguccugguggccacauuccaccccacggauccuaccguucugaucacaugcggcaagucucacauuuacuuuuggacccucgaagggggaucccugagcaaaagacaaggccuuuucgagaagcaugagaaacccaaguaugugcugugugucacauuucucgaagggggagacgugguuaccggcgauucugggggcaaccuguacguguggggaaagggcgggaaucggaucacgcaggcuguccugggagcccacgacggcgggguguucggacuuugcgcucucagagauggcacacugguguccgggggcggacgcgaccggagaguuguccuguggggcagcgacuauuccaaacuccaggagguggaggugccugaagauuuugggcccguccgcaccguggccgagggacauggcgacacccuguacguugggacaaccagaaacucuauucuucagggaagcgugcacacaggcuucucccugcucguccaagggcacguggaggaacuguggggccuggcgacgcauccgucucgggcccaguuuguuaccuguggacaggauaaacuugugcaccucuggagcuccgacagccaucaaccucuguggucucgcaucauugaggaucccgcuagauccgccggcuuccacccuagcgggucuguccuggcugugggaacaguuaccggccgguggcuccugcuugacacagaaacccaugaucugguggccauccacacggacgggaaugagcagauuuccgucgugagcuucucucccgauggagcguaucucgccgugggcagccacgacaaccuggucuacguuuacaccguggaucagggcgggcgcaagguguccagacugggaaagugcagcggccauucuuccuuuaucacacaccuugacugggcucaggauagcuccuguuucgucaccaauucuggggacuaugagauccucuacugggacccugccacaugcaaacaaauuaccagcgcugaugccgugcggaacauggaaugggccacggcuacauguguucugggauuuggcguguucgggaucugguccgagggagcggacggcaccgauauuaacgccgucgcucgcucucaugacggcaagcugcucgccagcgccgaugacuuugggaaggugcaccuguucuccuaucccugcugucagccgagagcucuuucucacaaauacggaggccauagcucccacguuacaaauguggccuuucugugggaugacagcauggcgcucaccaccgggggaaaggauacaucuguccugcaguggcgggugguuuga

SEQ ID NO: 68825 - RNA, 2772 nt, Artificial Sequence
  derived and/or modified sequence opt5 from EML4__Homo_sapiens__NP_001138548
auggacggcuucgccgggagccuggaugacuccaucucugcugccagcaccuccgaugugcaggacagacucucugcgcuggagagccggguccaacagcaggaagaugagauuacaguucuuaaggcugcccuggccgacgugcuccgcagacuggcuaucuccgaagaucacguggccucugucaaaaagagcguguccagcaaaggacagcccucuccucgggcuguuauuccgauguccugcaucacgaacggcagcggggccaaucgcaagcccucucauaccuccgcggugagcauugccggaaaagagacacuuucuuccgcugccaagagcaucaagagaccuucccccgcugaaaaaucucacaacagcugggaaaauuccgacgauagccggaacaagcugucuaaaaucccuuccacccccaagcucauuccuaaagucacaaagaccgccgacaagcauaaagaugugaucauuaaucaagagggcgaauacaucaagauguuuaugcgcgggagaccgauuacaauguucauccccagcgacguugauaacuaugacgacauucggaccgagcugccucccgaaaaacugaagcucgagugggcguacggauaucgcggcaaagauuguagagccaauguguaccugcuuccuacgggcgagaucgucuauuuuaucgcuucuguggugguccuguucaacuacgaggagcggacccagcgccacuaucucgggcauacagacugcguuaagugucuggccauucaccccgauaaaaucagaauugcuaccggacagaucgccggcguggacaaggaugggcggccgcuucagccucacgugcgcgucugggacagcgugacacuguccacccuccaaauuaucggacugggcacguuugaaagagggguuggaugccuggauuucucuaaggccgacagcggcgugcaucucugugucaucgaugacuccaaugagcacaugcugacagugugggauuggcagaaaaaggcuaaaggcgcggaaauuaagaccacaaacgagguugugcuugccgucgaguuucaucccaccgacgcuaauaccaucauuacaugcgggaaaagccacaucuucuuuuggacguggucuggaaacucccugacccggaagcagggcauuuucgggaaguacgaaaaaccuaaguuugugcagugucucgccuuccugggaaauggcgacguccuuacaggggauagcggaggcgugaugcugaucuggucuaaaaccacaguugagcccacccccggcaaggggccuaaaggaguguaccaaaucuccaagcagauuaaggcccacgacggcagcgucuuuacgcucugccagaugagaaacgggaugcugcugacaggaggcgggaaagaucgcaagaucauucucugggaccaugaucugaauccggaacgggagaucgaagugcccgaccaauauggcaccauuagagcuguugccgagggaaaagcggaucaguuccuugugggcaccucccgcaacuucauccugcgggggacauuuaacgacggauuccagauugagguccagggccacaccgaugaacucugggggcuggcuacacauccuuuuaaggaccuucugcucacgugugcccaagauagacaggugugccuguggaauagcauggagcaccgccuggaauggacccggcucguggacgagcccggacauugugccgauuuccacccuagcggcacaguugucgcuaucgggacccacuccggcagaugguuugugcuggacgccgaaacacgcgaccuugugucuauccauaccgauggaaacgagcagcugagcgucaugcgguacuccauugacggcacguuccucgcuguggggagccacgauaauuuuaucuaucuguacguugugucugagaacggaagaaaauauucccgcuacggccggugcaccgggcauagcucuuauauuacacaccuggacuggucccccgauaauaaguacaucaugagcaacucuggagacuacgaaauucuuuauugggauaucccgaauggcugcaagcucaucagaaaccggagcgacuguaaagauauugacuggaccacauauaccugcguccugggguuccagguguuuggcguuuggccugagggauccgauggcacggacaucaaugcccuggugcgcagccacaacagaaaggucauugcgguggccgaugacuucuguaaaguucaucucuuucaauaccccugcucuaaggcuaaagccccuucccacaaguacagcgcucauuccucucacgugacaaaugucagcuucacccauaacgacucccaccugaucucuacagggggaaaagauaugagcauuauccaguggaaacuuguggaaaagcugucccucccccagaaugagaccguggccgacaccacacugacgaaggcgccugucucuagcaccgaguccguuauccagagcaacacacccaccccgccucccucucaaccccugaaugaaacagccgaggaagagucccggauuucuucuuccccuacccuucucgaaaacagccuggagcagacgguggagccgucugaagaucacuccgaggaagagagcgaagagggcuccggggaccugggagagccccucuaugaggaaccuuguaacgaaaucagcaaggagcaggcuaaagccacacugcuugaagaucagcaagaccccucuccuagcuccuga

SEQ ID NO: 68826 - RNA, 5934 nt, Artificial Sequence
  derived and/or modified sequence opt5 from EML5__Homo_sapiens__NP_899243
auggccgcucgcagcgcccccuccugccaucugcggcuggaguggguguacggcuaucgcgggcaucaguguagaaacaaucuguacuauaccgcggcuaaggaaaucgucuacuucguugccggagugggcguggucuauucuccucgggaacaccgccaaaaguuuuacagagggcauagcgacgauauuaucucccuugcccugcacccggaacgggugcucguugcuaccggacaggugggcaaggagcccuauauuugcaucugggacucuuacacgguccagaccauuagcgugcugaaagauguucauacacacgggaucgccugucuugcuuucgaccuggauggacagcgccucguguccgucggccuggacucuaagaacgccgugugcgugugggauuggaaaagaggcaagaugcugagcauggccccugggcacaccgaccggaucuuugauauuuccugggaccucuaccaacccaauaagcuggucagcuguggaguuaaacauaucaaguucuggucucuuugcggcaacgcccugacaccuaaacgcgggguguuuggaaagaccggcgaucuccagacaauucugugucuugcuugcgccagagacgaacugaccuauuccggggcucucaauggagauaucuacguguggaaaggcauuaaccugauccggacgauucagggcgcccacgcggccgggaucuucagcaugaaugcuugugaggagggauuugccaccggcgggcgcgacggaugcaucagacugugggaccucacauucaagcccauuaccgucaucgaucugcgggaaacagaccagggcuauaaggggcuuucugugcgcuccguuuguuggagaggagaucauauucuggugggcacccaagacagcgagaucuuugaaauugucgugcaggagcggaacaaaccuuuccucaucaugcagggccacugcgagggggaacugugggcucuugccguucacccgacgaagccccuggccgugacaggaucugaugacagauccguccgcaucuggagccucguggaucaugcucugauugcccggugcaauauggaggaaccuaucagaugugccgcugucaacgccgacggcauucaccuggcccucgggaugaaagauggauccuuuaccgugcugcgcguucgggacaugacagaggugguccauaucaaggauagaaaagaagcuauucacgagcuuaaguacucucccgacggcaccuaucuggccguggggugcaaugacagcuccguugauaucuacggcguggcgcagcgcuauaaaaaggucggagagugucucggcagccugucuuucaucacccaucuugacugguccagcgauucucgguaccugcaaacaaacgacgggaauggaaagagacucuuuuaccgcaugccuggcgggaaagaagugacgagcaccgaggaaauuaagggagugcacugggcuuccuggacaugcguuucuggccuggaggucaacgggaucuggcccaaauauagcgauauuaaugacaucaacuccguggauggcaacuacauuggacaggugcuggucaccgccgacgauuauggcaucauuaagcuguuccgguacccgugucugagaaaaggggccaaguuccgcaaguauaucggacacagcgcucaugugacaaauguucgguggucucacgacuaccagugggugaucuccauuggcggggccgaucauagcgucuuucaauggaaauucaucccugaaagaaaacuuaaagacgcugugcacauugcgccccaggagucucuggcggauucccacagcgacgaguccgacucugaucucagcgacguuccugaacuggauuccgagaucgaacaggagacccagcugacguaucggcgccaaguguacaaggaagaccuuccccagcucaaagagcagugcaaggagaagcagaaaucugccacaagcaagagacgggaaagagcucccggaaacuccauucgccugcauuuuguccacggcuaccggggguaugauuguagaagcaaucuguucuacacccaaaucggcgagaucguguaucauguugccgcugugggagucauuuacaaccgccagcagaauacccagagauuuuaucucggccacgacgaugacauccugugccuuacaauucauccucugaaagauuacguggccaccgggcaagugggacgggacccgucuauccacauuugggauacagaaacgaucaagccccucuccauccugaaaggccaccaucaguauggggucagcgcgguugacuucucugccgauggaaagcgccuggcuuccgugggcauugacgacagccacaccgugguccuuugggauuggaagaaaggggagaagcucucuaucgccagaggcagcaaagacaagauuuuugugguuaaaaugaacccuuacgugcccgauaagcugaucacagcuggaauuaaacauaugaaguucuggcggaaggccggcgggggacugaucggccgcaaaggguacaucggaacccucggcaagaaugacacaaugaugugugccgucuauggcuggaccgaggaaauggcuuuuuccgggacgagcaccggagaugugugcauuuggagagacaucuuccugguuaaaacagugaaggcgcacgauggcccugucuuuucuaugcaugcccuugagaaaggguucgugaccggaggcaaggacgggauuguugcucugugggaugacuccuuugaacggugucucaagacauacgccaucaaacgcgccgcucuggcccccggaagcaagggccugcuucucgaggauaacccguccauuagagcgaucucucugggccacgggcacauucuggugggaaccaaaaauggcgaaauccucgaggucgacaagagcgggccuaucacgcugcuugugcagggacauauggagggcgaagugugggggcuggcuacacaccccuaucucccuauuugcgccaccgucuccgacgauaaaacacugcggaucugggaccugucucccagccauugcaugcuugccguucgcaagcucaagaaaggaggcagauguugcuguuucuccccugauggcaaggcucuggccguggggcugaacgacggaucuuuccucauggcgaaugcugauacccuggaggaccuugugagcuuucaccaccggaaagauaugauuuccgacaucagauucagccccggcucugggaaguaccuggccgucgccucccaugauagcuuuauugacaucuauaacgugaugucuuccaaacgcguuggaaucugcaagggcgcuaccagcuacauuacacacaucgauugggacauucgggggaagcuccuccaggugaauacgggagccaaagaacaacuguucuuugaggcuccgagaggcaagaaacagaccaucccuucugucgaaguggagaagauugccugggcguccuggacaagcguucuuggccuguguugcgaggggaucuggcccgugaucggagaagucaccgaugugacagccuccugucucaccagcgacaaaaugguccuggcuacgggcgacgaucucggguucgugaagcuguuucgcuaucccacaaaaggaaaguucggcaaguuuaaacgguacguugcccauucuacccacgugaccaacgucagauggacauacgacgauagcaugcuugugacccucggcgggacagacaugucccucaugguuuggacgaaugagauggaaggguaucgcgagaagcggccuugcgauucugaagagagcgacauugauuccgaggaagacggcggguacgauucugacgugaccagagagaacgaaaucagcuauacaauucgcgcucuguccaccaacauccggccgaugcugggaauuaaaccccaucuucagcaaaaggagccuucuaucgaugagagacagggcgucgugcgggggagcagacccccuguguccagagcgcccccucagcccgaaaaacugcagacaaauaacguuggaaagaagaaacggccgauugaggaccucguccuggaacucaucuucggcuaccgcgggagagauugucggaauaacgugcacuaucugaaugacggagacgauaucauuuaccacaccgccagcgugggcauccuucauaacgucgcuacgggcucucaauccuuuuaucaggagcacaaugacgauauucugugccucaccgugaaccagcauccuaaguucaucaauauuguugcgacaggacaggugggagacagcgccgauaugucugcuaccgcccccuccauccacaucugggacgccaugaacaaacaaacacugagcauucugagauguuaccacuccaagggcgucugcucugugagcuuuuccgcuaccgggaaacuucugcucagcguuggacuggauccugaacauacaaucaccauuuggcgcuggcaggagggcgccaagaucgcgucucgggcugggcacaaucagagaauuuucguggccgaguuccgccccgacuccgauacgcaguuugucagcgugggaguuaagcaugugaaauucuggacacucgccggccgggcucugcuuucuaagaaaggccugcugagcacccucgaagacgccagaaugcaaaccaugcuggcgaucgcuuuuggggccaacaaucuuacauucaccggaacgaucuccggcgaugucugcguguggaaggaccacauucugugucgcaucguggcccgggcucauaacgggccggucuuugccauguacacaacccucagagacggacugauuguuacaggcgggaaagagcgcccuucuaaggaaggcggagcugugaagcucugggaucaggagcugagacggugccgcgccuucagacuugaaaccggccaggcgacagacugugugcggagcgucugccgcgggaaaggaaagauccuggugggcaccagaaaugccgagauuaucgagguuggggagaagaacgcugccuguaacauucuggugaauggacacgucgauggccccaucugggggcucgcuacgcacccuucccgggacuuuuuccugucugccgccgaggauggcaccgugagacuuugggacaucgcugauaagaaaaugcugaacaagguuaaucucggacaugcggcccgcacagugugcuauagccccgaaggcgacauggucgcuauugggaugaagaacggagaguuuaucauucugcucguguccagccugaaaaucuggggcaagaaacgggauagacgcugugccauucacgacauccgguucucucccgauuccagauaccuugccgucgggagcuccgaaaauucuguggacuuuuaugaucugacccugggaccuacacucaaccggaucagcuacugcaaggacauuccguccuucguuauccaaauggacuucucugcugauagcuccuaucuccaggugagcucuggcuguuacaaacgccauguguaugagguccccuccgggaagcaccuuauggaccacgccgcgauugauagaaucaccugggcuacguggacaagcauucugggcgacgagguucucggaaucuggucucggcaugccgaaaaagccgaugugaauugcgcuugugugucccacagcggcaucucucuggucaccggggacgauuuuggaauggugaaacuguucgacuuuccuugccccgagaaguucgccaaacauaagcgcuuucugggccacagcccucauguuacaaacauuagauucaccuccggggaucggcacguggucucugcgggaggcgacgauugcagccuuuuuguguggaaauguguccacacaccccacuga

SEQ ID NO: 68827 - RNA, 5877 nt, Artificial Sequence
  derived and/or modified sequence opt5 from EML6__Homo_sapiens__NP_001034842
auggccgaccgcaccgcuccccggugccagcugcgccuugaauggguguacggcuauagagggcaccaaugucggaacaaucuguacuauacagccggaaaggaagucguuuacuucguggccggcgugggggucguguauaacacgcgcgaacauagccagaaauuuuuccuuggacacaaugaugacaucauuucccuggcucuccauccugauaagacccugguugccacaggccagguggggaaagaaccguacaucugcauuugggacucuuauaacguccagaccgugagccuucugaaggauguucacacacauggaguggccugucucgcuuuugacuccgauggccaaagacuggccucugucggccuggacgcuaaaaauaccgugugcaucugggauuggcggaaggggaagcuccuggccagcgccacaggacacuccgaccgcauuuucgauaucucuugggaccccuaccagccuaacagaguggucagcuguggcguuaaacacaucaaguuuuggacccuuugcgggaaugcccugacggcuaaacggggaauuuucggcaagaccggggaucuccagacaauccugugucuugccugcgcuaaagaagacauuaccuacuccggagcccugaacggcgacaucuauguguggaagggccucaaucuggugcgcacaauucagggggcgcauagcgccggaaucuuuucuauguacgcuugugaagagggcuucgccaccgggggaagagauggcugcauucggcugugggacacggauuuuaagcccaucacaaaaaucgaccuccgcgagaccgaacaaggguauaagggacuguccauuagaagcgucuguuggaaagcugaucggcuucuggccggcacacaggacucugagaucuucgaagugauuguucgcgagagagauaagccuaugcucauccugcagggccacugcgagggggaacuuugggcccuggcucuccaucccaaaaagccucuggcggugaccggauccgacgaucggagcgucagacuguggucucucgccgaccacgcucugauugcccgcugcaacauggaggaagccgugcgguccguugcuuuuagcccggauggcucccagcuugcccuggggaugaaagacggaucuuucaucgugcucagaguccgcgacaugaccgaggugguccacaucaaggaucggaaggaagugauucaugagaugaaauuuagccccgacggcuccuaccuggcgguugggagcaaugauggcccuguggacgucuaugcuguggcccaaagauacaagaaaaucggagaguguucuaagucccuuagcuucauuacacacaucgauuggucucuggacagcaaauaucuccagacgaacgauggcgccggggaacgccuguucuaccggaugcccuccggaaagccucugaccucuaaggaggaaauuaaaggcauccccugggcuagcuggacaugcguuaaggggccggagguguccggaaucuggccuaaauacaccgaagucacagacauuaauagcguggaugccaacuauaauucuuccgugcucguuagcggcgacgauuuugggcuggucaaacuuuucaaauuucccugucugaagagaggcgcuaaguuccgcaaauacgugggacauucugcccacgugaccaacguccgguggucccaugacuuucagugggugcucagcacgggcggggcggaucacuccguuuuccaauggagauuuaucccugagggagugucuaacggcaugcuggagacagcgccccaggaagggggagcugacagcuauuccgaggaaucugacagcgaucuguccgacguccccgagcuugauagcgacauugaacaggaggcccagaucaauuacgaucgccaaguguauaaggaggaccucccucagcugaaacagcagucuaaggagaagaaccacgcuguuccguuccugaagcgggagaaggcccccgaagauucccucaaacugcaauuuauucauggcuacagaggguaugacugccggaauaaccuuuucuacacccaggcgggcgagguggucuaccacaucgccgcuguggccguuguguauaaucgccagcagcauagccaaagacuguaccucggacacgaugacgauauucugucucugaccauccacccugucaaggacuauguggcuacaggccagguggggcgggaugccgccauccaugucugggacacccagacacuuaaaugucucucccugcugaagggacagcaccaaagaggcguuugcgcucucgacuuuagcgcggaugggaaaugucuggugucugugggacuugacgauuuccauagcauugucuuuugggacuggaagaaaggcgagaagaucgccacgacccgcgggcacaaggauaaaauuuucgugguuaagugcaacccccaucacguggacaaacuggucacagugggcaucaagcacauuaaauucuggcagcaggcuggaggcggguuuaccuccaagcggggaacauucggcagcguugggaagcucgaaaccaugaugugugugucuuacggaagaauggaggaucuggucuuuuccggcgccgccacgggcgacaucuucaucuggaaagauauucugcuucucaagaccgugaaagcucaugacgggccuguuuuugccauguaugcgcuggauaagggauucgugacaggcgggaaagacggaaucgucgaacugugggacgauauguuugagcgcugccucaagaccuacgcuauuaagagaagcgcccuguccacaucuagcaaaggccuucugcucgaagacaaucccuccauccgggccauuacccuggggcacggacauauccuggugggcacgaagaacggcgagauccuugagauugauaaaucugggccgaugacacuccuggugcaaggacacauggaaggcgaggucugggggcuggcugcccauccucuccugcccaucugugcgaccguuagcgacgauaagacacuucgcauuugggaacuguccgcucagcacagaaugcucgccgugcggaaacugaagaagggaggccgcugcugcgccuucucuccugacgggaaagcucuggccgugggacuuaaugauggcagcuuucuggucgugaacgcugacaccguugaggauaugguguccuuccaccauagaaaggaaaugaucagcgacauuaaauuuucuaaggauaccggcaaauaucucgccgucgcgucccacgacaauuucguggauaucuacaacguucugacaagcaagcggguggggaucuguaaaggagccucuuccuacauuacgcauaucgacugggacagccgcggcaagcuccugcaggucaauucuggggcuagagagcagcucuuuuucgaggcgccccggggaaagcgccacauuaucagaccuuccgaaauugagaaaaucgaaugggauaccuggacaugcgugcugggccccaccugugaggggauuuggccggcucacagcgacaucacagaugucaacgccgccucccucaccaaggacugcagccugcuggcuacgggagaugacuucggcuuugugaaacuuuucucuuauccuguuaagggccaacaugcgcgguuuaaaaaguacguggggcacagcgcccaugucacaaaugugagauggcugcacaacgauuccguucuccugaccgugggaggcgcugacaccgcccucaugaucuggacacgcgaguucgucgggacccaggagucuaagcugguggauagcgaggaauccgacacagauguggaggaagacggaggcuaugauucugacguugcccgggagaaagcuauugacuacacgaccaagaucuaugccgucagcauuagagagauggaagggacaaaaccccaucagcagcuuaaggagguguccguggaagaaagacccccugucucucgggcggcuccgcaacccgaaaaacugcagaagaacaauaucaccaagaaaaagaaacucguggaggagcuggcccuggaucacguuuuuggauacagaggcuucgacugucgcaacaaucuucacuaucugaacgauggcgccgacauuaucuuucauacagcugccgcggggaucgugcagaaucucagcaccggaucccagagcuucuaccuggaacacacggaugacauucucugccugaccgucaaccaacauccuaaguaccggaaugugguugcuacaucucagaucggcaccacacccuccauucacaucugggaugccaugaccaaacacacacuuagcaugcugagauguuuucauucuaagggggugaacuauauuaauuucuccgccaccggaaagcugcucgucagcgugggcguugacccugagcacacgaucacaguguggcgcuggcaggaaggggcuaaagucgccucccggggaggccaucuggagagaaucuuugugguggaguuccggcccgauucugacacccaauucgucagcguuggcgugaagcacaugaaauuuuggacccuugcuggguccgcccugcucuacaagaaaggagugauuggcagccugggggcggccaagaugcagacaaugcucucugucgcuuucggagccaacaaucugaccuuuacgggcgcuaucaacggggauguguauguuuggaaggaccauuuccuuauucgccugguggccaaagcccacacaggaccugucuuuaccauguacacaacccugagagacggccucaucgugacaggcgggaaggagcggcccaccaaagagggaggcgcuguuaagcugugggaucaggaaaugaaacgcugcagagcguuccagcuugagacggggcaacugguggaauguguccgguccgugugcagaggaaagggcaaaauucucgucgggaccaaggacggcgagaucauugaagugggagagaagaaugccgcuagcaacauccugaucgauggccacauggagggggaaauuuggggacucgccacacauccgucuaaagaccuguuuaucagcgccuccaaugauggcaccgcucgcauuugggaccuugccgauaagaaacugcugaacaagguuucucucgggcacgcggcucggugugccgccuauagcccugacggagagaugguggcuaucggcaugaaaaacggggaguucgugauucugcuugucaauucccugaagguuuggggcaagaaaagagaucgcaagucugccauccaggacauccggauuagccccgauaacagauuucucgcggugggauccagcgagcauacaguggacuucuacgaucugacccagggcacgaaucucaaccgcaucggguauugcaaagacauuccuucuuuugucauccagauggacuucuccgccgauggaaaguacauucaagugagcacaggcgcuuacaaacggcagguucacgaggugccccuggggaagcaggucaccgaagccguggucaucgagaagaucacaugggcuuccuggaccucugugcuuggagacgaaguuauuggcaucuggccgagaaaugccgauaaagcugacgugaacugcgccugugucacccacgcggggcugaauauugugacaggcgaugacuuuggacugguuaaacucuucgauuucccuugcacggagaaguuugccaagcauaaacgcuauuucggccacagcgcucaugugaccaacaucagauuuuccuacgacgauaaguaugucgugucuacagggggagacgauuguagcguguucguuuggcggugccuguga

SEQ ID NO: 68828 - RNA, 474 nt, Artificial Sequence
  derived and/or modified sequence opt5 from EMP1__Homo_sapiens__NP_001414
augcuggugcuccuggccggcaucuucgucguucacauugcuaccgugaucaugcuuuuugugagcacaauugccaacgucuggcugguguccaauacgguugacgcgucuguggggcucuggaagaacugcaccaauaucagcuguuccgauucucugagcuacgcuuccgaggacgcccuuaaaacaguccaggccuucaugauucugucuaucaucuuuugcgugauugcucuccugguuuucguguuucaacuguucaccauggaaaagggaaacagauuuuuccucagcggcgccacaacccuggucuguuggcuuugcauccugguggggguguccauuuauacaagccauuacgcuaaucgggauggaacccaguaucaccauggcuacucuuauauccucggguggauuuguuuuugcuucuccuuuaucauuggaguccuguaccuuguucugcgcaaaaaguga

SEQ ID NO: 68829 - RNA, 504 nt, Artificial Sequence
  derived and/or modified sequence opt5 from EMP2__Homo_sapiens__XP_006720927
augcuggugcuccuggccuucaucauugcuuuucacaucaccagcgccgcgcuucuguucauugcuacagucgacaacgccugguggguuggcgaugaguuuuucgccgacguguggagaaucugcacgaauaacaccaauuguacagugauuaacgauuccuuucaggaauacucuacccuccaagcuguccaggccacaaugauccugagcaccauccuuugcuguauugcuuucuuuaucuucgugcugcagcucuuucggcugaagcagggggagcgcuucguucugacauccauuauccaacucaugucuugccugugugugaugauugccgcgagcaucuauaccgacagacgggaagauauucaugacaaaaaugccaaguuuuaccccgucacgcgcgagggauccuauggcuacucuuauauccuugcuuggguggccuucgcuugcaccuuuaucagcgggaugauguaccugauucucagaaaacggaaguga

SEQ ID NO: 68830 - RNA, 873 nt, Artificial Sequence
  derived and/or modified sequence opt5 from EMX1__Homo_sapiens__NP_004088
augugccuggccggcuguacccccagaaaggcugccgcgccugggcggggagcucucccgcgcgccagacugccccggacagccccugcugccgcuacgauguuccagcccgccgcgaaacgcggcuuuaccaucgagagccuuguggccaaggacgggggaacaggcgggggaaccggcggcgggggagcuggcucccaucugcucgccgcugccgcgucugaggaaccucugagacccacagcccuuaacuacccucacccgagcgcugccgaagcugccuucgucuccggguuucccgccgcugcggccgcuggagccggccggucucuguaugggggaccugagcucguuuuccccgaagccaugaaucacccugcucugaccgugcaucccgcccaccaacugggcgcgagcccgcuccagccuccccauuccuuuuucggcgcucagcaccgcgauccucugcacuuuuaccccugggugcuuagaaaccgguucuuugggcaucgcuuccaggccucugacgucccccaagauggacugcuccugcacggcccuuuugccagaaaaccgaagcggauucgcacagcuuucagccccucccagcuucugagacucgagcgggccuuugagaaaaaucauuaugugguuggggcugaacgcaagcagcuggccggaagccugucucucuccgagacccaggugaaggucugguuccaaaacagacggacgaaauacaagagacagaaacuggaagaggagggcccugaaagcgagcagaagaaaaaggggucucaccacaucaaucgcuggcggauugcgaccaagcaggccaacggagaagacaucgaugugacauccaaugacuga

SEQ ID NO: 68831 - RNA, 510 nt, Artificial Sequence
  derived and/or modified sequence opt5 from EMX2__Homo_sapiens__NP_001159396
auguuccagcccgccccuaagagaugcuuuaccaucgagagccugguggcuaaagacuccccgcuccccgccucucggagcgaagauccuauucgccccgcggcucuguccuacgccaacucuagcccuaucaaucccuuccuuaacggcuuucacuccgccgcugccgcugccgcggggagaggagucuauucuaauccugaccugguuuucgccgaggcugugagccauccgcccaacccugccgugcccguccacccugugcccccgccucaugcucucgccgcgcacccccugccuuccagccauucuccccacccccuuuuugccucccaacagcgggauccuagcacauucuacccguggcugauucaccgcuauagauaccucggccaucgguuucaggggaagucuaugguuuccgaacccaaaaauaaggugcagaaagcugaggccggaggccgcagacugcgguucgcuacgaaggaaaagcgcgacgccccuuauuga

SEQ ID NO: 68832 - RNA, 1179 nt, Artificial Sequence
  derived and/or modified sequence opt5 from EN1__Homo_sapiens__NP_001417
auggaggaacagcaacccgagccuaagagccagagagacuccgcccugggcgcugccgcggcugccacccccgggggacucucucugagccuuucccccggcgccucugggagcuccggaucuggcagcgauggggacuccgugccugucagcccccagccugcucccccuucuccgcccgccgcuccuugccugcccccucucgcccaccauccccaccuuccgccucaucccccuccgcccccuccgcagcaccuugcggcccccgcucaucaaccucagcccgccgcucagcugcaccggacaacgaacuucuuuaucgauaauauucuccgcccugacuucggauguaaaaaggaacagcccccgccucaacugcugguugccgcggccgcuagaggcggcgccgggggaggcgggcggguggagcgcgauagaggacagaccgcugccggccgggaccccgugcacccucucgggacacgcgcccccggagcugcgucccugcuuugcgccccugaugcuaacugugggcccccggacggcagccagccugccgccgcuggcgccggagcgucuaaagcuggcaaucccgccgccgcugccgcugccgcggccgcugccgucgcugccgcggccgcugccgcugccgccaagcccuccgauaccgggggaggcgggagcggaggcggcgcugggucuccuggagcgcagggcacaaaauacccggaacaugggaaccccgccauccugcucaugggauccgcuaauggcgggccugugguuaagaccgacagccaacagccccugguguggccugccugggucuauugcacaagauacuccgaucggcccucuagcggcccucgcaccagaaagcugaaaaagaaaaagaacgagaaagaggacaagcggccccgcacggccuuuaccgcugaacagcugcaaagacucaaggccgaguuccaggcgaaucgguauauuacagaacagcgcagacagacccuggcucaagagcugucccucaacgagagccagaucaaaauuugguuucagaauaagcgggccaaaaucaagaaagccacaggaaucaagaacggccuggcccuucaccugauggcucaggggcucuacaaucauucuaccacgacagugcaagauaaagacgaauccgaguga

SEQ ID NO: 68833 - RNA, 1002 nt, Artificial Sequence
  derived and/or modified sequence opt5 from EN2__Homo_sapiens__NP_001418
auggaggaaaacgaccccaagccuggcgaggccgcugccgcgguggaagggcagagacaaccggagagcucccccggaggcgggucuggaggcgggggaggcagcuccccuggcgaagcugauaccgggcggcgcagagcccugaugcuccccgccguccugcaggcuccuggaaaucaccagcauccccaccggaucacaaacuucuuuauugacaauauccuucgcccugaguucggcagacggaaagaugccgggacgugcugugcuggagccggcgggggacgcggcggcggggcgggaggcgagggaggggccucuggcgcugaagggggaggcggcgccgggggaagcgagcagcugcucggcuccgggucuagagaaccgcggcaaaaucccccuugcgcucccggagccggcgggccucugcccgcggccggcagcgacuccccgggagauggcgaagggggaagcaagacccuuucucugcauggcggggcuaaaaagggaggcgacccugggggcccccucgauggaucccugaaagcccgcggccucgggggaggcgaccugagcguuucuuccgauagcgacucuucccaggcuggggccaaccugggagcccagccuaugcuuuggcccgcuuggguguacuguacaagauauagcgaucggcccuccucuggcccucgcagcagaaagccgaagaaaaagaaccccaauaaagaggacaagcggccucgcaccgcguuuacagccgagcagcugcaaagacucaaagcugaguuccagaccaaccgguaccugacagaacagagacgccagucccuugcccaagagcugagccucaaugaaucucagauuaagaucugguuucagaacaagcgggccaaaauuaagaaagcuaccgggaauaagaacacgcuggccgugcaccugauggcgcaaggccucuauaaucauuccaccacagcuaaagagggaaagagcgauucugaguga

SEQ ID NO: 68834 - RNA, 1776 nt, Artificial Sequence
  derived and/or modified sequence opt5 from ENAH__Homo_sapiens__NP_001008493
augagcgagcaguccaucugccaagccagagcugccgugauggucuacgacgaugcgaacaagaaauggguucccgcuggcgggucuaccggauucagccgggugcacauuuaucaucacacaggcaauaacacguuucgcguggucgggagaaagauccaggaccaucaggugguuauuaauugugccaucccuaaaggacugaaguacaaccaggccacccaaacauuccaccaguggcgggaugcucgccagguguauggccucaauuuuggguccaaagaagacgccaacgucuucgcuucugccaugaugcaugcgcuggaggugcuuaauagccaggaaaccggaccgacacugcccagacaaaacucccagcucccugcccagguucagaauggccccucucaagaggaacuggagauucagcggcgccagcuucaagagcagcagagacagaaggaacuggagcgggaacgccucgagagagagcggauggaacgcgagagacuggaacgggagcgccuggaaagagagcggcucgagagagaacgccuggagcaagaacagcuugagcgggaaagacaggagcgcgagcggcaggaaagacuggagcgccaagaacggcucgagagacaggaacgccuggagcggcaggagagacuugaucgcgaacggcaggagagacaagaacgggagcgccuggagagacucgaacgggagagacaggaacgcgagcggcaggaacagcuggagagagagcaacuggaaugggagcgcgaaagacggaucagcuccgcugccgcuccugccagcguggagacaccccucaacucuguccugggcgacuccagcgcgucugaaccugggcuucaggccgcuucccagccggccgagacccccagccaacagggaaucgugcugggcccucucgcucccccucccccgccuccccugccucccgggcccgcccaggccucuguggcgcuuccuccgcccccuggacccccucccccgccuccccugccuuccaccgggcccccucccccgccucccccucccccgcuccccaaucaggucccucccccucccccucccccgccugcucccccucugcccgccagcggcuuuuuccuggcuuccaugucugaggauaaccgcccgcucacgggacuggccgccgcuauugccggcgcgaaacuuagaaagguuagccggauggaagacaccuccuuuccuagcggcgggaaugcuaucggagugaacucugccuccagcaagacagauaccggccgcgggaauggaccccugccucucggcgggucuggacugauggaggaaaugagcgcccuucuggcuagacggcgcagaauugccgagaaaggcuccacaaucgaaaccgagcaaaaggaggacaaaggcgaagauucugagcccgugacgagcaaggcuuccagcacaucuacccccgaaccuacacggaagccgugggagcgcaccaacaccaugaacggguccaaaagccccgucauuucuagacgggacuccccuagaaagaaucagaucguguucgauaaccgcagcuacgacucccuccaccggcccaaaucuacaccucugagccagcccuccgccaauggaguucagacggagggccuggacuaugauagacucaagcaagacauucuggaugaaaugcgcaaagagcuuaccaagcugaaagaggaacucaucgacgcgauccggcaggaacugucuaagagcaacacagccuga

SEQ ID NO: 68835 - RNA, 3429 nt, Artificial Sequence
  derived and/or modified sequence opt5 from ENAM__Homo_sapiens__NP_114095
augcuggugcucagaugccggcugggcaccagcuuccccaaacuugacaaccuggucccuaaggggaagaugaaaauccuccugguuuuucuuggacugcucggcaauuccguggccaugccgaugcacaugccccgcaugccuggguucucuagcaaguccgaagaaaugaugagauacaaccaguuuaauuucaugaacggaccccauauggcucaccugggccccuuuuucgggaauggacugccccaacaguuuccucaguaucagaugccgauguggccccaaccucccccuaacacauggcauccccggaaaucuagcgccccgaagcgccacaauaagacggaucagacccaggagacacagaaaccuaaccaaacccaguccaagaaacccccucagaagagaccccucaaacagcccucucauaaucaaccucagccggaagaggaagcgcagcccccucaggcuuuucccccuuucggcaacggccuguuccccuaccaacagccgccuuggcagauuccccaacggcuuccucccccuggguauggaagacccccgaucagcaaugaggagggcgggaacccuuacuuuggauauuucggcuaccacggguuuggaggccgcccucccuauuacuccgaagagauguucgaacaggacuucgagaagccuaaggaggaagauccgcccaaagccgagagcccuggcacagaacccaccgccaauucuacagugaccgagacgaacuccacccagccuaaucccaaggggagccagggaggcaacgacacaucuccuaccgggaacuccacacccggacugaauaccggcaacaauccgccugcucaaaacgggauuggaccccucccugccgucaaugcuagcggccagggcgggcccggaucucagaucccguggcggccuucccagcccaacauucgcgaaaaucacccuuaccccaacaucagaaauuuucccagcggccggcaaugguauuucacggggacagugaugggacaucgccagaacagaccuuuuuaccggaaucagcagguucaacgcggcccgagauggaacuucuuugccugggagcggaaacagguggcgagacccgggaauccugucuaucacaaggccuaucccccuaccucccgcggcaacuaccccaauuacgcuggaaacccugccaaccugcggagaaaaccgcagggccccaauaagcauccuguggggacaaccguugcuccccuuggaccuaaacccggcccggugguccgcaacgagaagauccaaaauccuaaggaaaaaccccuggggcccaaggagcagauuaucgugccuaccaaaaaccccacaucuccuuggcggaauagccagcaguaugaagugaacaaguccaauuacaaacucccgcacagcgagggauacaugcccgucccuaacuucaauucuguugaucaacacgaaaacuccuauuaccccagaggcgacagccgcaaggugccuaauucugaugggcagacgcagagccagaaccugcccaagggcauugugcugggaucccggagaaugccguaugagucugagaccaaucaaagcgaacucaaacauuccagcuaccagccugccgucuaucccgaggaaaucccuucucccgcgaaggagcacuuuccugccggccgcaacacaugggaccaucaggaaauuuccccgcccuucaaagaggauccugggcggcaggaggaacaucugccccaccccagccacggaucuagaggcuccguguuuuacccugaguauaauccguacgacccccgcgaaaacagcccuuaccuucgggggaacaccugggaugagagagacgauucccccaauacaaugggacaaaaggagucuccucuguaucccaucaacaccccugaccagaaagaaauuguuccguacaaugaggaagaccccguggauccuacgggcgacgaggucuuccccgggcagaaccgguggggcgaggaacucagcuuuaagggaggcccuacagugcgccacuaugagggggaacaauacaccuccaaucagcccaaggaguaucugccguacucucuugauaacccuagcaaacccagagaagacuucuauuacuccgaguuuuaccccuggagcccugaugaaaauuuccccucuuauaacaccgcuuccacaaugccuccgcccaucgagagccggggauacuauguuaauaacgccgcuggcccugaggaaucuacccuguuccccuccagaaauagcugggaccaucgcauccaggcccaggggcaacgggagagacgcccuuacuuuaacagaaauauuugggaucaggccacacaccuccagaaggcucccgcgcggccgccugaccagaaaggaaaccaacccuauuacucuaauacgccugccggccugcagaagaaccccaucuggcaugaaggggagaaccugaauuauggcaugcagauuacccgcaugaacagcccugaaagagagcacuccagcuuccccaauuuuaucccgccuucuuaccccuccggacagaaagaggcucaccucuuccaucugagccaacggggcuccuguugcgccgggucuagcacaggacccaaggauaacccucuugcccugcaggacuacaccccguccuauggccucgcucccggggaaaaucaggauacaucuccucuguacaccgacggaagccacacgaagcagacccgcgacauuaucucccccacaucuauccuuccuggccaaagaaacagcuccgagaaacgggaaagccagaaucccuuucgcgaugacgugucuacccugagacggaacacaccuuguuccauuaagaaucagcucggccaaaaagagaucaugcccuucccggaggccagcucucugcaguccaagaacaccccuugccugaaaaaugaucucgggggagacggcaacaauauucuggaacaggucuuugaggauaaccagcuuaaugaacgcacgguggaccugacacccgagcaacucgucaucgggaccccugaugaaggaagcaaccccgagggcauucagucucaggugcaggagaaugaauccgagagacaacagcagcggccgagcaacauccugcaucugccuuguuucggguccaaacuugcgaagcaccauagcucuacaaccggaacccccagcuccgacggcagacagucucccuuugauggcgacagcaucacaccuacggaaaaccccaauacccucguugagcuggcuacagaggaacaauucaaguccauuaacguggauccucuggacgccgaugagcacucuccguuugaguuccuccagcgcgggaccaauguccaggaccaagugcaggacugccugcuucugcaggccuga

SEQ ID NO: 68836 - RNA, 1770 nt, Artificial Sequence
  derived and/or modified sequence opt5 from ENC1__Homo_sapiens__XP_011541999
augagcguguccguccacgagaacagaaagucucgggccagcuccggcucuaucaauauuuaccuguuccauaaaagcuccuaugcugacucuguucucacccaccugaaccuucugcgccagcaaagacucuuuacagaugugcugcuucaugccgggaaucggacguuccccugccaccgcgcggugcuggcugccuguagcagauacuuugaagccauguucuccggaggccucaaggagagccaggacucugaagucaacuuugauaauuccauccauccugaggugcuggaacugcuccuggacuaugcuuacagcucucggguuauuaucaacgaggagaaugccgaaucccuucuggaggcuggggauaugcucgaguuccaggacauucgcgaugccugcgcggaguuucuggagaaaaaccuucacccgaccaauugucugggaaugcuccugcugagcgacgcccaccagugcacaaagcucuaugaacugucuuggagaaugugucuuuccaacuuccaaaccauccggaaaaaugaggauuuucugcagcucccccaggacauggugguccagcugcuuagcuccgaagaacuggaaacagaggaugagcgccucguguacgaaucugcuaucaacuggauuagcuaugaccugaagaagagauacugcuaccugccugagcuccugcaaaccguucggcuugcccugcuccccgcuaucuaucugauggaaaauguggccauggaggaacuuauuacaaaacagcgcaaguccaaagagaucgucgaggaagcgauuagauguaagcugaaaauccuccagaacgauggcguggugaccagccugugcgcccggccucgcaagacggggcaugcucuguuccuccugggaggccagaccuuuaugugugacaaacuuuaccuggucgaccaaaaggccaaggagauuauccccaaagcugauaucccuucuccgagaaaggaguucuccgccugcgccauuggcuguaaaguuuauaucacagggggacggggcagcgaaaauggggugucuaaggacgugugggucuacgauacccuccacgaagaguggagcaaagcugcgcccaugcugguggccagauuuggacauggcuccgcugagcugaagcacugccuuuauguugucgggggacacacagccgccaccggcugccucccugcuucucccagcgugucccugaaacagguggaacauuacgacccuacgauuaacaaguggacaaugguugcgccccugcgcgagggcgugagcaacgccgcugucgugucugccaagcucaaacuguucgccuucgggggaaccuccgucagccacgauaaacuuccgaaggugcaguguuaugaccaaugcgaaaaucgguggacaguuccugcuaccuguccccagccuuggagauacaccgccgcugccgugcugggcaaccagaucuuuauuaugggaggggauacagaguucucugcgugcuccgccuacaaguuuaauagcgagacguaucaguggaccaaggucggcgacgugacagcuaaacgcauguccugucaugccguugcuucugggaacaagcucuacguggucggaggcuauuucggcauccaacggugcaaaacccuggauuguuacgaccccacacuggauguguggaauagcaucaccacggugcccuauucccuuauuccuacagccuuuguuucuaccuggaagcaccucccgagcuga

SEQ ID NO: 68837 - RNA, 894 nt, Artificial Sequence
  derived and/or modified sequence opt5 from ENDOG__Homo_sapiens__NP_004426
augagagcccugcgggcuggccucacccuggccagcggggcgggacuuggcgcuguggucgagggguggcgcagacggcgcgaagacgccagagccgcucccggacugcucggccggcugccuguucuuccgguggccgcugccgcggagcugcccccugugcccgggggaccucgcggccccggcgaacucgccaaguacgggcugccuggacuggcucagcucaaauccagagagucuuauguccugugcuacgauccgcggacacgcggcgcccuuugggugguugaacaacugagacccgagcggcuccgcggggacggagauagacgggagugugacuuccgcgaagaugacagcgugcacgcuuaucauagagccacgaacgcggauuaccggggcuccggguuugacagaggacaccuggccgcugccgcuaaucaucgcuggucucagaaggccauggaugacaccuucuaucuuagcaacgucgccccucaggugccccaccugaaucagaacgcuuggaauaaccucgagaaauacucccggucucugacaagaagcuaucaaaauguuuacgugugcaccggcccucuguuucucccccgcacagaagcggauggcaaguccuacgucaaauaucaggugaucgggaagaaccauguggccgucccgacccacuucuuuaagguucugauucuugaggcugccggaggccagaucgagcugcggacauacgugaugccuaaugcccccguggacgaagcuauuccucucgagagauuccugguccccaucgaaagcauugagcgcgccucugggcuucuguuugugcccaacauccucgcgcgggcuggaucccugaaagccaucaccgccggcagcaaguga

SEQ ID NO: 68838 - RNA, 1233 nt, Artificial Sequence
  derived and/or modified sequence opt5 from ENDOU__Homo_sapiens__NP_001165910
augagagccugcaucagccuggugcucgcuguccuguguggccuugccugggcggggaagauugaguccugcgcuucucgguguaacgaaaaauucaaucgcgacgccgccugccagugugauagacggugccuguggcacggaaacuguugcgaggacuacgaacaucucuguaccgaggaucacaaggaaagcgagccccugccucaacuugaggaagagacagaagaggcucuggccuccaaucucuauucugcuccgacgagcugccagggccgcuguuacgaggccuuugacaaacaucaccagugccauugcaacgcgagaugucaggaguucgggaauugcuguaaggauuuugaaucccugugcucugaccacgaaguuagccacuccagcgaugccaucaccaaagaggaaauucaaucuaucuccgagaagauuuaucgggcugacacaaacaaggcccagaaagaggauaucgugcugaauagccagaacuguaucucucccuccgaaacccgcaaucagguggacagaugcccuaagccccucuucacauacgucaacgagaaacuguuuagcaagccuaccuaugcugccuucauuaaucuucugaacaauuaccaacgggcgacaggacauggcgaacacuuuucugcccaggagcucgcugaacaggaugccuuccugcgcgagaucaugaaaaccgcugugaugaaggagcuuuauuccuuucugcaucaccagaacagauacgggagcgaacaagaguucguugacgaucucaagaauaugugguuuggacuguacucccggggcaacgaagagggcgacucuagcggguucgaacacguguuuuccggagaggucaaaaagggcaaagugacgggguuccauaacuggauucgcuucuaucuggaggaaaaggagggacucguugacuacuauagccacaucuacgauggccccugggacucuuauccugaugugcuggccaugcaguuuaauugggacggguacuauaaagaagucggauccgccuucauuggcagcucuccggaguuugaguucgcucuuuacagccuguguuuuaucgcgagacccggcaaggugugccagcucucccuugggggauacccucuggccgugcggaccuauacaugggauaaaucuaccuacggcaacgggaagaaguauauugcuacagccuacaucgucagcuccaccuga

SEQ ID NO: 68839 - RNA, 714 nt, Artificial Sequence
  derived and/or modified sequence opt5 from ENDOV__Homo_sapiens__NP_001158109
auggcccuggaggcugccggcgggcccccugaagagacccucagccuguggaagagagaacaggcgcggcuuaaagcucacguggucgaccgcgauaccgaggccuggcaaagagacccggccuucuccggacugcagcggguuggcgggguggaugugucuuuugucaagggagacagcgugcgcgcuugcgccucccucguugugcugucuuuccccgaacuugagguccugcucguggauggcaacgggguucugcaucacagaggauuuggcguggcuugucaucugggcguccucacggaccugccuugcguggggguggccaaaaagcugcuucaggucgauggacucgagaauaacgcgcugcacaaagaaaagauccggcuucugcagacccgcggcgacagcuucccccuccugggggauuccggaacaguucugggcauggcccucagaucucaugaccggagcacccgcccucuguacauuuccguggggcacagaaugagccuugaggcugccgugcggcugacauguugcuguugccgcuuuagaauccccgaaccuguccggcaagcugauauuuguucucgcgagcacaucagaaagucccucggacugccggggcccccuacaccccggagcccuaaagcccagagacccguggcgugcccgaagggcgacucuggcgaguccagcgcccuuuguuga

SEQ ID NO: 68840 - RNA, 2232 nt, Artificial Sequence
  derived and/or modified sequence opt5 from ENGASE__Homo_sapiens__NP_001036038
auggaggccgcugccgugaccgucacaagaagcgcgacgcggcgcagacggcgccagcugcaaggccucgcugcccccgaagccgggacccaggaggaacaggaggaccaggaaccuagaccgcggcgcagacggcccggacgcuccaucaaggaugaggaggaagagacaguuuucagagaaguggugucuuuuagcccugacccccugccuguccgguacuaugauaaagacaccacaaagcccauuuccuucuaccuuucuagccuggaggagcuccuggcuuggaaaccucgccuugaagauggcuuuaacguggcccuggagccgcucgcuugcagacaacccccucuguccucucagcggccccgcacccugcucugucacgacaugaugggcggauaucuggaugacagauucauccagggcagcguugugcagacaccuuacgccuuuuaucauuggcaaugcauugaugucuucguguacuuuucccaccauaccguuacgauucccccggugggguggaccaauacagcgcaccggcauggagucugugugcuuggcaccuucaucacagaauggaacgagggcgggagacugugcgaagccuuucucgcuggagacgagcgcagcuaucaggccguggcugaucggcugguccagaucacccaguucuuuagauucgacggcuggcuuaucaauauugagaacucucugucccucgccgcgguugggaauaugccucccuuucugcgcuaccugacgacacaacuccacagacaggugccuggaggccuggugcuuugguacgauagcgucgugcagucugggcaacugaaguggcaggacgaacucaaccagcacaaucggguuuucuucgacuccugugauggauuuuucaccaacuauaauuggcgcgaggaacaucuggagcggaugcuuggccaggccggcgaaagacgcgcugacguguacgucgggguggauguuuuugcccggggaaacguggucggcgggagauucgacacagauaaaagccuggagcucauccgcaagcacggauuuucuguggcucuguucgcccccggcugggucuaugagugccuggaaaagaaagacuuuuuccaaaaucaggauaaguuuugggggcggcucgagagauaccugcccacccauuccauuuguagccuuccuuucgugaccuccuuuugccugggaaugggcgcccggcgcguuuguuauggccaggaagaggcuguggggccgugguaccaccucucugcgcaggaaauccaaccccuguucggagagcacagacuuggcggggacggacggggcugggucagaacacauugcugucuggaggaugccuggcacgggggcagcucccuccuggugcgcggaguuauuccucccgaagugggcaacgucgcugugcggcuguuuagccuccaggccccugugcccccgaaaaucuaucugucuaugguuuacaaacuugaggggccuacggacgucaccguggcccuggaacucacaaccggagaugcuggcuccugccauauugggggaaucagcgugcugaaugccgagacaucuagcagacacucccugcgcccccuuagagucccucccaccaagcucgcgcggugggugggccgcugcgggagacagcugucuggcggauggguucagcauuguuacgaggugagccugcggggcugccuccugcuugaccugcucgucuguuucucccgcccucccgggagcagagaagaggaaucuuucacgugccggcugggagagauccaagugguugacgcugccucccugcuugccccgcucccucaggugcaggcugucacaauuagccacauccgcuggcagcccucugccuccgaaagagaggggcccccugcucugcugcaacucagcuguacccugcacugguccuuucuucugucucaggugcggugcuuccgcauucauuguuggggagggaugagcgaugacuccccgggcagagagcucccccggccugaaaugcccauguuucuggggcuggccuucgcgacccaguauagaaucguugaucuucucguggaggccgcuggcccuggacaagaccgccggauggaauuucuggucgagcccgugccuaaggaaggcuucagagugccccaggccgagugggggcgcgcuguccugcucuacucugccccggcguga

SEQ ID NO: 68841 - RNA, 1878 nt, Artificial Sequence
  derived and/or modified sequence opt5 from ENG__Homo_sapiens__NP_000109
auggacagaggcacccugccccucgccguggcucugcuucuggccagcugcucccucucuccuacaagccuggcggagacgguccacugugaucuucagccgguugggcccgaacggggagaggugaccuacacaaccucccaagugucuaagggcugcgucgcucaggccccuaacgccauccuggaagugcauguucucuuccuggaguuucccacagggccuagccagcuggaacucacccugcaggcuuccaaacaaaauggaacauggccccgcgaggugcuucugguccucucugugaacagcuccguuuuccugcaccuucaggcccugggcauuccucuccaucuggcuuauaauagcucucuggugaccuuucaggagccgcccggggucaacacgaccgaacucccuuccuuccccaagacacagauccuggagugggccgcggaaagaggaccuauuaccagcgccgcugagcuuaaugacccccaaucuauccugcuccggcugggccaggcccagggcucccuuagcuuuuguaugcuggaggcuucucaggauauggggcgcacacucgaauggagaccgcggaccccugcccuggugcgcggaugccaccuggagggcguggcggggcauaaagaagcccacauucucagaguccugcccggacacuccgcuggcccucggacgguuacagugaagguggagcuuagcugugcccccggggaccuggaugcuguccucauccugcaaggacccccuuacguguccuggcuuaucgacgccaaccauaauaugcagauuuggaccacaggcgaauauucuuucaaaaucuuuccggagaagaacauucgcggcuucaagcugcccgauaccccucaggggcuccugggagaggccagaaugcugaaugcuagcaucguugcguccuuuguggaacucccccuggccagcauugucucucuucacgcuuccagcugcggcgggcggcugcaaaccucuccugcccccauccagacaacgccgccuaaagacaccuguagccccgagcuccugaugucccugauucagacaaagugcgccgaugacgcuaugacccuugugcucaaaaaggaacugguugcccaucugaaauguacaaucaccggacucacguucugggauccuucuugcgaggcggaagaccgcggcgauaaguuugugcugagaagcgcuuacuccagcugugggaugcaggucucugccuccaugaucagcaacgaggccguggucaauauucuuucuuccagcagcccccaacggaagaaagugcacugccugaacauggacucucucagcuuccagcugggacuguaucuuuccccucacuuucuccaggcuucuaauacaaucgagcccggccagcaauccuucguucaggugcgcgucuccccgagcgugucugaguuccugcugcagcucgacuccugccaucuggaucuuggcccugaagggggaaccguugaacugauucagggcagagccgcuaaggggaacugugugagccuccugucucccucccccgagggagacccucgguuuagcuuccugcuucacuuuuacaccgucccgauccccaaaacaggcacccucucuugcacaguggcccugagaccuaagacggggagccaagaucaggaagugcaucgcaccguuuucaugcggcugaauauuaucucccccgaccucagcggcuguacaucuaaaggacugguccuuccugcggugcugggcaucaccuuuggggccuuccucauuggagcucugcugacagccgcucuuugguauaucuacucccacaccagagaguacccccgcccuccccaguga

SEQ ID NO: 68842 - RNA, 231 nt, Artificial Sequence
  derived and/or modified sequence opt5 from ENHO__Homo_sapiens__NP_940975
augggcgccgcuaucagccagggggcccugauugcgaucgugugcaacggacucgucggcuuccugcuucugcuccuguggguuauucuuuguugggcuugccacuccagaucugccgacguggauagccuguccgagucuagccccaauuccucuccugggccgugucccgaaaaggccccucccccucaaaaacccagccaugagggauccuaccuccugcagccuuga

SEQ ID NO: 68843 - RNA, 1305 nt, Artificial Sequence
  derived and/or modified sequence opt5 from ENO2__Homo_sapiens__NP_001966
augagcaucgagaagauuugggccagagaaauccuggacucccggggcaaccccaccguggaggucgaucucuacacagcuaaagggcuguuccgcgccgcgguuccuucuggagcuagcacgggcauuuaugaagcccuugagcugagagacggggauaagcagcgguaccucggaaaaggcgugcugaaggccguggaccacaucaauuccaccauugcuccggcccuuaucucuagcgggcuguccgucguggaacaagagaaacucgauaaccugaugcuggagcucgacggaacagaaaauaagucuaaguuuggcgcuaacgccauccugggcguuagccuugcggugugcaaagccggggcugccgagcgcgaacugccccucuauagacauauugcucagcuggccggaaauuccgaucuuauccugccuguccccgcguucaacgugauuaauggcgggagccacgccggaaacaagcucgcuaugcaggaguuuaugauccugccuguuggcgccgagucuuuccgggacgcuaugcgccugggggccgaaguguaccauacccucaaaggagucauuaaggauaaauauggcaaggacgccacaaaugugggcgaugagggaggauuugcucccaacauccuggaaaauuccgaggcgcuugaacuggugaaggaggccauugacaaagcuggcuacaccgagaagaucgucaucgggauggauguugccgccagcgaguucuauagagacggaaaauacgaccucgauuuuaagucuccuacagacccgucccgguacauuaccggcgaucagcugggggcucuuuaucaagacuucgugcgcgauuaccccguggucagcaucgaggacccuuuugaucaggacgauugggccgcguggucuaaauucacggcuaacguggggauucagaucguuggcgacgaucugaccgugacaaaucccaagagaauugaacgggccgucgaggaaaaagccuguaacugccuccugcugaaggugaaucagaucggcuccguuaccgaggcuauccaagccuguaagcucgcucaggagaacggguggggagugauggucagccaccgcuccggcgaaacagaggacaccuuuauugccgaccugguggucgggcuuugcacgggacagaucaaaacaggcgcgccuuguagaucugaacggcuggccaaguauaaccagcucaugcgcauugaggaagaacugggggaugaggcuagauucgccggccauaauuuucggaaccccagcgugcuuuga

SEQ ID NO: 68844 - RNA, 1176 nt, Artificial Sequence
  derived and/or modified sequence opt5 from ENO3__Homo_sapiens__NP_001180432
auggccaugcagaagaucuucgcuagagagauucuggacagccggggcaaccccaccguggaagucgaucuccacacagccaaagggcgcuuuagagcggcuguuccuuccggagccucuacgggcaucuacgaggcccuggaacuucgggacggggauaagggacgcuaucugggcaaagcuaaguucggggccaaugcuauucucggagugagccuggccgugugcaaagcgggcgccgcugagaagggcgucccgcuuuacagacauaucgccgaccuggcugggaaccccgaucucauucugccugugcccgccuuuaauguuaucaacggaggcucccacgcggggaauaagcuggccaugcaagaguucaugauccucccugugggagcuucuagcuuuaaagaagccaugcggauuggcgcugaggucuaucaucaccugaagggggugaucaaagccaaguacggaaaagacgccaccaacguuggcgaugaaggcggguucgcucccaauauucuugagaacaaugaagcgcuggagcuccugaagacagccauccaggcugccggauauccugacaagguggucauuggcauggauguggccgcuuccgaguuuuaccgcaacgggaaauaugaccuugauuucaagucuccggacgaucccgccagacauaucaccggagaaaaacugggcgagcucuacaagagcuuuauuaaaaauuacccuguggucuccaucgaagaccccuucgaccaggaugacugggcgacauggaccagcuuucugucugggguuaacauccagauugugggagaugaccugacagugaccaauccuaagcggaucgcucaagccgucgagaaaaaggccuguaacugccuccugcuuaaggugaaucagauuggcuccguuacggaaagcauccaggcuuguaaacuggcccagucuaacggcuggggagugauggucucccaccgcagcggggagaccgaggauacauucauugcugaccucgugguuggccugugcaccgggcaaaucaagacaggagcccccuguagaucugaacggcuugcgaaauauaaccagcugaugcgcaucgaggaagcccucggcgauaaggcuauuuuugccgggagaaaauuccggaauccgaaggcuaaguga

SEQ ID NO: 68845 - RNA, 1878 nt, Artificial Sequence
  derived and/or modified sequence opt5 from ENO4__Homo_sapiens__NP_001229628
auggaggaagagggcgggggaagaagcugcggcaccacacgggaacugcagaagcucaaacaacaggccauggaguacuaucgcgaaaacgacgugcccagacggcuggaggagcuucucaauuccacguucuaccugcagccugcugaugucuaugggcaccuggccaacuguuuuucuaaacuugcgaaaccgcccaccaucugcaagauuguuggaaaagacgugcuggauggccucgggcugccuacacuccagguggacaucuucuguaccauucaaaauuuucccaagaacgucugcagcgugguuaucuccacacauuucgaagugcacgagaaugcucugccugaacuggccaaggccgaggaggcugaacgcgccucugcugucagcaccgccgugcaguggguuaacuccacaauuacccaugagcuucagggaauggcgcccucugaucaggccgaaguggaccaucugcucagaaucuuuuucgcuagcaaaguccaagaggauaagggccggaaagaacuggagaagucccuugaguacagcacggugccuaccccgcugcccccugugcccccucccccgccucccccuccucccacaaagaagaagggccagaaacccgggcgcaaggacaccaucacagaaaaaccgauugcccccgcugagccugucgaacccguucucucuggauccauggccaucggcgcggugagccuggccguggcuaaggccugugcuaugcugcucaauaaaccucuguaucuuaacauugcccugcucaagcacaaucaggagcagcccaccacgcugucuaugccgcuucugauggucucccucgugagcugcgggaaaucuuccagcggaaagcugaaccugaugaaggaaguuaucuguauuccucaccccgagcucacaaccaaacaaggcguggagaugcugauggaaaugcagaagcacaucaauaaaauuaucgagaugccuucucccccuaaggccgaaaccaaaaaggggcaugauggauccaagagaggccagcaacagaucacaggcaaaaugagccaccuugggugccugaccauuaacugugacuccaucgagcagccccuccugcuuauucaggaaaucugcgcuaaucugggacucgagcugggcacaaaccugcaucucgcgauuaauugugccgggcacgagcugauggauuacaacaagggaaaauaugaagucaucaugggcacguacaagaacgcugccgagaugguggaccuuuacguugaucugaucaauaaauauccgagcauuaucgcccucauugacccuuuucggaaggaagacucugagcaaugggauuccaucuaccacgcucuggggagccgcugcuauauuaucgccggaaccgcgucuaagagcaucuccaaacugcuugagcagggcaacauuucuauccccaagagcaauggccucauuaucaaacauacaaaccagaccacaauguccgaccugguggaaauuaccaaucugaucgauagcaagaaacacauuacggucuucgggucuacagagggagaauccagcgacgauucucucguggaccuggcugucggccuuggggugagauuuaucaagcugggaggccucucccgcggggagcggguuaccaaguacaacagacugcugaccaucgaagaggagcuugugcagaauggcacacucggauucaaagaggaacauaccuuuuucuauuuuaacgaagaggccgaaaaggccgcugaggcccuggaggcugccgcggcccgggaaccccuggucccuacauucccgacgcaaggcguggaggaaagcgcugagaccggggccuccucuggauga

SEQ ID NO: 68846 - RNA, 786 nt, Artificial Sequence
  derived and/or modified sequence opt5 from ENOPH1__Homo_sapiens__NP_067027
auggugguccugagcguucccgccgaggugaccgugauccuccuggacauugaaggcacaacgaccccuaucgcuuucgucaaggauauucuuuuuccguacaucgaggaaaacgugaaagaguaucugcagacacacugggaagaggaggaaugccaacaggacguuucccuccugagaaagcaggccgaggaagaugcgcaucuugacggggcugugcccauuccugccgccucuggaaauggcgucgaugaccugcagcaaaugauccaggcugugguugauaacguguguuggcagaugagccucgaccggaaaaccacagcccugaagcagcugcaagggcacauguggcgcgcugccuucaccgcgggaagaaugaaagccgaguuuuucgcugaugucgugcccgccgugcggaaguggcgcgaggcuggcaugaaggucuacaucuauuccucugggagcguugaagcccagaaacuccuguuuggacauuccacagagggcgacauucuugaacugguggauggccacuucgacaccaagaucgggcauaaaguggagucugaaagcuacagaaagauugcggauuccaucggaugcagcacgaauaacauucucuuucugaccgacgucacacgggaggccucugcugccgaggaagcugacgugcacguugccguggucgugcgcccuggcaaugccgggcuuaccgaugacgagaaaacauauuacucccugaucaccagcuucucugaacucuaucugcccuccagcacguga

SEQ ID NO: 68847 - RNA, 1086 nt, Artificial Sequence
  derived and/or modified sequence opt5 from ENOSF1__Homo_sapiens__NP_001119595
augcagaagauggagagcagaggcguggaacugcccucccucugggagaaagcccugaaacuuaucgggccugaaaaaggagucguucaccuggcuaccgccgcggugcucaacgcugugugggaccugugggccaagcaagagggcaaaccggucuggaaacuucugguggauauggacccccggaugcucguuucuugcauugauuuccgcuacaucacagacgugcugacggaagaggaugcccuggagauucuccagaaggggcagaucggaaagaaggaaagagagaaacagaugcuggcucaaggcuauccugccuacaccacaagcugugcuuggcuuggguauuccgacgauacccugaagcagcucugcgcccaggcgcugaaagacggauggacacgguuuaaggucaaggugggcgccgaucuucaggacgauaugcgcagaugucaaauuauccgggacaugaucggccccgaaaagacccugaugauggaugcuaaucagcgcugggacguuccugaggccguggaguggaugucuaagcucgcuaaauucaagccccuguggauugaggaaccuacaagcccggacgauauccuggggcaugccaccauuuccaaagcgcucgucccccugggaaucggcauugccacgggggaacagugccacaacagagugaucuuuaagcagcuucugcaagcuaaagcccuccaguuccugcagauugacucuugucggcuuggaagcgugaaugagaaccuguccguccuccugauggcuaagaaguuugaaaucccuguuugcccccaugccggcggggugggacugugugagcucgugcaacaccugaucauuuucgauuacaucagcgucucugccucccuugagaaucgcgugugcgaauauguugaccaucugcacgagcacuuuaaauacccugugaugauucagagagcuagcuauaugcccccgaaggauccuggcuacucuaccgaaaugaaagaggaauccgucaagaaacaucaguaccccgacggcgagguguggaagaagcuccugccugcgcaggagaacuga

SEQ ID NO: 68848 - RNA, 1932 nt, Artificial Sequence
  derived and/or modified sequence opt5 from ENOX1__Homo_sapiens__NP_001121087
augguggacgccggcggggucgagaacaucacccagcugccccaagaacucccucagaugauggcugccgcggcugauggacugggcagcauugccaucgacacaacgcagcuuaauauguccguuaccgauccgacagccugggcuaccgccaugaacaaucuggggauggugcccgugggacucccuggccagcaacuggucucugacagcauuugcgugcccggguucgauccuucccuuaacaugaugacaggaaucacccccauuaauccuaugaucccgggccugggccucguucccccucccccucccacagagguggcugucgugaaggaaaucauucacuguaaaucuugcacccuguuuccgcagaacccuaaucugcccccucccagcacgagagagcggcccccuggguguaagaccguuuucgugggaggccucccggaaaacgccacagaggagaucauucaggaagucuuugagcagugcggggacaucaccgcgauucgcaaauccaagaaaaauuucugucauaucagauuugccgaagaguucaugguggauaaggcuauuuaccugucuggauaucggaugcgccuuggcagcuccacagacaagaaagauagcgggagacugcacguggacuuugcccaagcucgggaugacuucuacgagugggaaugcaagcagcgcaugagagcccgggaggaacgccauagacggaaacucgaggaagaucgccugagacccccuucucccccugcgaucaugcacuauuccgagcaugaggccgcucuccuggccgaaaagcucaaagacgacagcaaguuuucugaggcuaucaccguccugcuguccuggauugaacggggagagguuaaccgcagaagcgccaaucaguucuacucuauggugcaguccgccaacagccacgugcggagacucaugaaugaaaaggcuacgcacgagcaagagauggaagaggcgaaagaaaacuuuaagaaugcccugacaggcauccuuacccaguucgagcagauugucgcuguguuuaacgccuccacacgccaaaaagccugggaucauuucucuaaggcucagcggaaaaacaucgacauuuggagaaagcacagcgaagaacugcgcaaugcccaguccgagcagcucaugggcauccggagagaagaggaaauggagaugagcgaugacgagaacugugauucucccaccaaaaagaugcgcguugacgaauccgcgcuggcugcccaagccuaugcucuuaaggaggaaaaugauagccugcgguggcagcucgacgccuacagaaacgagguggaacugcugaaacaggagaaggagcagcuuuuccgcaccgaagagaaucugacaaaagaucaacagcuucaguuucugcagcaaacgaugcaggggaugcagcagcaacuccugaccauccaggaagaacuuaacaauaagaaaucugaacuggagcaggcuaaggaggaacaaagccauacacaggcccuccugaagguccugcaggagcagcucaaaggaaccaaggaacugguggagacaaacggccacucccacgaagacucuaaugagauuaacguucuuaccguggcgcuggucaaucaagaucgggagaacaauaucgagaaaagaagccaggggcucaaguccgagaaagaagcccugcugauuggaaucauuagcacguuccuucaugugcacccguuuggcgcuaacaucgaguaucucuggucuuacaugcagcagcuggacuccaagaucagcgccaaugagauugaaaugcugcucaugcgccugccucggauguucaagcaagaguuuacaggggucggagcuacccuugagaaaagauggaagcugugcgccuucgagggcaucaaaaccacauga

SEQ ID NO: 68849 - RNA, 2022 nt, Artificial Sequence
  derived and/or modified sequence opt5 from ENOX2__Homo_sapiens__XP_011529546
augcugcacaucaaccagcuccugcuuugcaauggcaccgccagcgcugccacaaacaaggacgagacgaauuguaacuuccugauuuccucugggcucaaucaacugcccuuugauccugcgaacaauaacgaaccgcuucaguucggaagcgcuuccggcccccuggugaccgaggggcucaucgaaaauggaggcgagucuagcaaaaagagaaaacggacaaacaccccuuccgccgacaauucucgcacacugaacgucgauagcaccgccaugacacugcccauguccgacccuaccgcuugggccacggcuaugaauaaccucgggauggcgccccugggaauugccggccagccuauccuuccggauuuugaccccgcccugggcaugaugaccgggauuccucccaucacaccuaugaugcccggacucggcaucguuccgccucccauuccucccgauaugcccguggugaaggaaaucauucauugcaaaagcuguacccuguucccuccgaaucccaaccuuccucccccugcuacaagagagcggcccccggggugcaagaccgucuuugugggaggccugccugagaacgggacggaacagaucauuguugagguguucgaacaauguggagagaucauugccauccgcaagucuaaaaagaauuuuugccacaucagauucgcugaggaauacauggucgacaaagcccucuaucuguccggcuaccggauucgccugggcagcucuacagauaagaaagacaccgggagacuccauguggauuuugcgcaggcccgggacgaucuguaugagugggaauguaagcagcgcaugcuugcuagagaggaacggcaccgcagacggauggaggaggaacgccugagacccccuagcccuccgcccguugugcauuacuccgaccacgagugcucuaucgucgccgaaaagcucaaagacgauuccaaguucagcgaggcugugcagacacugcuuaccuggauugaacggggagaggugaacagacgcuccgccaauaacuuuuauucuaugauccaaagcgccaauucccacguccggagacugguuaacgagaaagcugcgcaugaaaaggacauggaggaagccaaagagaaguucaaacaggcucucagcggcauucugauccaguuugaacagaucguggccguguaccacucugccuccaagcaaaaggcuugggaucauuucaccaaagcccagcgcaagaauauuagcgucugguguaaacaggcggaggagauccggaacauucacaaugacgaacugauggggaucagacgcgaggaagagauggagaugucugaugacgaaauugaggaaaugacagagacgaaggaaaccgaggagagcgcucucgugucccaagccgaagcccugaaagaggaaaacgauucucuucgguggcagcuggacgcuuauagaaaugagguugaacuccugaagcaggagcagggaaaggugcaccgcgaggaugaccccaacaaagaacaacagcuuaagcugcuccagcaggcccugcaaggcaugcagcagcaucugcucaaaguccaggaggaauacaagaaaaaggaggcugaacuggagaaacuuaaggaugacaagcugcaaguggagaaaaugcucgaaaaucugaaggagaaagaaagcugcgccucccggcugugugcgagcaaccaggacucugaguacccucuugagaagacaaugaacuccagccccaucaagucugaaagagaggcccuccugguugggaucauuuccaccuuccugcacgugcaucccuuuggagcuagcaucgaauauauuugcuccuaccuccaccgccuggauaauaaaaucugcacaucugacgucgagugucuuaugggccggcugcagcauaccuucaagcaggaaaugacgggcgugggggccagccucgagaaaagauggaaguuuugcggauucgagggccugaaacugacauga

SEQ ID NO: 68850 - RNA, 2874 nt, Artificial Sequence
  derived and/or modified sequence opt5 from ENPEP__Homo_sapiens__NP_001968
augaacuucgccgagagagaaggcagcaagcgguacugcauccagaccaaacacguggcuauucugugugccgucguugugggggugggacucaucgucggccuggcgguggggcuuacacgcuccugcgacucuagcggagauggcgggcccggaacggcuccugccccgucccaucugcccucuagcaccgccuccccuucugggcccccugcucaagaccaggauauuugucccgccagcgaggacgaauccggccaguggaagaauuuuagacucccugauuucguuaacccggugcacuaugaccugcaugucaaaccccuucuggaggaagauacauacaccggcacagugagcaucucuauuaaucucuccgcuccuacccgguaucuguggcugcaccuccgcgagacaagaaucacccggcugcccgagcuuaagcgcccuagcggagaccagguucaagugagacggugcuuugaauacaaaaagcaggaguaugucgugguggaagccgaggaggaacugacgcccucuuccggcgaugggcucuaccugcuuaccauggaguucgcgggauggcugaacggcagccucgucggguuuuaucgcacaaccuacacagaaaauggacagguuaagucuaucguggccaccgaccaugagccgacggaugcuagaaaauccuucccuuguuuugacgaacccaacaagaaagccacauacaccauuagcaucacacacccuaaggaguauggcgcucuguccaauaugcccguggccaaagaggaaucugucgaugacaaguggacccggaccacauucgaaaagagcgugcccauguccacguaccugguuugcuuugcggugcaccaguucgacagcgucaaacgcauuucuaacuccggcaagccucucaccaucuaugugcaaccggagcagaaacauacagccgaguacgcugccaauauuaccaagagcguuuuugauuauuucgaagaguacuuugcuaugaacuauucucugcccaaacuugacaagaucgccauuccugauuucgggacaggagccauggagaauuggggccugaucaccuacagagaaacgaaccuccuguacgaccccaaagagagcgcuuccucuaaucagcagcggguggcgacagucguggcccacgaacuuguccaucaaugguucgggaacaucgugaccauggauuggugggaggaccuguggcucaaugaaggauuugcuagcuucuuugaguuccugggcguuaaccacgccgagaccgauuggcagaugcgcgaccagaugcugcucgaagaugugcugccuguccaagaggacgauucccuuaugagcucucaccccauuaucgugacaguuaccacaccggacgaaauuacguccguguuugacgggaucagcuauucuaagggauccagcauucugagaaugcucgaggauuggaucaagccugagaacuuccagaaaggcugucagauguaccuggaaaaguaucaguuuaaaaaugccaagaccuccgacuucugggcugcccuugaggaagcgucucggcugcccgucaaagaggugauggauacauggaccagacaaaugggcuacccugugcucaacguuaauggggucaagaacaucacacagaagcgcuuucugcuggacccccgggcuaauccuagccagcccccguccgaucucggauauaccuggaacauuccugugaaauggacggaagacaauaucaccucuagcgugcuguucaacagauccgagaaggagggcauuacacuuaauagcucuaaccccuccgggaaugccuuucugaaaaucaaccccgaucauauuggauucuaccgcgucaauuaugaaguggccaccugggacagcaucgcuacagcccucucucugaaccacaagaccuuuuccagcgcugaucgggccucucugaucgacgaugcguucgcccuugcuagagcccagcuccuggacuacaaaguugcucugaaucucacgaaguaccugaagcgcgaggaaaacuuccuuccuuggcaacgggugauuagcgccgucacauauaucauuuccauguuugaggaugacaaagaacuguacccgaugaucgaggaguauuuccagggccaggugaagcccauugcggacagccucggguggaacgaugccggcgaccauguuaccaaacugcugagaucuuccgugcuuggauuugcuugcaagaugggcgaucgcgaagcccucaauaacgcuagcucccuguucgagcaguggcugaaugggacagucucucucccugugaaccugcggcuucugguuuacagauauggaaugcaaaauagcggcaacgaaaucuccuggaauuacacccucgagcaguaucagaaaaccucucuggcccaggaaaaggagaagcugcuuuacgggcucgccagcgugaaaaacgucacacugcugucccgcuaccucgaccugcuuaaggauacgaaucugauuaaaacccaagacguguuuacagugauccgguauaucucuuacaacagcuauggaaagaauauggcuuggaacuggauucagcucaauugggauuaccuggucaacagauauacccugaauaaccggaaccuuggccgcaucguuacaauugcggagcccuucaauaccgaacuccagcuguggcaaauggaguccuuuuucgccaaauacccucaggcuggggccggcgaaaagcccagagaacaggugcuggagacggugaaaaacaauaucgaguggcucaagcagcaccggaacacaauuagagagugguuuuucaaucugcuugaaagcggauga
